United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 114

SEQ ID NO: 4829895 - DNA, 14 bp, Homo sapiens
ctgaaatggcctgt

SEQ ID NO: 4829896 - DNA, 17 bp, Homo sapiens
ctgaaattagtgttttc

SEQ ID NO: 4829897 - DNA, 23 bp, Homo sapiens
ctgaaattatgtcaaatggatgt

SEQ ID NO: 4829898 - DNA, 17 bp, Homo sapiens
ctgaacagaccggggtg

SEQ ID NO: 4829899 - DNA, 16 bp, Homo sapiens
ctgaactcacagactg

SEQ ID NO: 4829900 - DNA, 18 bp, Homo sapiens
ctgaactgcaacactgga

SEQ ID NO: 4829901 - DNA, 20 bp, Homo sapiens
ctgaactggccgctgggaga

SEQ ID NO: 4829902 - DNA, 14 bp, Homo sapiens
ctgaactttggaag

SEQ ID NO: 4829903 - DNA, 12 bp, Homo sapiens
ctgaagaaacac

SEQ ID NO: 4829904 - DNA, 12 bp, Homo sapiens
ctgaagatctca

SEQ ID NO: 4829905 - DNA, 14 bp, Homo sapiens
ctgaaggagaggag

SEQ ID NO: 4829906 - DNA, 19 bp, Homo sapiens
ctgaagggaggggaagaga

SEQ ID NO: 4829907 - DNA, 21 bp, Homo sapiens
ctgaagggaggggaagagaga

SEQ ID NO: 4829908 - DNA, 15 bp, Homo sapiens
ctgaagtcccttcct

SEQ ID NO: 4829909 - DNA, 17 bp, Homo sapiens
ctgaagtcccttcctgt

SEQ ID NO: 4829910 - DNA, 15 bp, Homo sapiens
ctgaagttggacagc

SEQ ID NO: 4829911 - DNA, 23 bp, Homo sapiens
ctgaataaataagtaaatacatt

SEQ ID NO: 4829912 - DNA, 16 bp, Homo sapiens
ctgaataacaacaatt

SEQ ID NO: 4829913 - DNA, 15 bp, Homo sapiens
ctgaatcagaggcag

SEQ ID NO: 4829914 - DNA, 16 bp, Homo sapiens
ctgaatcagaggcaga

SEQ ID NO: 4829915 - DNA, 17 bp, Homo sapiens
ctgaatctctcaaaatg

SEQ ID NO: 4829916 - DNA, 20 bp, Homo sapiens
ctgaatctctcaaaatgtgc

SEQ ID NO: 4829917 - DNA, 18 bp, Homo sapiens
ctgaatgctatttgtgta

SEQ ID NO: 4829918 - DNA, 13 bp, Homo sapiens
ctgaatgtatgta

SEQ ID NO: 4829919 - DNA, 15 bp, Homo sapiens
ctgaattaaagtcta

SEQ ID NO: 4829920 - DNA, 15 bp, Homo sapiens
ctgaattggctgcca

SEQ ID NO: 4829921 - DNA, 20 bp, Homo sapiens
ctgaattgttatgtaaacat

SEQ ID NO: 4829922 - DNA, 20 bp, Homo sapiens
ctgaatttggggctacttat

SEQ ID NO: 4829923 - DNA, 19 bp, Homo sapiens
ctgacaagggctgacctgc

SEQ ID NO: 4829924 - DNA, 20 bp, Homo sapiens
ctgacaagggctgacctgcc

SEQ ID NO: 4829925 - DNA, 10 bp, Homo sapiens
ctgacacagg

SEQ ID NO: 4829926 - DNA, 13 bp, Homo sapiens
ctgacacctgccg

SEQ ID NO: 4829927 - DNA, 17 bp, Homo sapiens
ctgacagcctccacctt

SEQ ID NO: 4829928 - DNA, 21 bp, Homo sapiens
ctgacagcctccaccttgagc

SEQ ID NO: 4829929 - DNA, 19 bp, Homo sapiens
ctgacagcgccatgtgtgt

SEQ ID NO: 4829930 - DNA, 23 bp, Homo sapiens
ctgacagcgccatgtgtgtcagc

SEQ ID NO: 4829931 - DNA, 14 bp, Homo sapiens
ctgacaggccttcc

SEQ ID NO: 4829932 - DNA, 16 bp, Homo sapiens
ctgacatcagcactgc

SEQ ID NO: 4829933 - DNA, 13 bp, Homo sapiens
ctgaccaacaggc

SEQ ID NO: 4829934 - DNA, 14 bp, Homo sapiens
ctgaccatgcattt

SEQ ID NO: 4829935 - DNA, 22 bp, Homo sapiens
ctgacctgcctctcacacacat

SEQ ID NO: 4829936 - DNA, 14 bp, Homo sapiens
ctgaccttggagag

SEQ ID NO: 4829937 - DNA, 20 bp, Homo sapiens
ctgaccttggagagacacag

SEQ ID NO: 4829938 - DNA, 14 bp, Homo sapiens
ctgacggccctgca

SEQ ID NO: 4829939 - DNA, 15 bp, Homo sapiens
ctgacggccctgcaa

SEQ ID NO: 4829940 - DNA, 16 bp, Homo sapiens
ctgacggccctgcaat

SEQ ID NO: 4829941 - DNA, 16 bp, Homo sapiens
ctgactccctgtgggg

SEQ ID NO: 4829942 - DNA, 17 bp, Homo sapiens
ctgactccctgtggggg

SEQ ID NO: 4829943 - DNA, 20 bp, Homo sapiens
ctgacttagcaggaatttaa

SEQ ID NO: 4829944 - DNA, 14 bp, Homo sapiens
ctgacttcccagct

SEQ ID NO: 4829945 - DNA, 17 bp, Homo sapiens
ctgacttcccagctggc

SEQ ID NO: 4829946 - DNA, 21 bp, Homo sapiens
ctgagaagaggagccctcatc

SEQ ID NO: 4829947 - DNA, 17 bp, Homo sapiens
ctgagaaggccccaggg

SEQ ID NO: 4829948 - DNA, 19 bp, Homo sapiens
ctgagaaggccccagggca

SEQ ID NO: 4829949 - DNA, 16 bp, Homo sapiens
ctgagaattgagggga

SEQ ID NO: 4829950 - DNA, 18 bp, Homo sapiens
ctgagaattgaggggagg

SEQ ID NO: 4829951 - DNA, 21 bp, Homo sapiens
ctgagaattgaggggaggtgg

SEQ ID NO: 4829952 - DNA, 17 bp, Homo sapiens
ctgagacacagcccaga

SEQ ID NO: 4829953 - DNA, 17 bp, Homo sapiens
ctgagacgcaaggatca

SEQ ID NO: 4829954 - DNA, 18 bp, Homo sapiens
ctgagatagcttagtgtc

SEQ ID NO: 4829955 - DNA, 18 bp, Homo sapiens
ctgagatgtttagtagct

SEQ ID NO: 4829956 - DNA, 14 bp, Homo sapiens
ctgagcagtgggga

SEQ ID NO: 4829957 - DNA, 17 bp, Homo sapiens
ctgagcagttgttatat

SEQ ID NO: 4829958 - DNA, 20 bp, Homo sapiens
ctgagccacagtggggccca

SEQ ID NO: 4829959 - DNA, 15 bp, Homo sapiens
ctgagccccctgcac

SEQ ID NO: 4829960 - DNA, 14 bp, Homo sapiens
ctgagcccctcctc

SEQ ID NO: 4829961 - DNA, 19 bp, Homo sapiens
ctgagccctgccctcactc

SEQ ID NO: 4829962 - DNA, 12 bp, Homo sapiens
ctgagcctgtct

SEQ ID NO: 4829963 - DNA, 16 bp, Homo sapiens
ctgagcctgtctctcc

SEQ ID NO: 4829964 - DNA, 14 bp, Homo sapiens
ctgagcgcctgcag

SEQ ID NO: 4829965 - DNA, 14 bp, Homo sapiens
ctgagctccaccct

SEQ ID NO: 4829966 - DNA, 23 bp, Homo sapiens
ctgagcttgattctaaaggggac

SEQ ID NO: 4829967 - DNA, 22 bp, Homo sapiens
ctgaggaaggaggggaagctgc

SEQ ID NO: 4829968 - DNA, 19 bp, Homo sapiens
ctgaggacctttctgagga

SEQ ID NO: 4829969 - DNA, 22 bp, Homo sapiens
ctgaggacggggcagagctgag

SEQ ID NO: 4829970 - DNA, 12 bp, Homo sapiens
ctgaggagtcca

SEQ ID NO: 4829971 - DNA, 20 bp, Homo sapiens
ctgaggagtgatgggcaagg

SEQ ID NO: 4829972 - DNA, 13 bp, Homo sapiens
ctgaggccaaata

SEQ ID NO: 4829973 - DNA, 21 bp, Homo sapiens
ctgaggctgccccaggggcac

SEQ ID NO: 4829974 - DNA, 17 bp, Homo sapiens
ctgagggaagcccaccc

SEQ ID NO: 4829975 - DNA, 19 bp, Homo sapiens
ctgagggaagcccacccgc

SEQ ID NO: 4829976 - DNA, 22 bp, Homo sapiens
ctgagggaagcccacccgcccc

SEQ ID NO: 4829977 - DNA, 21 bp, Homo sapiens
ctgagggacgagcagagcgca

SEQ ID NO: 4829978 - DNA, 19 bp, Homo sapiens
ctgagggcagggttctaga

SEQ ID NO: 4829979 - DNA, 19 bp, Homo sapiens
ctgaggtcatctgtaaaat

SEQ ID NO: 4829980 - DNA, 18 bp, Homo sapiens
ctgagtaaacagatattt

SEQ ID NO: 4829981 - DNA, 23 bp, Homo sapiens
ctgagtcagggcccagaggctga

SEQ ID NO: 4829982 - DNA, 20 bp, Homo sapiens
ctgagtcctcattgttcaga

SEQ ID NO: 4829983 - DNA, 16 bp, Homo sapiens
ctgagtcggctgggca

SEQ ID NO: 4829984 - DNA, 19 bp, Homo sapiens
ctgagtcggctgggcaggg

SEQ ID NO: 4829985 - DNA, 22 bp, Homo sapiens
ctgagtctgtgaataaagccac

SEQ ID NO: 4829986 - DNA, 22 bp, Homo sapiens
ctgagtgagggcatagaagtta

SEQ ID NO: 4829987 - DNA, 13 bp, Homo sapiens
ctgagtggctcgt

SEQ ID NO: 4829988 - DNA, 24 bp, Homo sapiens
ctgagtggctcgtgtttcacagtg

SEQ ID NO: 4829989 - DNA, 22 bp, Homo sapiens
ctgagtttgaacacagatcatt

SEQ ID NO: 4829990 - DNA, 12 bp, Homo sapiens
ctgatacctgcc

SEQ ID NO: 4829991 - DNA, 24 bp, Homo sapiens
ctgatagaagaaggactgaagaaa

SEQ ID NO: 4829992 - DNA, 18 bp, Homo sapiens
ctgatagatatccttggc

SEQ ID NO: 4829993 - DNA, 20 bp, Homo sapiens
ctgatatcacgggcccgctc

SEQ ID NO: 4829994 - DNA, 19 bp, Homo sapiens
ctgatatctgtttgcttct

SEQ ID NO: 4829995 - DNA, 20 bp, Homo sapiens
ctgatatctgtttgcttcta

SEQ ID NO: 4829996 - DNA, 21 bp, Homo sapiens
ctgatatctttgagggctgac

SEQ ID NO: 4829997 - DNA, 23 bp, Homo sapiens
ctgatcaaggtgctcttctcatt

SEQ ID NO: 4829998 - DNA, 13 bp, Homo sapiens
ctgatcctctctt

SEQ ID NO: 4829999 - DNA, 19 bp, Homo sapiens
ctgatgaagttaagcacaa

SEQ ID NO: 4830000 - DNA, 19 bp, Homo sapiens
ctgatgagacaacacacac

SEQ ID NO: 4830001 - DNA, 15 bp, Homo sapiens
ctgatgaggcatttt

SEQ ID NO: 4830002 - DNA, 15 bp, Homo sapiens
ctgatgatggaaggg

SEQ ID NO: 4830003 - DNA, 21 bp, Homo sapiens
ctgatgatgttctgaaatgga

SEQ ID NO: 4830004 - DNA, 17 bp, Homo sapiens
ctgatggacatgagagt

SEQ ID NO: 4830005 - DNA, 12 bp, Homo sapiens
ctgatggcactt

SEQ ID NO: 4830006 - DNA, 19 bp, Homo sapiens
ctgatggcacttttgagct

SEQ ID NO: 4830007 - DNA, 12 bp, Homo sapiens
ctgatggccagg

SEQ ID NO: 4830008 - DNA, 15 bp, Homo sapiens
ctgatggccaggcct

SEQ ID NO: 4830009 - DNA, 18 bp, Homo sapiens
ctgatgggtcctgctgct

SEQ ID NO: 4830010 - DNA, 23 bp, Homo sapiens
ctgattattacaacaagcaaact

SEQ ID NO: 4830011 - DNA, 14 bp, Homo sapiens
ctgattctgggatg

SEQ ID NO: 4830012 - DNA, 15 bp, Homo sapiens
ctgattggaaaataa

SEQ ID NO: 4830013 - DNA, 19 bp, Homo sapiens
ctgattggaaaataataaa

SEQ ID NO: 4830014 - DNA, 20 bp, Homo sapiens
ctgattggaaaataataaaa

SEQ ID NO: 4830015 - DNA, 21 bp, Homo sapiens
ctgattggaaaataataaaag

SEQ ID NO: 4830016 - DNA, 15 bp, Homo sapiens
ctgattgttcctccc

SEQ ID NO: 4830017 - DNA, 13 bp, Homo sapiens
ctgattgttttaa

SEQ ID NO: 4830018 - DNA, 23 bp, Homo sapiens
ctgatttattttgtatgaaatat

SEQ ID NO: 4830019 - DNA, 20 bp, Homo sapiens
ctgatttgggctgaatgtat

SEQ ID NO: 4830020 - DNA, 17 bp, Homo sapiens
ctgcaaaatgaagacac

SEQ ID NO: 4830021 - DNA, 13 bp, Homo sapiens
ctgcaaggcccac

SEQ ID NO: 4830022 - DNA, 17 bp, Homo sapiens
ctgcaaggcccacagga

SEQ ID NO: 4830023 - DNA, 19 bp, Homo sapiens
ctgcaaggcccacaggagg

SEQ ID NO: 4830024 - DNA, 20 bp, Homo sapiens
ctgcaaggcccacaggaggc

SEQ ID NO: 4830025 - DNA, 18 bp, Homo sapiens
ctgcaaggtgcacctgcc

SEQ ID NO: 4830026 - DNA, 12 bp, Homo sapiens
ctgcaataacag

SEQ ID NO: 4830027 - DNA, 14 bp, Homo sapiens
ctgcaataacagtt

SEQ ID NO: 4830028 - DNA, 15 bp, Homo sapiens
ctgcaataacagttt

SEQ ID NO: 4830029 - DNA, 20 bp, Homo sapiens
ctgcaataacagttttaaga

SEQ ID NO: 4830030 - DNA, 20 bp, Homo sapiens
ctgcaatgtatcccttctca

SEQ ID NO: 4830031 - DNA, 13 bp, Homo sapiens
ctgcaattcaact

SEQ ID NO: 4830032 - DNA, 16 bp, Homo sapiens
ctgcacacacctgcct

SEQ ID NO: 4830033 - DNA, 14 bp, Homo sapiens
ctgcacacataaca

SEQ ID NO: 4830034 - DNA, 15 bp, Homo sapiens
ctgcacacataacac

SEQ ID NO: 4830035 - DNA, 18 bp, Homo sapiens
ctgcacacataacacaca

SEQ ID NO: 4830036 - DNA, 19 bp, Homo sapiens
ctgcacacataacacacat

SEQ ID NO: 4830037 - DNA, 15 bp, Homo sapiens
ctgcacagtggtcca

SEQ ID NO: 4830038 - DNA, 15 bp, Homo sapiens
ctgcacctgcttctc

SEQ ID NO: 4830039 - DNA, 16 bp, Homo sapiens
ctgcacctgcttctca

SEQ ID NO: 4830040 - DNA, 15 bp, Homo sapiens
ctgcaccttgggcac

SEQ ID NO: 4830041 - DNA, 17 bp, Homo sapiens
ctgcactcctgtctctt

SEQ ID NO: 4830042 - DNA, 18 bp, Homo sapiens
ctgcactgaaaaggttct

SEQ ID NO: 4830043 - DNA, 12 bp, Homo sapiens
ctgcactgccct

SEQ ID NO: 4830044 - DNA, 22 bp, Homo sapiens
ctgcagaaaattaattgaaata

SEQ ID NO: 4830045 - DNA, 18 bp, Homo sapiens
ctgcagaccctgccaggg

SEQ ID NO: 4830046 - DNA, 13 bp, Homo sapiens
ctgcagcccagaa

SEQ ID NO: 4830047 - DNA, 14 bp, Homo sapiens
ctgcagccccctgc

SEQ ID NO: 4830048 - DNA, 14 bp, Homo sapiens
ctgcagcctgagct

SEQ ID NO: 4830049 - DNA, 16 bp, Homo sapiens
ctgcagcctgagctcc

SEQ ID NO: 4830050 - DNA, 17 bp, Homo sapiens
ctgcagcctgagctcca

SEQ ID NO: 4830051 - DNA, 21 bp, Homo sapiens
ctgcagcctgagctccaccct

SEQ ID NO: 4830052 - DNA, 22 bp, Homo sapiens
ctgcagcctgagctccaccctc

SEQ ID NO: 4830053 - DNA, 23 bp, Homo sapiens
ctgcagcctgagctccaccctcc

SEQ ID NO: 4830054 - DNA, 14 bp, Homo sapiens
ctgcagctaatttg

SEQ ID NO: 4830055 - DNA, 20 bp, Homo sapiens
ctgcagctaatttgtgaaag

SEQ ID NO: 4830056 - DNA, 20 bp, Homo sapiens
ctgcagctatgcgcaatgtg

SEQ ID NO: 4830057 - DNA, 22 bp, Homo sapiens
ctgcagctatgcgcaatgtggc

SEQ ID NO: 4830058 - DNA, 10 bp, Homo sapiens
ctgcagctgc

SEQ ID NO: 4830059 - DNA, 22 bp, Homo sapiens
ctgcaggaatcaaaaattgaag

SEQ ID NO: 4830060 - DNA, 20 bp, Homo sapiens
ctgcagggacagttgggtgt

SEQ ID NO: 4830061 - DNA, 21 bp, Homo sapiens
ctgcaggttggaccccagaga

SEQ ID NO: 4830062 - DNA, 16 bp, Homo sapiens
ctgcagtattctgtag

SEQ ID NO: 4830063 - DNA, 21 bp, Homo sapiens
ctgcagtattctgtagccaac

SEQ ID NO: 4830064 - DNA, 13 bp, Homo sapiens
ctgcagtcagcac

SEQ ID NO: 4830065 - DNA, 16 bp, Homo sapiens
ctgcagtcagcacaga

SEQ ID NO: 4830066 - DNA, 17 bp, Homo sapiens
ctgcagtcagcacagag

SEQ ID NO: 4830067 - DNA, 18 bp, Homo sapiens
ctgcagtcctcggcagct

SEQ ID NO: 4830068 - DNA, 19 bp, Homo sapiens
ctgcagtcctcggcagctc

SEQ ID NO: 4830069 - DNA, 17 bp, Homo sapiens
ctgcagtgttcgcttgg

SEQ ID NO: 4830070 - DNA, 19 bp, Homo sapiens
ctgcagtgttcgcttggct

SEQ ID NO: 4830071 - DNA, 18 bp, Homo sapiens
ctgcagttagcacagagg

SEQ ID NO: 4830072 - DNA, 22 bp, Homo sapiens
ctgcagttatttaccagaagtt

SEQ ID NO: 4830073 - DNA, 13 bp, Homo sapiens
ctgcatagacaaa

SEQ ID NO: 4830074 - DNA, 15 bp, Homo sapiens
ctgcatagacaaagg

SEQ ID NO: 4830075 - DNA, 17 bp, Homo sapiens
ctgcatagacaaaggcc

SEQ ID NO: 4830076 - DNA, 14 bp, Homo sapiens
ctgcatccaaggct

SEQ ID NO: 4830077 - DNA, 13 bp, Homo sapiens
ctgcatccctcca

SEQ ID NO: 4830078 - DNA, 18 bp, Homo sapiens
ctgcatgattagtgcaat

SEQ ID NO: 4830079 - DNA, 21 bp, Homo sapiens
ctgcatgatttttgccctgcg

SEQ ID NO: 4830080 - DNA, 22 bp, Homo sapiens
ctgcatgcgggcttcctcctgg

SEQ ID NO: 4830081 - DNA, 14 bp, Homo sapiens
ctgcatggctgaga

SEQ ID NO: 4830082 - DNA, 19 bp, Homo sapiens
ctgcatgtcggggcccctg

SEQ ID NO: 4830083 - DNA, 19 bp, Homo sapiens
ctgccaactttccagactt

SEQ ID NO: 4830084 - DNA, 13 bp, Homo sapiens
ctgccaagagtcc

SEQ ID NO: 4830085 - DNA, 18 bp, Homo sapiens
ctgccaaggccagcccac

SEQ ID NO: 4830086 - DNA, 15 bp, Homo sapiens
ctgccaatgggagct

SEQ ID NO: 4830087 - DNA, 14 bp, Homo sapiens
ctgccacaagcaca

SEQ ID NO: 4830088 - DNA, 15 bp, Homo sapiens
ctgccacaagcacaa

SEQ ID NO: 4830089 - DNA, 16 bp, Homo sapiens
ctgccacaagcacaat

SEQ ID NO: 4830090 - DNA, 17 bp, Homo sapiens
ctgccacacatgctcat

SEQ ID NO: 4830091 - DNA, 13 bp, Homo sapiens
ctgccacactctg

SEQ ID NO: 4830092 - DNA, 15 bp, Homo sapiens
ctgccacactctgac

SEQ ID NO: 4830093 - DNA, 22 bp, Homo sapiens
ctgccacccaccccaagctgct

SEQ ID NO: 4830094 - DNA, 13 bp, Homo sapiens
ctgccaccctctg

SEQ ID NO: 4830095 - DNA, 19 bp, Homo sapiens
ctgccactaaaatccaccc

SEQ ID NO: 4830096 - DNA, 20 bp, Homo sapiens
ctgccactaaaatccaccca

SEQ ID NO: 4830097 - DNA, 22 bp, Homo sapiens
ctgccactaaaatccacccagc

SEQ ID NO: 4830098 - DNA, 21 bp, Homo sapiens
ctgccactcaggcagcctgtg

SEQ ID NO: 4830099 - DNA, 22 bp, Homo sapiens
ctgccactcaggcagcctgtgg

SEQ ID NO: 4830100 - DNA, 19 bp, Homo sapiens
ctgccagccgagatagcca

SEQ ID NO: 4830101 - DNA, 14 bp, Homo sapiens
ctgccaggaagcca

SEQ ID NO: 4830102 - DNA, 18 bp, Homo sapiens
ctgccaggaagccagcag

SEQ ID NO: 4830103 - DNA, 22 bp, Homo sapiens
ctgccaggaagccagcaggctc

SEQ ID NO: 4830104 - DNA, 21 bp, Homo sapiens
ctgccaggctcccactgcccc

SEQ ID NO: 4830105 - DNA, 22 bp, Homo sapiens
ctgccaggctcccactgcccct

SEQ ID NO: 4830106 - DNA, 16 bp, Homo sapiens
ctgccagggcagtgct

SEQ ID NO: 4830107 - DNA, 17 bp, Homo sapiens
ctgcccaatttcacaga

SEQ ID NO: 4830108 - DNA, 21 bp, Homo sapiens
ctgcccaatttcacagagtac

SEQ ID NO: 4830109 - DNA, 16 bp, Homo sapiens
ctgcccaccctgggcc

SEQ ID NO: 4830110 - DNA, 18 bp, Homo sapiens
ctgcccacgtcccgggca

SEQ ID NO: 4830111 - DNA, 22 bp, Homo sapiens
ctgcccactctgaccgggcttc

SEQ ID NO: 4830112 - DNA, 19 bp, Homo sapiens
ctgcccagagtatgggcac

SEQ ID NO: 4830113 - DNA, 21 bp, Homo sapiens
ctgcccagcggctcttcctgg

SEQ ID NO: 4830114 - DNA, 21 bp, Homo sapiens
ctgcccagttagcccggccaa

SEQ ID NO: 4830115 - DNA, 21 bp, Homo sapiens
ctgccccagcctactccacct

SEQ ID NO: 4830116 - DNA, 19 bp, Homo sapiens
ctgccccaggggcactgtg

SEQ ID NO: 4830117 - DNA, 12 bp, Homo sapiens
ctgcccccacag

SEQ ID NO: 4830118 - DNA, 16 bp, Homo sapiens
ctgcccccacagatcc

SEQ ID NO: 4830119 - DNA, 18 bp, Homo sapiens
ctgcccccacagatccat

SEQ ID NO: 4830120 - DNA, 13 bp, Homo sapiens
ctgccccccttcc

SEQ ID NO: 4830121 - DNA, 14 bp, Homo sapiens
ctgccccctccccc

SEQ ID NO: 4830122 - DNA, 15 bp, Homo sapiens
ctgccccctcccccg

SEQ ID NO: 4830123 - DNA, 19 bp, Homo sapiens
ctgccccctcccccgcaga

SEQ ID NO: 4830124 - DNA, 21 bp, Homo sapiens
ctgccccctcccccgcagaca

SEQ ID NO: 4830125 - DNA, 22 bp, Homo sapiens
ctgccccctcccccgcagacag

SEQ ID NO: 4830126 - DNA, 20 bp, Homo sapiens
ctgcccctccgtccccaggg

SEQ ID NO: 4830127 - DNA, 21 bp, Homo sapiens
ctgcccctccgtccccagggt

SEQ ID NO: 4830128 - DNA, 15 bp, Homo sapiens
ctgcccctcttccct

SEQ ID NO: 4830129 - DNA, 20 bp, Homo sapiens
ctgcccctcttccctggcca

SEQ ID NO: 4830130 - DNA, 20 bp, Homo sapiens
ctgcccctgcacctgcttct

SEQ ID NO: 4830131 - DNA, 18 bp, Homo sapiens
ctgcccctggcagcccct

SEQ ID NO: 4830132 - DNA, 20 bp, Homo sapiens
ctgccccttgaccccacacg

SEQ ID NO: 4830133 - DNA, 18 bp, Homo sapiens
ctgcccgagggcaggggc

SEQ ID NO: 4830134 - DNA, 16 bp, Homo sapiens
ctgcccgcacaccctc

SEQ ID NO: 4830135 - DNA, 17 bp, Homo sapiens
ctgcccgcacaccctca

SEQ ID NO: 4830136 - DNA, 15 bp, Homo sapiens
ctgcccgcgcccgcc

SEQ ID NO: 4830137 - DNA, 14 bp, Homo sapiens
ctgccctcactcca

SEQ ID NO: 4830138 - DNA, 16 bp, Homo sapiens
ctgccctcactccact

SEQ ID NO: 4830139 - DNA, 19 bp, Homo sapiens
ctgccctcactccactccc

SEQ ID NO: 4830140 - DNA, 13 bp, Homo sapiens
ctgccctgcacct

SEQ ID NO: 4830141 - DNA, 15 bp, Homo sapiens
ctgccctgcaccttg

SEQ ID NO: 4830142 - DNA, 19 bp, Homo sapiens
ctgccctgcaccttgggca

SEQ ID NO: 4830143 - DNA, 20 bp, Homo sapiens
ctgccctgcaccttgggcac

SEQ ID NO: 4830144 - DNA, 16 bp, Homo sapiens
ctgccctggcctacca

SEQ ID NO: 4830145 - DNA, 18 bp, Homo sapiens
ctgccctggcctaccaca

SEQ ID NO: 4830146 - DNA, 12 bp, Homo sapiens
ctgcccttacct

SEQ ID NO: 4830147 - DNA, 23 bp, Homo sapiens
ctgcccttacctgccaggaagcc

SEQ ID NO: 4830148 - DNA, 12 bp, Homo sapiens
ctgccgcagccc

SEQ ID NO: 4830149 - DNA, 21 bp, Homo sapiens
ctgccgcagccctgcagaggg

SEQ ID NO: 4830150 - DNA, 22 bp, Homo sapiens
ctgccgcagccctgcagagggc

SEQ ID NO: 4830151 - DNA, 17 bp, Homo sapiens
ctgccgcctcaccttcc

SEQ ID NO: 4830152 - DNA, 16 bp, Homo sapiens
ctgccgctgcaccacg

SEQ ID NO: 4830153 - DNA, 19 bp, Homo sapiens
ctgccgctgccgctgcacc

SEQ ID NO: 4830154 - DNA, 20 bp, Homo sapiens
ctgccgctgccgctgcacca

SEQ ID NO: 4830155 - DNA, 19 bp, Homo sapiens
ctgccgctgctctcccagg

SEQ ID NO: 4830156 - DNA, 19 bp, Homo sapiens
ctgccgctgcttgagtgga

SEQ ID NO: 4830157 - DNA, 14 bp, Homo sapiens
ctgccgctggaggc

SEQ ID NO: 4830158 - DNA, 18 bp, Homo sapiens
ctgccggtcccccatgcc

SEQ ID NO: 4830159 - DNA, 19 bp, Homo sapiens
ctgccggtcccccatgcca

SEQ ID NO: 4830160 - DNA, 22 bp, Homo sapiens
ctgccggtcccccatgccacca

SEQ ID NO: 4830161 - DNA, 20 bp, Homo sapiens
ctgccgtgggcaaggatacc

SEQ ID NO: 4830162 - DNA, 20 bp, Homo sapiens
ctgcctaaatccactctgca

SEQ ID NO: 4830163 - DNA, 22 bp, Homo sapiens
ctgcctccaagtcatgggagaa

SEQ ID NO: 4830164 - DNA, 18 bp, Homo sapiens
ctgcctccggccctgccc

SEQ ID NO: 4830165 - DNA, 20 bp, Homo sapiens
ctgcctccggccctgcccca

SEQ ID NO: 4830166 - DNA, 15 bp, Homo sapiens
ctgcctccgggcctc

SEQ ID NO: 4830167 - DNA, 23 bp, Homo sapiens
ctgcctctctcatggcttgggct

SEQ ID NO: 4830168 - DNA, 14 bp, Homo sapiens
ctgcctctgcctta

SEQ ID NO: 4830169 - DNA, 15 bp, Homo sapiens
ctgcctctgccttag

SEQ ID NO: 4830170 - DNA, 23 bp, Homo sapiens
ctgcctctgccttagaggagccc

SEQ ID NO: 4830171 - DNA, 12 bp, Homo sapiens
ctgcctgccatg

SEQ ID NO: 4830172 - DNA, 13 bp, Homo sapiens
ctgcctgccatgt

SEQ ID NO: 4830173 - DNA, 17 bp, Homo sapiens
ctgcctgccatgtgtga

SEQ ID NO: 4830174 - DNA, 17 bp, Homo sapiens
ctgcctgcccgcacagc

SEQ ID NO: 4830175 - DNA, 19 bp, Homo sapiens
ctgcctgcccgcacagcag

SEQ ID NO: 4830176 - DNA, 14 bp, Homo sapiens
ctgcctgcctccgg

SEQ ID NO: 4830177 - DNA, 21 bp, Homo sapiens
ctgcctgcctccggccctgcc

SEQ ID NO: 4830178 - DNA, 14 bp, Homo sapiens
ctgcctggcgggca

SEQ ID NO: 4830179 - DNA, 16 bp, Homo sapiens
ctgcctggcgggcagc

SEQ ID NO: 4830180 - DNA, 19 bp, Homo sapiens
ctgcctggcgggcagcccc

SEQ ID NO: 4830181 - DNA, 22 bp, Homo sapiens
ctgcctggcgggcagcccctgc

SEQ ID NO: 4830182 - DNA, 23 bp, Homo sapiens
ctgcctggcgggcagcccctgct

SEQ ID NO: 4830183 - DNA, 21 bp, Homo sapiens
ctgcctgggacagccactgga

SEQ ID NO: 4830184 - DNA, 22 bp, Homo sapiens
ctgcctgtggtgaggtcctgtc

SEQ ID NO: 4830185 - DNA, 20 bp, Homo sapiens
ctgcctgttgggccaggagc

SEQ ID NO: 4830186 - DNA, 21 bp, Homo sapiens
ctgcctgttgggccaggagcc

SEQ ID NO: 4830187 - DNA, 21 bp, Homo sapiens
ctgccttatattattttctgt

SEQ ID NO: 4830188 - DNA, 18 bp, Homo sapiens
ctgccttctgacggccct

SEQ ID NO: 4830189 - DNA, 23 bp, Homo sapiens
ctgccttctgacggccctgcaat

SEQ ID NO: 4830190 - DNA, 13 bp, Homo sapiens
ctgcctttcaaag

SEQ ID NO: 4830191 - DNA, 22 bp, Homo sapiens
ctgcctttcaaagtgcacacac

SEQ ID NO: 4830192 - DNA, 23 bp, Homo sapiens
ctgcctttcaaagtgcacacaca

SEQ ID NO: 4830193 - DNA, 19 bp, Homo sapiens
ctgcgaccacaagaaggat

SEQ ID NO: 4830194 - DNA, 13 bp, Homo sapiens
ctgcgcaccccgt

SEQ ID NO: 4830195 - DNA, 18 bp, Homo sapiens
ctgcgccccccagtggac

SEQ ID NO: 4830196 - DNA, 21 bp, Homo sapiens
ctgcgcccctgcccagcacct

SEQ ID NO: 4830197 - DNA, 12 bp, Homo sapiens
ctgcgccctccc

SEQ ID NO: 4830198 - DNA, 16 bp, Homo sapiens
ctgcgccctccctccc

SEQ ID NO: 4830199 - DNA, 20 bp, Homo sapiens
ctgcgccctccctccctcca

SEQ ID NO: 4830200 - DNA, 17 bp, Homo sapiens
ctgcgcctcctcctgca

SEQ ID NO: 4830201 - DNA, 17 bp, Homo sapiens
ctgcgcctgcgcctcct

SEQ ID NO: 4830202 - DNA, 18 bp, Homo sapiens
ctgcgctcctctgcagcc

SEQ ID NO: 4830203 - DNA, 19 bp, Homo sapiens
ctgcgctcctctgcagcct

SEQ ID NO: 4830204 - DNA, 20 bp, Homo sapiens
ctgcgctggacgatagcttg

SEQ ID NO: 4830205 - DNA, 17 bp, Homo sapiens
ctgcgcttaccttccca

SEQ ID NO: 4830206 - DNA, 22 bp, Homo sapiens
ctgcggggcggcatccgagccc

SEQ ID NO: 4830207 - DNA, 18 bp, Homo sapiens
ctgcgtaggagagaacag

SEQ ID NO: 4830208 - DNA, 17 bp, Homo sapiens
ctgctaagtggaagaca

SEQ ID NO: 4830209 - DNA, 21 bp, Homo sapiens
ctgctaagtggaagacagaga

SEQ ID NO: 4830210 - DNA, 22 bp, Homo sapiens
ctgctaagtggaagacagagat

SEQ ID NO: 4830211 - DNA, 23 bp, Homo sapiens
ctgctaagtggaagacagagatg

SEQ ID NO: 4830212 - DNA, 22 bp, Homo sapiens
ctgctaatttatgaagatagtt

SEQ ID NO: 4830213 - DNA, 14 bp, Homo sapiens
ctgctcaggcctca

SEQ ID NO: 4830214 - DNA, 18 bp, Homo sapiens
ctgctcaggcctcacctg

SEQ ID NO: 4830215 - DNA, 21 bp, Homo sapiens
ctgctcaggcctcacctggct

SEQ ID NO: 4830216 - DNA, 14 bp, Homo sapiens
ctgctccagatcct

SEQ ID NO: 4830217 - DNA, 14 bp, Homo sapiens
ctgctccatgcaga

SEQ ID NO: 4830218 - DNA, 16 bp, Homo sapiens
ctgctccatgcagatc

SEQ ID NO: 4830219 - DNA, 21 bp, Homo sapiens
ctgctcgccctgtgccctctc

SEQ ID NO: 4830220 - DNA, 15 bp, Homo sapiens
ctgctcgggaaggcc

SEQ ID NO: 4830221 - DNA, 17 bp, Homo sapiens
ctgctcgggaaggcctg

SEQ ID NO: 4830222 - DNA, 15 bp, Homo sapiens
ctgctctccatctct

SEQ ID NO: 4830223 - DNA, 15 bp, Homo sapiens
ctgctctcccaggtg

SEQ ID NO: 4830224 - DNA, 21 bp, Homo sapiens
ctgctgaaaaccatctggcct

SEQ ID NO: 4830225 - DNA, 19 bp, Homo sapiens
ctgctgaccttctgcggct

SEQ ID NO: 4830226 - DNA, 12 bp, Homo sapiens
ctgctgcactgc

SEQ ID NO: 4830227 - DNA, 16 bp, Homo sapiens
ctgctgcactgccctc

SEQ ID NO: 4830228 - DNA, 16 bp, Homo sapiens
ctgctgccgcctcacc

SEQ ID NO: 4830229 - DNA, 17 bp, Homo sapiens
ctgctgccgcctcacct

SEQ ID NO: 4830230 - DNA, 12 bp, Homo sapiens
ctgctgcctcca

SEQ ID NO: 4830231 - DNA, 13 bp, Homo sapiens
ctgctgcctccaa

SEQ ID NO: 4830232 - DNA, 22 bp, Homo sapiens
ctgctgcctgcccgcacagcag

SEQ ID NO: 4830233 - DNA, 19 bp, Homo sapiens
ctgctgctcgggaaggcct

SEQ ID NO: 4830234 - DNA, 23 bp, Homo sapiens
ctgctgctcgggaaggcctgagg

SEQ ID NO: 4830235 - DNA, 15 bp, Homo sapiens
ctgctgcttaaaatg

SEQ ID NO: 4830236 - DNA, 15 bp, Homo sapiens
ctgctgcttctccct

SEQ ID NO: 4830237 - DNA, 19 bp, Homo sapiens
ctgctggaccaaggtgcgg

SEQ ID NO: 4830238 - DNA, 22 bp, Homo sapiens
ctgctgggtgggaatgcgctct

SEQ ID NO: 4830239 - DNA, 18 bp, Homo sapiens
ctgctgtagcaacagagc

SEQ ID NO: 4830240 - DNA, 21 bp, Homo sapiens
ctgctgtatttgaggaaactc

SEQ ID NO: 4830241 - DNA, 23 bp, Homo sapiens
ctgctgtggcatcaggaaaggaa

SEQ ID NO: 4830242 - DNA, 16 bp, Homo sapiens
ctgcttaaaatgcaag

SEQ ID NO: 4830243 - DNA, 18 bp, Homo sapiens
ctgcttaaaatgcaagga

SEQ ID NO: 4830244 - DNA, 13 bp, Homo sapiens
ctgcttaaggaaa

SEQ ID NO: 4830245 - DNA, 23 bp, Homo sapiens
ctgcttagtatctcatcaacaaa

SEQ ID NO: 4830246 - DNA, 16 bp, Homo sapiens
ctgcttcccacctccc

SEQ ID NO: 4830247 - DNA, 13 bp, Homo sapiens
ctgcttctccacc

SEQ ID NO: 4830248 - DNA, 14 bp, Homo sapiens
ctgcttctccacct

SEQ ID NO: 4830249 - DNA, 16 bp, Homo sapiens
ctgcttctcccgccat

SEQ ID NO: 4830250 - DNA, 20 bp, Homo sapiens
ctgcttctcccgccattggc

SEQ ID NO: 4830251 - DNA, 13 bp, Homo sapiens
ctgcttctccctg

SEQ ID NO: 4830252 - DNA, 14 bp, Homo sapiens
ctgcttctgctgcc

SEQ ID NO: 4830253 - DNA, 16 bp, Homo sapiens
ctgcttctgctgccct

SEQ ID NO: 4830254 - DNA, 18 bp, Homo sapiens
ctgcttctgctgccctga

SEQ ID NO: 4830255 - DNA, 20 bp, Homo sapiens
ctgcttgagtggacagcagc

SEQ ID NO: 4830256 - DNA, 22 bp, Homo sapiens
ctgcttgagtggacagcagctg

SEQ ID NO: 4830257 - DNA, 14 bp, Homo sapiens
ctgcttgctggaaa

SEQ ID NO: 4830258 - DNA, 15 bp, Homo sapiens
ctgcttgctggaaaa

SEQ ID NO: 4830259 - DNA, 18 bp, Homo sapiens
ctgcttgggcttcatcct

SEQ ID NO: 4830260 - DNA, 13 bp, Homo sapiens
ctgctttggggat

SEQ ID NO: 4830261 - DNA, 17 bp, Homo sapiens
ctggaaaaaaaaaaata

SEQ ID NO: 4830262 - DNA, 18 bp, Homo sapiens
ctggaaaacctgaggcca

SEQ ID NO: 4830263 - DNA, 14 bp, Homo sapiens
ctggaaaactgcca

SEQ ID NO: 4830264 - DNA, 13 bp, Homo sapiens
ctggaaagccagg

SEQ ID NO: 4830265 - DNA, 15 bp, Homo sapiens
ctggaaagccaggtt

SEQ ID NO: 4830266 - DNA, 20 bp, Homo sapiens
ctggaactctatctgggcct

SEQ ID NO: 4830267 - DNA, 17 bp, Homo sapiens
ctggaagggtccggctt

SEQ ID NO: 4830268 - DNA, 18 bp, Homo sapiens
ctggaaggtcacgctgaa

SEQ ID NO: 4830269 - DNA, 16 bp, Homo sapiens
ctggaagttgtccttt

SEQ ID NO: 4830270 - DNA, 13 bp, Homo sapiens
ctggaataagaag

SEQ ID NO: 4830271 - DNA, 17 bp, Homo sapiens
ctggaattgggctccgt

SEQ ID NO: 4830272 - DNA, 22 bp, Homo sapiens
ctggacagtgagagcagggctg

SEQ ID NO: 4830273 - DNA, 17 bp, Homo sapiens
ctggaccaactgctttg

SEQ ID NO: 4830274 - DNA, 16 bp, Homo sapiens
ctggaccaaggtgcgg

SEQ ID NO: 4830275 - DNA, 22 bp, Homo sapiens
ctggaccaaggtgcggaccgga

SEQ ID NO: 4830276 - DNA, 20 bp, Homo sapiens
ctggaccacgtctccctggc

SEQ ID NO: 4830277 - DNA, 23 bp, Homo sapiens
ctggaccgagtggaccacgacct

SEQ ID NO: 4830278 - DNA, 23 bp, Homo sapiens
ctggacctgaccagactgtgggt

SEQ ID NO: 4830279 - DNA, 21 bp, Homo sapiens
ctggacgatagcttggaggga

SEQ ID NO: 4830280 - DNA, 20 bp, Homo sapiens
ctggactgatggttgctttg

SEQ ID NO: 4830281 - DNA, 21 bp, Homo sapiens
ctggactgggtgggccccaca

SEQ ID NO: 4830282 - DNA, 22 bp, Homo sapiens
ctggactgggtgggccccacag

SEQ ID NO: 4830283 - DNA, 15 bp, Homo sapiens
ctggagaccctgcgc

SEQ ID NO: 4830284 - DNA, 16 bp, Homo sapiens
ctggagaccctgcgcc

SEQ ID NO: 4830285 - DNA, 19 bp, Homo sapiens
ctggagaccctgcgcccct

SEQ ID NO: 4830286 - DNA, 12 bp, Homo sapiens
ctggagccccat

SEQ ID NO: 4830287 - DNA, 19 bp, Homo sapiens
ctggagcccctatcctgca

SEQ ID NO: 4830288 - DNA, 21 bp, Homo sapiens
ctggagcccgcctgcgccccc

SEQ ID NO: 4830289 - DNA, 21 bp, Homo sapiens
ctggagcgtgtactaccccag

SEQ ID NO: 4830290 - DNA, 14 bp, Homo sapiens
ctggaggctggacc

SEQ ID NO: 4830291 - DNA, 19 bp, Homo sapiens
ctggaggctggaccaactg

SEQ ID NO: 4830292 - DNA, 20 bp, Homo sapiens
ctggaggctggaccaactgc

SEQ ID NO: 4830293 - DNA, 17 bp, Homo sapiens
ctggagtctgaaggaga

SEQ ID NO: 4830294 - DNA, 18 bp, Homo sapiens
ctggagtctgaaggagag

SEQ ID NO: 4830295 - DNA, 15 bp, Homo sapiens
ctggagttctggttc

SEQ ID NO: 4830296 - DNA, 15 bp, Homo sapiens
ctggataatttgtat

SEQ ID NO: 4830297 - DNA, 23 bp, Homo sapiens
ctggatcagtaaaattatactgt

SEQ ID NO: 4830298 - DNA, 20 bp, Homo sapiens
ctggatctcttaagacagca

SEQ ID NO: 4830299 - DNA, 22 bp, Homo sapiens
ctggatgagtagcgctatagtt

SEQ ID NO: 4830300 - DNA, 18 bp, Homo sapiens
ctggatggatctgctcca

SEQ ID NO: 4830301 - DNA, 22 bp, Homo sapiens
ctggatggatctgctccatgca

SEQ ID NO: 4830302 - DNA, 22 bp, Homo sapiens
ctggatggggcggcctgcagac

SEQ ID NO: 4830303 - DNA, 18 bp, Homo sapiens
ctggatgtgcatctggcc

SEQ ID NO: 4830304 - DNA, 19 bp, Homo sapiens
ctggatgtgcatctggcct

SEQ ID NO: 4830305 - DNA, 20 bp, Homo sapiens
ctggatgtgcatctggccta

SEQ ID NO: 4830306 - DNA, 13 bp, Homo sapiens
ctggatgtgcttt

SEQ ID NO: 4830307 - DNA, 20 bp, Homo sapiens
ctggattcccgtggctttgt

SEQ ID NO: 4830308 - DNA, 12 bp, Homo sapiens
ctggatttaact

SEQ ID NO: 4830309 - DNA, 14 bp, Homo sapiens
ctggattttcaaag

SEQ ID NO: 4830310 - DNA, 16 bp, Homo sapiens
ctggattttcaaagat

SEQ ID NO: 4830311 - DNA, 17 bp, Homo sapiens
ctggcaatcttgccctt

SEQ ID NO: 4830312 - DNA, 15 bp, Homo sapiens
ctggcacaggactga

SEQ ID NO: 4830313 - DNA, 18 bp, Homo sapiens
ctggcacaggactgattc

SEQ ID NO: 4830314 - DNA, 12 bp, Homo sapiens
ctggcacctggc

SEQ ID NO: 4830315 - DNA, 13 bp, Homo sapiens
ctggcacctggcg

SEQ ID NO: 4830316 - DNA, 22 bp, Homo sapiens
ctggcacctggcgggctggtga

SEQ ID NO: 4830317 - DNA, 19 bp, Homo sapiens
ctggcagagttgaagacag

SEQ ID NO: 4830318 - DNA, 21 bp, Homo sapiens
ctggcagagttgaagacagag

SEQ ID NO: 4830319 - DNA, 22 bp, Homo sapiens
ctggcagcgcctcccgccgcct

SEQ ID NO: 4830320 - DNA, 17 bp, Homo sapiens
ctggcagggaggtcagg

SEQ ID NO: 4830321 - DNA, 21 bp, Homo sapiens
ctggcagggaggtcaggccct

SEQ ID NO: 4830322 - DNA, 18 bp, Homo sapiens
ctggcatgggaatgaatg

SEQ ID NO: 4830323 - DNA, 22 bp, Homo sapiens
ctggcatgggaatgaatgtcag

SEQ ID NO: 4830324 - DNA, 13 bp, Homo sapiens
ctggccagcaccc

SEQ ID NO: 4830325 - DNA, 15 bp, Homo sapiens
ctggccagcaccctc

SEQ ID NO: 4830326 - DNA, 22 bp, Homo sapiens
ctggccagcaccctctcctggg

SEQ ID NO: 4830327 - DNA, 23 bp, Homo sapiens
ctggccagcaccctctcctgggg

SEQ ID NO: 4830328 - DNA, 20 bp, Homo sapiens
ctggccagcctggggcctgg

SEQ ID NO: 4830329 - DNA, 20 bp, Homo sapiens
ctggccaggggcttctcccc

SEQ ID NO: 4830330 - DNA, 13 bp, Homo sapiens
ctggcccacccct

SEQ ID NO: 4830331 - DNA, 14 bp, Homo sapiens
ctggcccagccagc

SEQ ID NO: 4830332 - DNA, 15 bp, Homo sapiens
ctggcccagccagca

SEQ ID NO: 4830333 - DNA, 17 bp, Homo sapiens
ctggcccagccagcagg

SEQ ID NO: 4830334 - DNA, 15 bp, Homo sapiens
ctggcccagccatgg

SEQ ID NO: 4830335 - DNA, 23 bp, Homo sapiens
ctggcccatagaaacatgacact

SEQ ID NO: 4830336 - DNA, 21 bp, Homo sapiens
ctggccccaaatgttctttcc

SEQ ID NO: 4830337 - DNA, 11 bp, Homo sapiens
ctggccccagg

SEQ ID NO: 4830338 - DNA, 15 bp, Homo sapiens
ctggccccctcgcgc

SEQ ID NO: 4830339 - DNA, 18 bp, Homo sapiens
ctggcccggtcccagtcc

SEQ ID NO: 4830340 - DNA, 14 bp, Homo sapiens
ctggccctcgggcc

SEQ ID NO: 4830341 - DNA, 13 bp, Homo sapiens
ctggccctgccct

SEQ ID NO: 4830342 - DNA, 16 bp, Homo sapiens
ctggccctgccctccc

SEQ ID NO: 4830343 - DNA, 19 bp, Homo sapiens
ctggccctgccctccccca

SEQ ID NO: 4830344 - DNA, 14 bp, Homo sapiens
ctggcccttccttc

SEQ ID NO: 4830345 - DNA, 15 bp, Homo sapiens
ctggcccttccttca

SEQ ID NO: 4830346 - DNA, 19 bp, Homo sapiens
ctggccggcccacgtcctg

SEQ ID NO: 4830347 - DNA, 20 bp, Homo sapiens
ctggccggcccacgtcctgg

SEQ ID NO: 4830348 - DNA, 22 bp, Homo sapiens
ctggccggcccacgtcctgggt

SEQ ID NO: 4830349 - DNA, 23 bp, Homo sapiens
ctggccggcccacgtcctgggtg

SEQ ID NO: 4830350 - DNA, 15 bp, Homo sapiens
ctggccggtccaccc

SEQ ID NO: 4830351 - DNA, 16 bp, Homo sapiens
ctggccggtccacccc

SEQ ID NO: 4830352 - DNA, 18 bp, Homo sapiens
ctggccggtccaccccgt

SEQ ID NO: 4830353 - DNA, 13 bp, Homo sapiens
ctggcctaccaca

SEQ ID NO: 4830354 - DNA, 18 bp, Homo sapiens
ctggcctaccacagctgc

SEQ ID NO: 4830355 - DNA, 21 bp, Homo sapiens
ctggcctaccacagctgcctc

SEQ ID NO: 4830356 - DNA, 15 bp, Homo sapiens
ctggcctatgaccct

SEQ ID NO: 4830357 - DNA, 17 bp, Homo sapiens
ctggcctatgaccctgt

SEQ ID NO: 4830358 - DNA, 18 bp, Homo sapiens
ctggcctatgaccctgtg

SEQ ID NO: 4830359 - DNA, 19 bp, Homo sapiens
ctggcctatgaccctgtgc

SEQ ID NO: 4830360 - DNA, 18 bp, Homo sapiens
ctggcctgacacaatggt

SEQ ID NO: 4830361 - DNA, 19 bp, Homo sapiens
ctggcctgagaattgaggg

SEQ ID NO: 4830362 - DNA, 22 bp, Homo sapiens
ctggcctgagaattgaggggag

SEQ ID NO: 4830363 - DNA, 13 bp, Homo sapiens
ctggcctggccct

SEQ ID NO: 4830364 - DNA, 16 bp, Homo sapiens
ctggcctggccctgcc

SEQ ID NO: 4830365 - DNA, 23 bp, Homo sapiens
ctggcctggccctgccctgagga

SEQ ID NO: 4830366 - DNA, 16 bp, Homo sapiens
ctggcctggcctggcc

SEQ ID NO: 4830367 - DNA, 14 bp, Homo sapiens
ctggccttgcctcc

SEQ ID NO: 4830368 - DNA, 18 bp, Homo sapiens
ctggccttgcctccagga

SEQ ID NO: 4830369 - DNA, 17 bp, Homo sapiens
ctggcgcgtgtgtggcc

SEQ ID NO: 4830370 - DNA, 13 bp, Homo sapiens
ctggcgggcagcc

SEQ ID NO: 4830371 - DNA, 15 bp, Homo sapiens
ctggcgggcagcccc

SEQ ID NO: 4830372 - DNA, 16 bp, Homo sapiens
ctggcgggctggtgac

SEQ ID NO: 4830373 - DNA, 22 bp, Homo sapiens
ctggcggggtctgctcctggga

SEQ ID NO: 4830374 - DNA, 17 bp, Homo sapiens
ctggctacgacttggga

SEQ ID NO: 4830375 - DNA, 14 bp, Homo sapiens
ctggctcacagcca

SEQ ID NO: 4830376 - DNA, 22 bp, Homo sapiens
ctggctctttagaatggaccac

SEQ ID NO: 4830377 - DNA, 21 bp, Homo sapiens
ctggctgggtcgcccctcctc

SEQ ID NO: 4830378 - DNA, 14 bp, Homo sapiens
ctggcttcaccgca

SEQ ID NO: 4830379 - DNA, 23 bp, Homo sapiens
ctggctttgggtagtgccatggc

SEQ ID NO: 4830380 - DNA, 21 bp, Homo sapiens
ctggcttttaaacctgttcct

SEQ ID NO: 4830381 - DNA, 22 bp, Homo sapiens
ctggcttttaaacctgttcctg

SEQ ID NO: 4830382 - DNA, 23 bp, Homo sapiens
ctgggaaatgagatcccagagtt

SEQ ID NO: 4830383 - DNA, 19 bp, Homo sapiens
ctgggaatcaggattcctt

SEQ ID NO: 4830384 - DNA, 21 bp, Homo sapiens
ctgggaatcaggattccttct

SEQ ID NO: 4830385 - DNA, 23 bp, Homo sapiens
ctgggaatggggtgggagccaca

SEQ ID NO: 4830386 - DNA, 15 bp, Homo sapiens
ctgggagatgcagct

SEQ ID NO: 4830387 - DNA, 18 bp, Homo sapiens
ctgggagatgcagctgga

SEQ ID NO: 4830388 - DNA, 19 bp, Homo sapiens
ctgggagatgcagctggat

SEQ ID NO: 4830389 - DNA, 18 bp, Homo sapiens
ctgggagccagagcctct

SEQ ID NO: 4830390 - DNA, 23 bp, Homo sapiens
ctgggattacaggtgtgagccac

SEQ ID NO: 4830391 - DNA, 16 bp, Homo sapiens
ctgggcagaaggaaga

SEQ ID NO: 4830392 - DNA, 18 bp, Homo sapiens
ctgggcagaaggaagact

SEQ ID NO: 4830393 - DNA, 13 bp, Homo sapiens
ctgggcagcccag

SEQ ID NO: 4830394 - DNA, 19 bp, Homo sapiens
ctgggcagggccgcagggc

SEQ ID NO: 4830395 - DNA, 17 bp, Homo sapiens
ctgggccccccagctca

SEQ ID NO: 4830396 - DNA, 20 bp, Homo sapiens
ctgggcccctccacgcctcc

SEQ ID NO: 4830397 - DNA, 13 bp, Homo sapiens
ctgggccctaggc

SEQ ID NO: 4830398 - DNA, 14 bp, Homo sapiens
ctgggccctaggca

SEQ ID NO: 4830399 - DNA, 23 bp, Homo sapiens
ctgggccggggtgtggaatcacc

SEQ ID NO: 4830400 - DNA, 19 bp, Homo sapiens
ctgggcgcaagcgacacag

SEQ ID NO: 4830401 - DNA, 20 bp, Homo sapiens
ctgggcgccggttccacgtg

SEQ ID NO: 4830402 - DNA, 14 bp, Homo sapiens
ctgggcgcctctgt

SEQ ID NO: 4830403 - DNA, 18 bp, Homo sapiens
ctgggcgcctctgtcctg

SEQ ID NO: 4830404 - DNA, 20 bp, Homo sapiens
ctgggctaggggacatcaga

SEQ ID NO: 4830405 - DNA, 21 bp, Homo sapiens
ctgggctatatgcctatattt

SEQ ID NO: 4830406 - DNA, 20 bp, Homo sapiens
ctgggcttggggaccagagc

SEQ ID NO: 4830407 - DNA, 23 bp, Homo sapiens
ctggggacttcgggggcggctct

SEQ ID NO: 4830408 - DNA, 18 bp, Homo sapiens
ctggggaggacccctgcc

SEQ ID NO: 4830409 - DNA, 14 bp, Homo sapiens
ctggggagggacac

SEQ ID NO: 4830410 - DNA, 15 bp, Homo sapiens
ctggggagggacaca

SEQ ID NO: 4830411 - DNA, 13 bp, Homo sapiens
ctggggcagggtg

SEQ ID NO: 4830412 - DNA, 16 bp, Homo sapiens
ctggggccctgggcct

SEQ ID NO: 4830413 - DNA, 18 bp, Homo sapiens
ctggggccctgggcctca

SEQ ID NO: 4830414 - DNA, 12 bp, Homo sapiens
ctggggcctggc

SEQ ID NO: 4830415 - DNA, 19 bp, Homo sapiens
ctggggcctggcagggagg

SEQ ID NO: 4830416 - DNA, 13 bp, Homo sapiens
ctggggctgggcc

SEQ ID NO: 4830417 - DNA, 11 bp, Homo sapiens
ctgggggaggc

SEQ ID NO: 4830418 - DNA, 17 bp, Homo sapiens
ctgggggaggcttccag

SEQ ID NO: 4830419 - DNA, 22 bp, Homo sapiens
ctgggggaggcttccagctcag

SEQ ID NO: 4830420 - DNA, 19 bp, Homo sapiens
ctgggggctgggcagagga

SEQ ID NO: 4830421 - DNA, 13 bp, Homo sapiens
ctggggggcacag

SEQ ID NO: 4830422 - DNA, 15 bp, Homo sapiens
ctggggggcaggcct

SEQ ID NO: 4830423 - DNA, 19 bp, Homo sapiens
ctggggggctgtcctgagc

SEQ ID NO: 4830424 - DNA, 22 bp, Homo sapiens
ctggggtggggacctcaggcct

SEQ ID NO: 4830425 - DNA, 14 bp, Homo sapiens
ctggggtggggctt

SEQ ID NO: 4830426 - DNA, 17 bp, Homo sapiens
ctggggtggttggaggc

SEQ ID NO: 4830427 - DNA, 16 bp, Homo sapiens
ctgggtccccctcctg

SEQ ID NO: 4830428 - DNA, 20 bp, Homo sapiens
ctgggtccccctcctgcacg

SEQ ID NO: 4830429 - DNA, 16 bp, Homo sapiens
ctgggtcctcccagct

SEQ ID NO: 4830430 - DNA, 17 bp, Homo sapiens
ctgggtcctcccagctg

SEQ ID NO: 4830431 - DNA, 17 bp, Homo sapiens
ctgggtcctcggccctg

SEQ ID NO: 4830432 - DNA, 16 bp, Homo sapiens
ctgggtcgcccctcct

SEQ ID NO: 4830433 - DNA, 22 bp, Homo sapiens
ctgggtcgcccctcctcgggcg

SEQ ID NO: 4830434 - DNA, 11 bp, Homo sapiens
ctgggtgctca

SEQ ID NO: 4830435 - DNA, 14 bp, Homo sapiens
ctgggtgctcaggg

SEQ ID NO: 4830436 - DNA, 20 bp, Homo sapiens
ctgggtgctcagggcatgct

SEQ ID NO: 4830437 - DNA, 15 bp, Homo sapiens
ctgggtgggccccac

SEQ ID NO: 4830438 - DNA, 16 bp, Homo sapiens
ctgggtgggccccaca

SEQ ID NO: 4830439 - DNA, 19 bp, Homo sapiens
ctgggtgtgacctgacacc

SEQ ID NO: 4830440 - DNA, 23 bp, Homo sapiens
ctgggtgtgacctgacacctgcc

SEQ ID NO: 4830441 - DNA, 14 bp, Homo sapiens
ctgggttaacagta

SEQ ID NO: 4830442 - DNA, 15 bp, Homo sapiens
ctgggttgttgcaga

SEQ ID NO: 4830443 - DNA, 23 bp, Homo sapiens
ctgggttgttgcagagtaaatcc

SEQ ID NO: 4830444 - DNA, 20 bp, Homo sapiens
ctggtaagattgttattaaa

SEQ ID NO: 4830445 - DNA, 12 bp, Homo sapiens
ctggtaattatc

SEQ ID NO: 4830446 - DNA, 21 bp, Homo sapiens
ctggtaggtctggattttcaa

SEQ ID NO: 4830447 - DNA, 13 bp, Homo sapiens
ctggtattaaatg

SEQ ID NO: 4830448 - DNA, 22 bp, Homo sapiens
ctggtcagtgaagcccaggagg

SEQ ID NO: 4830449 - DNA, 14 bp, Homo sapiens
ctggtccacacacc

SEQ ID NO: 4830450 - DNA, 12 bp, Homo sapiens
ctggtcctgcac

SEQ ID NO: 4830451 - DNA, 20 bp, Homo sapiens
ctggtccttagtaaattcct

SEQ ID NO: 4830452 - DNA, 21 bp, Homo sapiens
ctggtctgtgcattgtggctg

SEQ ID NO: 4830453 - DNA, 14 bp, Homo sapiens
ctggtgaaagagta

SEQ ID NO: 4830454 - DNA, 21 bp, Homo sapiens
ctggtgaaagagtaaaaccaa

SEQ ID NO: 4830455 - DNA, 15 bp, Homo sapiens
ctggtgcgtgtggcc

SEQ ID NO: 4830456 - DNA, 18 bp, Homo sapiens
ctggtgcgtgtggccctg

SEQ ID NO: 4830457 - DNA, 20 bp, Homo sapiens
ctggtgcgtgtggccctgtg

SEQ ID NO: 4830458 - DNA, 12 bp, Homo sapiens
ctggtggccctg

SEQ ID NO: 4830459 - DNA, 22 bp, Homo sapiens
ctggtgttctcaatgcttttct

SEQ ID NO: 4830460 - DNA, 23 bp, Homo sapiens
ctggttaaccgggactacagaag

SEQ ID NO: 4830461 - DNA, 22 bp, Homo sapiens
ctggttctgtacatgtggaaaa

SEQ ID NO: 4830462 - DNA, 15 bp, Homo sapiens
ctggtttgtttctca

SEQ ID NO: 4830463 - DNA, 15 bp, Homo sapiens
ctggttttctctgat

SEQ ID NO: 4830464 - DNA, 18 bp, Homo sapiens
ctggtttttctgttccct

SEQ ID NO: 4830465 - DNA, 23 bp, Homo sapiens
ctggtttttctgttccctgctgg

SEQ ID NO: 4830466 - DNA, 23 bp, Homo sapiens
ctgtaaaatacatggtatctctt

SEQ ID NO: 4830467 - DNA, 22 bp, Homo sapiens
ctgtaaaatagtctcattgcca

SEQ ID NO: 4830468 - DNA, 16 bp, Homo sapiens
ctgtaaataaaaatag

SEQ ID NO: 4830469 - DNA, 17 bp, Homo sapiens
ctgtaactgttacagta

SEQ ID NO: 4830470 - DNA, 19 bp, Homo sapiens
ctgtaatagcctcaccttc

SEQ ID NO: 4830471 - DNA, 15 bp, Homo sapiens
ctgtaatatttacaa

SEQ ID NO: 4830472 - DNA, 21 bp, Homo sapiens
ctgtaatatttacaatgtatt

SEQ ID NO: 4830473 - DNA, 17 bp, Homo sapiens
ctgtaatcttgttgata

SEQ ID NO: 4830474 - DNA, 18 bp, Homo sapiens
ctgtaattcttctccttt

SEQ ID NO: 4830475 - DNA, 20 bp, Homo sapiens
ctgtacagattgctgcttct

SEQ ID NO: 4830476 - DNA, 16 bp, Homo sapiens
ctgtaccggccactgc

SEQ ID NO: 4830477 - DNA, 17 bp, Homo sapiens
ctgtaccggccactgca

SEQ ID NO: 4830478 - DNA, 19 bp, Homo sapiens
ctgtacttcagttctcatc

SEQ ID NO: 4830479 - DNA, 19 bp, Homo sapiens
ctgtagcctggtctgtgca

SEQ ID NO: 4830480 - DNA, 14 bp, Homo sapiens
ctgtagtaattgtt

SEQ ID NO: 4830481 - DNA, 15 bp, Homo sapiens
ctgtataaatgtgaa

SEQ ID NO: 4830482 - DNA, 18 bp, Homo sapiens
ctgtataaatgtgaaatt

SEQ ID NO: 4830483 - DNA, 23 bp, Homo sapiens
ctgtatatagatgtctgtgtata

SEQ ID NO: 4830484 - DNA, 14 bp, Homo sapiens
ctgtatcatttctt

SEQ ID NO: 4830485 - DNA, 23 bp, Homo sapiens
ctgtatccaagttatttgatctg

SEQ ID NO: 4830486 - DNA, 22 bp, Homo sapiens
ctgtattaagctccagtgcttt

SEQ ID NO: 4830487 - DNA, 19 bp, Homo sapiens
ctgtattatcttaaaccca

SEQ ID NO: 4830488 - DNA, 23 bp, Homo sapiens
ctgtattgaaaaaatattgttta

SEQ ID NO: 4830489 - DNA, 14 bp, Homo sapiens
ctgtattggcagca

SEQ ID NO: 4830490 - DNA, 16 bp, Homo sapiens
ctgtattggcagcaca

SEQ ID NO: 4830491 - DNA, 17 bp, Homo sapiens
ctgtattggcagcacag

SEQ ID NO: 4830492 - DNA, 20 bp, Homo sapiens
ctgtattggcagcacagcta

SEQ ID NO: 4830493 - DNA, 20 bp, Homo sapiens
ctgtatttacttgttatgtt

SEQ ID NO: 4830494 - DNA, 15 bp, Homo sapiens
ctgtatttttagaga

SEQ ID NO: 4830495 - DNA, 18 bp, Homo sapiens
ctgtcaaatccatgtgtc

SEQ ID NO: 4830496 - DNA, 22 bp, Homo sapiens
ctgtcaacctgaattaaagtct

SEQ ID NO: 4830497 - DNA, 16 bp, Homo sapiens
ctgtcaattacaggaa

SEQ ID NO: 4830498 - DNA, 18 bp, Homo sapiens
ctgtcaattacaggaagt

SEQ ID NO: 4830499 - DNA, 20 bp, Homo sapiens
ctgtcaattacaggaagtac

SEQ ID NO: 4830500 - DNA, 22 bp, Homo sapiens
ctgtcacccaggttggagtgca

SEQ ID NO: 4830501 - DNA, 18 bp, Homo sapiens
ctgtcactcacaaaaggc

SEQ ID NO: 4830502 - DNA, 19 bp, Homo sapiens
ctgtcactcacaaaaggct

SEQ ID NO: 4830503 - DNA, 10 bp, Homo sapiens
ctgtcactgt

SEQ ID NO: 4830504 - DNA, 17 bp, Homo sapiens
ctgtcactgtccagagt

SEQ ID NO: 4830505 - DNA, 14 bp, Homo sapiens
ctgtcagtttgtga

SEQ ID NO: 4830506 - DNA, 21 bp, Homo sapiens
ctgtcagtttgtgaagtgatt

SEQ ID NO: 4830507 - DNA, 13 bp, Homo sapiens
ctgtcatctctct

SEQ ID NO: 4830508 - DNA, 18 bp, Homo sapiens
ctgtcatctctctggggc

SEQ ID NO: 4830509 - DNA, 16 bp, Homo sapiens
ctgtcatgcccagctt

SEQ ID NO: 4830510 - DNA, 16 bp, Homo sapiens
ctgtccagagtctctt

SEQ ID NO: 4830511 - DNA, 21 bp, Homo sapiens
ctgtccatccgtctctgtccg

SEQ ID NO: 4830512 - DNA, 22 bp, Homo sapiens
ctgtccccgcactgggcttggg

SEQ ID NO: 4830513 - DNA, 16 bp, Homo sapiens
ctgtccctagggctct

SEQ ID NO: 4830514 - DNA, 15 bp, Homo sapiens
ctgtccctgtgggct

SEQ ID NO: 4830515 - DNA, 19 bp, Homo sapiens
ctgtccctgtgggctcaca

SEQ ID NO: 4830516 - DNA, 16 bp, Homo sapiens
ctgtccgtctgtcctg

SEQ ID NO: 4830517 - DNA, 17 bp, Homo sapiens
ctgtcctctcgagccca

SEQ ID NO: 4830518 - DNA, 12 bp, Homo sapiens
ctgtcctgagcc

SEQ ID NO: 4830519 - DNA, 15 bp, Homo sapiens
ctgtcctgctcacgt

SEQ ID NO: 4830520 - DNA, 18 bp, Homo sapiens
ctgtccttcccccagcac

SEQ ID NO: 4830521 - DNA, 16 bp, Homo sapiens
ctgtcgccccaggccc

SEQ ID NO: 4830522 - DNA, 20 bp, Homo sapiens
ctgtctaacttggggaaggg

SEQ ID NO: 4830523 - DNA, 22 bp, Homo sapiens
ctgtctcctaagctggagtgca

SEQ ID NO: 4830524 - DNA, 12 bp, Homo sapiens
ctgtctcctctg

SEQ ID NO: 4830525 - DNA, 16 bp, Homo sapiens
ctgtctcctctgtcag

SEQ ID NO: 4830526 - DNA, 21 bp, Homo sapiens
ctgtctctccctaccctcttc

SEQ ID NO: 4830527 - DNA, 23 bp, Homo sapiens
ctgtctctccctaccctcttctc

SEQ ID NO: 4830528 - DNA, 11 bp, Homo sapiens
ctgtctctctt

SEQ ID NO: 4830529 - DNA, 14 bp, Homo sapiens
ctgtctgagccctg

SEQ ID NO: 4830530 - DNA, 18 bp, Homo sapiens
ctgtctgagccctgccct

SEQ ID NO: 4830531 - DNA, 24 bp, Homo sapiens
ctgtctgagccctgccctcactcc

SEQ ID NO: 4830532 - DNA, 12 bp, Homo sapiens
ctgtctgcaggc

SEQ ID NO: 4830533 - DNA, 14 bp, Homo sapiens
ctgtctgcaggcca

SEQ ID NO: 4830534 - DNA, 18 bp, Homo sapiens
ctgtctgtaagagaattc

SEQ ID NO: 4830535 - DNA, 22 bp, Homo sapiens
ctgtctgtgtgaggctccctcc

SEQ ID NO: 4830536 - DNA, 15 bp, Homo sapiens
ctgtcttactaatag

SEQ ID NO: 4830537 - DNA, 22 bp, Homo sapiens
ctgtcttagtcataccatccat

SEQ ID NO: 4830538 - DNA, 16 bp, Homo sapiens
ctgtcttcaaccctgc

SEQ ID NO: 4830539 - DNA, 20 bp, Homo sapiens
ctgtcttcaaccctgccctg

SEQ ID NO: 4830540 - DNA, 21 bp, Homo sapiens
ctgtgaaagtctcctgtatca

SEQ ID NO: 4830541 - DNA, 16 bp, Homo sapiens
ctgtgaagcctttatc

SEQ ID NO: 4830542 - DNA, 16 bp, Homo sapiens
ctgtgaataaagccac

SEQ ID NO: 4830543 - DNA, 18 bp, Homo sapiens
ctgtgaataaagccacat

SEQ ID NO: 4830544 - DNA, 19 bp, Homo sapiens
ctgtgaataaagccacata

SEQ ID NO: 4830545 - DNA, 16 bp, Homo sapiens
ctgtgaatatgtgtaa

SEQ ID NO: 4830546 - DNA, 18 bp, Homo sapiens
ctgtgaatcaaaacaaat

SEQ ID NO: 4830547 - DNA, 16 bp, Homo sapiens
ctgtgacacagctgag

SEQ ID NO: 4830548 - DNA, 18 bp, Homo sapiens
ctgtgagaactgtgaata

SEQ ID NO: 4830549 - DNA, 16 bp, Homo sapiens
ctgtgagataaatatc

SEQ ID NO: 4830550 - DNA, 19 bp, Homo sapiens
ctgtgagataaatatcatt

SEQ ID NO: 4830551 - DNA, 13 bp, Homo sapiens
ctgtgagatgtgt

SEQ ID NO: 4830552 - DNA, 16 bp, Homo sapiens
ctgtgaggacagggcc

SEQ ID NO: 4830553 - DNA, 18 bp, Homo sapiens
ctgtgaggatagagactt

SEQ ID NO: 4830554 - DNA, 19 bp, Homo sapiens
ctgtgaggtgggcctttga

SEQ ID NO: 4830555 - DNA, 20 bp, Homo sapiens
ctgtgagtctgtcctttccc

SEQ ID NO: 4830556 - DNA, 15 bp, Homo sapiens
ctgtgatgcatgagc

SEQ ID NO: 4830557 - DNA, 18 bp, Homo sapiens
ctgtgatgcatgagctcc

SEQ ID NO: 4830558 - DNA, 22 bp, Homo sapiens
ctgtgcagtttggtatgaaaca

SEQ ID NO: 4830559 - DNA, 15 bp, Homo sapiens
ctgtgcattgtggct

SEQ ID NO: 4830560 - DNA, 15 bp, Homo sapiens
ctgtgccatgtgttt

SEQ ID NO: 4830561 - DNA, 14 bp, Homo sapiens
ctgtgcgttttaga

SEQ ID NO: 4830562 - DNA, 21 bp, Homo sapiens
ctgtgctttcatgtttaagaa

SEQ ID NO: 4830563 - DNA, 12 bp, Homo sapiens
ctgtgctttccg

SEQ ID NO: 4830564 - DNA, 15 bp, Homo sapiens
ctgtgctttctgcat

SEQ ID NO: 4830565 - DNA, 23 bp, Homo sapiens
ctgtggagcgtccttgtccccgc

SEQ ID NO: 4830566 - DNA, 19 bp, Homo sapiens
ctgtggcccctccttctcc

SEQ ID NO: 4830567 - DNA, 21 bp, Homo sapiens
ctgtggcccctccttctcccc

SEQ ID NO: 4830568 - DNA, 21 bp, Homo sapiens
ctgtgggactggcccacccct

SEQ ID NO: 4830569 - DNA, 23 bp, Homo sapiens
ctgtgggactggcccacccctct

SEQ ID NO: 4830570 - DNA, 13 bp, Homo sapiens
ctgtgggcagcac

SEQ ID NO: 4830571 - DNA, 21 bp, Homo sapiens
ctgtgggcagcaccctccccc

SEQ ID NO: 4830572 - DNA, 23 bp, Homo sapiens
ctgtgggcagcaccctcccccgc

SEQ ID NO: 4830573 - DNA, 12 bp, Homo sapiens
ctgtgggctcac

SEQ ID NO: 4830574 - DNA, 18 bp, Homo sapiens
ctgtgggctcacaccggc

SEQ ID NO: 4830575 - DNA, 20 bp, Homo sapiens
ctgtgggggtggccatccct

SEQ ID NO: 4830576 - DNA, 21 bp, Homo sapiens
ctgtgggggtggccatccctg

SEQ ID NO: 4830577 - DNA, 23 bp, Homo sapiens
ctgtgggggtggccatccctggg

SEQ ID NO: 4830578 - DNA, 14 bp, Homo sapiens
ctgtgggtccctgc

SEQ ID NO: 4830579 - DNA, 23 bp, Homo sapiens
ctgtgggtccctgcgtctcctgc

SEQ ID NO: 4830580 - DNA, 21 bp, Homo sapiens
ctgtgggtttctaaagctgcc

SEQ ID NO: 4830581 - DNA, 13 bp, Homo sapiens
ctgtggtctgtgt

SEQ ID NO: 4830582 - DNA, 14 bp, Homo sapiens
ctgtggtctgtgtg

SEQ ID NO: 4830583 - DNA, 17 bp, Homo sapiens
ctgtggtgaggtcctgt

SEQ ID NO: 4830584 - DNA, 20 bp, Homo sapiens
ctgtggtgaggtcctgtcct

SEQ ID NO: 4830585 - DNA, 17 bp, Homo sapiens
ctgtggtttgttatcag

SEQ ID NO: 4830586 - DNA, 13 bp, Homo sapiens
ctgtgtatacata

SEQ ID NO: 4830587 - DNA, 18 bp, Homo sapiens
ctgtgtatacatatgtat

SEQ ID NO: 4830588 - DNA, 19 bp, Homo sapiens
ctgtgtcacgtgaccctgt

SEQ ID NO: 4830589 - DNA, 12 bp, Homo sapiens
ctgtgtcatctg

SEQ ID NO: 4830590 - DNA, 11 bp, Homo sapiens
ctgtgtcccag

SEQ ID NO: 4830591 - DNA, 16 bp, Homo sapiens
ctgtgtcccagtgtct

SEQ ID NO: 4830592 - DNA, 12 bp, Homo sapiens
ctgtgtctcatg

SEQ ID NO: 4830593 - DNA, 13 bp, Homo sapiens
ctgtgtctcatgg

SEQ ID NO: 4830594 - DNA, 14 bp, Homo sapiens
ctgtgtctcccttc

SEQ ID NO: 4830595 - DNA, 13 bp, Homo sapiens
ctgtgtggcaaac

SEQ ID NO: 4830596 - DNA, 22 bp, Homo sapiens
ctgtgtggcaaacatttaaaaa

SEQ ID NO: 4830597 - DNA, 18 bp, Homo sapiens
ctgtgtgtgagtgtgaat

SEQ ID NO: 4830598 - DNA, 21 bp, Homo sapiens
ctgtgtgtggaaggcacccgc

SEQ ID NO: 4830599 - DNA, 14 bp, Homo sapiens
ctgtgttctcaaca

SEQ ID NO: 4830600 - DNA, 14 bp, Homo sapiens
ctgtgttgttcata

SEQ ID NO: 4830601 - DNA, 15 bp, Homo sapiens
ctgttaacttattca

SEQ ID NO: 4830602 - DNA, 21 bp, Homo sapiens
ctgttaaggcatccacttcac

SEQ ID NO: 4830603 - DNA, 20 bp, Homo sapiens
ctgttacagtaatgtcataa

SEQ ID NO: 4830604 - DNA, 15 bp, Homo sapiens
ctgttatctgtcttt

SEQ ID NO: 4830605 - DNA, 15 bp, Homo sapiens
ctgttcacgtgactc

SEQ ID NO: 4830606 - DNA, 13 bp, Homo sapiens
ctgttcagaggca

SEQ ID NO: 4830607 - DNA, 14 bp, Homo sapiens
ctgttccaagtgtg

SEQ ID NO: 4830608 - DNA, 17 bp, Homo sapiens
ctgttccaagtgtgtgt

SEQ ID NO: 4830609 - DNA, 16 bp, Homo sapiens
ctgttccacttctcta

SEQ ID NO: 4830610 - DNA, 13 bp, Homo sapiens
ctgttccctgctg

SEQ ID NO: 4830611 - DNA, 14 bp, Homo sapiens
ctgttccctgctgg

SEQ ID NO: 4830612 - DNA, 18 bp, Homo sapiens
ctgttccctgctgggtgg

SEQ ID NO: 4830613 - DNA, 18 bp, Homo sapiens
ctgttccgcctcactggg

SEQ ID NO: 4830614 - DNA, 24 bp, Homo sapiens
ctgttcctgactgttctcttactg

SEQ ID NO: 4830615 - DNA, 19 bp, Homo sapiens
ctgttctaactagtaatct

SEQ ID NO: 4830616 - DNA, 14 bp, Homo sapiens
ctgttctgcactga

SEQ ID NO: 4830617 - DNA, 19 bp, Homo sapiens
ctgttctttcatactacat

SEQ ID NO: 4830618 - DNA, 17 bp, Homo sapiens
ctgttctttttgactga

SEQ ID NO: 4830619 - DNA, 16 bp, Homo sapiens
ctgttgaagtgcatgt

SEQ ID NO: 4830620 - DNA, 18 bp, Homo sapiens
ctgttgacctaccctgga

SEQ ID NO: 4830621 - DNA, 14 bp, Homo sapiens
ctgttgatctatgg

SEQ ID NO: 4830622 - DNA, 13 bp, Homo sapiens
ctgttgattaatt

SEQ ID NO: 4830623 - DNA, 21 bp, Homo sapiens
ctgttgccaggctggagtgca

SEQ ID NO: 4830624 - DNA, 12 bp, Homo sapiens
ctgttgctacat

SEQ ID NO: 4830625 - DNA, 13 bp, Homo sapiens
ctgttggctgatt

SEQ ID NO: 4830626 - DNA, 21 bp, Homo sapiens
ctgttggctgattggaaaata

SEQ ID NO: 4830627 - DNA, 22 bp, Homo sapiens
ctgttggctgattggaaaataa

SEQ ID NO: 4830628 - DNA, 16 bp, Homo sapiens
ctgttgggccaggagc

SEQ ID NO: 4830629 - DNA, 16 bp, Homo sapiens
ctgttgtaatatcagt

SEQ ID NO: 4830630 - DNA, 14 bp, Homo sapiens
ctgtttaccctccc

SEQ ID NO: 4830631 - DNA, 19 bp, Homo sapiens
ctgtttaccctccctgtcc

SEQ ID NO: 4830632 - DNA, 15 bp, Homo sapiens
ctgtttatatatata

SEQ ID NO: 4830633 - DNA, 18 bp, Homo sapiens
ctgtttatggtattttcg

SEQ ID NO: 4830634 - DNA, 14 bp, Homo sapiens
ctgtttatgttctt

SEQ ID NO: 4830635 - DNA, 13 bp, Homo sapiens
ctgtttgaatttt

SEQ ID NO: 4830636 - DNA, 19 bp, Homo sapiens
ctgttttaaaaaatacagt

SEQ ID NO: 4830637 - DNA, 22 bp, Homo sapiens
ctgtttttgaagaagggaaatt

SEQ ID NO: 4830638 - DNA, 12 bp, Homo sapiens
cttaaaaatgta

SEQ ID NO: 4830639 - DNA, 14 bp, Homo sapiens
cttaaacaaaaact

SEQ ID NO: 4830640 - DNA, 23 bp, Homo sapiens
cttaaacaaaaactttccatgac

SEQ ID NO: 4830641 - DNA, 19 bp, Homo sapiens
cttaaacatttccctgctg

SEQ ID NO: 4830642 - DNA, 12 bp, Homo sapiens
cttaaacatttt

SEQ ID NO: 4830643 - DNA, 17 bp, Homo sapiens
cttaaacccacataaac

SEQ ID NO: 4830644 - DNA, 15 bp, Homo sapiens
cttaaacctgtgctt

SEQ ID NO: 4830645 - DNA, 22 bp, Homo sapiens
cttaaacctgtgctttcatgtt

SEQ ID NO: 4830646 - DNA, 13 bp, Homo sapiens
cttaaactttgtc

SEQ ID NO: 4830647 - DNA, 21 bp, Homo sapiens
cttaaactttgtcacttctgc

SEQ ID NO: 4830648 - DNA, 19 bp, Homo sapiens
cttaaagaacagctaacaa

SEQ ID NO: 4830649 - DNA, 13 bp, Homo sapiens
cttaaagcttgtt

SEQ ID NO: 4830650 - DNA, 20 bp, Homo sapiens
cttaaattaaacaatttatt

SEQ ID NO: 4830651 - DNA, 21 bp, Homo sapiens
cttaaattaaacaatttattt

SEQ ID NO: 4830652 - DNA, 22 bp, Homo sapiens
cttaacaaacgtaatttgttat

SEQ ID NO: 4830653 - DNA, 16 bp, Homo sapiens
cttaacagctgtatta

SEQ ID NO: 4830654 - DNA, 21 bp, Homo sapiens
cttaacataaacttgtactta

SEQ ID NO: 4830655 - DNA, 22 bp, Homo sapiens
cttaacataaacttgtacttac

SEQ ID NO: 4830656 - DNA, 23 bp, Homo sapiens
cttaacattaagtattccttggc

SEQ ID NO: 4830657 - DNA, 12 bp, Homo sapiens
cttaactggccc

SEQ ID NO: 4830658 - DNA, 18 bp, Homo sapiens
cttaagattccattttgg

SEQ ID NO: 4830659 - DNA, 13 bp, Homo sapiens
cttaagctgccca

SEQ ID NO: 4830660 - DNA, 16 bp, Homo sapiens
cttaaggacagtgttc

SEQ ID NO: 4830661 - DNA, 21 bp, Homo sapiens
cttaaggacagtgttcaaatt

SEQ ID NO: 4830662 - DNA, 21 bp, Homo sapiens
cttaagtataactaatttgct

SEQ ID NO: 4830663 - DNA, 15 bp, Homo sapiens
cttaagtcttactgt

SEQ ID NO: 4830664 - DNA, 11 bp, Homo sapiens
cttaatatttc

SEQ ID NO: 4830665 - DNA, 19 bp, Homo sapiens
cttaatatttcttcaaata

SEQ ID NO: 4830666 - DNA, 14 bp, Homo sapiens
cttaatgaagaaat

SEQ ID NO: 4830667 - DNA, 20 bp, Homo sapiens
cttaatgaagaaatacagct

SEQ ID NO: 4830668 - DNA, 18 bp, Homo sapiens
cttaatggaaacacgaga

SEQ ID NO: 4830669 - DNA, 20 bp, Homo sapiens
cttaatgtctttgtgttttg

SEQ ID NO: 4830670 - DNA, 20 bp, Homo sapiens
cttaattcttacctcatttg

SEQ ID NO: 4830671 - DNA, 13 bp, Homo sapiens
cttacaaagccag

SEQ ID NO: 4830672 - DNA, 15 bp, Homo sapiens
cttacaaagccagct

SEQ ID NO: 4830673 - DNA, 16 bp, Homo sapiens
cttacaaagccagctc

SEQ ID NO: 4830674 - DNA, 18 bp, Homo sapiens
cttacaactgactgactt

SEQ ID NO: 4830675 - DNA, 13 bp, Homo sapiens
cttacacaatggt

SEQ ID NO: 4830676 - DNA, 20 bp, Homo sapiens
cttacacacctgagaatgtg

SEQ ID NO: 4830677 - DNA, 16 bp, Homo sapiens
cttacactgaaatcca

SEQ ID NO: 4830678 - DNA, 18 bp, Homo sapiens
cttacagaagggagtgaa

SEQ ID NO: 4830679 - DNA, 22 bp, Homo sapiens
cttacccacttccctgcaaggt

SEQ ID NO: 4830680 - DNA, 18 bp, Homo sapiens
cttaccccgtccctttcc

SEQ ID NO: 4830681 - DNA, 16 bp, Homo sapiens
cttaccgaaatgaaaa

SEQ ID NO: 4830682 - DNA, 17 bp, Homo sapiens
cttaccgaaatgaaaat

SEQ ID NO: 4830683 - DNA, 15 bp, Homo sapiens
cttacctcatttgca

SEQ ID NO: 4830684 - DNA, 16 bp, Homo sapiens
cttacctgacacaaga

SEQ ID NO: 4830685 - DNA, 20 bp, Homo sapiens
cttacctgccaggaagccag

SEQ ID NO: 4830686 - DNA, 15 bp, Homo sapiens
cttactgattaactc

SEQ ID NO: 4830687 - DNA, 16 bp, Homo sapiens
cttacttagaatttat

SEQ ID NO: 4830688 - DNA, 19 bp, Homo sapiens
cttactttacctctctgtc

SEQ ID NO: 4830689 - DNA, 21 bp, Homo sapiens
cttactttatctgggcttaat

SEQ ID NO: 4830690 - DNA, 17 bp, Homo sapiens
cttagaagaatattgta

SEQ ID NO: 4830691 - DNA, 14 bp, Homo sapiens
cttagaagatgttg

SEQ ID NO: 4830692 - DNA, 17 bp, Homo sapiens
cttagaatactgtattg

SEQ ID NO: 4830693 - DNA, 14 bp, Homo sapiens
cttagaatgtgaaa

SEQ ID NO: 4830694 - DNA, 20 bp, Homo sapiens
cttagaccgtggtgtcctct

SEQ ID NO: 4830695 - DNA, 15 bp, Homo sapiens
cttagcctccagcac

SEQ ID NO: 4830696 - DNA, 15 bp, Homo sapiens
cttagcgttctgttt

SEQ ID NO: 4830697 - DNA, 22 bp, Homo sapiens
cttagggagtgtgccttgggcg

SEQ ID NO: 4830698 - DNA, 17 bp, Homo sapiens
cttagggtacagcccag

SEQ ID NO: 4830699 - DNA, 18 bp, Homo sapiens
cttagggtacagcccagg

SEQ ID NO: 4830700 - DNA, 20 bp, Homo sapiens
cttagggtacagcccaggcg

SEQ ID NO: 4830701 - DNA, 14 bp, Homo sapiens
cttagggtctgtcc

SEQ ID NO: 4830702 - DNA, 13 bp, Homo sapiens
cttagtatctcat

SEQ ID NO: 4830703 - DNA, 19 bp, Homo sapiens
cttagtatctcatcaacaa

SEQ ID NO: 4830704 - DNA, 22 bp, Homo sapiens
cttagtatctcatcaacaaaga

SEQ ID NO: 4830705 - DNA, 14 bp, Homo sapiens
cttagtgtctcgtg

SEQ ID NO: 4830706 - DNA, 12 bp, Homo sapiens
cttatagagcac

SEQ ID NO: 4830707 - DNA, 13 bp, Homo sapiens
cttatagagcaca

SEQ ID NO: 4830708 - DNA, 15 bp, Homo sapiens
cttatagagcacaat

SEQ ID NO: 4830709 - DNA, 17 bp, Homo sapiens
cttatattattttctgt

SEQ ID NO: 4830710 - DNA, 13 bp, Homo sapiens
cttatattctgca

SEQ ID NO: 4830711 - DNA, 17 bp, Homo sapiens
cttatcagtttgctaat

SEQ ID NO: 4830712 - DNA, 20 bp, Homo sapiens
cttatggagtgtgcctctct

SEQ ID NO: 4830713 - DNA, 13 bp, Homo sapiens
cttattaaaatat

SEQ ID NO: 4830714 - DNA, 23 bp, Homo sapiens
cttattaaaatattttcttaatt

SEQ ID NO: 4830715 - DNA, 14 bp, Homo sapiens
cttattatttttga

SEQ ID NO: 4830716 - DNA, 18 bp, Homo sapiens
cttattcctaattcctgt

SEQ ID NO: 4830717 - DNA, 15 bp, Homo sapiens
cttatttatatatga

SEQ ID NO: 4830718 - DNA, 19 bp, Homo sapiens
cttatttatatatgaagta

SEQ ID NO: 4830719 - DNA, 23 bp, Homo sapiens
cttatttatattcagagatgtac

SEQ ID NO: 4830720 - DNA, 14 bp, Homo sapiens
cttattttgattgt

SEQ ID NO: 4830721 - DNA, 21 bp, Homo sapiens
cttcaaaatataaaatgccaa

SEQ ID NO: 4830722 - DNA, 16 bp, Homo sapiens
cttcaaacgaaatggc

SEQ ID NO: 4830723 - DNA, 13 bp, Homo sapiens
cttcaaagtctca

SEQ ID NO: 4830724 - DNA, 22 bp, Homo sapiens
cttcaaagtctcaatgaaatag

SEQ ID NO: 4830725 - DNA, 13 bp, Homo sapiens
cttcaaatgtgta

SEQ ID NO: 4830726 - DNA, 14 bp, Homo sapiens
cttcaaatgtgtaa

SEQ ID NO: 4830727 - DNA, 17 bp, Homo sapiens
cttcaaccctgccctgc

SEQ ID NO: 4830728 - DNA, 18 bp, Homo sapiens
cttcaaccctgccctgca

SEQ ID NO: 4830729 - DNA, 23 bp, Homo sapiens
cttcaatccccataatgcttctt

SEQ ID NO: 4830730 - DNA, 17 bp, Homo sapiens
cttcaatgttaaatcta

SEQ ID NO: 4830731 - DNA, 14 bp, Homo sapiens
cttcaattaatgga

SEQ ID NO: 4830732 - DNA, 22 bp, Homo sapiens
cttcaattaatggaaaactgtt

SEQ ID NO: 4830733 - DNA, 13 bp, Homo sapiens
cttcacaaaatgc

SEQ ID NO: 4830734 - DNA, 14 bp, Homo sapiens
cttcacaaaatgca

SEQ ID NO: 4830735 - DNA, 15 bp, Homo sapiens
cttcaccaggaagaa

SEQ ID NO: 4830736 - DNA, 23 bp, Homo sapiens
cttcacccaccacccccatcatc

SEQ ID NO: 4830737 - DNA, 15 bp, Homo sapiens
cttcaccccggcagg

SEQ ID NO: 4830738 - DNA, 19 bp, Homo sapiens
cttcaccccggcaggccct

SEQ ID NO: 4830739 - DNA, 20 bp, Homo sapiens
cttcaccccggcaggccctg

SEQ ID NO: 4830740 - DNA, 16 bp, Homo sapiens
cttcaccgcattccag

SEQ ID NO: 4830741 - DNA, 19 bp, Homo sapiens
cttcaccgcattccagggg

SEQ ID NO: 4830742 - DNA, 10 bp, Homo sapiens
cttcacctca

SEQ ID NO: 4830743 - DNA, 13 bp, Homo sapiens
cttcacctccttc

SEQ ID NO: 4830744 - DNA, 15 bp, Homo sapiens
cttcacctccttctg

SEQ ID NO: 4830745 - DNA, 23 bp, Homo sapiens
cttcacgattcttaccctttctt

SEQ ID NO: 4830746 - DNA, 22 bp, Homo sapiens
cttcactctgacagtattaaca

SEQ ID NO: 4830747 - DNA, 18 bp, Homo sapiens
cttcactgtcttactcaa

SEQ ID NO: 4830748 - DNA, 15 bp, Homo sapiens
cttcacttaaaatca

SEQ ID NO: 4830749 - DNA, 20 bp, Homo sapiens
cttcagacacacggggcacc

SEQ ID NO: 4830750 - DNA, 21 bp, Homo sapiens
cttcagactctctcctctctc

SEQ ID NO: 4830751 - DNA, 18 bp, Homo sapiens
cttcagagttctctgtaa

SEQ ID NO: 4830752 - DNA, 20 bp, Homo sapiens
cttcagcaaccctacagtat

SEQ ID NO: 4830753 - DNA, 21 bp, Homo sapiens
cttcagcaaccctacagtata

SEQ ID NO: 4830754 - DNA, 21 bp, Homo sapiens
cttcaggaaagcagcagtttt

SEQ ID NO: 4830755 - DNA, 14 bp, Homo sapiens
cttcagtgccaaaa

SEQ ID NO: 4830756 - DNA, 13 bp, Homo sapiens
cttcataggcaga

SEQ ID NO: 4830757 - DNA, 15 bp, Homo sapiens
cttcataggcagagc

SEQ ID NO: 4830758 - DNA, 18 bp, Homo sapiens
cttcatccatagacacag

SEQ ID NO: 4830759 - DNA, 15 bp, Homo sapiens
cttcatcccagggta

SEQ ID NO: 4830760 - DNA, 13 bp, Homo sapiens
cttcatccctctg

SEQ ID NO: 4830761 - DNA, 15 bp, Homo sapiens
cttcatccctttcca

SEQ ID NO: 4830762 - DNA, 15 bp, Homo sapiens
cttcatcctcctcag

SEQ ID NO: 4830763 - DNA, 15 bp, Homo sapiens
cttcatctggagtcc

SEQ ID NO: 4830764 - DNA, 20 bp, Homo sapiens
cttcatctggagtccctcct

SEQ ID NO: 4830765 - DNA, 19 bp, Homo sapiens
cttcatctggattccagag

SEQ ID NO: 4830766 - DNA, 19 bp, Homo sapiens
cttcatgaccttacatagc

SEQ ID NO: 4830767 - DNA, 13 bp, Homo sapiens
cttcatgctgtct

SEQ ID NO: 4830768 - DNA, 19 bp, Homo sapiens
cttcatggccatagctttt

SEQ ID NO: 4830769 - DNA, 14 bp, Homo sapiens
cttcatgttgatgt

SEQ ID NO: 4830770 - DNA, 13 bp, Homo sapiens
cttcattaaaaca

SEQ ID NO: 4830771 - DNA, 15 bp, Homo sapiens
cttcattaaaacaag

SEQ ID NO: 4830772 - DNA, 18 bp, Homo sapiens
cttcattgcactgcagtt

SEQ ID NO: 4830773 - DNA, 16 bp, Homo sapiens
cttccacaagagccca

SEQ ID NO: 4830774 - DNA, 17 bp, Homo sapiens
cttccacaagagcccag

SEQ ID NO: 4830775 - DNA, 19 bp, Homo sapiens
cttccacaagagcccaggc

SEQ ID NO: 4830776 - DNA, 15 bp, Homo sapiens
cttccaccctgccct

SEQ ID NO: 4830777 - DNA, 16 bp, Homo sapiens
cttccaccctgccctg

SEQ ID NO: 4830778 - DNA, 14 bp, Homo sapiens
cttccactgcctct

SEQ ID NO: 4830779 - DNA, 16 bp, Homo sapiens
cttccagctcagtccc

SEQ ID NO: 4830780 - DNA, 17 bp, Homo sapiens
cttccagctcagtccca

SEQ ID NO: 4830781 - DNA, 19 bp, Homo sapiens
cttccagctcagtcccaca

SEQ ID NO: 4830782 - DNA, 15 bp, Homo sapiens
cttccagctttctct

SEQ ID NO: 4830783 - DNA, 18 bp, Homo sapiens
cttccagctttctctttg

SEQ ID NO: 4830784 - DNA, 21 bp, Homo sapiens
cttccatggtggtttcagaaa

SEQ ID NO: 4830785 - DNA, 22 bp, Homo sapiens
cttcccaacctcccctggtcct

SEQ ID NO: 4830786 - DNA, 22 bp, Homo sapiens
cttcccaacgtactcctcagac

SEQ ID NO: 4830787 - DNA, 18 bp, Homo sapiens
cttcccaaggcagctgga

SEQ ID NO: 4830788 - DNA, 17 bp, Homo sapiens
cttcccaatcagcactg

SEQ ID NO: 4830789 - DNA, 19 bp, Homo sapiens
cttcccaatcagcactgaa

SEQ ID NO: 4830790 - DNA, 17 bp, Homo sapiens
cttcccacctccctgcc

SEQ ID NO: 4830791 - DNA, 18 bp, Homo sapiens
cttcccagctggcagcgc

SEQ ID NO: 4830792 - DNA, 18 bp, Homo sapiens
cttcccaggaccctgggt

SEQ ID NO: 4830793 - DNA, 21 bp, Homo sapiens
cttcccatttgtaatgtatct

SEQ ID NO: 4830794 - DNA, 22 bp, Homo sapiens
cttccccaaggcactgagcgcc

SEQ ID NO: 4830795 - DNA, 23 bp, Homo sapiens
cttcccccagcacaaagcactgg

SEQ ID NO: 4830796 - DNA, 23 bp, Homo sapiens
cttcccccagggtcccctgcatg

SEQ ID NO: 4830797 - DNA, 12 bp, Homo sapiens
cttcccccttcc

SEQ ID NO: 4830798 - DNA, 18 bp, Homo sapiens
cttccccgtgcggcccgt

SEQ ID NO: 4830799 - DNA, 19 bp, Homo sapiens
cttcccctgcgccctccct

SEQ ID NO: 4830800 - DNA, 20 bp, Homo sapiens
cttcccctgcgccctccctc

SEQ ID NO: 4830801 - DNA, 22 bp, Homo sapiens
cttcccctgcgccctccctccc

SEQ ID NO: 4830802 - DNA, 15 bp, Homo sapiens
cttcccgcagcacca

SEQ ID NO: 4830803 - DNA, 16 bp, Homo sapiens
cttcccgcagcaccag

SEQ ID NO: 4830804 - DNA, 17 bp, Homo sapiens
cttcccgcagcaccagc

SEQ ID NO: 4830805 - DNA, 18 bp, Homo sapiens
cttcccgcagcaccagcc

SEQ ID NO: 4830806 - DNA, 20 bp, Homo sapiens
cttcccgcagcaccagcctg

SEQ ID NO: 4830807 - DNA, 11 bp, Homo sapiens
cttccctccaa

SEQ ID NO: 4830808 - DNA, 17 bp, Homo sapiens
cttccctctcgctcccc

SEQ ID NO: 4830809 - DNA, 17 bp, Homo sapiens
cttccctgaacactcat

SEQ ID NO: 4830810 - DNA, 16 bp, Homo sapiens
cttccctgacactgtc

SEQ ID NO: 4830811 - DNA, 12 bp, Homo sapiens
cttccctgcttc

SEQ ID NO: 4830812 - DNA, 14 bp, Homo sapiens
cttcccttcttttc

SEQ ID NO: 4830813 - DNA, 20 bp, Homo sapiens
cttccctttacagctctcct

SEQ ID NO: 4830814 - DNA, 23 bp, Homo sapiens
cttccgagattcagactgcttca

SEQ ID NO: 4830815 - DNA, 22 bp, Homo sapiens
cttcctattaatttattaaatt

SEQ ID NO: 4830816 - DNA, 19 bp, Homo sapiens
cttcctcatctccatgctc

SEQ ID NO: 4830817 - DNA, 13 bp, Homo sapiens
cttcctcctggtg

SEQ ID NO: 4830818 - DNA, 17 bp, Homo sapiens
cttcctgcaacaccttg

SEQ ID NO: 4830819 - DNA, 18 bp, Homo sapiens
cttcctgggcagcccaga

SEQ ID NO: 4830820 - DNA, 14 bp, Homo sapiens
cttcctgtcctgct

SEQ ID NO: 4830821 - DNA, 17 bp, Homo sapiens
cttcctgtcctgctcac

SEQ ID NO: 4830822 - DNA, 15 bp, Homo sapiens
cttccttaacagctg

SEQ ID NO: 4830823 - DNA, 16 bp, Homo sapiens
cttccttacccaaact

SEQ ID NO: 4830824 - DNA, 22 bp, Homo sapiens
cttccttgaaatttctcagcgg

SEQ ID NO: 4830825 - DNA, 23 bp, Homo sapiens
cttccttgccacaatcactaaat

SEQ ID NO: 4830826 - DNA, 20 bp, Homo sapiens
cttcgctattcccaggcagg

SEQ ID NO: 4830827 - DNA, 21 bp, Homo sapiens
cttcgctattcccaggcaggg

SEQ ID NO: 4830828 - DNA, 19 bp, Homo sapiens
cttcgctgtgatgcatgag

SEQ ID NO: 4830829 - DNA, 14 bp, Homo sapiens
cttcggtggccttg

SEQ ID NO: 4830830 - DNA, 21 bp, Homo sapiens
cttcgttagtaatctgtataa

SEQ ID NO: 4830831 - DNA, 15 bp, Homo sapiens
cttcgtttgcctcca

SEQ ID NO: 4830832 - DNA, 17 bp, Homo sapiens
cttcgtttgcctccaga

SEQ ID NO: 4830833 - DNA, 15 bp, Homo sapiens
cttctaaaataaatg

SEQ ID NO: 4830834 - DNA, 16 bp, Homo sapiens
cttctaaaataaatgt

SEQ ID NO: 4830835 - DNA, 23 bp, Homo sapiens
cttctaaaataaatgttttggaa

SEQ ID NO: 4830836 - DNA, 19 bp, Homo sapiens
cttctaaatcataatcatc

SEQ ID NO: 4830837 - DNA, 21 bp, Homo sapiens
cttctaagggatccagagacc

SEQ ID NO: 4830838 - DNA, 17 bp, Homo sapiens
cttctaatatttattgc

SEQ ID NO: 4830839 - DNA, 21 bp, Homo sapiens
cttctaatatttattgcttta

SEQ ID NO: 4830840 - DNA, 20 bp, Homo sapiens
cttctaatccatgtgctgct

SEQ ID NO: 4830841 - DNA, 23 bp, Homo sapiens
cttctacaatacaacacattgaa

SEQ ID NO: 4830842 - DNA, 14 bp, Homo sapiens
cttctactgagcaa

SEQ ID NO: 4830843 - DNA, 17 bp, Homo sapiens
cttctatattaaggcag

SEQ ID NO: 4830844 - DNA, 15 bp, Homo sapiens
cttctatgtccaaca

SEQ ID NO: 4830845 - DNA, 20 bp, Homo sapiens
cttctcaaatgctactcagt

SEQ ID NO: 4830846 - DNA, 13 bp, Homo sapiens
cttctcacagcac

SEQ ID NO: 4830847 - DNA, 23 bp, Homo sapiens
cttctcacagcacatgctggcca

SEQ ID NO: 4830848 - DNA, 13 bp, Homo sapiens
cttctcagctcca

SEQ ID NO: 4830849 - DNA, 16 bp, Homo sapiens
cttctcagctccactc

SEQ ID NO: 4830850 - DNA, 23 bp, Homo sapiens
cttctcattttttcctgagaacc

SEQ ID NO: 4830851 - DNA, 14 bp, Homo sapiens
cttctccacctccc

SEQ ID NO: 4830852 - DNA, 22 bp, Homo sapiens
cttctccacctcccccaaaccc

SEQ ID NO: 4830853 - DNA, 20 bp, Homo sapiens
cttctccactttctagccag

SEQ ID NO: 4830854 - DNA, 14 bp, Homo sapiens
cttctccccctcag

SEQ ID NO: 4830855 - DNA, 14 bp, Homo sapiens
cttctcccgccatt

SEQ ID NO: 4830856 - DNA, 19 bp, Homo sapiens
cttctcccgccattggcct

SEQ ID NO: 4830857 - DNA, 21 bp, Homo sapiens
cttctcccgccattggcctta

SEQ ID NO: 4830858 - DNA, 13 bp, Homo sapiens
cttctccctgggg

SEQ ID NO: 4830859 - DNA, 22 bp, Homo sapiens
cttctccctggggaggacccct

SEQ ID NO: 4830860 - DNA, 16 bp, Homo sapiens
cttctctaaaacagca

SEQ ID NO: 4830861 - DNA, 15 bp, Homo sapiens
cttctctctgtgctg

SEQ ID NO: 4830862 - DNA, 17 bp, Homo sapiens
cttctctttggggctcc

SEQ ID NO: 4830863 - DNA, 19 bp, Homo sapiens
cttctgaacttggcgctgc

SEQ ID NO: 4830864 - DNA, 18 bp, Homo sapiens
cttctgaactttggaagc

SEQ ID NO: 4830865 - DNA, 16 bp, Homo sapiens
cttctgacggccctgc

SEQ ID NO: 4830866 - DNA, 18 bp, Homo sapiens
cttctgctgccctgatgc

SEQ ID NO: 4830867 - DNA, 18 bp, Homo sapiens
cttctggaggtggggagg

SEQ ID NO: 4830868 - DNA, 22 bp, Homo sapiens
cttctggaggtggggagggcct

SEQ ID NO: 4830869 - DNA, 11 bp, Homo sapiens
cttctggcacc

SEQ ID NO: 4830870 - DNA, 22 bp, Homo sapiens
cttctggggagggacacagagg

SEQ ID NO: 4830871 - DNA, 21 bp, Homo sapiens
cttctggggaggggctccgtg

SEQ ID NO: 4830872 - DNA, 18 bp, Homo sapiens
cttctgtgcatctggcct

SEQ ID NO: 4830873 - DNA, 20 bp, Homo sapiens
cttctgtgcatctggcctgg

SEQ ID NO: 4830874 - DNA, 18 bp, Homo sapiens
cttcttaaggacagtgtt

SEQ ID NO: 4830875 - DNA, 20 bp, Homo sapiens
cttcttccaaaaggaagcac

SEQ ID NO: 4830876 - DNA, 19 bp, Homo sapiens
cttcttccccaaggcactg

SEQ ID NO: 4830877 - DNA, 17 bp, Homo sapiens
cttcttcccccagggtc

SEQ ID NO: 4830878 - DNA, 15 bp, Homo sapiens
cttcttctgtaatat

SEQ ID NO: 4830879 - DNA, 21 bp, Homo sapiens
cttcttgcggcaccgcccacc

SEQ ID NO: 4830880 - DNA, 12 bp, Homo sapiens
cttcttgtctct

SEQ ID NO: 4830881 - DNA, 21 bp, Homo sapiens
cttcttgttcatgttttgcta

SEQ ID NO: 4830882 - DNA, 18 bp, Homo sapiens
cttctttactaacactgg

SEQ ID NO: 4830883 - DNA, 13 bp, Homo sapiens
cttctttcctctt

SEQ ID NO: 4830884 - DNA, 14 bp, Homo sapiens
cttctttcctctta

SEQ ID NO: 4830885 - DNA, 20 bp, Homo sapiens
cttcttttcaatgcaatgca

SEQ ID NO: 4830886 - DNA, 17 bp, Homo sapiens
cttgaaaacttctcatt

SEQ ID NO: 4830887 - DNA, 21 bp, Homo sapiens
cttgaaaacttctcatttatg

SEQ ID NO: 4830888 - DNA, 22 bp, Homo sapiens
cttgaaaatgtggcttcttcaa

SEQ ID NO: 4830889 - DNA, 21 bp, Homo sapiens
cttgaaattatatctgtggtc

SEQ ID NO: 4830890 - DNA, 16 bp, Homo sapiens
cttgaaatttctcagc

SEQ ID NO: 4830891 - DNA, 13 bp, Homo sapiens
cttgaagggccca

SEQ ID NO: 4830892 - DNA, 14 bp, Homo sapiens
cttgaagggcccag

SEQ ID NO: 4830893 - DNA, 15 bp, Homo sapiens
cttgaagggcccagg

SEQ ID NO: 4830894 - DNA, 16 bp, Homo sapiens
cttgaagggcccagga

SEQ ID NO: 4830895 - DNA, 17 bp, Homo sapiens
cttgaatagtattgtgt

SEQ ID NO: 4830896 - DNA, 19 bp, Homo sapiens
cttgaatattatacttctt

SEQ ID NO: 4830897 - DNA, 23 bp, Homo sapiens
cttgaatgatgccatgaggaaca

SEQ ID NO: 4830898 - DNA, 13 bp, Homo sapiens
cttgaatgcttaa

SEQ ID NO: 4830899 - DNA, 13 bp, Homo sapiens
cttgacaggcgcc

SEQ ID NO: 4830900 - DNA, 20 bp, Homo sapiens
cttgacaggcgccgcctcgc

SEQ ID NO: 4830901 - DNA, 17 bp, Homo sapiens
cttgacagttacttaca

SEQ ID NO: 4830902 - DNA, 23 bp, Homo sapiens
cttgaccctgaaatattttctac

SEQ ID NO: 4830903 - DNA, 16 bp, Homo sapiens
cttgacgcagcccccc

SEQ ID NO: 4830904 - DNA, 13 bp, Homo sapiens
cttgagagcccca

SEQ ID NO: 4830905 - DNA, 22 bp, Homo sapiens
cttgagcaataaacgctgactt

SEQ ID NO: 4830906 - DNA, 16 bp, Homo sapiens
cttgagcagctgaatt

SEQ ID NO: 4830907 - DNA, 22 bp, Homo sapiens
cttgagggacgactttctttaa

SEQ ID NO: 4830908 - DNA, 13 bp, Homo sapiens
cttgagtctctga

SEQ ID NO: 4830909 - DNA, 17 bp, Homo sapiens
cttgagtggacagcagc

SEQ ID NO: 4830910 - DNA, 18 bp, Homo sapiens
cttgagtggacagcagct

SEQ ID NO: 4830911 - DNA, 23 bp, Homo sapiens
cttgagtggacagcagctggact

SEQ ID NO: 4830912 - DNA, 16 bp, Homo sapiens
cttgagtgggccccct

SEQ ID NO: 4830913 - DNA, 18 bp, Homo sapiens
cttgagtgggccccctct

SEQ ID NO: 4830914 - DNA, 20 bp, Homo sapiens
cttgagtgggccccctctct

SEQ ID NO: 4830915 - DNA, 14 bp, Homo sapiens
cttgatatcccaag

SEQ ID NO: 4830916 - DNA, 17 bp, Homo sapiens
cttgatatcctctttga

SEQ ID NO: 4830917 - DNA, 22 bp, Homo sapiens
cttgatatcctctttgagtgaa

SEQ ID NO: 4830918 - DNA, 13 bp, Homo sapiens
cttgatctttgga

SEQ ID NO: 4830919 - DNA, 14 bp, Homo sapiens
cttgattcaaataa

SEQ ID NO: 4830920 - DNA, 20 bp, Homo sapiens
cttgattctaaaggggacag

SEQ ID NO: 4830921 - DNA, 21 bp, Homo sapiens
cttgatttgaccactgacagc

SEQ ID NO: 4830922 - DNA, 17 bp, Homo sapiens
cttgatttttacataat

SEQ ID NO: 4830923 - DNA, 14 bp, Homo sapiens
cttgcaataagata

SEQ ID NO: 4830924 - DNA, 18 bp, Homo sapiens
cttgcactgtatccaagt

SEQ ID NO: 4830925 - DNA, 15 bp, Homo sapiens
cttgcagtcatcaga

SEQ ID NO: 4830926 - DNA, 22 bp, Homo sapiens
cttgcagttagactcaaagaag

SEQ ID NO: 4830927 - DNA, 13 bp, Homo sapiens
cttgccacaatca

SEQ ID NO: 4830928 - DNA, 15 bp, Homo sapiens
cttgccacaatcact

SEQ ID NO: 4830929 - DNA, 12 bp, Homo sapiens
cttgccactgcc

SEQ ID NO: 4830930 - DNA, 13 bp, Homo sapiens
cttgccactgcca

SEQ ID NO: 4830931 - DNA, 14 bp, Homo sapiens
cttgccagcaacac

SEQ ID NO: 4830932 - DNA, 18 bp, Homo sapiens
cttgccctattataattg

SEQ ID NO: 4830933 - DNA, 14 bp, Homo sapiens
cttgcctccaggac

SEQ ID NO: 4830934 - DNA, 16 bp, Homo sapiens
cttgcctccaggacct

SEQ ID NO: 4830935 - DNA, 18 bp, Homo sapiens
cttgcctctttcctcctc

SEQ ID NO: 4830936 - DNA, 23 bp, Homo sapiens
cttgctcctttccatcagcttta

SEQ ID NO: 4830937 - DNA, 17 bp, Homo sapiens
cttgctgcactcttgca

SEQ ID NO: 4830938 - DNA, 21 bp, Homo sapiens
cttgctgcactcttgcacatg

SEQ ID NO: 4830939 - DNA, 19 bp, Homo sapiens
cttgctggaaaactgccac

SEQ ID NO: 4830940 - DNA, 18 bp, Homo sapiens
cttgctgtgaaatgactg

SEQ ID NO: 4830941 - DNA, 19 bp, Homo sapiens
cttgctgtttaccgcccac

SEQ ID NO: 4830942 - DNA, 23 bp, Homo sapiens
cttgctgtttaccgcccacccag

SEQ ID NO: 4830943 - DNA, 15 bp, Homo sapiens
cttgcttctaaggga

SEQ ID NO: 4830944 - DNA, 12 bp, Homo sapiens
cttggagaggag

SEQ ID NO: 4830945 - DNA, 21 bp, Homo sapiens
cttggagaggaggtgtggagt

SEQ ID NO: 4830946 - DNA, 20 bp, Homo sapiens
cttggagcgtttttgctggc

SEQ ID NO: 4830947 - DNA, 20 bp, Homo sapiens
cttggagtgccacatggccg

SEQ ID NO: 4830948 - DNA, 20 bp, Homo sapiens
cttggagtgccacgtggccg

SEQ ID NO: 4830949 - DNA, 21 bp, Homo sapiens
cttggataggagcttccagat

SEQ ID NO: 4830950 - DNA, 12 bp, Homo sapiens
cttggatgtcat

SEQ ID NO: 4830951 - DNA, 19 bp, Homo sapiens
cttggcaccaaagatgcag

SEQ ID NO: 4830952 - DNA, 22 bp, Homo sapiens
cttggcaccaaagatgcagccg

SEQ ID NO: 4830953 - DNA, 13 bp, Homo sapiens
cttggcccagcag

SEQ ID NO: 4830954 - DNA, 22 bp, Homo sapiens
cttggcccagcagcggcccaga

SEQ ID NO: 4830955 - DNA, 14 bp, Homo sapiens
cttggcgctgcccc

SEQ ID NO: 4830956 - DNA, 20 bp, Homo sapiens
cttggcgctgcccctggcag

SEQ ID NO: 4830957 - DNA, 21 bp, Homo sapiens
cttggcgctgcccctggcagc

SEQ ID NO: 4830958 - DNA, 14 bp, Homo sapiens
cttggctccatgct

SEQ ID NO: 4830959 - DNA, 16 bp, Homo sapiens
cttggctccatgctcc

SEQ ID NO: 4830960 - DNA, 22 bp, Homo sapiens
cttggctccatgctcctcactg

SEQ ID NO: 4830961 - DNA, 14 bp, Homo sapiens
cttgggaagcagtt

SEQ ID NO: 4830962 - DNA, 23 bp, Homo sapiens
cttgggacggaagtggcctgaga

SEQ ID NO: 4830963 - DNA, 17 bp, Homo sapiens
cttgggagagcccctgg

SEQ ID NO: 4830964 - DNA, 22 bp, Homo sapiens
cttgggagagcccctggggcct

SEQ ID NO: 4830965 - DNA, 20 bp, Homo sapiens
cttgggcacgggagagcgcc

SEQ ID NO: 4830966 - DNA, 22 bp, Homo sapiens
cttgggcacgggagagcgccac

SEQ ID NO: 4830967 - DNA, 18 bp, Homo sapiens
cttgggctggcacccact

SEQ ID NO: 4830968 - DNA, 22 bp, Homo sapiens
cttgggcttcatcctcctcaga

SEQ ID NO: 4830969 - DNA, 15 bp, Homo sapiens
cttggggaaggggcc

SEQ ID NO: 4830970 - DNA, 23 bp, Homo sapiens
cttggggaaggggcctgggctgt

SEQ ID NO: 4830971 - DNA, 23 bp, Homo sapiens
cttggtcacaaagctatttaagt

SEQ ID NO: 4830972 - DNA, 21 bp, Homo sapiens
cttggtctctttctttccaaa

SEQ ID NO: 4830973 - DNA, 22 bp, Homo sapiens
cttggtctctttctttccaaag

SEQ ID NO: 4830974 - DNA, 14 bp, Homo sapiens
cttggtctgtgttc

SEQ ID NO: 4830975 - DNA, 20 bp, Homo sapiens
cttggtgattacctgaaagc

SEQ ID NO: 4830976 - DNA, 18 bp, Homo sapiens
cttggtgcttattgatat

SEQ ID NO: 4830977 - DNA, 13 bp, Homo sapiens
cttggttatattt

SEQ ID NO: 4830978 - DNA, 13 bp, Homo sapiens
cttggttcctgat

SEQ ID NO: 4830979 - DNA, 22 bp, Homo sapiens
cttggtttccatcaaagccctc

SEQ ID NO: 4830980 - DNA, 15 bp, Homo sapiens
cttgtaaaactgtga

SEQ ID NO: 4830981 - DNA, 21 bp, Homo sapiens
cttgtaaataatgcttaacat

SEQ ID NO: 4830982 - DNA, 15 bp, Homo sapiens
cttgtaccagcccag

SEQ ID NO: 4830983 - DNA, 19 bp, Homo sapiens
cttgtacttacactgaaat

SEQ ID NO: 4830984 - DNA, 18 bp, Homo sapiens
cttgtagacgcacctgct

SEQ ID NO: 4830985 - DNA, 19 bp, Homo sapiens
cttgtatctggattcaaat

SEQ ID NO: 4830986 - DNA, 12 bp, Homo sapiens
cttgtattggaa

SEQ ID NO: 4830987 - DNA, 15 bp, Homo sapiens
cttgtattggaagta

SEQ ID NO: 4830988 - DNA, 19 bp, Homo sapiens
cttgtattttcttcccatt

SEQ ID NO: 4830989 - DNA, 23 bp, Homo sapiens
cttgtattttcttcccatttgta

SEQ ID NO: 4830990 - DNA, 14 bp, Homo sapiens
cttgtcattctcat

SEQ ID NO: 4830991 - DNA, 16 bp, Homo sapiens
cttgtcattctcatcc

SEQ ID NO: 4830992 - DNA, 22 bp, Homo sapiens
cttgtcattctcatccaaaagt

SEQ ID NO: 4830993 - DNA, 19 bp, Homo sapiens
cttgtctcctcctccagga

SEQ ID NO: 4830994 - DNA, 22 bp, Homo sapiens
cttgtgcatgcaaaaatgaatt

SEQ ID NO: 4830995 - DNA, 17 bp, Homo sapiens
cttgtgtaatttcctgc

SEQ ID NO: 4830996 - DNA, 21 bp, Homo sapiens
cttgtgtaatttcctgctcct

SEQ ID NO: 4830997 - DNA, 22 bp, Homo sapiens
cttgtgtgtatgtctatgtgta

SEQ ID NO: 4830998 - DNA, 19 bp, Homo sapiens
cttgtgttcaatctgtgaa

SEQ ID NO: 4830999 - DNA, 14 bp, Homo sapiens
cttgttcagtcact

SEQ ID NO: 4831000 - DNA, 20 bp, Homo sapiens
cttgttcatgttttgctaat

SEQ ID NO: 4831001 - DNA, 21 bp, Homo sapiens
cttgttcatgttttgctaatg

SEQ ID NO: 4831002 - DNA, 12 bp, Homo sapiens
cttgttcttcct

SEQ ID NO: 4831003 - DNA, 20 bp, Homo sapiens
cttgtttgtaaaagagctgt

SEQ ID NO: 4831004 - DNA, 14 bp, Homo sapiens
cttgtttgttctag

SEQ ID NO: 4831005 - DNA, 10 bp, Homo sapiens
ctttaaatta

SEQ ID NO: 4831006 - DNA, 12 bp, Homo sapiens
ctttaaattata

SEQ ID NO: 4831007 - DNA, 21 bp, Homo sapiens
ctttaaattatatgatatgca

SEQ ID NO: 4831008 - DNA, 21 bp, Homo sapiens
ctttaaattatgacgtgcaca

SEQ ID NO: 4831009 - DNA, 18 bp, Homo sapiens
ctttaaattgtggatgaa

SEQ ID NO: 4831010 - DNA, 17 bp, Homo sapiens
ctttaagcgaggcagaa

SEQ ID NO: 4831011 - DNA, 19 bp, Homo sapiens
ctttaatatactccttaaa

SEQ ID NO: 4831012 - DNA, 21 bp, Homo sapiens
ctttaatatactccttaaaaa

SEQ ID NO: 4831013 - DNA, 16 bp, Homo sapiens
ctttaattcttttccc

SEQ ID NO: 4831014 - DNA, 16 bp, Homo sapiens
ctttaatttttctgtt

SEQ ID NO: 4831015 - DNA, 20 bp, Homo sapiens
ctttacagctctcctccagc

SEQ ID NO: 4831016 - DNA, 24 bp, Homo sapiens
ctttacagctctcctccagccctg

SEQ ID NO: 4831017 - DNA, 19 bp, Homo sapiens
ctttaccatagcttaagaa

SEQ ID NO: 4831018 - DNA, 16 bp, Homo sapiens
ctttacctctctgtca

SEQ ID NO: 4831019 - DNA, 14 bp, Homo sapiens
ctttactaacactg

SEQ ID NO: 4831020 - DNA, 16 bp, Homo sapiens
ctttactaacactggc

SEQ ID NO: 4831021 - DNA, 23 bp, Homo sapiens
ctttagaaataaaccttaatatt

SEQ ID NO: 4831022 - DNA, 15 bp, Homo sapiens
ctttagagaagccat

SEQ ID NO: 4831023 - DNA, 17 bp, Homo sapiens
ctttagagaagccataa

SEQ ID NO: 4831024 - DNA, 14 bp, Homo sapiens
ctttaggcaggaag

SEQ ID NO: 4831025 - DNA, 18 bp, Homo sapiens
ctttataaaccataaaat

SEQ ID NO: 4831026 - DNA, 22 bp, Homo sapiens
ctttataagccaatgaagcaaa

SEQ ID NO: 4831027 - DNA, 24 bp, Homo sapiens
ctttataagccaatgaagcaaaca

SEQ ID NO: 4831028 - DNA, 16 bp, Homo sapiens
ctttataataaactgt

SEQ ID NO: 4831029 - DNA, 17 bp, Homo sapiens
ctttataataaactgtt

SEQ ID NO: 4831030 - DNA, 18 bp, Homo sapiens
ctttataataaactgttt

SEQ ID NO: 4831031 - DNA, 16 bp, Homo sapiens
ctttataatggctctg

SEQ ID NO: 4831032 - DNA, 18 bp, Homo sapiens
ctttataatggctctggg

SEQ ID NO: 4831033 - DNA, 15 bp, Homo sapiens
ctttatccacattgt

SEQ ID NO: 4831034 - DNA, 23 bp, Homo sapiens
ctttatctatgggagattaaaac

SEQ ID NO: 4831035 - DNA, 16 bp, Homo sapiens
ctttatgatttcatga

SEQ ID NO: 4831036 - DNA, 15 bp, Homo sapiens
ctttatgtattctct

SEQ ID NO: 4831037 - DNA, 14 bp, Homo sapiens
ctttattagtgaag

SEQ ID NO: 4831038 - DNA, 18 bp, Homo sapiens
ctttcaaagtgcacacac

SEQ ID NO: 4831039 - DNA, 17 bp, Homo sapiens
ctttcaatccacagtat

SEQ ID NO: 4831040 - DNA, 19 bp, Homo sapiens
ctttcaatccacagtattg

SEQ ID NO: 4831041 - DNA, 14 bp, Homo sapiens
ctttcacccttttc

SEQ ID NO: 4831042 - DNA, 15 bp, Homo sapiens
ctttcactataatgt

SEQ ID NO: 4831043 - DNA, 13 bp, Homo sapiens
ctttcatgaccac

SEQ ID NO: 4831044 - DNA, 19 bp, Homo sapiens
ctttcatgaccactgggcc

SEQ ID NO: 4831045 - DNA, 23 bp, Homo sapiens
ctttcatgaccactgggcctgct

SEQ ID NO: 4831046 - DNA, 18 bp, Homo sapiens
ctttcatgtttaagaaat

SEQ ID NO: 4831047 - DNA, 16 bp, Homo sapiens
ctttccagtgctgctc

SEQ ID NO: 4831048 - DNA, 13 bp, Homo sapiens
ctttccatcagct

SEQ ID NO: 4831049 - DNA, 14 bp, Homo sapiens
ctttccatgacagt

SEQ ID NO: 4831050 - DNA, 11 bp, Homo sapiens
ctttcccacac

SEQ ID NO: 4831051 - DNA, 14 bp, Homo sapiens
ctttccccactgaa

SEQ ID NO: 4831052 - DNA, 22 bp, Homo sapiens
ctttcccctctcatacataaaa

SEQ ID NO: 4831053 - DNA, 22 bp, Homo sapiens
ctttccctccgaacgctgctcc

SEQ ID NO: 4831054 - DNA, 14 bp, Homo sapiens
ctttccctgcatcc

SEQ ID NO: 4831055 - DNA, 23 bp, Homo sapiens
ctttccgcgtggttctgccactt

SEQ ID NO: 4831056 - DNA, 21 bp, Homo sapiens
ctttcctcctcatgaaagcag

SEQ ID NO: 4831057 - DNA, 12 bp, Homo sapiens
ctttcctctctc

SEQ ID NO: 4831058 - DNA, 13 bp, Homo sapiens
ctttccttgcctt

SEQ ID NO: 4831059 - DNA, 14 bp, Homo sapiens
ctttccttgccttc

SEQ ID NO: 4831060 - DNA, 19 bp, Homo sapiens
ctttcctttcatcctcagc

SEQ ID NO: 4831061 - DNA, 15 bp, Homo sapiens
ctttcggtctcctta

SEQ ID NO: 4831062 - DNA, 15 bp, Homo sapiens
ctttctacatgcaaa

SEQ ID NO: 4831063 - DNA, 15 bp, Homo sapiens
ctttctagccagagg

SEQ ID NO: 4831064 - DNA, 23 bp, Homo sapiens
ctttctccaaagttatccagagg

SEQ ID NO: 4831065 - DNA, 12 bp, Homo sapiens
ctttctctctgt

SEQ ID NO: 4831066 - DNA, 13 bp, Homo sapiens
ctttctctctgtg

SEQ ID NO: 4831067 - DNA, 20 bp, Homo sapiens
ctttctctttgttcttcaat

SEQ ID NO: 4831068 - DNA, 16 bp, Homo sapiens
ctttctgatacatctg

SEQ ID NO: 4831069 - DNA, 20 bp, Homo sapiens
ctttcttaatagaaagtcag

SEQ ID NO: 4831070 - DNA, 14 bp, Homo sapiens
ctttcttccttcct

SEQ ID NO: 4831071 - DNA, 21 bp, Homo sapiens
ctttcttccttcctttctctc

SEQ ID NO: 4831072 - DNA, 13 bp, Homo sapiens
ctttctttaacat

SEQ ID NO: 4831073 - DNA, 12 bp, Homo sapiens
ctttctttccaa

SEQ ID NO: 4831074 - DNA, 19 bp, Homo sapiens
ctttctttccaaaggttgt

SEQ ID NO: 4831075 - DNA, 20 bp, Homo sapiens
ctttcttttgaatcaatctg

SEQ ID NO: 4831076 - DNA, 18 bp, Homo sapiens
ctttgagggactgcctct

SEQ ID NO: 4831077 - DNA, 21 bp, Homo sapiens
ctttgagggactgcctctgcc

SEQ ID NO: 4831078 - DNA, 22 bp, Homo sapiens
ctttgagggactgcctctgcca

SEQ ID NO: 4831079 - DNA, 20 bp, Homo sapiens
ctttgagtgtcaggctctga

SEQ ID NO: 4831080 - DNA, 21 bp, Homo sapiens
ctttgagtgtcaggctctgaa

SEQ ID NO: 4831081 - DNA, 21 bp, Homo sapiens
ctttgataattactttccagc

SEQ ID NO: 4831082 - DNA, 23 bp, Homo sapiens
ctttgatgtggatgaaaaaaagg

SEQ ID NO: 4831083 - DNA, 18 bp, Homo sapiens
ctttgatttagagatgat

SEQ ID NO: 4831084 - DNA, 23 bp, Homo sapiens
ctttgcaaccttgtactttacaa

SEQ ID NO: 4831085 - DNA, 21 bp, Homo sapiens
ctttgcaggagttcctttccc

SEQ ID NO: 4831086 - DNA, 20 bp, Homo sapiens
ctttgcattgtctgtctgca

SEQ ID NO: 4831087 - DNA, 16 bp, Homo sapiens
ctttgcgctctgggtt

SEQ ID NO: 4831088 - DNA, 17 bp, Homo sapiens
ctttgcgctctgggttt

SEQ ID NO: 4831089 - DNA, 20 bp, Homo sapiens
ctttggaattctgcttctct

SEQ ID NO: 4831090 - DNA, 18 bp, Homo sapiens
ctttggaatttgaagaat

SEQ ID NO: 4831091 - DNA, 13 bp, Homo sapiens
ctttggccacagc

SEQ ID NO: 4831092 - DNA, 13 bp, Homo sapiens
ctttggctattgt

SEQ ID NO: 4831093 - DNA, 22 bp, Homo sapiens
ctttggctattgtccttgtgta

SEQ ID NO: 4831094 - DNA, 21 bp, Homo sapiens
ctttggggcttatcagaactc

SEQ ID NO: 4831095 - DNA, 14 bp, Homo sapiens
ctttggtgaataac

SEQ ID NO: 4831096 - DNA, 21 bp, Homo sapiens
ctttgtaaaccggctggacca

SEQ ID NO: 4831097 - DNA, 16 bp, Homo sapiens
ctttgtatacaagtac

SEQ ID NO: 4831098 - DNA, 15 bp, Homo sapiens
ctttgtcaaatggta

SEQ ID NO: 4831099 - DNA, 15 bp, Homo sapiens
ctttgtcaatgctct

SEQ ID NO: 4831100 - DNA, 13 bp, Homo sapiens
ctttgtcacttct

SEQ ID NO: 4831101 - DNA, 17 bp, Homo sapiens
ctttgtcacttctgctg

SEQ ID NO: 4831102 - DNA, 22 bp, Homo sapiens
ctttgtctcacgattccagtgc

SEQ ID NO: 4831103 - DNA, 22 bp, Homo sapiens
ctttgtgacaggaaagccctcc

SEQ ID NO: 4831104 - DNA, 21 bp, Homo sapiens
ctttgtggggcttggcgtgga

SEQ ID NO: 4831105 - DNA, 16 bp, Homo sapiens
ctttgttaaaatatag

SEQ ID NO: 4831106 - DNA, 18 bp, Homo sapiens
ctttgttcttcaatgtga

SEQ ID NO: 4831107 - DNA, 20 bp, Homo sapiens
ctttgttttgggttttcttc

SEQ ID NO: 4831108 - DNA, 22 bp, Homo sapiens
ctttgttttgggttttcttccc

SEQ ID NO: 4831109 - DNA, 14 bp, Homo sapiens
cttttaactgccgc

SEQ ID NO: 4831110 - DNA, 20 bp, Homo sapiens
cttttaagatgtgtcttcaa

SEQ ID NO: 4831111 - DNA, 11 bp, Homo sapiens
cttttaatttt

SEQ ID NO: 4831112 - DNA, 12 bp, Homo sapiens
cttttataaatg

SEQ ID NO: 4831113 - DNA, 13 bp, Homo sapiens
cttttataaatgt

SEQ ID NO: 4831114 - DNA, 14 bp, Homo sapiens
cttttataaatgtt

SEQ ID NO: 4831115 - DNA, 15 bp, Homo sapiens
cttttataaatgttt

SEQ ID NO: 4831116 - DNA, 13 bp, Homo sapiens
cttttataaatta

SEQ ID NO: 4831117 - DNA, 15 bp, Homo sapiens
cttttataaattaaa

SEQ ID NO: 4831118 - DNA, 20 bp, Homo sapiens
cttttataaattaaatatat

SEQ ID NO: 4831119 - DNA, 13 bp, Homo sapiens
cttttcaatgcaa

SEQ ID NO: 4831120 - DNA, 14 bp, Homo sapiens
cttttcaatgcaat

SEQ ID NO: 4831121 - DNA, 22 bp, Homo sapiens
cttttcatttaggtgaggaagc

SEQ ID NO: 4831122 - DNA, 17 bp, Homo sapiens
cttttcctgggtgctca

SEQ ID NO: 4831123 - DNA, 21 bp, Homo sapiens
cttttctattccttctggcct

SEQ ID NO: 4831124 - DNA, 14 bp, Homo sapiens
cttttctcatggta

SEQ ID NO: 4831125 - DNA, 16 bp, Homo sapiens
cttttctttcagccaa

SEQ ID NO: 4831126 - DNA, 17 bp, Homo sapiens
cttttctttcagccaag

SEQ ID NO: 4831127 - DNA, 17 bp, Homo sapiens
cttttctttttattagg

SEQ ID NO: 4831128 - DNA, 16 bp, Homo sapiens
cttttgaatcaatctg

SEQ ID NO: 4831129 - DNA, 21 bp, Homo sapiens
cttttgaatcaatctggcttc

SEQ ID NO: 4831130 - DNA, 15 bp, Homo sapiens
cttttgagcagtaaa

SEQ ID NO: 4831131 - DNA, 16 bp, Homo sapiens
cttttgagcatttaga

SEQ ID NO: 4831132 - DNA, 13 bp, Homo sapiens
cttttgatggcta

SEQ ID NO: 4831133 - DNA, 23 bp, Homo sapiens
cttttgcccacacttgggagcaa

SEQ ID NO: 4831134 - DNA, 23 bp, Homo sapiens
cttttgggtttgccttaattctt

SEQ ID NO: 4831135 - DNA, 22 bp, Homo sapiens
cttttggtgtttgagtgttcat

SEQ ID NO: 4831136 - DNA, 21 bp, Homo sapiens
cttttgtcctgcatcatcttg

SEQ ID NO: 4831137 - DNA, 19 bp, Homo sapiens
ctttttaggctctgagact

SEQ ID NO: 4831138 - DNA, 20 bp, Homo sapiens
ctttttattaggttaagtct

SEQ ID NO: 4831139 - DNA, 22 bp, Homo sapiens
ctttttggcattatctctttct

SEQ ID NO: 4831140 - DNA, 14 bp, Homo sapiens
cttttttcaatgta

SEQ ID NO: 4831141 - DNA, 17 bp, Homo sapiens
cttttttcctgtcaata

SEQ ID NO: 4831142 - DNA, 19 bp, Homo sapiens
cttttttcctgtcaatata

SEQ ID NO: 4831143 - DNA, 22 bp, Homo sapiens
cttttttcctgtcaatatatag

SEQ ID NO: 4831144 - DNA, 19 bp, Homo sapiens
cttttttgcaataaggatt

SEQ ID NO: 4831145 - DNA, 13 bp, Homo sapiens
ctttttttaagtg

SEQ ID NO: 4831146 - DNA, 18 bp, Homo sapiens
ctttttttctatattatt

SEQ ID NO: 4831147 - DNA, 19 bp, Homo sapiens
ctttttttctatattattg

SEQ ID NO: 4831148 - DNA, 22 bp, Homo sapiens
ctttttttgagcgacatctctg

SEQ ID NO: 4831149 - DNA, 17 bp, Homo sapiens
gaaaaaaaaatatgtgt

SEQ ID NO: 4831150 - DNA, 18 bp, Homo sapiens
gaaaaaaaaatgttcatt

SEQ ID NO: 4831151 - DNA, 11 bp, Homo sapiens
gaaaaaattag

SEQ ID NO: 4831152 - DNA, 19 bp, Homo sapiens
gaaaaagatattgtattat

SEQ ID NO: 4831153 - DNA, 15 bp, Homo sapiens
gaaaaatctgaattt

SEQ ID NO: 4831154 - DNA, 19 bp, Homo sapiens
gaaaacaggaaaaaaactt

SEQ ID NO: 4831155 - DNA, 23 bp, Homo sapiens
gaaaacaggaaaaaaacttttat

SEQ ID NO: 4831156 - DNA, 16 bp, Homo sapiens
gaaaaccatctggcct

SEQ ID NO: 4831157 - DNA, 19 bp, Homo sapiens
gaaaaccatctggcctggc

SEQ ID NO: 4831158 - DNA, 21 bp, Homo sapiens
gaaaaccatctggcctggcct

SEQ ID NO: 4831159 - DNA, 23 bp, Homo sapiens
gaaaactctcagtcagtgtcatg

SEQ ID NO: 4831160 - DNA, 23 bp, Homo sapiens
gaaaactgtttatggtattttcg

SEQ ID NO: 4831161 - DNA, 23 bp, Homo sapiens
gaaaacttctcatttatgttatt

SEQ ID NO: 4831162 - DNA, 11 bp, Homo sapiens
gaaaagaattt

SEQ ID NO: 4831163 - DNA, 22 bp, Homo sapiens
gaaaagccagatgacagggagc

SEQ ID NO: 4831164 - DNA, 20 bp, Homo sapiens
gaaaagcccacataagtttt

SEQ ID NO: 4831165 - DNA, 20 bp, Homo sapiens
gaaaaggcttgagtctggat

SEQ ID NO: 4831166 - DNA, 23 bp, Homo sapiens
gaaaaggtagcttacctgacaca

SEQ ID NO: 4831167 - DNA, 21 bp, Homo sapiens
gaaaagttttcaagcattgct

SEQ ID NO: 4831168 - DNA, 18 bp, Homo sapiens
gaaaataataaaagaatc

SEQ ID NO: 4831169 - DNA, 21 bp, Homo sapiens
gaaaatggaagacagctctta

SEQ ID NO: 4831170 - DNA, 19 bp, Homo sapiens
gaaaatggacgtgttatga

SEQ ID NO: 4831171 - DNA, 14 bp, Homo sapiens
gaaacaaaatataa

SEQ ID NO: 4831172 - DNA, 17 bp, Homo sapiens
gaaacaaaatataaatc

SEQ ID NO: 4831173 - DNA, 24 bp, Homo sapiens
gaaacaaagcatttgactttctgt

SEQ ID NO: 4831174 - DNA, 17 bp, Homo sapiens
gaaacaaatatactcat

SEQ ID NO: 4831175 - DNA, 12 bp, Homo sapiens
gaaacaaggaag

SEQ ID NO: 4831176 - DNA, 13 bp, Homo sapiens
gaaacaaggaagg

SEQ ID NO: 4831177 - DNA, 15 bp, Homo sapiens
gaaacacggagtttc

SEQ ID NO: 4831178 - DNA, 15 bp, Homo sapiens
gaaacagtttaacag

SEQ ID NO: 4831179 - DNA, 16 bp, Homo sapiens
gaaacatctgatttct

SEQ ID NO: 4831180 - DNA, 13 bp, Homo sapiens
gaaacatgacact

SEQ ID NO: 4831181 - DNA, 20 bp, Homo sapiens
gaaaccttttcttgtatctg

SEQ ID NO: 4831182 - DNA, 17 bp, Homo sapiens
gaaactttggaagtttt

SEQ ID NO: 4831183 - DNA, 13 bp, Homo sapiens
gaaacttttcaag

SEQ ID NO: 4831184 - DNA, 12 bp, Homo sapiens
gaaagacagtaa

SEQ ID NO: 4831185 - DNA, 20 bp, Homo sapiens
gaaagacgtttttgtgctgt

SEQ ID NO: 4831186 - DNA, 16 bp, Homo sapiens
gaaagagaaaatgctt

SEQ ID NO: 4831187 - DNA, 23 bp, Homo sapiens
gaaagagaaaatgctttctcatg

SEQ ID NO: 4831188 - DNA, 11 bp, Homo sapiens
gaaagaggaat

SEQ ID NO: 4831189 - DNA, 18 bp, Homo sapiens
gaaagatcccaagtcaaa

SEQ ID NO: 4831190 - DNA, 14 bp, Homo sapiens
gaaagcatattgac

SEQ ID NO: 4831191 - DNA, 21 bp, Homo sapiens
gaaagccctcccccttcccct

SEQ ID NO: 4831192 - DNA, 18 bp, Homo sapiens
gaaagcctcactgatata

SEQ ID NO: 4831193 - DNA, 14 bp, Homo sapiens
gaaaggaaaccttt

SEQ ID NO: 4831194 - DNA, 15 bp, Homo sapiens
gaaaggagagtactt

SEQ ID NO: 4831195 - DNA, 18 bp, Homo sapiens
gaaaggaggcatgcctct

SEQ ID NO: 4831196 - DNA, 14 bp, Homo sapiens
gaaaggcagggccc

SEQ ID NO: 4831197 - DNA, 19 bp, Homo sapiens
gaaaggcagggccctgaaa

SEQ ID NO: 4831198 - DNA, 20 bp, Homo sapiens
gaaagttctattatctgggt

SEQ ID NO: 4831199 - DNA, 22 bp, Homo sapiens
gaaagttctattatctgggttt

SEQ ID NO: 4831200 - DNA, 16 bp, Homo sapiens
gaaataaatctaaata

SEQ ID NO: 4831201 - DNA, 15 bp, Homo sapiens
gaaatagtgttcttt

SEQ ID NO: 4831202 - DNA, 21 bp, Homo sapiens
gaaatagtgttctttttaaaa

SEQ ID NO: 4831203 - DNA, 20 bp, Homo sapiens
gaaatagttccattctatga

SEQ ID NO: 4831204 - DNA, 18 bp, Homo sapiens
gaaatataaactgtgaga

SEQ ID NO: 4831205 - DNA, 15 bp, Homo sapiens
gaaatatcatcacgt

SEQ ID NO: 4831206 - DNA, 15 bp, Homo sapiens
gaaatatctgtgaaa

SEQ ID NO: 4831207 - DNA, 16 bp, Homo sapiens
gaaatatctgtgaaat

SEQ ID NO: 4831208 - DNA, 15 bp, Homo sapiens
gaaatatttgcttat

SEQ ID NO: 4831209 - DNA, 18 bp, Homo sapiens
gaaatatttgcttattta

SEQ ID NO: 4831210 - DNA, 19 bp, Homo sapiens
gaaatcaatttaaaggaaa

SEQ ID NO: 4831211 - DNA, 16 bp, Homo sapiens
gaaatccaactccagg

SEQ ID NO: 4831212 - DNA, 14 bp, Homo sapiens
gaaatcctgttact

SEQ ID NO: 4831213 - DNA, 14 bp, Homo sapiens
gaaatctgaagcct

SEQ ID NO: 4831214 - DNA, 20 bp, Homo sapiens
gaaatctgaagccttttcct

SEQ ID NO: 4831215 - DNA, 12 bp, Homo sapiens
gaaatgagaaat

SEQ ID NO: 4831216 - DNA, 11 bp, Homo sapiens
gaaatgagctg

SEQ ID NO: 4831217 - DNA, 21 bp, Homo sapiens
gaaatgccaagactctatgct

SEQ ID NO: 4831218 - DNA, 14 bp, Homo sapiens
gaaatgctgttggt

SEQ ID NO: 4831219 - DNA, 18 bp, Homo sapiens
gaaatgctgttggtgaga

SEQ ID NO: 4831220 - DNA, 18 bp, Homo sapiens
gaaatggatagattgttt

SEQ ID NO: 4831221 - DNA, 16 bp, Homo sapiens
gaaatgtggatgctct

SEQ ID NO: 4831222 - DNA, 22 bp, Homo sapiens
gaaattagtgttttcattctgg

SEQ ID NO: 4831223 - DNA, 23 bp, Homo sapiens
gaaattagtgttttcattctggt

SEQ ID NO: 4831224 - DNA, 13 bp, Homo sapiens
gaaattatatctg

SEQ ID NO: 4831225 - DNA, 16 bp, Homo sapiens
gaaattctataagaga

SEQ ID NO: 4831226 - DNA, 19 bp, Homo sapiens
gaaattctataagagacaa

SEQ ID NO: 4831227 - DNA, 16 bp, Homo sapiens
gaaattttatctcttc

SEQ ID NO: 4831228 - DNA, 16 bp, Homo sapiens
gaacaaaaccccagaa

SEQ ID NO: 4831229 - DNA, 23 bp, Homo sapiens
gaacaacaacaaagcatgctcag

SEQ ID NO: 4831230 - DNA, 14 bp, Homo sapiens
gaacaaggcaaggc

SEQ ID NO: 4831231 - DNA, 15 bp, Homo sapiens
gaacaaggcaaggct

SEQ ID NO: 4831232 - DNA, 18 bp, Homo sapiens
gaacaccaagtaaatcta

SEQ ID NO: 4831233 - DNA, 20 bp, Homo sapiens
gaacaccactttgtctctga

SEQ ID NO: 4831234 - DNA, 17 bp, Homo sapiens
gaacactgcaccctcca

SEQ ID NO: 4831235 - DNA, 17 bp, Homo sapiens
gaacaggagtgactctg

SEQ ID NO: 4831236 - DNA, 22 bp, Homo sapiens
gaacaggagtgactctggctgc

SEQ ID NO: 4831237 - DNA, 18 bp, Homo sapiens
gaacataaaccctccaag

SEQ ID NO: 4831238 - DNA, 23 bp, Homo sapiens
gaacatggccaatagtcatatgt

SEQ ID NO: 4831239 - DNA, 18 bp, Homo sapiens
gaaccaacgggtctgtgg

SEQ ID NO: 4831240 - DNA, 21 bp, Homo sapiens
gaaccaacgggtctgtgggac

SEQ ID NO: 4831241 - DNA, 22 bp, Homo sapiens
gaaccagagcgatgtgttcttt

SEQ ID NO: 4831242 - DNA, 16 bp, Homo sapiens
gaaccagcactcccag

SEQ ID NO: 4831243 - DNA, 19 bp, Homo sapiens
gaaccagcactcccagggc

SEQ ID NO: 4831244 - DNA, 23 bp, Homo sapiens
gaacccatcactgtgtctcatgg

SEQ ID NO: 4831245 - DNA, 20 bp, Homo sapiens
gaacccatggaaaaatgcca

SEQ ID NO: 4831246 - DNA, 14 bp, Homo sapiens
gaacccccctcccc

SEQ ID NO: 4831247 - DNA, 15 bp, Homo sapiens
gaacccccctcccca

SEQ ID NO: 4831248 - DNA, 16 bp, Homo sapiens
gaacccccctccccaa

SEQ ID NO: 4831249 - DNA, 18 bp, Homo sapiens
gaaccgaggactccaggg

SEQ ID NO: 4831250 - DNA, 14 bp, Homo sapiens
gaacctctgattta

SEQ ID NO: 4831251 - DNA, 16 bp, Homo sapiens
gaacctgatacctgcc

SEQ ID NO: 4831252 - DNA, 21 bp, Homo sapiens
gaacctgatacctgcctggga

SEQ ID NO: 4831253 - DNA, 22 bp, Homo sapiens
gaacctgatacctgcctgggac

SEQ ID NO: 4831254 - DNA, 16 bp, Homo sapiens
gaacctgctcttcatt

SEQ ID NO: 4831255 - DNA, 13 bp, Homo sapiens
gaacctttgtcaa

SEQ ID NO: 4831256 - DNA, 14 bp, Homo sapiens
gaacgcatgcaggg

SEQ ID NO: 4831257 - DNA, 17 bp, Homo sapiens
gaacgcatgcagggccc

SEQ ID NO: 4831258 - DNA, 23 bp, Homo sapiens
gaactatttgaaacacacagtga

SEQ ID NO: 4831259 - DNA, 20 bp, Homo sapiens
gaactcagctgtctgtggct

SEQ ID NO: 4831260 - DNA, 19 bp, Homo sapiens
gaactcccccagaggtgga

SEQ ID NO: 4831261 - DNA, 20 bp, Homo sapiens
gaactccttggcctagccca

SEQ ID NO: 4831262 - DNA, 15 bp, Homo sapiens
gaactcgctcagaag

SEQ ID NO: 4831263 - DNA, 17 bp, Homo sapiens
gaactcgggattacaga

SEQ ID NO: 4831264 - DNA, 21 bp, Homo sapiens
gaactctatctgggcctgggc

SEQ ID NO: 4831265 - DNA, 11 bp, Homo sapiens
gaactctgaca

SEQ ID NO: 4831266 - DNA, 14 bp, Homo sapiens
gaactctgacaagg

SEQ ID NO: 4831267 - DNA, 17 bp, Homo sapiens
gaactctgacaagggct

SEQ ID NO: 4831268 - DNA, 16 bp, Homo sapiens
gaactgcaacactgga

SEQ ID NO: 4831269 - DNA, 16 bp, Homo sapiens
gaactggccccagctc

SEQ ID NO: 4831270 - DNA, 23 bp, Homo sapiens
gaactggtttttctgttccctgc

SEQ ID NO: 4831271 - DNA, 11 bp, Homo sapiens
gaactgtgaat

SEQ ID NO: 4831272 - DNA, 15 bp, Homo sapiens
gaactgtgaatatgt

SEQ ID NO: 4831273 - DNA, 16 bp, Homo sapiens
gaacttcatgcttgat

SEQ ID NO: 4831274 - DNA, 16 bp, Homo sapiens
gaagaaacatttatct

SEQ ID NO: 4831275 - DNA, 16 bp, Homo sapiens
gaagaaagaacggaag

SEQ ID NO: 4831276 - DNA, 12 bp, Homo sapiens
gaagaaagcctg

SEQ ID NO: 4831277 - DNA, 14 bp, Homo sapiens
gaagaaatatgagc

SEQ ID NO: 4831278 - DNA, 19 bp, Homo sapiens
gaagaactcaccagggttt

SEQ ID NO: 4831279 - DNA, 18 bp, Homo sapiens
gaagaaggactgaagaaa

SEQ ID NO: 4831280 - DNA, 17 bp, Homo sapiens
gaagaaggcccgggagg

SEQ ID NO: 4831281 - DNA, 18 bp, Homo sapiens
gaagaaggcccgggagga

SEQ ID NO: 4831282 - DNA, 13 bp, Homo sapiens
gaagaatataaat

SEQ ID NO: 4831283 - DNA, 14 bp, Homo sapiens
gaagaatattgtta

SEQ ID NO: 4831284 - DNA, 17 bp, Homo sapiens
gaagacagagatggcag

SEQ ID NO: 4831285 - DNA, 19 bp, Homo sapiens
gaagacagagatggcagag

SEQ ID NO: 4831286 - DNA, 13 bp, Homo sapiens
gaagacagagcta

SEQ ID NO: 4831287 - DNA, 12 bp, Homo sapiens
gaagacagctct

SEQ ID NO: 4831288 - DNA, 15 bp, Homo sapiens
gaagacagctcttat

SEQ ID NO: 4831289 - DNA, 16 bp, Homo sapiens
gaagacttcatccctc

SEQ ID NO: 4831290 - DNA, 21 bp, Homo sapiens
gaagacttccagctttctctt

SEQ ID NO: 4831291 - DNA, 18 bp, Homo sapiens
gaagagagatatatctga

SEQ ID NO: 4831292 - DNA, 16 bp, Homo sapiens
gaagagatcaggaaga

SEQ ID NO: 4831293 - DNA, 14 bp, Homo sapiens
gaagagatgctcta

SEQ ID NO: 4831294 - DNA, 18 bp, Homo sapiens
gaagagggaggggccctg

SEQ ID NO: 4831295 - DNA, 14 bp, Homo sapiens
gaagagtatggatt

SEQ ID NO: 4831296 - DNA, 13 bp, Homo sapiens
gaagatgccaagg

SEQ ID NO: 4831297 - DNA, 15 bp, Homo sapiens
gaagcaaataaatat

SEQ ID NO: 4831298 - DNA, 14 bp, Homo sapiens
gaagcacatgcctc

SEQ ID NO: 4831299 - DNA, 18 bp, Homo sapiens
gaagcagtttcagataaa

SEQ ID NO: 4831300 - DNA, 14 bp, Homo sapiens
gaagcatccaagga

SEQ ID NO: 4831301 - DNA, 15 bp, Homo sapiens
gaagccacgctgtcc

SEQ ID NO: 4831302 - DNA, 18 bp, Homo sapiens
gaagccacgctgtcctct

SEQ ID NO: 4831303 - DNA, 19 bp, Homo sapiens
gaagccacgctgtcctctc

SEQ ID NO: 4831304 - DNA, 21 bp, Homo sapiens
gaagccagcaggctctcaggc

SEQ ID NO: 4831305 - DNA, 22 bp, Homo sapiens
gaagccagcaggctctcaggcc

SEQ ID NO: 4831306 - DNA, 22 bp, Homo sapiens
gaagccataacgttagactgca

SEQ ID NO: 4831307 - DNA, 16 bp, Homo sapiens
gaagcccacccgcccc

SEQ ID NO: 4831308 - DNA, 17 bp, Homo sapiens
gaagcccacccgcccca

SEQ ID NO: 4831309 - DNA, 18 bp, Homo sapiens
gaagcccacccgccccag

SEQ ID NO: 4831310 - DNA, 19 bp, Homo sapiens
gaagcccacccgccccaga

SEQ ID NO: 4831311 - DNA, 20 bp, Homo sapiens
gaagcccacccgccccagag

SEQ ID NO: 4831312 - DNA, 14 bp, Homo sapiens
gaagcccaggagga

SEQ ID NO: 4831313 - DNA, 20 bp, Homo sapiens
gaagcccaggaggacctggg

SEQ ID NO: 4831314 - DNA, 19 bp, Homo sapiens
gaagccctaagtaaatcta

SEQ ID NO: 4831315 - DNA, 23 bp, Homo sapiens
gaagcccttctaccttcctgcaa

SEQ ID NO: 4831316 - DNA, 14 bp, Homo sapiens
gaagcctttatcta

SEQ ID NO: 4831317 - DNA, 15 bp, Homo sapiens
gaagctcaaggctgc

SEQ ID NO: 4831318 - DNA, 18 bp, Homo sapiens
gaagctcaaggctgcagt

SEQ ID NO: 4831319 - DNA, 18 bp, Homo sapiens
gaagctgatacagagaga

SEQ ID NO: 4831320 - DNA, 19 bp, Homo sapiens
gaaggaagacttcatccct

SEQ ID NO: 4831321 - DNA, 19 bp, Homo sapiens
gaaggaaggcagggaggag

SEQ ID NO: 4831322 - DNA, 20 bp, Homo sapiens
gaaggaaggcagggaggagg

SEQ ID NO: 4831323 - DNA, 20 bp, Homo sapiens
gaaggaatgcaataaagagt

SEQ ID NO: 4831324 - DNA, 14 bp, Homo sapiens
gaaggactgaagaa

SEQ ID NO: 4831325 - DNA, 15 bp, Homo sapiens
gaaggactgaagaaa

SEQ ID NO: 4831326 - DNA, 14 bp, Homo sapiens
gaaggaggggaagc

SEQ ID NO: 4831327 - DNA, 20 bp, Homo sapiens
gaaggaggggaagctgcagc

SEQ ID NO: 4831328 - DNA, 15 bp, Homo sapiens
gaaggcacccgccct

SEQ ID NO: 4831329 - DNA, 21 bp, Homo sapiens
gaaggcacccgccctttcctt

SEQ ID NO: 4831330 - DNA, 20 bp, Homo sapiens
gaaggcagggaggaggcaga

SEQ ID NO: 4831331 - DNA, 14 bp, Homo sapiens
gaaggcctgaggga

SEQ ID NO: 4831332 - DNA, 23 bp, Homo sapiens
gaaggcctgagggaagcccaccc

SEQ ID NO: 4831333 - DNA, 15 bp, Homo sapiens
gaaggcctgcccccc

SEQ ID NO: 4831334 - DNA, 16 bp, Homo sapiens
gaaggcctgcccccct

SEQ ID NO: 4831335 - DNA, 15 bp, Homo sapiens
gaaggccttgttaaa

SEQ ID NO: 4831336 - DNA, 11 bp, Homo sapiens
gaagggaaatt

SEQ ID NO: 4831337 - DNA, 13 bp, Homo sapiens
gaagggcagcccc

SEQ ID NO: 4831338 - DNA, 19 bp, Homo sapiens
gaagggcgctgagggcagg

SEQ ID NO: 4831339 - DNA, 20 bp, Homo sapiens
gaagggcgctgagggcaggg

SEQ ID NO: 4831340 - DNA, 13 bp, Homo sapiens
gaaggggcctggg

SEQ ID NO: 4831341 - DNA, 12 bp, Homo sapiens
gaaggggctggt

SEQ ID NO: 4831342 - DNA, 14 bp, Homo sapiens
gaaggggctggtgg

SEQ ID NO: 4831343 - DNA, 18 bp, Homo sapiens
gaaggtcacgctgaatga

SEQ ID NO: 4831344 - DNA, 14 bp, Homo sapiens
gaaggtgatggggg

SEQ ID NO: 4831345 - DNA, 14 bp, Homo sapiens
gaagtaaattattt

SEQ ID NO: 4831346 - DNA, 14 bp, Homo sapiens
gaagtaattttctt

SEQ ID NO: 4831347 - DNA, 19 bp, Homo sapiens
gaagtaattttcttctcat

SEQ ID NO: 4831348 - DNA, 20 bp, Homo sapiens
gaagtaattttcttctcatt

SEQ ID NO: 4831349 - DNA, 15 bp, Homo sapiens
gaagtactggagaaa

SEQ ID NO: 4831350 - DNA, 15 bp, Homo sapiens
gaagtagtgtgagtg

SEQ ID NO: 4831351 - DNA, 22 bp, Homo sapiens
gaagtagtgtgagtgttagaaa

SEQ ID NO: 4831352 - DNA, 21 bp, Homo sapiens
gaagtatagatggtagaaact

SEQ ID NO: 4831353 - DNA, 19 bp, Homo sapiens
gaagtatccctgatttatt

SEQ ID NO: 4831354 - DNA, 16 bp, Homo sapiens
gaagtcaggagccagc

SEQ ID NO: 4831355 - DNA, 18 bp, Homo sapiens
gaagtcaggagccagcag

SEQ ID NO: 4831356 - DNA, 20 bp, Homo sapiens
gaagtcaggagccagcaggg

SEQ ID NO: 4831357 - DNA, 14 bp, Homo sapiens
gaagtcccttcctg

SEQ ID NO: 4831358 - DNA, 17 bp, Homo sapiens
gaagtcccttcctgtcc

SEQ ID NO: 4831359 - DNA, 19 bp, Homo sapiens
gaagtcccttcctgtcctg

SEQ ID NO: 4831360 - DNA, 15 bp, Homo sapiens
gaagtccgaggcctg

SEQ ID NO: 4831361 - DNA, 23 bp, Homo sapiens
gaagtccgaggcctggctctgga

SEQ ID NO: 4831362 - DNA, 15 bp, Homo sapiens
gaagtgaccaaggtg

SEQ ID NO: 4831363 - DNA, 16 bp, Homo sapiens
gaagtgagaaaatgaa

SEQ ID NO: 4831364 - DNA, 18 bp, Homo sapiens
gaagtgcatgttaaaata

SEQ ID NO: 4831365 - DNA, 15 bp, Homo sapiens
gaagtggcctgagaa

SEQ ID NO: 4831366 - DNA, 19 bp, Homo sapiens
gaagtgggattcaggaatg

SEQ ID NO: 4831367 - DNA, 20 bp, Homo sapiens
gaagtgggattcaggaatgg

SEQ ID NO: 4831368 - DNA, 21 bp, Homo sapiens
gaagtgggattcaggaatggg

SEQ ID NO: 4831369 - DNA, 18 bp, Homo sapiens
gaagtggtaggaaagcct

SEQ ID NO: 4831370 - DNA, 12 bp, Homo sapiens
gaagtgtgttct

SEQ ID NO: 4831371 - DNA, 13 bp, Homo sapiens
gaagttggacagc

SEQ ID NO: 4831372 - DNA, 23 bp, Homo sapiens
gaagttggacagcaaaaccattg

SEQ ID NO: 4831373 - DNA, 21 bp, Homo sapiens
gaagtttaaatctttgttaaa

SEQ ID NO: 4831374 - DNA, 12 bp, Homo sapiens
gaagtttctgcc

SEQ ID NO: 4831375 - DNA, 21 bp, Homo sapiens
gaagtttctgccgcagccctg

SEQ ID NO: 4831376 - DNA, 15 bp, Homo sapiens
gaataaaccggatcc

SEQ ID NO: 4831377 - DNA, 16 bp, Homo sapiens
gaataaaccggatcct

SEQ ID NO: 4831378 - DNA, 18 bp, Homo sapiens
gaataaaccggatcctgt

SEQ ID NO: 4831379 - DNA, 20 bp, Homo sapiens
gaataaaccggatcctgttg

SEQ ID NO: 4831380 - DNA, 21 bp, Homo sapiens
gaataatgtgggaagaaacaa

SEQ ID NO: 4831381 - DNA, 15 bp, Homo sapiens
gaatactaataaaat

SEQ ID NO: 4831382 - DNA, 20 bp, Homo sapiens
gaatactaataaaatacata

SEQ ID NO: 4831383 - DNA, 24 bp, Homo sapiens
gaatactgtattgttacagctgaa

SEQ ID NO: 4831384 - DNA, 15 bp, Homo sapiens
gaatacttcctgaaa

SEQ ID NO: 4831385 - DNA, 19 bp, Homo sapiens
gaatacttcctgaaataaa

SEQ ID NO: 4831386 - DNA, 23 bp, Homo sapiens
gaatacttcctgaaataaaactg

SEQ ID NO: 4831387 - DNA, 11 bp, Homo sapiens
gaatataaatg

SEQ ID NO: 4831388 - DNA, 20 bp, Homo sapiens
gaatataaatgtactacatt

SEQ ID NO: 4831389 - DNA, 19 bp, Homo sapiens
gaatataatggcctcttaa

SEQ ID NO: 4831390 - DNA, 15 bp, Homo sapiens
gaatattaaaaatta

SEQ ID NO: 4831391 - DNA, 14 bp, Homo sapiens
gaatattgttaaaa

SEQ ID NO: 4831392 - DNA, 17 bp, Homo sapiens
gaatcaatctggcttct

SEQ ID NO: 4831393 - DNA, 23 bp, Homo sapiens
gaatcaatctggcttctgcatta

SEQ ID NO: 4831394 - DNA, 18 bp, Homo sapiens
gaatcacctaattaattt

SEQ ID NO: 4831395 - DNA, 21 bp, Homo sapiens
gaatcactcatttatttccat

SEQ ID NO: 4831396 - DNA, 23 bp, Homo sapiens
gaatcaggattccttcttcccca

SEQ ID NO: 4831397 - DNA, 20 bp, Homo sapiens
gaatcagtcctagaatgttt

SEQ ID NO: 4831398 - DNA, 18 bp, Homo sapiens
gaatccatatcagctctg

SEQ ID NO: 4831399 - DNA, 18 bp, Homo sapiens
gaatccctgttcattgta

SEQ ID NO: 4831400 - DNA, 19 bp, Homo sapiens
gaatcctgccacacatgct

SEQ ID NO: 4831401 - DNA, 13 bp, Homo sapiens
gaatcctttgtac

SEQ ID NO: 4831402 - DNA, 12 bp, Homo sapiens
gaatctcagcac

SEQ ID NO: 4831403 - DNA, 19 bp, Homo sapiens
gaatctctcaaaatgtgcc

SEQ ID NO: 4831404 - DNA, 20 bp, Homo sapiens
gaatgaaatataaactgtga

SEQ ID NO: 4831405 - DNA, 14 bp, Homo sapiens
gaatgaatgtcagt

SEQ ID NO: 4831406 - DNA, 22 bp, Homo sapiens
gaatgacatcaacattccccca

SEQ ID NO: 4831407 - DNA, 15 bp, Homo sapiens
gaatgcaaaaagata

SEQ ID NO: 4831408 - DNA, 16 bp, Homo sapiens
gaatgcaataaagagt

SEQ ID NO: 4831409 - DNA, 18 bp, Homo sapiens
gaatgcacaaacagaggc

SEQ ID NO: 4831410 - DNA, 19 bp, Homo sapiens
gaatgcacaaacagaggcc

SEQ ID NO: 4831411 - DNA, 20 bp, Homo sapiens
gaatgcacaaacagaggccg

SEQ ID NO: 4831412 - DNA, 21 bp, Homo sapiens
gaatgcacaaacagaggccgc

SEQ ID NO: 4831413 - DNA, 19 bp, Homo sapiens
gaatgcccaggaagtaatt

SEQ ID NO: 4831414 - DNA, 21 bp, Homo sapiens
gaatgcgctcttcaccaggaa

SEQ ID NO: 4831415 - DNA, 22 bp, Homo sapiens
gaatgcgctcttcaccaggaag

SEQ ID NO: 4831416 - DNA, 23 bp, Homo sapiens
gaatgcgctcttcaccaggaaga

SEQ ID NO: 4831417 - DNA, 22 bp, Homo sapiens
gaatgctgcgcttaccttccca

SEQ ID NO: 4831418 - DNA, 11 bp, Homo sapiens
gaatggggctt

SEQ ID NO: 4831419 - DNA, 17 bp, Homo sapiens
gaatggggcttccatgg

SEQ ID NO: 4831420 - DNA, 22 bp, Homo sapiens
gaatggggtgggagccacaggg

SEQ ID NO: 4831421 - DNA, 13 bp, Homo sapiens
gaatggttgcaaa

SEQ ID NO: 4831422 - DNA, 17 bp, Homo sapiens
gaatgtcatttgctaat

SEQ ID NO: 4831423 - DNA, 13 bp, Homo sapiens
gaatgttgcatga

SEQ ID NO: 4831424 - DNA, 12 bp, Homo sapiens
gaattaaagtct

SEQ ID NO: 4831425 - DNA, 14 bp, Homo sapiens
gaattacataacag

SEQ ID NO: 4831426 - DNA, 15 bp, Homo sapiens
gaattacataacagg

SEQ ID NO: 4831427 - DNA, 18 bp, Homo sapiens
gaattaccatttgttaat

SEQ ID NO: 4831428 - DNA, 12 bp, Homo sapiens
gaattactgttt

SEQ ID NO: 4831429 - DNA, 24 bp, Homo sapiens
gaattactgtttgaaacttttcaa

SEQ ID NO: 4831430 - DNA, 13 bp, Homo sapiens
gaattagaagaaa

SEQ ID NO: 4831431 - DNA, 20 bp, Homo sapiens
gaattattagcaccagcttg

SEQ ID NO: 4831432 - DNA, 14 bp, Homo sapiens
gaattcacccctcc

SEQ ID NO: 4831433 - DNA, 15 bp, Homo sapiens
gaattcacccctccc

SEQ ID NO: 4831434 - DNA, 23 bp, Homo sapiens
gaattccacctggaaagccaggt

SEQ ID NO: 4831435 - DNA, 18 bp, Homo sapiens
gaattctaagattgtaca

SEQ ID NO: 4831436 - DNA, 15 bp, Homo sapiens
gaattgccagtcttt

SEQ ID NO: 4831437 - DNA, 16 bp, Homo sapiens
gaattggcagaagcag

SEQ ID NO: 4831438 - DNA, 19 bp, Homo sapiens
gaattgtgtggagaagtgt

SEQ ID NO: 4831439 - DNA, 14 bp, Homo sapiens
gaatttgaagaatt

SEQ ID NO: 4831440 - DNA, 19 bp, Homo sapiens
gaatttgaagaattaatga

SEQ ID NO: 4831441 - DNA, 21 bp, Homo sapiens
gaatttggggctacttatatt

SEQ ID NO: 4831442 - DNA, 12 bp, Homo sapiens
gacaaagaaaat

SEQ ID NO: 4831443 - DNA, 18 bp, Homo sapiens
gacaaagaaaatgagaat

SEQ ID NO: 4831444 - DNA, 17 bp, Homo sapiens
gacaaatatttctttct

SEQ ID NO: 4831445 - DNA, 12 bp, Homo sapiens
gacaacacacac

SEQ ID NO: 4831446 - DNA, 19 bp, Homo sapiens
gacaacgaacatggcatgt

SEQ ID NO: 4831447 - DNA, 23 bp, Homo sapiens
gacaacgaacatggcatgtgaaa

SEQ ID NO: 4831448 - DNA, 16 bp, Homo sapiens
gacaacttgctccttt

SEQ ID NO: 4831449 - DNA, 15 bp, Homo sapiens
gacaagggctgacct

SEQ ID NO: 4831450 - DNA, 22 bp, Homo sapiens
gacaagggctgacctgcctctc

SEQ ID NO: 4831451 - DNA, 16 bp, Homo sapiens
gacaaggggtggaagg

SEQ ID NO: 4831452 - DNA, 22 bp, Homo sapiens
gacaaggggtggaagggcagga

SEQ ID NO: 4831453 - DNA, 17 bp, Homo sapiens
gacaataagaaacagtt

SEQ ID NO: 4831454 - DNA, 21 bp, Homo sapiens
gacaataagaaacagtttaac

SEQ ID NO: 4831455 - DNA, 18 bp, Homo sapiens
gacaatgacactggaagg

SEQ ID NO: 4831456 - DNA, 18 bp, Homo sapiens
gacaatgtggaattacat

SEQ ID NO: 4831457 - DNA, 23 bp, Homo sapiens
gacaatgtggaattacataacag

SEQ ID NO: 4831458 - DNA, 14 bp, Homo sapiens
gacacaactcatcc

SEQ ID NO: 4831459 - DNA, 16 bp, Homo sapiens
gacacactcaccattt

SEQ ID NO: 4831460 - DNA, 16 bp, Homo sapiens
gacacagcccagagac

SEQ ID NO: 4831461 - DNA, 19 bp, Homo sapiens
gacacagctgagctggcct

SEQ ID NO: 4831462 - DNA, 19 bp, Homo sapiens
gacacaggatcctggcctg

SEQ ID NO: 4831463 - DNA, 14 bp, Homo sapiens
gacacaggctgccg

SEQ ID NO: 4831464 - DNA, 16 bp, Homo sapiens
gacacaggctgccgct

SEQ ID NO: 4831465 - DNA, 16 bp, Homo sapiens
gacacagtcaggggcc

SEQ ID NO: 4831466 - DNA, 16 bp, Homo sapiens
gacacagttttgtctt

SEQ ID NO: 4831467 - DNA, 16 bp, Homo sapiens
gacaccaccactgtgt

SEQ ID NO: 4831468 - DNA, 19 bp, Homo sapiens
gacaccaccactgtgtccc

SEQ ID NO: 4831469 - DNA, 12 bp, Homo sapiens
gacaccttccca

SEQ ID NO: 4831470 - DNA, 14 bp, Homo sapiens
gacactacaaacat

SEQ ID NO: 4831471 - DNA, 21 bp, Homo sapiens
gacactgatgggtcctgctgc

SEQ ID NO: 4831472 - DNA, 22 bp, Homo sapiens
gacactgatgggtcctgctgct

SEQ ID NO: 4831473 - DNA, 14 bp, Homo sapiens
gacactgtctgctg

SEQ ID NO: 4831474 - DNA, 17 bp, Homo sapiens
gacacttttcatatcat

SEQ ID NO: 4831475 - DNA, 21 bp, Homo sapiens
gacacttttcatatcatttct

SEQ ID NO: 4831476 - DNA, 14 bp, Homo sapiens
gacagacagacaga

SEQ ID NO: 4831477 - DNA, 12 bp, Homo sapiens
gacagacagacg

SEQ ID NO: 4831478 - DNA, 18 bp, Homo sapiens
gacagacggacgggacag

SEQ ID NO: 4831479 - DNA, 19 bp, Homo sapiens
gacagacggacgggacagc

SEQ ID NO: 4831480 - DNA, 17 bp, Homo sapiens
gacagagatggcagagc

SEQ ID NO: 4831481 - DNA, 13 bp, Homo sapiens
gacagagtggatc

SEQ ID NO: 4831482 - DNA, 18 bp, Homo sapiens
gacagagtggatctggag

SEQ ID NO: 4831483 - DNA, 21 bp, Homo sapiens
gacagagtggatctggagtct

SEQ ID NO: 4831484 - DNA, 22 bp, Homo sapiens
gacagatgggtgtcccctggtg

SEQ ID NO: 4831485 - DNA, 19 bp, Homo sapiens
gacagcctccaccttgagc

SEQ ID NO: 4831486 - DNA, 14 bp, Homo sapiens
gacagcggcccggc

SEQ ID NO: 4831487 - DNA, 16 bp, Homo sapiens
gacagcggcccggccc

SEQ ID NO: 4831488 - DNA, 17 bp, Homo sapiens
gacagcggcccggccca

SEQ ID NO: 4831489 - DNA, 15 bp, Homo sapiens
gacaggaaagccctc

SEQ ID NO: 4831490 - DNA, 19 bp, Homo sapiens
gacaggaaagccctccccc

SEQ ID NO: 4831491 - DNA, 22 bp, Homo sapiens
gacaggatgttcaacttaatga

SEQ ID NO: 4831492 - DNA, 24 bp, Homo sapiens
gacaggattgtctgctgcctccaa

SEQ ID NO: 4831493 - DNA, 15 bp, Homo sapiens
gacaggcgccgcctc

SEQ ID NO: 4831494 - DNA, 16 bp, Homo sapiens
gacaggcgccgcctcg

SEQ ID NO: 4831495 - DNA, 13 bp, Homo sapiens
gacagggagggaa

SEQ ID NO: 4831496 - DNA, 20 bp, Homo sapiens
gacagggcccccacagggga

SEQ ID NO: 4831497 - DNA, 12 bp, Homo sapiens
gacagggtgggg

SEQ ID NO: 4831498 - DNA, 18 bp, Homo sapiens
gacagtggttatatttca

SEQ ID NO: 4831499 - DNA, 19 bp, Homo sapiens
gacagttagacccctgggt

SEQ ID NO: 4831500 - DNA, 12 bp, Homo sapiens
gacatacgaaac

SEQ ID NO: 4831501 - DNA, 13 bp, Homo sapiens
gacatctctgtaa

SEQ ID NO: 4831502 - DNA, 22 bp, Homo sapiens
gacatgaacgttttctcttcac

SEQ ID NO: 4831503 - DNA, 21 bp, Homo sapiens
gacatgctaacctctctgaac

SEQ ID NO: 4831504 - DNA, 13 bp, Homo sapiens
gacattaaataat

SEQ ID NO: 4831505 - DNA, 13 bp, Homo sapiens
gacattgtcagaa

SEQ ID NO: 4831506 - DNA, 17 bp, Homo sapiens
gacattgtcagaatgtt

SEQ ID NO: 4831507 - DNA, 18 bp, Homo sapiens
gacattgtcagaatgttg

SEQ ID NO: 4831508 - DNA, 13 bp, Homo sapiens
gacattttgtagc

SEQ ID NO: 4831509 - DNA, 15 bp, Homo sapiens
gacattttgtagcta

SEQ ID NO: 4831510 - DNA, 22 bp, Homo sapiens
gacattttgtagctagtttaaa

SEQ ID NO: 4831511 - DNA, 15 bp, Homo sapiens
gaccaaggagatggg

SEQ ID NO: 4831512 - DNA, 14 bp, Homo sapiens
gaccaagtctctct

SEQ ID NO: 4831513 - DNA, 22 bp, Homo sapiens
gaccacatgcgctcctggcttt

SEQ ID NO: 4831514 - DNA, 15 bp, Homo sapiens
gaccacccctgtgcg

SEQ ID NO: 4831515 - DNA, 16 bp, Homo sapiens
gaccaccctgccaagg

SEQ ID NO: 4831516 - DNA, 16 bp, Homo sapiens
gaccaccgcgcccctc

SEQ ID NO: 4831517 - DNA, 18 bp, Homo sapiens
gaccaccgcgcccctctg

SEQ ID NO: 4831518 - DNA, 24 bp, Homo sapiens
gaccaccgcgcccctctgcgcccc

SEQ ID NO: 4831519 - DNA, 15 bp, Homo sapiens
gaccacgcccctgcc

SEQ ID NO: 4831520 - DNA, 16 bp, Homo sapiens
gaccacgtctccctgg

SEQ ID NO: 4831521 - DNA, 21 bp, Homo sapiens
gaccacgtctccctggcccca

SEQ ID NO: 4831522 - DNA, 22 bp, Homo sapiens
gaccacgtctccctggccccag

SEQ ID NO: 4831523 - DNA, 23 bp, Homo sapiens
gaccacgtctccctggccccagt

SEQ ID NO: 4831524 - DNA, 14 bp, Homo sapiens
gaccactgggcctg

SEQ ID NO: 4831525 - DNA, 17 bp, Homo sapiens
gaccactgggcctgcta

SEQ ID NO: 4831526 - DNA, 14 bp, Homo sapiens
gaccacttccttaa

SEQ ID NO: 4831527 - DNA, 15 bp, Homo sapiens
gaccacttccttaac

SEQ ID NO: 4831528 - DNA, 19 bp, Homo sapiens
gaccacttccttaacagct

SEQ ID NO: 4831529 - DNA, 11 bp, Homo sapiens
gaccagagctg

SEQ ID NO: 4831530 - DNA, 19 bp, Homo sapiens
gaccagcataccagttctt

SEQ ID NO: 4831531 - DNA, 11 bp, Homo sapiens
gaccagcatag

SEQ ID NO: 4831532 - DNA, 20 bp, Homo sapiens
gaccagttccctcagccctc

SEQ ID NO: 4831533 - DNA, 19 bp, Homo sapiens
gaccatttagtcctcacct

SEQ ID NO: 4831534 - DNA, 20 bp, Homo sapiens
gaccccaccctgtctgcagg

SEQ ID NO: 4831535 - DNA, 14 bp, Homo sapiens
gaccccattctggg

SEQ ID NO: 4831536 - DNA, 16 bp, Homo sapiens
gaccccattctgggac

SEQ ID NO: 4831537 - DNA, 19 bp, Homo sapiens
gaccccattctgggactgc

SEQ ID NO: 4831538 - DNA, 15 bp, Homo sapiens
gacccctaccctttc

SEQ ID NO: 4831539 - DNA, 18 bp, Homo sapiens
gacccctaccctttccca

SEQ ID NO: 4831540 - DNA, 17 bp, Homo sapiens
gacccctgccctcggcc

SEQ ID NO: 4831541 - DNA, 13 bp, Homo sapiens
gacccctggggga

SEQ ID NO: 4831542 - DNA, 14 bp, Homo sapiens
gacccctgggggag

SEQ ID NO: 4831543 - DNA, 18 bp, Homo sapiens
gacccctgggggaggctt

SEQ ID NO: 4831544 - DNA, 21 bp, Homo sapiens
gacccctgggtgggccctgcc

SEQ ID NO: 4831545 - DNA, 17 bp, Homo sapiens
gacccgacactctcacc

SEQ ID NO: 4831546 - DNA, 21 bp, Homo sapiens
gacccgacactctcacccccc

SEQ ID NO: 4831547 - DNA, 12 bp, Homo sapiens
gaccctcacctg

SEQ ID NO: 4831548 - DNA, 13 bp, Homo sapiens
gaccctcccaggt

SEQ ID NO: 4831549 - DNA, 22 bp, Homo sapiens
gaccctgccaactttccagact

SEQ ID NO: 4831550 - DNA, 11 bp, Homo sapiens
gaccctgtgcc

SEQ ID NO: 4831551 - DNA, 13 bp, Homo sapiens
gaccctgtgcccc

SEQ ID NO: 4831552 - DNA, 22 bp, Homo sapiens
gaccctgtgccccgcctcccgg

SEQ ID NO: 4831553 - DNA, 13 bp, Homo sapiens
gaccctgtgcctg

SEQ ID NO: 4831554 - DNA, 15 bp, Homo sapiens
gaccgccccaggcac

SEQ ID NO: 4831555 - DNA, 11 bp, Homo sapiens
gaccggcccgc

SEQ ID NO: 4831556 - DNA, 17 bp, Homo sapiens
gaccggcccgccacctt

SEQ ID NO: 4831557 - DNA, 17 bp, Homo sapiens
gaccgtggccctgccct

SEQ ID NO: 4831558 - DNA, 17 bp, Homo sapiens
gaccgtggtgtcctctg

SEQ ID NO: 4831559 - DNA, 19 bp, Homo sapiens
gaccgtggtgtcctctgtc

SEQ ID NO: 4831560 - DNA, 17 bp, Homo sapiens
gacctacatctgaaatc

SEQ ID NO: 4831561 - DNA, 12 bp, Homo sapiens
gacctcaggcct

SEQ ID NO: 4831562 - DNA, 19 bp, Homo sapiens
gacctcaggcctgggggct

SEQ ID NO: 4831563 - DNA, 20 bp, Homo sapiens
gacctccagattattttcta

SEQ ID NO: 4831564 - DNA, 15 bp, Homo sapiens
gacctcccccaggga

SEQ ID NO: 4831565 - DNA, 17 bp, Homo sapiens
gacctctcactttttta

SEQ ID NO: 4831566 - DNA, 13 bp, Homo sapiens
gacctgacacctg

SEQ ID NO: 4831567 - DNA, 15 bp, Homo sapiens
gacctgacacctgcc

SEQ ID NO: 4831568 - DNA, 13 bp, Homo sapiens
gacctgctccaga

SEQ ID NO: 4831569 - DNA, 17 bp, Homo sapiens
gacctgctccagatcct

SEQ ID NO: 4831570 - DNA, 12 bp, Homo sapiens
gacctggctgag

SEQ ID NO: 4831571 - DNA, 12 bp, Homo sapiens
gaccttcctctg

SEQ ID NO: 4831572 - DNA, 17 bp, Homo sapiens
gaccttcctctggggct

SEQ ID NO: 4831573 - DNA, 21 bp, Homo sapiens
gaccttcctctggggctctag

SEQ ID NO: 4831574 - DNA, 15 bp, Homo sapiens
gaccttgcttccttc

SEQ ID NO: 4831575 - DNA, 11 bp, Homo sapiens
gacctttattt

SEQ ID NO: 4831576 - DNA, 14 bp, Homo sapiens
gaccttttgctgcc

SEQ ID NO: 4831577 - DNA, 15 bp, Homo sapiens
gacgacctacatctg

SEQ ID NO: 4831578 - DNA, 13 bp, Homo sapiens
gacgagcagagcg

SEQ ID NO: 4831579 - DNA, 17 bp, Homo sapiens
gacgcagccccccacgc

SEQ ID NO: 4831580 - DNA, 16 bp, Homo sapiens
gacgcatgcagggccc

SEQ ID NO: 4831581 - DNA, 21 bp, Homo sapiens
gacgcccagcccccacccccg

SEQ ID NO: 4831582 - DNA, 12 bp, Homo sapiens
gacgcccctccg

SEQ ID NO: 4831583 - DNA, 18 bp, Homo sapiens
gacgctgccgctgccgct

SEQ ID NO: 4831584 - DNA, 19 bp, Homo sapiens
gacgctggagaccctgcgc

SEQ ID NO: 4831585 - DNA, 14 bp, Homo sapiens
gacgctggtaactg

SEQ ID NO: 4831586 - DNA, 14 bp, Homo sapiens
gacggcagccccat

SEQ ID NO: 4831587 - DNA, 21 bp, Homo sapiens
gacgggacagcggcccggccc

SEQ ID NO: 4831588 - DNA, 13 bp, Homo sapiens
gacggggcagagc

SEQ ID NO: 4831589 - DNA, 15 bp, Homo sapiens
gacggggcagagctg

SEQ ID NO: 4831590 - DNA, 22 bp, Homo sapiens
gacggggcagagctgagtcggc

SEQ ID NO: 4831591 - DNA, 16 bp, Homo sapiens
gacgggtttcaccatg

SEQ ID NO: 4831592 - DNA, 18 bp, Homo sapiens
gacggtggaatatttgga

SEQ ID NO: 4831593 - DNA, 20 bp, Homo sapiens
gacgtcgctgtccgtcctgc

SEQ ID NO: 4831594 - DNA, 14 bp, Homo sapiens
gacgtgttatgact

SEQ ID NO: 4831595 - DNA, 17 bp, Homo sapiens
gacgtgttatgactcca

SEQ ID NO: 4831596 - DNA, 20 bp, Homo sapiens
gacgtgttatgactccagaa

SEQ ID NO: 4831597 - DNA, 22 bp, Homo sapiens
gacgtgttatgactccagaatt

SEQ ID NO: 4831598 - DNA, 19 bp, Homo sapiens
gactaaccccaacgcacag

SEQ ID NO: 4831599 - DNA, 23 bp, Homo sapiens
gactaaccccaacgcacaggaaa

SEQ ID NO: 4831600 - DNA, 19 bp, Homo sapiens
gactaagggcaggaagact

SEQ ID NO: 4831601 - DNA, 22 bp, Homo sapiens
gactaatgaatgcaaaaagata

SEQ ID NO: 4831602 - DNA, 13 bp, Homo sapiens
gactacagaagtg

SEQ ID NO: 4831603 - DNA, 19 bp, Homo sapiens
gactacctataaatggact

SEQ ID NO: 4831604 - DNA, 20 bp, Homo sapiens
gactacctataaatggactt

SEQ ID NO: 4831605 - DNA, 20 bp, Homo sapiens
gactcagtgcagggacagcc

SEQ ID NO: 4831606 - DNA, 15 bp, Homo sapiens
gactccaagccctgg

SEQ ID NO: 4831607 - DNA, 18 bp, Homo sapiens
gactccaagccctggggc

SEQ ID NO: 4831608 - DNA, 18 bp, Homo sapiens
gactccagaagcagcagc

SEQ ID NO: 4831609 - DNA, 19 bp, Homo sapiens
gactccaggggctggggac

SEQ ID NO: 4831610 - DNA, 21 bp, Homo sapiens
gactccccgcccgccctcctc

SEQ ID NO: 4831611 - DNA, 22 bp, Homo sapiens
gactccccgcccgccctcctct

SEQ ID NO: 4831612 - DNA, 13 bp, Homo sapiens
gactccctgtggg

SEQ ID NO: 4831613 - DNA, 20 bp, Homo sapiens
gactcctcaattccagggaa

SEQ ID NO: 4831614 - DNA, 20 bp, Homo sapiens
gactctctcctctctctccc

SEQ ID NO: 4831615 - DNA, 23 bp, Homo sapiens
gactctctcctctctctccctcc

SEQ ID NO: 4831616 - DNA, 17 bp, Homo sapiens
gactctgaaactataga

SEQ ID NO: 4831617 - DNA, 21 bp, Homo sapiens
gactcttactaaccaccattt

SEQ ID NO: 4831618 - DNA, 19 bp, Homo sapiens
gactgaagaaaatccttca

SEQ ID NO: 4831619 - DNA, 18 bp, Homo sapiens
gactgaccgaagggacgg

SEQ ID NO: 4831620 - DNA, 10 bp, Homo sapiens
gactgcccac

SEQ ID NO: 4831621 - DNA, 17 bp, Homo sapiens
gactgcccaccctgggc

SEQ ID NO: 4831622 - DNA, 23 bp, Homo sapiens
gactgcccaccctgggcctcccg

SEQ ID NO: 4831623 - DNA, 16 bp, Homo sapiens
gactgctcaggctccc

SEQ ID NO: 4831624 - DNA, 22 bp, Homo sapiens
gactgctcaggctccccaagac

SEQ ID NO: 4831625 - DNA, 15 bp, Homo sapiens
gactgctgcctcccc

SEQ ID NO: 4831626 - DNA, 14 bp, Homo sapiens
gactggcccacccc

SEQ ID NO: 4831627 - DNA, 19 bp, Homo sapiens
gactgggtgggccccacag

SEQ ID NO: 4831628 - DNA, 20 bp, Homo sapiens
gactgggtgggccccacagt

SEQ ID NO: 4831629 - DNA, 16 bp, Homo sapiens
gactgtcattagaatt

SEQ ID NO: 4831630 - DNA, 11 bp, Homo sapiens
gactgtcccac

SEQ ID NO: 4831631 - DNA, 12 bp, Homo sapiens
gacttaatttag

SEQ ID NO: 4831632 - DNA, 17 bp, Homo sapiens
gacttcaaaatattgag

SEQ ID NO: 4831633 - DNA, 15 bp, Homo sapiens
gacttcacaaaatgc

SEQ ID NO: 4831634 - DNA, 17 bp, Homo sapiens
gacttcacaaaatgcaa

SEQ ID NO: 4831635 - DNA, 20 bp, Homo sapiens
gacttcagactctctcctct

SEQ ID NO: 4831636 - DNA, 22 bp, Homo sapiens
gacttcagactctctcctctct

SEQ ID NO: 4831637 - DNA, 12 bp, Homo sapiens
gacttcatccct

SEQ ID NO: 4831638 - DNA, 16 bp, Homo sapiens
gacttccagctttctc

SEQ ID NO: 4831639 - DNA, 15 bp, Homo sapiens
gacttcccagctggc

SEQ ID NO: 4831640 - DNA, 24 bp, Homo sapiens
gacttcccagctggcagcgcctcc

SEQ ID NO: 4831641 - DNA, 20 bp, Homo sapiens
gacttcgctattcccaggca

SEQ ID NO: 4831642 - DNA, 17 bp, Homo sapiens
gacttcgggggcggctc

SEQ ID NO: 4831643 - DNA, 23 bp, Homo sapiens
gacttcgggggcggctctgggaa

SEQ ID NO: 4831644 - DNA, 14 bp, Homo sapiens
gacttctaaaataa

SEQ ID NO: 4831645 - DNA, 22 bp, Homo sapiens
gacttctaaaataaatgttttg

SEQ ID NO: 4831646 - DNA, 21 bp, Homo sapiens
gacttctaaatcataatcatc

SEQ ID NO: 4831647 - DNA, 15 bp, Homo sapiens
gacttcttgttcatg

SEQ ID NO: 4831648 - DNA, 19 bp, Homo sapiens
gacttctttactaacactg

SEQ ID NO: 4831649 - DNA, 15 bp, Homo sapiens
gacttgcttcttgtg

SEQ ID NO: 4831650 - DNA, 16 bp, Homo sapiens
gacttggataggagct

SEQ ID NO: 4831651 - DNA, 18 bp, Homo sapiens
gactttcagattgtatct

SEQ ID NO: 4831652 - DNA, 16 bp, Homo sapiens
gactttcctatgacac

SEQ ID NO: 4831653 - DNA, 18 bp, Homo sapiens
gactttctacatgcaaat

SEQ ID NO: 4831654 - DNA, 19 bp, Homo sapiens
gagaaaaaaaaatatgtgt

SEQ ID NO: 4831655 - DNA, 14 bp, Homo sapiens
gagaaaagattaaa

SEQ ID NO: 4831656 - DNA, 13 bp, Homo sapiens
gagaaagaaggct

SEQ ID NO: 4831657 - DNA, 19 bp, Homo sapiens
gagaaagcagatcatctcc

SEQ ID NO: 4831658 - DNA, 18 bp, Homo sapiens
gagaaatttttttccaga

SEQ ID NO: 4831659 - DNA, 21 bp, Homo sapiens
gagaagaggggtataggacaa

SEQ ID NO: 4831660 - DNA, 14 bp, Homo sapiens
gagaagccacgctg

SEQ ID NO: 4831661 - DNA, 18 bp, Homo sapiens
gagaagctctcgagggaa

SEQ ID NO: 4831662 - DNA, 13 bp, Homo sapiens
gagaaggagcaga

SEQ ID NO: 4831663 - DNA, 17 bp, Homo sapiens
gagaaggattctttttt

SEQ ID NO: 4831664 - DNA, 12 bp, Homo sapiens
gagaaggcctgc

SEQ ID NO: 4831665 - DNA, 21 bp, Homo sapiens
gagaaggcctgccccccttcc

SEQ ID NO: 4831666 - DNA, 16 bp, Homo sapiens
gagaagggcgcaggaa

SEQ ID NO: 4831667 - DNA, 22 bp, Homo sapiens
gagaatgcacaaacagaggccg

SEQ ID NO: 4831668 - DNA, 23 bp, Homo sapiens
gagaatgcacaaacagaggccgc

SEQ ID NO: 4831669 - DNA, 13 bp, Homo sapiens
gagaatgtcattt

SEQ ID NO: 4831670 - DNA, 19 bp, Homo sapiens
gagaattgaggggaggtgg

SEQ ID NO: 4831671 - DNA, 17 bp, Homo sapiens
gagacacaagccttcgg

SEQ ID NO: 4831672 - DNA, 18 bp, Homo sapiens
gagaccacccatatcatg

SEQ ID NO: 4831673 - DNA, 18 bp, Homo sapiens
gagaccaccgcgcccctc

SEQ ID NO: 4831674 - DNA, 21 bp, Homo sapiens
gagaccaccgcgcccctctgc

SEQ ID NO: 4831675 - DNA, 12 bp, Homo sapiens
gagaccctgcca

SEQ ID NO: 4831676 - DNA, 23 bp, Homo sapiens
gagaccctgccaactttccagac

SEQ ID NO: 4831677 - DNA, 19 bp, Homo sapiens
gagaccctgcgcccctgcc

SEQ ID NO: 4831678 - DNA, 14 bp, Homo sapiens
gagacctcccccag

SEQ ID NO: 4831679 - DNA, 18 bp, Homo sapiens
gagacctgctccagatcc

SEQ ID NO: 4831680 - DNA, 19 bp, Homo sapiens
gagacctgctccagatcct

SEQ ID NO: 4831681 - DNA, 19 bp, Homo sapiens
gagacggcagccccatcct

SEQ ID NO: 4831682 - DNA, 13 bp, Homo sapiens
gagactatgtgtc

SEQ ID NO: 4831683 - DNA, 16 bp, Homo sapiens
gagactcgcctgggaa

SEQ ID NO: 4831684 - DNA, 13 bp, Homo sapiens
gagactgcccacc

SEQ ID NO: 4831685 - DNA, 17 bp, Homo sapiens
gagactgcccaccctgg

SEQ ID NO: 4831686 - DNA, 19 bp, Homo sapiens
gagactgcccaccctgggc

SEQ ID NO: 4831687 - DNA, 22 bp, Homo sapiens
gagactgcccaccctgggcctc

SEQ ID NO: 4831688 - DNA, 19 bp, Homo sapiens
gagacttgcagttagactc

SEQ ID NO: 4831689 - DNA, 15 bp, Homo sapiens
gagagaacagggatg

SEQ ID NO: 4831690 - DNA, 17 bp, Homo sapiens
gagagaagagaatgcac

SEQ ID NO: 4831691 - DNA, 15 bp, Homo sapiens
gagagaagcacccca

SEQ ID NO: 4831692 - DNA, 18 bp, Homo sapiens
gagagaggcctgggtgtg

SEQ ID NO: 4831693 - DNA, 14 bp, Homo sapiens
gagagatatatctg

SEQ ID NO: 4831694 - DNA, 17 bp, Homo sapiens
gagagatatatctgaaa

SEQ ID NO: 4831695 - DNA, 13 bp, Homo sapiens
gagagcagggctg

SEQ ID NO: 4831696 - DNA, 23 bp, Homo sapiens
gagagccccacccctgaactggc

SEQ ID NO: 4831697 - DNA, 19 bp, Homo sapiens
gagagcctccaggttcctc

SEQ ID NO: 4831698 - DNA, 22 bp, Homo sapiens
gagagcgccacccgcccgcccc

SEQ ID NO: 4831699 - DNA, 16 bp, Homo sapiens
gagagcggcttcccca

SEQ ID NO: 4831700 - DNA, 21 bp, Homo sapiens
gagagcggcttccccattgcc

SEQ ID NO: 4831701 - DNA, 15 bp, Homo sapiens
gagaggaaaaaggct

SEQ ID NO: 4831702 - DNA, 22 bp, Homo sapiens
gagaggaactccttggcctagc

SEQ ID NO: 4831703 - DNA, 20 bp, Homo sapiens
gagaggaggtgtggagtgga

SEQ ID NO: 4831704 - DNA, 22 bp, Homo sapiens
gagaggcatccagtatcttgaa

SEQ ID NO: 4831705 - DNA, 15 bp, Homo sapiens
gagaggcggcctcgt

SEQ ID NO: 4831706 - DNA, 16 bp, Homo sapiens
gagaggcggcctcgtg

SEQ ID NO: 4831707 - DNA, 11 bp, Homo sapiens
gagagggctga

SEQ ID NO: 4831708 - DNA, 12 bp, Homo sapiens
gagagggctgag

SEQ ID NO: 4831709 - DNA, 17 bp, Homo sapiens
gagagggctgagcccct

SEQ ID NO: 4831710 - DNA, 22 bp, Homo sapiens
gagagggtgccgcgggcgagaa

SEQ ID NO: 4831711 - DNA, 15 bp, Homo sapiens
gagagtagggccctg

SEQ ID NO: 4831712 - DNA, 12 bp, Homo sapiens
gagataaatatc

SEQ ID NO: 4831713 - DNA, 16 bp, Homo sapiens
gagatagccaaggcca

SEQ ID NO: 4831714 - DNA, 12 bp, Homo sapiens
gagatagcttag

SEQ ID NO: 4831715 - DNA, 17 bp, Homo sapiens
gagatagcttagtgtct

SEQ ID NO: 4831716 - DNA, 13 bp, Homo sapiens
gagatcagaattg

SEQ ID NO: 4831717 - DNA, 17 bp, Homo sapiens
gagatcctcaaaaatca

SEQ ID NO: 4831718 - DNA, 12 bp, Homo sapiens
gagatgatttcc

SEQ ID NO: 4831719 - DNA, 20 bp, Homo sapiens
gagatggcagagccatccac

SEQ ID NO: 4831720 - DNA, 21 bp, Homo sapiens
gagatgtaccatgttaaagag

SEQ ID NO: 4831721 - DNA, 16 bp, Homo sapiens
gagatgtgtatcagtg

SEQ ID NO: 4831722 - DNA, 17 bp, Homo sapiens
gagatgtgtatcagtgt

SEQ ID NO: 4831723 - DNA, 16 bp, Homo sapiens
gagattggatcaagta

SEQ ID NO: 4831724 - DNA, 19 bp, Homo sapiens
gagattgggggggcttggg

SEQ ID NO: 4831725 - DNA, 13 bp, Homo sapiens
gagatttgtattt

SEQ ID NO: 4831726 - DNA, 13 bp, Homo sapiens
gagcaaggctgct

SEQ ID NO: 4831727 - DNA, 19 bp, Homo sapiens
gagcaaggctgctaagtgg

SEQ ID NO: 4831728 - DNA, 21 bp, Homo sapiens
gagcacaagaagtttcttcag

SEQ ID NO: 4831729 - DNA, 15 bp, Homo sapiens
gagcaccacggggtc

SEQ ID NO: 4831730 - DNA, 11 bp, Homo sapiens
gagcaccccca

SEQ ID NO: 4831731 - DNA, 12 bp, Homo sapiens
gagcacccccag

SEQ ID NO: 4831732 - DNA, 15 bp, Homo sapiens
gagcacccccagcct

SEQ ID NO: 4831733 - DNA, 20 bp, Homo sapiens
gagcacccccagcctccccc

SEQ ID NO: 4831734 - DNA, 17 bp, Homo sapiens
gagcactagaatgagaa

SEQ ID NO: 4831735 - DNA, 20 bp, Homo sapiens
gagcactagaatgagaaatc

SEQ ID NO: 4831736 - DNA, 17 bp, Homo sapiens
gagcactattctaagga

SEQ ID NO: 4831737 - DNA, 13 bp, Homo sapiens
gagcactgctcca

SEQ ID NO: 4831738 - DNA, 14 bp, Homo sapiens
gagcagacagggcg

SEQ ID NO: 4831739 - DNA, 15 bp, Homo sapiens
gagcagagcgcagcc

SEQ ID NO: 4831740 - DNA, 16 bp, Homo sapiens
gagcagagcgcagccc

SEQ ID NO: 4831741 - DNA, 20 bp, Homo sapiens
gagcagagcgcagcccccac

SEQ ID NO: 4831742 - DNA, 23 bp, Homo sapiens
gagcagagctgatggagaaggaa

SEQ ID NO: 4831743 - DNA, 17 bp, Homo sapiens
gagcaggaaggcctggg

SEQ ID NO: 4831744 - DNA, 12 bp, Homo sapiens
gagcagtgggga

SEQ ID NO: 4831745 - DNA, 13 bp, Homo sapiens
gagcagtggggag

SEQ ID NO: 4831746 - DNA, 16 bp, Homo sapiens
gagcagtggggagcgg

SEQ ID NO: 4831747 - DNA, 22 bp, Homo sapiens
gagcatgcccaaatataacatg

SEQ ID NO: 4831748 - DNA, 20 bp, Homo sapiens
gagcatggccgcaacttccc

SEQ ID NO: 4831749 - DNA, 18 bp, Homo sapiens
gagcattctggggtgggg

SEQ ID NO: 4831750 - DNA, 19 bp, Homo sapiens
gagccaataaagctcacac

SEQ ID NO: 4831751 - DNA, 14 bp, Homo sapiens
gagccacagtgggg

SEQ ID NO: 4831752 - DNA, 18 bp, Homo sapiens
gagccacagtggggccca

SEQ ID NO: 4831753 - DNA, 22 bp, Homo sapiens
gagccacagtggggcccatggc

SEQ ID NO: 4831754 - DNA, 23 bp, Homo sapiens
gagccacagtggggcccatggcc

SEQ ID NO: 4831755 - DNA, 13 bp, Homo sapiens
gagcccaggcctc

SEQ ID NO: 4831756 - DNA, 14 bp, Homo sapiens
gagcccaggcctcc

SEQ ID NO: 4831757 - DNA, 22 bp, Homo sapiens
gagccccacccctgaactggcc

SEQ ID NO: 4831758 - DNA, 17 bp, Homo sapiens
gagccccccgtgttcac

SEQ ID NO: 4831759 - DNA, 19 bp, Homo sapiens
gagcccccgcccctccccc

SEQ ID NO: 4831760 - DNA, 21 bp, Homo sapiens
gagccccctgcacccacccct

SEQ ID NO: 4831761 - DNA, 22 bp, Homo sapiens
gagccccctgcacccacccctg

SEQ ID NO: 4831762 - DNA, 23 bp, Homo sapiens
gagccccctgcacccacccctgc

SEQ ID NO: 4831763 - DNA, 14 bp, Homo sapiens
gagccccggagcac

SEQ ID NO: 4831764 - DNA, 16 bp, Homo sapiens
gagcccctccctcctg

SEQ ID NO: 4831765 - DNA, 17 bp, Homo sapiens
gagcccctcctctcctc

SEQ ID NO: 4831766 - DNA, 18 bp, Homo sapiens
gagcccctcctctcctcg

SEQ ID NO: 4831767 - DNA, 20 bp, Homo sapiens
gagcccctgtttctcctcca

SEQ ID NO: 4831768 - DNA, 15 bp, Homo sapiens
gagcccgcccacctg

SEQ ID NO: 4831769 - DNA, 20 bp, Homo sapiens
gagcccgcctgcgcccccca

SEQ ID NO: 4831770 - DNA, 24 bp, Homo sapiens
gagccctgccctcactccactccc

SEQ ID NO: 4831771 - DNA, 18 bp, Homo sapiens
gagccgcaggggcccctc

SEQ ID NO: 4831772 - DNA, 21 bp, Homo sapiens
gagccgcaggggcccctcctc

SEQ ID NO: 4831773 - DNA, 16 bp, Homo sapiens
gagccgtcagcctgtg

SEQ ID NO: 4831774 - DNA, 22 bp, Homo sapiens
gagccgtgacctccaggaaggg

SEQ ID NO: 4831775 - DNA, 17 bp, Homo sapiens
gagcctccaggttcctc

SEQ ID NO: 4831776 - DNA, 13 bp, Homo sapiens
gagcctcctgccc

SEQ ID NO: 4831777 - DNA, 20 bp, Homo sapiens
gagcctcctgcccttacctg

SEQ ID NO: 4831778 - DNA, 22 bp, Homo sapiens
gagcctcctgcccttacctgcc

SEQ ID NO: 4831779 - DNA, 17 bp, Homo sapiens
gagcctggcacaggact

SEQ ID NO: 4831780 - DNA, 18 bp, Homo sapiens
gagcctggcacaggactg

SEQ ID NO: 4831781 - DNA, 11 bp, Homo sapiens
gagcctgtctc

SEQ ID NO: 4831782 - DNA, 16 bp, Homo sapiens
gagcgcacctcgccgt

SEQ ID NO: 4831783 - DNA, 15 bp, Homo sapiens
gagcgcagcccccac

SEQ ID NO: 4831784 - DNA, 14 bp, Homo sapiens
gagcgccacccgcc

SEQ ID NO: 4831785 - DNA, 22 bp, Homo sapiens
gagcgccacccgcccgcccccg

SEQ ID NO: 4831786 - DNA, 16 bp, Homo sapiens
gagcgcgtgccttccc

SEQ ID NO: 4831787 - DNA, 17 bp, Homo sapiens
gagcggagaaaggaagg

SEQ ID NO: 4831788 - DNA, 18 bp, Homo sapiens
gagcggagaaaggaaggg

SEQ ID NO: 4831789 - DNA, 14 bp, Homo sapiens
gagcggctgaggac

SEQ ID NO: 4831790 - DNA, 19 bp, Homo sapiens
gagcgggggctaactggcc

SEQ ID NO: 4831791 - DNA, 20 bp, Homo sapiens
gagcgggggctaactggccc

SEQ ID NO: 4831792 - DNA, 15 bp, Homo sapiens
gagcgtccttgtccc

SEQ ID NO: 4831793 - DNA, 18 bp, Homo sapiens
gagcgtgtcctatccccg

SEQ ID NO: 4831794 - DNA, 23 bp, Homo sapiens
gagcgtgtcctatccccggacgc

SEQ ID NO: 4831795 - DNA, 23 bp, Homo sapiens
gagctacacaggggaaaagagga

SEQ ID NO: 4831796 - DNA, 15 bp, Homo sapiens
gagctaccaggaaga

SEQ ID NO: 4831797 - DNA, 18 bp, Homo sapiens
gagctaccaggaagaggg

SEQ ID NO: 4831798 - DNA, 13 bp, Homo sapiens
gagctagagaaat

SEQ ID NO: 4831799 - DNA, 17 bp, Homo sapiens
gagctatgatatgtgct

SEQ ID NO: 4831800 - DNA, 20 bp, Homo sapiens
gagctatgatatgtgcttgt

SEQ ID NO: 4831801 - DNA, 22 bp, Homo sapiens
gagctatgcacaccaaattgct

SEQ ID NO: 4831802 - DNA, 18 bp, Homo sapiens
gagctcaggagaaggcct

SEQ ID NO: 4831803 - DNA, 13 bp, Homo sapiens
gagctccaccctc

SEQ ID NO: 4831804 - DNA, 17 bp, Homo sapiens
gagctccaccctcccct

SEQ ID NO: 4831805 - DNA, 22 bp, Homo sapiens
gagctccaccctcccctcttct

SEQ ID NO: 4831806 - DNA, 14 bp, Homo sapiens
gagctccagtttct

SEQ ID NO: 4831807 - DNA, 15 bp, Homo sapiens
gagctccagtttctc

SEQ ID NO: 4831808 - DNA, 20 bp, Homo sapiens
gagctccctttttgaattgt

SEQ ID NO: 4831809 - DNA, 15 bp, Homo sapiens
gagctctggctttcg

SEQ ID NO: 4831810 - DNA, 15 bp, Homo sapiens
gagctcttggcagga

SEQ ID NO: 4831811 - DNA, 17 bp, Homo sapiens
gagctgagtcggctggg

SEQ ID NO: 4831812 - DNA, 18 bp, Homo sapiens
gagctgatggagaaggaa

SEQ ID NO: 4831813 - DNA, 18 bp, Homo sapiens
gagctgttctttttgact

SEQ ID NO: 4831814 - DNA, 14 bp, Homo sapiens
gagctgttttggat

SEQ ID NO: 4831815 - DNA, 19 bp, Homo sapiens
gagctgttttggatgaatg

SEQ ID NO: 4831816 - DNA, 18 bp, Homo sapiens
gagcttgattctaaaggg

SEQ ID NO: 4831817 - DNA, 21 bp, Homo sapiens
gagcttgattctaaaggggac

SEQ ID NO: 4831818 - DNA, 22 bp, Homo sapiens
gagcttgattctaaaggggaca

SEQ ID NO: 4831819 - DNA, 16 bp, Homo sapiens
gaggaaagcaaaggag

SEQ ID NO: 4831820 - DNA, 14 bp, Homo sapiens
gaggaagtggtgtt

SEQ ID NO: 4831821 - DNA, 22 bp, Homo sapiens
gaggaataagaatggagcagta

SEQ ID NO: 4831822 - DNA, 13 bp, Homo sapiens
gaggacagggagg

SEQ ID NO: 4831823 - DNA, 12 bp, Homo sapiens
gaggacagggcc

SEQ ID NO: 4831824 - DNA, 19 bp, Homo sapiens
gaggacagggcccccacag

SEQ ID NO: 4831825 - DNA, 18 bp, Homo sapiens
gaggaccccattctggga

SEQ ID NO: 4831826 - DNA, 11 bp, Homo sapiens
gaggacccctg

SEQ ID NO: 4831827 - DNA, 15 bp, Homo sapiens
gaggacccctgccct

SEQ ID NO: 4831828 - DNA, 21 bp, Homo sapiens
gaggacccctgccctcggcca

SEQ ID NO: 4831829 - DNA, 16 bp, Homo sapiens
gaggaccctcccaggt

SEQ ID NO: 4831830 - DNA, 17 bp, Homo sapiens
gaggacggggcagagct

SEQ ID NO: 4831831 - DNA, 21 bp, Homo sapiens
gaggactgttctaactagtaa

SEQ ID NO: 4831832 - DNA, 14 bp, Homo sapiens
gaggagagaggacc

SEQ ID NO: 4831833 - DNA, 16 bp, Homo sapiens
gaggagattgctctgg

SEQ ID NO: 4831834 - DNA, 11 bp, Homo sapiens
gaggagcaccc

SEQ ID NO: 4831835 - DNA, 15 bp, Homo sapiens
gaggagcacccccag

SEQ ID NO: 4831836 - DNA, 18 bp, Homo sapiens
gaggagcacccccagcct

SEQ ID NO: 4831837 - DNA, 19 bp, Homo sapiens
gaggagcacccccagcctc

SEQ ID NO: 4831838 - DNA, 13 bp, Homo sapiens
gaggagccaggca

SEQ ID NO: 4831839 - DNA, 15 bp, Homo sapiens
gaggaggggagcaag

SEQ ID NO: 4831840 - DNA, 14 bp, Homo sapiens
gaggagtccaaaat

SEQ ID NO: 4831841 - DNA, 16 bp, Homo sapiens
gaggcagaatggtggg

SEQ ID NO: 4831842 - DNA, 23 bp, Homo sapiens
gaggcagaatggtgggctccaga

SEQ ID NO: 4831843 - DNA, 16 bp, Homo sapiens
gaggcagagaagaaag

SEQ ID NO: 4831844 - DNA, 15 bp, Homo sapiens
gaggcagcaacagga

SEQ ID NO: 4831845 - DNA, 18 bp, Homo sapiens
gaggcagcaacaggacca

SEQ ID NO: 4831846 - DNA, 21 bp, Homo sapiens
gaggcagcaacaggaccagga

SEQ ID NO: 4831847 - DNA, 23 bp, Homo sapiens
gaggcagcaacaggaccaggagc

SEQ ID NO: 4831848 - DNA, 14 bp, Homo sapiens
gaggcagggccctg

SEQ ID NO: 4831849 - DNA, 17 bp, Homo sapiens
gaggccagtactttgcc

SEQ ID NO: 4831850 - DNA, 13 bp, Homo sapiens
gaggcccccggag

SEQ ID NO: 4831851 - DNA, 17 bp, Homo sapiens
gaggcccccggaggcgc

SEQ ID NO: 4831852 - DNA, 20 bp, Homo sapiens
gaggcccccggaggcgccca

SEQ ID NO: 4831853 - DNA, 17 bp, Homo sapiens
gaggcctggctctggag

SEQ ID NO: 4831854 - DNA, 22 bp, Homo sapiens
gaggcctgggagatgcagctgg

SEQ ID NO: 4831855 - DNA, 21 bp, Homo sapiens
gaggcctgggtgtgacctgac

SEQ ID NO: 4831856 - DNA, 13 bp, Homo sapiens
gaggccttccctt

SEQ ID NO: 4831857 - DNA, 14 bp, Homo sapiens
gaggcgtcttgtat

SEQ ID NO: 4831858 - DNA, 16 bp, Homo sapiens
gaggcgtcttgtattt

SEQ ID NO: 4831859 - DNA, 21 bp, Homo sapiens
gaggcgttgtgaatgtgtccc

SEQ ID NO: 4831860 - DNA, 17 bp, Homo sapiens
gaggctcgtgcatgtaa

SEQ ID NO: 4831861 - DNA, 19 bp, Homo sapiens
gaggctgccccaggggcac

SEQ ID NO: 4831862 - DNA, 15 bp, Homo sapiens
gaggctgggcccctg

SEQ ID NO: 4831863 - DNA, 16 bp, Homo sapiens
gaggcttccagctcag

SEQ ID NO: 4831864 - DNA, 21 bp, Homo sapiens
gagggaaacccggggaactgg

SEQ ID NO: 4831865 - DNA, 15 bp, Homo sapiens
gagggaagcccaccc

SEQ ID NO: 4831866 - DNA, 14 bp, Homo sapiens
gagggactccaagc

SEQ ID NO: 4831867 - DNA, 21 bp, Homo sapiens
gagggactccaagccctgggg

SEQ ID NO: 4831868 - DNA, 21 bp, Homo sapiens
gagggaggggccctgtcactg

SEQ ID NO: 4831869 - DNA, 13 bp, Homo sapiens
gagggatggagag

SEQ ID NO: 4831870 - DNA, 20 bp, Homo sapiens
gagggcaaaccaggctgcag

SEQ ID NO: 4831871 - DNA, 16 bp, Homo sapiens
gagggcctctggacag

SEQ ID NO: 4831872 - DNA, 14 bp, Homo sapiens
gagggcgcctgggt

SEQ ID NO: 4831873 - DNA, 21 bp, Homo sapiens
gagggcgcctgggtcctccca

SEQ ID NO: 4831874 - DNA, 15 bp, Homo sapiens
gagggctgacaaggc

SEQ ID NO: 4831875 - DNA, 17 bp, Homo sapiens
gagggctgagcccctcc

SEQ ID NO: 4831876 - DNA, 18 bp, Homo sapiens
gagggctgagcccctcct

SEQ ID NO: 4831877 - DNA, 21 bp, Homo sapiens
gagggctgagcccctcctctc

SEQ ID NO: 4831878 - DNA, 14 bp, Homo sapiens
gaggggaagagaga

SEQ ID NO: 4831879 - DNA, 16 bp, Homo sapiens
gaggggaagctgcagc

SEQ ID NO: 4831880 - DNA, 19 bp, Homo sapiens
gaggggaagctgcagcttg

SEQ ID NO: 4831881 - DNA, 17 bp, Homo sapiens
gaggggcgctgccccca

SEQ ID NO: 4831882 - DNA, 18 bp, Homo sapiens
gaggggcgctgcccccac

SEQ ID NO: 4831883 - DNA, 17 bp, Homo sapiens
gaggggcttggagcaga

SEQ ID NO: 4831884 - DNA, 21 bp, Homo sapiens
gaggggcttggagcagagacg

SEQ ID NO: 4831885 - DNA, 18 bp, Homo sapiens
gagggggtcagttgggcc

SEQ ID NO: 4831886 - DNA, 20 bp, Homo sapiens
gagggggtcagttgggcccc

SEQ ID NO: 4831887 - DNA, 23 bp, Homo sapiens
gaggggtataggacaaggggtgg

SEQ ID NO: 4831888 - DNA, 16 bp, Homo sapiens
gaggggtcagcagggg

SEQ ID NO: 4831889 - DNA, 13 bp, Homo sapiens
gagggtaaggctg

SEQ ID NO: 4831890 - DNA, 18 bp, Homo sapiens
gaggtatcttactttcct

SEQ ID NO: 4831891 - DNA, 18 bp, Homo sapiens
gaggtcatctgtaaaata

SEQ ID NO: 4831892 - DNA, 20 bp, Homo sapiens
gaggtggatactggggggca

SEQ ID NO: 4831893 - DNA, 23 bp, Homo sapiens
gaggtggccagcccgcagaggtg

SEQ ID NO: 4831894 - DNA, 17 bp, Homo sapiens
gaggtggggagggcctc

SEQ ID NO: 4831895 - DNA, 19 bp, Homo sapiens
gaggtggggagggcctctg

SEQ ID NO: 4831896 - DNA, 16 bp, Homo sapiens
gaggtggggtgctggg

SEQ ID NO: 4831897 - DNA, 17 bp, Homo sapiens
gaggtggggtgctgggg

SEQ ID NO: 4831898 - DNA, 19 bp, Homo sapiens
gaggttgagctatgatatg

SEQ ID NO: 4831899 - DNA, 13 bp, Homo sapiens
gaggtttcagcat

SEQ ID NO: 4831900 - DNA, 19 bp, Homo sapiens
gagtaaaacttgtattgga

SEQ ID NO: 4831901 - DNA, 21 bp, Homo sapiens
gagtaagcacctttagaatat

SEQ ID NO: 4831902 - DNA, 21 bp, Homo sapiens
gagtagataagtgctcagtat

SEQ ID NO: 4831903 - DNA, 22 bp, Homo sapiens
gagtagggccctgacaggcctt

SEQ ID NO: 4831904 - DNA, 15 bp, Homo sapiens
gagtaggtgggtctt

SEQ ID NO: 4831905 - DNA, 17 bp, Homo sapiens
gagtatatatgtacagt

SEQ ID NO: 4831906 - DNA, 19 bp, Homo sapiens
gagtatatatgtacagtta

SEQ ID NO: 4831907 - DNA, 22 bp, Homo sapiens
gagtatgcaagaagaatataaa

SEQ ID NO: 4831908 - DNA, 17 bp, Homo sapiens
gagtatggtgctgggtc

SEQ ID NO: 4831909 - DNA, 17 bp, Homo sapiens
gagtatgtgtatgtact

SEQ ID NO: 4831910 - DNA, 18 bp, Homo sapiens
gagtcaagctgatgaagt

SEQ ID NO: 4831911 - DNA, 18 bp, Homo sapiens
gagtcaccttccaggacc

SEQ ID NO: 4831912 - DNA, 21 bp, Homo sapiens
gagtcactggaacactaatga

SEQ ID NO: 4831913 - DNA, 17 bp, Homo sapiens
gagtcagggctgtgctt

SEQ ID NO: 4831914 - DNA, 14 bp, Homo sapiens
gagtcattgttaca

SEQ ID NO: 4831915 - DNA, 21 bp, Homo sapiens
gagtccactttcctctctctc

SEQ ID NO: 4831916 - DNA, 23 bp, Homo sapiens
gagtccagacaccatcaccacgc

SEQ ID NO: 4831917 - DNA, 20 bp, Homo sapiens
gagtcccccctcccacctcc

SEQ ID NO: 4831918 - DNA, 22 bp, Homo sapiens
gagtcccccctcccacctccag

SEQ ID NO: 4831919 - DNA, 17 bp, Homo sapiens
gagtccctcctccccca

SEQ ID NO: 4831920 - DNA, 23 bp, Homo sapiens
gagtccctcctcccccacgcctc

SEQ ID NO: 4831921 - DNA, 17 bp, Homo sapiens
gagtctcctcactgcca

SEQ ID NO: 4831922 - DNA, 19 bp, Homo sapiens
gagtctcctcactgccact

SEQ ID NO: 4831923 - DNA, 16 bp, Homo sapiens
gagtctgaaggagagg

SEQ ID NO: 4831924 - DNA, 18 bp, Homo sapiens
gagtctgaaggagaggag

SEQ ID NO: 4831925 - DNA, 20 bp, Homo sapiens
gagtctgaaggagaggagtg

SEQ ID NO: 4831926 - DNA, 20 bp, Homo sapiens
gagtctgtgaataaagccac

SEQ ID NO: 4831927 - DNA, 17 bp, Homo sapiens
gagtgaagctgggagaa

SEQ ID NO: 4831928 - DNA, 19 bp, Homo sapiens
gagtgactctggctgccaa

SEQ ID NO: 4831929 - DNA, 17 bp, Homo sapiens
gagtgagctaccaggaa

SEQ ID NO: 4831930 - DNA, 18 bp, Homo sapiens
gagtgagctaccaggaag

SEQ ID NO: 4831931 - DNA, 20 bp, Homo sapiens
gagtgatgggcaaggggcca

SEQ ID NO: 4831932 - DNA, 23 bp, Homo sapiens
gagtgccacatggccgctgccca

SEQ ID NO: 4831933 - DNA, 18 bp, Homo sapiens
gagtgccacgtggccgct

SEQ ID NO: 4831934 - DNA, 15 bp, Homo sapiens
gagtgcgaccaccac

SEQ ID NO: 4831935 - DNA, 16 bp, Homo sapiens
gagtgcgaccaccact

SEQ ID NO: 4831936 - DNA, 12 bp, Homo sapiens
gagtggacagca

SEQ ID NO: 4831937 - DNA, 15 bp, Homo sapiens
gagtggacagcagct

SEQ ID NO: 4831938 - DNA, 20 bp, Homo sapiens
gagtggacagcagctggact

SEQ ID NO: 4831939 - DNA, 13 bp, Homo sapiens
gagtggaccacga

SEQ ID NO: 4831940 - DNA, 18 bp, Homo sapiens
gagtggcgagtccagaca

SEQ ID NO: 4831941 - DNA, 14 bp, Homo sapiens
gagtggctcgtgtt

SEQ ID NO: 4831942 - DNA, 14 bp, Homo sapiens
gagtgggccccctc

SEQ ID NO: 4831943 - DNA, 13 bp, Homo sapiens
gagtgtatgtata

SEQ ID NO: 4831944 - DNA, 22 bp, Homo sapiens
gagtgtgaatataaatgtgtgt

SEQ ID NO: 4831945 - DNA, 16 bp, Homo sapiens
gagtgtgatgcaggaa

SEQ ID NO: 4831946 - DNA, 19 bp, Homo sapiens
gagtgtgtagaaacacagc

SEQ ID NO: 4831947 - DNA, 13 bp, Homo sapiens
gagttaagtctat

SEQ ID NO: 4831948 - DNA, 15 bp, Homo sapiens
gagttacagacaaag

SEQ ID NO: 4831949 - DNA, 15 bp, Homo sapiens
gagttcagctgcttc

SEQ ID NO: 4831950 - DNA, 14 bp, Homo sapiens
gagttcatcttgaa

SEQ ID NO: 4831951 - DNA, 21 bp, Homo sapiens
gagttcccttgattcaaataa

SEQ ID NO: 4831952 - DNA, 14 bp, Homo sapiens
gagttcctttccct

SEQ ID NO: 4831953 - DNA, 21 bp, Homo sapiens
gagttcttcctgtaatcttgt

SEQ ID NO: 4831954 - DNA, 21 bp, Homo sapiens
gagttgaagacagagctacac

SEQ ID NO: 4831955 - DNA, 16 bp, Homo sapiens
gagtttccatttggat

SEQ ID NO: 4831956 - DNA, 20 bp, Homo sapiens
gagtttggggtatgggagag

SEQ ID NO: 4831957 - DNA, 21 bp, Homo sapiens
gagttttctctttgtggggct

SEQ ID NO: 4831958 - DNA, 16 bp, Homo sapiens
gataaaatcttcaact

SEQ ID NO: 4831959 - DNA, 17 bp, Homo sapiens
gataaatatcattatag

SEQ ID NO: 4831960 - DNA, 19 bp, Homo sapiens
gataaatatcattatagca

SEQ ID NO: 4831961 - DNA, 21 bp, Homo sapiens
gataaatcatgggcattgctg

SEQ ID NO: 4831962 - DNA, 18 bp, Homo sapiens
gataaatccaactctgac

SEQ ID NO: 4831963 - DNA, 15 bp, Homo sapiens
gataacagagtgatt

SEQ ID NO: 4831964 - DNA, 17 bp, Homo sapiens
gataataaaattcattc

SEQ ID NO: 4831965 - DNA, 15 bp, Homo sapiens
gataataactagatc

SEQ ID NO: 4831966 - DNA, 18 bp, Homo sapiens
gataataactagatctcc

SEQ ID NO: 4831967 - DNA, 21 bp, Homo sapiens
gataatagctcacagcacatt

SEQ ID NO: 4831968 - DNA, 14 bp, Homo sapiens
gataattaaatgaa

SEQ ID NO: 4831969 - DNA, 17 bp, Homo sapiens
gataattaaatgaaata

SEQ ID NO: 4831970 - DNA, 13 bp, Homo sapiens
gataattatatca

SEQ ID NO: 4831971 - DNA, 12 bp, Homo sapiens
gataattgtaaa

SEQ ID NO: 4831972 - DNA, 21 bp, Homo sapiens
gatacagtattatagatataa

SEQ ID NO: 4831973 - DNA, 15 bp, Homo sapiens
gatacctgcctggga

SEQ ID NO: 4831974 - DNA, 13 bp, Homo sapiens
gatacctgtgagg

SEQ ID NO: 4831975 - DNA, 14 bp, Homo sapiens
gatacttggtcctt

SEQ ID NO: 4831976 - DNA, 16 bp, Homo sapiens
gatacttgtaactttt

SEQ ID NO: 4831977 - DNA, 21 bp, Homo sapiens
gatagagacttgcagttagac

SEQ ID NO: 4831978 - DNA, 22 bp, Homo sapiens
gatagcactggtttgtttctca

SEQ ID NO: 4831979 - DNA, 17 bp, Homo sapiens
gataggagaggaaaagg

SEQ ID NO: 4831980 - DNA, 17 bp, Homo sapiens
gataggagcttccagat

SEQ ID NO: 4831981 - DNA, 22 bp, Homo sapiens
gatagtgtttcgttaagcagta

SEQ ID NO: 4831982 - DNA, 16 bp, Homo sapiens
gatataactttagaaa

SEQ ID NO: 4831983 - DNA, 23 bp, Homo sapiens
gatataataaatatatatttatc

SEQ ID NO: 4831984 - DNA, 22 bp, Homo sapiens
gatatagcttttggtgtttgag

SEQ ID NO: 4831985 - DNA, 12 bp, Homo sapiens
gatatatctgaa

SEQ ID NO: 4831986 - DNA, 18 bp, Homo sapiens
gatatatctgaaaactgg

SEQ ID NO: 4831987 - DNA, 13 bp, Homo sapiens
gatatcacctgaa

SEQ ID NO: 4831988 - DNA, 18 bp, Homo sapiens
gatatcacctgaattatt

SEQ ID NO: 4831989 - DNA, 20 bp, Homo sapiens
gatatctgtttgcttctaaa

SEQ ID NO: 4831990 - DNA, 15 bp, Homo sapiens
gatatgaaaaatgag

SEQ ID NO: 4831991 - DNA, 20 bp, Homo sapiens
gatatgagaaatataaaaat

SEQ ID NO: 4831992 - DNA, 22 bp, Homo sapiens
gatatgcatgtagcatataaat

SEQ ID NO: 4831993 - DNA, 20 bp, Homo sapiens
gatatgggactgagcctggc

SEQ ID NO: 4831994 - DNA, 15 bp, Homo sapiens
gatatgtctttaaaa

SEQ ID NO: 4831995 - DNA, 18 bp, Homo sapiens
gatatgtctttaaaatga

SEQ ID NO: 4831996 - DNA, 13 bp, Homo sapiens
gatattcccaggg

SEQ ID NO: 4831997 - DNA, 14 bp, Homo sapiens
gatattcccagggc

SEQ ID NO: 4831998 - DNA, 21 bp, Homo sapiens
gatattctaagaaatatctgt

SEQ ID NO: 4831999 - DNA, 17 bp, Homo sapiens
gatattgctgaagaatc

SEQ ID NO: 4832000 - DNA, 20 bp, Homo sapiens
gatattggttctatttattt

SEQ ID NO: 4832001 - DNA, 22 bp, Homo sapiens
gatattgtattatcatatatgc

SEQ ID NO: 4832002 - DNA, 13 bp, Homo sapiens
gatatttaaaaga

SEQ ID NO: 4832003 - DNA, 15 bp, Homo sapiens
gatatttttaattta

SEQ ID NO: 4832004 - DNA, 13 bp, Homo sapiens
gatcaaaatgcat

SEQ ID NO: 4832005 - DNA, 20 bp, Homo sapiens
gatcaaaatgcatacgtatt

SEQ ID NO: 4832006 - DNA, 19 bp, Homo sapiens
gatcaacagacctaagaaa

SEQ ID NO: 4832007 - DNA, 19 bp, Homo sapiens
gatcaaggagggagaaagg

SEQ ID NO: 4832008 - DNA, 15 bp, Homo sapiens
gatcaaggtgctctt

SEQ ID NO: 4832009 - DNA, 22 bp, Homo sapiens
gatcaaggtgctcttctcattt

SEQ ID NO: 4832010 - DNA, 21 bp, Homo sapiens
gatcacatgcccctcttagaa

SEQ ID NO: 4832011 - DNA, 12 bp, Homo sapiens
gatcaggaagag

SEQ ID NO: 4832012 - DNA, 17 bp, Homo sapiens
gatcaggaagagaagga

SEQ ID NO: 4832013 - DNA, 20 bp, Homo sapiens
gatcaggtcagagcccagga

SEQ ID NO: 4832014 - DNA, 23 bp, Homo sapiens
gatcagtaaaattatactgtgtg

SEQ ID NO: 4832015 - DNA, 14 bp, Homo sapiens
gatcagtctttgtc

SEQ ID NO: 4832016 - DNA, 21 bp, Homo sapiens
gatcagtctttgtcaatgctc

SEQ ID NO: 4832017 - DNA, 17 bp, Homo sapiens
gatcatctccaaatctt

SEQ ID NO: 4832018 - DNA, 20 bp, Homo sapiens
gatcatctccaaatcttgcc

SEQ ID NO: 4832019 - DNA, 20 bp, Homo sapiens
gatcattggtatctgatatc

SEQ ID NO: 4832020 - DNA, 16 bp, Homo sapiens
gatccacagtaatctt

SEQ ID NO: 4832021 - DNA, 21 bp, Homo sapiens
gatccacccgcctcagcctcc

SEQ ID NO: 4832022 - DNA, 20 bp, Homo sapiens
gatccaccgccacactggcc

SEQ ID NO: 4832023 - DNA, 14 bp, Homo sapiens
gatccagagacctg

SEQ ID NO: 4832024 - DNA, 19 bp, Homo sapiens
gatccagagacctgctcca

SEQ ID NO: 4832025 - DNA, 14 bp, Homo sapiens
gatccagagagaag

SEQ ID NO: 4832026 - DNA, 15 bp, Homo sapiens
gatccagagagaagc

SEQ ID NO: 4832027 - DNA, 16 bp, Homo sapiens
gatccagagagaagca

SEQ ID NO: 4832028 - DNA, 21 bp, Homo sapiens
gatccagcggggcttctgggc

SEQ ID NO: 4832029 - DNA, 21 bp, Homo sapiens
gatccccatggaacagccctg

SEQ ID NO: 4832030 - DNA, 19 bp, Homo sapiens
gatccctcggtcagcaccg

SEQ ID NO: 4832031 - DNA, 20 bp, Homo sapiens
gatcctcaaaaatcatcaaa

SEQ ID NO: 4832032 - DNA, 23 bp, Homo sapiens
gatcctccgcggaggcccctgag

SEQ ID NO: 4832033 - DNA, 15 bp, Homo sapiens
gatcctgtgattcct

SEQ ID NO: 4832034 - DNA, 23 bp, Homo sapiens
gatccttcaaagtctcaatgaaa

SEQ ID NO: 4832035 - DNA, 18 bp, Homo sapiens
gatctaaaaggaggacag

SEQ ID NO: 4832036 - DNA, 15 bp, Homo sapiens
gatctagccaggcct

SEQ ID NO: 4832037 - DNA, 21 bp, Homo sapiens
gatctcagataaagtgaccag

SEQ ID NO: 4832038 - DNA, 19 bp, Homo sapiens
gatctcagcatcctggaaa

SEQ ID NO: 4832039 - DNA, 17 bp, Homo sapiens
gatctcagctcactaca

SEQ ID NO: 4832040 - DNA, 12 bp, Homo sapiens
gatctccaggcc

SEQ ID NO: 4832041 - DNA, 15 bp, Homo sapiens
gatctccaggcccag

SEQ ID NO: 4832042 - DNA, 19 bp, Homo sapiens
gatctccaggcccagcctg

SEQ ID NO: 4832043 - DNA, 22 bp, Homo sapiens
gatctccaggcccagcctggcc

SEQ ID NO: 4832044 - DNA, 13 bp, Homo sapiens
gatctcctgtaat

SEQ ID NO: 4832045 - DNA, 18 bp, Homo sapiens
gatctctgttctttcata

SEQ ID NO: 4832046 - DNA, 13 bp, Homo sapiens
gatctgcactcct

SEQ ID NO: 4832047 - DNA, 16 bp, Homo sapiens
gatctgcactcctgtc

SEQ ID NO: 4832048 - DNA, 15 bp, Homo sapiens
gatctgctccatgca

SEQ ID NO: 4832049 - DNA, 13 bp, Homo sapiens
gatctggagtctg

SEQ ID NO: 4832050 - DNA, 17 bp, Homo sapiens
gatctggtgcgtgtggc

SEQ ID NO: 4832051 - DNA, 18 bp, Homo sapiens
gatctggtgcgtgtggcc

SEQ ID NO: 4832052 - DNA, 22 bp, Homo sapiens
gatctggtgcgtgtggccctgt

SEQ ID NO: 4832053 - DNA, 22 bp, Homo sapiens
gatcttctgtgggtttctaaag

SEQ ID NO: 4832054 - DNA, 17 bp, Homo sapiens
gatcttgcctctttcct

SEQ ID NO: 4832055 - DNA, 13 bp, Homo sapiens
gatgaaatgccaa

SEQ ID NO: 4832056 - DNA, 14 bp, Homo sapiens
gatgaaatgccaag

SEQ ID NO: 4832057 - DNA, 18 bp, Homo sapiens
gatgaaatgccaagactc

SEQ ID NO: 4832058 - DNA, 15 bp, Homo sapiens
gatgacaaagaaaat

SEQ ID NO: 4832059 - DNA, 20 bp, Homo sapiens
gatgacaaagaaaatgagaa

SEQ ID NO: 4832060 - DNA, 19 bp, Homo sapiens
gatgacagggagctgggga

SEQ ID NO: 4832061 - DNA, 18 bp, Homo sapiens
gatgaccaatctctgtga

SEQ ID NO: 4832062 - DNA, 20 bp, Homo sapiens
gatgacggtattatgcttct

SEQ ID NO: 4832063 - DNA, 16 bp, Homo sapiens
gatgactgaatttcta

SEQ ID NO: 4832064 - DNA, 14 bp, Homo sapiens
gatgaggttgagct

SEQ ID NO: 4832065 - DNA, 20 bp, Homo sapiens
gatgaggttgagctatgata

SEQ ID NO: 4832066 - DNA, 21 bp, Homo sapiens
gatgaggttgagctatgatat

SEQ ID NO: 4832067 - DNA, 15 bp, Homo sapiens
gatgatttaattctt

SEQ ID NO: 4832068 - DNA, 14 bp, Homo sapiens
gatgatttccaagc

SEQ ID NO: 4832069 - DNA, 13 bp, Homo sapiens
gatgcaataaaca

SEQ ID NO: 4832070 - DNA, 14 bp, Homo sapiens
gatgcagccgcctt

SEQ ID NO: 4832071 - DNA, 19 bp, Homo sapiens
gatgcaggaagaccacatg

SEQ ID NO: 4832072 - DNA, 22 bp, Homo sapiens
gatgcaggcaagacaccttccc

SEQ ID NO: 4832073 - DNA, 17 bp, Homo sapiens
gatgcatctgtggcctg

SEQ ID NO: 4832074 - DNA, 17 bp, Homo sapiens
gatgcattttaaatgtc

SEQ ID NO: 4832075 - DNA, 19 bp, Homo sapiens
gatgcccaaagatgcagcc

SEQ ID NO: 4832076 - DNA, 19 bp, Homo sapiens
gatgcgtctacccagactc

SEQ ID NO: 4832077 - DNA, 13 bp, Homo sapiens
gatggagaaggaa

SEQ ID NO: 4832078 - DNA, 21 bp, Homo sapiens
gatggagaggcggcctcgtgc

SEQ ID NO: 4832079 - DNA, 14 bp, Homo sapiens
gatggccaggcctc

SEQ ID NO: 4832080 - DNA, 20 bp, Homo sapiens
gatggcttccgtgagacaca

SEQ ID NO: 4832081 - DNA, 22 bp, Homo sapiens
gatggcttccgtgagacacaag

SEQ ID NO: 4832082 - DNA, 14 bp, Homo sapiens
gatgggaccaggga

SEQ ID NO: 4832083 - DNA, 20 bp, Homo sapiens
gatgggaccagggatggggg

SEQ ID NO: 4832084 - DNA, 23 bp, Homo sapiens
gatggggcggcctgcagaccctg

SEQ ID NO: 4832085 - DNA, 13 bp, Homo sapiens
gatggggtgagaa

SEQ ID NO: 4832086 - DNA, 17 bp, Homo sapiens
gatggggtttcaccatg

SEQ ID NO: 4832087 - DNA, 16 bp, Homo sapiens
gatgggtcctgctgct

SEQ ID NO: 4832088 - DNA, 19 bp, Homo sapiens
gatgggttcccacgtagca

SEQ ID NO: 4832089 - DNA, 17 bp, Homo sapiens
gatggtgtcctgcatgt

SEQ ID NO: 4832090 - DNA, 14 bp, Homo sapiens
gatggttgctttga

SEQ ID NO: 4832091 - DNA, 23 bp, Homo sapiens
gatgtcaatgctatggactgcac

SEQ ID NO: 4832092 - DNA, 16 bp, Homo sapiens
gatgtccctgtcccct

SEQ ID NO: 4832093 - DNA, 17 bp, Homo sapiens
gatgtgtcttcaatttg

SEQ ID NO: 4832094 - DNA, 12 bp, Homo sapiens
gatgtgttcttt

SEQ ID NO: 4832095 - DNA, 19 bp, Homo sapiens
gatgttattttgtacgtgt

SEQ ID NO: 4832096 - DNA, 21 bp, Homo sapiens
gatgttcaacttaatgaagaa

SEQ ID NO: 4832097 - DNA, 18 bp, Homo sapiens
gatgttctagcatggctg

SEQ ID NO: 4832098 - DNA, 21 bp, Homo sapiens
gatgttctttcacccttttct

SEQ ID NO: 4832099 - DNA, 14 bp, Homo sapiens
gatgtttagtagct

SEQ ID NO: 4832100 - DNA, 17 bp, Homo sapiens
gatgtttagtagctgat

SEQ ID NO: 4832101 - DNA, 17 bp, Homo sapiens
gatgtttggcaagaaat

SEQ ID NO: 4832102 - DNA, 14 bp, Homo sapiens
gattaaactgggaa

SEQ ID NO: 4832103 - DNA, 18 bp, Homo sapiens
gattaaattatcattgtt

SEQ ID NO: 4832104 - DNA, 16 bp, Homo sapiens
gattaaggactacaga

SEQ ID NO: 4832105 - DNA, 18 bp, Homo sapiens
gattaaggactacagaat

SEQ ID NO: 4832106 - DNA, 16 bp, Homo sapiens
gattaatttgtgtaga

SEQ ID NO: 4832107 - DNA, 23 bp, Homo sapiens
gattaatttgtgtagattgtgta

SEQ ID NO: 4832108 - DNA, 15 bp, Homo sapiens
gattagtaagatctc

SEQ ID NO: 4832109 - DNA, 18 bp, Homo sapiens
gattatatacaaagctgt

SEQ ID NO: 4832110 - DNA, 13 bp, Homo sapiens
gattattacaaca

SEQ ID NO: 4832111 - DNA, 13 bp, Homo sapiens
gattatttacaag

SEQ ID NO: 4832112 - DNA, 14 bp, Homo sapiens
gattattttctata

SEQ ID NO: 4832113 - DNA, 17 bp, Homo sapiens
gattcaaataaccctga

SEQ ID NO: 4832114 - DNA, 14 bp, Homo sapiens
gattcaaatttatt

SEQ ID NO: 4832115 - DNA, 19 bp, Homo sapiens
gattcaacaggttttcctg

SEQ ID NO: 4832116 - DNA, 20 bp, Homo sapiens
gattcaatcattttgggaaa

SEQ ID NO: 4832117 - DNA, 15 bp, Homo sapiens
gattcaggaatgggc

SEQ ID NO: 4832118 - DNA, 18 bp, Homo sapiens
gattcatttttgaaactg

SEQ ID NO: 4832119 - DNA, 19 bp, Homo sapiens
gattccagagcactgctcc

SEQ ID NO: 4832120 - DNA, 22 bp, Homo sapiens
gattcccgtggctttgtgctta

SEQ ID NO: 4832121 - DNA, 19 bp, Homo sapiens
gattcctacttaaacaaaa

SEQ ID NO: 4832122 - DNA, 21 bp, Homo sapiens
gattcctacttaaacaaaaac

SEQ ID NO: 4832123 - DNA, 18 bp, Homo sapiens
gattctaaaggggacaga

SEQ ID NO: 4832124 - DNA, 24 bp, Homo sapiens
gattctaaaggggacagatcttga

SEQ ID NO: 4832125 - DNA, 13 bp, Homo sapiens
gattctcttctca

SEQ ID NO: 4832126 - DNA, 17 bp, Homo sapiens
gattctgggatgctcct

SEQ ID NO: 4832127 - DNA, 12 bp, Homo sapiens
gattcttccttg

SEQ ID NO: 4832128 - DNA, 22 bp, Homo sapiens
gattcttttcccatcaccagaa

SEQ ID NO: 4832129 - DNA, 19 bp, Homo sapiens
gattcttttttcaatgtac

SEQ ID NO: 4832130 - DNA, 22 bp, Homo sapiens
gattcttttttcaatgtactgt

SEQ ID NO: 4832131 - DNA, 12 bp, Homo sapiens
gattgacatttt

SEQ ID NO: 4832132 - DNA, 19 bp, Homo sapiens
gattggaaaataataaaag

SEQ ID NO: 4832133 - DNA, 20 bp, Homo sapiens
gattggaaaataataaaaga

SEQ ID NO: 4832134 - DNA, 17 bp, Homo sapiens
gattgggggggcttggg

SEQ ID NO: 4832135 - DNA, 16 bp, Homo sapiens
gattggtaccagagcc

SEQ ID NO: 4832136 - DNA, 22 bp, Homo sapiens
gattgtacagaatcattgctta

SEQ ID NO: 4832137 - DNA, 20 bp, Homo sapiens
gattgtacatatggaaatcc

SEQ ID NO: 4832138 - DNA, 19 bp, Homo sapiens
gattgtattgtgagatcct

SEQ ID NO: 4832139 - DNA, 17 bp, Homo sapiens
gattgtccacaaatgtc

SEQ ID NO: 4832140 - DNA, 13 bp, Homo sapiens
gattgtctgctgc

SEQ ID NO: 4832141 - DNA, 14 bp, Homo sapiens
gattgtctgctgcc

SEQ ID NO: 4832142 - DNA, 22 bp, Homo sapiens
gattgtctgctgcctccaagtc

SEQ ID NO: 4832143 - DNA, 14 bp, Homo sapiens
gattgttattaaat

SEQ ID NO: 4832144 - DNA, 16 bp, Homo sapiens
gattgttattaaatgt

SEQ ID NO: 4832145 - DNA, 22 bp, Homo sapiens
gattgtttgatgaataaaatgt

SEQ ID NO: 4832146 - DNA, 14 bp, Homo sapiens
gatttaaactctta

SEQ ID NO: 4832147 - DNA, 23 bp, Homo sapiens
gatttaggcttctatgtccaaca

SEQ ID NO: 4832148 - DNA, 14 bp, Homo sapiens
gatttattatgaac

SEQ ID NO: 4832149 - DNA, 15 bp, Homo sapiens
gatttattttttgta

SEQ ID NO: 4832150 - DNA, 15 bp, Homo sapiens
gatttcatgattaga

SEQ ID NO: 4832151 - DNA, 19 bp, Homo sapiens
gatttcatgattagacaat

SEQ ID NO: 4832152 - DNA, 14 bp, Homo sapiens
gatttccaagcctc

SEQ ID NO: 4832153 - DNA, 18 bp, Homo sapiens
gatttcctttgacctctc

SEQ ID NO: 4832154 - DNA, 16 bp, Homo sapiens
gatttggggtgatttc

SEQ ID NO: 4832155 - DNA, 13 bp, Homo sapiens
gatttgtatttat

SEQ ID NO: 4832156 - DNA, 15 bp, Homo sapiens
gatttgtatttatat

SEQ ID NO: 4832157 - DNA, 16 bp, Homo sapiens
gatttgtatttatatt

SEQ ID NO: 4832158 - DNA, 17 bp, Homo sapiens
gatttgtatttatatta

SEQ ID NO: 4832159 - DNA, 15 bp, Homo sapiens
gattttcatgttctt

SEQ ID NO: 4832160 - DNA, 22 bp, Homo sapiens
gatttttgccctgcgtcccttc

SEQ ID NO: 4832161 - DNA, 19 bp, Homo sapiens
gcaaaacacaaaacaaatc

SEQ ID NO: 4832162 - DNA, 16 bp, Homo sapiens
gcaaaaccattgcttc

SEQ ID NO: 4832163 - DNA, 18 bp, Homo sapiens
gcaaaaccattgcttcac

SEQ ID NO: 4832164 - DNA, 21 bp, Homo sapiens
gcaaacacacagactctgtga

SEQ ID NO: 4832165 - DNA, 16 bp, Homo sapiens
gcaaacactgtgtatt

SEQ ID NO: 4832166 - DNA, 15 bp, Homo sapiens
gcaaaccaatttgtt

SEQ ID NO: 4832167 - DNA, 16 bp, Homo sapiens
gcaaaccaggctgcag

SEQ ID NO: 4832168 - DNA, 14 bp, Homo sapiens
gcaaactgaaatta

SEQ ID NO: 4832169 - DNA, 19 bp, Homo sapiens
gcaaactgaaattagtgtt

SEQ ID NO: 4832170 - DNA, 19 bp, Homo sapiens
gcaaagatccagcggggct

SEQ ID NO: 4832171 - DNA, 21 bp, Homo sapiens
gcaaagatccagcggggcttc

SEQ ID NO: 4832172 - DNA, 15 bp, Homo sapiens
gcaaagatggcttcc

SEQ ID NO: 4832173 - DNA, 19 bp, Homo sapiens
gcaaagcatttgagctgtg

SEQ ID NO: 4832174 - DNA, 19 bp, Homo sapiens
gcaaatgaaggaatgcaat

SEQ ID NO: 4832175 - DNA, 22 bp, Homo sapiens
gcaaatttctagatatgagaaa

SEQ ID NO: 4832176 - DNA, 15 bp, Homo sapiens
gcaacagactgcctt

SEQ ID NO: 4832177 - DNA, 19 bp, Homo sapiens
gcaacaggaccaggagcca

SEQ ID NO: 4832178 - DNA, 16 bp, Homo sapiens
gcaaccaccaccaacc

SEQ ID NO: 4832179 - DNA, 17 bp, Homo sapiens
gcaaccctacagtatat

SEQ ID NO: 4832180 - DNA, 22 bp, Homo sapiens
gcaaccctggtgaccagcacca

SEQ ID NO: 4832181 - DNA, 13 bp, Homo sapiens
gcaacctccacct

SEQ ID NO: 4832182 - DNA, 20 bp, Homo sapiens
gcaacctgttcttcctacca

SEQ ID NO: 4832183 - DNA, 19 bp, Homo sapiens
gcaacttcagtcctgggag

SEQ ID NO: 4832184 - DNA, 16 bp, Homo sapiens
gcaacttgagggacga

SEQ ID NO: 4832185 - DNA, 18 bp, Homo sapiens
gcaacttgagggacgact

SEQ ID NO: 4832186 - DNA, 15 bp, Homo sapiens
gcaagacaccttccc

SEQ ID NO: 4832187 - DNA, 19 bp, Homo sapiens
gcaagacaccttcccagct

SEQ ID NO: 4832188 - DNA, 23 bp, Homo sapiens
gcaagctcatagcacatgtttta

SEQ ID NO: 4832189 - DNA, 11 bp, Homo sapiens
gcaaggatcac

SEQ ID NO: 4832190 - DNA, 14 bp, Homo sapiens
gcaaggcccacagg

SEQ ID NO: 4832191 - DNA, 14 bp, Homo sapiens
gcaaggggccagga

SEQ ID NO: 4832192 - DNA, 19 bp, Homo sapiens
gcaaggggccaggaagggg

SEQ ID NO: 4832193 - DNA, 22 bp, Homo sapiens
gcaaggtattggtaggttactc

SEQ ID NO: 4832194 - DNA, 15 bp, Homo sapiens
gcaataaactcagtc

SEQ ID NO: 4832195 - DNA, 17 bp, Homo sapiens
gcaataaggatttattc

SEQ ID NO: 4832196 - DNA, 20 bp, Homo sapiens
gcaataaggatttattctca

SEQ ID NO: 4832197 - DNA, 17 bp, Homo sapiens
gcaatcctgcaagaaca

SEQ ID NO: 4832198 - DNA, 16 bp, Homo sapiens
gcaatctgtccagaca

SEQ ID NO: 4832199 - DNA, 15 bp, Homo sapiens
gcaatgtatcccttc

SEQ ID NO: 4832200 - DNA, 22 bp, Homo sapiens
gcaatgtatcccttctcacagc

SEQ ID NO: 4832201 - DNA, 20 bp, Homo sapiens
gcaatgttccgttcatctga

SEQ ID NO: 4832202 - DNA, 18 bp, Homo sapiens
gcaattctaagtgagatg

SEQ ID NO: 4832203 - DNA, 19 bp, Homo sapiens
gcaattgtttaagaatcat

SEQ ID NO: 4832204 - DNA, 22 bp, Homo sapiens
gcaattgtttaagaatcatgga

SEQ ID NO: 4832205 - DNA, 18 bp, Homo sapiens
gcacaaaaaatttaagag

SEQ ID NO: 4832206 - DNA, 14 bp, Homo sapiens
gcacaaacagaggc

SEQ ID NO: 4832207 - DNA, 21 bp, Homo sapiens
gcacaaaccttcttttcaatg

SEQ ID NO: 4832208 - DNA, 23 bp, Homo sapiens
gcacaaaccttcttttcaatgca

SEQ ID NO: 4832209 - DNA, 17 bp, Homo sapiens
gcacaaagcactggcct

SEQ ID NO: 4832210 - DNA, 19 bp, Homo sapiens
gcacaaagcactggccttg

SEQ ID NO: 4832211 - DNA, 18 bp, Homo sapiens
gcacacaattagatttct

SEQ ID NO: 4832212 - DNA, 14 bp, Homo sapiens
gcacacacctgcct

SEQ ID NO: 4832213 - DNA, 12 bp, Homo sapiens
gcacacagcagc

SEQ ID NO: 4832214 - DNA, 13 bp, Homo sapiens
gcacacagcagcc

SEQ ID NO: 4832215 - DNA, 20 bp, Homo sapiens
gcacacagcagccccccagc

SEQ ID NO: 4832216 - DNA, 13 bp, Homo sapiens
gcacacataacac

SEQ ID NO: 4832217 - DNA, 17 bp, Homo sapiens
gcacacataacacacat

SEQ ID NO: 4832218 - DNA, 14 bp, Homo sapiens
gcacacattgtgtt

SEQ ID NO: 4832219 - DNA, 20 bp, Homo sapiens
gcacaccctcactctgccag

SEQ ID NO: 4832220 - DNA, 22 bp, Homo sapiens
gcacactgagtttgaacacaga

SEQ ID NO: 4832221 - DNA, 18 bp, Homo sapiens
gcacactgccctctgcca

SEQ ID NO: 4832222 - DNA, 13 bp, Homo sapiens
gcacagcagcctg

SEQ ID NO: 4832223 - DNA, 18 bp, Homo sapiens
gcacaggaaaaggtagct

SEQ ID NO: 4832224 - DNA, 16 bp, Homo sapiens
gcacaggactgattct

SEQ ID NO: 4832225 - DNA, 21 bp, Homo sapiens
gcacaggactgattctgggat

SEQ ID NO: 4832226 - DNA, 15 bp, Homo sapiens
gcacaggtgtaaata

SEQ ID NO: 4832227 - DNA, 16 bp, Homo sapiens
gcacaggtgtaaatat

SEQ ID NO: 4832228 - DNA, 19 bp, Homo sapiens
gcacatagcataggctggg

SEQ ID NO: 4832229 - DNA, 13 bp, Homo sapiens
gcacatgctggcc

SEQ ID NO: 4832230 - DNA, 16 bp, Homo sapiens
gcacatgctggccagc

SEQ ID NO: 4832231 - DNA, 13 bp, Homo sapiens
gcacatgtattct

SEQ ID NO: 4832232 - DNA, 22 bp, Homo sapiens
gcacatgtattctgttggccag

SEQ ID NO: 4832233 - DNA, 15 bp, Homo sapiens
gcacatgttttacaa

SEQ ID NO: 4832234 - DNA, 19 bp, Homo sapiens
gcacatttgttaatgattc

SEQ ID NO: 4832235 - DNA, 21 bp, Homo sapiens
gcaccacggcgtttttttaca

SEQ ID NO: 4832236 - DNA, 15 bp, Homo sapiens
gcaccacggggtcgg

SEQ ID NO: 4832237 - DNA, 17 bp, Homo sapiens
gcaccagatgcaacctc

SEQ ID NO: 4832238 - DNA, 15 bp, Homo sapiens
gcaccagcctgagcc

SEQ ID NO: 4832239 - DNA, 17 bp, Homo sapiens
gcaccagcctgagccac

SEQ ID NO: 4832240 - DNA, 18 bp, Homo sapiens
gcaccagcctgagccaca

SEQ ID NO: 4832241 - DNA, 15 bp, Homo sapiens
gcaccatctctcctc

SEQ ID NO: 4832242 - DNA, 15 bp, Homo sapiens
gcacccaccactctc

SEQ ID NO: 4832243 - DNA, 14 bp, Homo sapiens
gcacccacccctgc

SEQ ID NO: 4832244 - DNA, 12 bp, Homo sapiens
gcacccactgga

SEQ ID NO: 4832245 - DNA, 13 bp, Homo sapiens
gcacccagcccaa

SEQ ID NO: 4832246 - DNA, 12 bp, Homo sapiens
gcacccccagcc

SEQ ID NO: 4832247 - DNA, 14 bp, Homo sapiens
gcacccccagcctc

SEQ ID NO: 4832248 - DNA, 21 bp, Homo sapiens
gcacccccagcctcccccagg

SEQ ID NO: 4832249 - DNA, 15 bp, Homo sapiens
gcacccccggacgcc

SEQ ID NO: 4832250 - DNA, 23 bp, Homo sapiens
gcaccccgatgtggacctctact

SEQ ID NO: 4832251 - DNA, 15 bp, Homo sapiens
gcacccgccctttcc

SEQ ID NO: 4832252 - DNA, 18 bp, Homo sapiens
gcaccctccacaggagcc

SEQ ID NO: 4832253 - DNA, 19 bp, Homo sapiens
gcaccctccacaggagccg

SEQ ID NO: 4832254 - DNA, 22 bp, Homo sapiens
gcaccctctgctatgtctgtga

SEQ ID NO: 4832255 - DNA, 15 bp, Homo sapiens
gcaccgcccaacccc

SEQ ID NO: 4832256 - DNA, 20 bp, Homo sapiens
gcaccgcccaacccccacct

SEQ ID NO: 4832257 - DNA, 22 bp, Homo sapiens
gcaccgcccaacccccacctcc

SEQ ID NO: 4832258 - DNA, 23 bp, Homo sapiens
gcaccgcccaacccccacctccc

SEQ ID NO: 4832259 - DNA, 15 bp, Homo sapiens
gcaccgcccacccac

SEQ ID NO: 4832260 - DNA, 16 bp, Homo sapiens
gcaccggacgctggag

SEQ ID NO: 4832261 - DNA, 19 bp, Homo sapiens
gcaccggacgctggagacc

SEQ ID NO: 4832262 - DNA, 13 bp, Homo sapiens
gcaccgggctggc

SEQ ID NO: 4832263 - DNA, 21 bp, Homo sapiens
gcaccgggctggcctgacaca

SEQ ID NO: 4832264 - DNA, 21 bp, Homo sapiens
gcaccgtggtgtgaggccccc

SEQ ID NO: 4832265 - DNA, 13 bp, Homo sapiens
gcacctcttgaag

SEQ ID NO: 4832266 - DNA, 14 bp, Homo sapiens
gcacctgcttctca

SEQ ID NO: 4832267 - DNA, 13 bp, Homo sapiens
gcacgggagagcg

SEQ ID NO: 4832268 - DNA, 15 bp, Homo sapiens
gcacgggagagcgcc

SEQ ID NO: 4832269 - DNA, 20 bp, Homo sapiens
gcactaaggccgtgtctctg

SEQ ID NO: 4832270 - DNA, 17 bp, Homo sapiens
gcactagaatgagaaat

SEQ ID NO: 4832271 - DNA, 19 bp, Homo sapiens
gcactagaatgagaaatca

SEQ ID NO: 4832272 - DNA, 13 bp, Homo sapiens
gcactcaggagca

SEQ ID NO: 4832273 - DNA, 21 bp, Homo sapiens
gcactcaggagcacagccata

SEQ ID NO: 4832274 - DNA, 13 bp, Homo sapiens
gcactcccagggc

SEQ ID NO: 4832275 - DNA, 18 bp, Homo sapiens
gcactcccagggcccgag

SEQ ID NO: 4832276 - DNA, 21 bp, Homo sapiens
gcactcccagggcccgagcgc

SEQ ID NO: 4832277 - DNA, 19 bp, Homo sapiens
gcactcttttgagcagtaa

SEQ ID NO: 4832278 - DNA, 14 bp, Homo sapiens
gcactgaaaaggtt

SEQ ID NO: 4832279 - DNA, 20 bp, Homo sapiens
gcactgaaaataccatcagg

SEQ ID NO: 4832280 - DNA, 14 bp, Homo sapiens
gcactgacccttcc

SEQ ID NO: 4832281 - DNA, 16 bp, Homo sapiens
gcactgacccttccag

SEQ ID NO: 4832282 - DNA, 21 bp, Homo sapiens
gcactgacccttccagacata

SEQ ID NO: 4832283 - DNA, 13 bp, Homo sapiens
gcactggccttgc

SEQ ID NO: 4832284 - DNA, 12 bp, Homo sapiens
gcactgggcttg

SEQ ID NO: 4832285 - DNA, 22 bp, Homo sapiens
gcactgggcttggggaccagag

SEQ ID NO: 4832286 - DNA, 21 bp, Homo sapiens
gcactgtcatgcccagcttgg

SEQ ID NO: 4832287 - DNA, 14 bp, Homo sapiens
gcacttcaagcaaa

SEQ ID NO: 4832288 - DNA, 17 bp, Homo sapiens
gcactttgggaggctga

SEQ ID NO: 4832289 - DNA, 16 bp, Homo sapiens
gcacttttgagctcct

SEQ ID NO: 4832290 - DNA, 21 bp, Homo sapiens
gcacttttgagctcctaagct

SEQ ID NO: 4832291 - DNA, 23 bp, Homo sapiens
gcacttttgagctcctaagctgc

SEQ ID NO: 4832292 - DNA, 16 bp, Homo sapiens
gcagaaatgtgctgca

SEQ ID NO: 4832293 - DNA, 12 bp, Homo sapiens
gcagaaggaaga

SEQ ID NO: 4832294 - DNA, 14 bp, Homo sapiens
gcagaaggaagact

SEQ ID NO: 4832295 - DNA, 16 bp, Homo sapiens
gcagaaggaaggcagg

SEQ ID NO: 4832296 - DNA, 22 bp, Homo sapiens
gcagaaggaaggcagggaggag

SEQ ID NO: 4832297 - DNA, 22 bp, Homo sapiens
gcagaataaaccggatcctgtt

SEQ ID NO: 4832298 - DNA, 22 bp, Homo sapiens
gcagaatggtgggctccagagt

SEQ ID NO: 4832299 - DNA, 14 bp, Homo sapiens
gcagaattcattca

SEQ ID NO: 4832300 - DNA, 21 bp, Homo sapiens
gcagaattcattcatacttaa

SEQ ID NO: 4832301 - DNA, 21 bp, Homo sapiens
gcagacagggcgtcctctcgt

SEQ ID NO: 4832302 - DNA, 16 bp, Homo sapiens
gcagaccctgccaggg

SEQ ID NO: 4832303 - DNA, 16 bp, Homo sapiens
gcagacggggggctgc

SEQ ID NO: 4832304 - DNA, 21 bp, Homo sapiens
gcagactttctacatgcaaat

SEQ ID NO: 4832305 - DNA, 19 bp, Homo sapiens
gcagagacctcctgatgtc

SEQ ID NO: 4832306 - DNA, 14 bp, Homo sapiens
gcagagacggcagc

SEQ ID NO: 4832307 - DNA, 19 bp, Homo sapiens
gcagagacggcagccccat

SEQ ID NO: 4832308 - DNA, 18 bp, Homo sapiens
gcagagaggggaggtggg

SEQ ID NO: 4832309 - DNA, 18 bp, Homo sapiens
gcagagattgggggggct

SEQ ID NO: 4832310 - DNA, 20 bp, Homo sapiens
gcagagattgggggggcttg

SEQ ID NO: 4832311 - DNA, 14 bp, Homo sapiens
gcagagccccggag

SEQ ID NO: 4832312 - DNA, 19 bp, Homo sapiens
gcagagccccggagcacca

SEQ ID NO: 4832313 - DNA, 22 bp, Homo sapiens
gcagagcccgcccacctgggcc

SEQ ID NO: 4832314 - DNA, 15 bp, Homo sapiens
gcagagcgcagcccc

SEQ ID NO: 4832315 - DNA, 22 bp, Homo sapiens
gcagagctgagtcggctgggca

SEQ ID NO: 4832316 - DNA, 21 bp, Homo sapiens
gcagaggaaagcaaaggagat

SEQ ID NO: 4832317 - DNA, 12 bp, Homo sapiens
gcagaggcaggg

SEQ ID NO: 4832318 - DNA, 13 bp, Homo sapiens
gcagaggcagggc

SEQ ID NO: 4832319 - DNA, 14 bp, Homo sapiens
gcagaggcagggcc

SEQ ID NO: 4832320 - DNA, 21 bp, Homo sapiens
gcagaggcccgaggcaccgga

SEQ ID NO: 4832321 - DNA, 17 bp, Homo sapiens
gcagagggatgaaatgc

SEQ ID NO: 4832322 - DNA, 23 bp, Homo sapiens
gcagaggtggggtgctggggctg

SEQ ID NO: 4832323 - DNA, 16 bp, Homo sapiens
gcagagttgaagacag

SEQ ID NO: 4832324 - DNA, 21 bp, Homo sapiens
gcagagttgaagacagagcta

SEQ ID NO: 4832325 - DNA, 14 bp, Homo sapiens
gcagatctagccag

SEQ ID NO: 4832326 - DNA, 22 bp, Homo sapiens
gcagatctagccaggcctcccg

SEQ ID NO: 4832327 - DNA, 18 bp, Homo sapiens
gcagatggagaccccttg

SEQ ID NO: 4832328 - DNA, 19 bp, Homo sapiens
gcagatgggggcctctctg

SEQ ID NO: 4832329 - DNA, 19 bp, Homo sapiens
gcagcaacaggaccaggag

SEQ ID NO: 4832330 - DNA, 15 bp, Homo sapiens
gcagcaccagcctga

SEQ ID NO: 4832331 - DNA, 17 bp, Homo sapiens
gcagcaccagcctgagc

SEQ ID NO: 4832332 - DNA, 19 bp, Homo sapiens
gcagcaccagcctgagcca

SEQ ID NO: 4832333 - DNA, 21 bp, Homo sapiens
gcagcagtaccatcccactga

SEQ ID NO: 4832334 - DNA, 14 bp, Homo sapiens
gcagccactattgt

SEQ ID NO: 4832335 - DNA, 22 bp, Homo sapiens
gcagcccagaacgggcctcccc

SEQ ID NO: 4832336 - DNA, 23 bp, Homo sapiens
gcagcccagaacgggcctccccg

SEQ ID NO: 4832337 - DNA, 12 bp, Homo sapiens
gcagcccagaga

SEQ ID NO: 4832338 - DNA, 23 bp, Homo sapiens
gcagcccagagagaccctgccaa

SEQ ID NO: 4832339 - DNA, 14 bp, Homo sapiens
gcagcccccacgcc

SEQ ID NO: 4832340 - DNA, 21 bp, Homo sapiens
gcagccccgcgaccacccctg

SEQ ID NO: 4832341 - DNA, 14 bp, Homo sapiens
gcagcccctgctgg

SEQ ID NO: 4832342 - DNA, 15 bp, Homo sapiens
gcagcccctgctgga

SEQ ID NO: 4832343 - DNA, 18 bp, Homo sapiens
gcagcccctgctggacca

SEQ ID NO: 4832344 - DNA, 22 bp, Homo sapiens
gcagcccctgctggaccaaggt

SEQ ID NO: 4832345 - DNA, 21 bp, Homo sapiens
gcagcccctgttctggcagag

SEQ ID NO: 4832346 - DNA, 20 bp, Homo sapiens
gcagcccgatgtccctgtcc

SEQ ID NO: 4832347 - DNA, 18 bp, Homo sapiens
gcagccgccttccttgac

SEQ ID NO: 4832348 - DNA, 14 bp, Homo sapiens
gcagccgcgctctg

SEQ ID NO: 4832349 - DNA, 17 bp, Homo sapiens
gcagccgcgctctgccc

SEQ ID NO: 4832350 - DNA, 14 bp, Homo sapiens
gcagcctctgaagt

SEQ ID NO: 4832351 - DNA, 13 bp, Homo sapiens
gcagcggcccaga

SEQ ID NO: 4832352 - DNA, 14 bp, Homo sapiens
gcagcggcccagat

SEQ ID NO: 4832353 - DNA, 19 bp, Homo sapiens
gcagctaatttgtgaaagt

SEQ ID NO: 4832354 - DNA, 17 bp, Homo sapiens
gcagctattcacacaca

SEQ ID NO: 4832355 - DNA, 18 bp, Homo sapiens
gcagctattcacacacac

SEQ ID NO: 4832356 - DNA, 21 bp, Homo sapiens
gcagctccggaaggacacagt

SEQ ID NO: 4832357 - DNA, 19 bp, Homo sapiens
gcagctggggggctgtcct

SEQ ID NO: 4832358 - DNA, 20 bp, Homo sapiens
gcagctggggggctgtcctg

SEQ ID NO: 4832359 - DNA, 23 bp, Homo sapiens
gcagctttgaggctggcggggtc

SEQ ID NO: 4832360 - DNA, 22 bp, Homo sapiens
gcaggaaagatcccaagtcaaa

SEQ ID NO: 4832361 - DNA, 21 bp, Homo sapiens
gcaggaaatgagagatagagg

SEQ ID NO: 4832362 - DNA, 17 bp, Homo sapiens
gcaggaaccgaggactc

SEQ ID NO: 4832363 - DNA, 14 bp, Homo sapiens
gcaggaagaccaca

SEQ ID NO: 4832364 - DNA, 13 bp, Homo sapiens
gcaggaaggcctg

SEQ ID NO: 4832365 - DNA, 14 bp, Homo sapiens
gcaggaaggcctgg

SEQ ID NO: 4832366 - DNA, 17 bp, Homo sapiens
gcaggaagtcaggagcc

SEQ ID NO: 4832367 - DNA, 17 bp, Homo sapiens
gcaggagtgggctctga

SEQ ID NO: 4832368 - DNA, 21 bp, Homo sapiens
gcaggcaagacaccttcccag

SEQ ID NO: 4832369 - DNA, 11 bp, Homo sapiens
gcaggccctgc

SEQ ID NO: 4832370 - DNA, 13 bp, Homo sapiens
gcaggccctgcag

SEQ ID NO: 4832371 - DNA, 22 bp, Homo sapiens
gcaggctcgggctccccagccc

SEQ ID NO: 4832372 - DNA, 13 bp, Homo sapiens
gcaggctctcagg

SEQ ID NO: 4832373 - DNA, 17 bp, Homo sapiens
gcaggctctcaggccag

SEQ ID NO: 4832374 - DNA, 18 bp, Homo sapiens
gcaggctctcaggccagc

SEQ ID NO: 4832375 - DNA, 22 bp, Homo sapiens
gcaggctctcaggccagctgct

SEQ ID NO: 4832376 - DNA, 23 bp, Homo sapiens
gcaggctctcaggccagctgctt

SEQ ID NO: 4832377 - DNA, 14 bp, Homo sapiens
gcagggacagcctg

SEQ ID NO: 4832378 - DNA, 15 bp, Homo sapiens
gcagggaggtcaggc

SEQ ID NO: 4832379 - DNA, 21 bp, Homo sapiens
gcagggccctgaaatggcctg

SEQ ID NO: 4832380 - DNA, 15 bp, Homo sapiens
gcagggccctggggt

SEQ ID NO: 4832381 - DNA, 17 bp, Homo sapiens
gcagggccctggggtct

SEQ ID NO: 4832382 - DNA, 20 bp, Homo sapiens
gcagggccctggggtctctg

SEQ ID NO: 4832383 - DNA, 14 bp, Homo sapiens
gcagggcgctccgg

SEQ ID NO: 4832384 - DNA, 17 bp, Homo sapiens
gcagggcgctccggcag

SEQ ID NO: 4832385 - DNA, 16 bp, Homo sapiens
gcagggcgggccagga

SEQ ID NO: 4832386 - DNA, 19 bp, Homo sapiens
gcagggcgggccaggagaa

SEQ ID NO: 4832387 - DNA, 18 bp, Homo sapiens
gcaggggccgtgcagggc

SEQ ID NO: 4832388 - DNA, 21 bp, Homo sapiens
gcaggggggttgggttccaga

SEQ ID NO: 4832389 - DNA, 13 bp, Homo sapiens
gcagggttctaga

SEQ ID NO: 4832390 - DNA, 14 bp, Homo sapiens
gcagggttctagaa

SEQ ID NO: 4832391 - DNA, 17 bp, Homo sapiens
gcagggttctagaaggg

SEQ ID NO: 4832392 - DNA, 12 bp, Homo sapiens
gcaggtgccatc

SEQ ID NO: 4832393 - DNA, 14 bp, Homo sapiens
gcaggttggacccc

SEQ ID NO: 4832394 - DNA, 15 bp, Homo sapiens
gcaggttggacccca

SEQ ID NO: 4832395 - DNA, 18 bp, Homo sapiens
gcaggttggaccccagag

SEQ ID NO: 4832396 - DNA, 17 bp, Homo sapiens
gcagtacatcttgtgca

SEQ ID NO: 4832397 - DNA, 18 bp, Homo sapiens
gcagtacatcttgtgcat

SEQ ID NO: 4832398 - DNA, 17 bp, Homo sapiens
gcagtaccatcccactg

SEQ ID NO: 4832399 - DNA, 13 bp, Homo sapiens
gcagtagagagca

SEQ ID NO: 4832400 - DNA, 11 bp, Homo sapiens
gcagtcagact

SEQ ID NO: 4832401 - DNA, 17 bp, Homo sapiens
gcagtcatcaacaaaag

SEQ ID NO: 4832402 - DNA, 14 bp, Homo sapiens
gcagtcatcagaag

SEQ ID NO: 4832403 - DNA, 20 bp, Homo sapiens
gcagtccatttttgagtaaa

SEQ ID NO: 4832404 - DNA, 18 bp, Homo sapiens
gcagtcctcggcagctcc

SEQ ID NO: 4832405 - DNA, 13 bp, Homo sapiens
gcagtctccgctc

SEQ ID NO: 4832406 - DNA, 16 bp, Homo sapiens
gcagtctccgctcccg

SEQ ID NO: 4832407 - DNA, 17 bp, Homo sapiens
gcagtctccgctcccgc

SEQ ID NO: 4832408 - DNA, 14 bp, Homo sapiens
gcagtgaactattt

SEQ ID NO: 4832409 - DNA, 15 bp, Homo sapiens
gcagtgatgtggtgg

SEQ ID NO: 4832410 - DNA, 22 bp, Homo sapiens
gcagtgctagtgagctgggcat

SEQ ID NO: 4832411 - DNA, 14 bp, Homo sapiens
gcagtggagagggg

SEQ ID NO: 4832412 - DNA, 24 bp, Homo sapiens
gcagtggagaggggacttggatag

SEQ ID NO: 4832413 - DNA, 22 bp, Homo sapiens
gcagtggcgcgatctcagctca

SEQ ID NO: 4832414 - DNA, 21 bp, Homo sapiens
gcagttaccgaggagctaaac

SEQ ID NO: 4832415 - DNA, 18 bp, Homo sapiens
gcagttagcacagaggat

SEQ ID NO: 4832416 - DNA, 20 bp, Homo sapiens
gcagttatttaccagaagtt

SEQ ID NO: 4832417 - DNA, 21 bp, Homo sapiens
gcagttgttatattcattctt

SEQ ID NO: 4832418 - DNA, 13 bp, Homo sapiens
gcataacacacta

SEQ ID NO: 4832419 - DNA, 15 bp, Homo sapiens
gcatactctccagga

SEQ ID NO: 4832420 - DNA, 19 bp, Homo sapiens
gcatactgatgagacaaca

SEQ ID NO: 4832421 - DNA, 14 bp, Homo sapiens
gcatatataaaaca

SEQ ID NO: 4832422 - DNA, 13 bp, Homo sapiens
gcatattgataat

SEQ ID NO: 4832423 - DNA, 19 bp, Homo sapiens
gcatcccacgatcggcctt

SEQ ID NO: 4832424 - DNA, 17 bp, Homo sapiens
gcatccctccaccccag

SEQ ID NO: 4832425 - DNA, 22 bp, Homo sapiens
gcatcccttggcccctctctgt

SEQ ID NO: 4832426 - DNA, 16 bp, Homo sapiens
gcatccgagcccctgt

SEQ ID NO: 4832427 - DNA, 15 bp, Homo sapiens
gcatcctcagcccca

SEQ ID NO: 4832428 - DNA, 14 bp, Homo sapiens
gcatcctggaaatt

SEQ ID NO: 4832429 - DNA, 20 bp, Homo sapiens
gcatctatctggtgatttct

SEQ ID NO: 4832430 - DNA, 19 bp, Homo sapiens
gcatctggcctatgaccct

SEQ ID NO: 4832431 - DNA, 13 bp, Homo sapiens
gcatctggcctgg

SEQ ID NO: 4832432 - DNA, 16 bp, Homo sapiens
gcatctggcctggggg

SEQ ID NO: 4832433 - DNA, 17 bp, Homo sapiens
gcatctgtggcctgggg

SEQ ID NO: 4832434 - DNA, 13 bp, Homo sapiens
gcatgaagataaa

SEQ ID NO: 4832435 - DNA, 22 bp, Homo sapiens
gcatgagctccctcgctgtatg

SEQ ID NO: 4832436 - DNA, 16 bp, Homo sapiens
gcatgagttctgcaca

SEQ ID NO: 4832437 - DNA, 21 bp, Homo sapiens
gcatgagttctgcacatacag

SEQ ID NO: 4832438 - DNA, 16 bp, Homo sapiens
gcatgcccaaatataa

SEQ ID NO: 4832439 - DNA, 21 bp, Homo sapiens
gcatgcctctgatatgggact

SEQ ID NO: 4832440 - DNA, 14 bp, Homo sapiens
gcatgcctggacaa

SEQ ID NO: 4832441 - DNA, 11 bp, Homo sapiens
gcatgctcagt

SEQ ID NO: 4832442 - DNA, 15 bp, Homo sapiens
gcatgctcagtattg

SEQ ID NO: 4832443 - DNA, 16 bp, Homo sapiens
gcatgctcagtattga

SEQ ID NO: 4832444 - DNA, 20 bp, Homo sapiens
gcatgctccctcatgcagat

SEQ ID NO: 4832445 - DNA, 13 bp, Homo sapiens
gcatgctgcctgc

SEQ ID NO: 4832446 - DNA, 14 bp, Homo sapiens
gcatgctgcctgcc

SEQ ID NO: 4832447 - DNA, 21 bp, Homo sapiens
gcatgcttattagcagctggg

SEQ ID NO: 4832448 - DNA, 23 bp, Homo sapiens
gcatggccgcaacttcccaggcc

SEQ ID NO: 4832449 - DNA, 13 bp, Homo sapiens
gcatggcctccca

SEQ ID NO: 4832450 - DNA, 16 bp, Homo sapiens
gcatggcctcccagcc

SEQ ID NO: 4832451 - DNA, 13 bp, Homo sapiens
gcatgggaatgaa

SEQ ID NO: 4832452 - DNA, 15 bp, Homo sapiens
gcatgggtggagggt

SEQ ID NO: 4832453 - DNA, 19 bp, Homo sapiens
gcatggtaccagccctggg

SEQ ID NO: 4832454 - DNA, 17 bp, Homo sapiens
gcatgtaatattaaatt

SEQ ID NO: 4832455 - DNA, 15 bp, Homo sapiens
gcatgtcacatgaca

SEQ ID NO: 4832456 - DNA, 19 bp, Homo sapiens
gcatgtcggggcccctgcg

SEQ ID NO: 4832457 - DNA, 11 bp, Homo sapiens
gcatgtctgca

SEQ ID NO: 4832458 - DNA, 16 bp, Homo sapiens
gcatgtcttatttaaa

SEQ ID NO: 4832459 - DNA, 22 bp, Homo sapiens
gcatgtgctcagccccagacct

SEQ ID NO: 4832460 - DNA, 22 bp, Homo sapiens
gcattctggggtggggcttgga

SEQ ID NO: 4832461 - DNA, 14 bp, Homo sapiens
gcattgaaataata

SEQ ID NO: 4832462 - DNA, 18 bp, Homo sapiens
gcattgaaataataatat

SEQ ID NO: 4832463 - DNA, 16 bp, Homo sapiens
gcattgaccttcatga

SEQ ID NO: 4832464 - DNA, 17 bp, Homo sapiens
gcattgcactaaaagtg

SEQ ID NO: 4832465 - DNA, 17 bp, Homo sapiens
gcattgctggactgatg

SEQ ID NO: 4832466 - DNA, 23 bp, Homo sapiens
gcattgtggctgtcaaatccatg

SEQ ID NO: 4832467 - DNA, 14 bp, Homo sapiens
gcatttaagaattg

SEQ ID NO: 4832468 - DNA, 16 bp, Homo sapiens
gcatttagcacagtat

SEQ ID NO: 4832469 - DNA, 22 bp, Homo sapiens
gcatttatgcatgagaactaaa

SEQ ID NO: 4832470 - DNA, 23 bp, Homo sapiens
gcatttatgcatgagaactaaat

SEQ ID NO: 4832471 - DNA, 14 bp, Homo sapiens
gcatttcagctgtg

SEQ ID NO: 4832472 - DNA, 21 bp, Homo sapiens
gcatttctttttaggctctga

SEQ ID NO: 4832473 - DNA, 12 bp, Homo sapiens
gcatttgctgaa

SEQ ID NO: 4832474 - DNA, 19 bp, Homo sapiens
gcatttgtgagccaaagag

SEQ ID NO: 4832475 - DNA, 17 bp, Homo sapiens
gcattttaaatgtctat

SEQ ID NO: 4832476 - DNA, 12 bp, Homo sapiens
gcattttaccat

SEQ ID NO: 4832477 - DNA, 20 bp, Homo sapiens
gccaaaaaccttagctccct

SEQ ID NO: 4832478 - DNA, 19 bp, Homo sapiens
gccaaactcacctgcccct

SEQ ID NO: 4832479 - DNA, 21 bp, Homo sapiens
gccaaactcacctgcccctca

SEQ ID NO: 4832480 - DNA, 12 bp, Homo sapiens
gccaaaggaagc

SEQ ID NO: 4832481 - DNA, 21 bp, Homo sapiens
gccaaatatgtttaggaaccg

SEQ ID NO: 4832482 - DNA, 11 bp, Homo sapiens
gccaaatgagt

SEQ ID NO: 4832483 - DNA, 13 bp, Homo sapiens
gccaacttaaacc

SEQ ID NO: 4832484 - DNA, 16 bp, Homo sapiens
gccaactttccagact

SEQ ID NO: 4832485 - DNA, 17 bp, Homo sapiens
gccaactttccagactt

SEQ ID NO: 4832486 - DNA, 18 bp, Homo sapiens
gccaagaattcttaaata

SEQ ID NO: 4832487 - DNA, 12 bp, Homo sapiens
gccaagccaggg

SEQ ID NO: 4832488 - DNA, 19 bp, Homo sapiens
gccaagccagggttccaga

SEQ ID NO: 4832489 - DNA, 14 bp, Homo sapiens
gccaaggcatcccc

SEQ ID NO: 4832490 - DNA, 24 bp, Homo sapiens
gccaaggccaaaggaagcacatgc

SEQ ID NO: 4832491 - DNA, 13 bp, Homo sapiens
gccaagtgtcctg

SEQ ID NO: 4832492 - DNA, 20 bp, Homo sapiens
gccaatgaatcaatgtgctc

SEQ ID NO: 4832493 - DNA, 14 bp, Homo sapiens
gccaattcatctca

SEQ ID NO: 4832494 - DNA, 18 bp, Homo sapiens
gccaatttcaaagaaaac

SEQ ID NO: 4832495 - DNA, 22 bp, Homo sapiens
gccaatttcaaagaaaacagac

SEQ ID NO: 4832496 - DNA, 14 bp, Homo sapiens
gccacaagcacaat

SEQ ID NO: 4832497 - DNA, 15 bp, Homo sapiens
gccacaagcacaatt

SEQ ID NO: 4832498 - DNA, 22 bp, Homo sapiens
gccacaatcactaaatatctag

SEQ ID NO: 4832499 - DNA, 13 bp, Homo sapiens
gccacagtggggc

SEQ ID NO: 4832500 - DNA, 19 bp, Homo sapiens
gccacatggccgctgccca

SEQ ID NO: 4832501 - DNA, 22 bp, Homo sapiens
gccacatggccgctgcccacgt

SEQ ID NO: 4832502 - DNA, 12 bp, Homo sapiens
gccacccacccc

SEQ ID NO: 4832503 - DNA, 22 bp, Homo sapiens
gccacccaccccaagctgctgc

SEQ ID NO: 4832504 - DNA, 19 bp, Homo sapiens
gccacccggatctccaggc

SEQ ID NO: 4832505 - DNA, 23 bp, Homo sapiens
gccacccggatctccaggcccag

SEQ ID NO: 4832506 - DNA, 24 bp, Homo sapiens
gccacccggatctccaggcccagc

SEQ ID NO: 4832507 - DNA, 15 bp, Homo sapiens
gccacgctgtcctct

SEQ ID NO: 4832508 - DNA, 18 bp, Homo sapiens
gccacgctgtcctctcga

SEQ ID NO: 4832509 - DNA, 21 bp, Homo sapiens
gccacgctgtcctctcgagcc

SEQ ID NO: 4832510 - DNA, 15 bp, Homo sapiens
gccacgtggccgctg

SEQ ID NO: 4832511 - DNA, 20 bp, Homo sapiens
gccactattgttagtctctt

SEQ ID NO: 4832512 - DNA, 16 bp, Homo sapiens
gccacttatttccatg

SEQ ID NO: 4832513 - DNA, 17 bp, Homo sapiens
gccagacagagatcaga

SEQ ID NO: 4832514 - DNA, 16 bp, Homo sapiens
gccagaccacgcccct

SEQ ID NO: 4832515 - DNA, 14 bp, Homo sapiens
gccagacttctaaa

SEQ ID NO: 4832516 - DNA, 15 bp, Homo sapiens
gccagacttctaaaa

SEQ ID NO: 4832517 - DNA, 18 bp, Homo sapiens
gccagacttctaaaataa

SEQ ID NO: 4832518 - DNA, 23 bp, Homo sapiens
gccagacttctaaaataaatgtt

SEQ ID NO: 4832519 - DNA, 17 bp, Homo sapiens
gccagagacacaagcct

SEQ ID NO: 4832520 - DNA, 19 bp, Homo sapiens
gccagagacacaagccttc

SEQ ID NO: 4832521 - DNA, 22 bp, Homo sapiens
gccagagacacaagccttcggc

SEQ ID NO: 4832522 - DNA, 15 bp, Homo sapiens
gccagaggagagagg

SEQ ID NO: 4832523 - DNA, 19 bp, Homo sapiens
gccagaggagagaggaccc

SEQ ID NO: 4832524 - DNA, 15 bp, Homo sapiens
gccagagtgtcctgc

SEQ ID NO: 4832525 - DNA, 16 bp, Homo sapiens
gccagagtgtcctgct

SEQ ID NO: 4832526 - DNA, 19 bp, Homo sapiens
gccagagtgtcctgctacc

SEQ ID NO: 4832527 - DNA, 21 bp, Homo sapiens
gccagcaccctctcctggggg

SEQ ID NO: 4832528 - DNA, 22 bp, Homo sapiens
gccagcacgttctccagactct

SEQ ID NO: 4832529 - DNA, 16 bp, Homo sapiens
gccagcaggctctcag

SEQ ID NO: 4832530 - DNA, 18 bp, Homo sapiens
gccagcagggcgggccag

SEQ ID NO: 4832531 - DNA, 22 bp, Homo sapiens
gccagcaggttctctcctgtga

SEQ ID NO: 4832532 - DNA, 23 bp, Homo sapiens
gccagccctgttccgcctcactg

SEQ ID NO: 4832533 - DNA, 22 bp, Homo sapiens
gccagccgagatagccaaggcc

SEQ ID NO: 4832534 - DNA, 19 bp, Homo sapiens
gccagccgccctgggctgt

SEQ ID NO: 4832535 - DNA, 15 bp, Homo sapiens
gccagcctggggcct

SEQ ID NO: 4832536 - DNA, 17 bp, Homo sapiens
gccagcctggggcctgg

SEQ ID NO: 4832537 - DNA, 18 bp, Homo sapiens
gccagctctgagcagaca

SEQ ID NO: 4832538 - DNA, 14 bp, Homo sapiens
gccagctgcttggg

SEQ ID NO: 4832539 - DNA, 19 bp, Homo sapiens
gccagctggtgaatccatg

SEQ ID NO: 4832540 - DNA, 21 bp, Homo sapiens
gccagcttggtggttatgtcc

SEQ ID NO: 4832541 - DNA, 12 bp, Homo sapiens
gccaggaagcca

SEQ ID NO: 4832542 - DNA, 20 bp, Homo sapiens
gccaggaagccagcaggctc

SEQ ID NO: 4832543 - DNA, 10 bp, Homo sapiens
gccaggagac

SEQ ID NO: 4832544 - DNA, 16 bp, Homo sapiens
gccaggagaccctgtc

SEQ ID NO: 4832545 - DNA, 14 bp, Homo sapiens
gccaggagcctcct

SEQ ID NO: 4832546 - DNA, 16 bp, Homo sapiens
gccaggagcctcctgc

SEQ ID NO: 4832547 - DNA, 20 bp, Homo sapiens
gccaggagcctcctgccctt

SEQ ID NO: 4832548 - DNA, 19 bp, Homo sapiens
gccaggcaacttcagtcct

SEQ ID NO: 4832549 - DNA, 17 bp, Homo sapiens
gccaggccctctctgca

SEQ ID NO: 4832550 - DNA, 23 bp, Homo sapiens
gccaggccctctctgcagtcctc

SEQ ID NO: 4832551 - DNA, 13 bp, Homo sapiens
gccaggctgcagg

SEQ ID NO: 4832552 - DNA, 16 bp, Homo sapiens
gccaggctgcagggac

SEQ ID NO: 4832553 - DNA, 17 bp, Homo sapiens
gccaggctgcagggaca

SEQ ID NO: 4832554 - DNA, 19 bp, Homo sapiens
gccaggctggagtgcagtg

SEQ ID NO: 4832555 - DNA, 19 bp, Homo sapiens
gccaggggcttctccccct

SEQ ID NO: 4832556 - DNA, 22 bp, Homo sapiens
gccagggggtttgaggaccctc

SEQ ID NO: 4832557 - DNA, 22 bp, Homo sapiens
gccagggttccagacagggtgg

SEQ ID NO: 4832558 - DNA, 18 bp, Homo sapiens
gccagtggtggaggtggg

SEQ ID NO: 4832559 - DNA, 14 bp, Homo sapiens
gccataacttgttt

SEQ ID NO: 4832560 - DNA, 19 bp, Homo sapiens
gccataacttgtttgtaaa

SEQ ID NO: 4832561 - DNA, 18 bp, Homo sapiens
gccatagccccaggcccg

SEQ ID NO: 4832562 - DNA, 13 bp, Homo sapiens
gccatccaccctg

SEQ ID NO: 4832563 - DNA, 14 bp, Homo sapiens
gccatccaccctga

SEQ ID NO: 4832564 - DNA, 17 bp, Homo sapiens
gccatccaccctgagga

SEQ ID NO: 4832565 - DNA, 12 bp, Homo sapiens
gccatccctggg

SEQ ID NO: 4832566 - DNA, 18 bp, Homo sapiens
gccatccctgggcccctc

SEQ ID NO: 4832567 - DNA, 19 bp, Homo sapiens
gccatccctgggcccctcc

SEQ ID NO: 4832568 - DNA, 20 bp, Homo sapiens
gccatgaggaacaaggcaag

SEQ ID NO: 4832569 - DNA, 22 bp, Homo sapiens
gccatgttcccagaaccttgat

SEQ ID NO: 4832570 - DNA, 22 bp, Homo sapiens
gccattcagtctatgctgtgtg

SEQ ID NO: 4832571 - DNA, 17 bp, Homo sapiens
gccatttcacattcctg

SEQ ID NO: 4832572 - DNA, 19 bp, Homo sapiens
gccatttcacattcctgac

SEQ ID NO: 4832573 - DNA, 14 bp, Homo sapiens
gccatttcatgtcc

SEQ ID NO: 4832574 - DNA, 20 bp, Homo sapiens
gccattttgtctggctgtgg

SEQ ID NO: 4832575 - DNA, 15 bp, Homo sapiens
gcccaaagatgcagc

SEQ ID NO: 4832576 - DNA, 21 bp, Homo sapiens
gcccaaataacagtggcaagc

SEQ ID NO: 4832577 - DNA, 15 bp, Homo sapiens
gcccaacccccacct

SEQ ID NO: 4832578 - DNA, 17 bp, Homo sapiens
gcccaacccccacctcc

SEQ ID NO: 4832579 - DNA, 21 bp, Homo sapiens
gcccaaggcccccacctctgt

SEQ ID NO: 4832580 - DNA, 15 bp, Homo sapiens
gcccaatttcacaga

SEQ ID NO: 4832581 - DNA, 17 bp, Homo sapiens
gcccaatttcacagagt

SEQ ID NO: 4832582 - DNA, 15 bp, Homo sapiens
gcccacccagcagcg

SEQ ID NO: 4832583 - DNA, 18 bp, Homo sapiens
gcccacccagcagcgccc

SEQ ID NO: 4832584 - DNA, 17 bp, Homo sapiens
gcccaccccgctgcctg

SEQ ID NO: 4832585 - DNA, 20 bp, Homo sapiens
gcccaccccgctgcctggcg

SEQ ID NO: 4832586 - DNA, 12 bp, Homo sapiens
gcccacccctct

SEQ ID NO: 4832587 - DNA, 14 bp, Homo sapiens
gcccacccgcccca

SEQ ID NO: 4832588 - DNA, 20 bp, Homo sapiens
gcccacccgtgttctcctcc

SEQ ID NO: 4832589 - DNA, 15 bp, Homo sapiens
gcccaccctgggcct

SEQ ID NO: 4832590 - DNA, 13 bp, Homo sapiens
gcccacctgccag

SEQ ID NO: 4832591 - DNA, 14 bp, Homo sapiens
gcccacctgccagg

SEQ ID NO: 4832592 - DNA, 12 bp, Homo sapiens
gcccacctgccc

SEQ ID NO: 4832593 - DNA, 15 bp, Homo sapiens
gcccacctgcccagt

SEQ ID NO: 4832594 - DNA, 14 bp, Homo sapiens
gcccacgcagagcc

SEQ ID NO: 4832595 - DNA, 17 bp, Homo sapiens
gcccacgcagagccccg

SEQ ID NO: 4832596 - DNA, 18 bp, Homo sapiens
gcccacgcagagccccgg

SEQ ID NO: 4832597 - DNA, 22 bp, Homo sapiens
gcccacgtcctgggtgctgtca

SEQ ID NO: 4832598 - DNA, 17 bp, Homo sapiens
gcccactctgaccgggc

SEQ ID NO: 4832599 - DNA, 18 bp, Homo sapiens
gcccagagagaccctgcc

SEQ ID NO: 4832600 - DNA, 19 bp, Homo sapiens
gcccagagagaccctgcca

SEQ ID NO: 4832601 - DNA, 20 bp, Homo sapiens
gcccagagtatgggcactca

SEQ ID NO: 4832602 - DNA, 17 bp, Homo sapiens
gcccagcagcggcccag

SEQ ID NO: 4832603 - DNA, 23 bp, Homo sapiens
gcccagcatatgtgccataaaca

SEQ ID NO: 4832604 - DNA, 13 bp, Homo sapiens
gcccagccagcag

SEQ ID NO: 4832605 - DNA, 14 bp, Homo sapiens
gcccagccatggct

SEQ ID NO: 4832606 - DNA, 16 bp, Homo sapiens
gcccagccatggctgg

SEQ ID NO: 4832607 - DNA, 13 bp, Homo sapiens
gcccagcccccac

SEQ ID NO: 4832608 - DNA, 15 bp, Homo sapiens
gcccagcctggcccc

SEQ ID NO: 4832609 - DNA, 20 bp, Homo sapiens
gcccagcctggccccaagca

SEQ ID NO: 4832610 - DNA, 13 bp, Homo sapiens
gcccagcggctct

SEQ ID NO: 4832611 - DNA, 20 bp, Homo sapiens
gcccagcggctcttcctgga

SEQ ID NO: 4832612 - DNA, 17 bp, Homo sapiens
gcccagcttggagtgcc

SEQ ID NO: 4832613 - DNA, 21 bp, Homo sapiens
gcccagcttggagtgccacgt

SEQ ID NO: 4832614 - DNA, 23 bp, Homo sapiens
gcccaggcaatagtgttgaggag

SEQ ID NO: 4832615 - DNA, 13 bp, Homo sapiens
gcccaggccggcc

SEQ ID NO: 4832616 - DNA, 17 bp, Homo sapiens
gcccaggccggccagcc

SEQ ID NO: 4832617 - DNA, 19 bp, Homo sapiens
gcccaggccggccagcctc

SEQ ID NO: 4832618 - DNA, 18 bp, Homo sapiens
gcccaggcctcctacagc

SEQ ID NO: 4832619 - DNA, 14 bp, Homo sapiens
gcccagtcttgagt

SEQ ID NO: 4832620 - DNA, 17 bp, Homo sapiens
gcccagtcttgagtggg

SEQ ID NO: 4832621 - DNA, 18 bp, Homo sapiens
gcccagtcttgagtgggc

SEQ ID NO: 4832622 - DNA, 20 bp, Homo sapiens
gcccagttagcccggccaag

SEQ ID NO: 4832623 - DNA, 21 bp, Homo sapiens
gcccatagaaacatgacactg

SEQ ID NO: 4832624 - DNA, 22 bp, Homo sapiens
gcccatagaaacatgacactga

SEQ ID NO: 4832625 - DNA, 18 bp, Homo sapiens
gcccatgatataacttta

SEQ ID NO: 4832626 - DNA, 13 bp, Homo sapiens
gcccatggcccca

SEQ ID NO: 4832627 - DNA, 14 bp, Homo sapiens
gcccatggccccag

SEQ ID NO: 4832628 - DNA, 15 bp, Homo sapiens
gcccatggccccagc

SEQ ID NO: 4832629 - DNA, 17 bp, Homo sapiens
gcccatggccccagctg

SEQ ID NO: 4832630 - DNA, 18 bp, Homo sapiens
gcccatggccccagctgg

SEQ ID NO: 4832631 - DNA, 21 bp, Homo sapiens
gcccatggccccagctggctg

SEQ ID NO: 4832632 - DNA, 22 bp, Homo sapiens
gcccatggccccagctggctgg

SEQ ID NO: 4832633 - DNA, 17 bp, Homo sapiens
gcccatgtgtcccctca

SEQ ID NO: 4832634 - DNA, 22 bp, Homo sapiens
gcccatgtgtcccctcactctg

SEQ ID NO: 4832635 - DNA, 23 bp, Homo sapiens
gcccatgtgtcccctcactctgt

SEQ ID NO: 4832636 - DNA, 19 bp, Homo sapiens
gccccaaggtttacatagt

SEQ ID NO: 4832637 - DNA, 14 bp, Homo sapiens
gccccacacaggcc

SEQ ID NO: 4832638 - DNA, 17 bp, Homo sapiens
gccccacacaggcctgg

SEQ ID NO: 4832639 - DNA, 19 bp, Homo sapiens
gccccacacaggcctggcc

SEQ ID NO: 4832640 - DNA, 11 bp, Homo sapiens
gccccagagaa

SEQ ID NO: 4832641 - DNA, 18 bp, Homo sapiens
gccccagagaagcctcag

SEQ ID NO: 4832642 - DNA, 21 bp, Homo sapiens
gccccagagaagcctcagtcc

SEQ ID NO: 4832643 - DNA, 13 bp, Homo sapiens
gccccagctggct

SEQ ID NO: 4832644 - DNA, 12 bp, Homo sapiens
gccccaggcacc

SEQ ID NO: 4832645 - DNA, 11 bp, Homo sapiens
gccccaggccc

SEQ ID NO: 4832646 - DNA, 13 bp, Homo sapiens
gccccaggcccgc

SEQ ID NO: 4832647 - DNA, 21 bp, Homo sapiens
gccccaggcccgccctgcccg

SEQ ID NO: 4832648 - DNA, 20 bp, Homo sapiens
gccccaggccctccctgact

SEQ ID NO: 4832649 - DNA, 22 bp, Homo sapiens
gccccaggctcaggctgcccag

SEQ ID NO: 4832650 - DNA, 12 bp, Homo sapiens
gccccagggccc

SEQ ID NO: 4832651 - DNA, 16 bp, Homo sapiens
gccccagggccctgct

SEQ ID NO: 4832652 - DNA, 17 bp, Homo sapiens
gccccagggccctgctc

SEQ ID NO: 4832653 - DNA, 11 bp, Homo sapiens
gccccatcctt

SEQ ID NO: 4832654 - DNA, 24 bp, Homo sapiens
gccccatccttcccgcagcaccag

SEQ ID NO: 4832655 - DNA, 18 bp, Homo sapiens
gccccatggtcacagacc

SEQ ID NO: 4832656 - DNA, 23 bp, Homo sapiens
gccccatggtcacagacccctgg

SEQ ID NO: 4832657 - DNA, 12 bp, Homo sapiens
gcccccacagat

SEQ ID NO: 4832658 - DNA, 13 bp, Homo sapiens
gcccccacagatc

SEQ ID NO: 4832659 - DNA, 17 bp, Homo sapiens
gcccccacccctacagc

SEQ ID NO: 4832660 - DNA, 13 bp, Homo sapiens
gcccccacctctg

SEQ ID NO: 4832661 - DNA, 16 bp, Homo sapiens
gcccccacctctgtga

SEQ ID NO: 4832662 - DNA, 10 bp, Homo sapiens
gcccccagga

SEQ ID NO: 4832663 - DNA, 12 bp, Homo sapiens
gcccccaggacc

SEQ ID NO: 4832664 - DNA, 15 bp, Homo sapiens
gcccccaggaccccc

SEQ ID NO: 4832665 - DNA, 13 bp, Homo sapiens
gccccccagctca

SEQ ID NO: 4832666 - DNA, 16 bp, Homo sapiens
gccccccatgccctcc

SEQ ID NO: 4832667 - DNA, 17 bp, Homo sapiens
gccccccctatctcttc

SEQ ID NO: 4832668 - DNA, 19 bp, Homo sapiens
gccccccgcccggcctcct

SEQ ID NO: 4832669 - DNA, 20 bp, Homo sapiens
gccccccgcccggcctccta

SEQ ID NO: 4832670 - DNA, 17 bp, Homo sapiens
gccccccggcctggccc

SEQ ID NO: 4832671 - DNA, 13 bp, Homo sapiens
gccccccttccca

SEQ ID NO: 4832672 - DNA, 13 bp, Homo sapiens
gcccccgcccagg

SEQ ID NO: 4832673 - DNA, 13 bp, Homo sapiens
gcccccgcccctc

SEQ ID NO: 4832674 - DNA, 18 bp, Homo sapiens
gcccccgcccctccccct

SEQ ID NO: 4832675 - DNA, 19 bp, Homo sapiens
gcccccgccctcgctccgg

SEQ ID NO: 4832676 - DNA, 20 bp, Homo sapiens
gcccccgccctcgctccggg

SEQ ID NO: 4832677 - DNA, 14 bp, Homo sapiens
gccccctcccccgc

SEQ ID NO: 4832678 - DNA, 16 bp, Homo sapiens
gccccctcccccgcag

SEQ ID NO: 4832679 - DNA, 17 bp, Homo sapiens
gccccctcccccgcaga

SEQ ID NO: 4832680 - DNA, 21 bp, Homo sapiens
gccccctcccccgcagacaga

SEQ ID NO: 4832681 - DNA, 14 bp, Homo sapiens
gccccctcgcgccc

SEQ ID NO: 4832682 - DNA, 19 bp, Homo sapiens
gccccctcgcgcccctgtc

SEQ ID NO: 4832683 - DNA, 12 bp, Homo sapiens
gccccctgcacc

SEQ ID NO: 4832684 - DNA, 19 bp, Homo sapiens
gccccctgcacccacccct

SEQ ID NO: 4832685 - DNA, 16 bp, Homo sapiens
gccccgcccccacccc

SEQ ID NO: 4832686 - DNA, 22 bp, Homo sapiens
gccccgcctcccggggtgcccg

SEQ ID NO: 4832687 - DNA, 16 bp, Homo sapiens
gccccgcgaccacccc

SEQ ID NO: 4832688 - DNA, 21 bp, Homo sapiens
gccccgcgaccacccctgtgc

SEQ ID NO: 4832689 - DNA, 14 bp, Homo sapiens
gccccgcgcgtgcc

SEQ ID NO: 4832690 - DNA, 17 bp, Homo sapiens
gccccgcgcgtgccccc

SEQ ID NO: 4832691 - DNA, 19 bp, Homo sapiens
gccccgcgcgtgcccccag

SEQ ID NO: 4832692 - DNA, 16 bp, Homo sapiens
gccccgcggagccccc

SEQ ID NO: 4832693 - DNA, 20 bp, Homo sapiens
gccccggacagggtggcacc

SEQ ID NO: 4832694 - DNA, 20 bp, Homo sapiens
gccccgtgctcctctgcccg

SEQ ID NO: 4832695 - DNA, 14 bp, Homo sapiens
gcccctatcctgca

SEQ ID NO: 4832696 - DNA, 19 bp, Homo sapiens
gcccctatcctgcaccctc

SEQ ID NO: 4832697 - DNA, 23 bp, Homo sapiens
gcccctccacgcctcctggccag

SEQ ID NO: 4832698 - DNA, 17 bp, Homo sapiens
gcccctccccatggtgc

SEQ ID NO: 4832699 - DNA, 19 bp, Homo sapiens
gcccctccgtccccagggt

SEQ ID NO: 4832700 - DNA, 19 bp, Homo sapiens
gcccctcctcgggcgcctg

SEQ ID NO: 4832701 - DNA, 23 bp, Homo sapiens
gcccctccttctcccctccagac

SEQ ID NO: 4832702 - DNA, 14 bp, Homo sapiens
gcccctctcatcac

SEQ ID NO: 4832703 - DNA, 21 bp, Homo sapiens
gcccctctctgtttaccctcc

SEQ ID NO: 4832704 - DNA, 17 bp, Homo sapiens
gcccctctgcgccccag

SEQ ID NO: 4832705 - DNA, 11 bp, Homo sapiens
gcccctgccca

SEQ ID NO: 4832706 - DNA, 16 bp, Homo sapiens
gcccctgcccagcacc

SEQ ID NO: 4832707 - DNA, 20 bp, Homo sapiens
gcccctgcccagcacctcct

SEQ ID NO: 4832708 - DNA, 12 bp, Homo sapiens
gcccctggcagc

SEQ ID NO: 4832709 - DNA, 23 bp, Homo sapiens
gcccctggcagcccctgttctgg

SEQ ID NO: 4832710 - DNA, 20 bp, Homo sapiens
gcccctgggatgggaccagg

SEQ ID NO: 4832711 - DNA, 12 bp, Homo sapiens
gcccctggggcc

SEQ ID NO: 4832712 - DNA, 17 bp, Homo sapiens
gcccctgttctggcaga

SEQ ID NO: 4832713 - DNA, 21 bp, Homo sapiens
gcccctgttctggcagagttg

SEQ ID NO: 4832714 - DNA, 15 bp, Homo sapiens
gcccctgtttctcct

SEQ ID NO: 4832715 - DNA, 21 bp, Homo sapiens
gccccttctaggggcaggtga

SEQ ID NO: 4832716 - DNA, 14 bp, Homo sapiens
gccccttgacccca

SEQ ID NO: 4832717 - DNA, 15 bp, Homo sapiens
gccccttgaccccac

SEQ ID NO: 4832718 - DNA, 15 bp, Homo sapiens
gccccttgcttctaa

SEQ ID NO: 4832719 - DNA, 15 bp, Homo sapiens
gcccctttctcttgc

SEQ ID NO: 4832720 - DNA, 18 bp, Homo sapiens
gcccctttctcttgctgt

SEQ ID NO: 4832721 - DNA, 16 bp, Homo sapiens
gcccgagccccttggg

SEQ ID NO: 4832722 - DNA, 14 bp, Homo sapiens
gcccgcacagcagc

SEQ ID NO: 4832723 - DNA, 16 bp, Homo sapiens
gcccgcacagcagcct

SEQ ID NO: 4832724 - DNA, 18 bp, Homo sapiens
gcccgcactcaggagcac

SEQ ID NO: 4832725 - DNA, 15 bp, Homo sapiens
gcccgcagaggtggg

SEQ ID NO: 4832726 - DNA, 13 bp, Homo sapiens
gcccgcccacctg

SEQ ID NO: 4832727 - DNA, 14 bp, Homo sapiens
gcccgcccacctgg

SEQ ID NO: 4832728 - DNA, 15 bp, Homo sapiens
gcccgcccacctggg

SEQ ID NO: 4832729 - DNA, 17 bp, Homo sapiens
gcccgcccacctgggcc

SEQ ID NO: 4832730 - DNA, 16 bp, Homo sapiens
gcccgcccccgccctc

SEQ ID NO: 4832731 - DNA, 15 bp, Homo sapiens
gcccgccgcctccct

SEQ ID NO: 4832732 - DNA, 18 bp, Homo sapiens
gcccgctcaacctctcag

SEQ ID NO: 4832733 - DNA, 23 bp, Homo sapiens
gcccgctcaacctctcagatccc

SEQ ID NO: 4832734 - DNA, 18 bp, Homo sapiens
gcccggactgaccgaagg

SEQ ID NO: 4832735 - DNA, 16 bp, Homo sapiens
gcccggcccacgcaga

SEQ ID NO: 4832736 - DNA, 13 bp, Homo sapiens
gcccggcctccta

SEQ ID NO: 4832737 - DNA, 21 bp, Homo sapiens
gcccggcctcctagcctctcc

SEQ ID NO: 4832738 - DNA, 22 bp, Homo sapiens
gcccggcctcctagcctctccg

SEQ ID NO: 4832739 - DNA, 14 bp, Homo sapiens
gcccgggagccgca

SEQ ID NO: 4832740 - DNA, 15 bp, Homo sapiens
gcccgggagccgcag

SEQ ID NO: 4832741 - DNA, 24 bp, Homo sapiens
gcccgtgcgcagccgcgctctgcc

SEQ ID NO: 4832742 - DNA, 23 bp, Homo sapiens
gccctaggcatactctccaggat

SEQ ID NO: 4832743 - DNA, 16 bp, Homo sapiens
gccctcactccactcc

SEQ ID NO: 4832744 - DNA, 17 bp, Homo sapiens
gccctcactccactccc

SEQ ID NO: 4832745 - DNA, 14 bp, Homo sapiens
gccctcccccacgg

SEQ ID NO: 4832746 - DNA, 15 bp, Homo sapiens
gccctcccccacggc

SEQ ID NO: 4832747 - DNA, 23 bp, Homo sapiens
gccctcccccttccccttctgtg

SEQ ID NO: 4832748 - DNA, 11 bp, Homo sapiens
gccctccctcc

SEQ ID NO: 4832749 - DNA, 12 bp, Homo sapiens
gccctccctccc

SEQ ID NO: 4832750 - DNA, 16 bp, Homo sapiens
gccctccctccctcca

SEQ ID NO: 4832751 - DNA, 19 bp, Homo sapiens
gccctccctccctccacac

SEQ ID NO: 4832752 - DNA, 19 bp, Homo sapiens
gccctccctgactccctgt

SEQ ID NO: 4832753 - DNA, 18 bp, Homo sapiens
gccctccgcccttccctg

SEQ ID NO: 4832754 - DNA, 13 bp, Homo sapiens
gccctcctctgcc

SEQ ID NO: 4832755 - DNA, 14 bp, Homo sapiens
gccctcctctgccc

SEQ ID NO: 4832756 - DNA, 15 bp, Homo sapiens
gccctcctctgcccc

SEQ ID NO: 4832757 - DNA, 17 bp, Homo sapiens
gccctcctctgccccct

SEQ ID NO: 4832758 - DNA, 20 bp, Homo sapiens
gccctcctctgccccctccc

SEQ ID NO: 4832759 - DNA, 14 bp, Homo sapiens
gccctcgggccctc

SEQ ID NO: 4832760 - DNA, 17 bp, Homo sapiens
gccctctcactgacttc

SEQ ID NO: 4832761 - DNA, 21 bp, Homo sapiens
gccctctctccgccccggaca

SEQ ID NO: 4832762 - DNA, 13 bp, Homo sapiens
gccctctttctct

SEQ ID NO: 4832763 - DNA, 20 bp, Homo sapiens
gccctgacaacaactatcac

SEQ ID NO: 4832764 - DNA, 15 bp, Homo sapiens
gccctgcagagggca

SEQ ID NO: 4832765 - DNA, 15 bp, Homo sapiens
gccctgcattttcat

SEQ ID NO: 4832766 - DNA, 19 bp, Homo sapiens
gccctgccccacacaggcc

SEQ ID NO: 4832767 - DNA, 21 bp, Homo sapiens
gccctgcccgcgcccgccgcc

SEQ ID NO: 4832768 - DNA, 12 bp, Homo sapiens
gccctgccctcc

SEQ ID NO: 4832769 - DNA, 14 bp, Homo sapiens
gccctgccctcccc

SEQ ID NO: 4832770 - DNA, 16 bp, Homo sapiens
gccctgccctccccca

SEQ ID NO: 4832771 - DNA, 20 bp, Homo sapiens
gccctgccctgaggaaggag

SEQ ID NO: 4832772 - DNA, 17 bp, Homo sapiens
gccctgcgtcccttctc

SEQ ID NO: 4832773 - DNA, 22 bp, Homo sapiens
gccctgctcaggcctcacctgg

SEQ ID NO: 4832774 - DNA, 21 bp, Homo sapiens
gccctggaactctatctgggc

SEQ ID NO: 4832775 - DNA, 10 bp, Homo sapiens
gccctggcct

SEQ ID NO: 4832776 - DNA, 13 bp, Homo sapiens
gccctggcctacc

SEQ ID NO: 4832777 - DNA, 16 bp, Homo sapiens
gccctggcctaccaca

SEQ ID NO: 4832778 - DNA, 22 bp, Homo sapiens
gccctgggctgtctgtcaccag

SEQ ID NO: 4832779 - DNA, 18 bp, Homo sapiens
gccctggggcagggtggg

SEQ ID NO: 4832780 - DNA, 16 bp, Homo sapiens
gccctgtagccctggc

SEQ ID NO: 4832781 - DNA, 18 bp, Homo sapiens
gccctgtagccctggccc

SEQ ID NO: 4832782 - DNA, 15 bp, Homo sapiens
gccctgtagctctga

SEQ ID NO: 4832783 - DNA, 15 bp, Homo sapiens
gccctgtctccctac

SEQ ID NO: 4832784 - DNA, 13 bp, Homo sapiens
gccctgtgccctc

SEQ ID NO: 4832785 - DNA, 14 bp, Homo sapiens
gccctgtgccctct

SEQ ID NO: 4832786 - DNA, 17 bp, Homo sapiens
gccctgtgccctctcac

SEQ ID NO: 4832787 - DNA, 19 bp, Homo sapiens
gccctgtgccctctcactg

SEQ ID NO: 4832788 - DNA, 18 bp, Homo sapiens
gccctgttccgcctcact

SEQ ID NO: 4832789 - DNA, 20 bp, Homo sapiens
gcccttacctgccaggaagc

SEQ ID NO: 4832790 - DNA, 21 bp, Homo sapiens
gcccttacctgccaggaagcc

SEQ ID NO: 4832791 - DNA, 22 bp, Homo sapiens
gcccttacctgccaggaagcca

SEQ ID NO: 4832792 - DNA, 23 bp, Homo sapiens
gcccttacctgccaggaagccag

SEQ ID NO: 4832793 - DNA, 16 bp, Homo sapiens
gcccttccttcaccca

SEQ ID NO: 4832794 - DNA, 20 bp, Homo sapiens
gccgaaacccttgactgtta

SEQ ID NO: 4832795 - DNA, 15 bp, Homo sapiens
gccgaagggcagccc

SEQ ID NO: 4832796 - DNA, 16 bp, Homo sapiens
gccgagatagccaagg

SEQ ID NO: 4832797 - DNA, 17 bp, Homo sapiens
gccgagatagccaaggc

SEQ ID NO: 4832798 - DNA, 16 bp, Homo sapiens
gccgaggagccaggca

SEQ ID NO: 4832799 - DNA, 13 bp, Homo sapiens
gccgagggaaatg

SEQ ID NO: 4832800 - DNA, 16 bp, Homo sapiens
gccgatataagccata

SEQ ID NO: 4832801 - DNA, 12 bp, Homo sapiens
gccgcagaggcc

SEQ ID NO: 4832802 - DNA, 11 bp, Homo sapiens
gccgcagccct

SEQ ID NO: 4832803 - DNA, 13 bp, Homo sapiens
gccgcagccctgc

SEQ ID NO: 4832804 - DNA, 15 bp, Homo sapiens
gccgcagccctgcag

SEQ ID NO: 4832805 - DNA, 17 bp, Homo sapiens
gccgcagccctgcagag

SEQ ID NO: 4832806 - DNA, 20 bp, Homo sapiens
gccgcagccctgcagagggc

SEQ ID NO: 4832807 - DNA, 13 bp, Homo sapiens
gccgcagggcgct

SEQ ID NO: 4832808 - DNA, 19 bp, Homo sapiens
gccgcaggggcccctcctc

SEQ ID NO: 4832809 - DNA, 15 bp, Homo sapiens
gccgccgaagggcag

SEQ ID NO: 4832810 - DNA, 24 bp, Homo sapiens
gccgccgaagggcagccccgcgac

SEQ ID NO: 4832811 - DNA, 13 bp, Homo sapiens
gccgcctcgcccc

SEQ ID NO: 4832812 - DNA, 20 bp, Homo sapiens
gccgcctcgcccccgggccc

SEQ ID NO: 4832813 - DNA, 13 bp, Homo sapiens
gccgcctcgggcc

SEQ ID NO: 4832814 - DNA, 22 bp, Homo sapiens
gccgccttccttgaccttcctc

SEQ ID NO: 4832815 - DNA, 15 bp, Homo sapiens
gccgcgctctgcccc

SEQ ID NO: 4832816 - DNA, 17 bp, Homo sapiens
gccgcgctctgcccctc

SEQ ID NO: 4832817 - DNA, 19 bp, Homo sapiens
gccgcgctctgcccctccg

SEQ ID NO: 4832818 - DNA, 14 bp, Homo sapiens
gccgctctccgccc

SEQ ID NO: 4832819 - DNA, 19 bp, Homo sapiens
gccgctctccgccccccgg

SEQ ID NO: 4832820 - DNA, 14 bp, Homo sapiens
gccgctgcaccacg

SEQ ID NO: 4832821 - DNA, 17 bp, Homo sapiens
gccgctgccgctgcacc

SEQ ID NO: 4832822 - DNA, 17 bp, Homo sapiens
gccgctgctctcccagg

SEQ ID NO: 4832823 - DNA, 21 bp, Homo sapiens
gccgctgcttgagtggacagc

SEQ ID NO: 4832824 - DNA, 21 bp, Homo sapiens
gccgcttaaacatttccctgc

SEQ ID NO: 4832825 - DNA, 15 bp, Homo sapiens
gccggcccacgtcct

SEQ ID NO: 4832826 - DNA, 18 bp, Homo sapiens
gccggcccacgtcctggg

SEQ ID NO: 4832827 - DNA, 23 bp, Homo sapiens
gccggcccacgtcctgggtgctg

SEQ ID NO: 4832828 - DNA, 12 bp, Homo sapiens
gccggcgccccg

SEQ ID NO: 4832829 - DNA, 16 bp, Homo sapiens
gccggggctggccctg

SEQ ID NO: 4832830 - DNA, 17 bp, Homo sapiens
gccggggctggccctgc

SEQ ID NO: 4832831 - DNA, 18 bp, Homo sapiens
gccggtccaccccgtccc

SEQ ID NO: 4832832 - DNA, 20 bp, Homo sapiens
gccggttggccggctggccg

SEQ ID NO: 4832833 - DNA, 12 bp, Homo sapiens
gccgtcacgctt

SEQ ID NO: 4832834 - DNA, 13 bp, Homo sapiens
gccgtcagcctgt

SEQ ID NO: 4832835 - DNA, 15 bp, Homo sapiens
gccgtgcagggccag

SEQ ID NO: 4832836 - DNA, 22 bp, Homo sapiens
gccgtgttttatgactaatcct

SEQ ID NO: 4832837 - DNA, 22 bp, Homo sapiens
gccgttagggaaatccaactcc

SEQ ID NO: 4832838 - DNA, 21 bp, Homo sapiens
gcctaatattcatgctgcctg

SEQ ID NO: 4832839 - DNA, 17 bp, Homo sapiens
gcctaccacagctgcct

SEQ ID NO: 4832840 - DNA, 13 bp, Homo sapiens
gcctatgaccctg

SEQ ID NO: 4832841 - DNA, 20 bp, Homo sapiens
gcctatgaccctgtgcctgt

SEQ ID NO: 4832842 - DNA, 18 bp, Homo sapiens
gcctcacctggcttccca

SEQ ID NO: 4832843 - DNA, 22 bp, Homo sapiens
gcctcaccttccctagttcttt

SEQ ID NO: 4832844 - DNA, 19 bp, Homo sapiens
gcctcaccttccttgaaat

SEQ ID NO: 4832845 - DNA, 22 bp, Homo sapiens
gcctcactgatatattttccag

SEQ ID NO: 4832846 - DNA, 19 bp, Homo sapiens
gcctcactgggtgtggcct

SEQ ID NO: 4832847 - DNA, 12 bp, Homo sapiens
gcctcagccctc

SEQ ID NO: 4832848 - DNA, 13 bp, Homo sapiens
gcctcagccctca

SEQ ID NO: 4832849 - DNA, 21 bp, Homo sapiens
gcctcagggaccaaggagatg

SEQ ID NO: 4832850 - DNA, 12 bp, Homo sapiens
gcctcagtccct

SEQ ID NO: 4832851 - DNA, 16 bp, Homo sapiens
gcctcagtccctccct

SEQ ID NO: 4832852 - DNA, 23 bp, Homo sapiens
gcctcagtgagatcagtcagctc

SEQ ID NO: 4832853 - DNA, 23 bp, Homo sapiens
gcctcattttgcttcccatctga

SEQ ID NO: 4832854 - DNA, 22 bp, Homo sapiens
gcctccaagtcatgggagaaga

SEQ ID NO: 4832855 - DNA, 18 bp, Homo sapiens
gcctccaccttgagcact

SEQ ID NO: 4832856 - DNA, 15 bp, Homo sapiens
gcctccaggttcctc

SEQ ID NO: 4832857 - DNA, 13 bp, Homo sapiens
gcctccatccaca

SEQ ID NO: 4832858 - DNA, 14 bp, Homo sapiens
gcctccatccacac

SEQ ID NO: 4832859 - DNA, 15 bp, Homo sapiens
gcctccatccacaca

SEQ ID NO: 4832860 - DNA, 18 bp, Homo sapiens
gcctccatccacacacag

SEQ ID NO: 4832861 - DNA, 13 bp, Homo sapiens
gcctcccaagctg

SEQ ID NO: 4832862 - DNA, 13 bp, Homo sapiens
gcctcccagccac

SEQ ID NO: 4832863 - DNA, 16 bp, Homo sapiens
gcctcccccaggctgc

SEQ ID NO: 4832864 - DNA, 18 bp, Homo sapiens
gcctccccgggggtcccc

SEQ ID NO: 4832865 - DNA, 16 bp, Homo sapiens
gcctcccgtccgtccg

SEQ ID NO: 4832866 - DNA, 12 bp, Homo sapiens
gcctccctcacc

SEQ ID NO: 4832867 - DNA, 20 bp, Homo sapiens
gcctccggccctgccccaca

SEQ ID NO: 4832868 - DNA, 18 bp, Homo sapiens
gcctccgggcctcggcct

SEQ ID NO: 4832869 - DNA, 19 bp, Homo sapiens
gcctccgggcctcggcctg

SEQ ID NO: 4832870 - DNA, 21 bp, Homo sapiens
gcctccgggcctcggcctggc

SEQ ID NO: 4832871 - DNA, 15 bp, Homo sapiens
gcctcctccagactc

SEQ ID NO: 4832872 - DNA, 17 bp, Homo sapiens
gcctcctcttcaccccg

SEQ ID NO: 4832873 - DNA, 20 bp, Homo sapiens
gcctcctcttcaccccggca

SEQ ID NO: 4832874 - DNA, 18 bp, Homo sapiens
gcctcctgcccttacctg

SEQ ID NO: 4832875 - DNA, 13 bp, Homo sapiens
gcctcgcccccgg

SEQ ID NO: 4832876 - DNA, 18 bp, Homo sapiens
gcctcgcccccgggccct

SEQ ID NO: 4832877 - DNA, 14 bp, Homo sapiens
gcctcggcctggct

SEQ ID NO: 4832878 - DNA, 17 bp, Homo sapiens
gcctcggcctggcttca

SEQ ID NO: 4832879 - DNA, 23 bp, Homo sapiens
gcctcggcctggcttcaccgcat

SEQ ID NO: 4832880 - DNA, 17 bp, Homo sapiens
gcctcgggccgcctcct

SEQ ID NO: 4832881 - DNA, 18 bp, Homo sapiens
gcctcgggccgcctcctc

SEQ ID NO: 4832882 - DNA, 15 bp, Homo sapiens
gcctctcacacacat

SEQ ID NO: 4832883 - DNA, 12 bp, Homo sapiens
gcctctccgccc

SEQ ID NO: 4832884 - DNA, 13 bp, Homo sapiens
gcctctctcaggc

SEQ ID NO: 4832885 - DNA, 14 bp, Homo sapiens
gcctctctcaggcc

SEQ ID NO: 4832886 - DNA, 15 bp, Homo sapiens
gcctctctctcccaa

SEQ ID NO: 4832887 - DNA, 16 bp, Homo sapiens
gcctctgcccctcttc

SEQ ID NO: 4832888 - DNA, 21 bp, Homo sapiens
gcctctggacagatgggtgtc

SEQ ID NO: 4832889 - DNA, 23 bp, Homo sapiens
gcctctggacagatgggtgtccc

SEQ ID NO: 4832890 - DNA, 20 bp, Homo sapiens
gcctctgtcctggcccggga

SEQ ID NO: 4832891 - DNA, 12 bp, Homo sapiens
gcctctttaaat

SEQ ID NO: 4832892 - DNA, 16 bp, Homo sapiens
gcctgacacaatggta

SEQ ID NO: 4832893 - DNA, 21 bp, Homo sapiens
gcctgacacaatggtagctct

SEQ ID NO: 4832894 - DNA, 23 bp, Homo sapiens
gcctgagaattgaggggaggtgg

SEQ ID NO: 4832895 - DNA, 21 bp, Homo sapiens
gcctgagaggagcgtgtccta

SEQ ID NO: 4832896 - DNA, 18 bp, Homo sapiens
gcctgagccacagtgggg

SEQ ID NO: 4832897 - DNA, 20 bp, Homo sapiens
gcctgagccacagtggggcc

SEQ ID NO: 4832898 - DNA, 19 bp, Homo sapiens
gcctgagctccaccctccc

SEQ ID NO: 4832899 - DNA, 20 bp, Homo sapiens
gcctgagggaagcccacccg

SEQ ID NO: 4832900 - DNA, 12 bp, Homo sapiens
gcctgagtcagg

SEQ ID NO: 4832901 - DNA, 18 bp, Homo sapiens
gcctgagtcagggcccag

SEQ ID NO: 4832902 - DNA, 19 bp, Homo sapiens
gcctgagtcagggcccaga

SEQ ID NO: 4832903 - DNA, 10 bp, Homo sapiens
gcctgcacac

SEQ ID NO: 4832904 - DNA, 16 bp, Homo sapiens
gcctgcacacacctgc

SEQ ID NO: 4832905 - DNA, 17 bp, Homo sapiens
gcctgcacacacctgcc

SEQ ID NO: 4832906 - DNA, 12 bp, Homo sapiens
gcctgcagccca

SEQ ID NO: 4832907 - DNA, 15 bp, Homo sapiens
gcctgccatgtgtga

SEQ ID NO: 4832908 - DNA, 22 bp, Homo sapiens
gcctgccatgtgtgagtcactt

SEQ ID NO: 4832909 - DNA, 14 bp, Homo sapiens
gcctgcccgcacag

SEQ ID NO: 4832910 - DNA, 20 bp, Homo sapiens
gcctgcccgcacagcagcct

SEQ ID NO: 4832911 - DNA, 20 bp, Homo sapiens
gcctgcctccggccctgccc

SEQ ID NO: 4832912 - DNA, 23 bp, Homo sapiens
gcctgcctccggccctgccccac

SEQ ID NO: 4832913 - DNA, 17 bp, Homo sapiens
gcctgcgccccccagtg

SEQ ID NO: 4832914 - DNA, 14 bp, Homo sapiens
gcctgcgcctcctc

SEQ ID NO: 4832915 - DNA, 23 bp, Homo sapiens
gcctgcgcctcctcctgcatgtc

SEQ ID NO: 4832916 - DNA, 14 bp, Homo sapiens
gcctgcgctcctct

SEQ ID NO: 4832917 - DNA, 15 bp, Homo sapiens
gcctgcgctcctctg

SEQ ID NO: 4832918 - DNA, 16 bp, Homo sapiens
gcctgcgctcctctgc

SEQ ID NO: 4832919 - DNA, 17 bp, Homo sapiens
gcctgcgctcctctgca

SEQ ID NO: 4832920 - DNA, 18 bp, Homo sapiens
gcctgcgctcctctgcag

SEQ ID NO: 4832921 - DNA, 19 bp, Homo sapiens
gcctgcgctcctctgcagc

SEQ ID NO: 4832922 - DNA, 22 bp, Homo sapiens
gcctgcttcccacctccctgcc

SEQ ID NO: 4832923 - DNA, 19 bp, Homo sapiens
gcctggaggagaaggagga

SEQ ID NO: 4832924 - DNA, 22 bp, Homo sapiens
gcctggaggagaaggaggaacc

SEQ ID NO: 4832925 - DNA, 19 bp, Homo sapiens
gcctggcagggaggtcagg

SEQ ID NO: 4832926 - DNA, 23 bp, Homo sapiens
gcctggcagggaggtcaggccct

SEQ ID NO: 4832927 - DNA, 16 bp, Homo sapiens
gcctggccccctcgcg

SEQ ID NO: 4832928 - DNA, 15 bp, Homo sapiens
gcctggccctgccct

SEQ ID NO: 4832929 - DNA, 14 bp, Homo sapiens
gcctggcctggccc

SEQ ID NO: 4832930 - DNA, 16 bp, Homo sapiens
gcctggcctggccctg

SEQ ID NO: 4832931 - DNA, 19 bp, Homo sapiens
gcctggcctggccctgccc

SEQ ID NO: 4832932 - DNA, 15 bp, Homo sapiens
gcctggcgggcagcc

SEQ ID NO: 4832933 - DNA, 18 bp, Homo sapiens
gcctggcgggcagcccct

SEQ ID NO: 4832934 - DNA, 19 bp, Homo sapiens
gcctggcgggcagcccctg

SEQ ID NO: 4832935 - DNA, 20 bp, Homo sapiens
gcctggcttcaccgcattcc

SEQ ID NO: 4832936 - DNA, 22 bp, Homo sapiens
gcctggcttcaccgcattccag

SEQ ID NO: 4832937 - DNA, 23 bp, Homo sapiens
gcctggcttcaccgcattccagg

SEQ ID NO: 4832938 - DNA, 13 bp, Homo sapiens
gcctggcttctgg

SEQ ID NO: 4832939 - DNA, 19 bp, Homo sapiens
gcctgggaaattgctccat

SEQ ID NO: 4832940 - DNA, 16 bp, Homo sapiens
gcctgggacagccact

SEQ ID NO: 4832941 - DNA, 17 bp, Homo sapiens
gcctgggagatgcagct

SEQ ID NO: 4832942 - DNA, 22 bp, Homo sapiens
gcctgggcagaaatgtgctgca

SEQ ID NO: 4832943 - DNA, 16 bp, Homo sapiens
gcctgggcagaaggaa

SEQ ID NO: 4832944 - DNA, 20 bp, Homo sapiens
gcctgggggctgggcagagg

SEQ ID NO: 4832945 - DNA, 14 bp, Homo sapiens
gcctgggtccccct

SEQ ID NO: 4832946 - DNA, 21 bp, Homo sapiens
gcctgggtccccctcctgcac

SEQ ID NO: 4832947 - DNA, 22 bp, Homo sapiens
gcctgggtccccctcctgcacg

SEQ ID NO: 4832948 - DNA, 12 bp, Homo sapiens
gcctgggtcctc

SEQ ID NO: 4832949 - DNA, 14 bp, Homo sapiens
gcctggtctggagc

SEQ ID NO: 4832950 - DNA, 16 bp, Homo sapiens
gcctggtctggagccc

SEQ ID NO: 4832951 - DNA, 19 bp, Homo sapiens
gcctggtctggagccccta

SEQ ID NO: 4832952 - DNA, 17 bp, Homo sapiens
gcctggtctgtgcattg

SEQ ID NO: 4832953 - DNA, 13 bp, Homo sapiens
gcctgtccctagg

SEQ ID NO: 4832954 - DNA, 21 bp, Homo sapiens
gcctgtccctagggctctcca

SEQ ID NO: 4832955 - DNA, 13 bp, Homo sapiens
gcctgtcgggccc

SEQ ID NO: 4832956 - DNA, 17 bp, Homo sapiens
gcctgtgatcgtgtgtt

SEQ ID NO: 4832957 - DNA, 18 bp, Homo sapiens
gcctgtgtttcatgttct

SEQ ID NO: 4832958 - DNA, 15 bp, Homo sapiens
gccttacacaatggt

SEQ ID NO: 4832959 - DNA, 20 bp, Homo sapiens
gccttccaccctgccctggc

SEQ ID NO: 4832960 - DNA, 21 bp, Homo sapiens
gccttccaccctgccctggcc

SEQ ID NO: 4832961 - DNA, 17 bp, Homo sapiens
gccttcccagcttcccg

SEQ ID NO: 4832962 - DNA, 22 bp, Homo sapiens
gccttccccgtgcggcccgtgc

SEQ ID NO: 4832963 - DNA, 15 bp, Homo sapiens
gccttcctcctctca

SEQ ID NO: 4832964 - DNA, 17 bp, Homo sapiens
gccttcctcctctcaaa

SEQ ID NO: 4832965 - DNA, 21 bp, Homo sapiens
gccttcctcctctcaaacctg

SEQ ID NO: 4832966 - DNA, 19 bp, Homo sapiens
gccttccttgaccttcctc

SEQ ID NO: 4832967 - DNA, 13 bp, Homo sapiens
gccttctcccctc

SEQ ID NO: 4832968 - DNA, 19 bp, Homo sapiens
gccttctctaaacatttca

SEQ ID NO: 4832969 - DNA, 18 bp, Homo sapiens
gccttctgacggccctgc

SEQ ID NO: 4832970 - DNA, 18 bp, Homo sapiens
gccttctggctgctgcag

SEQ ID NO: 4832971 - DNA, 14 bp, Homo sapiens
gccttgagtctctg

SEQ ID NO: 4832972 - DNA, 16 bp, Homo sapiens
gccttgagtctctgaa

SEQ ID NO: 4832973 - DNA, 23 bp, Homo sapiens
gccttgtctgtgtatttctattt

SEQ ID NO: 4832974 - DNA, 19 bp, Homo sapiens
gcctttcaaagtgcacaca

SEQ ID NO: 4832975 - DNA, 18 bp, Homo sapiens
gcctttcctctctcctgt

SEQ ID NO: 4832976 - DNA, 11 bp, Homo sapiens
gcgaccacccc

SEQ ID NO: 4832977 - DNA, 16 bp, Homo sapiens
gcgaccacccctgtgc

SEQ ID NO: 4832978 - DNA, 17 bp, Homo sapiens
gcgacggaggcaggacc

SEQ ID NO: 4832979 - DNA, 23 bp, Homo sapiens
gcgattctcctgcctcagcctcc

SEQ ID NO: 4832980 - DNA, 21 bp, Homo sapiens
gcgcagccgcgctctgcccct

SEQ ID NO: 4832981 - DNA, 23 bp, Homo sapiens
gcgcagccgcgctctgcccctcc

SEQ ID NO: 4832982 - DNA, 15 bp, Homo sapiens
gcgcaggaaccgagg

SEQ ID NO: 4832983 - DNA, 12 bp, Homo sapiens
gcgccacccgcc

SEQ ID NO: 4832984 - DNA, 13 bp, Homo sapiens
gcgccacccgccc

SEQ ID NO: 4832985 - DNA, 18 bp, Homo sapiens
gcgccatgtgtgtcagcc

SEQ ID NO: 4832986 - DNA, 12 bp, Homo sapiens
gcgcccccagga

SEQ ID NO: 4832987 - DNA, 16 bp, Homo sapiens
gcgccccccagtggac

SEQ ID NO: 4832988 - DNA, 12 bp, Homo sapiens
gcgccccgcccc

SEQ ID NO: 4832989 - DNA, 20 bp, Homo sapiens
gcgccccgcccccaccccta

SEQ ID NO: 4832990 - DNA, 12 bp, Homo sapiens
gcgcccctctgc

SEQ ID NO: 4832991 - DNA, 13 bp, Homo sapiens
gcgcccctctgcg

SEQ ID NO: 4832992 - DNA, 15 bp, Homo sapiens
gcgcccctctgcgcc

SEQ ID NO: 4832993 - DNA, 19 bp, Homo sapiens
gcgcccctctgcgccccag

SEQ ID NO: 4832994 - DNA, 13 bp, Homo sapiens
gcgcccctgccca

SEQ ID NO: 4832995 - DNA, 17 bp, Homo sapiens
gcgcccctgcccagcac

SEQ ID NO: 4832996 - DNA, 18 bp, Homo sapiens
gcgcccctgcccagcacc

SEQ ID NO: 4832997 - DNA, 13 bp, Homo sapiens
gcgcccctgtcca

SEQ ID NO: 4832998 - DNA, 14 bp, Homo sapiens
gcgcccctgtccat

SEQ ID NO: 4832999 - DNA, 15 bp, Homo sapiens
gcgcccgccgcctcc

SEQ ID NO: 4833000 - DNA, 19 bp, Homo sapiens
gcgcccgccgcctccctca

SEQ ID NO: 4833001 - DNA, 16 bp, Homo sapiens
gcgccctccctccctc

SEQ ID NO: 4833002 - DNA, 16 bp, Homo sapiens
gcgccggcgccccgga

SEQ ID NO: 4833003 - DNA, 20 bp, Homo sapiens
gcgccggcgccccggacgcc

SEQ ID NO: 4833004 - DNA, 16 bp, Homo sapiens
gcgccggttccacgtg

SEQ ID NO: 4833005 - DNA, 14 bp, Homo sapiens
gcgcctcccgccgc

SEQ ID NO: 4833006 - DNA, 16 bp, Homo sapiens
gcgcctcccgccgcct

SEQ ID NO: 4833007 - DNA, 21 bp, Homo sapiens
gcgcctcccgccgcctcgggc

SEQ ID NO: 4833008 - DNA, 13 bp, Homo sapiens
gcgcctcctcctg

SEQ ID NO: 4833009 - DNA, 14 bp, Homo sapiens
gcgcctgcccgccc

SEQ ID NO: 4833010 - DNA, 17 bp, Homo sapiens
gcgcctgcgcctcctcc

SEQ ID NO: 4833011 - DNA, 23 bp, Homo sapiens
gcgcctgcgcctcctcctgcatg

SEQ ID NO: 4833012 - DNA, 15 bp, Homo sapiens
gcgcctgcgctcctc

SEQ ID NO: 4833013 - DNA, 17 bp, Homo sapiens
gcgcctgcgctcctctg

SEQ ID NO: 4833014 - DNA, 21 bp, Homo sapiens
gcgcctgcgctcctctgcagc

SEQ ID NO: 4833015 - DNA, 14 bp, Homo sapiens
gcgcctgggtcctc

SEQ ID NO: 4833016 - DNA, 18 bp, Homo sapiens
gcgcctgggtcctcccag

SEQ ID NO: 4833017 - DNA, 15 bp, Homo sapiens
gcgcctgtcgggccc

SEQ ID NO: 4833018 - DNA, 17 bp, Homo sapiens
gcgcctgtcgggcccgc

SEQ ID NO: 4833019 - DNA, 21 bp, Homo sapiens
gcgccttaaggatgttctagc

SEQ ID NO: 4833020 - DNA, 16 bp, Homo sapiens
gcgcgatctcagctca

SEQ ID NO: 4833021 - DNA, 15 bp, Homo sapiens
gcgcgcccccaggac

SEQ ID NO: 4833022 - DNA, 18 bp, Homo sapiens
gcgcgcgcccccaggacc

SEQ ID NO: 4833023 - DNA, 23 bp, Homo sapiens
gcgcgcgggacagcggccccgcg

SEQ ID NO: 4833024 - DNA, 18 bp, Homo sapiens
gcgcgggacagcggcccc

SEQ ID NO: 4833025 - DNA, 12 bp, Homo sapiens
gcgcgggacagg

SEQ ID NO: 4833026 - DNA, 15 bp, Homo sapiens
gcgcgtgcccccagc

SEQ ID NO: 4833027 - DNA, 15 bp, Homo sapiens
gcgctccggcagagg

SEQ ID NO: 4833028 - DNA, 22 bp, Homo sapiens
gcgctccggcagaggcagggcc

SEQ ID NO: 4833029 - DNA, 23 bp, Homo sapiens
gcgctccggcagaggcagggccc

SEQ ID NO: 4833030 - DNA, 13 bp, Homo sapiens
gcgctcctcccag

SEQ ID NO: 4833031 - DNA, 16 bp, Homo sapiens
gcgctcctcccagctg

SEQ ID NO: 4833032 - DNA, 14 bp, Homo sapiens
gcgctcctctgcag

SEQ ID NO: 4833033 - DNA, 15 bp, Homo sapiens
gcgctcctctgcagc

SEQ ID NO: 4833034 - DNA, 17 bp, Homo sapiens
gcgctcctctgcagcct

SEQ ID NO: 4833035 - DNA, 22 bp, Homo sapiens
gcgctcctctgcagcctgagct

SEQ ID NO: 4833036 - DNA, 12 bp, Homo sapiens
gcgctcctggct

SEQ ID NO: 4833037 - DNA, 18 bp, Homo sapiens
gcgctgcccccacagatc

SEQ ID NO: 4833038 - DNA, 21 bp, Homo sapiens
gcgctgcccccacagatccat

SEQ ID NO: 4833039 - DNA, 23 bp, Homo sapiens
gcgctgcccccacagatccatcc

SEQ ID NO: 4833040 - DNA, 17 bp, Homo sapiens
gcggaacaggagtgact

SEQ ID NO: 4833041 - DNA, 23 bp, Homo sapiens
gcggaacaggagtgactctggct

SEQ ID NO: 4833042 - DNA, 16 bp, Homo sapiens
gcggagaaaggaaggg

SEQ ID NO: 4833043 - DNA, 13 bp, Homo sapiens
gcggagaggaccc

SEQ ID NO: 4833044 - DNA, 18 bp, Homo sapiens
gcggagcccccgcccctc

SEQ ID NO: 4833045 - DNA, 12 bp, Homo sapiens
gcggaggcccct

SEQ ID NO: 4833046 - DNA, 14 bp, Homo sapiens
gcggaggcccctga

SEQ ID NO: 4833047 - DNA, 16 bp, Homo sapiens
gcggaggcccctgagg

SEQ ID NO: 4833048 - DNA, 15 bp, Homo sapiens
gcggcaccgcccacc

SEQ ID NO: 4833049 - DNA, 18 bp, Homo sapiens
gcggcaccgcccacccac

SEQ ID NO: 4833050 - DNA, 19 bp, Homo sapiens
gcggcatccgagcccctgt

SEQ ID NO: 4833051 - DNA, 16 bp, Homo sapiens
gcggccccgcggagcc

SEQ ID NO: 4833052 - DNA, 14 bp, Homo sapiens
gcggcccggcccac

SEQ ID NO: 4833053 - DNA, 23 bp, Homo sapiens
gcggcccggcccacgcagagccc

SEQ ID NO: 4833054 - DNA, 17 bp, Homo sapiens
gcggcccgtgcgcagcc

SEQ ID NO: 4833055 - DNA, 21 bp, Homo sapiens
gcggccgctctccgccccccg

SEQ ID NO: 4833056 - DNA, 16 bp, Homo sapiens
gcggcggtgggcgcct

SEQ ID NO: 4833057 - DNA, 18 bp, Homo sapiens
gcggcggtgggcgcctgt

SEQ ID NO: 4833058 - DNA, 12 bp, Homo sapiens
gcggctctggga

SEQ ID NO: 4833059 - DNA, 20 bp, Homo sapiens
gcggctgaggacggggcaga

SEQ ID NO: 4833060 - DNA, 17 bp, Homo sapiens
gcgggacagcggccccg

SEQ ID NO: 4833061 - DNA, 13 bp, Homo sapiens
gcgggcagcccct

SEQ ID NO: 4833062 - DNA, 16 bp, Homo sapiens
gcgggcagcccctgct

SEQ ID NO: 4833063 - DNA, 18 bp, Homo sapiens
gcgggcagcccctgctgg

SEQ ID NO: 4833064 - DNA, 19 bp, Homo sapiens
gcgggcagcccctgctgga

SEQ ID NO: 4833065 - DNA, 22 bp, Homo sapiens
gcgggcagcccctgctggacca

SEQ ID NO: 4833066 - DNA, 15 bp, Homo sapiens
gcgggcttcctcctg

SEQ ID NO: 4833067 - DNA, 22 bp, Homo sapiens
gcggggctgtgcgggcgcccgg

SEQ ID NO: 4833068 - DNA, 13 bp, Homo sapiens
gcggggcttctgg

SEQ ID NO: 4833069 - DNA, 17 bp, Homo sapiens
gcgggggctaactggcc

SEQ ID NO: 4833070 - DNA, 19 bp, Homo sapiens
gcgtatgcagtgtagattt

SEQ ID NO: 4833071 - DNA, 21 bp, Homo sapiens
gcgtcagtcgatattcccagg

SEQ ID NO: 4833072 - DNA, 22 bp, Homo sapiens
gcgtcccttctctttggggctc

SEQ ID NO: 4833073 - DNA, 20 bp, Homo sapiens
gcgtctcctcgtcccgaggg

SEQ ID NO: 4833074 - DNA, 14 bp, Homo sapiens
gcgtcttgtatttt

SEQ ID NO: 4833075 - DNA, 18 bp, Homo sapiens
gcgtgaccggcccgccac

SEQ ID NO: 4833076 - DNA, 16 bp, Homo sapiens
gcgtgatctcagctca

SEQ ID NO: 4833077 - DNA, 22 bp, Homo sapiens
gcgtgggatccagagagaagca

SEQ ID NO: 4833078 - DNA, 14 bp, Homo sapiens
gcgtggttctgcca

SEQ ID NO: 4833079 - DNA, 11 bp, Homo sapiens
gcgtgtggccc

SEQ ID NO: 4833080 - DNA, 16 bp, Homo sapiens
gcgtgtggccctgtgg

SEQ ID NO: 4833081 - DNA, 14 bp, Homo sapiens
gcgtgtgtggccta

SEQ ID NO: 4833082 - DNA, 17 bp, Homo sapiens
gctaacatggaagtact

SEQ ID NO: 4833083 - DNA, 18 bp, Homo sapiens
gctaacatggaagtacta

SEQ ID NO: 4833084 - DNA, 16 bp, Homo sapiens
gctaactggccccagg

SEQ ID NO: 4833085 - DNA, 17 bp, Homo sapiens
gctaactggccccaggc

SEQ ID NO: 4833086 - DNA, 13 bp, Homo sapiens
gctaagaggctgc

SEQ ID NO: 4833087 - DNA, 14 bp, Homo sapiens
gctaagaggctgct

SEQ ID NO: 4833088 - DNA, 23 bp, Homo sapiens
gctaagataattaaatgaaatac

SEQ ID NO: 4833089 - DNA, 18 bp, Homo sapiens
gctaagtggaagacagag

SEQ ID NO: 4833090 - DNA, 18 bp, Homo sapiens
gctacatatgtaggaaaa

SEQ ID NO: 4833091 - DNA, 14 bp, Homo sapiens
gctactcagatctg

SEQ ID NO: 4833092 - DNA, 14 bp, Homo sapiens
gctactcttcagaa

SEQ ID NO: 4833093 - DNA, 16 bp, Homo sapiens
gctacttggtgggttt

SEQ ID NO: 4833094 - DNA, 15 bp, Homo sapiens
gctagaaagagaaaa

SEQ ID NO: 4833095 - DNA, 18 bp, Homo sapiens
gctagagaaattcttgtt

SEQ ID NO: 4833096 - DNA, 15 bp, Homo sapiens
gctagagcattctgg

SEQ ID NO: 4833097 - DNA, 17 bp, Homo sapiens
gctaggggacatcagag

SEQ ID NO: 4833098 - DNA, 13 bp, Homo sapiens
gctagtctgtgcc

SEQ ID NO: 4833099 - DNA, 16 bp, Homo sapiens
gctagtctgtgcctca

SEQ ID NO: 4833100 - DNA, 19 bp, Homo sapiens
gctagtctgtgcctcagtg

SEQ ID NO: 4833101 - DNA, 17 bp, Homo sapiens
gctagtgttaatccaga

SEQ ID NO: 4833102 - DNA, 17 bp, Homo sapiens
gctagtttaaaattatt

SEQ ID NO: 4833103 - DNA, 21 bp, Homo sapiens
gctagtttaaaattattaaaa

SEQ ID NO: 4833104 - DNA, 18 bp, Homo sapiens
gctataaatagtgaaaat

SEQ ID NO: 4833105 - DNA, 19 bp, Homo sapiens
gctatccacagaacctttg

SEQ ID NO: 4833106 - DNA, 22 bp, Homo sapiens
gctatccacagaacctttgtca

SEQ ID NO: 4833107 - DNA, 13 bp, Homo sapiens
gctatccagccgc

SEQ ID NO: 4833108 - DNA, 15 bp, Homo sapiens
gctatccagccgcaa

SEQ ID NO: 4833109 - DNA, 16 bp, Homo sapiens
gctatctgtcatctct

SEQ ID NO: 4833110 - DNA, 15 bp, Homo sapiens
gctatcttcatgtaa

SEQ ID NO: 4833111 - DNA, 21 bp, Homo sapiens
gctatgaagagctagagaaat

SEQ ID NO: 4833112 - DNA, 14 bp, Homo sapiens
gctatgatatgtgc

SEQ ID NO: 4833113 - DNA, 23 bp, Homo sapiens
gctatgcacaccaaattgctgag

SEQ ID NO: 4833114 - DNA, 19 bp, Homo sapiens
gctatgcgcaatgtggcat

SEQ ID NO: 4833115 - DNA, 23 bp, Homo sapiens
gctatgttttggagagagcaatc

SEQ ID NO: 4833116 - DNA, 16 bp, Homo sapiens
gctattcccaggcagg

SEQ ID NO: 4833117 - DNA, 18 bp, Homo sapiens
gctattgtccttgtgtat

SEQ ID NO: 4833118 - DNA, 12 bp, Homo sapiens
gctatttaagtg

SEQ ID NO: 4833119 - DNA, 13 bp, Homo sapiens
gctatttgtgtaa

SEQ ID NO: 4833120 - DNA, 15 bp, Homo sapiens
gctcaacataacata

SEQ ID NO: 4833121 - DNA, 13 bp, Homo sapiens
gctcaatgtgctg

SEQ ID NO: 4833122 - DNA, 14 bp, Homo sapiens
gctcaatgtgctgt

SEQ ID NO: 4833123 - DNA, 17 bp, Homo sapiens
gctcacaactgtttttg

SEQ ID NO: 4833124 - DNA, 19 bp, Homo sapiens
gctcacaagccgtgtttta

SEQ ID NO: 4833125 - DNA, 20 bp, Homo sapiens
gctcacaagccgtgttttat

SEQ ID NO: 4833126 - DNA, 21 bp, Homo sapiens
gctcacaccggcactgtgcac

SEQ ID NO: 4833127 - DNA, 15 bp, Homo sapiens
gctcacagcacattt

SEQ ID NO: 4833128 - DNA, 14 bp, Homo sapiens
gctcacagccacca

SEQ ID NO: 4833129 - DNA, 18 bp, Homo sapiens
gctcaccaagctgttcca

SEQ ID NO: 4833130 - DNA, 15 bp, Homo sapiens
gctcagcattgtgta

SEQ ID NO: 4833131 - DNA, 18 bp, Homo sapiens
gctcagccccagacctgc

SEQ ID NO: 4833132 - DNA, 11 bp, Homo sapiens
gctcaggagaa

SEQ ID NO: 4833133 - DNA, 17 bp, Homo sapiens
gctcaggagaaggcctg

SEQ ID NO: 4833134 - DNA, 19 bp, Homo sapiens
gctcaggcctcacctggct

SEQ ID NO: 4833135 - DNA, 13 bp, Homo sapiens
gctcaggctgccc

SEQ ID NO: 4833136 - DNA, 15 bp, Homo sapiens
gctcagtcccacagc

SEQ ID NO: 4833137 - DNA, 18 bp, Homo sapiens
gctcagtcccacagcccc

SEQ ID NO: 4833138 - DNA, 19 bp, Homo sapiens
gctcagtcccacagcccct

SEQ ID NO: 4833139 - DNA, 21 bp, Homo sapiens
gctcataactagagtatgtgt

SEQ ID NO: 4833140 - DNA, 22 bp, Homo sapiens
gctcataactagagtatgtgta

SEQ ID NO: 4833141 - DNA, 23 bp, Homo sapiens
gctcataactagagtatgtgtat

SEQ ID NO: 4833142 - DNA, 15 bp, Homo sapiens
gctcatcagaaacaa

SEQ ID NO: 4833143 - DNA, 14 bp, Homo sapiens
gctccaacctggag

SEQ ID NO: 4833144 - DNA, 15 bp, Homo sapiens
gctccaacctggagg

SEQ ID NO: 4833145 - DNA, 13 bp, Homo sapiens
gctccaccctccc

SEQ ID NO: 4833146 - DNA, 15 bp, Homo sapiens
gctccaccctcccct

SEQ ID NO: 4833147 - DNA, 22 bp, Homo sapiens
gctccagtataaattacatgca

SEQ ID NO: 4833148 - DNA, 18 bp, Homo sapiens
gctccagtttctcttaag

SEQ ID NO: 4833149 - DNA, 20 bp, Homo sapiens
gctccatgcagatctagcca

SEQ ID NO: 4833150 - DNA, 15 bp, Homo sapiens
gctcccactgcccct

SEQ ID NO: 4833151 - DNA, 22 bp, Homo sapiens
gctccccaatccaacccatgca

SEQ ID NO: 4833152 - DNA, 15 bp, Homo sapiens
gctcccggctctgag

SEQ ID NO: 4833153 - DNA, 17 bp, Homo sapiens
gctccctcatgcagata

SEQ ID NO: 4833154 - DNA, 19 bp, Homo sapiens
gctccctttttgaattgtg

SEQ ID NO: 4833155 - DNA, 16 bp, Homo sapiens
gctccggcagaggcag

SEQ ID NO: 4833156 - DNA, 21 bp, Homo sapiens
gctccggcagaggcagggccc

SEQ ID NO: 4833157 - DNA, 22 bp, Homo sapiens
gctccgggtgcgtgaccggccc

SEQ ID NO: 4833158 - DNA, 23 bp, Homo sapiens
gctcctaagctgccagccttccc

SEQ ID NO: 4833159 - DNA, 19 bp, Homo sapiens
gctcctcgggtggggcctg

SEQ ID NO: 4833160 - DNA, 19 bp, Homo sapiens
gctcctgctgaccttctgc

SEQ ID NO: 4833161 - DNA, 17 bp, Homo sapiens
gctcctttcccctctca

SEQ ID NO: 4833162 - DNA, 18 bp, Homo sapiens
gctcctttcccctctcat

SEQ ID NO: 4833163 - DNA, 16 bp, Homo sapiens
gctccttttctctttg

SEQ ID NO: 4833164 - DNA, 12 bp, Homo sapiens
gctcggacacag

SEQ ID NO: 4833165 - DNA, 21 bp, Homo sapiens
gctcggccaggcacggaggct

SEQ ID NO: 4833166 - DNA, 22 bp, Homo sapiens
gctcggccaggcacggaggctc

SEQ ID NO: 4833167 - DNA, 15 bp, Homo sapiens
gctcggcctcttgag

SEQ ID NO: 4833168 - DNA, 23 bp, Homo sapiens
gctcggcctcttgagagccccac

SEQ ID NO: 4833169 - DNA, 18 bp, Homo sapiens
gctcgggaaggcctgagg

SEQ ID NO: 4833170 - DNA, 23 bp, Homo sapiens
gctcgggaaggcctgagggaagc

SEQ ID NO: 4833171 - DNA, 17 bp, Homo sapiens
gctcgtgtttcacagtg

SEQ ID NO: 4833172 - DNA, 23 bp, Homo sapiens
gctcgtgtttcacagtgggcggc

SEQ ID NO: 4833173 - DNA, 14 bp, Homo sapiens
gctctaaagcagag

SEQ ID NO: 4833174 - DNA, 22 bp, Homo sapiens
gctctagggttgctggagcctg

SEQ ID NO: 4833175 - DNA, 24 bp, Homo sapiens
gctctagggttgctggagcctgag

SEQ ID NO: 4833176 - DNA, 15 bp, Homo sapiens
gctctcaggccagct

SEQ ID NO: 4833177 - DNA, 16 bp, Homo sapiens
gctctcaggccagctg

SEQ ID NO: 4833178 - DNA, 19 bp, Homo sapiens
gctctcaggccagctgctt

SEQ ID NO: 4833179 - DNA, 20 bp, Homo sapiens
gctctcaggccagctgcttg

SEQ ID NO: 4833180 - DNA, 19 bp, Homo sapiens
gctctccctcccttctttc

SEQ ID NO: 4833181 - DNA, 14 bp, Homo sapiens
gctctcctccagcc

SEQ ID NO: 4833182 - DNA, 17 bp, Homo sapiens
gctctcctccagccctg

SEQ ID NO: 4833183 - DNA, 20 bp, Homo sapiens
gctctcctccagccctgggc

SEQ ID NO: 4833184 - DNA, 14 bp, Homo sapiens
gctctccttcactc

SEQ ID NO: 4833185 - DNA, 20 bp, Homo sapiens
gctctctcattcccaggcac

SEQ ID NO: 4833186 - DNA, 13 bp, Homo sapiens
gctctctgtctgg

SEQ ID NO: 4833187 - DNA, 14 bp, Homo sapiens
gctctgaatctctc

SEQ ID NO: 4833188 - DNA, 17 bp, Homo sapiens
gctctgaatctctcaaa

SEQ ID NO: 4833189 - DNA, 23 bp, Homo sapiens
gctctgaatctctcaaaatgtgc

SEQ ID NO: 4833190 - DNA, 19 bp, Homo sapiens
gctctgaggctgccccagg

SEQ ID NO: 4833191 - DNA, 11 bp, Homo sapiens
gctctgcccct

SEQ ID NO: 4833192 - DNA, 16 bp, Homo sapiens
gctctgcccctccgtc

SEQ ID NO: 4833193 - DNA, 18 bp, Homo sapiens
gctctgcccctccgtccc

SEQ ID NO: 4833194 - DNA, 23 bp, Homo sapiens
gctctgcccctccgtccccaggg

SEQ ID NO: 4833195 - DNA, 22 bp, Homo sapiens
gctctgctacactcgtccccct

SEQ ID NO: 4833196 - DNA, 19 bp, Homo sapiens
gctctgctcatctacacat

SEQ ID NO: 4833197 - DNA, 22 bp, Homo sapiens
gctctggagcccgcctgcgccc

SEQ ID NO: 4833198 - DNA, 15 bp, Homo sapiens
gctctgtagcctggt

SEQ ID NO: 4833199 - DNA, 19 bp, Homo sapiens
gctctgtagcctggtctgt

SEQ ID NO: 4833200 - DNA, 23 bp, Homo sapiens
gctctgtagcctggtctgtgcat

SEQ ID NO: 4833201 - DNA, 19 bp, Homo sapiens
gctcttcattgcactgcag

SEQ ID NO: 4833202 - DNA, 20 bp, Homo sapiens
gctcttcccaagtcctcgcc

SEQ ID NO: 4833203 - DNA, 22 bp, Homo sapiens
gctcttcccaagtcctcgcccc

SEQ ID NO: 4833204 - DNA, 12 bp, Homo sapiens
gctcttctcatt

SEQ ID NO: 4833205 - DNA, 20 bp, Homo sapiens
gctcttctgttctcaaatgc

SEQ ID NO: 4833206 - DNA, 18 bp, Homo sapiens
gctctttaagtaaaatgt

SEQ ID NO: 4833207 - DNA, 22 bp, Homo sapiens
gctctttcaccctgccaccctc

SEQ ID NO: 4833208 - DNA, 16 bp, Homo sapiens
gctgaaagacagtaaa

SEQ ID NO: 4833209 - DNA, 18 bp, Homo sapiens
gctgaagaaacacagcat

SEQ ID NO: 4833210 - DNA, 12 bp, Homo sapiens
gctgaataacaa

SEQ ID NO: 4833211 - DNA, 16 bp, Homo sapiens
gctgaatgagaagtaa

SEQ ID NO: 4833212 - DNA, 19 bp, Homo sapiens
gctgaatgagaagtaaatt

SEQ ID NO: 4833213 - DNA, 18 bp, Homo sapiens
gctgaatgtatgtaaata

SEQ ID NO: 4833214 - DNA, 19 bp, Homo sapiens
gctgacagcactaaacttg

SEQ ID NO: 4833215 - DNA, 23 bp, Homo sapiens
gctgactcttactaaccaccatt

SEQ ID NO: 4833216 - DNA, 14 bp, Homo sapiens
gctgagaggatgaa

SEQ ID NO: 4833217 - DNA, 23 bp, Homo sapiens
gctgagatgggaggatcacttga

SEQ ID NO: 4833218 - DNA, 19 bp, Homo sapiens
gctgagatgtttagtagct

SEQ ID NO: 4833219 - DNA, 20 bp, Homo sapiens
gctgagatgtttagtagctg

SEQ ID NO: 4833220 - DNA, 14 bp, Homo sapiens
gctgagcacatctc

SEQ ID NO: 4833221 - DNA, 13 bp, Homo sapiens
gctgagcccctcc

SEQ ID NO: 4833222 - DNA, 14 bp, Homo sapiens
gctgagcccctcct

SEQ ID NO: 4833223 - DNA, 17 bp, Homo sapiens
gctgaggacggggcaga

SEQ ID NO: 4833224 - DNA, 15 bp, Homo sapiens
gctgagggcagggtt

SEQ ID NO: 4833225 - DNA, 17 bp, Homo sapiens
gctgagtcggctgggca

SEQ ID NO: 4833226 - DNA, 22 bp, Homo sapiens
gctgagtcggctgggcagggcc

SEQ ID NO: 4833227 - DNA, 14 bp, Homo sapiens
gctgatagaagaag

SEQ ID NO: 4833228 - DNA, 13 bp, Homo sapiens
gctgatagtgttt

SEQ ID NO: 4833229 - DNA, 17 bp, Homo sapiens
gctgatggagaaggaag

SEQ ID NO: 4833230 - DNA, 15 bp, Homo sapiens
gctgattggaaaata

SEQ ID NO: 4833231 - DNA, 16 bp, Homo sapiens
gctgattggaaaataa

SEQ ID NO: 4833232 - DNA, 17 bp, Homo sapiens
gctgattggaaaataat

SEQ ID NO: 4833233 - DNA, 23 bp, Homo sapiens
gctgattggaaaataataaaaga

SEQ ID NO: 4833234 - DNA, 18 bp, Homo sapiens
gctgatttactaacagta

SEQ ID NO: 4833235 - DNA, 17 bp, Homo sapiens
gctgcaaaatgaagaca

SEQ ID NO: 4833236 - DNA, 14 bp, Homo sapiens
gctgcacagtagtg

SEQ ID NO: 4833237 - DNA, 14 bp, Homo sapiens
gctgcaccagcagg

SEQ ID NO: 4833238 - DNA, 19 bp, Homo sapiens
gctgcagccccctgcttct

SEQ ID NO: 4833239 - DNA, 20 bp, Homo sapiens
gctgcagccccctgcttctc

SEQ ID NO: 4833240 - DNA, 20 bp, Homo sapiens
gctgcagctaatttgtgaaa

SEQ ID NO: 4833241 - DNA, 10 bp, Homo sapiens
gctgcagctt

SEQ ID NO: 4833242 - DNA, 13 bp, Homo sapiens
gctgcagcttggg

SEQ ID NO: 4833243 - DNA, 23 bp, Homo sapiens
gctgcagcttgggagagcccctg

SEQ ID NO: 4833244 - DNA, 15 bp, Homo sapiens
gctgcaggaatcaaa

SEQ ID NO: 4833245 - DNA, 18 bp, Homo sapiens
gctgcagtcagcacagag

SEQ ID NO: 4833246 - DNA, 20 bp, Homo sapiens
gctgcagtcagcacagagag

SEQ ID NO: 4833247 - DNA, 18 bp, Homo sapiens
gctgcagttagcacagag

SEQ ID NO: 4833248 - DNA, 19 bp, Homo sapiens
gctgcagttagcacagagg

SEQ ID NO: 4833249 - DNA, 16 bp, Homo sapiens
gctgcatccaaggctt

SEQ ID NO: 4833250 - DNA, 16 bp, Homo sapiens
gctgcatcctcagccc

SEQ ID NO: 4833251 - DNA, 23 bp, Homo sapiens
gctgcatcctcagccccagggcc

SEQ ID NO: 4833252 - DNA, 21 bp, Homo sapiens
gctgccaagataccttcatgg

SEQ ID NO: 4833253 - DNA, 19 bp, Homo sapiens
gctgccaatgggagctcat

SEQ ID NO: 4833254 - DNA, 14 bp, Homo sapiens
gctgccagccttcc

SEQ ID NO: 4833255 - DNA, 16 bp, Homo sapiens
gctgccagccttccct

SEQ ID NO: 4833256 - DNA, 15 bp, Homo sapiens
gctgccaggctccca

SEQ ID NO: 4833257 - DNA, 18 bp, Homo sapiens
gctgccaggctcccactg

SEQ ID NO: 4833258 - DNA, 18 bp, Homo sapiens
gctgcccaatttcacaga

SEQ ID NO: 4833259 - DNA, 16 bp, Homo sapiens
gctgcccagcggctct

SEQ ID NO: 4833260 - DNA, 15 bp, Homo sapiens
gctgcccccacagat

SEQ ID NO: 4833261 - DNA, 13 bp, Homo sapiens
gctgcccctggca

SEQ ID NO: 4833262 - DNA, 20 bp, Homo sapiens
gctgcccctggcagcccctg

SEQ ID NO: 4833263 - DNA, 15 bp, Homo sapiens
gctgccgctgcacca

SEQ ID NO: 4833264 - DNA, 14 bp, Homo sapiens
gctgcctaaatcca

SEQ ID NO: 4833265 - DNA, 21 bp, Homo sapiens
gctgcctccaagtcatgggag

SEQ ID NO: 4833266 - DNA, 13 bp, Homo sapiens
gctgcctccgggc

SEQ ID NO: 4833267 - DNA, 23 bp, Homo sapiens
gctgcctccgggcctcggcctgg

SEQ ID NO: 4833268 - DNA, 16 bp, Homo sapiens
gctgcctgaaaatcaa

SEQ ID NO: 4833269 - DNA, 13 bp, Homo sapiens
gctgcctgccatg

SEQ ID NO: 4833270 - DNA, 23 bp, Homo sapiens
gctgcctgcccgcacagcagcct

SEQ ID NO: 4833271 - DNA, 22 bp, Homo sapiens
gctgcctgcctccggccctgcc

SEQ ID NO: 4833272 - DNA, 23 bp, Homo sapiens
gctgcctggcgggcagcccctgc

SEQ ID NO: 4833273 - DNA, 22 bp, Homo sapiens
gctgccttctgacggccctgca

SEQ ID NO: 4833274 - DNA, 12 bp, Homo sapiens
gctgcgcctgcc

SEQ ID NO: 4833275 - DNA, 14 bp, Homo sapiens
gctgcgcctgcccg

SEQ ID NO: 4833276 - DNA, 15 bp, Homo sapiens
gctgcgcctgcccgc

SEQ ID NO: 4833277 - DNA, 13 bp, Homo sapiens
gctgctaagtgga

SEQ ID NO: 4833278 - DNA, 17 bp, Homo sapiens
gctgctaagtggaagac

SEQ ID NO: 4833279 - DNA, 14 bp, Homo sapiens
gctgctatgctgtt

SEQ ID NO: 4833280 - DNA, 16 bp, Homo sapiens
gctgctccatgcacag

SEQ ID NO: 4833281 - DNA, 14 bp, Homo sapiens
gctgctcccggtgt

SEQ ID NO: 4833282 - DNA, 15 bp, Homo sapiens
gctgctcccggtgtg

SEQ ID NO: 4833283 - DNA, 16 bp, Homo sapiens
gctgctcgggaaggcc

SEQ ID NO: 4833284 - DNA, 19 bp, Homo sapiens
gctgctcgggaaggcctga

SEQ ID NO: 4833285 - DNA, 20 bp, Homo sapiens
gctgctcgggaaggcctgag

SEQ ID NO: 4833286 - DNA, 13 bp, Homo sapiens
gctgctctccatc

SEQ ID NO: 4833287 - DNA, 23 bp, Homo sapiens
gctgctctccttcactctgacag

SEQ ID NO: 4833288 - DNA, 16 bp, Homo sapiens
gctgctctctaagaat

SEQ ID NO: 4833289 - DNA, 19 bp, Homo sapiens
gctgctctctaagaattca

SEQ ID NO: 4833290 - DNA, 22 bp, Homo sapiens
gctgctgagcacatctcttcat

SEQ ID NO: 4833291 - DNA, 12 bp, Homo sapiens
gctgctgcactg

SEQ ID NO: 4833292 - DNA, 16 bp, Homo sapiens
gctgcttgagtggaca

SEQ ID NO: 4833293 - DNA, 17 bp, Homo sapiens
gctgcttgggcttcatc

SEQ ID NO: 4833294 - DNA, 19 bp, Homo sapiens
gctgctttccaacacacaa

SEQ ID NO: 4833295 - DNA, 13 bp, Homo sapiens
gctgcttttgatg

SEQ ID NO: 4833296 - DNA, 11 bp, Homo sapiens
gctggaaaact

SEQ ID NO: 4833297 - DNA, 16 bp, Homo sapiens
gctggaaaactgccac

SEQ ID NO: 4833298 - DNA, 17 bp, Homo sapiens
gctggaaaactgccaca

SEQ ID NO: 4833299 - DNA, 14 bp, Homo sapiens
gctggaaaggcccg

SEQ ID NO: 4833300 - DNA, 20 bp, Homo sapiens
gctggagaccctgcgcccct

SEQ ID NO: 4833301 - DNA, 22 bp, Homo sapiens
gctggagaccctgcgcccctgc

SEQ ID NO: 4833302 - DNA, 13 bp, Homo sapiens
gctggagccccat

SEQ ID NO: 4833303 - DNA, 14 bp, Homo sapiens
gctggagccccatc

SEQ ID NO: 4833304 - DNA, 22 bp, Homo sapiens
gctggagccccatcgcctggga

SEQ ID NO: 4833305 - DNA, 13 bp, Homo sapiens
gctggagcctgag

SEQ ID NO: 4833306 - DNA, 20 bp, Homo sapiens
gctggagtgcagtggcgcga

SEQ ID NO: 4833307 - DNA, 20 bp, Homo sapiens
gctggatgtgcatctggcct

SEQ ID NO: 4833308 - DNA, 16 bp, Homo sapiens
gctggcacccactgga

SEQ ID NO: 4833309 - DNA, 16 bp, Homo sapiens
gctggccagcaccctc

SEQ ID NO: 4833310 - DNA, 19 bp, Homo sapiens
gctggccagcaccctctcc

SEQ ID NO: 4833311 - DNA, 21 bp, Homo sapiens
gctggccagcaccctctcctg

SEQ ID NO: 4833312 - DNA, 12 bp, Homo sapiens
gctggccagcct

SEQ ID NO: 4833313 - DNA, 13 bp, Homo sapiens
gctggccagcctg

SEQ ID NO: 4833314 - DNA, 14 bp, Homo sapiens
gctggccagcctgg

SEQ ID NO: 4833315 - DNA, 12 bp, Homo sapiens
gctggccctgcc

SEQ ID NO: 4833316 - DNA, 17 bp, Homo sapiens
gctggccctgccctccc

SEQ ID NO: 4833317 - DNA, 12 bp, Homo sapiens
gctggcttgcac

SEQ ID NO: 4833318 - DNA, 18 bp, Homo sapiens
gctgggagaaaagccaga

SEQ ID NO: 4833319 - DNA, 15 bp, Homo sapiens
gctgggcagaggaaa

SEQ ID NO: 4833320 - DNA, 19 bp, Homo sapiens
gctgggcagaggaaagcaa

SEQ ID NO: 4833321 - DNA, 22 bp, Homo sapiens
gctgggcatggtaccagccctg

SEQ ID NO: 4833322 - DNA, 18 bp, Homo sapiens
gctgggccccccagctca

SEQ ID NO: 4833323 - DNA, 19 bp, Homo sapiens
gctgggccccccagctcag

SEQ ID NO: 4833324 - DNA, 17 bp, Homo sapiens
gctgggcccctgggatg

SEQ ID NO: 4833325 - DNA, 21 bp, Homo sapiens
gctgggcgcctctgtcctggc

SEQ ID NO: 4833326 - DNA, 23 bp, Homo sapiens
gctgggcgcctctgtcctggccc

SEQ ID NO: 4833327 - DNA, 12 bp, Homo sapiens
gctgggtcgccc

SEQ ID NO: 4833328 - DNA, 14 bp, Homo sapiens
gctgggtcgcccct

SEQ ID NO: 4833329 - DNA, 18 bp, Homo sapiens
gctgggtcgcccctcctc

SEQ ID NO: 4833330 - DNA, 18 bp, Homo sapiens
gctggtggagatgtagga

SEQ ID NO: 4833331 - DNA, 19 bp, Homo sapiens
gctggtggagatgtaggaa

SEQ ID NO: 4833332 - DNA, 18 bp, Homo sapiens
gctgtaccggccactgca

SEQ ID NO: 4833333 - DNA, 16 bp, Homo sapiens
gctgtacgtctggtgt

SEQ ID NO: 4833334 - DNA, 18 bp, Homo sapiens
gctgtagacatctgtcct

SEQ ID NO: 4833335 - DNA, 22 bp, Homo sapiens
gctgtataaggtaataaaactc

SEQ ID NO: 4833336 - DNA, 20 bp, Homo sapiens
gctgtatacaaacaggtgct

SEQ ID NO: 4833337 - DNA, 14 bp, Homo sapiens
gctgtatgatttag

SEQ ID NO: 4833338 - DNA, 17 bp, Homo sapiens
gctgtatttgaggaaac

SEQ ID NO: 4833339 - DNA, 21 bp, Homo sapiens
gctgtcaaatccatgtgtccc

SEQ ID NO: 4833340 - DNA, 23 bp, Homo sapiens
gctgtcaattacaggaagtactg

SEQ ID NO: 4833341 - DNA, 14 bp, Homo sapiens
gctgtcatgcccag

SEQ ID NO: 4833342 - DNA, 16 bp, Homo sapiens
gctgtcatgcccagct

SEQ ID NO: 4833343 - DNA, 18 bp, Homo sapiens
gctgtcatgcccagcttg

SEQ ID NO: 4833344 - DNA, 16 bp, Homo sapiens
gctgtcccctgcaagt

SEQ ID NO: 4833345 - DNA, 13 bp, Homo sapiens
gctgtccctgtgg

SEQ ID NO: 4833346 - DNA, 20 bp, Homo sapiens
gctgtccctgtgggctcaca

SEQ ID NO: 4833347 - DNA, 23 bp, Homo sapiens
gctgtccctgtgggctcacaccg

SEQ ID NO: 4833348 - DNA, 16 bp, Homo sapiens
gctgtcccttttcctt

SEQ ID NO: 4833349 - DNA, 16 bp, Homo sapiens
gctgtccgtcctgctc

SEQ ID NO: 4833350 - DNA, 22 bp, Homo sapiens
gctgtcctctcagaactcctgt

SEQ ID NO: 4833351 - DNA, 23 bp, Homo sapiens
gctgtcctctcagaactcctgtg

SEQ ID NO: 4833352 - DNA, 16 bp, Homo sapiens
gctgtcgccccaggcc

SEQ ID NO: 4833353 - DNA, 23 bp, Homo sapiens
gctgtcgccccaggccctccctg

SEQ ID NO: 4833354 - DNA, 22 bp, Homo sapiens
gctgtctgaaaaagtgttttta

SEQ ID NO: 4833355 - DNA, 21 bp, Homo sapiens
gctgtctgtcaccagctatct

SEQ ID NO: 4833356 - DNA, 14 bp, Homo sapiens
gctgtctgtggctt

SEQ ID NO: 4833357 - DNA, 20 bp, Homo sapiens
gctgtgatgcatgagctccc

SEQ ID NO: 4833358 - DNA, 19 bp, Homo sapiens
gctgtggcatcaggaaagg

SEQ ID NO: 4833359 - DNA, 16 bp, Homo sapiens
gctgtgtgcagagtat

SEQ ID NO: 4833360 - DNA, 14 bp, Homo sapiens
gctgttatctgtct

SEQ ID NO: 4833361 - DNA, 17 bp, Homo sapiens
gctgttccacttctcta

SEQ ID NO: 4833362 - DNA, 18 bp, Homo sapiens
gctgttccacttctctag

SEQ ID NO: 4833363 - DNA, 15 bp, Homo sapiens
gctgttctgcactga

SEQ ID NO: 4833364 - DNA, 17 bp, Homo sapiens
gctgttctgcactgaaa

SEQ ID NO: 4833365 - DNA, 16 bp, Homo sapiens
gctgttgattctttca

SEQ ID NO: 4833366 - DNA, 22 bp, Homo sapiens
gctgttttggatgaatgcagta

SEQ ID NO: 4833367 - DNA, 12 bp, Homo sapiens
gcttaaacattt

SEQ ID NO: 4833368 - DNA, 20 bp, Homo sapiens
gcttaaacatttccctgctg

SEQ ID NO: 4833369 - DNA, 14 bp, Homo sapiens
gcttaacataaact

SEQ ID NO: 4833370 - DNA, 15 bp, Homo sapiens
gcttaacataaactt

SEQ ID NO: 4833371 - DNA, 23 bp, Homo sapiens
gcttaacattaagtattccttgg

SEQ ID NO: 4833372 - DNA, 22 bp, Homo sapiens
gcttaacctttccgctgtcgcc

SEQ ID NO: 4833373 - DNA, 18 bp, Homo sapiens
gcttaaggaaaagagaaa

SEQ ID NO: 4833374 - DNA, 15 bp, Homo sapiens
gcttaatctagagct

SEQ ID NO: 4833375 - DNA, 19 bp, Homo sapiens
gcttaatctagagctatgc

SEQ ID NO: 4833376 - DNA, 22 bp, Homo sapiens
gcttaatctagagctatgcaca

SEQ ID NO: 4833377 - DNA, 12 bp, Homo sapiens
gcttacctgaca

SEQ ID NO: 4833378 - DNA, 14 bp, Homo sapiens
gcttacctgacaca

SEQ ID NO: 4833379 - DNA, 16 bp, Homo sapiens
gcttacctgacacaag

SEQ ID NO: 4833380 - DNA, 13 bp, Homo sapiens
gcttagaatgggg

SEQ ID NO: 4833381 - DNA, 13 bp, Homo sapiens
gcttagctgaaac

SEQ ID NO: 4833382 - DNA, 14 bp, Homo sapiens
gcttagtatctcat

SEQ ID NO: 4833383 - DNA, 11 bp, Homo sapiens
gcttagtgtct

SEQ ID NO: 4833384 - DNA, 22 bp, Homo sapiens
gcttatcagaactcctttctaa

SEQ ID NO: 4833385 - DNA, 17 bp, Homo sapiens
gcttatgagatactttg

SEQ ID NO: 4833386 - DNA, 18 bp, Homo sapiens
gcttatgagatactttgc

SEQ ID NO: 4833387 - DNA, 14 bp, Homo sapiens
gcttatttatattc

SEQ ID NO: 4833388 - DNA, 10 bp, Homo sapiens
gcttcacaca

SEQ ID NO: 4833389 - DNA, 16 bp, Homo sapiens
gcttcaccgcattcca

SEQ ID NO: 4833390 - DNA, 15 bp, Homo sapiens
gcttcatcctcctca

SEQ ID NO: 4833391 - DNA, 14 bp, Homo sapiens
gcttcattaaaaca

SEQ ID NO: 4833392 - DNA, 11 bp, Homo sapiens
gcttcattcaa

SEQ ID NO: 4833393 - DNA, 18 bp, Homo sapiens
gcttcattcaagcttcat

SEQ ID NO: 4833394 - DNA, 15 bp, Homo sapiens
gcttccagctcagtc

SEQ ID NO: 4833395 - DNA, 23 bp, Homo sapiens
gcttccatggtggtttcagaaag

SEQ ID NO: 4833396 - DNA, 17 bp, Homo sapiens
gcttcccacctccctgc

SEQ ID NO: 4833397 - DNA, 22 bp, Homo sapiens
gcttcccacctccctgcccagg

SEQ ID NO: 4833398 - DNA, 14 bp, Homo sapiens
gcttcccaggaccc

SEQ ID NO: 4833399 - DNA, 16 bp, Homo sapiens
gcttcccatctgaaga

SEQ ID NO: 4833400 - DNA, 14 bp, Homo sapiens
gcttccccatcgcc

SEQ ID NO: 4833401 - DNA, 19 bp, Homo sapiens
gcttccctgcgacggaggc

SEQ ID NO: 4833402 - DNA, 17 bp, Homo sapiens
gcttccgtgagacacaa

SEQ ID NO: 4833403 - DNA, 21 bp, Homo sapiens
gcttccttctcatcttgcctc

SEQ ID NO: 4833404 - DNA, 20 bp, Homo sapiens
gcttctaagggatccagaga

SEQ ID NO: 4833405 - DNA, 18 bp, Homo sapiens
gcttctaatatttattgc

SEQ ID NO: 4833406 - DNA, 21 bp, Homo sapiens
gcttctaatatttattgcttt

SEQ ID NO: 4833407 - DNA, 13 bp, Homo sapiens
gcttctccacctc

SEQ ID NO: 4833408 - DNA, 14 bp, Homo sapiens
gcttctccacctcc

SEQ ID NO: 4833409 - DNA, 15 bp, Homo sapiens
gcttctccacctccc

SEQ ID NO: 4833410 - DNA, 13 bp, Homo sapiens
gcttctccccctc

SEQ ID NO: 4833411 - DNA, 14 bp, Homo sapiens
gcttctccccctca

SEQ ID NO: 4833412 - DNA, 16 bp, Homo sapiens
gcttctccccctcagc

SEQ ID NO: 4833413 - DNA, 21 bp, Homo sapiens
gcttctccccctcagctctcc

SEQ ID NO: 4833414 - DNA, 13 bp, Homo sapiens
gcttctcccgcca

SEQ ID NO: 4833415 - DNA, 15 bp, Homo sapiens
gcttctcccgccatt

SEQ ID NO: 4833416 - DNA, 20 bp, Homo sapiens
gcttctcccgccattggcct

SEQ ID NO: 4833417 - DNA, 19 bp, Homo sapiens
gcttgaccgtgaggccaga

SEQ ID NO: 4833418 - DNA, 20 bp, Homo sapiens
gcttgaccgtgaggccagag

SEQ ID NO: 4833419 - DNA, 23 bp, Homo sapiens
gcttgaccgtgaggccagagaca

SEQ ID NO: 4833420 - DNA, 18 bp, Homo sapiens
gcttgacctttaagagaa

SEQ ID NO: 4833421 - DNA, 13 bp, Homo sapiens
gcttgagcatgcc

SEQ ID NO: 4833422 - DNA, 19 bp, Homo sapiens
gcttgaggccaaatgagtt

SEQ ID NO: 4833423 - DNA, 14 bp, Homo sapiens
gcttgagtggacag

SEQ ID NO: 4833424 - DNA, 19 bp, Homo sapiens
gcttgagtggacagcagct

SEQ ID NO: 4833425 - DNA, 19 bp, Homo sapiens
gcttgattctaaaggggac

SEQ ID NO: 4833426 - DNA, 23 bp, Homo sapiens
gcttgctcttaagtaccagaagc

SEQ ID NO: 4833427 - DNA, 22 bp, Homo sapiens
gcttgctggaaaactgccacaa

SEQ ID NO: 4833428 - DNA, 23 bp, Homo sapiens
gcttggaaaatgttctgacagca

SEQ ID NO: 4833429 - DNA, 19 bp, Homo sapiens
gcttggactacctataaat

SEQ ID NO: 4833430 - DNA, 20 bp, Homo sapiens
gcttggagcagagacggcag

SEQ ID NO: 4833431 - DNA, 21 bp, Homo sapiens
gcttggagcagagacggcagc

SEQ ID NO: 4833432 - DNA, 19 bp, Homo sapiens
gcttgggcttcatcctcct

SEQ ID NO: 4833433 - DNA, 14 bp, Homo sapiens
gcttggggtagaga

SEQ ID NO: 4833434 - DNA, 22 bp, Homo sapiens
gcttggtttagctgtgcagaag

SEQ ID NO: 4833435 - DNA, 19 bp, Homo sapiens
gcttgtagggtgaggcgtg

SEQ ID NO: 4833436 - DNA, 15 bp, Homo sapiens
gcttgttcagtcact

SEQ ID NO: 4833437 - DNA, 11 bp, Homo sapiens
gcttgttcttc

SEQ ID NO: 4833438 - DNA, 21 bp, Homo sapiens
gcttgtttaaggttcttgctg

SEQ ID NO: 4833439 - DNA, 17 bp, Homo sapiens
gctttagagaagccata

SEQ ID NO: 4833440 - DNA, 17 bp, Homo sapiens
gctttataataaactgt

SEQ ID NO: 4833441 - DNA, 19 bp, Homo sapiens
gctttcatgaccactgggc

SEQ ID NO: 4833442 - DNA, 21 bp, Homo sapiens
gctttcatgtttaagaaatga

SEQ ID NO: 4833443 - DNA, 16 bp, Homo sapiens
gctttccaacacacaa

SEQ ID NO: 4833444 - DNA, 22 bp, Homo sapiens
gctttccgcgtggttctgccac

SEQ ID NO: 4833445 - DNA, 14 bp, Homo sapiens
gctttcctgggtct

SEQ ID NO: 4833446 - DNA, 19 bp, Homo sapiens
gctttcggaattcctgcag

SEQ ID NO: 4833447 - DNA, 13 bp, Homo sapiens
gctttctcatgca

SEQ ID NO: 4833448 - DNA, 17 bp, Homo sapiens
gctttctcatgcataga

SEQ ID NO: 4833449 - DNA, 14 bp, Homo sapiens
gctttctctttgtt

SEQ ID NO: 4833450 - DNA, 14 bp, Homo sapiens
gctttgatcccttc

SEQ ID NO: 4833451 - DNA, 17 bp, Homo sapiens
gctttgatcccttctta

SEQ ID NO: 4833452 - DNA, 21 bp, Homo sapiens
gctttgcaaccttgtacttta

SEQ ID NO: 4833453 - DNA, 18 bp, Homo sapiens
gctttgctctagggaagc

SEQ ID NO: 4833454 - DNA, 21 bp, Homo sapiens
gctttgtaaaccggctggacc

SEQ ID NO: 4833455 - DNA, 20 bp, Homo sapiens
gctttgttttggctgctctc

SEQ ID NO: 4833456 - DNA, 14 bp, Homo sapiens
gcttttcacttctt

SEQ ID NO: 4833457 - DNA, 14 bp, Homo sapiens
gcttttctcatggt

SEQ ID NO: 4833458 - DNA, 20 bp, Homo sapiens
gcttttggtgtttgagtgtt

SEQ ID NO: 4833459 - DNA, 19 bp, Homo sapiens
gcttttgtacgttaattaa

SEQ ID NO: 4833460 - DNA, 22 bp, Homo sapiens
gcttttgtacgttaattaaaca

SEQ ID NO: 4833461 - DNA, 18 bp, Homo sapiens
gcttttttctcaataaaa

SEQ ID NO: 4833462 - DNA, 23 bp, Homo sapiens
ggaaaaaaacttttataaattaa

SEQ ID NO: 4833463 - DNA, 19 bp, Homo sapiens
ggaaaacataatatcttga

SEQ ID NO: 4833464 - DNA, 20 bp, Homo sapiens
ggaaaaggcttgagtctgga

SEQ ID NO: 4833465 - DNA, 14 bp, Homo sapiens
ggaaacatctgatt

SEQ ID NO: 4833466 - DNA, 15 bp, Homo sapiens
ggaaacatctgattt

SEQ ID NO: 4833467 - DNA, 18 bp, Homo sapiens
ggaaaccgggtggcagcg

SEQ ID NO: 4833468 - DNA, 21 bp, Homo sapiens
ggaaagaccctaggtgctcat

SEQ ID NO: 4833469 - DNA, 16 bp, Homo sapiens
ggaaagacgtttttgt

SEQ ID NO: 4833470 - DNA, 14 bp, Homo sapiens
ggaaagaggctctg

SEQ ID NO: 4833471 - DNA, 12 bp, Homo sapiens
ggaaagccctcc

SEQ ID NO: 4833472 - DNA, 16 bp, Homo sapiens
ggaaagccctccccct

SEQ ID NO: 4833473 - DNA, 20 bp, Homo sapiens
ggaaaggcagggccctgaaa

SEQ ID NO: 4833474 - DNA, 18 bp, Homo sapiens
ggaaagggtgtggcttgg

SEQ ID NO: 4833475 - DNA, 17 bp, Homo sapiens
ggaaaggtcctgctgtg

SEQ ID NO: 4833476 - DNA, 20 bp, Homo sapiens
ggaaagttctattatctggg

SEQ ID NO: 4833477 - DNA, 22 bp, Homo sapiens
ggaaagttggttttgtaaaatt

SEQ ID NO: 4833478 - DNA, 23 bp, Homo sapiens
ggaaataggcccaaccaccagat

SEQ ID NO: 4833479 - DNA, 15 bp, Homo sapiens
ggaaatctgaagcct

SEQ ID NO: 4833480 - DNA, 21 bp, Homo sapiens
ggaaattcttgcactgtatcc

SEQ ID NO: 4833481 - DNA, 22 bp, Homo sapiens
ggaacaggagtgactctggctg

SEQ ID NO: 4833482 - DNA, 13 bp, Homo sapiens
ggaaccgaggact

SEQ ID NO: 4833483 - DNA, 16 bp, Homo sapiens
ggaactcccccagagg

SEQ ID NO: 4833484 - DNA, 15 bp, Homo sapiens
ggaactccttggcct

SEQ ID NO: 4833485 - DNA, 23 bp, Homo sapiens
ggaactctatctgggcctgggct

SEQ ID NO: 4833486 - DNA, 11 bp, Homo sapiens
ggaactctgac

SEQ ID NO: 4833487 - DNA, 16 bp, Homo sapiens
ggaactctgacaaggg

SEQ ID NO: 4833488 - DNA, 19 bp, Homo sapiens
ggaactctgacaagggctg

SEQ ID NO: 4833489 - DNA, 23 bp, Homo sapiens
ggaactggtttttctgttccctg

SEQ ID NO: 4833490 - DNA, 16 bp, Homo sapiens
ggaagaaaactatcct

SEQ ID NO: 4833491 - DNA, 21 bp, Homo sapiens
ggaagaagagatcaggaagag

SEQ ID NO: 4833492 - DNA, 17 bp, Homo sapiens
ggaagacagagatggca

SEQ ID NO: 4833493 - DNA, 17 bp, Homo sapiens
ggaagacttcatccctc

SEQ ID NO: 4833494 - DNA, 12 bp, Homo sapiens
ggaagagaagga

SEQ ID NO: 4833495 - DNA, 17 bp, Homo sapiens
ggaagagaaggagcaga

SEQ ID NO: 4833496 - DNA, 14 bp, Homo sapiens
ggaagagggagggg

SEQ ID NO: 4833497 - DNA, 20 bp, Homo sapiens
ggaagattagaaagaattag

SEQ ID NO: 4833498 - DNA, 15 bp, Homo sapiens
ggaagcacatgcctc

SEQ ID NO: 4833499 - DNA, 23 bp, Homo sapiens
ggaagcacatgcctctctcaggc

SEQ ID NO: 4833500 - DNA, 17 bp, Homo sapiens
ggaagccagcaggctct

SEQ ID NO: 4833501 - DNA, 21 bp, Homo sapiens
ggaagccagcaggctctcagg

SEQ ID NO: 4833502 - DNA, 14 bp, Homo sapiens
ggaagcccacccgc

SEQ ID NO: 4833503 - DNA, 22 bp, Homo sapiens
ggaagcccacccgccccagaga

SEQ ID NO: 4833504 - DNA, 23 bp, Homo sapiens
ggaagcccacccgccccagagac

SEQ ID NO: 4833505 - DNA, 10 bp, Homo sapiens
ggaagctgca

SEQ ID NO: 4833506 - DNA, 12 bp, Homo sapiens
ggaagctgcagc

SEQ ID NO: 4833507 - DNA, 21 bp, Homo sapiens
ggaaggcacccgccctttcct

SEQ ID NO: 4833508 - DNA, 19 bp, Homo sapiens
ggaaggcctgagggaagcc

SEQ ID NO: 4833509 - DNA, 12 bp, Homo sapiens
ggaaggcctggg

SEQ ID NO: 4833510 - DNA, 14 bp, Homo sapiens
ggaaggggacagga

SEQ ID NO: 4833511 - DNA, 15 bp, Homo sapiens
ggaaggggacaggat

SEQ ID NO: 4833512 - DNA, 16 bp, Homo sapiens
ggaaggggcctgggct

SEQ ID NO: 4833513 - DNA, 22 bp, Homo sapiens
ggaaggggcctgggctgtgagg

SEQ ID NO: 4833514 - DNA, 14 bp, Homo sapiens
ggaaggtgatgggg

SEQ ID NO: 4833515 - DNA, 17 bp, Homo sapiens
ggaagtacataaagtaa

SEQ ID NO: 4833516 - DNA, 20 bp, Homo sapiens
ggaagtatgatttgttcctt

SEQ ID NO: 4833517 - DNA, 20 bp, Homo sapiens
ggaagtcaggagccagcagg

SEQ ID NO: 4833518 - DNA, 13 bp, Homo sapiens
ggaagtgaccaag

SEQ ID NO: 4833519 - DNA, 17 bp, Homo sapiens
ggaagtggcctgagaag

SEQ ID NO: 4833520 - DNA, 17 bp, Homo sapiens
ggaataagaagcaaata

SEQ ID NO: 4833521 - DNA, 12 bp, Homo sapiens
ggaatcacagcc

SEQ ID NO: 4833522 - DNA, 24 bp, Homo sapiens
ggaatgattaattaaaacacaaca

SEQ ID NO: 4833523 - DNA, 22 bp, Homo sapiens
ggaatgcgctcttcaccaggaa

SEQ ID NO: 4833524 - DNA, 20 bp, Homo sapiens
ggaattattagcaccagctt

SEQ ID NO: 4833525 - DNA, 23 bp, Homo sapiens
ggaattcaatgggtaaataaatg

SEQ ID NO: 4833526 - DNA, 12 bp, Homo sapiens
ggaattccacct

SEQ ID NO: 4833527 - DNA, 19 bp, Homo sapiens
ggaattccacctggaaagc

SEQ ID NO: 4833528 - DNA, 14 bp, Homo sapiens
ggaatttaattagg

SEQ ID NO: 4833529 - DNA, 15 bp, Homo sapiens
ggacaaacccttctt

SEQ ID NO: 4833530 - DNA, 13 bp, Homo sapiens
ggacaagagcagg

SEQ ID NO: 4833531 - DNA, 17 bp, Homo sapiens
ggacaaggggtggaagg

SEQ ID NO: 4833532 - DNA, 23 bp, Homo sapiens
ggacacagaggacagcttcccca

SEQ ID NO: 4833533 - DNA, 15 bp, Homo sapiens
ggacactacaaacat

SEQ ID NO: 4833534 - DNA, 12 bp, Homo sapiens
ggacagcagctg

SEQ ID NO: 4833535 - DNA, 20 bp, Homo sapiens
ggacagcggccccgcggagc

SEQ ID NO: 4833536 - DNA, 18 bp, Homo sapiens
ggacagcggcccggccca

SEQ ID NO: 4833537 - DNA, 22 bp, Homo sapiens
ggacagcggcccggcccacgca

SEQ ID NO: 4833538 - DNA, 14 bp, Homo sapiens
ggacaggacttgtg

SEQ ID NO: 4833539 - DNA, 21 bp, Homo sapiens
ggacagttagacccctgggtg

SEQ ID NO: 4833540 - DNA, 16 bp, Homo sapiens
ggacagttcacaccct

SEQ ID NO: 4833541 - DNA, 18 bp, Homo sapiens
ggacagttcacaccctgc

SEQ ID NO: 4833542 - DNA, 18 bp, Homo sapiens
ggaccaaatgtaaaatat

SEQ ID NO: 4833543 - DNA, 13 bp, Homo sapiens
ggaccaccctgcc

SEQ ID NO: 4833544 - DNA, 15 bp, Homo sapiens
ggaccaccctgccaa

SEQ ID NO: 4833545 - DNA, 14 bp, Homo sapiens
ggaccagagctgcc

SEQ ID NO: 4833546 - DNA, 12 bp, Homo sapiens
ggaccaggagcc

SEQ ID NO: 4833547 - DNA, 14 bp, Homo sapiens
ggaccaggagccag

SEQ ID NO: 4833548 - DNA, 13 bp, Homo sapiens
ggacccctgccct

SEQ ID NO: 4833549 - DNA, 13 bp, Homo sapiens
ggaccctcccagg

SEQ ID NO: 4833550 - DNA, 16 bp, Homo sapiens
ggaccggagcggctga

SEQ ID NO: 4833551 - DNA, 20 bp, Homo sapiens
ggaccgtggccctgccctct

SEQ ID NO: 4833552 - DNA, 15 bp, Homo sapiens
ggacctcaggcctgg

SEQ ID NO: 4833553 - DNA, 20 bp, Homo sapiens
ggacctcaggcctgggggct

SEQ ID NO: 4833554 - DNA, 14 bp, Homo sapiens
ggaccttgcttcct

SEQ ID NO: 4833555 - DNA, 21 bp, Homo sapiens
ggacgagcagagcgcagcccc

SEQ ID NO: 4833556 - DNA, 18 bp, Homo sapiens
ggacgcatgcagggcccc

SEQ ID NO: 4833557 - DNA, 16 bp, Homo sapiens
ggacgcccagccccca

SEQ ID NO: 4833558 - DNA, 19 bp, Homo sapiens
ggacgctggagaccctgcg

SEQ ID NO: 4833559 - DNA, 21 bp, Homo sapiens
ggacgctggagaccctgcgcc

SEQ ID NO: 4833560 - DNA, 21 bp, Homo sapiens
ggacgtcatcggaggctgggc

SEQ ID NO: 4833561 - DNA, 20 bp, Homo sapiens
ggacgtgttatgactccaga

SEQ ID NO: 4833562 - DNA, 15 bp, Homo sapiens
ggactccaggggctg

SEQ ID NO: 4833563 - DNA, 20 bp, Homo sapiens
ggactccaggggctggggac

SEQ ID NO: 4833564 - DNA, 16 bp, Homo sapiens
ggactgaccgaaggga

SEQ ID NO: 4833565 - DNA, 14 bp, Homo sapiens
ggactgcctctgcc

SEQ ID NO: 4833566 - DNA, 13 bp, Homo sapiens
ggactgctcaggc

SEQ ID NO: 4833567 - DNA, 17 bp, Homo sapiens
ggactgctcaggctccc

SEQ ID NO: 4833568 - DNA, 20 bp, Homo sapiens
ggactgggtgggccccacag

SEQ ID NO: 4833569 - DNA, 21 bp, Homo sapiens
ggactgggtgggccccacagt

SEQ ID NO: 4833570 - DNA, 23 bp, Homo sapiens
ggactgtcttcaaccctgccctg

SEQ ID NO: 4833571 - DNA, 20 bp, Homo sapiens
ggacttcgggggcggctctg

SEQ ID NO: 4833572 - DNA, 22 bp, Homo sapiens
ggacttcgggggcggctctggg

SEQ ID NO: 4833573 - DNA, 21 bp, Homo sapiens
ggacttggtgattacctgaaa

SEQ ID NO: 4833574 - DNA, 13 bp, Homo sapiens
ggagaaaagccag

SEQ ID NO: 4833575 - DNA, 22 bp, Homo sapiens
ggagaaccaaaaagaggctatg

SEQ ID NO: 4833576 - DNA, 13 bp, Homo sapiens
ggagaaggaggaa

SEQ ID NO: 4833577 - DNA, 14 bp, Homo sapiens
ggagaaggaggaac

SEQ ID NO: 4833578 - DNA, 13 bp, Homo sapiens
ggagaaggcctgc

SEQ ID NO: 4833579 - DNA, 17 bp, Homo sapiens
ggagaaggcctgccccc

SEQ ID NO: 4833580 - DNA, 22 bp, Homo sapiens
ggagaaggcctgccccccttcc

SEQ ID NO: 4833581 - DNA, 16 bp, Homo sapiens
ggagaatggctctggc

SEQ ID NO: 4833582 - DNA, 18 bp, Homo sapiens
ggagaccctgcgcccctg

SEQ ID NO: 4833583 - DNA, 21 bp, Homo sapiens
ggagaccctgcgcccctgccc

SEQ ID NO: 4833584 - DNA, 22 bp, Homo sapiens
ggagaccctgcgcccctgccca

SEQ ID NO: 4833585 - DNA, 14 bp, Homo sapiens
ggagaccctgtctt

SEQ ID NO: 4833586 - DNA, 17 bp, Homo sapiens
ggagactatgtgtcatg

SEQ ID NO: 4833587 - DNA, 23 bp, Homo sapiens
ggagagagcaatcttgctgtgaa

SEQ ID NO: 4833588 - DNA, 17 bp, Homo sapiens
ggagagcccctggggcc

SEQ ID NO: 4833589 - DNA, 16 bp, Homo sapiens
ggagagcgccacccgc

SEQ ID NO: 4833590 - DNA, 18 bp, Homo sapiens
ggagagcgccacccgccc

SEQ ID NO: 4833591 - DNA, 21 bp, Homo sapiens
ggagaggaccccattctggga

SEQ ID NO: 4833592 - DNA, 17 bp, Homo sapiens
ggagaggcggcctcgtg

SEQ ID NO: 4833593 - DNA, 23 bp, Homo sapiens
ggagataccagagactctgaaac

SEQ ID NO: 4833594 - DNA, 14 bp, Homo sapiens
ggagatgcagctgg

SEQ ID NO: 4833595 - DNA, 22 bp, Homo sapiens
ggagatgtaggaaccgatctgc

SEQ ID NO: 4833596 - DNA, 22 bp, Homo sapiens
ggagattaaaaccagagagaaa

SEQ ID NO: 4833597 - DNA, 15 bp, Homo sapiens
ggagcaaacaggaaa

SEQ ID NO: 4833598 - DNA, 12 bp, Homo sapiens
ggagcaaggctg

SEQ ID NO: 4833599 - DNA, 17 bp, Homo sapiens
ggagcaaggctgctaag

SEQ ID NO: 4833600 - DNA, 13 bp, Homo sapiens
ggagcacagccat

SEQ ID NO: 4833601 - DNA, 15 bp, Homo sapiens
ggagcacagccatag

SEQ ID NO: 4833602 - DNA, 19 bp, Homo sapiens
ggagcacccccagcctccc

SEQ ID NO: 4833603 - DNA, 18 bp, Homo sapiens
ggagcactagaatgagaa

SEQ ID NO: 4833604 - DNA, 16 bp, Homo sapiens
ggagcagagacggcag

SEQ ID NO: 4833605 - DNA, 23 bp, Homo sapiens
ggagcagagacggcagccccatc

SEQ ID NO: 4833606 - DNA, 14 bp, Homo sapiens
ggagccacagggac

SEQ ID NO: 4833607 - DNA, 14 bp, Homo sapiens
ggagccatgctctt

SEQ ID NO: 4833608 - DNA, 13 bp, Homo sapiens
ggagcccccgccc

SEQ ID NO: 4833609 - DNA, 14 bp, Homo sapiens
ggagcccccgcccc

SEQ ID NO: 4833610 - DNA, 18 bp, Homo sapiens
ggagcccccgcccctccc

SEQ ID NO: 4833611 - DNA, 20 bp, Homo sapiens
ggagcccccgcccctccccc

SEQ ID NO: 4833612 - DNA, 15 bp, Homo sapiens
ggagccgcagaggcc

SEQ ID NO: 4833613 - DNA, 19 bp, Homo sapiens
ggagccgcagaggcccgag

SEQ ID NO: 4833614 - DNA, 23 bp, Homo sapiens
ggagcctgagtcagggcccagag

SEQ ID NO: 4833615 - DNA, 14 bp, Homo sapiens
ggagcggctgagga

SEQ ID NO: 4833616 - DNA, 22 bp, Homo sapiens
ggagcggctgaggacggggcag

SEQ ID NO: 4833617 - DNA, 22 bp, Homo sapiens
ggagcgggggctaactggcccc

SEQ ID NO: 4833618 - DNA, 13 bp, Homo sapiens
ggagcgtgtccta

SEQ ID NO: 4833619 - DNA, 14 bp, Homo sapiens
ggagctagtgttaa

SEQ ID NO: 4833620 - DNA, 23 bp, Homo sapiens
ggagctctggctttcgtgttttt

SEQ ID NO: 4833621 - DNA, 13 bp, Homo sapiens
ggagcttccagat

SEQ ID NO: 4833622 - DNA, 21 bp, Homo sapiens
ggagcttccccggccgggaga

SEQ ID NO: 4833623 - DNA, 14 bp, Homo sapiens
ggaggacccctgcc

SEQ ID NO: 4833624 - DNA, 16 bp, Homo sapiens
ggaggacccctgccct

SEQ ID NO: 4833625 - DNA, 19 bp, Homo sapiens
ggaggacccctgccctcgg

SEQ ID NO: 4833626 - DNA, 18 bp, Homo sapiens
ggaggacctggggggggc

SEQ ID NO: 4833627 - DNA, 20 bp, Homo sapiens
ggaggagcacccccagcctc

SEQ ID NO: 4833628 - DNA, 20 bp, Homo sapiens
ggaggatggacgagtgagct

SEQ ID NO: 4833629 - DNA, 19 bp, Homo sapiens
ggaggcagagaagaaagaa

SEQ ID NO: 4833630 - DNA, 12 bp, Homo sapiens
ggaggcgcccac

SEQ ID NO: 4833631 - DNA, 14 bp, Homo sapiens
ggaggcgcccacct

SEQ ID NO: 4833632 - DNA, 18 bp, Homo sapiens
ggaggcgcccacctgccc

SEQ ID NO: 4833633 - DNA, 19 bp, Homo sapiens
ggaggcgcccacctgccca

SEQ ID NO: 4833634 - DNA, 23 bp, Homo sapiens
ggaggcgcccacctgcccagtta

SEQ ID NO: 4833635 - DNA, 12 bp, Homo sapiens
ggaggctgggcc

SEQ ID NO: 4833636 - DNA, 16 bp, Homo sapiens
ggaggctgggcccctg

SEQ ID NO: 4833637 - DNA, 19 bp, Homo sapiens
ggaggctgggcccctggga

SEQ ID NO: 4833638 - DNA, 15 bp, Homo sapiens
ggagggacacagagg

SEQ ID NO: 4833639 - DNA, 22 bp, Homo sapiens
ggagggatggagaggcggcctc

SEQ ID NO: 4833640 - DNA, 14 bp, Homo sapiens
ggagggcctctgga

SEQ ID NO: 4833641 - DNA, 15 bp, Homo sapiens
ggagggcctctggac

SEQ ID NO: 4833642 - DNA, 14 bp, Homo sapiens
ggaggggaagagag

SEQ ID NO: 4833643 - DNA, 14 bp, Homo sapiens
ggaggggaagctgc

SEQ ID NO: 4833644 - DNA, 13 bp, Homo sapiens
ggaggggcttgga

SEQ ID NO: 4833645 - DNA, 20 bp, Homo sapiens
ggagggggtcagttgggccc

SEQ ID NO: 4833646 - DNA, 24 bp, Homo sapiens
ggagggtccctaattctcttcgct

SEQ ID NO: 4833647 - DNA, 21 bp, Homo sapiens
ggagggtgacgggggtgaact

SEQ ID NO: 4833648 - DNA, 15 bp, Homo sapiens
ggaggtcaggccctg

SEQ ID NO: 4833649 - DNA, 20 bp, Homo sapiens
ggaggtggggagggcctctg

SEQ ID NO: 4833650 - DNA, 16 bp, Homo sapiens
ggagtcaagtgtgcct

SEQ ID NO: 4833651 - DNA, 21 bp, Homo sapiens
ggagtcaagtgtgcctgctat

SEQ ID NO: 4833652 - DNA, 16 bp, Homo sapiens
ggagtccactttcctc

SEQ ID NO: 4833653 - DNA, 18 bp, Homo sapiens
ggagtccctcctccccca

SEQ ID NO: 4833654 - DNA, 16 bp, Homo sapiens
ggagtctcctcactgc

SEQ ID NO: 4833655 - DNA, 20 bp, Homo sapiens
ggagtctcctcactgccact

SEQ ID NO: 4833656 - DNA, 17 bp, Homo sapiens
ggagtctgaaggagagg

SEQ ID NO: 4833657 - DNA, 21 bp, Homo sapiens
ggagtgactctggctgccaag

SEQ ID NO: 4833658 - DNA, 16 bp, Homo sapiens
ggagtgagaaattttt

SEQ ID NO: 4833659 - DNA, 21 bp, Homo sapiens
ggagtggaggggtcagcaggg

SEQ ID NO: 4833660 - DNA, 15 bp, Homo sapiens
ggagtggccacagaa

SEQ ID NO: 4833661 - DNA, 16 bp, Homo sapiens
ggagtggccacagaaa

SEQ ID NO: 4833662 - DNA, 21 bp, Homo sapiens
ggataaataataaaggttcta

SEQ ID NO: 4833663 - DNA, 15 bp, Homo sapiens
ggataattatatcag

SEQ ID NO: 4833664 - DNA, 18 bp, Homo sapiens
ggatactggggggcaggc

SEQ ID NO: 4833665 - DNA, 18 bp, Homo sapiens
ggataggagcttccagat

SEQ ID NO: 4833666 - DNA, 11 bp, Homo sapiens
ggatataaatc

SEQ ID NO: 4833667 - DNA, 15 bp, Homo sapiens
ggatatgaaagagaa

SEQ ID NO: 4833668 - DNA, 11 bp, Homo sapiens
ggatccagaga

SEQ ID NO: 4833669 - DNA, 12 bp, Homo sapiens
ggatccagagac

SEQ ID NO: 4833670 - DNA, 15 bp, Homo sapiens
ggatccagagacctg

SEQ ID NO: 4833671 - DNA, 22 bp, Homo sapiens
ggatccagagacctgctccaga

SEQ ID NO: 4833672 - DNA, 13 bp, Homo sapiens
ggatccagagaga

SEQ ID NO: 4833673 - DNA, 15 bp, Homo sapiens
ggatccagagagaag

SEQ ID NO: 4833674 - DNA, 12 bp, Homo sapiens
ggatctccaggc

SEQ ID NO: 4833675 - DNA, 18 bp, Homo sapiens
ggatctccaggcccagcc

SEQ ID NO: 4833676 - DNA, 14 bp, Homo sapiens
ggatgaaaaaataa

SEQ ID NO: 4833677 - DNA, 23 bp, Homo sapiens
ggatgacggtattatgcttcttg

SEQ ID NO: 4833678 - DNA, 13 bp, Homo sapiens
ggatgcatgcagg

SEQ ID NO: 4833679 - DNA, 14 bp, Homo sapiens
ggatgcatgcaggg

SEQ ID NO: 4833680 - DNA, 22 bp, Homo sapiens
ggatgcttcatgtgaacgtggg

SEQ ID NO: 4833681 - DNA, 16 bp, Homo sapiens
ggatggaatcacagcc

SEQ ID NO: 4833682 - DNA, 15 bp, Homo sapiens
ggatggacgagtgag

SEQ ID NO: 4833683 - DNA, 17 bp, Homo sapiens
ggatggagaggcggcct

SEQ ID NO: 4833684 - DNA, 22 bp, Homo sapiens
ggatggatctgctccatgcaga

SEQ ID NO: 4833685 - DNA, 15 bp, Homo sapiens
ggatgggaccaggga

SEQ ID NO: 4833686 - DNA, 16 bp, Homo sapiens
ggatgggcagctgggg

SEQ ID NO: 4833687 - DNA, 17 bp, Homo sapiens
ggatgggccagggttta

SEQ ID NO: 4833688 - DNA, 23 bp, Homo sapiens
ggatgggggtcctggtatgtctc

SEQ ID NO: 4833689 - DNA, 19 bp, Homo sapiens
ggatggttggttagtgcat

SEQ ID NO: 4833690 - DNA, 21 bp, Homo sapiens
ggatgtaatatagggtttgtt

SEQ ID NO: 4833691 - DNA, 12 bp, Homo sapiens
ggatgtgctttc

SEQ ID NO: 4833692 - DNA, 20 bp, Homo sapiens
ggattcagtttctaaaattg

SEQ ID NO: 4833693 - DNA, 16 bp, Homo sapiens
ggattcccctggacat

SEQ ID NO: 4833694 - DNA, 18 bp, Homo sapiens
ggattgtccacaaatgtc

SEQ ID NO: 4833695 - DNA, 19 bp, Homo sapiens
ggattgtccacaaatgtcc

SEQ ID NO: 4833696 - DNA, 16 bp, Homo sapiens
ggatttgacacactca

SEQ ID NO: 4833697 - DNA, 14 bp, Homo sapiens
ggattttaaacaaa

SEQ ID NO: 4833698 - DNA, 19 bp, Homo sapiens
ggattttaaacaaaattta

SEQ ID NO: 4833699 - DNA, 11 bp, Homo sapiens
ggcaaacattt

SEQ ID NO: 4833700 - DNA, 20 bp, Homo sapiens
ggcaaaccaatttgttctgt

SEQ ID NO: 4833701 - DNA, 20 bp, Homo sapiens
ggcaaatgacatgcactgac

SEQ ID NO: 4833702 - DNA, 22 bp, Homo sapiens
ggcaaatgtccaagcatcagca

SEQ ID NO: 4833703 - DNA, 23 bp, Homo sapiens
ggcaacttcagtcctgggagacc

SEQ ID NO: 4833704 - DNA, 20 bp, Homo sapiens
ggcaagacaccttcccagct

SEQ ID NO: 4833705 - DNA, 22 bp, Homo sapiens
ggcaagacaccttcccagctgc

SEQ ID NO: 4833706 - DNA, 21 bp, Homo sapiens
ggcaagagctcaggagaaggc

SEQ ID NO: 4833707 - DNA, 21 bp, Homo sapiens
ggcaaggatacccggtggctt

SEQ ID NO: 4833708 - DNA, 15 bp, Homo sapiens
ggcaaggctgtcaat

SEQ ID NO: 4833709 - DNA, 20 bp, Homo sapiens
ggcaatagtgttgaggaggg

SEQ ID NO: 4833710 - DNA, 13 bp, Homo sapiens
ggcaatcttgccc

SEQ ID NO: 4833711 - DNA, 14 bp, Homo sapiens
ggcacacaccacca

SEQ ID NO: 4833712 - DNA, 19 bp, Homo sapiens
ggcacacagcagcccccca

SEQ ID NO: 4833713 - DNA, 23 bp, Homo sapiens
ggcacagaaaatggaagacagct

SEQ ID NO: 4833714 - DNA, 15 bp, Homo sapiens
ggcacagccagaaac

SEQ ID NO: 4833715 - DNA, 13 bp, Homo sapiens
ggcacaggactga

SEQ ID NO: 4833716 - DNA, 15 bp, Homo sapiens
ggcacatagcatagg

SEQ ID NO: 4833717 - DNA, 20 bp, Homo sapiens
ggcacatagcataggctggg

SEQ ID NO: 4833718 - DNA, 17 bp, Homo sapiens
ggcaccaaagatgcagc

SEQ ID NO: 4833719 - DNA, 17 bp, Homo sapiens
ggcaccagatgcaacct

SEQ ID NO: 4833720 - DNA, 18 bp, Homo sapiens
ggcaccagatgcaacctc

SEQ ID NO: 4833721 - DNA, 22 bp, Homo sapiens
ggcacccaccactctcaggacc

SEQ ID NO: 4833722 - DNA, 21 bp, Homo sapiens
ggcaccgccagagtgtcctgc

SEQ ID NO: 4833723 - DNA, 21 bp, Homo sapiens
ggcaccgcccacccacacccc

SEQ ID NO: 4833724 - DNA, 13 bp, Homo sapiens
ggcacgggagagc

SEQ ID NO: 4833725 - DNA, 15 bp, Homo sapiens
ggcacgggagagcgc

SEQ ID NO: 4833726 - DNA, 22 bp, Homo sapiens
ggcacgggagagcgccacccgc

SEQ ID NO: 4833727 - DNA, 22 bp, Homo sapiens
ggcactccctaagtccactcta

SEQ ID NO: 4833728 - DNA, 20 bp, Homo sapiens
ggcactgtcatgcccagctt

SEQ ID NO: 4833729 - DNA, 15 bp, Homo sapiens
ggcacttcaagcaaa

SEQ ID NO: 4833730 - DNA, 17 bp, Homo sapiens
ggcacttttgagctcct

SEQ ID NO: 4833731 - DNA, 21 bp, Homo sapiens
ggcagaataaaccggatcctg

SEQ ID NO: 4833732 - DNA, 22 bp, Homo sapiens
ggcagaatggtgggctccagag

SEQ ID NO: 4833733 - DNA, 16 bp, Homo sapiens
ggcagagacctcctga

SEQ ID NO: 4833734 - DNA, 22 bp, Homo sapiens
ggcagagccatccaccctgagg

SEQ ID NO: 4833735 - DNA, 20 bp, Homo sapiens
ggcagagctgagtcggctgg

SEQ ID NO: 4833736 - DNA, 21 bp, Homo sapiens
ggcagagctgagtcggctggg

SEQ ID NO: 4833737 - DNA, 23 bp, Homo sapiens
ggcagagctgagtcggctgggca

SEQ ID NO: 4833738 - DNA, 17 bp, Homo sapiens
ggcagaggaaagcaaag

SEQ ID NO: 4833739 - DNA, 13 bp, Homo sapiens
ggcagaggcaggg

SEQ ID NO: 4833740 - DNA, 23 bp, Homo sapiens
ggcagagggatgaaatgccaaga

SEQ ID NO: 4833741 - DNA, 23 bp, Homo sapiens
ggcagagttgaagacagagctac

SEQ ID NO: 4833742 - DNA, 19 bp, Homo sapiens
ggcagcaacaggaccagga

SEQ ID NO: 4833743 - DNA, 20 bp, Homo sapiens
ggcagcaacaggaccaggag

SEQ ID NO: 4833744 - DNA, 21 bp, Homo sapiens
ggcagcaacaggaccaggagc

SEQ ID NO: 4833745 - DNA, 14 bp, Homo sapiens
ggcagcaccctccc

SEQ ID NO: 4833746 - DNA, 16 bp, Homo sapiens
ggcagcaccctccccc

SEQ ID NO: 4833747 - DNA, 19 bp, Homo sapiens
ggcagcaccctcccccgca

SEQ ID NO: 4833748 - DNA, 15 bp, Homo sapiens
ggcagcagcagcagc

SEQ ID NO: 4833749 - DNA, 16 bp, Homo sapiens
ggcagcccagagagac

SEQ ID NO: 4833750 - DNA, 15 bp, Homo sapiens
ggcagccccatcctt

SEQ ID NO: 4833751 - DNA, 23 bp, Homo sapiens
ggcagccccgcgaccacccctgt

SEQ ID NO: 4833752 - DNA, 13 bp, Homo sapiens
ggcagcccctccc

SEQ ID NO: 4833753 - DNA, 15 bp, Homo sapiens
ggcagcccctcccca

SEQ ID NO: 4833754 - DNA, 13 bp, Homo sapiens
ggcagcctgcaga

SEQ ID NO: 4833755 - DNA, 23 bp, Homo sapiens
ggcagcgcccagcctggccccaa

SEQ ID NO: 4833756 - DNA, 20 bp, Homo sapiens
ggcagcgcctcccgccgcct

SEQ ID NO: 4833757 - DNA, 21 bp, Homo sapiens
ggcagcgcctcccgccgcctc

SEQ ID NO: 4833758 - DNA, 23 bp, Homo sapiens
ggcagctcctcgggtggggcctg

SEQ ID NO: 4833759 - DNA, 22 bp, Homo sapiens
ggcagctgcagttagcacagag

SEQ ID NO: 4833760 - DNA, 23 bp, Homo sapiens
ggcagctgcagttagcacagagg

SEQ ID NO: 4833761 - DNA, 20 bp, Homo sapiens
ggcagctggggggctgtcct

SEQ ID NO: 4833762 - DNA, 22 bp, Homo sapiens
ggcagctggggggctgtcctga

SEQ ID NO: 4833763 - DNA, 18 bp, Homo sapiens
ggcaggaagtcaggagcc

SEQ ID NO: 4833764 - DNA, 21 bp, Homo sapiens
ggcaggaagtcaggagccagc

SEQ ID NO: 4833765 - DNA, 13 bp, Homo sapiens
ggcaggagctcac

SEQ ID NO: 4833766 - DNA, 17 bp, Homo sapiens
ggcaggagctcacaccg

SEQ ID NO: 4833767 - DNA, 18 bp, Homo sapiens
ggcaggagctcacaccgc

SEQ ID NO: 4833768 - DNA, 19 bp, Homo sapiens
ggcaggagtgggctctgag

SEQ ID NO: 4833769 - DNA, 22 bp, Homo sapiens
ggcaggcacacagcagcccccc

SEQ ID NO: 4833770 - DNA, 10 bp, Homo sapiens
ggcaggccct

SEQ ID NO: 4833771 - DNA, 11 bp, Homo sapiens
ggcaggccctg

SEQ ID NO: 4833772 - DNA, 12 bp, Homo sapiens
ggcaggccctgc

SEQ ID NO: 4833773 - DNA, 15 bp, Homo sapiens
ggcagggccctgaaa

SEQ ID NO: 4833774 - DNA, 21 bp, Homo sapiens
ggcaggggccgtgcagggcca

SEQ ID NO: 4833775 - DNA, 13 bp, Homo sapiens
ggcagggtggggg

SEQ ID NO: 4833776 - DNA, 15 bp, Homo sapiens
ggcaggtcctgccca

SEQ ID NO: 4833777 - DNA, 16 bp, Homo sapiens
ggcaggtcctgcccat

SEQ ID NO: 4833778 - DNA, 18 bp, Homo sapiens
ggcaggtgaaaggaatag

SEQ ID NO: 4833779 - DNA, 12 bp, Homo sapiens
ggcagtttcctc

SEQ ID NO: 4833780 - DNA, 15 bp, Homo sapiens
ggcatactctccagg

SEQ ID NO: 4833781 - DNA, 16 bp, Homo sapiens
ggcatactctccagga

SEQ ID NO: 4833782 - DNA, 23 bp, Homo sapiens
ggcatcatctcagctcactgcaa

SEQ ID NO: 4833783 - DNA, 23 bp, Homo sapiens
ggcatctctccccatatataaat

SEQ ID NO: 4833784 - DNA, 23 bp, Homo sapiens
ggcatgcctctgatatgggactg

SEQ ID NO: 4833785 - DNA, 22 bp, Homo sapiens
ggcatgggaatgaatgtcagtg

SEQ ID NO: 4833786 - DNA, 15 bp, Homo sapiens
ggcatgggtggaggg

SEQ ID NO: 4833787 - DNA, 19 bp, Homo sapiens
ggcatggtaccagccctgg

SEQ ID NO: 4833788 - DNA, 20 bp, Homo sapiens
ggcatggtaccagccctggg

SEQ ID NO: 4833789 - DNA, 21 bp, Homo sapiens
ggcatgtgaaaagtaaaacag

SEQ ID NO: 4833790 - DNA, 23 bp, Homo sapiens
ggcatgtgaaaagtaaaacagat

SEQ ID NO: 4833791 - DNA, 14 bp, Homo sapiens
ggcattgaccttca

SEQ ID NO: 4833792 - DNA, 16 bp, Homo sapiens
ggcattgaccttcatg

SEQ ID NO: 4833793 - DNA, 16 bp, Homo sapiens
ggcattgcactaaaag

SEQ ID NO: 4833794 - DNA, 13 bp, Homo sapiens
ggcatttgctgaa

SEQ ID NO: 4833795 - DNA, 14 bp, Homo sapiens
ggcatttgctgaat

SEQ ID NO: 4833796 - DNA, 21 bp, Homo sapiens
ggcatttgctgaataacaaca

SEQ ID NO: 4833797 - DNA, 23 bp, Homo sapiens
ggccaaacaacagtcttcatttt

SEQ ID NO: 4833798 - DNA, 14 bp, Homo sapiens
ggccaaaggaagca

SEQ ID NO: 4833799 - DNA, 16 bp, Homo sapiens
ggccaaaggaagcaca

SEQ ID NO: 4833800 - DNA, 21 bp, Homo sapiens
ggccaaaggaagcacatgcct

SEQ ID NO: 4833801 - DNA, 20 bp, Homo sapiens
ggccaaatattgatctgtat

SEQ ID NO: 4833802 - DNA, 20 bp, Homo sapiens
ggccacccccacctccctgc

SEQ ID NO: 4833803 - DNA, 21 bp, Homo sapiens
ggccacccccacctccctgca

SEQ ID NO: 4833804 - DNA, 22 bp, Homo sapiens
ggccacccccacctccctgcag

SEQ ID NO: 4833805 - DNA, 14 bp, Homo sapiens
ggccagacgctgcc

SEQ ID NO: 4833806 - DNA, 14 bp, Homo sapiens
ggccagcccgcaga

SEQ ID NO: 4833807 - DNA, 21 bp, Homo sapiens
ggccagcccgcagaggtgggg

SEQ ID NO: 4833808 - DNA, 14 bp, Homo sapiens
ggccagcctcaccc

SEQ ID NO: 4833809 - DNA, 18 bp, Homo sapiens
ggccagcctggggcctgg

SEQ ID NO: 4833810 - DNA, 20 bp, Homo sapiens
ggccagcctggggcctggca

SEQ ID NO: 4833811 - DNA, 23 bp, Homo sapiens
ggccagctgcttgggcttcatcc

SEQ ID NO: 4833812 - DNA, 14 bp, Homo sapiens
ggccaggagcctcc

SEQ ID NO: 4833813 - DNA, 16 bp, Homo sapiens
ggccaggagcctcctg

SEQ ID NO: 4833814 - DNA, 21 bp, Homo sapiens
ggccaggggcttctccccctc

SEQ ID NO: 4833815 - DNA, 13 bp, Homo sapiens
ggccatccctggg

SEQ ID NO: 4833816 - DNA, 16 bp, Homo sapiens
ggccatccctgggccc

SEQ ID NO: 4833817 - DNA, 20 bp, Homo sapiens
ggccatccctgggcccctcc

SEQ ID NO: 4833818 - DNA, 20 bp, Homo sapiens
ggcccaaataacagtggcaa

SEQ ID NO: 4833819 - DNA, 21 bp, Homo sapiens
ggcccaaataacagtggcaag

SEQ ID NO: 4833820 - DNA, 15 bp, Homo sapiens
ggcccacgcagagcc

SEQ ID NO: 4833821 - DNA, 23 bp, Homo sapiens
ggcccacgcagagccccggagca

SEQ ID NO: 4833822 - DNA, 23 bp, Homo sapiens
ggcccagaggctgagttttctct

SEQ ID NO: 4833823 - DNA, 11 bp, Homo sapiens
ggcccagcagc

SEQ ID NO: 4833824 - DNA, 19 bp, Homo sapiens
ggcccagcagcggcccaga

SEQ ID NO: 4833825 - DNA, 11 bp, Homo sapiens
ggcccagccag

SEQ ID NO: 4833826 - DNA, 15 bp, Homo sapiens
ggcccagccagcagg

SEQ ID NO: 4833827 - DNA, 12 bp, Homo sapiens
ggcccagcctgg

SEQ ID NO: 4833828 - DNA, 18 bp, Homo sapiens
ggcccagcctggccccaa

SEQ ID NO: 4833829 - DNA, 20 bp, Homo sapiens
ggcccagtgcaatctgtcca

SEQ ID NO: 4833830 - DNA, 14 bp, Homo sapiens
ggcccatggcccca

SEQ ID NO: 4833831 - DNA, 18 bp, Homo sapiens
ggccccaaatgttctttc

SEQ ID NO: 4833832 - DNA, 11 bp, Homo sapiens
ggccccagctc

SEQ ID NO: 4833833 - DNA, 16 bp, Homo sapiens
ggccccagctggctgg

SEQ ID NO: 4833834 - DNA, 23 bp, Homo sapiens
ggcccccacaggagcatgtccta

SEQ ID NO: 4833835 - DNA, 15 bp, Homo sapiens
ggccccccagctcag

SEQ ID NO: 4833836 - DNA, 23 bp, Homo sapiens
ggccccccagctcaggggcagct

SEQ ID NO: 4833837 - DNA, 14 bp, Homo sapiens
ggccccgcgcgtgc

SEQ ID NO: 4833838 - DNA, 18 bp, Homo sapiens
ggccccgcgcgtgccccc

SEQ ID NO: 4833839 - DNA, 21 bp, Homo sapiens
ggccccgcgcgtgcccccagc

SEQ ID NO: 4833840 - DNA, 12 bp, Homo sapiens
ggcccctccacg

SEQ ID NO: 4833841 - DNA, 18 bp, Homo sapiens
ggcccctccacgcctcct

SEQ ID NO: 4833842 - DNA, 15 bp, Homo sapiens
ggcccctcctccaga

SEQ ID NO: 4833843 - DNA, 15 bp, Homo sapiens
ggcccctccttctcc

SEQ ID NO: 4833844 - DNA, 11 bp, Homo sapiens
ggcccctctct

SEQ ID NO: 4833845 - DNA, 15 bp, Homo sapiens
ggccccttcccacgt

SEQ ID NO: 4833846 - DNA, 13 bp, Homo sapiens
ggcccgaggcacc

SEQ ID NO: 4833847 - DNA, 16 bp, Homo sapiens
ggcccgcactcaggag

SEQ ID NO: 4833848 - DNA, 18 bp, Homo sapiens
ggcccgcactcaggagca

SEQ ID NO: 4833849 - DNA, 20 bp, Homo sapiens
ggcccgcactcaggagcaca

SEQ ID NO: 4833850 - DNA, 22 bp, Homo sapiens
ggcccgcactcaggagcacagc

SEQ ID NO: 4833851 - DNA, 19 bp, Homo sapiens
ggcccgccctgcccgcgcc

SEQ ID NO: 4833852 - DNA, 21 bp, Homo sapiens
ggcccgcggggacgtcgctgt

SEQ ID NO: 4833853 - DNA, 15 bp, Homo sapiens
ggcccggcccacgca

SEQ ID NO: 4833854 - DNA, 21 bp, Homo sapiens
ggcccggcccacgcagagccc

SEQ ID NO: 4833855 - DNA, 22 bp, Homo sapiens
ggcccggcccacgcagagcccc

SEQ ID NO: 4833856 - DNA, 15 bp, Homo sapiens
ggcccgggaggagga

SEQ ID NO: 4833857 - DNA, 22 bp, Homo sapiens
ggcccggtcccagtccggtgcc

SEQ ID NO: 4833858 - DNA, 15 bp, Homo sapiens
ggcccgtgcgcagcc

SEQ ID NO: 4833859 - DNA, 18 bp, Homo sapiens
ggcccgtgcgcagccgcg

SEQ ID NO: 4833860 - DNA, 11 bp, Homo sapiens
ggccctaggca

SEQ ID NO: 4833861 - DNA, 12 bp, Homo sapiens
ggccctaggcat

SEQ ID NO: 4833862 - DNA, 23 bp, Homo sapiens
ggccctaggcatactctccagga

SEQ ID NO: 4833863 - DNA, 17 bp, Homo sapiens
ggccctcgggccctctc

SEQ ID NO: 4833864 - DNA, 18 bp, Homo sapiens
ggccctcgggccctctct

SEQ ID NO: 4833865 - DNA, 18 bp, Homo sapiens
ggccctctctccgccccg

SEQ ID NO: 4833866 - DNA, 20 bp, Homo sapiens
ggccctctctccgccccgga

SEQ ID NO: 4833867 - DNA, 13 bp, Homo sapiens
ggccctctctgca

SEQ ID NO: 4833868 - DNA, 19 bp, Homo sapiens
ggccctgaaatggcctgtc

SEQ ID NO: 4833869 - DNA, 22 bp, Homo sapiens
ggccctgcaatgtatcccttct

SEQ ID NO: 4833870 - DNA, 10 bp, Homo sapiens
ggccctgccc

SEQ ID NO: 4833871 - DNA, 11 bp, Homo sapiens
ggccctgcccc

SEQ ID NO: 4833872 - DNA, 14 bp, Homo sapiens
ggccctgccccaca

SEQ ID NO: 4833873 - DNA, 19 bp, Homo sapiens
ggccctgccctcccccacg

SEQ ID NO: 4833874 - DNA, 15 bp, Homo sapiens
ggccctgccctctcc

SEQ ID NO: 4833875 - DNA, 12 bp, Homo sapiens
ggccctggggtc

SEQ ID NO: 4833876 - DNA, 20 bp, Homo sapiens
ggccctggggtctctgagca

SEQ ID NO: 4833877 - DNA, 16 bp, Homo sapiens
ggccctgtagccctgg

SEQ ID NO: 4833878 - DNA, 19 bp, Homo sapiens
ggccctgtagccctggccc

SEQ ID NO: 4833879 - DNA, 16 bp, Homo sapiens
ggccctgtcactgtcc

SEQ ID NO: 4833880 - DNA, 19 bp, Homo sapiens
ggcccttacacccttgtcc

SEQ ID NO: 4833881 - DNA, 18 bp, Homo sapiens
ggcccttccttcacccac

SEQ ID NO: 4833882 - DNA, 19 bp, Homo sapiens
ggccgcaacttcccaggcc

SEQ ID NO: 4833883 - DNA, 19 bp, Homo sapiens
ggccgcagggcgctccggc

SEQ ID NO: 4833884 - DNA, 18 bp, Homo sapiens
ggccgccgaagggcagcc

SEQ ID NO: 4833885 - DNA, 22 bp, Homo sapiens
ggccgccgaagggcagccccgc

SEQ ID NO: 4833886 - DNA, 15 bp, Homo sapiens
ggccgcctcctccag

SEQ ID NO: 4833887 - DNA, 20 bp, Homo sapiens
ggccgcctcctccagactcg

SEQ ID NO: 4833888 - DNA, 21 bp, Homo sapiens
ggccgcttctcctgcagtctg

SEQ ID NO: 4833889 - DNA, 19 bp, Homo sapiens
ggccggcccacgtcctggg

SEQ ID NO: 4833890 - DNA, 22 bp, Homo sapiens
ggccggctggccggtccacccc

SEQ ID NO: 4833891 - DNA, 17 bp, Homo sapiens
ggccgtcacgctttcat

SEQ ID NO: 4833892 - DNA, 23 bp, Homo sapiens
ggccgtcacgctttcatgaccac

SEQ ID NO: 4833893 - DNA, 23 bp, Homo sapiens
ggccgtccctgacttcccagctg

SEQ ID NO: 4833894 - DNA, 16 bp, Homo sapiens
ggccgtgggggttgag

SEQ ID NO: 4833895 - DNA, 13 bp, Homo sapiens
ggccgtgtctctg

SEQ ID NO: 4833896 - DNA, 18 bp, Homo sapiens
ggccgtgtctctgaggac

SEQ ID NO: 4833897 - DNA, 15 bp, Homo sapiens
ggcctaatccacctg

SEQ ID NO: 4833898 - DNA, 16 bp, Homo sapiens
ggcctacaaatcagta

SEQ ID NO: 4833899 - DNA, 19 bp, Homo sapiens
ggcctaccacagctgcctc

SEQ ID NO: 4833900 - DNA, 16 bp, Homo sapiens
ggcctatgaccctgtg

SEQ ID NO: 4833901 - DNA, 17 bp, Homo sapiens
ggcctatgaccctgtgc

SEQ ID NO: 4833902 - DNA, 23 bp, Homo sapiens
ggcctcacctggcttcccaggac

SEQ ID NO: 4833903 - DNA, 23 bp, Homo sapiens
ggcctccccgggggtccccggac

SEQ ID NO: 4833904 - DNA, 14 bp, Homo sapiens
ggcctcctcttcac

SEQ ID NO: 4833905 - DNA, 14 bp, Homo sapiens
ggcctcggcctggc

SEQ ID NO: 4833906 - DNA, 15 bp, Homo sapiens
ggcctctctggaaga

SEQ ID NO: 4833907 - DNA, 21 bp, Homo sapiens
ggcctctctggaagagggagg

SEQ ID NO: 4833908 - DNA, 20 bp, Homo sapiens
ggcctctgcccctcttccct

SEQ ID NO: 4833909 - DNA, 19 bp, Homo sapiens
ggcctcttgagagccccac

SEQ ID NO: 4833910 - DNA, 19 bp, Homo sapiens
ggcctgagggaagcccacc

SEQ ID NO: 4833911 - DNA, 18 bp, Homo sapiens
ggcctgatggccaggcct

SEQ ID NO: 4833912 - DNA, 18 bp, Homo sapiens
ggcctgcagaccctgcca

SEQ ID NO: 4833913 - DNA, 20 bp, Homo sapiens
ggcctgcagaccctgccagg

SEQ ID NO: 4833914 - DNA, 15 bp, Homo sapiens
ggcctgcagcccaga

SEQ ID NO: 4833915 - DNA, 22 bp, Homo sapiens
ggcctgccccccttcccacccc

SEQ ID NO: 4833916 - DNA, 21 bp, Homo sapiens
ggcctgcggggttccctgcgc

SEQ ID NO: 4833917 - DNA, 12 bp, Homo sapiens
ggcctggcccag

SEQ ID NO: 4833918 - DNA, 18 bp, Homo sapiens
ggcctggcccagccagca

SEQ ID NO: 4833919 - DNA, 20 bp, Homo sapiens
ggcctggcccagccagcagg

SEQ ID NO: 4833920 - DNA, 13 bp, Homo sapiens
ggcctggccctgc

SEQ ID NO: 4833921 - DNA, 18 bp, Homo sapiens
ggcctggcctggccctgc

SEQ ID NO: 4833922 - DNA, 14 bp, Homo sapiens
ggcctggctctgga

SEQ ID NO: 4833923 - DNA, 22 bp, Homo sapiens
ggcctggcttcaccgcattcca

SEQ ID NO: 4833924 - DNA, 17 bp, Homo sapiens
ggcctgggctaggggac

SEQ ID NO: 4833925 - DNA, 16 bp, Homo sapiens
ggcctgggctgtgagg

SEQ ID NO: 4833926 - DNA, 14 bp, Homo sapiens
ggcctgggggctgg

SEQ ID NO: 4833927 - DNA, 23 bp, Homo sapiens
ggcctgggggctgggcagaggaa

SEQ ID NO: 4833928 - DNA, 20 bp, Homo sapiens
ggcctgggtccccctcctgc

SEQ ID NO: 4833929 - DNA, 21 bp, Homo sapiens
ggcctgggtcctcggccctgt

SEQ ID NO: 4833930 - DNA, 22 bp, Homo sapiens
ggcctgggtcctcggccctgta

SEQ ID NO: 4833931 - DNA, 19 bp, Homo sapiens
ggcctgggtgtgacctgac

SEQ ID NO: 4833932 - DNA, 16 bp, Homo sapiens
ggcctggtctggagcc

SEQ ID NO: 4833933 - DNA, 16 bp, Homo sapiens
ggccttaactggccct

SEQ ID NO: 4833934 - DNA, 17 bp, Homo sapiens
ggccttaactggccctc

SEQ ID NO: 4833935 - DNA, 15 bp, Homo sapiens
ggccttagaaaacat

SEQ ID NO: 4833936 - DNA, 14 bp, Homo sapiens
ggccttgagtctct

SEQ ID NO: 4833937 - DNA, 18 bp, Homo sapiens
ggccttggttcctccagc

SEQ ID NO: 4833938 - DNA, 13 bp, Homo sapiens
ggcctttcctctc

SEQ ID NO: 4833939 - DNA, 14 bp, Homo sapiens
ggcgagtccagaca

SEQ ID NO: 4833940 - DNA, 13 bp, Homo sapiens
ggcgcccacctgc

SEQ ID NO: 4833941 - DNA, 17 bp, Homo sapiens
ggcgccccggacgccgc

SEQ ID NO: 4833942 - DNA, 16 bp, Homo sapiens
ggcgcccggactgacc

SEQ ID NO: 4833943 - DNA, 13 bp, Homo sapiens
ggcgcctctgtcc

SEQ ID NO: 4833944 - DNA, 14 bp, Homo sapiens
ggcgcctgcgctcc

SEQ ID NO: 4833945 - DNA, 18 bp, Homo sapiens
ggcgcctgcgctcctctg

SEQ ID NO: 4833946 - DNA, 19 bp, Homo sapiens
ggcgcctgcgctcctctgc

SEQ ID NO: 4833947 - DNA, 21 bp, Homo sapiens
ggcgcctgcgctcctctgcag

SEQ ID NO: 4833948 - DNA, 20 bp, Homo sapiens
ggcgcgcaccgcccaacccc

SEQ ID NO: 4833949 - DNA, 17 bp, Homo sapiens
ggcgcgcgcccccagga

SEQ ID NO: 4833950 - DNA, 19 bp, Homo sapiens
ggcgcgcgcccccaggacc

SEQ ID NO: 4833951 - DNA, 23 bp, Homo sapiens
ggcgcgcgcccccaggacccccc

SEQ ID NO: 4833952 - DNA, 20 bp, Homo sapiens
ggcgctccggcagaggcagg

SEQ ID NO: 4833953 - DNA, 13 bp, Homo sapiens
ggcgctcctccca

SEQ ID NO: 4833954 - DNA, 18 bp, Homo sapiens
ggcgctgcccccacagat

SEQ ID NO: 4833955 - DNA, 19 bp, Homo sapiens
ggcgctgcccccacagatc

SEQ ID NO: 4833956 - DNA, 21 bp, Homo sapiens
ggcgctgcccctggcagcccc

SEQ ID NO: 4833957 - DNA, 15 bp, Homo sapiens
ggcggaggggcttgg

SEQ ID NO: 4833958 - DNA, 16 bp, Homo sapiens
ggcggaggggcttgga

SEQ ID NO: 4833959 - DNA, 20 bp, Homo sapiens
ggcggaggggcttggagcag

SEQ ID NO: 4833960 - DNA, 17 bp, Homo sapiens
ggcggcatccgagcccc

SEQ ID NO: 4833961 - DNA, 14 bp, Homo sapiens
ggcggcctgcagac

SEQ ID NO: 4833962 - DNA, 18 bp, Homo sapiens
ggcggcctgcagaccctg

SEQ ID NO: 4833963 - DNA, 11 bp, Homo sapiens
ggcgggcagcc

SEQ ID NO: 4833964 - DNA, 16 bp, Homo sapiens
ggcgggcagcccctgc

SEQ ID NO: 4833965 - DNA, 13 bp, Homo sapiens
ggcgggccaggag

SEQ ID NO: 4833966 - DNA, 15 bp, Homo sapiens
ggcgggctgatgtct

SEQ ID NO: 4833967 - DNA, 13 bp, Homo sapiens
ggcggggcctggg

SEQ ID NO: 4833968 - DNA, 16 bp, Homo sapiens
ggcggtcactgcccac

SEQ ID NO: 4833969 - DNA, 15 bp, Homo sapiens
ggcgtggagcaggcg

SEQ ID NO: 4833970 - DNA, 14 bp, Homo sapiens
ggcgtggcttggca

SEQ ID NO: 4833971 - DNA, 21 bp, Homo sapiens
ggctaaaaaagctgaatcaga

SEQ ID NO: 4833972 - DNA, 16 bp, Homo sapiens
ggctaaagtgattcct

SEQ ID NO: 4833973 - DNA, 17 bp, Homo sapiens
ggctaactggccccagg

SEQ ID NO: 4833974 - DNA, 18 bp, Homo sapiens
ggctaactggccccaggc

SEQ ID NO: 4833975 - DNA, 15 bp, Homo sapiens
ggctatatgcctata

SEQ ID NO: 4833976 - DNA, 14 bp, Homo sapiens
ggctattgtccttg

SEQ ID NO: 4833977 - DNA, 14 bp, Homo sapiens
ggctcacagccacc

SEQ ID NO: 4833978 - DNA, 16 bp, Homo sapiens
ggctcagacacctaga

SEQ ID NO: 4833979 - DNA, 16 bp, Homo sapiens
ggctcaggctgcccag

SEQ ID NO: 4833980 - DNA, 18 bp, Homo sapiens
ggctccagagtaggtggg

SEQ ID NO: 4833981 - DNA, 18 bp, Homo sapiens
ggctccccaagacttgac

SEQ ID NO: 4833982 - DNA, 23 bp, Homo sapiens
ggctccctccctccctgctccct

SEQ ID NO: 4833983 - DNA, 17 bp, Homo sapiens
ggctcgtgtttcacagt

SEQ ID NO: 4833984 - DNA, 19 bp, Homo sapiens
ggctctagggttgctggag

SEQ ID NO: 4833985 - DNA, 14 bp, Homo sapiens
ggctctcaggccag

SEQ ID NO: 4833986 - DNA, 15 bp, Homo sapiens
ggctctcaggccagc

SEQ ID NO: 4833987 - DNA, 15 bp, Homo sapiens
ggctctctggacctg

SEQ ID NO: 4833988 - DNA, 17 bp, Homo sapiens
ggctctgaatctctcaa

SEQ ID NO: 4833989 - DNA, 12 bp, Homo sapiens
ggctcttcctgg

SEQ ID NO: 4833990 - DNA, 14 bp, Homo sapiens
ggctgaaattatgt

SEQ ID NO: 4833991 - DNA, 22 bp, Homo sapiens
ggctgaaattatgtcaaatgga

SEQ ID NO: 4833992 - DNA, 10 bp, Homo sapiens
ggctgaagaa

SEQ ID NO: 4833993 - DNA, 18 bp, Homo sapiens
ggctgaagaaacacagca

SEQ ID NO: 4833994 - DNA, 19 bp, Homo sapiens
ggctgaagaaacacagcat

SEQ ID NO: 4833995 - DNA, 19 bp, Homo sapiens
ggctgaatgtatgtaaata

SEQ ID NO: 4833996 - DNA, 17 bp, Homo sapiens
ggctgacctgcctctca

SEQ ID NO: 4833997 - DNA, 14 bp, Homo sapiens
ggctgactcagtgc

SEQ ID NO: 4833998 - DNA, 16 bp, Homo sapiens
ggctgagacacagccc

SEQ ID NO: 4833999 - DNA, 17 bp, Homo sapiens
ggctgaggacggggcag

SEQ ID NO: 4834000 - DNA, 20 bp, Homo sapiens
ggctgaggacggggcagagc

SEQ ID NO: 4834001 - DNA, 15 bp, Homo sapiens
ggctgatgtcttctt

SEQ ID NO: 4834002 - DNA, 17 bp, Homo sapiens
ggctgcagccccctgct

SEQ ID NO: 4834003 - DNA, 15 bp, Homo sapiens
ggctgcatcctcagc

SEQ ID NO: 4834004 - DNA, 17 bp, Homo sapiens
ggctgcatcctcagccc

SEQ ID NO: 4834005 - DNA, 20 bp, Homo sapiens
ggctgcatgcgggcttcctc

SEQ ID NO: 4834006 - DNA, 22 bp, Homo sapiens
ggctgcatgcgggcttcctcct

SEQ ID NO: 4834007 - DNA, 22 bp, Homo sapiens
ggctgccaagagtccaagccat

SEQ ID NO: 4834008 - DNA, 19 bp, Homo sapiens
ggctgccgctgctctccca

SEQ ID NO: 4834009 - DNA, 14 bp, Homo sapiens
ggctgcgcctgccc

SEQ ID NO: 4834010 - DNA, 15 bp, Homo sapiens
ggctgctaagtggaa

SEQ ID NO: 4834011 - DNA, 23 bp, Homo sapiens
ggctgctaagtggaagacagaga

SEQ ID NO: 4834012 - DNA, 22 bp, Homo sapiens
ggctgctgcagtcagcacagag

SEQ ID NO: 4834013 - DNA, 20 bp, Homo sapiens
ggctgctggaaaggcccgga

SEQ ID NO: 4834014 - DNA, 12 bp, Homo sapiens
ggctgctgtcac

SEQ ID NO: 4834015 - DNA, 22 bp, Homo sapiens
ggctgcttctccacctccccca

SEQ ID NO: 4834016 - DNA, 15 bp, Homo sapiens
ggctggaccacgtct

SEQ ID NO: 4834017 - DNA, 14 bp, Homo sapiens
ggctggagtgggct

SEQ ID NO: 4834018 - DNA, 14 bp, Homo sapiens
ggctggatgtgcat

SEQ ID NO: 4834019 - DNA, 11 bp, Homo sapiens
ggctggccctg

SEQ ID NO: 4834020 - DNA, 22 bp, Homo sapiens
ggctggccctgccctcccccac

SEQ ID NO: 4834021 - DNA, 13 bp, Homo sapiens
ggctggcctgaca

SEQ ID NO: 4834022 - DNA, 20 bp, Homo sapiens
ggctggcggggtctgctcct

SEQ ID NO: 4834023 - DNA, 15 bp, Homo sapiens
ggctgggcccctggg

SEQ ID NO: 4834024 - DNA, 12 bp, Homo sapiens
ggctggggacac

SEQ ID NO: 4834025 - DNA, 19 bp, Homo sapiens
ggctgtcagtcgtgttgct

SEQ ID NO: 4834026 - DNA, 15 bp, Homo sapiens
ggctgtcccctgcaa

SEQ ID NO: 4834027 - DNA, 17 bp, Homo sapiens
ggctgtcccctgcaagt

SEQ ID NO: 4834028 - DNA, 16 bp, Homo sapiens
ggctgtcctgagcccc

SEQ ID NO: 4834029 - DNA, 14 bp, Homo sapiens
ggctgtctgtcacc

SEQ ID NO: 4834030 - DNA, 16 bp, Homo sapiens
ggctgtgaggacaggg

SEQ ID NO: 4834031 - DNA, 13 bp, Homo sapiens
ggctgtggcccct

SEQ ID NO: 4834032 - DNA, 20 bp, Homo sapiens
ggctgtgtcctaaatgcaaa

SEQ ID NO: 4834033 - DNA, 18 bp, Homo sapiens
ggctgttatctgtcttta

SEQ ID NO: 4834034 - DNA, 13 bp, Homo sapiens
ggctgttctgcac

SEQ ID NO: 4834035 - DNA, 18 bp, Homo sapiens
ggctgttctgcactgaaa

SEQ ID NO: 4834036 - DNA, 21 bp, Homo sapiens
ggctgttctgcactgaaaagg

SEQ ID NO: 4834037 - DNA, 20 bp, Homo sapiens
ggcttagcgttctgtttcac

SEQ ID NO: 4834038 - DNA, 13 bp, Homo sapiens
ggcttccagctca

SEQ ID NO: 4834039 - DNA, 12 bp, Homo sapiens
ggcttcccagga

SEQ ID NO: 4834040 - DNA, 15 bp, Homo sapiens
ggcttcccaggaccc

SEQ ID NO: 4834041 - DNA, 21 bp, Homo sapiens
ggcttcctcctggtgtggaag

SEQ ID NO: 4834042 - DNA, 18 bp, Homo sapiens
ggcttctccccctcagct

SEQ ID NO: 4834043 - DNA, 16 bp, Homo sapiens
ggcttctgggacaggc

SEQ ID NO: 4834044 - DNA, 17 bp, Homo sapiens
ggcttggagcagagacg

SEQ ID NO: 4834045 - DNA, 17 bp, Homo sapiens
ggcttggggtagagagg

SEQ ID NO: 4834046 - DNA, 23 bp, Homo sapiens
gggaaaaagatattgtattatca

SEQ ID NO: 4834047 - DNA, 14 bp, Homo sapiens
gggaaaacctcagt

SEQ ID NO: 4834048 - DNA, 16 bp, Homo sapiens
gggaaaggcagggccc

SEQ ID NO: 4834049 - DNA, 16 bp, Homo sapiens
gggaagagagaggcct

SEQ ID NO: 4834050 - DNA, 15 bp, Homo sapiens
gggaagcagtttcag

SEQ ID NO: 4834051 - DNA, 13 bp, Homo sapiens
gggaagcccaccc

SEQ ID NO: 4834052 - DNA, 18 bp, Homo sapiens
gggaagcccacccgcccc

SEQ ID NO: 4834053 - DNA, 12 bp, Homo sapiens
gggaagccctga

SEQ ID NO: 4834054 - DNA, 11 bp, Homo sapiens
gggaagctgat

SEQ ID NO: 4834055 - DNA, 22 bp, Homo sapiens
gggaagctgcagcttgggagag

SEQ ID NO: 4834056 - DNA, 13 bp, Homo sapiens
gggaaggcctgag

SEQ ID NO: 4834057 - DNA, 21 bp, Homo sapiens
gggaaggcctgagggaagccc

SEQ ID NO: 4834058 - DNA, 22 bp, Homo sapiens
gggaatgcgctcttcaccagga

SEQ ID NO: 4834059 - DNA, 13 bp, Homo sapiens
gggacagcggccc

SEQ ID NO: 4834060 - DNA, 22 bp, Homo sapiens
gggacagcggcccggcccacgc

SEQ ID NO: 4834061 - DNA, 17 bp, Homo sapiens
gggacaggattgtctgc

SEQ ID NO: 4834062 - DNA, 20 bp, Homo sapiens
gggaccagagctgccacctg

SEQ ID NO: 4834063 - DNA, 15 bp, Homo sapiens
gggacctcaggcctg

SEQ ID NO: 4834064 - DNA, 21 bp, Homo sapiens
gggacgacccggggcgggctg

SEQ ID NO: 4834065 - DNA, 16 bp, Homo sapiens
gggacgagcagagcgc

SEQ ID NO: 4834066 - DNA, 14 bp, Homo sapiens
gggacgcccagccc

SEQ ID NO: 4834067 - DNA, 15 bp, Homo sapiens
gggacgcccagcccc

SEQ ID NO: 4834068 - DNA, 12 bp, Homo sapiens
gggacgcccctt

SEQ ID NO: 4834069 - DNA, 22 bp, Homo sapiens
gggacggggcccgccccaggcc

SEQ ID NO: 4834070 - DNA, 14 bp, Homo sapiens
gggactacagaagt

SEQ ID NO: 4834071 - DNA, 22 bp, Homo sapiens
gggactccaagccctggggcag

SEQ ID NO: 4834072 - DNA, 16 bp, Homo sapiens
gggactgcctctgcca

SEQ ID NO: 4834073 - DNA, 16 bp, Homo sapiens
gggactggcccacccc

SEQ ID NO: 4834074 - DNA, 22 bp, Homo sapiens
gggacttcgggggcggctctgg

SEQ ID NO: 4834075 - DNA, 15 bp, Homo sapiens
gggagaaaagccaga

SEQ ID NO: 4834076 - DNA, 16 bp, Homo sapiens
gggagaacatggccaa

SEQ ID NO: 4834077 - DNA, 23 bp, Homo sapiens
gggagagcgccacccgcccgccc

SEQ ID NO: 4834078 - DNA, 13 bp, Homo sapiens
gggagaggaactc

SEQ ID NO: 4834079 - DNA, 14 bp, Homo sapiens
gggagatgcagctg

SEQ ID NO: 4834080 - DNA, 23 bp, Homo sapiens
gggagattaaaaccagagagaaa

SEQ ID NO: 4834081 - DNA, 21 bp, Homo sapiens
gggagcaaatatctaaataat

SEQ ID NO: 4834082 - DNA, 16 bp, Homo sapiens
gggagccgcaggggcc

SEQ ID NO: 4834083 - DNA, 12 bp, Homo sapiens
gggaggacccct

SEQ ID NO: 4834084 - DNA, 12 bp, Homo sapiens
gggaggagcacc

SEQ ID NO: 4834085 - DNA, 17 bp, Homo sapiens
gggaggaggatccgggc

SEQ ID NO: 4834086 - DNA, 13 bp, Homo sapiens
gggaggcctgcct

SEQ ID NO: 4834087 - DNA, 12 bp, Homo sapiens
gggaggctgaga

SEQ ID NO: 4834088 - DNA, 12 bp, Homo sapiens
gggagggcctct

SEQ ID NO: 4834089 - DNA, 15 bp, Homo sapiens
gggaggtcaggccct

SEQ ID NO: 4834090 - DNA, 12 bp, Homo sapiens
gggaggtggcca

SEQ ID NO: 4834091 - DNA, 18 bp, Homo sapiens
gggaggtggccagcccgc

SEQ ID NO: 4834092 - DNA, 20 bp, Homo sapiens
gggagtcaagtgtgcctgct

SEQ ID NO: 4834093 - DNA, 15 bp, Homo sapiens
gggagtggccacaga

SEQ ID NO: 4834094 - DNA, 18 bp, Homo sapiens
gggagtgtgatgcaggaa

SEQ ID NO: 4834095 - DNA, 15 bp, Homo sapiens
gggatccagagacct

SEQ ID NO: 4834096 - DNA, 13 bp, Homo sapiens
gggatccagagag

SEQ ID NO: 4834097 - DNA, 16 bp, Homo sapiens
gggatccagagagaag

SEQ ID NO: 4834098 - DNA, 16 bp, Homo sapiens
gggatcttacccactt

SEQ ID NO: 4834099 - DNA, 19 bp, Homo sapiens
gggcaagagctcaggagaa

SEQ ID NO: 4834100 - DNA, 14 bp, Homo sapiens
gggcaaggggccag

SEQ ID NO: 4834101 - DNA, 17 bp, Homo sapiens
gggcaaggggccaggaa

SEQ ID NO: 4834102 - DNA, 21 bp, Homo sapiens
gggcacagaaaatggaagaca

SEQ ID NO: 4834103 - DNA, 22 bp, Homo sapiens
gggcacatagcataggctgggg

SEQ ID NO: 4834104 - DNA, 23 bp, Homo sapiens
gggcacatagcataggctgggga

SEQ ID NO: 4834105 - DNA, 13 bp, Homo sapiens
gggcacgggagag

SEQ ID NO: 4834106 - DNA, 16 bp, Homo sapiens
gggcacgggagagcgc

SEQ ID NO: 4834107 - DNA, 20 bp, Homo sapiens
gggcacgggagagcgccacc

SEQ ID NO: 4834108 - DNA, 21 bp, Homo sapiens
gggcagaaatgtgctgcaaag

SEQ ID NO: 4834109 - DNA, 18 bp, Homo sapiens
gggcagaaggaagacttc

SEQ ID NO: 4834110 - DNA, 15 bp, Homo sapiens
gggcagagctgagtc

SEQ ID NO: 4834111 - DNA, 16 bp, Homo sapiens
gggcagagctgagtcg

SEQ ID NO: 4834112 - DNA, 20 bp, Homo sapiens
gggcagagctgagtcggctg

SEQ ID NO: 4834113 - DNA, 14 bp, Homo sapiens
gggcagaggaaagc

SEQ ID NO: 4834114 - DNA, 13 bp, Homo sapiens
gggcagcaccctc

SEQ ID NO: 4834115 - DNA, 14 bp, Homo sapiens
gggcagcaccctcc

SEQ ID NO: 4834116 - DNA, 15 bp, Homo sapiens
gggcagcaccctccc

SEQ ID NO: 4834117 - DNA, 18 bp, Homo sapiens
gggcagcaccctcccccg

SEQ ID NO: 4834118 - DNA, 13 bp, Homo sapiens
gggcagcccagag

SEQ ID NO: 4834119 - DNA, 19 bp, Homo sapiens
gggcagccccgcgaccacc

SEQ ID NO: 4834120 - DNA, 15 bp, Homo sapiens
gggcagcccctgctg

SEQ ID NO: 4834121 - DNA, 16 bp, Homo sapiens
gggcagcccctgctgg

SEQ ID NO: 4834122 - DNA, 20 bp, Homo sapiens
gggcagcccctgctggacca

SEQ ID NO: 4834123 - DNA, 18 bp, Homo sapiens
gggcaggaagacttccag

SEQ ID NO: 4834124 - DNA, 22 bp, Homo sapiens
gggcaggagctcacaccgcacc

SEQ ID NO: 4834125 - DNA, 13 bp, Homo sapiens
gggcaggcctccc

SEQ ID NO: 4834126 - DNA, 18 bp, Homo sapiens
gggcagggccgcagggcg

SEQ ID NO: 4834127 - DNA, 17 bp, Homo sapiens
gggcagggttctagaag

SEQ ID NO: 4834128 - DNA, 18 bp, Homo sapiens
gggcaggtcctgcccatg

SEQ ID NO: 4834129 - DNA, 11 bp, Homo sapiens
gggcaggtgaa

SEQ ID NO: 4834130 - DNA, 23 bp, Homo sapiens
gggcagtgctagtgagctgggca

SEQ ID NO: 4834131 - DNA, 17 bp, Homo sapiens
gggcagtggaagagctg

SEQ ID NO: 4834132 - DNA, 12 bp, Homo sapiens
gggcagtggaga

SEQ ID NO: 4834133 - DNA, 16 bp, Homo sapiens
gggcatgggtggaggg

SEQ ID NO: 4834134 - DNA, 18 bp, Homo sapiens
gggcatggtaccagccct

SEQ ID NO: 4834135 - DNA, 22 bp, Homo sapiens
gggccaagccagggttccagac

SEQ ID NO: 4834136 - DNA, 11 bp, Homo sapiens
gggccaggaga

SEQ ID NO: 4834137 - DNA, 12 bp, Homo sapiens
gggccaggagaa

SEQ ID NO: 4834138 - DNA, 12 bp, Homo sapiens
gggccaggagcc

SEQ ID NO: 4834139 - DNA, 14 bp, Homo sapiens
gggccaggagcctc

SEQ ID NO: 4834140 - DNA, 13 bp, Homo sapiens
gggccagggcgtg

SEQ ID NO: 4834141 - DNA, 15 bp, Homo sapiens
gggcccatggcccca

SEQ ID NO: 4834142 - DNA, 16 bp, Homo sapiens
gggcccatggccccag

SEQ ID NO: 4834143 - DNA, 18 bp, Homo sapiens
gggcccatggccccagct

SEQ ID NO: 4834144 - DNA, 19 bp, Homo sapiens
gggcccatggccccagctg

SEQ ID NO: 4834145 - DNA, 15 bp, Homo sapiens
gggcccccacaggag

SEQ ID NO: 4834146 - DNA, 22 bp, Homo sapiens
gggcccccatccctccccttgc

SEQ ID NO: 4834147 - DNA, 23 bp, Homo sapiens
gggccccctctcttaccccgtcc

SEQ ID NO: 4834148 - DNA, 14 bp, Homo sapiens
gggcccctccacgc

SEQ ID NO: 4834149 - DNA, 17 bp, Homo sapiens
gggcccctccacgcctc

SEQ ID NO: 4834150 - DNA, 22 bp, Homo sapiens
gggcccctcctccagagcctgg

SEQ ID NO: 4834151 - DNA, 16 bp, Homo sapiens
gggcccgagcgcgtgc

SEQ ID NO: 4834152 - DNA, 19 bp, Homo sapiens
gggcccgcactcaggagca

SEQ ID NO: 4834153 - DNA, 20 bp, Homo sapiens
gggcccgcactcaggagcac

SEQ ID NO: 4834154 - DNA, 16 bp, Homo sapiens
gggccctctctccgcc

SEQ ID NO: 4834155 - DNA, 17 bp, Homo sapiens
gggccctgggcctcagt

SEQ ID NO: 4834156 - DNA, 21 bp, Homo sapiens
gggccgaacctgatacctgcc

SEQ ID NO: 4834157 - DNA, 13 bp, Homo sapiens
gggccgcagggcg

SEQ ID NO: 4834158 - DNA, 14 bp, Homo sapiens
gggccgcagggcgc

SEQ ID NO: 4834159 - DNA, 21 bp, Homo sapiens
gggccgccgaagggcagcccc

SEQ ID NO: 4834160 - DNA, 14 bp, Homo sapiens
gggccgcctcctcc

SEQ ID NO: 4834161 - DNA, 16 bp, Homo sapiens
gggccgcctcctccag

SEQ ID NO: 4834162 - DNA, 17 bp, Homo sapiens
gggccgcctcctccaga

SEQ ID NO: 4834163 - DNA, 15 bp, Homo sapiens
gggccgcttctcctg

SEQ ID NO: 4834164 - DNA, 16 bp, Homo sapiens
gggccgcttctcctgc

SEQ ID NO: 4834165 - DNA, 13 bp, Homo sapiens
gggccgggcaggt

SEQ ID NO: 4834166 - DNA, 21 bp, Homo sapiens
gggcctcccgtccgtccgccc

SEQ ID NO: 4834167 - DNA, 17 bp, Homo sapiens
gggcctcggcctggctt

SEQ ID NO: 4834168 - DNA, 19 bp, Homo sapiens
gggcctcggcctggcttca

SEQ ID NO: 4834169 - DNA, 23 bp, Homo sapiens
gggcctgcggggttccctgcgcg

SEQ ID NO: 4834170 - DNA, 13 bp, Homo sapiens
gggcctggctccc

SEQ ID NO: 4834171 - DNA, 17 bp, Homo sapiens
gggcctgggctgtgagg

SEQ ID NO: 4834172 - DNA, 17 bp, Homo sapiens
gggcctgggtccccctc

SEQ ID NO: 4834173 - DNA, 18 bp, Homo sapiens
gggcctgggtccccctcc

SEQ ID NO: 4834174 - DNA, 15 bp, Homo sapiens
gggcgcctctgtcct

SEQ ID NO: 4834175 - DNA, 15 bp, Homo sapiens
gggcgcctgcgctcc

SEQ ID NO: 4834176 - DNA, 19 bp, Homo sapiens
gggcgcctgcgctcctctg

SEQ ID NO: 4834177 - DNA, 20 bp, Homo sapiens
gggcgcctgggtcctcccag

SEQ ID NO: 4834178 - DNA, 18 bp, Homo sapiens
gggcgctgcccccacaga

SEQ ID NO: 4834179 - DNA, 18 bp, Homo sapiens
gggcggcatccgagcccc

SEQ ID NO: 4834180 - DNA, 20 bp, Homo sapiens
gggcggcatccgagcccctg

SEQ ID NO: 4834181 - DNA, 20 bp, Homo sapiens
gggcggcctgcagaccctgc

SEQ ID NO: 4834182 - DNA, 16 bp, Homo sapiens
gggcgtgacttcagac

SEQ ID NO: 4834183 - DNA, 15 bp, Homo sapiens
gggctaactggcccc

SEQ ID NO: 4834184 - DNA, 22 bp, Homo sapiens
gggctcacaccggcactgtgca

SEQ ID NO: 4834185 - DNA, 14 bp, Homo sapiens
gggctgagcccctc

SEQ ID NO: 4834186 - DNA, 15 bp, Homo sapiens
gggctgagcccctcc

SEQ ID NO: 4834187 - DNA, 18 bp, Homo sapiens
gggctgcagccccctgct

SEQ ID NO: 4834188 - DNA, 20 bp, Homo sapiens
gggctgcagccccctgcttc

SEQ ID NO: 4834189 - DNA, 21 bp, Homo sapiens
gggctgcagccccctgcttct

SEQ ID NO: 4834190 - DNA, 16 bp, Homo sapiens
gggctgcatcctcagc

SEQ ID NO: 4834191 - DNA, 23 bp, Homo sapiens
gggctgcatcctcagccccaggg

SEQ ID NO: 4834192 - DNA, 21 bp, Homo sapiens
gggctgcatgcgggcttcctc

SEQ ID NO: 4834193 - DNA, 14 bp, Homo sapiens
gggctgcttctcca

SEQ ID NO: 4834194 - DNA, 15 bp, Homo sapiens
gggctggcacccact

SEQ ID NO: 4834195 - DNA, 14 bp, Homo sapiens
gggctggccctgcc

SEQ ID NO: 4834196 - DNA, 17 bp, Homo sapiens
gggctggccctgccctc

SEQ ID NO: 4834197 - DNA, 19 bp, Homo sapiens
gggctggccctgccctccc

SEQ ID NO: 4834198 - DNA, 15 bp, Homo sapiens
gggctgggcagagga

SEQ ID NO: 4834199 - DNA, 21 bp, Homo sapiens
gggctgtgaggacagggcccc

SEQ ID NO: 4834200 - DNA, 17 bp, Homo sapiens
gggctgttagctcagag

SEQ ID NO: 4834201 - DNA, 14 bp, Homo sapiens
gggcttagaatggg

SEQ ID NO: 4834202 - DNA, 16 bp, Homo sapiens
gggcttagaatggggc

SEQ ID NO: 4834203 - DNA, 19 bp, Homo sapiens
gggcttcatcctcctcaga

SEQ ID NO: 4834204 - DNA, 20 bp, Homo sapiens
gggcttcatcctcctcagat

SEQ ID NO: 4834205 - DNA, 21 bp, Homo sapiens
gggcttggggaccagagctgc

SEQ ID NO: 4834206 - DNA, 22 bp, Homo sapiens
gggcttggggtagagaggacag

SEQ ID NO: 4834207 - DNA, 15 bp, Homo sapiens
ggggaaaacctcagt

SEQ ID NO: 4834208 - DNA, 20 bp, Homo sapiens
ggggaactcccccagaggtg

SEQ ID NO: 4834209 - DNA, 19 bp, Homo sapiens
ggggaagagagaggcctgg

SEQ ID NO: 4834210 - DNA, 22 bp, Homo sapiens
ggggaagagagaggcctgggtg

SEQ ID NO: 4834211 - DNA, 13 bp, Homo sapiens
ggggaagggtgga

SEQ ID NO: 4834212 - DNA, 19 bp, Homo sapiens
ggggacagatcttgagcaa

SEQ ID NO: 4834213 - DNA, 14 bp, Homo sapiens
ggggaccagagctg

SEQ ID NO: 4834214 - DNA, 15 bp, Homo sapiens
ggggaccagagctgc

SEQ ID NO: 4834215 - DNA, 16 bp, Homo sapiens
ggggaccagagctgcc

SEQ ID NO: 4834216 - DNA, 13 bp, Homo sapiens
ggggacctcaggc

SEQ ID NO: 4834217 - DNA, 14 bp, Homo sapiens
ggggacgcccagcc

SEQ ID NO: 4834218 - DNA, 23 bp, Homo sapiens
ggggacgcccagcccccaccccc

SEQ ID NO: 4834219 - DNA, 16 bp, Homo sapiens
ggggacttggatagga

SEQ ID NO: 4834220 - DNA, 16 bp, Homo sapiens
ggggagaatggctctg

SEQ ID NO: 4834221 - DNA, 16 bp, Homo sapiens
ggggaggagcaccccc

SEQ ID NO: 4834222 - DNA, 16 bp, Homo sapiens
ggggagggcctctgga

SEQ ID NO: 4834223 - DNA, 13 bp, Homo sapiens
ggggatgcttcat

SEQ ID NO: 4834224 - DNA, 13 bp, Homo sapiens
ggggatgggccag

SEQ ID NO: 4834225 - DNA, 16 bp, Homo sapiens
ggggcaaccctggtga

SEQ ID NO: 4834226 - DNA, 14 bp, Homo sapiens
ggggcagagctgag

SEQ ID NO: 4834227 - DNA, 23 bp, Homo sapiens
ggggcaggcctcccaagctgatg

SEQ ID NO: 4834228 - DNA, 12 bp, Homo sapiens
ggggcaggtgaa

SEQ ID NO: 4834229 - DNA, 17 bp, Homo sapiens
ggggcatgggtggaggg

SEQ ID NO: 4834230 - DNA, 21 bp, Homo sapiens
ggggccaggaaggggacagga

SEQ ID NO: 4834231 - DNA, 20 bp, Homo sapiens
ggggccatgttcccagaacc

SEQ ID NO: 4834232 - DNA, 14 bp, Homo sapiens
ggggcccatggccc

SEQ ID NO: 4834233 - DNA, 15 bp, Homo sapiens
ggggcccatggcccc

SEQ ID NO: 4834234 - DNA, 16 bp, Homo sapiens
ggggcccatggcccca

SEQ ID NO: 4834235 - DNA, 18 bp, Homo sapiens
ggggcccatggccccagc

SEQ ID NO: 4834236 - DNA, 20 bp, Homo sapiens
ggggcccatggccccagctg

SEQ ID NO: 4834237 - DNA, 11 bp, Homo sapiens
ggggcccctgc

SEQ ID NO: 4834238 - DNA, 18 bp, Homo sapiens
ggggccctgggcctcagt

SEQ ID NO: 4834239 - DNA, 17 bp, Homo sapiens
ggggccgggcaggtcct

SEQ ID NO: 4834240 - DNA, 18 bp, Homo sapiens
ggggccgtgggggttgag

SEQ ID NO: 4834241 - DNA, 13 bp, Homo sapiens
ggggcctggcagg

SEQ ID NO: 4834242 - DNA, 14 bp, Homo sapiens
ggggcgagggcggc

SEQ ID NO: 4834243 - DNA, 12 bp, Homo sapiens
ggggcggctctg

SEQ ID NO: 4834244 - DNA, 21 bp, Homo sapiens
ggggctgcatcctcagcccca

SEQ ID NO: 4834245 - DNA, 21 bp, Homo sapiens
ggggctgctgcactgccctcc

SEQ ID NO: 4834246 - DNA, 12 bp, Homo sapiens
ggggctggccct

SEQ ID NO: 4834247 - DNA, 18 bp, Homo sapiens
ggggctggccctgccctc

SEQ ID NO: 4834248 - DNA, 22 bp, Homo sapiens
ggggctggccctgccctccccc

SEQ ID NO: 4834249 - DNA, 16 bp, Homo sapiens
ggggctgggcagagga

SEQ ID NO: 4834250 - DNA, 18 bp, Homo sapiens
ggggcttccatggtggtt

SEQ ID NO: 4834251 - DNA, 13 bp, Homo sapiens
ggggcttggagca

SEQ ID NO: 4834252 - DNA, 14 bp, Homo sapiens
ggggcttggagcag

SEQ ID NO: 4834253 - DNA, 16 bp, Homo sapiens
ggggcttggagcagag

SEQ ID NO: 4834254 - DNA, 19 bp, Homo sapiens
ggggcttggggtagagagg

SEQ ID NO: 4834255 - DNA, 20 bp, Homo sapiens
ggggcttggggtagagagga

SEQ ID NO: 4834256 - DNA, 14 bp, Homo sapiens
gggggaggagcacc

SEQ ID NO: 4834257 - DNA, 15 bp, Homo sapiens
gggggatgggccagg

SEQ ID NO: 4834258 - DNA, 21 bp, Homo sapiens
gggggcagaccagagagctca

SEQ ID NO: 4834259 - DNA, 17 bp, Homo sapiens
gggggcatgggtggagg

SEQ ID NO: 4834260 - DNA, 12 bp, Homo sapiens
gggggccgggca

SEQ ID NO: 4834261 - DNA, 18 bp, Homo sapiens
gggggccgggcaggtcct

SEQ ID NO: 4834262 - DNA, 16 bp, Homo sapiens
gggggcggctctggga

SEQ ID NO: 4834263 - DNA, 16 bp, Homo sapiens
gggggctaactggccc

SEQ ID NO: 4834264 - DNA, 13 bp, Homo sapiens
ggggtagagagga

SEQ ID NO: 4834265 - DNA, 15 bp, Homo sapiens
ggggtccccggacgc

SEQ ID NO: 4834266 - DNA, 20 bp, Homo sapiens
ggggtcgggggaggagcacc

SEQ ID NO: 4834267 - DNA, 15 bp, Homo sapiens
ggggtctctgagcag

SEQ ID NO: 4834268 - DNA, 21 bp, Homo sapiens
ggggtgagaagtacagggcag

SEQ ID NO: 4834269 - DNA, 18 bp, Homo sapiens
ggggtgccaaaatgccta

SEQ ID NO: 4834270 - DNA, 21 bp, Homo sapiens
ggggtggaattattagcacca

SEQ ID NO: 4834271 - DNA, 16 bp, Homo sapiens
ggggtgggagccacag

SEQ ID NO: 4834272 - DNA, 21 bp, Homo sapiens
ggggttttgacttgccactgc

SEQ ID NO: 4834273 - DNA, 23 bp, Homo sapiens
gggtaagggactccagaagcagc

SEQ ID NO: 4834274 - DNA, 17 bp, Homo sapiens
gggtactcagtcagccc

SEQ ID NO: 4834275 - DNA, 22 bp, Homo sapiens
gggtactcagtcagcccagtgg

SEQ ID NO: 4834276 - DNA, 15 bp, Homo sapiens
gggtagagaggacag

SEQ ID NO: 4834277 - DNA, 17 bp, Homo sapiens
gggtcatattcatacct

SEQ ID NO: 4834278 - DNA, 23 bp, Homo sapiens
gggtccccggacgctggctcggg

SEQ ID NO: 4834279 - DNA, 16 bp, Homo sapiens
gggtcctcccagctga

SEQ ID NO: 4834280 - DNA, 14 bp, Homo sapiens
gggtcctgctgctc

SEQ ID NO: 4834281 - DNA, 15 bp, Homo sapiens
gggtcgcccctcctc

SEQ ID NO: 4834282 - DNA, 14 bp, Homo sapiens
gggtcgcctgccct

SEQ ID NO: 4834283 - DNA, 16 bp, Homo sapiens
gggtcgggggaggagc

SEQ ID NO: 4834284 - DNA, 22 bp, Homo sapiens
gggtctctgagcagtggggagc

SEQ ID NO: 4834285 - DNA, 19 bp, Homo sapiens
gggtctgtgggactggccc

SEQ ID NO: 4834286 - DNA, 23 bp, Homo sapiens
gggtcttagggtacagcccaggc

SEQ ID NO: 4834287 - DNA, 15 bp, Homo sapiens
gggtgaggcgtggga

SEQ ID NO: 4834288 - DNA, 15 bp, Homo sapiens
gggtgcaggcgcgca

SEQ ID NO: 4834289 - DNA, 16 bp, Homo sapiens
gggtgccccccatgcc

SEQ ID NO: 4834290 - DNA, 20 bp, Homo sapiens
gggtgcgtgaccggcccgcc

SEQ ID NO: 4834291 - DNA, 23 bp, Homo sapiens
gggtgcgtgaccggcccgccacc

SEQ ID NO: 4834292 - DNA, 14 bp, Homo sapiens
gggtggaagggcag

SEQ ID NO: 4834293 - DNA, 13 bp, Homo sapiens
gggtgtcccctgg

SEQ ID NO: 4834294 - DNA, 17 bp, Homo sapiens
gggtgtcccctggtgcc

SEQ ID NO: 4834295 - DNA, 19 bp, Homo sapiens
gggtgtggcctcagccctc

SEQ ID NO: 4834296 - DNA, 12 bp, Homo sapiens
gggtgtggcttg

SEQ ID NO: 4834297 - DNA, 22 bp, Homo sapiens
gggtgtttgggaaaggcagggc

SEQ ID NO: 4834298 - DNA, 17 bp, Homo sapiens
gggttaaagaaaggcag

SEQ ID NO: 4834299 - DNA, 20 bp, Homo sapiens
gggttaaagaaaggcagaga

SEQ ID NO: 4834300 - DNA, 15 bp, Homo sapiens
gggttgggttccaga

SEQ ID NO: 4834301 - DNA, 20 bp, Homo sapiens
gggtttacccagtgggacag

SEQ ID NO: 4834302 - DNA, 12 bp, Homo sapiens
ggtaaataaatg

SEQ ID NO: 4834303 - DNA, 14 bp, Homo sapiens
ggtaaataaatgct

SEQ ID NO: 4834304 - DNA, 15 bp, Homo sapiens
ggtaaataaatgctg

SEQ ID NO: 4834305 - DNA, 15 bp, Homo sapiens
ggtaagattgttatt

SEQ ID NO: 4834306 - DNA, 18 bp, Homo sapiens
ggtactcagtcagcccag

SEQ ID NO: 4834307 - DNA, 19 bp, Homo sapiens
ggtagctctgaagggaggg

SEQ ID NO: 4834308 - DNA, 21 bp, Homo sapiens
ggtagctctgaagggagggga

SEQ ID NO: 4834309 - DNA, 18 bp, Homo sapiens
ggtagtagaatctcagca

SEQ ID NO: 4834310 - DNA, 19 bp, Homo sapiens
ggtagtagaatctcagcac

SEQ ID NO: 4834311 - DNA, 13 bp, Homo sapiens
ggtatgctggcca

SEQ ID NO: 4834312 - DNA, 22 bp, Homo sapiens
ggtcaactccaaggcaaatgtc

SEQ ID NO: 4834313 - DNA, 13 bp, Homo sapiens
ggtcacagacccc

SEQ ID NO: 4834314 - DNA, 15 bp, Homo sapiens
ggtcacagacccctg

SEQ ID NO: 4834315 - DNA, 22 bp, Homo sapiens
ggtcacagacccctgggggagg

SEQ ID NO: 4834316 - DNA, 11 bp, Homo sapiens
ggtcacaggca

SEQ ID NO: 4834317 - DNA, 21 bp, Homo sapiens
ggtcactgcccacctgccagg

SEQ ID NO: 4834318 - DNA, 22 bp, Homo sapiens
ggtcactgcccacctgccaggc

SEQ ID NO: 4834319 - DNA, 13 bp, Homo sapiens
ggtcagagcccag

SEQ ID NO: 4834320 - DNA, 13 bp, Homo sapiens
ggtcaggccctgg

SEQ ID NO: 4834321 - DNA, 16 bp, Homo sapiens
ggtcaggccctggaac

SEQ ID NO: 4834322 - DNA, 15 bp, Homo sapiens
ggtccaatccagcct

SEQ ID NO: 4834323 - DNA, 17 bp, Homo sapiens
ggtccaatccagccttc

SEQ ID NO: 4834324 - DNA, 22 bp, Homo sapiens
ggtcccagtccggtgccttcca

SEQ ID NO: 4834325 - DNA, 14 bp, Homo sapiens
ggtccccctcctgc

SEQ ID NO: 4834326 - DNA, 13 bp, Homo sapiens
ggtcctcccagct

SEQ ID NO: 4834327 - DNA, 14 bp, Homo sapiens
ggtcctcggccctg

SEQ ID NO: 4834328 - DNA, 16 bp, Homo sapiens
ggtcctcggccctgta

SEQ ID NO: 4834329 - DNA, 22 bp, Homo sapiens
ggtcctgcccatgtgtcccctc

SEQ ID NO: 4834330 - DNA, 18 bp, Homo sapiens
ggtcctgggggctgctgc

SEQ ID NO: 4834331 - DNA, 22 bp, Homo sapiens
ggtcctgggggctgctgcactg

SEQ ID NO: 4834332 - DNA, 11 bp, Homo sapiens
ggtccttaaaa

SEQ ID NO: 4834333 - DNA, 17 bp, Homo sapiens
ggtccttagtaaattcc

SEQ ID NO: 4834334 - DNA, 21 bp, Homo sapiens
ggtcgcccctcctcgggcgcc

SEQ ID NO: 4834335 - DNA, 21 bp, Homo sapiens
ggtcgggggaggagcaccccc

SEQ ID NO: 4834336 - DNA, 22 bp, Homo sapiens
ggtcgggggaggagcaccccca

SEQ ID NO: 4834337 - DNA, 14 bp, Homo sapiens
ggtctatggggaga

SEQ ID NO: 4834338 - DNA, 12 bp, Homo sapiens
ggtctccacccc

SEQ ID NO: 4834339 - DNA, 13 bp, Homo sapiens
ggtctccacccct

SEQ ID NO: 4834340 - DNA, 17 bp, Homo sapiens
ggtctccacccctcaag

SEQ ID NO: 4834341 - DNA, 13 bp, Homo sapiens
ggtctctgagcag

SEQ ID NO: 4834342 - DNA, 15 bp, Homo sapiens
ggtctctttctttcc

SEQ ID NO: 4834343 - DNA, 16 bp, Homo sapiens
ggtctggagcccctat

SEQ ID NO: 4834344 - DNA, 16 bp, Homo sapiens
ggtctggattttcaaa

SEQ ID NO: 4834345 - DNA, 23 bp, Homo sapiens
ggtctgtcccgggtactcagtca

SEQ ID NO: 4834346 - DNA, 20 bp, Homo sapiens
ggtctgtgcattgtggctgt

SEQ ID NO: 4834347 - DNA, 23 bp, Homo sapiens
ggtctgtgttctcaacacacagt

SEQ ID NO: 4834348 - DNA, 20 bp, Homo sapiens
ggtctgttgaagtgcatgtt

SEQ ID NO: 4834349 - DNA, 22 bp, Homo sapiens
ggtcttagggtacagcccaggc

SEQ ID NO: 4834350 - DNA, 23 bp, Homo sapiens
ggtcttagggtacagcccaggcg

SEQ ID NO: 4834351 - DNA, 14 bp, Homo sapiens
ggtcttggagagga

SEQ ID NO: 4834352 - DNA, 11 bp, Homo sapiens
ggtgaaagagt

SEQ ID NO: 4834353 - DNA, 15 bp, Homo sapiens
ggtgaactgaagcag

SEQ ID NO: 4834354 - DNA, 12 bp, Homo sapiens
ggtgaaggggct

SEQ ID NO: 4834355 - DNA, 16 bp, Homo sapiens
ggtgaaggggctggtg

SEQ ID NO: 4834356 - DNA, 17 bp, Homo sapiens
ggtgaaggggctggtgg

SEQ ID NO: 4834357 - DNA, 22 bp, Homo sapiens
ggtgaccagcaccatctctcct

SEQ ID NO: 4834358 - DNA, 13 bp, Homo sapiens
ggtgactgtccca

SEQ ID NO: 4834359 - DNA, 23 bp, Homo sapiens
ggtgactgtcccaccgggagcct

SEQ ID NO: 4834360 - DNA, 13 bp, Homo sapiens
ggtgagactctga

SEQ ID NO: 4834361 - DNA, 18 bp, Homo sapiens
ggtgaggcgtgggatcca

SEQ ID NO: 4834362 - DNA, 12 bp, Homo sapiens
ggtgatgaattt

SEQ ID NO: 4834363 - DNA, 17 bp, Homo sapiens
ggtgatgggggcatggg

SEQ ID NO: 4834364 - DNA, 20 bp, Homo sapiens
ggtgattatgaaatgccaga

SEQ ID NO: 4834365 - DNA, 12 bp, Homo sapiens
ggtgcaggcgcg

SEQ ID NO: 4834366 - DNA, 14 bp, Homo sapiens
ggtgccatcacgct

SEQ ID NO: 4834367 - DNA, 17 bp, Homo sapiens
ggtgcccgtgtggcctg

SEQ ID NO: 4834368 - DNA, 17 bp, Homo sapiens
ggtgccttccaccctgc

SEQ ID NO: 4834369 - DNA, 21 bp, Homo sapiens
ggtgccttccaccctgccctg

SEQ ID NO: 4834370 - DNA, 22 bp, Homo sapiens
ggtgccttccaccctgccctgg

SEQ ID NO: 4834371 - DNA, 15 bp, Homo sapiens
ggtgcggaccggagc

SEQ ID NO: 4834372 - DNA, 18 bp, Homo sapiens
ggtgcggaccggagcggc

SEQ ID NO: 4834373 - DNA, 16 bp, Homo sapiens
ggtgcgtgaccggccc

SEQ ID NO: 4834374 - DNA, 20 bp, Homo sapiens
ggtgcgtgaccggcccgcca

SEQ ID NO: 4834375 - DNA, 13 bp, Homo sapiens
ggtgcgtgtggcc

SEQ ID NO: 4834376 - DNA, 18 bp, Homo sapiens
ggtgctcagggcatgctt

SEQ ID NO: 4834377 - DNA, 23 bp, Homo sapiens
ggtgctcataactagagtatgtg

SEQ ID NO: 4834378 - DNA, 13 bp, Homo sapiens
ggtgctggggctg

SEQ ID NO: 4834379 - DNA, 14 bp, Homo sapiens
ggtgctggggctgc

SEQ ID NO: 4834380 - DNA, 15 bp, Homo sapiens
ggtggaagggcagga

SEQ ID NO: 4834381 - DNA, 12 bp, Homo sapiens
ggtggaggatgg

SEQ ID NO: 4834382 - DNA, 20 bp, Homo sapiens
ggtggatactggggggcagg

SEQ ID NO: 4834383 - DNA, 15 bp, Homo sapiens
ggtggcatttgcagg

SEQ ID NO: 4834384 - DNA, 14 bp, Homo sapiens
ggtggccagcccgc

SEQ ID NO: 4834385 - DNA, 14 bp, Homo sapiens
ggtggccatccctg

SEQ ID NO: 4834386 - DNA, 16 bp, Homo sapiens
ggtggccatccctggg

SEQ ID NO: 4834387 - DNA, 21 bp, Homo sapiens
ggtggccatccctgggcccct

SEQ ID NO: 4834388 - DNA, 23 bp, Homo sapiens
ggtggccatccctgggcccctcc

SEQ ID NO: 4834389 - DNA, 12 bp, Homo sapiens
ggtggccctgcg

SEQ ID NO: 4834390 - DNA, 19 bp, Homo sapiens
ggtggccttgagtctctga

SEQ ID NO: 4834391 - DNA, 21 bp, Homo sapiens
ggtggccttgagtctctgaat

SEQ ID NO: 4834392 - DNA, 18 bp, Homo sapiens
ggtggcttctggcacctg

SEQ ID NO: 4834393 - DNA, 21 bp, Homo sapiens
ggtgggagcacagctttcctg

SEQ ID NO: 4834394 - DNA, 19 bp, Homo sapiens
ggtgggagccacagggacg

SEQ ID NO: 4834395 - DNA, 22 bp, Homo sapiens
ggtgggcgcctgtcgggcccgc

SEQ ID NO: 4834396 - DNA, 19 bp, Homo sapiens
ggtggggacctcaggcctg

SEQ ID NO: 4834397 - DNA, 16 bp, Homo sapiens
ggtggggccagcgctg

SEQ ID NO: 4834398 - DNA, 21 bp, Homo sapiens
ggtggggctgcatccaaggct

SEQ ID NO: 4834399 - DNA, 15 bp, Homo sapiens
ggtggggtgctgggg

SEQ ID NO: 4834400 - DNA, 17 bp, Homo sapiens
ggtggtgaaggggctgg

SEQ ID NO: 4834401 - DNA, 13 bp, Homo sapiens
ggtggttggaggc

SEQ ID NO: 4834402 - DNA, 14 bp, Homo sapiens
ggtggttggaggcc

SEQ ID NO: 4834403 - DNA, 17 bp, Homo sapiens
ggtgtcccctggtgccc

SEQ ID NO: 4834404 - DNA, 23 bp, Homo sapiens
ggtgtcctctgtccgtctgtcct

SEQ ID NO: 4834405 - DNA, 22 bp, Homo sapiens
ggtgtgagaataacactggctt

SEQ ID NO: 4834406 - DNA, 15 bp, Homo sapiens
ggtgtgccaaactac

SEQ ID NO: 4834407 - DNA, 14 bp, Homo sapiens
ggtgtggcctcagc

SEQ ID NO: 4834408 - DNA, 19 bp, Homo sapiens
ggtgtggcctcagccctca

SEQ ID NO: 4834409 - DNA, 19 bp, Homo sapiens
ggtgtggcctggcttctgg

SEQ ID NO: 4834410 - DNA, 19 bp, Homo sapiens
ggttaaagaaaggcagaga

SEQ ID NO: 4834411 - DNA, 19 bp, Homo sapiens
ggttaaggggatctaaaag

SEQ ID NO: 4834412 - DNA, 12 bp, Homo sapiens
ggttaagtctca

SEQ ID NO: 4834413 - DNA, 19 bp, Homo sapiens
ggttaataggaggacagaa

SEQ ID NO: 4834414 - DNA, 22 bp, Homo sapiens
ggttaatgaaaaatctgaattt

SEQ ID NO: 4834415 - DNA, 16 bp, Homo sapiens
ggttatttaaaatgta

SEQ ID NO: 4834416 - DNA, 18 bp, Homo sapiens
ggttatttaaaatgtaaa

SEQ ID NO: 4834417 - DNA, 13 bp, Homo sapiens
ggttccacgtggg

SEQ ID NO: 4834418 - DNA, 12 bp, Homo sapiens
ggttccagacag

SEQ ID NO: 4834419 - DNA, 17 bp, Homo sapiens
ggttccagacagagtgg

SEQ ID NO: 4834420 - DNA, 13 bp, Homo sapiens
ggttccagacagg

SEQ ID NO: 4834421 - DNA, 17 bp, Homo sapiens
ggttccatccaccacct

SEQ ID NO: 4834422 - DNA, 13 bp, Homo sapiens
ggttccctgcgcg

SEQ ID NO: 4834423 - DNA, 12 bp, Homo sapiens
ggttcctccagc

SEQ ID NO: 4834424 - DNA, 13 bp, Homo sapiens
ggttcctccagca

SEQ ID NO: 4834425 - DNA, 16 bp, Homo sapiens
ggttctagaaggggcg

SEQ ID NO: 4834426 - DNA, 13 bp, Homo sapiens
ggttgactaagaa

SEQ ID NO: 4834427 - DNA, 18 bp, Homo sapiens
ggttgagctatgatatgt

SEQ ID NO: 4834428 - DNA, 15 bp, Homo sapiens
ggttgctggagcctg

SEQ ID NO: 4834429 - DNA, 11 bp, Homo sapiens
ggttgctttga

SEQ ID NO: 4834430 - DNA, 14 bp, Homo sapiens
ggttggaccccaga

SEQ ID NO: 4834431 - DNA, 14 bp, Homo sapiens
ggttggaggcctgg

SEQ ID NO: 4834432 - DNA, 19 bp, Homo sapiens
ggttgtacatagtggtcat

SEQ ID NO: 4834433 - DNA, 23 bp, Homo sapiens
ggttgtctctcttcggtggcctt

SEQ ID NO: 4834434 - DNA, 14 bp, Homo sapiens
ggtttacccagtgg

SEQ ID NO: 4834435 - DNA, 17 bp, Homo sapiens
ggtttagccgggcccca

SEQ ID NO: 4834436 - DNA, 23 bp, Homo sapiens
ggtttagcgttgttttgtggata

SEQ ID NO: 4834437 - DNA, 15 bp, Homo sapiens
ggtttagctgtgcag

SEQ ID NO: 4834438 - DNA, 17 bp, Homo sapiens
ggtttatttttctgtta

SEQ ID NO: 4834439 - DNA, 14 bp, Homo sapiens
ggtttcagaaaggg

SEQ ID NO: 4834440 - DNA, 23 bp, Homo sapiens
ggtttgaggaccctcccaggttt

SEQ ID NO: 4834441 - DNA, 14 bp, Homo sapiens
ggtttgggcagtgg

SEQ ID NO: 4834442 - DNA, 17 bp, Homo sapiens
ggtttgggcagtggaga

SEQ ID NO: 4834443 - DNA, 20 bp, Homo sapiens
ggtttgggcagtggagaggg

SEQ ID NO: 4834444 - DNA, 19 bp, Homo sapiens
ggtttgggggacgcccagc

SEQ ID NO: 4834445 - DNA, 19 bp, Homo sapiens
ggttttgacttgccactgc

SEQ ID NO: 4834446 - DNA, 21 bp, Homo sapiens
gtaaaacagatttgttcattc

SEQ ID NO: 4834447 - DNA, 15 bp, Homo sapiens
gtaaaactgtgacat

SEQ ID NO: 4834448 - DNA, 16 bp, Homo sapiens
gtaaaactgtgacatt

SEQ ID NO: 4834449 - DNA, 15 bp, Homo sapiens
gtaaaactttatttt

SEQ ID NO: 4834450 - DNA, 14 bp, Homo sapiens
gtaaaatgtattat

SEQ ID NO: 4834451 - DNA, 22 bp, Homo sapiens
gtaaacatcataaatagtaaat

SEQ ID NO: 4834452 - DNA, 20 bp, Homo sapiens
gtaaataaatgctgctttgg

SEQ ID NO: 4834453 - DNA, 13 bp, Homo sapiens
gtaaatacattat

SEQ ID NO: 4834454 - DNA, 21 bp, Homo sapiens
gtaaataggtttctaaaaagt

SEQ ID NO: 4834455 - DNA, 19 bp, Homo sapiens
gtaaatatacactttacat

SEQ ID NO: 4834456 - DNA, 22 bp, Homo sapiens
gtaaatcccacgacataagctg

SEQ ID NO: 4834457 - DNA, 16 bp, Homo sapiens
gtaaatgtcttcatgt

SEQ ID NO: 4834458 - DNA, 21 bp, Homo sapiens
gtaaattcctaattctatgat

SEQ ID NO: 4834459 - DNA, 19 bp, Homo sapiens
gtaacatcactatccatgc

SEQ ID NO: 4834460 - DNA, 20 bp, Homo sapiens
gtaacatcactatccatgca

SEQ ID NO: 4834461 - DNA, 17 bp, Homo sapiens
gtaacattctatttcaa

SEQ ID NO: 4834462 - DNA, 14 bp, Homo sapiens
gtaactattcttca

SEQ ID NO: 4834463 - DNA, 14 bp, Homo sapiens
gtaactctttggct

SEQ ID NO: 4834464 - DNA, 13 bp, Homo sapiens
gtaacttaattat

SEQ ID NO: 4834465 - DNA, 21 bp, Homo sapiens
gtaacttgctgtgaaatgact

SEQ ID NO: 4834466 - DNA, 13 bp, Homo sapiens
gtaagattgttat

SEQ ID NO: 4834467 - DNA, 21 bp, Homo sapiens
gtaagattgttattaaatgta

SEQ ID NO: 4834468 - DNA, 15 bp, Homo sapiens
gtaagttctgaaaac

SEQ ID NO: 4834469 - DNA, 13 bp, Homo sapiens
gtaataaaacatt

SEQ ID NO: 4834470 - DNA, 16 bp, Homo sapiens
gtaatagcctcacctt

SEQ ID NO: 4834471 - DNA, 23 bp, Homo sapiens
gtaatatagggtttgtttgctgc

SEQ ID NO: 4834472 - DNA, 17 bp, Homo sapiens
gtaatatcagttacagt

SEQ ID NO: 4834473 - DNA, 15 bp, Homo sapiens
gtaatatcatttcat

SEQ ID NO: 4834474 - DNA, 20 bp, Homo sapiens
gtaatatcatttcataaaaa

SEQ ID NO: 4834475 - DNA, 13 bp, Homo sapiens
gtaatattaaatt

SEQ ID NO: 4834476 - DNA, 19 bp, Homo sapiens
gtaatatttacaatgtatt

SEQ ID NO: 4834477 - DNA, 22 bp, Homo sapiens
gtaatctgtataatactttgta

SEQ ID NO: 4834478 - DNA, 21 bp, Homo sapiens
gtaattaaaaagacactttta

SEQ ID NO: 4834479 - DNA, 22 bp, Homo sapiens
gtaattaaactgttaacttatt

SEQ ID NO: 4834480 - DNA, 18 bp, Homo sapiens
gtaatttcctgctcctcc

SEQ ID NO: 4834481 - DNA, 22 bp, Homo sapiens
gtaatttgttatatcagcagac

SEQ ID NO: 4834482 - DNA, 23 bp, Homo sapiens
gtaattttcggatgggagagttt

SEQ ID NO: 4834483 - DNA, 14 bp, Homo sapiens
gtacaaacccagat

SEQ ID NO: 4834484 - DNA, 17 bp, Homo sapiens
gtacaataaataaaaga

SEQ ID NO: 4834485 - DNA, 13 bp, Homo sapiens
gtacaattactgt

SEQ ID NO: 4834486 - DNA, 19 bp, Homo sapiens
gtacaattctttgttgctt

SEQ ID NO: 4834487 - DNA, 21 bp, Homo sapiens
gtacaattctttgttgcttaa

SEQ ID NO: 4834488 - DNA, 19 bp, Homo sapiens
gtacaccactttcccacac

SEQ ID NO: 4834489 - DNA, 17 bp, Homo sapiens
gtacagaatcattgctt

SEQ ID NO: 4834490 - DNA, 20 bp, Homo sapiens
gtacagattgctgcttctgc

SEQ ID NO: 4834491 - DNA, 13 bp, Homo sapiens
gtacagcccaggc

SEQ ID NO: 4834492 - DNA, 23 bp, Homo sapiens
gtacaggatatcacctgaattat

SEQ ID NO: 4834493 - DNA, 20 bp, Homo sapiens
gtacagttatacatacctct

SEQ ID NO: 4834494 - DNA, 21 bp, Homo sapiens
gtacagtttgtgaggaccttt

SEQ ID NO: 4834495 - DNA, 21 bp, Homo sapiens
gtacataaagtaataactgtt

SEQ ID NO: 4834496 - DNA, 15 bp, Homo sapiens
gtacatatggaaatc

SEQ ID NO: 4834497 - DNA, 19 bp, Homo sapiens
gtacatatggaaatcctgt

SEQ ID NO: 4834498 - DNA, 18 bp, Homo sapiens
gtacatcttgtgcatgca

SEQ ID NO: 4834499 - DNA, 20 bp, Homo sapiens
gtacatcttgtgcatgcaaa

SEQ ID NO: 4834500 - DNA, 22 bp, Homo sapiens
gtaccagagcctatggaaaggg

SEQ ID NO: 4834501 - DNA, 16 bp, Homo sapiens
gtaccagcccaggcaa

SEQ ID NO: 4834502 - DNA, 14 bp, Homo sapiens
gtacctaagtaaat

SEQ ID NO: 4834503 - DNA, 16 bp, Homo sapiens
gtactacatttgcatg

SEQ ID NO: 4834504 - DNA, 13 bp, Homo sapiens
gtactagcaataa

SEQ ID NO: 4834505 - DNA, 14 bp, Homo sapiens
gtactcctcagacg

SEQ ID NO: 4834506 - DNA, 19 bp, Homo sapiens
gtactctgagtcctcattg

SEQ ID NO: 4834507 - DNA, 14 bp, Homo sapiens
gtactggatttaac

SEQ ID NO: 4834508 - DNA, 15 bp, Homo sapiens
gtactggtaagattg

SEQ ID NO: 4834509 - DNA, 17 bp, Homo sapiens
gtactgtactttcccag

SEQ ID NO: 4834510 - DNA, 19 bp, Homo sapiens
gtacttacactgaaatcca

SEQ ID NO: 4834511 - DNA, 21 bp, Homo sapiens
gtacttacactgaaatccaaa

SEQ ID NO: 4834512 - DNA, 22 bp, Homo sapiens
gtacttcttcatccatagacac

SEQ ID NO: 4834513 - DNA, 18 bp, Homo sapiens
gtacttcttctgtaatat

SEQ ID NO: 4834514 - DNA, 22 bp, Homo sapiens
gtacttgccctgaccatgcatt

SEQ ID NO: 4834515 - DNA, 13 bp, Homo sapiens
gtactttcccagg

SEQ ID NO: 4834516 - DNA, 20 bp, Homo sapiens
gtactttcccaggttgacta

SEQ ID NO: 4834517 - DNA, 17 bp, Homo sapiens
gtagaactttaaaagaa

SEQ ID NO: 4834518 - DNA, 19 bp, Homo sapiens
gtagagaaaaaaaaatatg

SEQ ID NO: 4834519 - DNA, 18 bp, Homo sapiens
gtagagagcaaagatggc

SEQ ID NO: 4834520 - DNA, 16 bp, Homo sapiens
gtagagcggagaaagg

SEQ ID NO: 4834521 - DNA, 16 bp, Homo sapiens
gtagagtcaggagaaa

SEQ ID NO: 4834522 - DNA, 17 bp, Homo sapiens
gtagagtcctaggacat

SEQ ID NO: 4834523 - DNA, 14 bp, Homo sapiens
gtagataaagcact

SEQ ID NO: 4834524 - DNA, 23 bp, Homo sapiens
gtagatagtatgcactatataca

SEQ ID NO: 4834525 - DNA, 14 bp, Homo sapiens
gtagatgagaaaac

SEQ ID NO: 4834526 - DNA, 21 bp, Homo sapiens
gtagattgtgtaaattcctgt

SEQ ID NO: 4834527 - DNA, 20 bp, Homo sapiens
gtagcaaattccaatacatt

SEQ ID NO: 4834528 - DNA, 13 bp, Homo sapiens
gtagcatatataa

SEQ ID NO: 4834529 - DNA, 12 bp, Homo sapiens
gtagccctggcc

SEQ ID NO: 4834530 - DNA, 13 bp, Homo sapiens
gtagccctggccc

SEQ ID NO: 4834531 - DNA, 22 bp, Homo sapiens
gtagcctggtctgtgcattgtg

SEQ ID NO: 4834532 - DNA, 18 bp, Homo sapiens
gtagctagtttaaaatta

SEQ ID NO: 4834533 - DNA, 16 bp, Homo sapiens
gtagctcgtgtgctta

SEQ ID NO: 4834534 - DNA, 18 bp, Homo sapiens
gtagctgataaagaaacc

SEQ ID NO: 4834535 - DNA, 15 bp, Homo sapiens
gtagggccctgacag

SEQ ID NO: 4834536 - DNA, 17 bp, Homo sapiens
gtagggccctgacaggc

SEQ ID NO: 4834537 - DNA, 17 bp, Homo sapiens
gtagggtgaggcgtggg

SEQ ID NO: 4834538 - DNA, 21 bp, Homo sapiens
gtagggtttagccgggcccca

SEQ ID NO: 4834539 - DNA, 16 bp, Homo sapiens
gtaggtctatgatgtc

SEQ ID NO: 4834540 - DNA, 14 bp, Homo sapiens
gtagtaattgttac

SEQ ID NO: 4834541 - DNA, 21 bp, Homo sapiens
gtagtacttcttctgtaatat

SEQ ID NO: 4834542 - DNA, 18 bp, Homo sapiens
gtagtagctcgtgtgctt

SEQ ID NO: 4834543 - DNA, 21 bp, Homo sapiens
gtagtcccggaggccttccct

SEQ ID NO: 4834544 - DNA, 22 bp, Homo sapiens
gtagtcccggaggccttccctt

SEQ ID NO: 4834545 - DNA, 19 bp, Homo sapiens
gtagtgccatggccaggag

SEQ ID NO: 4834546 - DNA, 19 bp, Homo sapiens
gtagtgtctggatcagtaa

SEQ ID NO: 4834547 - DNA, 22 bp, Homo sapiens
gtagttgatgaccaatctctgt

SEQ ID NO: 4834548 - DNA, 18 bp, Homo sapiens
gtataaaggcattgatat

SEQ ID NO: 4834549 - DNA, 16 bp, Homo sapiens
gtataaattacatgca

SEQ ID NO: 4834550 - DNA, 17 bp, Homo sapiens
gtataaattacatgcat

SEQ ID NO: 4834551 - DNA, 20 bp, Homo sapiens
gtataactaatttgctctgt

SEQ ID NO: 4834552 - DNA, 17 bp, Homo sapiens
gtatacaagtgtttcta

SEQ ID NO: 4834553 - DNA, 16 bp, Homo sapiens
gtatacatatgtatgt

SEQ ID NO: 4834554 - DNA, 17 bp, Homo sapiens
gtatacatatgtatgtg

SEQ ID NO: 4834555 - DNA, 18 bp, Homo sapiens
gtatagatggtagaaact

SEQ ID NO: 4834556 - DNA, 18 bp, Homo sapiens
gtatatacagagcctgtt

SEQ ID NO: 4834557 - DNA, 19 bp, Homo sapiens
gtatatattatatatacat

SEQ ID NO: 4834558 - DNA, 14 bp, Homo sapiens
gtatatattttgaa

SEQ ID NO: 4834559 - DNA, 18 bp, Homo sapiens
gtatatattttgaaagga

SEQ ID NO: 4834560 - DNA, 14 bp, Homo sapiens
gtatatcagctcta

SEQ ID NO: 4834561 - DNA, 22 bp, Homo sapiens
gtatatcagctctaaagcagag

SEQ ID NO: 4834562 - DNA, 18 bp, Homo sapiens
gtatatcgttatcactgt

SEQ ID NO: 4834563 - DNA, 16 bp, Homo sapiens
gtatatctgtgtaaga

SEQ ID NO: 4834564 - DNA, 21 bp, Homo sapiens
gtatattgatgtaactgtgtc

SEQ ID NO: 4834565 - DNA, 17 bp, Homo sapiens
gtatattttatttcaat

SEQ ID NO: 4834566 - DNA, 22 bp, Homo sapiens
gtatcagagatgtccattttta

SEQ ID NO: 4834567 - DNA, 24 bp, Homo sapiens
gtatcagtgtttatgtgctattaa

SEQ ID NO: 4834568 - DNA, 14 bp, Homo sapiens
gtatcctgacagcg

SEQ ID NO: 4834569 - DNA, 19 bp, Homo sapiens
gtatctgatgatgttctga

SEQ ID NO: 4834570 - DNA, 23 bp, Homo sapiens
gtatctgatgatgttctgaaatg

SEQ ID NO: 4834571 - DNA, 13 bp, Homo sapiens
gtatcttaaaatt

SEQ ID NO: 4834572 - DNA, 14 bp, Homo sapiens
gtatcttaaaattg

SEQ ID NO: 4834573 - DNA, 16 bp, Homo sapiens
gtatcttatttatata

SEQ ID NO: 4834574 - DNA, 18 bp, Homo sapiens
gtatcttatttatatatg

SEQ ID NO: 4834575 - DNA, 11 bp, Homo sapiens
gtatgaaatat

SEQ ID NO: 4834576 - DNA, 17 bp, Homo sapiens
gtatgaaatatatgtga

SEQ ID NO: 4834577 - DNA, 17 bp, Homo sapiens
gtatgatttaggcttct

SEQ ID NO: 4834578 - DNA, 16 bp, Homo sapiens
gtatgatttgttcctt

SEQ ID NO: 4834579 - DNA, 22 bp, Homo sapiens
gtatgatttgttcctttctgga

SEQ ID NO: 4834580 - DNA, 19 bp, Homo sapiens
gtatgccatgtatgttgca

SEQ ID NO: 4834581 - DNA, 13 bp, Homo sapiens
gtatgctggccag

SEQ ID NO: 4834582 - DNA, 14 bp, Homo sapiens
gtatgggagagaag

SEQ ID NO: 4834583 - DNA, 15 bp, Homo sapiens
gtatgggagagaaga

SEQ ID NO: 4834584 - DNA, 14 bp, Homo sapiens
gtatgtatacacac

SEQ ID NO: 4834585 - DNA, 13 bp, Homo sapiens
gtatgtcagttat

SEQ ID NO: 4834586 - DNA, 13 bp, Homo sapiens
gtatgtgtatgta

SEQ ID NO: 4834587 - DNA, 14 bp, Homo sapiens
gtatgtgtatgtac

SEQ ID NO: 4834588 - DNA, 16 bp, Homo sapiens
gtatgtgtgagtgtat

SEQ ID NO: 4834589 - DNA, 20 bp, Homo sapiens
gtatgtgtgagtgtatgtat

SEQ ID NO: 4834590 - DNA, 14 bp, Homo sapiens
gtatgttatacaac

SEQ ID NO: 4834591 - DNA, 18 bp, Homo sapiens
gtatgttttattgtaatc

SEQ ID NO: 4834592 - DNA, 20 bp, Homo sapiens
gtatgttttattgtaatcat

SEQ ID NO: 4834593 - DNA, 17 bp, Homo sapiens
gtattaaagatgcaggt

SEQ ID NO: 4834594 - DNA, 20 bp, Homo sapiens
gtattatcagtgaatataaa

SEQ ID NO: 4834595 - DNA, 12 bp, Homo sapiens
gtattatgcttc

SEQ ID NO: 4834596 - DNA, 15 bp, Homo sapiens
gtattatgcttcttg

SEQ ID NO: 4834597 - DNA, 17 bp, Homo sapiens
gtattatttagtaaaat

SEQ ID NO: 4834598 - DNA, 18 bp, Homo sapiens
gtattatttagtaaaatt

SEQ ID NO: 4834599 - DNA, 15 bp, Homo sapiens
gtattcctgcctttg

SEQ ID NO: 4834600 - DNA, 17 bp, Homo sapiens
gtattccttggcccagc

SEQ ID NO: 4834601 - DNA, 20 bp, Homo sapiens
gtattctgtagccaacttaa

SEQ ID NO: 4834602 - DNA, 17 bp, Homo sapiens
gtattgacaataagaaa

SEQ ID NO: 4834603 - DNA, 23 bp, Homo sapiens
gtattgacttctttttggcatta

SEQ ID NO: 4834604 - DNA, 14 bp, Homo sapiens
gtattggcagcaca

SEQ ID NO: 4834605 - DNA, 17 bp, Homo sapiens
gtattggcagcacagct

SEQ ID NO: 4834606 - DNA, 18 bp, Homo sapiens
gtattggcagcacagcta

SEQ ID NO: 4834607 - DNA, 23 bp, Homo sapiens
gtattggcagcacagctactcag

SEQ ID NO: 4834608 - DNA, 15 bp, Homo sapiens
gtattgtgagatcct

SEQ ID NO: 4834609 - DNA, 16 bp, Homo sapiens
gtattgttagatgttt

SEQ ID NO: 4834610 - DNA, 20 bp, Homo sapiens
gtattgttcttgtaaaactg

SEQ ID NO: 4834611 - DNA, 22 bp, Homo sapiens
gtatttaatgtttgtaagcaat

SEQ ID NO: 4834612 - DNA, 20 bp, Homo sapiens
gtatttactgcaatgtctgt

SEQ ID NO: 4834613 - DNA, 12 bp, Homo sapiens
gtatttgggttt

SEQ ID NO: 4834614 - DNA, 20 bp, Homo sapiens
gtattttaacatagcagctg

SEQ ID NO: 4834615 - DNA, 15 bp, Homo sapiens
gtattttaataaaga

SEQ ID NO: 4834616 - DNA, 16 bp, Homo sapiens
gtattttcttcccatt

SEQ ID NO: 4834617 - DNA, 19 bp, Homo sapiens
gtattttcttcccatttgt

SEQ ID NO: 4834618 - DNA, 20 bp, Homo sapiens
gtattttcttcccatttgta

SEQ ID NO: 4834619 - DNA, 23 bp, Homo sapiens
gtattttcttcccatttgtaatg

SEQ ID NO: 4834620 - DNA, 15 bp, Homo sapiens
gtatttttactatta

SEQ ID NO: 4834621 - DNA, 20 bp, Homo sapiens
gtatttttgtaattcctcta

SEQ ID NO: 4834622 - DNA, 16 bp, Homo sapiens
gtattttttgtgaatg

SEQ ID NO: 4834623 - DNA, 14 bp, Homo sapiens
gtcaaacagtgtgg

SEQ ID NO: 4834624 - DNA, 13 bp, Homo sapiens
gtcaaatggtatt

SEQ ID NO: 4834625 - DNA, 22 bp, Homo sapiens
gtcaaatggtattttttgtgaa

SEQ ID NO: 4834626 - DNA, 23 bp, Homo sapiens
gtcaaatggtattttttgtgaat

SEQ ID NO: 4834627 - DNA, 18 bp, Homo sapiens
gtcaacctgaattaaagt

SEQ ID NO: 4834628 - DNA, 13 bp, Homo sapiens
gtcaactccaagg

SEQ ID NO: 4834629 - DNA, 17 bp, Homo sapiens
gtcaagtctacctgcct

SEQ ID NO: 4834630 - DNA, 16 bp, Homo sapiens
gtcaataaaccactgt

SEQ ID NO: 4834631 - DNA, 15 bp, Homo sapiens
gtcaatcaaacaggg

SEQ ID NO: 4834632 - DNA, 22 bp, Homo sapiens
gtcaatgaaatatttgcttatt

SEQ ID NO: 4834633 - DNA, 22 bp, Homo sapiens
gtcaatgctatggactgcacaa

SEQ ID NO: 4834634 - DNA, 19 bp, Homo sapiens
gtcaatgtgaaataaagag

SEQ ID NO: 4834635 - DNA, 20 bp, Homo sapiens
gtcaatgtgaaataaagagt

SEQ ID NO: 4834636 - DNA, 13 bp, Homo sapiens
gtcaattacagga

SEQ ID NO: 4834637 - DNA, 15 bp, Homo sapiens
gtcaattacaggaag

SEQ ID NO: 4834638 - DNA, 13 bp, Homo sapiens
gtcaattccttag

SEQ ID NO: 4834639 - DNA, 16 bp, Homo sapiens
gtcacaaagctattta

SEQ ID NO: 4834640 - DNA, 13 bp, Homo sapiens
gtcacatatcaag

SEQ ID NO: 4834641 - DNA, 22 bp, Homo sapiens
gtcacatatcaagtcccgaggc

SEQ ID NO: 4834642 - DNA, 18 bp, Homo sapiens
gtcacatgacatccacat

SEQ ID NO: 4834643 - DNA, 23 bp, Homo sapiens
gtcaccagctatctgtcatctct

SEQ ID NO: 4834644 - DNA, 20 bp, Homo sapiens
gtcacccaggttggagtgca

SEQ ID NO: 4834645 - DNA, 19 bp, Homo sapiens
gtcacgctttcatgaccac

SEQ ID NO: 4834646 - DNA, 21 bp, Homo sapiens
gtcactgcccacctgccaggc

SEQ ID NO: 4834647 - DNA, 23 bp, Homo sapiens
gtcactggtaccggatgcagacc

SEQ ID NO: 4834648 - DNA, 19 bp, Homo sapiens
gtcacttttttcctgtcaa

SEQ ID NO: 4834649 - DNA, 15 bp, Homo sapiens
gtcagaagatctttc

SEQ ID NO: 4834650 - DNA, 22 bp, Homo sapiens
gtcagaatgttgtgttggtatt

SEQ ID NO: 4834651 - DNA, 12 bp, Homo sapiens
gtcagatgtttg

SEQ ID NO: 4834652 - DNA, 13 bp, Homo sapiens
gtcagcacagaga

SEQ ID NO: 4834653 - DNA, 11 bp, Homo sapiens
gtcagccagcc

SEQ ID NO: 4834654 - DNA, 21 bp, Homo sapiens
gtcagccagccgccctgggct

SEQ ID NO: 4834655 - DNA, 15 bp, Homo sapiens
gtcagcccatgtcaa

SEQ ID NO: 4834656 - DNA, 14 bp, Homo sapiens
gtcaggagccagca

SEQ ID NO: 4834657 - DNA, 15 bp, Homo sapiens
gtcagggcccagagg

SEQ ID NO: 4834658 - DNA, 16 bp, Homo sapiens
gtcagggcccagaggc

SEQ ID NO: 4834659 - DNA, 20 bp, Homo sapiens
gtcagggcccagaggctgag

SEQ ID NO: 4834660 - DNA, 18 bp, Homo sapiens
gtcagggccttggcccag

SEQ ID NO: 4834661 - DNA, 18 bp, Homo sapiens
gtcagggctgtgctttcc

SEQ ID NO: 4834662 - DNA, 15 bp, Homo sapiens
gtcaggtgggaaagc

SEQ ID NO: 4834663 - DNA, 19 bp, Homo sapiens
gtcagtccctacttaggaa

SEQ ID NO: 4834664 - DNA, 15 bp, Homo sapiens
gtcagtcgtgttgct

SEQ ID NO: 4834665 - DNA, 18 bp, Homo sapiens
gtcagtgaagcccaggag

SEQ ID NO: 4834666 - DNA, 23 bp, Homo sapiens
gtcagtgaagcccaggaggacct

SEQ ID NO: 4834667 - DNA, 13 bp, Homo sapiens
gtcagtttgtgaa

SEQ ID NO: 4834668 - DNA, 17 bp, Homo sapiens
gtcataactagagcacg

SEQ ID NO: 4834669 - DNA, 17 bp, Homo sapiens
gtcatatttaaacagaa

SEQ ID NO: 4834670 - DNA, 19 bp, Homo sapiens
gtcatcggaggctgggccc

SEQ ID NO: 4834671 - DNA, 22 bp, Homo sapiens
gtcatcggaggctgggcccctg

SEQ ID NO: 4834672 - DNA, 19 bp, Homo sapiens
gtcatctcaaacactgctt

SEQ ID NO: 4834673 - DNA, 15 bp, Homo sapiens
gtcatctctctgggg

SEQ ID NO: 4834674 - DNA, 17 bp, Homo sapiens
gtcatctctctggggcc

SEQ ID NO: 4834675 - DNA, 17 bp, Homo sapiens
gtcatgactttcagatt

SEQ ID NO: 4834676 - DNA, 19 bp, Homo sapiens
gtcatgatgaatcagtcct

SEQ ID NO: 4834677 - DNA, 12 bp, Homo sapiens
gtcatgcccagc

SEQ ID NO: 4834678 - DNA, 16 bp, Homo sapiens
gtcatgggagaagagg

SEQ ID NO: 4834679 - DNA, 17 bp, Homo sapiens
gtcatgggagaagaggg

SEQ ID NO: 4834680 - DNA, 14 bp, Homo sapiens
gtcattctgctaat

SEQ ID NO: 4834681 - DNA, 18 bp, Homo sapiens
gtcattctgctaatttat

SEQ ID NO: 4834682 - DNA, 20 bp, Homo sapiens
gtcattctgctaatttatga

SEQ ID NO: 4834683 - DNA, 17 bp, Homo sapiens
gtcattggttacaaatt

SEQ ID NO: 4834684 - DNA, 21 bp, Homo sapiens
gtcattggttacaaattttta

SEQ ID NO: 4834685 - DNA, 22 bp, Homo sapiens
gtcatttcttctctctgtgctg

SEQ ID NO: 4834686 - DNA, 15 bp, Homo sapiens
gtcatttgctaatga

SEQ ID NO: 4834687 - DNA, 22 bp, Homo sapiens
gtcatttgctaatgaattttaa

SEQ ID NO: 4834688 - DNA, 16 bp, Homo sapiens
gtcattttctgttata

SEQ ID NO: 4834689 - DNA, 15 bp, Homo sapiens
gtccaacagagtgga

SEQ ID NO: 4834690 - DNA, 12 bp, Homo sapiens
gtccaattttcc

SEQ ID NO: 4834691 - DNA, 23 bp, Homo sapiens
gtccacccccattgtgaatgttg

SEQ ID NO: 4834692 - DNA, 19 bp, Homo sapiens
gtccaccccgtcccggccc

SEQ ID NO: 4834693 - DNA, 18 bp, Homo sapiens
gtccaccttctgccaagg

SEQ ID NO: 4834694 - DNA, 22 bp, Homo sapiens
gtccagacaagccctgcttgct

SEQ ID NO: 4834695 - DNA, 17 bp, Homo sapiens
gtccagacaccatcacc

SEQ ID NO: 4834696 - DNA, 19 bp, Homo sapiens
gtccagacaccatcaccac

SEQ ID NO: 4834697 - DNA, 12 bp, Homo sapiens
gtccagccctcc

SEQ ID NO: 4834698 - DNA, 13 bp, Homo sapiens
gtccagccctccg

SEQ ID NO: 4834699 - DNA, 14 bp, Homo sapiens
gtccaggtcacagg

SEQ ID NO: 4834700 - DNA, 15 bp, Homo sapiens
gtccaggtcacaggc

SEQ ID NO: 4834701 - DNA, 19 bp, Homo sapiens
gtccatttttgagtaaaac

SEQ ID NO: 4834702 - DNA, 15 bp, Homo sapiens
gtcccagtccggtgc

SEQ ID NO: 4834703 - DNA, 17 bp, Homo sapiens
gtcccagtccggtgcct

SEQ ID NO: 4834704 - DNA, 20 bp, Homo sapiens
gtcccagtccggtgccttcc

SEQ ID NO: 4834705 - DNA, 16 bp, Homo sapiens
gtcccagtgtctggcc

SEQ ID NO: 4834706 - DNA, 11 bp, Homo sapiens
gtccccagggt

SEQ ID NO: 4834707 - DNA, 10 bp, Homo sapiens
gtccccggac

SEQ ID NO: 4834708 - DNA, 15 bp, Homo sapiens
gtcccctcactctgt

SEQ ID NO: 4834709 - DNA, 17 bp, Homo sapiens
gtcccctcactctgtca

SEQ ID NO: 4834710 - DNA, 20 bp, Homo sapiens
gtcccgagggcgcctgggtc

SEQ ID NO: 4834711 - DNA, 19 bp, Homo sapiens
gtcccggagctcaggccct

SEQ ID NO: 4834712 - DNA, 23 bp, Homo sapiens
gtcccgggtgccccccatgccct

SEQ ID NO: 4834713 - DNA, 19 bp, Homo sapiens
gtccctaattctcttcgct

SEQ ID NO: 4834714 - DNA, 22 bp, Homo sapiens
gtccctaattctcttcgctgtg

SEQ ID NO: 4834715 - DNA, 16 bp, Homo sapiens
gtccctacttaggaaa

SEQ ID NO: 4834716 - DNA, 16 bp, Homo sapiens
gtccctccctcctggc

SEQ ID NO: 4834717 - DNA, 18 bp, Homo sapiens
gtccctccctcctggctc

SEQ ID NO: 4834718 - DNA, 20 bp, Homo sapiens
gtccctccctcctggctcac

SEQ ID NO: 4834719 - DNA, 21 bp, Homo sapiens
gtccctcctcccccacgcctc

SEQ ID NO: 4834720 - DNA, 14 bp, Homo sapiens
gtccctcgagctct

SEQ ID NO: 4834721 - DNA, 16 bp, Homo sapiens
gtccctcgagctctgt

SEQ ID NO: 4834722 - DNA, 20 bp, Homo sapiens
gtccctcgagctctgtagcc

SEQ ID NO: 4834723 - DNA, 17 bp, Homo sapiens
gtccctgacttcccagc

SEQ ID NO: 4834724 - DNA, 20 bp, Homo sapiens
gtccctgagggcccttccca

SEQ ID NO: 4834725 - DNA, 17 bp, Homo sapiens
gtccctgcgtctcctgc

SEQ ID NO: 4834726 - DNA, 19 bp, Homo sapiens
gtccctgtgggctcacacc

SEQ ID NO: 4834727 - DNA, 22 bp, Homo sapiens
gtccctgtgggctcacaccggc

SEQ ID NO: 4834728 - DNA, 16 bp, Homo sapiens
gtcccttcctgtcctg

SEQ ID NO: 4834729 - DNA, 10 bp, Homo sapiens
gtccctttcc

SEQ ID NO: 4834730 - DNA, 15 bp, Homo sapiens
gtccctttccctgca

SEQ ID NO: 4834731 - DNA, 15 bp, Homo sapiens
gtccgcacgcggccg

SEQ ID NO: 4834732 - DNA, 15 bp, Homo sapiens
gtccgccccgtgctc

SEQ ID NO: 4834733 - DNA, 16 bp, Homo sapiens
gtccgcccgcccaccc

SEQ ID NO: 4834734 - DNA, 15 bp, Homo sapiens
gtccggcttggctag

SEQ ID NO: 4834735 - DNA, 13 bp, Homo sapiens
gtccggtgccttc

SEQ ID NO: 4834736 - DNA, 17 bp, Homo sapiens
gtccggtgccttccacc

SEQ ID NO: 4834737 - DNA, 18 bp, Homo sapiens
gtccggtgccttccaccc

SEQ ID NO: 4834738 - DNA, 19 bp, Homo sapiens
gtccggtgccttccaccct

SEQ ID NO: 4834739 - DNA, 22 bp, Homo sapiens
gtccggtgccttccaccctgcc

SEQ ID NO: 4834740 - DNA, 15 bp, Homo sapiens
gtccgtgaaagttgt

SEQ ID NO: 4834741 - DNA, 14 bp, Homo sapiens
gtcctaaatgcaaa

SEQ ID NO: 4834742 - DNA, 15 bp, Homo sapiens
gtcctactggggaaa

SEQ ID NO: 4834743 - DNA, 21 bp, Homo sapiens
gtcctactttacatatgcttt

SEQ ID NO: 4834744 - DNA, 22 bp, Homo sapiens
gtcctaggggccgagggaaatg

SEQ ID NO: 4834745 - DNA, 17 bp, Homo sapiens
gtcctatccccggacgc

SEQ ID NO: 4834746 - DNA, 21 bp, Homo sapiens
gtcctcagagggtccctaggt

SEQ ID NO: 4834747 - DNA, 14 bp, Homo sapiens
gtcctcatgtgaga

SEQ ID NO: 4834748 - DNA, 21 bp, Homo sapiens
gtcctcattgttcagaaaagc

SEQ ID NO: 4834749 - DNA, 14 bp, Homo sapiens
gtcctcccagctga

SEQ ID NO: 4834750 - DNA, 19 bp, Homo sapiens
gtcctcccagctgacggca

SEQ ID NO: 4834751 - DNA, 14 bp, Homo sapiens
gtcctcgccccccg

SEQ ID NO: 4834752 - DNA, 15 bp, Homo sapiens
gtcctcgccccccgc

SEQ ID NO: 4834753 - DNA, 23 bp, Homo sapiens
gtcctcgccccccgcccggcctc

SEQ ID NO: 4834754 - DNA, 15 bp, Homo sapiens
gtcctcggcagctcc

SEQ ID NO: 4834755 - DNA, 13 bp, Homo sapiens
gtcctcggccctg

SEQ ID NO: 4834756 - DNA, 17 bp, Homo sapiens
gtcctctcagaactcct

SEQ ID NO: 4834757 - DNA, 21 bp, Homo sapiens
gtcctctcagaactcctgtgt

SEQ ID NO: 4834758 - DNA, 16 bp, Homo sapiens
gtcctctcgagcccag

SEQ ID NO: 4834759 - DNA, 17 bp, Homo sapiens
gtcctctcgagcccaga

SEQ ID NO: 4834760 - DNA, 20 bp, Homo sapiens
gtcctgagccccctgcaccc

SEQ ID NO: 4834761 - DNA, 21 bp, Homo sapiens
gtcctgagccccctgcaccca

SEQ ID NO: 4834762 - DNA, 15 bp, Homo sapiens
gtcctgcatgtatgc

SEQ ID NO: 4834763 - DNA, 21 bp, Homo sapiens
gtcctgcgcctgcgcctcctc

SEQ ID NO: 4834764 - DNA, 24 bp, Homo sapiens
gtcctgcgcctgcgcctcctcctg

SEQ ID NO: 4834765 - DNA, 21 bp, Homo sapiens
gtcctgctacctttgtctcac

SEQ ID NO: 4834766 - DNA, 15 bp, Homo sapiens
gtcctgctcgccctg

SEQ ID NO: 4834767 - DNA, 16 bp, Homo sapiens
gtcctgctcgccctgt

SEQ ID NO: 4834768 - DNA, 18 bp, Homo sapiens
gtcctgctcgccctgtgc

SEQ ID NO: 4834769 - DNA, 12 bp, Homo sapiens
gtcctgctgctc

SEQ ID NO: 4834770 - DNA, 13 bp, Homo sapiens
gtcctgctgctcg

SEQ ID NO: 4834771 - DNA, 17 bp, Homo sapiens
gtcctggcatgggaatg

SEQ ID NO: 4834772 - DNA, 23 bp, Homo sapiens
gtcctggcccgggagccgcaggg

SEQ ID NO: 4834773 - DNA, 18 bp, Homo sapiens
gtcctgggggctgctgca

SEQ ID NO: 4834774 - DNA, 18 bp, Homo sapiens
gtcctgtgctttctgcat

SEQ ID NO: 4834775 - DNA, 21 bp, Homo sapiens
gtccttaaaaaatatgctctc

SEQ ID NO: 4834776 - DNA, 13 bp, Homo sapiens
gtccttgtccccg

SEQ ID NO: 4834777 - DNA, 22 bp, Homo sapiens
gtcctttcctctcctctctgga

SEQ ID NO: 4834778 - DNA, 18 bp, Homo sapiens
gtcgagtgatatggcttg

SEQ ID NO: 4834779 - DNA, 15 bp, Homo sapiens
gtcgcatttcatcaa

SEQ ID NO: 4834780 - DNA, 14 bp, Homo sapiens
gtcgccccaggccc

SEQ ID NO: 4834781 - DNA, 13 bp, Homo sapiens
gtcggctgggcag

SEQ ID NO: 4834782 - DNA, 14 bp, Homo sapiens
gtcgggggaggagc

SEQ ID NO: 4834783 - DNA, 22 bp, Homo sapiens
gtcgggggaggagcacccccag

SEQ ID NO: 4834784 - DNA, 11 bp, Homo sapiens
gtctaaagatc

SEQ ID NO: 4834785 - DNA, 23 bp, Homo sapiens
gtctaacttggggaaggggcctg

SEQ ID NO: 4834786 - DNA, 12 bp, Homo sapiens
gtctaataaaca

SEQ ID NO: 4834787 - DNA, 22 bp, Homo sapiens
gtctataggacttaatttagca

SEQ ID NO: 4834788 - DNA, 21 bp, Homo sapiens
gtctatgatgtccaaacttaa

SEQ ID NO: 4834789 - DNA, 15 bp, Homo sapiens
gtctcaaaataaaac

SEQ ID NO: 4834790 - DNA, 20 bp, Homo sapiens
gtctcaaaataaaaccagaa

SEQ ID NO: 4834791 - DNA, 15 bp, Homo sapiens
gtctcaatgttccat

SEQ ID NO: 4834792 - DNA, 20 bp, Homo sapiens
gtctcaattctgaaggggaa

SEQ ID NO: 4834793 - DNA, 23 bp, Homo sapiens
gtctcaattctgaaggggaaaac

SEQ ID NO: 4834794 - DNA, 16 bp, Homo sapiens
gtctcacgattccagt

SEQ ID NO: 4834795 - DNA, 18 bp, Homo sapiens
gtctcacgattccagtgc

SEQ ID NO: 4834796 - DNA, 19 bp, Homo sapiens
gtctcatgctccttaatgg

SEQ ID NO: 4834797 - DNA, 22 bp, Homo sapiens
gtctcatggtcccacttcccca

SEQ ID NO: 4834798 - DNA, 15 bp, Homo sapiens
gtctcattgccaagg

SEQ ID NO: 4834799 - DNA, 15 bp, Homo sapiens
gtctcatttgccagg

SEQ ID NO: 4834800 - DNA, 17 bp, Homo sapiens
gtctccctggccccagt

SEQ ID NO: 4834801 - DNA, 20 bp, Homo sapiens
gtctcctaagctggagtgca

SEQ ID NO: 4834802 - DNA, 19 bp, Homo sapiens
gtctcctcgtcccgagggc

SEQ ID NO: 4834803 - DNA, 13 bp, Homo sapiens
gtctcctctgtca

SEQ ID NO: 4834804 - DNA, 14 bp, Homo sapiens
gtctcctctgtcag

SEQ ID NO: 4834805 - DNA, 17 bp, Homo sapiens
gtctcctctgtcagttt

SEQ ID NO: 4834806 - DNA, 22 bp, Homo sapiens
gtctcctctgtcagtttgtgaa

SEQ ID NO: 4834807 - DNA, 19 bp, Homo sapiens
gtctccttaaactaccacc

SEQ ID NO: 4834808 - DNA, 20 bp, Homo sapiens
gtctctacaaaaaaaatcaa

SEQ ID NO: 4834809 - DNA, 18 bp, Homo sapiens
gtctctatttgatttgca

SEQ ID NO: 4834810 - DNA, 20 bp, Homo sapiens
gtctctccctaccctcttct

SEQ ID NO: 4834811 - DNA, 23 bp, Homo sapiens
gtctctccctaccctcttctcag

SEQ ID NO: 4834812 - DNA, 20 bp, Homo sapiens
gtctctcttcggtggccttg

SEQ ID NO: 4834813 - DNA, 13 bp, Homo sapiens
gtctctgagcagt

SEQ ID NO: 4834814 - DNA, 23 bp, Homo sapiens
gtctctgtccgcgtcctttcctc

SEQ ID NO: 4834815 - DNA, 15 bp, Homo sapiens
gtctcttcaaacagt

SEQ ID NO: 4834816 - DNA, 17 bp, Homo sapiens
gtctcttgggaagcagt

SEQ ID NO: 4834817 - DNA, 16 bp, Homo sapiens
gtctctttctttccaa

SEQ ID NO: 4834818 - DNA, 20 bp, Homo sapiens
gtctctttctttccaaaggt

SEQ ID NO: 4834819 - DNA, 14 bp, Homo sapiens
gtctgaaaaagtgt

SEQ ID NO: 4834820 - DNA, 17 bp, Homo sapiens
gtctgaaattttctaga

SEQ ID NO: 4834821 - DNA, 21 bp, Homo sapiens
gtctgaaattttctagaatac

SEQ ID NO: 4834822 - DNA, 17 bp, Homo sapiens
gtctgaaggagaggagt

SEQ ID NO: 4834823 - DNA, 22 bp, Homo sapiens
gtctgaaggagaggagtgcgct

SEQ ID NO: 4834824 - DNA, 14 bp, Homo sapiens
gtctgattgttcct

SEQ ID NO: 4834825 - DNA, 17 bp, Homo sapiens
gtctgattgttcctccc

SEQ ID NO: 4834826 - DNA, 20 bp, Homo sapiens
gtctgcacacataacacaca

SEQ ID NO: 4834827 - DNA, 19 bp, Homo sapiens
gtctgcagctattcacaca

SEQ ID NO: 4834828 - DNA, 10 bp, Homo sapiens
gtctgcccct

SEQ ID NO: 4834829 - DNA, 14 bp, Homo sapiens
gtctgctcctggga

SEQ ID NO: 4834830 - DNA, 12 bp, Homo sapiens
gtctgctgcctc

SEQ ID NO: 4834831 - DNA, 19 bp, Homo sapiens
gtctggaaggtcacgctga

SEQ ID NO: 4834832 - DNA, 15 bp, Homo sapiens
gtctggattttcaaa

SEQ ID NO: 4834833 - DNA, 13 bp, Homo sapiens
gtctggcccagcc

SEQ ID NO: 4834834 - DNA, 18 bp, Homo sapiens
gtctggctgtggcccctc

SEQ ID NO: 4834835 - DNA, 21 bp, Homo sapiens
gtctggctgtggcccctcctt

SEQ ID NO: 4834836 - DNA, 22 bp, Homo sapiens
gtctggctgtggcccctccttc

SEQ ID NO: 4834837 - DNA, 14 bp, Homo sapiens
gtctggtccacaca

SEQ ID NO: 4834838 - DNA, 11 bp, Homo sapiens
gtctgtacttc

SEQ ID NO: 4834839 - DNA, 20 bp, Homo sapiens
gtctgtcaccagctatctgt

SEQ ID NO: 4834840 - DNA, 19 bp, Homo sapiens
gtctgtcccagttaactgt

SEQ ID NO: 4834841 - DNA, 12 bp, Homo sapiens
gtctgtcctgcg

SEQ ID NO: 4834842 - DNA, 13 bp, Homo sapiens
gtctgtcctgcgc

SEQ ID NO: 4834843 - DNA, 22 bp, Homo sapiens
gtctgtctctcttttgctctct

SEQ ID NO: 4834844 - DNA, 18 bp, Homo sapiens
gtctgtgaataaagccac

SEQ ID NO: 4834845 - DNA, 16 bp, Homo sapiens
gtctgtgataacagag

SEQ ID NO: 4834846 - DNA, 15 bp, Homo sapiens
gtctgtgcattgtgg

SEQ ID NO: 4834847 - DNA, 14 bp, Homo sapiens
gtctgtgtatacat

SEQ ID NO: 4834848 - DNA, 20 bp, Homo sapiens
gtcttactaataggtctgga

SEQ ID NO: 4834849 - DNA, 22 bp, Homo sapiens
gtcttactaataggtctggaag

SEQ ID NO: 4834850 - DNA, 20 bp, Homo sapiens
gtcttagtcataccatccat

SEQ ID NO: 4834851 - DNA, 23 bp, Homo sapiens
gtcttattaaaacacttcattga

SEQ ID NO: 4834852 - DNA, 17 bp, Homo sapiens
gtcttcaaattgtcttt

SEQ ID NO: 4834853 - DNA, 17 bp, Homo sapiens
gtcttcaaccctgccct

SEQ ID NO: 4834854 - DNA, 22 bp, Homo sapiens
gtcttcctcctcagtcttctca

SEQ ID NO: 4834855 - DNA, 14 bp, Homo sapiens
gtcttcctctgtct

SEQ ID NO: 4834856 - DNA, 18 bp, Homo sapiens
gtcttgagtgggccccct

SEQ ID NO: 4834857 - DNA, 19 bp, Homo sapiens
gtcttgagtgggccccctc

SEQ ID NO: 4834858 - DNA, 14 bp, Homo sapiens
gtcttggagaggag

SEQ ID NO: 4834859 - DNA, 20 bp, Homo sapiens
gtcttggagaggaggtgtgg

SEQ ID NO: 4834860 - DNA, 14 bp, Homo sapiens
gtctttaaaatgat

SEQ ID NO: 4834861 - DNA, 13 bp, Homo sapiens
gtctttagctatt

SEQ ID NO: 4834862 - DNA, 15 bp, Homo sapiens
gtctttatgatttca

SEQ ID NO: 4834863 - DNA, 17 bp, Homo sapiens
gtctttatgatttcatg

SEQ ID NO: 4834864 - DNA, 14 bp, Homo sapiens
gtctttctccaaag

SEQ ID NO: 4834865 - DNA, 16 bp, Homo sapiens
gtctttctccaaagtt

SEQ ID NO: 4834866 - DNA, 16 bp, Homo sapiens
gtctttggttcctcat

SEQ ID NO: 4834867 - DNA, 19 bp, Homo sapiens
gtctttggttcctcatggc

SEQ ID NO: 4834868 - DNA, 18 bp, Homo sapiens
gtctttgtgttttgtcca

SEQ ID NO: 4834869 - DNA, 20 bp, Homo sapiens
gtcttttaaaaactcctgtt

SEQ ID NO: 4834870 - DNA, 12 bp, Homo sapiens
gtgaaatatcat

SEQ ID NO: 4834871 - DNA, 14 bp, Homo sapiens
gtgaaatgtaactg

SEQ ID NO: 4834872 - DNA, 18 bp, Homo sapiens
gtgaaattagtattttga

SEQ ID NO: 4834873 - DNA, 24 bp, Homo sapiens
gtgaacgtgggagttcagctgctt

SEQ ID NO: 4834874 - DNA, 21 bp, Homo sapiens
gtgaactaatgacaagtgact

SEQ ID NO: 4834875 - DNA, 19 bp, Homo sapiens
gtgaactatttctacacag

SEQ ID NO: 4834876 - DNA, 21 bp, Homo sapiens
gtgaacttggtgcctaatgtt

SEQ ID NO: 4834877 - DNA, 22 bp, Homo sapiens
gtgaagaaagcctgttgtttaa

SEQ ID NO: 4834878 - DNA, 16 bp, Homo sapiens
gtgaagacagagcaga

SEQ ID NO: 4834879 - DNA, 15 bp, Homo sapiens
gtgaagcccaggagg

SEQ ID NO: 4834880 - DNA, 11 bp, Homo sapiens
gtgaaggggct

SEQ ID NO: 4834881 - DNA, 15 bp, Homo sapiens
gtgaagtatgcacta

SEQ ID NO: 4834882 - DNA, 14 bp, Homo sapiens
gtgaagtgattgac

SEQ ID NO: 4834883 - DNA, 21 bp, Homo sapiens
gtgacaccaccactgtgtccc

SEQ ID NO: 4834884 - DNA, 22 bp, Homo sapiens
gtgacaccaccactgtgtccca

SEQ ID NO: 4834885 - DNA, 15 bp, Homo sapiens
gtgacaggaaagccc

SEQ ID NO: 4834886 - DNA, 19 bp, Homo sapiens
gtgacaggaaagccctccc

SEQ ID NO: 4834887 - DNA, 23 bp, Homo sapiens
gtgacaggcagtgttcttggggg

SEQ ID NO: 4834888 - DNA, 16 bp, Homo sapiens
gtgaccagcataccag

SEQ ID NO: 4834889 - DNA, 22 bp, Homo sapiens
gtgaccagcataccagttcttg

SEQ ID NO: 4834890 - DNA, 14 bp, Homo sapiens
gtgaccggcccgcc

SEQ ID NO: 4834891 - DNA, 20 bp, Homo sapiens
gtgaccggcccgccaccttg

SEQ ID NO: 4834892 - DNA, 21 bp, Homo sapiens
gtgaccggcccgccaccttgt

SEQ ID NO: 4834893 - DNA, 18 bp, Homo sapiens
gtgaccgggggaagctga

SEQ ID NO: 4834894 - DNA, 13 bp, Homo sapiens
gtgacctgacacc

SEQ ID NO: 4834895 - DNA, 14 bp, Homo sapiens
gtgacgaaaacatt

SEQ ID NO: 4834896 - DNA, 13 bp, Homo sapiens
gtgactctggctg

SEQ ID NO: 4834897 - DNA, 15 bp, Homo sapiens
gtgactctggctgcc

SEQ ID NO: 4834898 - DNA, 16 bp, Homo sapiens
gtgactctggctgcca

SEQ ID NO: 4834899 - DNA, 23 bp, Homo sapiens
gtgacttcagactctctcctctc

SEQ ID NO: 4834900 - DNA, 14 bp, Homo sapiens
gtgagaaagcagat

SEQ ID NO: 4834901 - DNA, 13 bp, Homo sapiens
gtgagaactgtga

SEQ ID NO: 4834902 - DNA, 20 bp, Homo sapiens
gtgagaagtacagggcagaa

SEQ ID NO: 4834903 - DNA, 21 bp, Homo sapiens
gtgagaagtacagggcagaac

SEQ ID NO: 4834904 - DNA, 22 bp, Homo sapiens
gtgagaattactgtttgaaact

SEQ ID NO: 4834905 - DNA, 14 bp, Homo sapiens
gtgagactctgagg

SEQ ID NO: 4834906 - DNA, 14 bp, Homo sapiens
gtgagataaatatc

SEQ ID NO: 4834907 - DNA, 17 bp, Homo sapiens
gtgagatcagtcagctc

SEQ ID NO: 4834908 - DNA, 20 bp, Homo sapiens
gtgagatttagggttctata

SEQ ID NO: 4834909 - DNA, 14 bp, Homo sapiens
gtgagatttgtatt

SEQ ID NO: 4834910 - DNA, 17 bp, Homo sapiens
gtgagcaggaaggcctg

SEQ ID NO: 4834911 - DNA, 18 bp, Homo sapiens
gtgagcaggaaggcctgg

SEQ ID NO: 4834912 - DNA, 23 bp, Homo sapiens
gtgagcgccccgcccccacccct

SEQ ID NO: 4834913 - DNA, 16 bp, Homo sapiens
gtgagctaccaggaag

SEQ ID NO: 4834914 - DNA, 13 bp, Homo sapiens
gtgaggacagggc

SEQ ID NO: 4834915 - DNA, 23 bp, Homo sapiens
gtgaggactgttggctgattgga

SEQ ID NO: 4834916 - DNA, 11 bp, Homo sapiens
gtgaggccaga

SEQ ID NO: 4834917 - DNA, 13 bp, Homo sapiens
gtgaggcgtggga

SEQ ID NO: 4834918 - DNA, 23 bp, Homo sapiens
gtgagggcaaaccaggctgcagg

SEQ ID NO: 4834919 - DNA, 15 bp, Homo sapiens
gtgaggtttcagtag

SEQ ID NO: 4834920 - DNA, 17 bp, Homo sapiens
gtgagtcctggcatggg

SEQ ID NO: 4834921 - DNA, 23 bp, Homo sapiens
gtgagtgtatgtatacacacaca

SEQ ID NO: 4834922 - DNA, 20 bp, Homo sapiens
gtgagtgtgaatataaatgt

SEQ ID NO: 4834923 - DNA, 13 bp, Homo sapiens
gtgatactccaag

SEQ ID NO: 4834924 - DNA, 18 bp, Homo sapiens
gtgatatgtgtaatatca

SEQ ID NO: 4834925 - DNA, 20 bp, Homo sapiens
gtgatatgtgtaatatcatt

SEQ ID NO: 4834926 - DNA, 21 bp, Homo sapiens
gtgatatgtgtaatatcattt

SEQ ID NO: 4834927 - DNA, 23 bp, Homo sapiens
gtgatcactttctgaaattcaca

SEQ ID NO: 4834928 - DNA, 24 bp, Homo sapiens
gtgatccacccgcctcagcctccc

SEQ ID NO: 4834929 - DNA, 18 bp, Homo sapiens
gtgatcccccaaacagca

SEQ ID NO: 4834930 - DNA, 18 bp, Homo sapiens
gtgatctgtccttccaac

SEQ ID NO: 4834931 - DNA, 13 bp, Homo sapiens
gtgatgatagcac

SEQ ID NO: 4834932 - DNA, 14 bp, Homo sapiens
gtgatgggcaaggg

SEQ ID NO: 4834933 - DNA, 15 bp, Homo sapiens
gtgatttatgcattt

SEQ ID NO: 4834934 - DNA, 17 bp, Homo sapiens
gtgatttatgcatttat

SEQ ID NO: 4834935 - DNA, 15 bp, Homo sapiens
gtgcaaagcagtatg

SEQ ID NO: 4834936 - DNA, 17 bp, Homo sapiens
gtgcaatttgtttgtgc

SEQ ID NO: 4834937 - DNA, 21 bp, Homo sapiens
gtgcaatttgtttgtgcttct

SEQ ID NO: 4834938 - DNA, 16 bp, Homo sapiens
gtgcacctgccccagg

SEQ ID NO: 4834939 - DNA, 18 bp, Homo sapiens
gtgcacctgccccaggct

SEQ ID NO: 4834940 - DNA, 22 bp, Homo sapiens
gtgcaggaaaaggctgcagcta

SEQ ID NO: 4834941 - DNA, 17 bp, Homo sapiens
gtgcagggacagcctgc

SEQ ID NO: 4834942 - DNA, 18 bp, Homo sapiens
gtgcagggacagcctgca

SEQ ID NO: 4834943 - DNA, 24 bp, Homo sapiens
gtgcagtggcatcatctcagctca

SEQ ID NO: 4834944 - DNA, 16 bp, Homo sapiens
gtgcagttgctgttta

SEQ ID NO: 4834945 - DNA, 20 bp, Homo sapiens
gtgcatatggcaacgttcat

SEQ ID NO: 4834946 - DNA, 22 bp, Homo sapiens
gtgcatatggcaacgttcatgt

SEQ ID NO: 4834947 - DNA, 23 bp, Homo sapiens
gtgcatctggcctatgaccctgt

SEQ ID NO: 4834948 - DNA, 16 bp, Homo sapiens
gtgcatctggcctggg

SEQ ID NO: 4834949 - DNA, 17 bp, Homo sapiens
gtgcatctggcctgggg

SEQ ID NO: 4834950 - DNA, 19 bp, Homo sapiens
gtgcatctggcctgggggc

SEQ ID NO: 4834951 - DNA, 22 bp, Homo sapiens
gtgcatgagaatgtcatttgct

SEQ ID NO: 4834952 - DNA, 23 bp, Homo sapiens
gtgcatgagaatgtcatttgcta

SEQ ID NO: 4834953 - DNA, 16 bp, Homo sapiens
gtgcatgcaaaaatga

SEQ ID NO: 4834954 - DNA, 18 bp, Homo sapiens
gtgcatgcaaaaatgaat

SEQ ID NO: 4834955 - DNA, 19 bp, Homo sapiens
gtgcatgcaaaaatgaatt

SEQ ID NO: 4834956 - DNA, 12 bp, Homo sapiens
gtgcatgtcaca

SEQ ID NO: 4834957 - DNA, 19 bp, Homo sapiens
gtgcatgtgtgttcatgca

SEQ ID NO: 4834958 - DNA, 15 bp, Homo sapiens
gtgcatgttaaaata

SEQ ID NO: 4834959 - DNA, 20 bp, Homo sapiens
gtgccaaaaggccccttccc

SEQ ID NO: 4834960 - DNA, 14 bp, Homo sapiens
gtgccaaagatagc

SEQ ID NO: 4834961 - DNA, 14 bp, Homo sapiens
gtgccaagcagagg

SEQ ID NO: 4834962 - DNA, 20 bp, Homo sapiens
gtgccacatggccgctgccc

SEQ ID NO: 4834963 - DNA, 13 bp, Homo sapiens
gtgccacgtggcc

SEQ ID NO: 4834964 - DNA, 14 bp, Homo sapiens
gtgcccagtcttga

SEQ ID NO: 4834965 - DNA, 20 bp, Homo sapiens
gtgcccagtcttgagtgggc

SEQ ID NO: 4834966 - DNA, 16 bp, Homo sapiens
gtgcccatttcacaca

SEQ ID NO: 4834967 - DNA, 18 bp, Homo sapiens
gtgcccccagcgtggggc

SEQ ID NO: 4834968 - DNA, 14 bp, Homo sapiens
gtgccccgcctccc

SEQ ID NO: 4834969 - DNA, 13 bp, Homo sapiens
gtgcccgtgtggc

SEQ ID NO: 4834970 - DNA, 17 bp, Homo sapiens
gtgcccgtgtggcctgg

SEQ ID NO: 4834971 - DNA, 23 bp, Homo sapiens
gtgccctctcactgacttctccc

SEQ ID NO: 4834972 - DNA, 18 bp, Homo sapiens
gtgcccttaaaataatga

SEQ ID NO: 4834973 - DNA, 23 bp, Homo sapiens
gtgcctctctctcccaactgctg

SEQ ID NO: 4834974 - DNA, 20 bp, Homo sapiens
gtgcctgctatccagccgca

SEQ ID NO: 4834975 - DNA, 19 bp, Homo sapiens
gtgcctgtgtttcatgttc

SEQ ID NO: 4834976 - DNA, 20 bp, Homo sapiens
gtgcctgtgtttcatgttct

SEQ ID NO: 4834977 - DNA, 16 bp, Homo sapiens
gtgccttccaccctgc

SEQ ID NO: 4834978 - DNA, 19 bp, Homo sapiens
gtgccttccaccctgccct

SEQ ID NO: 4834979 - DNA, 15 bp, Homo sapiens
gtgcgacttcacaaa

SEQ ID NO: 4834980 - DNA, 20 bp, Homo sapiens
gtgcgacttcacaaaatgca

SEQ ID NO: 4834981 - DNA, 22 bp, Homo sapiens
gtgcgacttcacaaaatgcaag

SEQ ID NO: 4834982 - DNA, 17 bp, Homo sapiens
gtgcggaccggagcggc

SEQ ID NO: 4834983 - DNA, 11 bp, Homo sapiens
gtgcggcccgt

SEQ ID NO: 4834984 - DNA, 17 bp, Homo sapiens
gtgcggcccgtgcgcag

SEQ ID NO: 4834985 - DNA, 14 bp, Homo sapiens
gtgcgggcgcccgg

SEQ ID NO: 4834986 - DNA, 19 bp, Homo sapiens
gtgcgtatgcagtgtagat

SEQ ID NO: 4834987 - DNA, 13 bp, Homo sapiens
gtgcgtgtggccc

SEQ ID NO: 4834988 - DNA, 15 bp, Homo sapiens
gtgctaaacctatct

SEQ ID NO: 4834989 - DNA, 23 bp, Homo sapiens
gtgctaaacctatctgtattggc

SEQ ID NO: 4834990 - DNA, 21 bp, Homo sapiens
gtgctagaggattagtaagat

SEQ ID NO: 4834991 - DNA, 21 bp, Homo sapiens
gtgctattcgtaagttctgtg

SEQ ID NO: 4834992 - DNA, 19 bp, Homo sapiens
gtgctcagccccagacctg

SEQ ID NO: 4834993 - DNA, 16 bp, Homo sapiens
gtgctcagggcatgct

SEQ ID NO: 4834994 - DNA, 14 bp, Homo sapiens
gtgctcctctgccc

SEQ ID NO: 4834995 - DNA, 13 bp, Homo sapiens
gtgctccttttct

SEQ ID NO: 4834996 - DNA, 15 bp, Homo sapiens
gtgctcggacacagt

SEQ ID NO: 4834997 - DNA, 17 bp, Homo sapiens
gtgctcggacacagttt

SEQ ID NO: 4834998 - DNA, 22 bp, Homo sapiens
gtgctcggacacagttttgtct

SEQ ID NO: 4834999 - DNA, 15 bp, Homo sapiens
gtgcttacctcacac

SEQ ID NO: 4835000 - DNA, 15 bp, Homo sapiens
gtgcttctcacactg

SEQ ID NO: 4835001 - DNA, 20 bp, Homo sapiens
gtgcttctcacactggagga

SEQ ID NO: 4835002 - DNA, 18 bp, Homo sapiens
gtgcttgtgtgtatgtct

SEQ ID NO: 4835003 - DNA, 19 bp, Homo sapiens
gtgcttgtgtgtatgtcta

SEQ ID NO: 4835004 - DNA, 20 bp, Homo sapiens
gtgctttctatctaattttt

SEQ ID NO: 4835005 - DNA, 17 bp, Homo sapiens
gtgctttctgcatgctt

SEQ ID NO: 4835006 - DNA, 23 bp, Homo sapiens
gtggaaggcacccgccctttcct

SEQ ID NO: 4835007 - DNA, 13 bp, Homo sapiens
gtggaagggcagg

SEQ ID NO: 4835008 - DNA, 19 bp, Homo sapiens
gtggaaggtgtcaatttgg

SEQ ID NO: 4835009 - DNA, 22 bp, Homo sapiens
gtggaattacataacaggcatt

SEQ ID NO: 4835010 - DNA, 16 bp, Homo sapiens
gtggacatttgttctg

SEQ ID NO: 4835011 - DNA, 19 bp, Homo sapiens
gtggacctctactttccag

SEQ ID NO: 4835012 - DNA, 17 bp, Homo sapiens
gtggacgtgggctccag

SEQ ID NO: 4835013 - DNA, 13 bp, Homo sapiens
gtggactgtattt

SEQ ID NO: 4835014 - DNA, 20 bp, Homo sapiens
gtggagcgtccttgtccccg

SEQ ID NO: 4835015 - DNA, 12 bp, Homo sapiens
gtggagtggagg

SEQ ID NO: 4835016 - DNA, 17 bp, Homo sapiens
gtggatacgtgtcaatg

SEQ ID NO: 4835017 - DNA, 19 bp, Homo sapiens
gtggatactggggggcagg

SEQ ID NO: 4835018 - DNA, 14 bp, Homo sapiens
gtggatgtaaattt

SEQ ID NO: 4835019 - DNA, 14 bp, Homo sapiens
gtggattgtttttt

SEQ ID NO: 4835020 - DNA, 14 bp, Homo sapiens
gtggcaccagatgc

SEQ ID NO: 4835021 - DNA, 18 bp, Homo sapiens
gtggcacccaccactctc

SEQ ID NO: 4835022 - DNA, 19 bp, Homo sapiens
gtggcaggcacacagcagc

SEQ ID NO: 4835023 - DNA, 21 bp, Homo sapiens
gtggcaggcacacagcagccc

SEQ ID NO: 4835024 - DNA, 12 bp, Homo sapiens
gtggcagtattg

SEQ ID NO: 4835025 - DNA, 15 bp, Homo sapiens
gtggccatccctggg

SEQ ID NO: 4835026 - DNA, 21 bp, Homo sapiens
gtggccatccctgggcccctc

SEQ ID NO: 4835027 - DNA, 11 bp, Homo sapiens
gtggcccctcc

SEQ ID NO: 4835028 - DNA, 18 bp, Homo sapiens
gtggccctgccctctcct

SEQ ID NO: 4835029 - DNA, 11 bp, Homo sapiens
gtggccctgcg

SEQ ID NO: 4835030 - DNA, 18 bp, Homo sapiens
gtggccgtcacgctttca

SEQ ID NO: 4835031 - DNA, 12 bp, Homo sapiens
gtggcctcagcc

SEQ ID NO: 4835032 - DNA, 14 bp, Homo sapiens
gtggcctcagccct

SEQ ID NO: 4835033 - DNA, 16 bp, Homo sapiens
gtggcctcagccctca

SEQ ID NO: 4835034 - DNA, 19 bp, Homo sapiens
gtggcctcagccctcagaa

SEQ ID NO: 4835035 - DNA, 21 bp, Homo sapiens
gtggcctggcttctgggacag

SEQ ID NO: 4835036 - DNA, 22 bp, Homo sapiens
gtggctaaatgcctaataaaca

SEQ ID NO: 4835037 - DNA, 16 bp, Homo sapiens
gtggctcccagcagag

SEQ ID NO: 4835038 - DNA, 20 bp, Homo sapiens
gtggctcgtgtttcacagtg

SEQ ID NO: 4835039 - DNA, 23 bp, Homo sapiens
gtggctggagccccatcgcctgg

SEQ ID NO: 4835040 - DNA, 17 bp, Homo sapiens
gtgggaagagggcaggg

SEQ ID NO: 4835041 - DNA, 21 bp, Homo sapiens
gtgggagaggagaggctgctg

SEQ ID NO: 4835042 - DNA, 19 bp, Homo sapiens
gtgggagcacagctttcct

SEQ ID NO: 4835043 - DNA, 13 bp, Homo sapiens
gtgggatccagag

SEQ ID NO: 4835044 - DNA, 14 bp, Homo sapiens
gtgggatccagaga

SEQ ID NO: 4835045 - DNA, 17 bp, Homo sapiens
gtgggatccagagagaa

SEQ ID NO: 4835046 - DNA, 20 bp, Homo sapiens
gtgggatccagagagaagca

SEQ ID NO: 4835047 - DNA, 15 bp, Homo sapiens
gtgggccccacagtg

SEQ ID NO: 4835048 - DNA, 18 bp, Homo sapiens
gtgggccccacagtggtc

SEQ ID NO: 4835049 - DNA, 19 bp, Homo sapiens
gtgggcgcctgtcgggccc

SEQ ID NO: 4835050 - DNA, 17 bp, Homo sapiens
gtgggctccagagtagg

SEQ ID NO: 4835051 - DNA, 22 bp, Homo sapiens
gtgggctccagggactggagtg

SEQ ID NO: 4835052 - DNA, 15 bp, Homo sapiens
gtggggacctcaggc

SEQ ID NO: 4835053 - DNA, 18 bp, Homo sapiens
gtggggagggcctctgga

SEQ ID NO: 4835054 - DNA, 14 bp, Homo sapiens
gtggggccagcgct

SEQ ID NO: 4835055 - DNA, 20 bp, Homo sapiens
gtggggcttagaatggggct

SEQ ID NO: 4835056 - DNA, 15 bp, Homo sapiens
gtggggcttggcgtg

SEQ ID NO: 4835057 - DNA, 17 bp, Homo sapiens
gtggggcttggcgtgga

SEQ ID NO: 4835058 - DNA, 14 bp, Homo sapiens
gtgggggagaatgg

SEQ ID NO: 4835059 - DNA, 21 bp, Homo sapiens
gtgggggtggccatccctggg

SEQ ID NO: 4835060 - DNA, 16 bp, Homo sapiens
gtggggtgctggggct

SEQ ID NO: 4835061 - DNA, 19 bp, Homo sapiens
gtggggttttcacttccta

SEQ ID NO: 4835062 - DNA, 23 bp, Homo sapiens
gtggggtttttaatctcttgtca

SEQ ID NO: 4835063 - DNA, 19 bp, Homo sapiens
gtgggtcaactccaaggca

SEQ ID NO: 4835064 - DNA, 20 bp, Homo sapiens
gtgggtccctgcgtctcctg

SEQ ID NO: 4835065 - DNA, 23 bp, Homo sapiens
gtggtcttcaaattgtcttttgt

SEQ ID NO: 4835066 - DNA, 16 bp, Homo sapiens
gtggtcttggagagga

SEQ ID NO: 4835067 - DNA, 17 bp, Homo sapiens
gtggtcttggagaggag

SEQ ID NO: 4835068 - DNA, 18 bp, Homo sapiens
gtggtcttggagaggagg

SEQ ID NO: 4835069 - DNA, 22 bp, Homo sapiens
gtggtgaggtcctgtcctggct

SEQ ID NO: 4835070 - DNA, 15 bp, Homo sapiens
gtggtgtgaggcccc

SEQ ID NO: 4835071 - DNA, 16 bp, Homo sapiens
gtggtgtgaggccccc

SEQ ID NO: 4835072 - DNA, 13 bp, Homo sapiens
gtggttgtttttt

SEQ ID NO: 4835073 - DNA, 23 bp, Homo sapiens
gtggtttgttatcagtacaattc

SEQ ID NO: 4835074 - DNA, 14 bp, Homo sapiens
gtgtaatatcattt

SEQ ID NO: 4835075 - DNA, 14 bp, Homo sapiens
gtgtactgtaaaga

SEQ ID NO: 4835076 - DNA, 18 bp, Homo sapiens
gtgtagattttatagtgt

SEQ ID NO: 4835077 - DNA, 20 bp, Homo sapiens
gtgtagattttatagtgtgt

SEQ ID NO: 4835078 - DNA, 13 bp, Homo sapiens
gtgtagctgtcct

SEQ ID NO: 4835079 - DNA, 20 bp, Homo sapiens
gtgtaggaaatctgaagcct

SEQ ID NO: 4835080 - DNA, 18 bp, Homo sapiens
gtgtagtcccggaggcct

SEQ ID NO: 4835081 - DNA, 16 bp, Homo sapiens
gtgtatacatatgtat

SEQ ID NO: 4835082 - DNA, 20 bp, Homo sapiens
gtgtatacatatgtatgtgt

SEQ ID NO: 4835083 - DNA, 14 bp, Homo sapiens
gtgtatgatccaag

SEQ ID NO: 4835084 - DNA, 22 bp, Homo sapiens
gtgtatttctattttgcagcag

SEQ ID NO: 4835085 - DNA, 14 bp, Homo sapiens
gtgtatttttgtaa

SEQ ID NO: 4835086 - DNA, 16 bp, Homo sapiens
gtgtatttttgtaatt

SEQ ID NO: 4835087 - DNA, 15 bp, Homo sapiens
gtgtcacgtgaccct

SEQ ID NO: 4835088 - DNA, 16 bp, Homo sapiens
gtgtcacgtgaccctg

SEQ ID NO: 4835089 - DNA, 17 bp, Homo sapiens
gtgtcacgtgaccctgt

SEQ ID NO: 4835090 - DNA, 19 bp, Homo sapiens
gtgtcataactagagcacg

SEQ ID NO: 4835091 - DNA, 13 bp, Homo sapiens
gtgtcatctgtca

SEQ ID NO: 4835092 - DNA, 13 bp, Homo sapiens
gtgtcatgatttc

SEQ ID NO: 4835093 - DNA, 18 bp, Homo sapiens
gtgtcccagtgtctggcc

SEQ ID NO: 4835094 - DNA, 21 bp, Homo sapiens
gtgtcccatgcataacacact

SEQ ID NO: 4835095 - DNA, 16 bp, Homo sapiens
gtgtcccccctgtggt

SEQ ID NO: 4835096 - DNA, 18 bp, Homo sapiens
gtgtcccccctgtggtct

SEQ ID NO: 4835097 - DNA, 13 bp, Homo sapiens
gtgtcccctcact

SEQ ID NO: 4835098 - DNA, 14 bp, Homo sapiens
gtgtcccgttgtgt

SEQ ID NO: 4835099 - DNA, 11 bp, Homo sapiens
gtgtcctctgt

SEQ ID NO: 4835100 - DNA, 13 bp, Homo sapiens
gtgtcctctgtcc

SEQ ID NO: 4835101 - DNA, 23 bp, Homo sapiens
gtgtcctctgtccgtctgtcctg

SEQ ID NO: 4835102 - DNA, 14 bp, Homo sapiens
gtgtcctgcatgta

SEQ ID NO: 4835103 - DNA, 20 bp, Homo sapiens
gtgtcctgtgctttctgcat

SEQ ID NO: 4835104 - DNA, 18 bp, Homo sapiens
gtgtcgtaacagcaggag

SEQ ID NO: 4835105 - DNA, 18 bp, Homo sapiens
gtgtctcatttgccagga

SEQ ID NO: 4835106 - DNA, 17 bp, Homo sapiens
gtgtctcccttcatcct

SEQ ID NO: 4835107 - DNA, 18 bp, Homo sapiens
gtgtctggcccagccatg

SEQ ID NO: 4835108 - DNA, 16 bp, Homo sapiens
gtgtgacaccaccact

SEQ ID NO: 4835109 - DNA, 21 bp, Homo sapiens
gtgtgacaccaccactgtgtc

SEQ ID NO: 4835110 - DNA, 18 bp, Homo sapiens
gtgtgagaaacttaaaga

SEQ ID NO: 4835111 - DNA, 20 bp, Homo sapiens
gtgtgagggcaaaccaggct

SEQ ID NO: 4835112 - DNA, 22 bp, Homo sapiens
gtgtgagtcacttctacgcata

SEQ ID NO: 4835113 - DNA, 17 bp, Homo sapiens
gtgtgctattcgtaagt

SEQ ID NO: 4835114 - DNA, 20 bp, Homo sapiens
gtgtggaaggcacccgccct

SEQ ID NO: 4835115 - DNA, 13 bp, Homo sapiens
gtgtggagtggag

SEQ ID NO: 4835116 - DNA, 23 bp, Homo sapiens
gtgtggccctgtgggagtccact

SEQ ID NO: 4835117 - DNA, 21 bp, Homo sapiens
gtgtggcctcagccctcagaa

SEQ ID NO: 4835118 - DNA, 15 bp, Homo sapiens
gtgtggcctggcttc

SEQ ID NO: 4835119 - DNA, 13 bp, Homo sapiens
gtgtggcctgggt

SEQ ID NO: 4835120 - DNA, 17 bp, Homo sapiens
gtgtggcctgggtcctc

SEQ ID NO: 4835121 - DNA, 18 bp, Homo sapiens
gtgtggcttaaacatttt

SEQ ID NO: 4835122 - DNA, 14 bp, Homo sapiens
gtgtggcttggaac

SEQ ID NO: 4835123 - DNA, 15 bp, Homo sapiens
gtgtggggagggtgg

SEQ ID NO: 4835124 - DNA, 16 bp, Homo sapiens
gtgtggggagggtggg

SEQ ID NO: 4835125 - DNA, 23 bp, Homo sapiens
gtgtgtatgtgtgtttctgtcct

SEQ ID NO: 4835126 - DNA, 13 bp, Homo sapiens
gtgtgtgcaatgt

SEQ ID NO: 4835127 - DNA, 16 bp, Homo sapiens
gtgtgtgcaatgttcc

SEQ ID NO: 4835128 - DNA, 20 bp, Homo sapiens
gtgtgtggaaggcacccgcc

SEQ ID NO: 4835129 - DNA, 23 bp, Homo sapiens
gtgtgtggaaggcacccgccctt

SEQ ID NO: 4835130 - DNA, 19 bp, Homo sapiens
gtgtgttgtgctttcaaga

SEQ ID NO: 4835131 - DNA, 13 bp, Homo sapiens
gtgttaatccaga

SEQ ID NO: 4835132 - DNA, 21 bp, Homo sapiens
gtgttagaaaaaactggaaac

SEQ ID NO: 4835133 - DNA, 12 bp, Homo sapiens
gtgttattatta

SEQ ID NO: 4835134 - DNA, 13 bp, Homo sapiens
gtgttcaaattct

SEQ ID NO: 4835135 - DNA, 16 bp, Homo sapiens
gtgttcaaattctgat

SEQ ID NO: 4835136 - DNA, 19 bp, Homo sapiens
gtgttctcaatgcttttct

SEQ ID NO: 4835137 - DNA, 12 bp, Homo sapiens
gtgttctgtggc

SEQ ID NO: 4835138 - DNA, 15 bp, Homo sapiens
gtgttcttgggggtg

SEQ ID NO: 4835139 - DNA, 21 bp, Homo sapiens
gtgttggctctgctggtcact

SEQ ID NO: 4835140 - DNA, 19 bp, Homo sapiens
gtgttgtccgtgtctgttg

SEQ ID NO: 4835141 - DNA, 16 bp, Homo sapiens
gtgtttatgtgctatt

SEQ ID NO: 4835142 - DNA, 20 bp, Homo sapiens
gtgtttcatgttctgtgtca

SEQ ID NO: 4835143 - DNA, 11 bp, Homo sapiens
gtgtttccagt

SEQ ID NO: 4835144 - DNA, 14 bp, Homo sapiens
gttaaaatggattt

SEQ ID NO: 4835145 - DNA, 21 bp, Homo sapiens
gttaaagaggcgtcttgtatt

SEQ ID NO: 4835146 - DNA, 16 bp, Homo sapiens
gttaaaggttactgtt

SEQ ID NO: 4835147 - DNA, 17 bp, Homo sapiens
gttaaaggttactgttt

SEQ ID NO: 4835148 - DNA, 21 bp, Homo sapiens
gttaaatgagcttaatgtctt

SEQ ID NO: 4835149 - DNA, 12 bp, Homo sapiens
gttaacagtaaa

SEQ ID NO: 4835150 - DNA, 21 bp, Homo sapiens
gttaacccagtgttcagcata

SEQ ID NO: 4835151 - DNA, 18 bp, Homo sapiens
gttaaccgggactacaga

SEQ ID NO: 4835152 - DNA, 18 bp, Homo sapiens
gttaagacaacaggcatt

SEQ ID NO: 4835153 - DNA, 11 bp, Homo sapiens
gttaagagaaa

SEQ ID NO: 4835154 - DNA, 14 bp, Homo sapiens
gttaatcttaatgt

SEQ ID NO: 4835155 - DNA, 12 bp, Homo sapiens
gttaatgaaaaa

SEQ ID NO: 4835156 - DNA, 21 bp, Homo sapiens
gttaatgaaaaatctgaattt

SEQ ID NO: 4835157 - DNA, 15 bp, Homo sapiens
gttaatgtgccaaaa

SEQ ID NO: 4835158 - DNA, 13 bp, Homo sapiens
gttaattaaacaa

SEQ ID NO: 4835159 - DNA, 20 bp, Homo sapiens
gttaattctcagaagtgaaa

SEQ ID NO: 4835160 - DNA, 15 bp, Homo sapiens
gttacagacaaagcg

SEQ ID NO: 4835161 - DNA, 19 bp, Homo sapiens
gttactgtgccatgtgttt

SEQ ID NO: 4835162 - DNA, 14 bp, Homo sapiens
gttacttacacacc

SEQ ID NO: 4835163 - DNA, 22 bp, Homo sapiens
gttagaattaggtaatggatat

SEQ ID NO: 4835164 - DNA, 16 bp, Homo sapiens
gttagcacagaggatg

SEQ ID NO: 4835165 - DNA, 23 bp, Homo sapiens
gttagcccggccaaggacactga

SEQ ID NO: 4835166 - DNA, 19 bp, Homo sapiens
gttaggattaggtttagaa

SEQ ID NO: 4835167 - DNA, 23 bp, Homo sapiens
gttagggaaatccaactccaggg

SEQ ID NO: 4835168 - DNA, 21 bp, Homo sapiens
gttaggggtgggggagaatgg

SEQ ID NO: 4835169 - DNA, 17 bp, Homo sapiens
gttagtaatctgtataa

SEQ ID NO: 4835170 - DNA, 19 bp, Homo sapiens
gttataataacctggttat

SEQ ID NO: 4835171 - DNA, 22 bp, Homo sapiens
gttatatgacttcttgttcatg

SEQ ID NO: 4835172 - DNA, 22 bp, Homo sapiens
gttatcagtacaattctttgtt

SEQ ID NO: 4835173 - DNA, 15 bp, Homo sapiens
gttatccactacagg

SEQ ID NO: 4835174 - DNA, 15 bp, Homo sapiens
gttatggtagaaaaa

SEQ ID NO: 4835175 - DNA, 16 bp, Homo sapiens
gttatggtagaaaaat

SEQ ID NO: 4835176 - DNA, 12 bp, Homo sapiens
gttatgttgtaa

SEQ ID NO: 4835177 - DNA, 22 bp, Homo sapiens
gttatgttgtaatattttgctg

SEQ ID NO: 4835178 - DNA, 17 bp, Homo sapiens
gttatttaccagaagtt

SEQ ID NO: 4835179 - DNA, 18 bp, Homo sapiens
gttattttgtacgtgtta

SEQ ID NO: 4835180 - DNA, 15 bp, Homo sapiens
gttattttgtgtcct

SEQ ID NO: 4835181 - DNA, 21 bp, Homo sapiens
gttcaaagaacccccctcccc

SEQ ID NO: 4835182 - DNA, 22 bp, Homo sapiens
gttcaatctgtgaagcctttat

SEQ ID NO: 4835183 - DNA, 21 bp, Homo sapiens
gttcaatgctacaaaatgtgt

SEQ ID NO: 4835184 - DNA, 24 bp, Homo sapiens
gttcaatgctacaaaatgtgtgct

SEQ ID NO: 4835185 - DNA, 14 bp, Homo sapiens
gttcaccttctgtg

SEQ ID NO: 4835186 - DNA, 16 bp, Homo sapiens
gttcacgcaacttgaa

SEQ ID NO: 4835187 - DNA, 20 bp, Homo sapiens
gttcacgtgactcctcaatt

SEQ ID NO: 4835188 - DNA, 17 bp, Homo sapiens
gttcagaaaagcacctc

SEQ ID NO: 4835189 - DNA, 22 bp, Homo sapiens
gttcagaaaagcacctcttgaa

SEQ ID NO: 4835190 - DNA, 14 bp, Homo sapiens
gttcatctgaggag

SEQ ID NO: 4835191 - DNA, 11 bp, Homo sapiens
gttcattcaca

SEQ ID NO: 4835192 - DNA, 17 bp, Homo sapiens
gttcattcatactcaaa

SEQ ID NO: 4835193 - DNA, 21 bp, Homo sapiens
gttccaagtgtgtgtgcaatg

SEQ ID NO: 4835194 - DNA, 14 bp, Homo sapiens
gttccacaattttg

SEQ ID NO: 4835195 - DNA, 16 bp, Homo sapiens
gttccacgtggggtgg

SEQ ID NO: 4835196 - DNA, 15 bp, Homo sapiens
gttccacttctctag

SEQ ID NO: 4835197 - DNA, 12 bp, Homo sapiens
gttccagacaga

SEQ ID NO: 4835198 - DNA, 15 bp, Homo sapiens
gttccagacagagtg

SEQ ID NO: 4835199 - DNA, 16 bp, Homo sapiens
gttccagacagggtgg

SEQ ID NO: 4835200 - DNA, 21 bp, Homo sapiens
gttccagacagggtggggctt

SEQ ID NO: 4835201 - DNA, 22 bp, Homo sapiens
gttcccagcgcatggcgccccg

SEQ ID NO: 4835202 - DNA, 19 bp, Homo sapiens
gttccctcagccctcatta

SEQ ID NO: 4835203 - DNA, 12 bp, Homo sapiens
gttccctgctgg

SEQ ID NO: 4835204 - DNA, 19 bp, Homo sapiens
gttcctaaagaaaaagata

SEQ ID NO: 4835205 - DNA, 14 bp, Homo sapiens
gttcctgactgttc

SEQ ID NO: 4835206 - DNA, 14 bp, Homo sapiens
gttcctttccctcc

SEQ ID NO: 4835207 - DNA, 17 bp, Homo sapiens
gttcggatcgctccgcc

SEQ ID NO: 4835208 - DNA, 19 bp, Homo sapiens
gttctatggaccaaatgta

SEQ ID NO: 4835209 - DNA, 22 bp, Homo sapiens
gttctatggaccaaatgtaaaa

SEQ ID NO: 4835210 - DNA, 18 bp, Homo sapiens
gttctcaacacacagtat

SEQ ID NO: 4835211 - DNA, 23 bp, Homo sapiens
gttctcaacacacagtatagata

SEQ ID NO: 4835212 - DNA, 13 bp, Homo sapiens
gttctcaatcatt

SEQ ID NO: 4835213 - DNA, 17 bp, Homo sapiens
gttctcaatgcttttct

SEQ ID NO: 4835214 - DNA, 12 bp, Homo sapiens
gttctcccatga

SEQ ID NO: 4835215 - DNA, 16 bp, Homo sapiens
gttctccttgtacttg

SEQ ID NO: 4835216 - DNA, 21 bp, Homo sapiens
gttctctcttggtctctttct

SEQ ID NO: 4835217 - DNA, 23 bp, Homo sapiens
gttctcttactgccgaaaccctt

SEQ ID NO: 4835218 - DNA, 15 bp, Homo sapiens
gttctgcaaatagaa

SEQ ID NO: 4835219 - DNA, 16 bp, Homo sapiens
gttctgcacatacaga

SEQ ID NO: 4835220 - DNA, 14 bp, Homo sapiens
gttctgcactgaaa

SEQ ID NO: 4835221 - DNA, 19 bp, Homo sapiens
gttctgtgcagtttggtat

SEQ ID NO: 4835222 - DNA, 15 bp, Homo sapiens
gttcttcctgtaatc

SEQ ID NO: 4835223 - DNA, 15 bp, Homo sapiens
gttcttgcaataaga

SEQ ID NO: 4835224 - DNA, 14 bp, Homo sapiens
gttcttggtgactg

SEQ ID NO: 4835225 - DNA, 18 bp, Homo sapiens
gttcttgtaaaactgtga

SEQ ID NO: 4835226 - DNA, 23 bp, Homo sapiens
gttctttgagggactgcctctgc

SEQ ID NO: 4835227 - DNA, 22 bp, Homo sapiens
gttctttttaaaaagttgcaca

SEQ ID NO: 4835228 - DNA, 21 bp, Homo sapiens
gttcttttttaagactcaatc

SEQ ID NO: 4835229 - DNA, 16 bp, Homo sapiens
gttgaagggaaatcaa

SEQ ID NO: 4835230 - DNA, 21 bp, Homo sapiens
gttgacacattgcacacacag

SEQ ID NO: 4835231 - DNA, 19 bp, Homo sapiens
gttgacctaccctggaccg

SEQ ID NO: 4835232 - DNA, 21 bp, Homo sapiens
gttgacctttatttattaaac

SEQ ID NO: 4835233 - DNA, 19 bp, Homo sapiens
gttgacttcaaatgtgtaa

SEQ ID NO: 4835234 - DNA, 15 bp, Homo sapiens
gttgagctatgatat

SEQ ID NO: 4835235 - DNA, 16 bp, Homo sapiens
gttgagctatgatatg

SEQ ID NO: 4835236 - DNA, 14 bp, Homo sapiens
gttgagtttgctgt

SEQ ID NO: 4835237 - DNA, 14 bp, Homo sapiens
gttgatgaccaatc

SEQ ID NO: 4835238 - DNA, 15 bp, Homo sapiens
gttgattctttcaat

SEQ ID NO: 4835239 - DNA, 23 bp, Homo sapiens
gttgcatgaatccatcgatttgt

SEQ ID NO: 4835240 - DNA, 21 bp, Homo sapiens
gttgccacattgcttcattaa

SEQ ID NO: 4835241 - DNA, 16 bp, Homo sapiens
gttgccattttgtctg

SEQ ID NO: 4835242 - DNA, 17 bp, Homo sapiens
gttgcttaatctagagc

SEQ ID NO: 4835243 - DNA, 14 bp, Homo sapiens
gttggaccccagag

SEQ ID NO: 4835244 - DNA, 15 bp, Homo sapiens
gttggagtgcagtgg

SEQ ID NO: 4835245 - DNA, 20 bp, Homo sapiens
gttggcagacaggatgttca

SEQ ID NO: 4835246 - DNA, 21 bp, Homo sapiens
gttggccggctggccggtcca

SEQ ID NO: 4835247 - DNA, 18 bp, Homo sapiens
gttggctagtctgtgcct

SEQ ID NO: 4835248 - DNA, 18 bp, Homo sapiens
gttggctgattggaaaat

SEQ ID NO: 4835249 - DNA, 12 bp, Homo sapiens
gttgtaaagata

SEQ ID NO: 4835250 - DNA, 17 bp, Homo sapiens
gttgtaaagatattgta

SEQ ID NO: 4835251 - DNA, 18 bp, Homo sapiens
gttgtacaattactgtga

SEQ ID NO: 4835252 - DNA, 23 bp, Homo sapiens
gttgtaggggaaatcaaggtgaa

SEQ ID NO: 4835253 - DNA, 20 bp, Homo sapiens
gttgtattcctgcctttgat

SEQ ID NO: 4835254 - DNA, 13 bp, Homo sapiens
gttgtccctgcag

SEQ ID NO: 4835255 - DNA, 18 bp, Homo sapiens
gttgtcctgtgtcatctg

SEQ ID NO: 4835256 - DNA, 13 bp, Homo sapiens
gttgtcctttctg

SEQ ID NO: 4835257 - DNA, 16 bp, Homo sapiens
gttgtcctttctgatc

SEQ ID NO: 4835258 - DNA, 13 bp, Homo sapiens
gttgtctctctaa

SEQ ID NO: 4835259 - DNA, 13 bp, Homo sapiens
gttgtgctgcctg

SEQ ID NO: 4835260 - DNA, 12 bp, Homo sapiens
gttgtgttacaa

SEQ ID NO: 4835261 - DNA, 16 bp, Homo sapiens
gttgttgtccctgcag

SEQ ID NO: 4835262 - DNA, 14 bp, Homo sapiens
gttgttttgtggat

SEQ ID NO: 4835263 - DNA, 20 bp, Homo sapiens
gtttaaaactagttagattc

SEQ ID NO: 4835264 - DNA, 13 bp, Homo sapiens
gtttaaaattatt

SEQ ID NO: 4835265 - DNA, 21 bp, Homo sapiens
gtttaaatctttgttaaaata

SEQ ID NO: 4835266 - DNA, 19 bp, Homo sapiens
gtttaagaaatgagaaatt

SEQ ID NO: 4835267 - DNA, 13 bp, Homo sapiens
gtttaagaatcat

SEQ ID NO: 4835268 - DNA, 13 bp, Homo sapiens
gtttaatgcaaat

SEQ ID NO: 4835269 - DNA, 20 bp, Homo sapiens
gtttaattgtataaaacagt

SEQ ID NO: 4835270 - DNA, 18 bp, Homo sapiens
gtttacaaccttgtgagc

SEQ ID NO: 4835271 - DNA, 22 bp, Homo sapiens
gtttacatagtctgaagtgaag

SEQ ID NO: 4835272 - DNA, 14 bp, Homo sapiens
gtttaccctccctg

SEQ ID NO: 4835273 - DNA, 15 bp, Homo sapiens
gtttaccctccctgt

SEQ ID NO: 4835274 - DNA, 22 bp, Homo sapiens
gtttaccgcccacccagcagcg

SEQ ID NO: 4835275 - DNA, 15 bp, Homo sapiens
gtttagaatgtcagt

SEQ ID NO: 4835276 - DNA, 20 bp, Homo sapiens
gtttagcgttgttttgtgga

SEQ ID NO: 4835277 - DNA, 15 bp, Homo sapiens
gtttataggaaataa

SEQ ID NO: 4835278 - DNA, 22 bp, Homo sapiens
gtttatggtattttcgtgcatt

SEQ ID NO: 4835279 - DNA, 23 bp, Homo sapiens
gtttatgtgctattaatatttgt

SEQ ID NO: 4835280 - DNA, 17 bp, Homo sapiens
gtttatttttctgttac

SEQ ID NO: 4835281 - DNA, 23 bp, Homo sapiens
gtttcagaaagggcagcccctcc

SEQ ID NO: 4835282 - DNA, 17 bp, Homo sapiens
gtttcagataaatcatg

SEQ ID NO: 4835283 - DNA, 18 bp, Homo sapiens
gtttcagataaatcatgg

SEQ ID NO: 4835284 - DNA, 20 bp, Homo sapiens
gtttcagtagctccttggtt

SEQ ID NO: 4835285 - DNA, 14 bp, Homo sapiens
gtttcatgttctgt

SEQ ID NO: 4835286 - DNA, 17 bp, Homo sapiens
gtttcatgttctgtgtc

SEQ ID NO: 4835287 - DNA, 14 bp, Homo sapiens
gtttccatagttta

SEQ ID NO: 4835288 - DNA, 19 bp, Homo sapiens
gtttccatcaaagccctcc

SEQ ID NO: 4835289 - DNA, 12 bp, Homo sapiens
gtttccatttgg

SEQ ID NO: 4835290 - DNA, 22 bp, Homo sapiens
gtttcgttaagcagtacatctt

SEQ ID NO: 4835291 - DNA, 15 bp, Homo sapiens
gtttctaaagctgcc

SEQ ID NO: 4835292 - DNA, 19 bp, Homo sapiens
gtttctcttaagctgccca

SEQ ID NO: 4835293 - DNA, 18 bp, Homo sapiens
gtttctgaatgacatcaa

SEQ ID NO: 4835294 - DNA, 15 bp, Homo sapiens
gtttctgcagtattc

SEQ ID NO: 4835295 - DNA, 15 bp, Homo sapiens
gtttctgccgcagcc

SEQ ID NO: 4835296 - DNA, 22 bp, Homo sapiens
gtttctgccgcagccctgcaga

SEQ ID NO: 4835297 - DNA, 15 bp, Homo sapiens
gtttctgtcctgtaa

SEQ ID NO: 4835298 - DNA, 19 bp, Homo sapiens
gtttctgtcctgtaactgt

SEQ ID NO: 4835299 - DNA, 14 bp, Homo sapiens
gtttctgtttgaat

SEQ ID NO: 4835300 - DNA, 18 bp, Homo sapiens
gtttcttgcaagctccag

SEQ ID NO: 4835301 - DNA, 19 bp, Homo sapiens
gtttcttgcaagctccagt

SEQ ID NO: 4835302 - DNA, 22 bp, Homo sapiens
gtttgaaacactcgtgtgcatg

SEQ ID NO: 4835303 - DNA, 18 bp, Homo sapiens
gtttgatgactaaaagtg

SEQ ID NO: 4835304 - DNA, 16 bp, Homo sapiens
gtttgcctccagaacc

SEQ ID NO: 4835305 - DNA, 22 bp, Homo sapiens
gtttgccttaattcttacctca

SEQ ID NO: 4835306 - DNA, 18 bp, Homo sapiens
gtttgcctttaggcagga

SEQ ID NO: 4835307 - DNA, 13 bp, Homo sapiens
gtttgctaagtga

SEQ ID NO: 4835308 - DNA, 19 bp, Homo sapiens
gtttgctgtatacaaacag

SEQ ID NO: 4835309 - DNA, 16 bp, Homo sapiens
gtttggcttcctcctg

SEQ ID NO: 4835310 - DNA, 18 bp, Homo sapiens
gtttgggaaaggcagggc

SEQ ID NO: 4835311 - DNA, 18 bp, Homo sapiens
gtttgtaagcaattctaa

SEQ ID NO: 4835312 - DNA, 19 bp, Homo sapiens
gtttgtcctttatgtattc

SEQ ID NO: 4835313 - DNA, 19 bp, Homo sapiens
gtttgttatcagtacaatt

SEQ ID NO: 4835314 - DNA, 22 bp, Homo sapiens
gtttgttgagctggtaacatcg

SEQ ID NO: 4835315 - DNA, 20 bp, Homo sapiens
gtttgtttgctgcttttgat

SEQ ID NO: 4835316 - DNA, 20 bp, Homo sapiens
gttttaaagaagtccatgtg

SEQ ID NO: 4835317 - DNA, 23 bp, Homo sapiens
gttttaaagggagccatgctctt

SEQ ID NO: 4835318 - DNA, 14 bp, Homo sapiens
gttttacaaagaaa

SEQ ID NO: 4835319 - DNA, 22 bp, Homo sapiens
gttttagaaattctataagaga

SEQ ID NO: 4835320 - DNA, 21 bp, Homo sapiens
gttttataaggtctgacatca

SEQ ID NO: 4835321 - DNA, 15 bp, Homo sapiens
gttttatatgattaa

SEQ ID NO: 4835322 - DNA, 12 bp, Homo sapiens
gttttcacacct

SEQ ID NO: 4835323 - DNA, 13 bp, Homo sapiens
gttttcacttcct

SEQ ID NO: 4835324 - DNA, 16 bp, Homo sapiens
gttttcatgtaaataa

SEQ ID NO: 4835325 - DNA, 20 bp, Homo sapiens
gttttccccaattatcctcc

SEQ ID NO: 4835326 - DNA, 20 bp, Homo sapiens
gttttctctttgtggggctt

SEQ ID NO: 4835327 - DNA, 12 bp, Homo sapiens
gttttcttccct

SEQ ID NO: 4835328 - DNA, 19 bp, Homo sapiens
gttttgaaattttctgtac

SEQ ID NO: 4835329 - DNA, 17 bp, Homo sapiens
gttttgacttgccactg

SEQ ID NO: 4835330 - DNA, 15 bp, Homo sapiens
gttttgatacttgta

SEQ ID NO: 4835331 - DNA, 18 bp, Homo sapiens
gttttgatacttgtaact

SEQ ID NO: 4835332 - DNA, 19 bp, Homo sapiens
gttttgatacttgtaactt

SEQ ID NO: 4835333 - DNA, 15 bp, Homo sapiens
gttttgcctctttaa

SEQ ID NO: 4835334 - DNA, 15 bp, Homo sapiens
gttttggaattcaat

SEQ ID NO: 4835335 - DNA, 15 bp, Homo sapiens
gttttggctgctctc

SEQ ID NO: 4835336 - DNA, 22 bp, Homo sapiens
gtttttaaaaaaaatattctgt

SEQ ID NO: 4835337 - DNA, 19 bp, Homo sapiens
gtttttaatctcttgtcat

SEQ ID NO: 4835338 - DNA, 20 bp, Homo sapiens
gtttttaatctttgtgacag

SEQ ID NO: 4835339 - DNA, 13 bp, Homo sapiens
gtttttgctggct

SEQ ID NO: 4835340 - DNA, 22 bp, Homo sapiens
gtttttgttcaccttctgtgca

SEQ ID NO: 4835341 - DNA, 17 bp, Homo sapiens
gttttttaataaaagtt

SEQ ID NO: 4835342 - DNA, 16 bp, Homo sapiens
gttttttaggaatcag

SEQ ID NO: 4835343 - DNA, 18 bp, Homo sapiens
gtttttttacaacattca

SEQ ID NO: 4835344 - DNA, 17 bp, Homo sapiens
taaaaaaaatattctgt

SEQ ID NO: 4835345 - DNA, 15 bp, Homo sapiens
taaaaaaataatata

SEQ ID NO: 4835346 - DNA, 12 bp, Homo sapiens
taaaaaagaaaa

SEQ ID NO: 4835347 - DNA, 14 bp, Homo sapiens
taaaaaatacagta

SEQ ID NO: 4835348 - DNA, 19 bp, Homo sapiens
taaaaaatatatgtaatat

SEQ ID NO: 4835349 - DNA, 19 bp, Homo sapiens
taaaaacatgtgaaagata

SEQ ID NO: 4835350 - DNA, 22 bp, Homo sapiens
taaaaacctcttagcttttctg

SEQ ID NO: 4835351 - DNA, 17 bp, Homo sapiens
taaaaagaccatgcatt

SEQ ID NO: 4835352 - DNA, 20 bp, Homo sapiens
taaaaagaccatgcattcag

SEQ ID NO: 4835353 - DNA, 18 bp, Homo sapiens
taaaaaggaatatgaaag

SEQ ID NO: 4835354 - DNA, 15 bp, Homo sapiens
taaaaagttgcacat

SEQ ID NO: 4835355 - DNA, 16 bp, Homo sapiens
taaaaatagctataaa

SEQ ID NO: 4835356 - DNA, 15 bp, Homo sapiens
taaaaatattctcca

SEQ ID NO: 4835357 - DNA, 18 bp, Homo sapiens
taaaaatccctcttcctc

SEQ ID NO: 4835358 - DNA, 23 bp, Homo sapiens
taaaaatccctcttcctccaaag

SEQ ID NO: 4835359 - DNA, 18 bp, Homo sapiens
taaaaattaattctttat

SEQ ID NO: 4835360 - DNA, 18 bp, Homo sapiens
taaaaattatctttaaaa

SEQ ID NO: 4835361 - DNA, 20 bp, Homo sapiens
taaaacaaaacaaacaacct

SEQ ID NO: 4835362 - DNA, 17 bp, Homo sapiens
taaaacaagagaccact

SEQ ID NO: 4835363 - DNA, 23 bp, Homo sapiens
taaaacaagagaccacttcctta

SEQ ID NO: 4835364 - DNA, 12 bp, Homo sapiens
taaaacaagctg

SEQ ID NO: 4835365 - DNA, 23 bp, Homo sapiens
taaaacacaacatctttttctac

SEQ ID NO: 4835366 - DNA, 12 bp, Homo sapiens
taaaaccaggct

SEQ ID NO: 4835367 - DNA, 18 bp, Homo sapiens
taaaaccttacttaaagc

SEQ ID NO: 4835368 - DNA, 15 bp, Homo sapiens
taaaactactgcctt

SEQ ID NO: 4835369 - DNA, 18 bp, Homo sapiens
taaaactcccttccttat

SEQ ID NO: 4835370 - DNA, 14 bp, Homo sapiens
taaaactgtgacat

SEQ ID NO: 4835371 - DNA, 22 bp, Homo sapiens
taaaactgtgacattccacaga

SEQ ID NO: 4835372 - DNA, 17 bp, Homo sapiens
taaaacttactatggta

SEQ ID NO: 4835373 - DNA, 23 bp, Homo sapiens
taaaagagaccacccatatcatg

SEQ ID NO: 4835374 - DNA, 12 bp, Homo sapiens
taaaagcatata

SEQ ID NO: 4835375 - DNA, 16 bp, Homo sapiens
taaaagcccatgctta

SEQ ID NO: 4835376 - DNA, 20 bp, Homo sapiens
taaaaggaggacagggaggg

SEQ ID NO: 4835377 - DNA, 12 bp, Homo sapiens
taaaataaatgt

SEQ ID NO: 4835378 - DNA, 20 bp, Homo sapiens
taaaataaatgttttggaat

SEQ ID NO: 4835379 - DNA, 18 bp, Homo sapiens
taaaataatgatttaagc

SEQ ID NO: 4835380 - DNA, 22 bp, Homo sapiens
taaaataatgatttaagcattt

SEQ ID NO: 4835381 - DNA, 17 bp, Homo sapiens
taaaataattatatgaa

SEQ ID NO: 4835382 - DNA, 20 bp, Homo sapiens
taaaataattatatgaagca

SEQ ID NO: 4835383 - DNA, 19 bp, Homo sapiens
taaaatactattggacaga

SEQ ID NO: 4835384 - DNA, 22 bp, Homo sapiens
taaaatactattggacagacac

SEQ ID NO: 4835385 - DNA, 13 bp, Homo sapiens
taaaatagttaca

SEQ ID NO: 4835386 - DNA, 16 bp, Homo sapiens
taaaatcacaaactca

SEQ ID NO: 4835387 - DNA, 21 bp, Homo sapiens
taaaatcacaaactcatccat

SEQ ID NO: 4835388 - DNA, 18 bp, Homo sapiens
taaaatccacccagccca

SEQ ID NO: 4835389 - DNA, 18 bp, Homo sapiens
taaaatctgtattgctaa

SEQ ID NO: 4835390 - DNA, 19 bp, Homo sapiens
taaaatgctgttctcaatc

SEQ ID NO: 4835391 - DNA, 23 bp, Homo sapiens
taaaatgctgttctcaatcattg

SEQ ID NO: 4835392 - DNA, 20 bp, Homo sapiens
taaaattagtgagatttgta

SEQ ID NO: 4835393 - DNA, 22 bp, Homo sapiens
taaaattagtgagatttgtatt

SEQ ID NO: 4835394 - DNA, 15 bp, Homo sapiens
taaaattatactgtg

SEQ ID NO: 4835395 - DNA, 17 bp, Homo sapiens
taaaattatctgttcta

SEQ ID NO: 4835396 - DNA, 14 bp, Homo sapiens
taaaattattaaaa

SEQ ID NO: 4835397 - DNA, 19 bp, Homo sapiens
taaaattattaaaaattat

SEQ ID NO: 4835398 - DNA, 22 bp, Homo sapiens
taaaattgcagcagttgctagc

SEQ ID NO: 4835399 - DNA, 19 bp, Homo sapiens
taaaattgtacatgaacat

SEQ ID NO: 4835400 - DNA, 22 bp, Homo sapiens
taaaatttgggacctgcttcat

SEQ ID NO: 4835401 - DNA, 18 bp, Homo sapiens
taaacaaaaactttccat

SEQ ID NO: 4835402 - DNA, 19 bp, Homo sapiens
taaacaaaaactttccatg

SEQ ID NO: 4835403 - DNA, 22 bp, Homo sapiens
taaacaaaaactttccatgaca

SEQ ID NO: 4835404 - DNA, 17 bp, Homo sapiens
taaacaaattccttccc

SEQ ID NO: 4835405 - DNA, 18 bp, Homo sapiens
taaacaatttattttatt

SEQ ID NO: 4835406 - DNA, 16 bp, Homo sapiens
taaacacagtaagata

SEQ ID NO: 4835407 - DNA, 13 bp, Homo sapiens
taaacacatagat

SEQ ID NO: 4835408 - DNA, 20 bp, Homo sapiens
taaacacatagattcacctg

SEQ ID NO: 4835409 - DNA, 13 bp, Homo sapiens
taaacatcataaa

SEQ ID NO: 4835410 - DNA, 17 bp, Homo sapiens
taaacatttccctgctg

SEQ ID NO: 4835411 - DNA, 14 bp, Homo sapiens
taaaccctccaagg

SEQ ID NO: 4835412 - DNA, 17 bp, Homo sapiens
taaacctatctgtattg

SEQ ID NO: 4835413 - DNA, 16 bp, Homo sapiens
taaacctgtgctttca

SEQ ID NO: 4835414 - DNA, 19 bp, Homo sapiens
taaacctgtgctttcatgt

SEQ ID NO: 4835415 - DNA, 20 bp, Homo sapiens
taaacctgtgctttcatgtt

SEQ ID NO: 4835416 - DNA, 12 bp, Homo sapiens
taaaccttaata

SEQ ID NO: 4835417 - DNA, 16 bp, Homo sapiens
taaactaccaccctcg

SEQ ID NO: 4835418 - DNA, 12 bp, Homo sapiens
taaactagcaaa

SEQ ID NO: 4835419 - DNA, 10 bp, Homo sapiens
taaactgtga

SEQ ID NO: 4835420 - DNA, 11 bp, Homo sapiens
taaactgtgag

SEQ ID NO: 4835421 - DNA, 14 bp, Homo sapiens
taaactgtgagata

SEQ ID NO: 4835422 - DNA, 17 bp, Homo sapiens
taaactgtgagataaat

SEQ ID NO: 4835423 - DNA, 19 bp, Homo sapiens
taaactgtgagataaatat

SEQ ID NO: 4835424 - DNA, 20 bp, Homo sapiens
taaactgtgagataaatatc

SEQ ID NO: 4835425 - DNA, 21 bp, Homo sapiens
taaactgttaacttattcaaa

SEQ ID NO: 4835426 - DNA, 22 bp, Homo sapiens
taaactgtttaacgtgaggttt

SEQ ID NO: 4835427 - DNA, 12 bp, Homo sapiens
taaacttcagca

SEQ ID NO: 4835428 - DNA, 13 bp, Homo sapiens
taaacttcagcaa

SEQ ID NO: 4835429 - DNA, 17 bp, Homo sapiens
taaacttcagcaaccct

SEQ ID NO: 4835430 - DNA, 16 bp, Homo sapiens
taaacttctactgagc

SEQ ID NO: 4835431 - DNA, 22 bp, Homo sapiens
taaacttggtgcttattgatat

SEQ ID NO: 4835432 - DNA, 13 bp, Homo sapiens
taaacttgtgtat

SEQ ID NO: 4835433 - DNA, 19 bp, Homo sapiens
taaactttgtcacttctgc

SEQ ID NO: 4835434 - DNA, 17 bp, Homo sapiens
taaagaaaggcagagat

SEQ ID NO: 4835435 - DNA, 22 bp, Homo sapiens
taaagacagaaaaaaataaaaa

SEQ ID NO: 4835436 - DNA, 19 bp, Homo sapiens
taaagaggcgtcttgtatt

SEQ ID NO: 4835437 - DNA, 22 bp, Homo sapiens
taaagaggcgtcttgtattttc

SEQ ID NO: 4835438 - DNA, 18 bp, Homo sapiens
taaagatattgtatctcc

SEQ ID NO: 4835439 - DNA, 19 bp, Homo sapiens
taaagcaagctcacttgct

SEQ ID NO: 4835440 - DNA, 21 bp, Homo sapiens
taaagctcacacttgggctgg

SEQ ID NO: 4835441 - DNA, 18 bp, Homo sapiens
taaaggaaagttctatta

SEQ ID NO: 4835442 - DNA, 14 bp, Homo sapiens
taaaggtctcccac

SEQ ID NO: 4835443 - DNA, 20 bp, Homo sapiens
taaaggtgatgaatttacca

SEQ ID NO: 4835444 - DNA, 21 bp, Homo sapiens
taaaggtgatgaatttaccat

SEQ ID NO: 4835445 - DNA, 21 bp, Homo sapiens
taaaggtttatttttctgtta

SEQ ID NO: 4835446 - DNA, 21 bp, Homo sapiens
taaaggtttcactgttcatga

SEQ ID NO: 4835447 - DNA, 14 bp, Homo sapiens
taaagtattccacc

SEQ ID NO: 4835448 - DNA, 20 bp, Homo sapiens
taaagtattccaccttaaat

SEQ ID NO: 4835449 - DNA, 15 bp, Homo sapiens
taaataaaaatagct

SEQ ID NO: 4835450 - DNA, 16 bp, Homo sapiens
taaataaaaatattct

SEQ ID NO: 4835451 - DNA, 13 bp, Homo sapiens
taaataaaaatta

SEQ ID NO: 4835452 - DNA, 14 bp, Homo sapiens
taaataaaaattat

SEQ ID NO: 4835453 - DNA, 17 bp, Homo sapiens
taaataaaaattatgtc

SEQ ID NO: 4835454 - DNA, 12 bp, Homo sapiens
taaataaataca

SEQ ID NO: 4835455 - DNA, 12 bp, Homo sapiens
taaataaatgct

SEQ ID NO: 4835456 - DNA, 13 bp, Homo sapiens
taaataaatgctg

SEQ ID NO: 4835457 - DNA, 12 bp, Homo sapiens
taaataactgtg

SEQ ID NO: 4835458 - DNA, 24 bp, Homo sapiens
taaataataaaggttctatgatat

SEQ ID NO: 4835459 - DNA, 15 bp, Homo sapiens
taaataatcatacac

SEQ ID NO: 4835460 - DNA, 15 bp, Homo sapiens
taaataatgattcaa

SEQ ID NO: 4835461 - DNA, 18 bp, Homo sapiens
taaataccagactgcagg

SEQ ID NO: 4835462 - DNA, 22 bp, Homo sapiens
taaatagatttttagattccta

SEQ ID NO: 4835463 - DNA, 12 bp, Homo sapiens
taaatagtaaat

SEQ ID NO: 4835464 - DNA, 22 bp, Homo sapiens
taaatatacactttacattctt

SEQ ID NO: 4835465 - DNA, 14 bp, Homo sapiens
taaatatatattta

SEQ ID NO: 4835466 - DNA, 16 bp, Homo sapiens
taaatatatatttatc

SEQ ID NO: 4835467 - DNA, 18 bp, Homo sapiens
taaatatatatttatcat

SEQ ID NO: 4835468 - DNA, 14 bp, Homo sapiens
taaatatatgtatg

SEQ ID NO: 4835469 - DNA, 19 bp, Homo sapiens
taaatatatgtatgtaaaa

SEQ ID NO: 4835470 - DNA, 20 bp, Homo sapiens
taaatatatgtatgtaaaaa

SEQ ID NO: 4835471 - DNA, 23 bp, Homo sapiens
taaatatctatttatctgtctga

SEQ ID NO: 4835472 - DNA, 16 bp, Homo sapiens
taaatcacagatttcc

SEQ ID NO: 4835473 - DNA, 12 bp, Homo sapiens
taaatcagtaat

SEQ ID NO: 4835474 - DNA, 15 bp, Homo sapiens
taaatcatgggcatt

SEQ ID NO: 4835475 - DNA, 17 bp, Homo sapiens
taaatcatgggcattgc

SEQ ID NO: 4835476 - DNA, 13 bp, Homo sapiens
taaatctaaatat

SEQ ID NO: 4835477 - DNA, 21 bp, Homo sapiens
taaatctaaattaacttctat

SEQ ID NO: 4835478 - DNA, 15 bp, Homo sapiens
taaatctacaaactt

SEQ ID NO: 4835479 - DNA, 20 bp, Homo sapiens
taaatctatctctatataaa

SEQ ID NO: 4835480 - DNA, 22 bp, Homo sapiens
taaatctcgcactacatctgat

SEQ ID NO: 4835481 - DNA, 16 bp, Homo sapiens
taaatctttgttaaaa

SEQ ID NO: 4835482 - DNA, 20 bp, Homo sapiens
taaatctttgttaaaatata

SEQ ID NO: 4835483 - DNA, 21 bp, Homo sapiens
taaatctttgttaaaatatag

SEQ ID NO: 4835484 - DNA, 24 bp, Homo sapiens
taaatctttgttaaaatatagtgt

SEQ ID NO: 4835485 - DNA, 12 bp, Homo sapiens
taaatgaaatac

SEQ ID NO: 4835486 - DNA, 15 bp, Homo sapiens
taaatgaaatacttg

SEQ ID NO: 4835487 - DNA, 22 bp, Homo sapiens
taaatgaaatacttgacaacat

SEQ ID NO: 4835488 - DNA, 15 bp, Homo sapiens
taaatgaagatgcat

SEQ ID NO: 4835489 - DNA, 15 bp, Homo sapiens
taaatgaatgaaata

SEQ ID NO: 4835490 - DNA, 15 bp, Homo sapiens
taaatgacttattga

SEQ ID NO: 4835491 - DNA, 19 bp, Homo sapiens
taaatgagcttaatgtctt

SEQ ID NO: 4835492 - DNA, 22 bp, Homo sapiens
taaatgataaggtttagaatga

SEQ ID NO: 4835493 - DNA, 20 bp, Homo sapiens
taaatgatttaaatttaagt

SEQ ID NO: 4835494 - DNA, 18 bp, Homo sapiens
taaatgcaaacactgtgt

SEQ ID NO: 4835495 - DNA, 14 bp, Homo sapiens
taaatgcctaataa

SEQ ID NO: 4835496 - DNA, 18 bp, Homo sapiens
taaatgctgctttgggga

SEQ ID NO: 4835497 - DNA, 20 bp, Homo sapiens
taaatggtgtcataactaga

SEQ ID NO: 4835498 - DNA, 13 bp, Homo sapiens
taaatgtactaca

SEQ ID NO: 4835499 - DNA, 14 bp, Homo sapiens
taaatgtactacat

SEQ ID NO: 4835500 - DNA, 16 bp, Homo sapiens
taaatgtactacattt

SEQ ID NO: 4835501 - DNA, 13 bp, Homo sapiens
taaatgtctataa

SEQ ID NO: 4835502 - DNA, 17 bp, Homo sapiens
taaatgtctataaatgg

SEQ ID NO: 4835503 - DNA, 17 bp, Homo sapiens
taaatgtcttcatgttg

SEQ ID NO: 4835504 - DNA, 22 bp, Homo sapiens
taaatgtcttcatgttgatgtg

SEQ ID NO: 4835505 - DNA, 12 bp, Homo sapiens
taaatgtgtaaa

SEQ ID NO: 4835506 - DNA, 15 bp, Homo sapiens
taaattaaacaattt

SEQ ID NO: 4835507 - DNA, 17 bp, Homo sapiens
taaattaacaaattcag

SEQ ID NO: 4835508 - DNA, 18 bp, Homo sapiens
taaattaacaaattcagt

SEQ ID NO: 4835509 - DNA, 15 bp, Homo sapiens
taaattaacttctat

SEQ ID NO: 4835510 - DNA, 13 bp, Homo sapiens
taaattacatgca

SEQ ID NO: 4835511 - DNA, 14 bp, Homo sapiens
taaattacatgcat

SEQ ID NO: 4835512 - DNA, 16 bp, Homo sapiens
taaattacatgcatga

SEQ ID NO: 4835513 - DNA, 16 bp, Homo sapiens
taaattactatagcaa

SEQ ID NO: 4835514 - DNA, 17 bp, Homo sapiens
taaattactatagcaaa

SEQ ID NO: 4835515 - DNA, 20 bp, Homo sapiens
taaattactatagcaaagta

SEQ ID NO: 4835516 - DNA, 23 bp, Homo sapiens
taaattactatagcaaagtagta

SEQ ID NO: 4835517 - DNA, 12 bp, Homo sapiens
taaattatcatt

SEQ ID NO: 4835518 - DNA, 21 bp, Homo sapiens
taaattatcattgtttgtcct

SEQ ID NO: 4835519 - DNA, 15 bp, Homo sapiens
taaattattacttta

SEQ ID NO: 4835520 - DNA, 19 bp, Homo sapiens
taaattattactttaaatt

SEQ ID NO: 4835521 - DNA, 23 bp, Homo sapiens
taaattattactttaaattatat

SEQ ID NO: 4835522 - DNA, 15 bp, Homo sapiens
taaattatttctaaa

SEQ ID NO: 4835523 - DNA, 16 bp, Homo sapiens
taaattcctcctgtct

SEQ ID NO: 4835524 - DNA, 21 bp, Homo sapiens
taaattcctcctgtctcctct

SEQ ID NO: 4835525 - DNA, 19 bp, Homo sapiens
taaattttggaagaattca

SEQ ID NO: 4835526 - DNA, 22 bp, Homo sapiens
taaattttggaagaattcatga

SEQ ID NO: 4835527 - DNA, 11 bp, Homo sapiens
taacaacaatt

SEQ ID NO: 4835528 - DNA, 12 bp, Homo sapiens
taacaatgcctt

SEQ ID NO: 4835529 - DNA, 19 bp, Homo sapiens
taacaatgccttgttgtat

SEQ ID NO: 4835530 - DNA, 14 bp, Homo sapiens
taacaattaattgt

SEQ ID NO: 4835531 - DNA, 18 bp, Homo sapiens
taacacctcttttccctt

SEQ ID NO: 4835532 - DNA, 22 bp, Homo sapiens
taacagctgtattatcttaaac

SEQ ID NO: 4835533 - DNA, 12 bp, Homo sapiens
taacagtaaata

SEQ ID NO: 4835534 - DNA, 13 bp, Homo sapiens
taacagtaactgc

SEQ ID NO: 4835535 - DNA, 16 bp, Homo sapiens
taacagtaactgccat

SEQ ID NO: 4835536 - DNA, 18 bp, Homo sapiens
taacataaacttgtactt

SEQ ID NO: 4835537 - DNA, 21 bp, Homo sapiens
taacataagctagaaaaatta

SEQ ID NO: 4835538 - DNA, 18 bp, Homo sapiens
taacatatcattcagaat

SEQ ID NO: 4835539 - DNA, 21 bp, Homo sapiens
taacatcactatccatgcacc

SEQ ID NO: 4835540 - DNA, 23 bp, Homo sapiens
taacattaagtattccttggccc

SEQ ID NO: 4835541 - DNA, 18 bp, Homo sapiens
taacattatattcccaaa

SEQ ID NO: 4835542 - DNA, 16 bp, Homo sapiens
taacattcttggtcac

SEQ ID NO: 4835543 - DNA, 19 bp, Homo sapiens
taacccagtgttcagcata

SEQ ID NO: 4835544 - DNA, 19 bp, Homo sapiens
taacctgggttgttgcaga

SEQ ID NO: 4835545 - DNA, 22 bp, Homo sapiens
taactacctttggcttaattcc

SEQ ID NO: 4835546 - DNA, 12 bp, Homo sapiens
taactagagcac

SEQ ID NO: 4835547 - DNA, 13 bp, Homo sapiens
taactagagcacg

SEQ ID NO: 4835548 - DNA, 18 bp, Homo sapiens
taactagagtatgtgtat

SEQ ID NO: 4835549 - DNA, 20 bp, Homo sapiens
taactagagtatgtgtatgt

SEQ ID NO: 4835550 - DNA, 21 bp, Homo sapiens
taactagagtatgtgtatgta

SEQ ID NO: 4835551 - DNA, 23 bp, Homo sapiens
taactatggtaaataactgtgac

SEQ ID NO: 4835552 - DNA, 16 bp, Homo sapiens
taactccgtttccaaa

SEQ ID NO: 4835553 - DNA, 15 bp, Homo sapiens
taactccttacagaa

SEQ ID NO: 4835554 - DNA, 20 bp, Homo sapiens
taactctgcatagacaaagg

SEQ ID NO: 4835555 - DNA, 22 bp, Homo sapiens
taactctgcatagacaaaggcc

SEQ ID NO: 4835556 - DNA, 14 bp, Homo sapiens
taactgaaaggttg

SEQ ID NO: 4835557 - DNA, 16 bp, Homo sapiens
taactgaggagctagt

SEQ ID NO: 4835558 - DNA, 19 bp, Homo sapiens
taactgatttccatccaaa

SEQ ID NO: 4835559 - DNA, 18 bp, Homo sapiens
taactgccattttttgtc

SEQ ID NO: 4835560 - DNA, 22 bp, Homo sapiens
taactgccattttttgtctgtg

SEQ ID NO: 4835561 - DNA, 17 bp, Homo sapiens
taactgtatatttgtat

SEQ ID NO: 4835562 - DNA, 19 bp, Homo sapiens
taactgttaacccagtgtt

SEQ ID NO: 4835563 - DNA, 20 bp, Homo sapiens
taactgttacagtaatgtca

SEQ ID NO: 4835564 - DNA, 18 bp, Homo sapiens
taacttattttgattgtt

SEQ ID NO: 4835565 - DNA, 16 bp, Homo sapiens
taacttcataagcaaa

SEQ ID NO: 4835566 - DNA, 14 bp, Homo sapiens
taacttgctgtgaa

SEQ ID NO: 4835567 - DNA, 13 bp, Homo sapiens
taacttggggaag

SEQ ID NO: 4835568 - DNA, 18 bp, Homo sapiens
taagaaatatctgtgaaa

SEQ ID NO: 4835569 - DNA, 17 bp, Homo sapiens
taagaaatgagaaattg

SEQ ID NO: 4835570 - DNA, 19 bp, Homo sapiens
taagaaccttttgagtgcc

SEQ ID NO: 4835571 - DNA, 19 bp, Homo sapiens
taagaatcatggatttatt

SEQ ID NO: 4835572 - DNA, 15 bp, Homo sapiens
taagacaaatgcagt

SEQ ID NO: 4835573 - DNA, 24 bp, Homo sapiens
taagacaaatgcagtgtatttaat

SEQ ID NO: 4835574 - DNA, 14 bp, Homo sapiens
taagacaacaggca

SEQ ID NO: 4835575 - DNA, 15 bp, Homo sapiens
taagacaacaggcat

SEQ ID NO: 4835576 - DNA, 16 bp, Homo sapiens
taagacaacaggcatt

SEQ ID NO: 4835577 - DNA, 14 bp, Homo sapiens
taagacagcatgtg

SEQ ID NO: 4835578 - DNA, 18 bp, Homo sapiens
taagagacaaagtttgga

SEQ ID NO: 4835579 - DNA, 14 bp, Homo sapiens
taagagattttatg

SEQ ID NO: 4835580 - DNA, 21 bp, Homo sapiens
taagagtaagcacctttagaa

SEQ ID NO: 4835581 - DNA, 18 bp, Homo sapiens
taagataattaaatgaaa

SEQ ID NO: 4835582 - DNA, 21 bp, Homo sapiens
taagataattaaatgaaatac

SEQ ID NO: 4835583 - DNA, 19 bp, Homo sapiens
taagattgttattaaatgt

SEQ ID NO: 4835584 - DNA, 14 bp, Homo sapiens
taagcaattctaag

SEQ ID NO: 4835585 - DNA, 18 bp, Homo sapiens
taagcaattctaagtgag

SEQ ID NO: 4835586 - DNA, 20 bp, Homo sapiens
taagcacaaccatgttcttg

SEQ ID NO: 4835587 - DNA, 16 bp, Homo sapiens
taagcacctttagaat

SEQ ID NO: 4835588 - DNA, 18 bp, Homo sapiens
taagcacctttagaatat

SEQ ID NO: 4835589 - DNA, 16 bp, Homo sapiens
taagcagtacatcttg

SEQ ID NO: 4835590 - DNA, 18 bp, Homo sapiens
taagcagtacatcttgtg

SEQ ID NO: 4835591 - DNA, 17 bp, Homo sapiens
taagccactggtatctg

SEQ ID NO: 4835592 - DNA, 15 bp, Homo sapiens
taagccatagcccca

SEQ ID NO: 4835593 - DNA, 17 bp, Homo sapiens
taagccatagccccagg

SEQ ID NO: 4835594 - DNA, 18 bp, Homo sapiens
taagccatagccccaggc

SEQ ID NO: 4835595 - DNA, 16 bp, Homo sapiens
taagctggagtgcagt

SEQ ID NO: 4835596 - DNA, 15 bp, Homo sapiens
taaggaaaagagaaa

SEQ ID NO: 4835597 - DNA, 21 bp, Homo sapiens
taaggaatgatattgctgaag

SEQ ID NO: 4835598 - DNA, 23 bp, Homo sapiens
taaggaccgtggccctgccctct

SEQ ID NO: 4835599 - DNA, 20 bp, Homo sapiens
taaggtacggtgagactctg

SEQ ID NO: 4835600 - DNA, 20 bp, Homo sapiens
taaggtgggtacgggagggt

SEQ ID NO: 4835601 - DNA, 19 bp, Homo sapiens
taagtaaatgtcttcatgt

SEQ ID NO: 4835602 - DNA, 20 bp, Homo sapiens
taagtaaatgtcttcatgtt

SEQ ID NO: 4835603 - DNA, 12 bp, Homo sapiens
taagtagatttc

SEQ ID NO: 4835604 - DNA, 13 bp, Homo sapiens
taagtatatctat

SEQ ID NO: 4835605 - DNA, 21 bp, Homo sapiens
taagtattccttggcccagca

SEQ ID NO: 4835606 - DNA, 20 bp, Homo sapiens
taagtatttcagatgcttta

SEQ ID NO: 4835607 - DNA, 18 bp, Homo sapiens
taagtcaaaataatctga

SEQ ID NO: 4835608 - DNA, 22 bp, Homo sapiens
taagtcaaaataatctgaaatg

SEQ ID NO: 4835609 - DNA, 23 bp, Homo sapiens
taagtcagaaactaaaacaaata

SEQ ID NO: 4835610 - DNA, 23 bp, Homo sapiens
taagtcctactttacatatgctt

SEQ ID NO: 4835611 - DNA, 23 bp, Homo sapiens
taagtgcttgaggccaaatgagt

SEQ ID NO: 4835612 - DNA, 17 bp, Homo sapiens
taagtggactgtatttc

SEQ ID NO: 4835613 - DNA, 22 bp, Homo sapiens
taagtgttgtacaattactgtg

SEQ ID NO: 4835614 - DNA, 23 bp, Homo sapiens
taagtgttgtacaattactgtga

SEQ ID NO: 4835615 - DNA, 15 bp, Homo sapiens
taagttctgtgcagt

SEQ ID NO: 4835616 - DNA, 15 bp, Homo sapiens
taagttgaagggaaa

SEQ ID NO: 4835617 - DNA, 15 bp, Homo sapiens
taagttgaatgataa

SEQ ID NO: 4835618 - DNA, 14 bp, Homo sapiens
taagttgtcttaca

SEQ ID NO: 4835619 - DNA, 19 bp, Homo sapiens
taagttttctcttttaagg

SEQ ID NO: 4835620 - DNA, 14 bp, Homo sapiens
taataaaatacata

SEQ ID NO: 4835621 - DNA, 13 bp, Homo sapiens
taataaactgttt

SEQ ID NO: 4835622 - DNA, 16 bp, Homo sapiens
taataaactgtttaac

SEQ ID NO: 4835623 - DNA, 14 bp, Homo sapiens
taataaaggttcta

SEQ ID NO: 4835624 - DNA, 15 bp, Homo sapiens
taataaagtattcca

SEQ ID NO: 4835625 - DNA, 18 bp, Homo sapiens
taataaagtattccacct

SEQ ID NO: 4835626 - DNA, 21 bp, Homo sapiens
taataaattgtttggcttcct

SEQ ID NO: 4835627 - DNA, 22 bp, Homo sapiens
taataactatggtaaataactg

SEQ ID NO: 4835628 - DNA, 14 bp, Homo sapiens
taataagtactttc

SEQ ID NO: 4835629 - DNA, 18 bp, Homo sapiens
taatacaccaaatagctt

SEQ ID NO: 4835630 - DNA, 20 bp, Homo sapiens
taatacaccaaatagctttt

SEQ ID NO: 4835631 - DNA, 20 bp, Homo sapiens
taatactttgtatacaagta

SEQ ID NO: 4835632 - DNA, 15 bp, Homo sapiens
taatagcctcacctt

SEQ ID NO: 4835633 - DNA, 13 bp, Homo sapiens
taataggtctgga

SEQ ID NO: 4835634 - DNA, 15 bp, Homo sapiens
taatataaaaacatt

SEQ ID NO: 4835635 - DNA, 20 bp, Homo sapiens
taatataaatcgtaacctat

SEQ ID NO: 4835636 - DNA, 12 bp, Homo sapiens
taatataaatga

SEQ ID NO: 4835637 - DNA, 15 bp, Homo sapiens
taatatactccttaa

SEQ ID NO: 4835638 - DNA, 23 bp, Homo sapiens
taatatactccttaaaaatgtat

SEQ ID NO: 4835639 - DNA, 19 bp, Homo sapiens
taatatagaaaaaaacatt

SEQ ID NO: 4835640 - DNA, 16 bp, Homo sapiens
taatatagggtttgtt

SEQ ID NO: 4835641 - DNA, 17 bp, Homo sapiens
taatatcactcattaat

SEQ ID NO: 4835642 - DNA, 16 bp, Homo sapiens
taatatcctgaataac

SEQ ID NO: 4835643 - DNA, 16 bp, Homo sapiens
taatatcttcatttct

SEQ ID NO: 4835644 - DNA, 16 bp, Homo sapiens
taatatcttgaagaat

SEQ ID NO: 4835645 - DNA, 17 bp, Homo sapiens
taatatcttgaagaata

SEQ ID NO: 4835646 - DNA, 22 bp, Homo sapiens
taatatcttgaagaatattgtt

SEQ ID NO: 4835647 - DNA, 15 bp, Homo sapiens
taatattaaattcct

SEQ ID NO: 4835648 - DNA, 19 bp, Homo sapiens
taatatttacaatgtatta

SEQ ID NO: 4835649 - DNA, 18 bp, Homo sapiens
taatcacactctcttctt

SEQ ID NO: 4835650 - DNA, 22 bp, Homo sapiens
taatcagaatggaagagagaaa

SEQ ID NO: 4835651 - DNA, 19 bp, Homo sapiens
taatcatttccagcaaaat

SEQ ID NO: 4835652 - DNA, 22 bp, Homo sapiens
taatcatttccagcaaaatata

SEQ ID NO: 4835653 - DNA, 13 bp, Homo sapiens
taatccaggcccc

SEQ ID NO: 4835654 - DNA, 16 bp, Homo sapiens
taatccatgtgctgct

SEQ ID NO: 4835655 - DNA, 16 bp, Homo sapiens
taatctagagctatgc

SEQ ID NO: 4835656 - DNA, 21 bp, Homo sapiens
taatctagagctatgcacacc

SEQ ID NO: 4835657 - DNA, 17 bp, Homo sapiens
taatctcatacctctga

SEQ ID NO: 4835658 - DNA, 19 bp, Homo sapiens
taatctcttgtcattctca

SEQ ID NO: 4835659 - DNA, 20 bp, Homo sapiens
taatctcttgtcattctcat

SEQ ID NO: 4835660 - DNA, 15 bp, Homo sapiens
taatctgaaatgaca

SEQ ID NO: 4835661 - DNA, 20 bp, Homo sapiens
taatctgtcgcatttcatca

SEQ ID NO: 4835662 - DNA, 21 bp, Homo sapiens
taatctgtcgcatttcatcaa

SEQ ID NO: 4835663 - DNA, 19 bp, Homo sapiens
taatctttcggtctcctta

SEQ ID NO: 4835664 - DNA, 15 bp, Homo sapiens
taatgaaaaatctga

SEQ ID NO: 4835665 - DNA, 18 bp, Homo sapiens
taatgaaaaatctgaatt

SEQ ID NO: 4835666 - DNA, 17 bp, Homo sapiens
taatgagatgtaataca

SEQ ID NO: 4835667 - DNA, 23 bp, Homo sapiens
taatgagccaataaagctcacac

SEQ ID NO: 4835668 - DNA, 14 bp, Homo sapiens
taatgatactgaat

SEQ ID NO: 4835669 - DNA, 19 bp, Homo sapiens
taatgatttaagcatttta

SEQ ID NO: 4835670 - DNA, 22 bp, Homo sapiens
taatgcttaacataaacttgta

SEQ ID NO: 4835671 - DNA, 22 bp, Homo sapiens
taatggattataatcagaatgg

SEQ ID NO: 4835672 - DNA, 22 bp, Homo sapiens
taatggctctgggctatatgcc

SEQ ID NO: 4835673 - DNA, 22 bp, Homo sapiens
taatgggctgcaaaatgaagac

SEQ ID NO: 4835674 - DNA, 19 bp, Homo sapiens
taatggtttttatttctcg

SEQ ID NO: 4835675 - DNA, 16 bp, Homo sapiens
taatgtagataaagca

SEQ ID NO: 4835676 - DNA, 16 bp, Homo sapiens
taatgtatcttattta

SEQ ID NO: 4835677 - DNA, 13 bp, Homo sapiens
taatgtcatctct

SEQ ID NO: 4835678 - DNA, 14 bp, Homo sapiens
taatgtctttgtgt

SEQ ID NO: 4835679 - DNA, 23 bp, Homo sapiens
taatgtgaaatgtaactgtccgt

SEQ ID NO: 4835680 - DNA, 12 bp, Homo sapiens
taatgtgccaaa

SEQ ID NO: 4835681 - DNA, 22 bp, Homo sapiens
taatgtgggaagaaacaaaccc

SEQ ID NO: 4835682 - DNA, 18 bp, Homo sapiens
taattaaaaagttaatct

SEQ ID NO: 4835683 - DNA, 21 bp, Homo sapiens
taattaaacaaattccttccc

SEQ ID NO: 4835684 - DNA, 14 bp, Homo sapiens
taattaaactgtta

SEQ ID NO: 4835685 - DNA, 15 bp, Homo sapiens
taattaaactgttaa

SEQ ID NO: 4835686 - DNA, 13 bp, Homo sapiens
taattaatttcag

SEQ ID NO: 4835687 - DNA, 17 bp, Homo sapiens
taattagatccattaat

SEQ ID NO: 4835688 - DNA, 20 bp, Homo sapiens
taattataagctatgtcact

SEQ ID NO: 4835689 - DNA, 15 bp, Homo sapiens
taattataatctctt

SEQ ID NO: 4835690 - DNA, 23 bp, Homo sapiens
taattatcctcaagttgtgtgct

SEQ ID NO: 4835691 - DNA, 12 bp, Homo sapiens
taattatggtac

SEQ ID NO: 4835692 - DNA, 18 bp, Homo sapiens
taattcctgtatgttatc

SEQ ID NO: 4835693 - DNA, 23 bp, Homo sapiens
taattgtataaaacagtgtttcc

SEQ ID NO: 4835694 - DNA, 16 bp, Homo sapiens
taattgtcatgacttt

SEQ ID NO: 4835695 - DNA, 18 bp, Homo sapiens
taatttaaatgatttaaa

SEQ ID NO: 4835696 - DNA, 22 bp, Homo sapiens
taatttagcagtccatttttga

SEQ ID NO: 4835697 - DNA, 21 bp, Homo sapiens
taatttatgaagatagtttat

SEQ ID NO: 4835698 - DNA, 14 bp, Homo sapiens
taatttattaaatt

SEQ ID NO: 4835699 - DNA, 16 bp, Homo sapiens
taatttattaaattta

SEQ ID NO: 4835700 - DNA, 20 bp, Homo sapiens
taatttattaaatttattaa

SEQ ID NO: 4835701 - DNA, 15 bp, Homo sapiens
taatttatttcatcc

SEQ ID NO: 4835702 - DNA, 12 bp, Homo sapiens
taatttcctgtg

SEQ ID NO: 4835703 - DNA, 14 bp, Homo sapiens
taatttcctgtgag

SEQ ID NO: 4835704 - DNA, 15 bp, Homo sapiens
taatttcctgtgagg

SEQ ID NO: 4835705 - DNA, 16 bp, Homo sapiens
taatttcctgtgagga

SEQ ID NO: 4835706 - DNA, 20 bp, Homo sapiens
taatttgccagacagagatc

SEQ ID NO: 4835707 - DNA, 15 bp, Homo sapiens
taatttgctctgtgg

SEQ ID NO: 4835708 - DNA, 13 bp, Homo sapiens
taatttgtgaaag

SEQ ID NO: 4835709 - DNA, 21 bp, Homo sapiens
taattttcttctcattcttct

SEQ ID NO: 4835710 - DNA, 19 bp, Homo sapiens
taattttgtagtagttgat

SEQ ID NO: 4835711 - DNA, 12 bp, Homo sapiens
taatttttatta

SEQ ID NO: 4835712 - DNA, 11 bp, Homo sapiens
taatttttcct

SEQ ID NO: 4835713 - DNA, 15 bp, Homo sapiens
tacaaacaggtgcta

SEQ ID NO: 4835714 - DNA, 16 bp, Homo sapiens
tacaaacttttataaa

SEQ ID NO: 4835715 - DNA, 18 bp, Homo sapiens
tacaaacttttataaatg

SEQ ID NO: 4835716 - DNA, 20 bp, Homo sapiens
tacaaacttttataaatgtt

SEQ ID NO: 4835717 - DNA, 21 bp, Homo sapiens
tacaaacttttataaatgttt

SEQ ID NO: 4835718 - DNA, 23 bp, Homo sapiens
tacaaagaaacaaaatataaatc

SEQ ID NO: 4835719 - DNA, 15 bp, Homo sapiens
tacaaatcagtaatt

SEQ ID NO: 4835720 - DNA, 19 bp, Homo sapiens
tacaaatttttactcaggc

SEQ ID NO: 4835721 - DNA, 19 bp, Homo sapiens
tacaacaagcaaactgaaa

SEQ ID NO: 4835722 - DNA, 22 bp, Homo sapiens
tacaacaagcaaactgaaatta

SEQ ID NO: 4835723 - DNA, 21 bp, Homo sapiens
tacaacacattgaaactgtat

SEQ ID NO: 4835724 - DNA, 18 bp, Homo sapiens
tacaacttccagatttga

SEQ ID NO: 4835725 - DNA, 17 bp, Homo sapiens
tacaagctacatatgta

SEQ ID NO: 4835726 - DNA, 16 bp, Homo sapiens
tacaagttatagtact

SEQ ID NO: 4835727 - DNA, 13 bp, Homo sapiens
tacaataagtgtt

SEQ ID NO: 4835728 - DNA, 14 bp, Homo sapiens
tacaatacaacaca

SEQ ID NO: 4835729 - DNA, 23 bp, Homo sapiens
tacaatacaacacattgaaactg

SEQ ID NO: 4835730 - DNA, 21 bp, Homo sapiens
tacaatatcattttcctggga

SEQ ID NO: 4835731 - DNA, 23 bp, Homo sapiens
tacaatcatgcctacattagtga

SEQ ID NO: 4835732 - DNA, 22 bp, Homo sapiens
tacaatggggacttcccgggaa

SEQ ID NO: 4835733 - DNA, 22 bp, Homo sapiens
tacaattactgtgagaactgtg

SEQ ID NO: 4835734 - DNA, 23 bp, Homo sapiens
tacaattactgtgagaactgtga

SEQ ID NO: 4835735 - DNA, 19 bp, Homo sapiens
tacaattctttgttgctta

SEQ ID NO: 4835736 - DNA, 23 bp, Homo sapiens
tacacaatggttttcttgtgtgt

SEQ ID NO: 4835737 - DNA, 15 bp, Homo sapiens
tacacacctgagaat

SEQ ID NO: 4835738 - DNA, 20 bp, Homo sapiens
tacacatataaacacagtaa

SEQ ID NO: 4835739 - DNA, 21 bp, Homo sapiens
tacacatataaacacagtaag

SEQ ID NO: 4835740 - DNA, 22 bp, Homo sapiens
tacaccactttcccacactgtg

SEQ ID NO: 4835741 - DNA, 23 bp, Homo sapiens
tacaccactttcccacactgtga

SEQ ID NO: 4835742 - DNA, 18 bp, Homo sapiens
tacacgtttcaacctctc

SEQ ID NO: 4835743 - DNA, 21 bp, Homo sapiens
tacactcgtccccctcctgcc

SEQ ID NO: 4835744 - DNA, 22 bp, Homo sapiens
tacactgtattacataaataaa

SEQ ID NO: 4835745 - DNA, 20 bp, Homo sapiens
tacacttctcaaatgctact

SEQ ID NO: 4835746 - DNA, 19 bp, Homo sapiens
tacagaaaaacaatggtaa

SEQ ID NO: 4835747 - DNA, 20 bp, Homo sapiens
tacagaaccagcactcccag

SEQ ID NO: 4835748 - DNA, 16 bp, Homo sapiens
tacagaagtggaagga

SEQ ID NO: 4835749 - DNA, 13 bp, Homo sapiens
tacagacctccag

SEQ ID NO: 4835750 - DNA, 21 bp, Homo sapiens
tacagagagacaacttgctcc

SEQ ID NO: 4835751 - DNA, 21 bp, Homo sapiens
tacagagcctgttttaaaaaa

SEQ ID NO: 4835752 - DNA, 21 bp, Homo sapiens
tacagatggtgtcctgcatgt

SEQ ID NO: 4835753 - DNA, 23 bp, Homo sapiens
tacagatggtgtcctgcatgtat

SEQ ID NO: 4835754 - DNA, 19 bp, Homo sapiens
tacagcctgcacacacctg

SEQ ID NO: 4835755 - DNA, 14 bp, Homo sapiens
tacagctaaggcct

SEQ ID NO: 4835756 - DNA, 18 bp, Homo sapiens
tacagctctcctccagcc

SEQ ID NO: 4835757 - DNA, 18 bp, Homo sapiens
tacaggatatcacctgaa

SEQ ID NO: 4835758 - DNA, 13 bp, Homo sapiens
tacaggtgtacta

SEQ ID NO: 4835759 - DNA, 18 bp, Homo sapiens
tacaggttttatgagact

SEQ ID NO: 4835760 - DNA, 17 bp, Homo sapiens
tacagtaatgtcataaa

SEQ ID NO: 4835761 - DNA, 20 bp, Homo sapiens
tacagtattatttagtaaaa

SEQ ID NO: 4835762 - DNA, 22 bp, Homo sapiens
tacagtattatttagtaaaatt

SEQ ID NO: 4835763 - DNA, 16 bp, Homo sapiens
tacagtttgtttacac

SEQ ID NO: 4835764 - DNA, 16 bp, Homo sapiens
tacataaaaggaaggt

SEQ ID NO: 4835765 - DNA, 16 bp, Homo sapiens
tacataaacaagtcct

SEQ ID NO: 4835766 - DNA, 16 bp, Homo sapiens
tacataacaggcattg

SEQ ID NO: 4835767 - DNA, 22 bp, Homo sapiens
tacataattgccaataatgtgt

SEQ ID NO: 4835768 - DNA, 19 bp, Homo sapiens
tacatactatagattcttt

SEQ ID NO: 4835769 - DNA, 14 bp, Homo sapiens
tacatatggaaatc

SEQ ID NO: 4835770 - DNA, 18 bp, Homo sapiens
tacatatggaaatcctgt

SEQ ID NO: 4835771 - DNA, 15 bp, Homo sapiens
tacatatgtatgtgt

SEQ ID NO: 4835772 - DNA, 17 bp, Homo sapiens
tacatatgtatgtgtga

SEQ ID NO: 4835773 - DNA, 13 bp, Homo sapiens
tacatattcaaag

SEQ ID NO: 4835774 - DNA, 13 bp, Homo sapiens
tacatcagagtgt

SEQ ID NO: 4835775 - DNA, 21 bp, Homo sapiens
tacatcagagtgtatttttgt

SEQ ID NO: 4835776 - DNA, 20 bp, Homo sapiens
tacatcctctgcttgtcatt

SEQ ID NO: 4835777 - DNA, 14 bp, Homo sapiens
tacatctgaaatct

SEQ ID NO: 4835778 - DNA, 18 bp, Homo sapiens
tacatctgatatcaggaa

SEQ ID NO: 4835779 - DNA, 20 bp, Homo sapiens
tacatctgatatcaggaaat

SEQ ID NO: 4835780 - DNA, 23 bp, Homo sapiens
tacatgcaaatctggcttagtaa

SEQ ID NO: 4835781 - DNA, 15 bp, Homo sapiens
tacatgcatgagcac

SEQ ID NO: 4835782 - DNA, 17 bp, Homo sapiens
tacatgcatgagcacct

SEQ ID NO: 4835783 - DNA, 13 bp, Homo sapiens
tacatggtatctc

SEQ ID NO: 4835784 - DNA, 23 bp, Homo sapiens
tacatgtatagtgagtgtggctt

SEQ ID NO: 4835785 - DNA, 21 bp, Homo sapiens
tacatgtggaaaactcacaga

SEQ ID NO: 4835786 - DNA, 21 bp, Homo sapiens
tacattagacacacatataca

SEQ ID NO: 4835787 - DNA, 20 bp, Homo sapiens
tacattattggacttccatt

SEQ ID NO: 4835788 - DNA, 14 bp, Homo sapiens
tacattatttctgt

SEQ ID NO: 4835789 - DNA, 16 bp, Homo sapiens
tacattatttctgtat

SEQ ID NO: 4835790 - DNA, 22 bp, Homo sapiens
tacattctgaaggccttgttaa

SEQ ID NO: 4835791 - DNA, 18 bp, Homo sapiens
tacattgtgccctgtagc

SEQ ID NO: 4835792 - DNA, 22 bp, Homo sapiens
tacattgtgccctgtagctcct

SEQ ID NO: 4835793 - DNA, 15 bp, Homo sapiens
tacatttatgtgtga

SEQ ID NO: 4835794 - DNA, 18 bp, Homo sapiens
tacatttgaacagggcaa

SEQ ID NO: 4835795 - DNA, 16 bp, Homo sapiens
taccaaatataaactt

SEQ ID NO: 4835796 - DNA, 12 bp, Homo sapiens
taccagcaaaag

SEQ ID NO: 4835797 - DNA, 20 bp, Homo sapiens
taccagccctggggctgggc

SEQ ID NO: 4835798 - DNA, 21 bp, Homo sapiens
taccagccctggggctgggcc

SEQ ID NO: 4835799 - DNA, 22 bp, Homo sapiens
taccagttcttgcaataagata

SEQ ID NO: 4835800 - DNA, 17 bp, Homo sapiens
taccatcggtcagcagg

SEQ ID NO: 4835801 - DNA, 12 bp, Homo sapiens
taccatttcaat

SEQ ID NO: 4835802 - DNA, 22 bp, Homo sapiens
tacccatcccatatgcctgggc

SEQ ID NO: 4835803 - DNA, 18 bp, Homo sapiens
tacccatcggtgtccatt

SEQ ID NO: 4835804 - DNA, 12 bp, Homo sapiens
taccccctgccc

SEQ ID NO: 4835805 - DNA, 18 bp, Homo sapiens
taccccgtccctttccct

SEQ ID NO: 4835806 - DNA, 23 bp, Homo sapiens
tacccggtggcttctggcacctg

SEQ ID NO: 4835807 - DNA, 20 bp, Homo sapiens
taccctaggtctccacccct

SEQ ID NO: 4835808 - DNA, 21 bp, Homo sapiens
taccctaggtctccacccctc

SEQ ID NO: 4835809 - DNA, 15 bp, Homo sapiens
taccctccctgtccc

SEQ ID NO: 4835810 - DNA, 19 bp, Homo sapiens
taccctccctgtcccctga

SEQ ID NO: 4835811 - DNA, 21 bp, Homo sapiens
taccctcttctcagctccact

SEQ ID NO: 4835812 - DNA, 18 bp, Homo sapiens
taccgaggagctaaacat

SEQ ID NO: 4835813 - DNA, 20 bp, Homo sapiens
taccgcccacccagcagcgc

SEQ ID NO: 4835814 - DNA, 22 bp, Homo sapiens
taccgcccacccagcagcgccc

SEQ ID NO: 4835815 - DNA, 16 bp, Homo sapiens
taccggagctccagtt

SEQ ID NO: 4835816 - DNA, 14 bp, Homo sapiens
tacctcatttgcat

SEQ ID NO: 4835817 - DNA, 23 bp, Homo sapiens
tacctcgagtggcgagtccagac

SEQ ID NO: 4835818 - DNA, 14 bp, Homo sapiens
tacctctctgtcat

SEQ ID NO: 4835819 - DNA, 13 bp, Homo sapiens
tacctgaagtctt

SEQ ID NO: 4835820 - DNA, 16 bp, Homo sapiens
tacctgaagtctttgt

SEQ ID NO: 4835821 - DNA, 13 bp, Homo sapiens
tacctgacacaag

SEQ ID NO: 4835822 - DNA, 23 bp, Homo sapiens
tacctgccaggaagccagcaggc

SEQ ID NO: 4835823 - DNA, 15 bp, Homo sapiens
tacctgcctgggaca

SEQ ID NO: 4835824 - DNA, 16 bp, Homo sapiens
tacctgccttgcctgt

SEQ ID NO: 4835825 - DNA, 15 bp, Homo sapiens
tacctggaatcaaat

SEQ ID NO: 4835826 - DNA, 20 bp, Homo sapiens
tacctggcttagcgttctgt

SEQ ID NO: 4835827 - DNA, 23 bp, Homo sapiens
tacctgtaatagcctcaccttcc

SEQ ID NO: 4835828 - DNA, 11 bp, Homo sapiens
tacctgtgagg

SEQ ID NO: 4835829 - DNA, 21 bp, Homo sapiens
taccttagctcccttgagctg

SEQ ID NO: 4835830 - DNA, 18 bp, Homo sapiens
taccttatagagcacaat

SEQ ID NO: 4835831 - DNA, 12 bp, Homo sapiens
taccttccagtc

SEQ ID NO: 4835832 - DNA, 20 bp, Homo sapiens
taccttctgatgaagttgta

SEQ ID NO: 4835833 - DNA, 22 bp, Homo sapiens
tacctttgtctcacgattccag

SEQ ID NO: 4835834 - DNA, 21 bp, Homo sapiens
tacgaaaagaggggaagagac

SEQ ID NO: 4835835 - DNA, 15 bp, Homo sapiens
tacgaaacacaaacc

SEQ ID NO: 4835836 - DNA, 16 bp, Homo sapiens
tacgaggcttctctaa

SEQ ID NO: 4835837 - DNA, 21 bp, Homo sapiens
tacggtacaagctacatatgt

SEQ ID NO: 4835838 - DNA, 22 bp, Homo sapiens
tacggtacaagctacatatgta

SEQ ID NO: 4835839 - DNA, 16 bp, Homo sapiens
tacgtgtcaatgtgtg

SEQ ID NO: 4835840 - DNA, 15 bp, Homo sapiens
tacgttaattaaaca

SEQ ID NO: 4835841 - DNA, 15 bp, Homo sapiens
tactacatttgcatg

SEQ ID NO: 4835842 - DNA, 17 bp, Homo sapiens
tactacatttgcatgcc

SEQ ID NO: 4835843 - DNA, 24 bp, Homo sapiens
tactagagatattttgtaaaatgt

SEQ ID NO: 4835844 - DNA, 16 bp, Homo sapiens
tactataatttacctg

SEQ ID NO: 4835845 - DNA, 16 bp, Homo sapiens
tactatggctgtattt

SEQ ID NO: 4835846 - DNA, 15 bp, Homo sapiens
tactcaggctttcta

SEQ ID NO: 4835847 - DNA, 20 bp, Homo sapiens
tactcatttggatataaatc

SEQ ID NO: 4835848 - DNA, 24 bp, Homo sapiens
tactcctccccctcctccatgctg

SEQ ID NO: 4835849 - DNA, 19 bp, Homo sapiens
tactctccaggattgtcca

SEQ ID NO: 4835850 - DNA, 15 bp, Homo sapiens
tactcttaaatatac

SEQ ID NO: 4835851 - DNA, 18 bp, Homo sapiens
tactgaaggtgccagacg

SEQ ID NO: 4835852 - DNA, 20 bp, Homo sapiens
tactgactccaaccattcaa

SEQ ID NO: 4835853 - DNA, 20 bp, Homo sapiens
tactgagatagcttagtgtc

SEQ ID NO: 4835854 - DNA, 21 bp, Homo sapiens
tactgatgagacaacacacac

SEQ ID NO: 4835855 - DNA, 15 bp, Homo sapiens
tactgcaatgtctgt

SEQ ID NO: 4835856 - DNA, 16 bp, Homo sapiens
tactggagaaaatgga

SEQ ID NO: 4835857 - DNA, 14 bp, Homo sapiens
tactgtaaagaatt

SEQ ID NO: 4835858 - DNA, 19 bp, Homo sapiens
tactgtacagattgctgct

SEQ ID NO: 4835859 - DNA, 16 bp, Homo sapiens
tactgtgagaactgtg

SEQ ID NO: 4835860 - DNA, 20 bp, Homo sapiens
tactgtgagaactgtgaata

SEQ ID NO: 4835861 - DNA, 22 bp, Homo sapiens
tactgtgagaactgtgaatatg

SEQ ID NO: 4835862 - DNA, 17 bp, Homo sapiens
tactgtgtgtgagtgtg

SEQ ID NO: 4835863 - DNA, 14 bp, Homo sapiens
tactgttttgtgcg

SEQ ID NO: 4835864 - DNA, 23 bp, Homo sapiens
tactgttttgtgcggtgtgtctc

SEQ ID NO: 4835865 - DNA, 18 bp, Homo sapiens
tacttaaaaatttattag

SEQ ID NO: 4835866 - DNA, 14 bp, Homo sapiens
tacttaaacaaaaa

SEQ ID NO: 4835867 - DNA, 19 bp, Homo sapiens
tacttaaacaaaaactttc

SEQ ID NO: 4835868 - DNA, 22 bp, Homo sapiens
tacttaaacaaaaactttccat

SEQ ID NO: 4835869 - DNA, 18 bp, Homo sapiens
tacttacactgaaatcca

SEQ ID NO: 4835870 - DNA, 22 bp, Homo sapiens
tacttacactgaaatccaaaat

SEQ ID NO: 4835871 - DNA, 17 bp, Homo sapiens
tacttatttataacatt

SEQ ID NO: 4835872 - DNA, 20 bp, Homo sapiens
tacttatttataacattgta

SEQ ID NO: 4835873 - DNA, 19 bp, Homo sapiens
tacttcagttctcatcttg

SEQ ID NO: 4835874 - DNA, 14 bp, Homo sapiens
tacttcttctgtaa

SEQ ID NO: 4835875 - DNA, 17 bp, Homo sapiens
tacttcttctgtaatat

SEQ ID NO: 4835876 - DNA, 15 bp, Homo sapiens
tactttacaatcatg

SEQ ID NO: 4835877 - DNA, 23 bp, Homo sapiens
tactttacatatgctttaagaat

SEQ ID NO: 4835878 - DNA, 22 bp, Homo sapiens
tactttacctctctgtcatgtg

SEQ ID NO: 4835879 - DNA, 12 bp, Homo sapiens
tactttgcattg

SEQ ID NO: 4835880 - DNA, 18 bp, Homo sapiens
tactttggtttctgagca

SEQ ID NO: 4835881 - DNA, 19 bp, Homo sapiens
tactttgtcttgatcctca

SEQ ID NO: 4835882 - DNA, 15 bp, Homo sapiens
tactttgtgtctttt

SEQ ID NO: 4835883 - DNA, 20 bp, Homo sapiens
tagaaaaaactggaaacatc

SEQ ID NO: 4835884 - DNA, 15 bp, Homo sapiens
tagaaaacaggaaaa

SEQ ID NO: 4835885 - DNA, 16 bp, Homo sapiens
tagaaacatgacactg

SEQ ID NO: 4835886 - DNA, 15 bp, Homo sapiens
tagaaactttggaag

SEQ ID NO: 4835887 - DNA, 15 bp, Homo sapiens
tagaaataaacctta

SEQ ID NO: 4835888 - DNA, 16 bp, Homo sapiens
tagaaattctataaga

SEQ ID NO: 4835889 - DNA, 23 bp, Homo sapiens
tagaaattttatctcttcttcct

SEQ ID NO: 4835890 - DNA, 22 bp, Homo sapiens
tagaagaaggactgaagaaaat

SEQ ID NO: 4835891 - DNA, 21 bp, Homo sapiens
tagaagccatcctaaggtgct

SEQ ID NO: 4835892 - DNA, 21 bp, Homo sapiens
tagaataatgtgggaagaaac

SEQ ID NO: 4835893 - DNA, 18 bp, Homo sapiens
tagaatactaataaaata

SEQ ID NO: 4835894 - DNA, 22 bp, Homo sapiens
tagaatactaataaaatacata

SEQ ID NO: 4835895 - DNA, 20 bp, Homo sapiens
tagaatattaaaaattaatt

SEQ ID NO: 4835896 - DNA, 21 bp, Homo sapiens
tagaatcttgttaatttcatt

SEQ ID NO: 4835897 - DNA, 13 bp, Homo sapiens
tagaatgagaaat

SEQ ID NO: 4835898 - DNA, 19 bp, Homo sapiens
tagaatgagaaatcatgtt

SEQ ID NO: 4835899 - DNA, 15 bp, Homo sapiens
tagaatgctgcgctt

SEQ ID NO: 4835900 - DNA, 14 bp, Homo sapiens
tagacaaaggcctt

SEQ ID NO: 4835901 - DNA, 18 bp, Homo sapiens
tagacaaaggccttaaca

SEQ ID NO: 4835902 - DNA, 12 bp, Homo sapiens
tagacaatgtgg

SEQ ID NO: 4835903 - DNA, 17 bp, Homo sapiens
tagacaatgtggaatta

SEQ ID NO: 4835904 - DNA, 20 bp, Homo sapiens
tagacaatgtggaattacat

SEQ ID NO: 4835905 - DNA, 16 bp, Homo sapiens
tagacacacatataca

SEQ ID NO: 4835906 - DNA, 19 bp, Homo sapiens
tagacacagtattgacttc

SEQ ID NO: 4835907 - DNA, 22 bp, Homo sapiens
tagacaggaaaagcatgtctta

SEQ ID NO: 4835908 - DNA, 20 bp, Homo sapiens
tagaccgtggtgtcctctgt

SEQ ID NO: 4835909 - DNA, 14 bp, Homo sapiens
tagactaagggcag

SEQ ID NO: 4835910 - DNA, 18 bp, Homo sapiens
tagactcaaagaagtact

SEQ ID NO: 4835911 - DNA, 20 bp, Homo sapiens
tagactcaaagaagtactgt

SEQ ID NO: 4835912 - DNA, 21 bp, Homo sapiens
tagagaaaaaaaaatatgtgt

SEQ ID NO: 4835913 - DNA, 16 bp, Homo sapiens
tagagatattttgtaa

SEQ ID NO: 4835914 - DNA, 21 bp, Homo sapiens
tagagatattttgtaaaatgt

SEQ ID NO: 4835915 - DNA, 15 bp, Homo sapiens
tagagattaatttgt

SEQ ID NO: 4835916 - DNA, 20 bp, Homo sapiens
tagagattaatttgtgtaga

SEQ ID NO: 4835917 - DNA, 17 bp, Homo sapiens
tagagctaccaattgtt

SEQ ID NO: 4835918 - DNA, 17 bp, Homo sapiens
tagagctatgcacacca

SEQ ID NO: 4835919 - DNA, 20 bp, Homo sapiens
tagaggggacaagccaggcc

SEQ ID NO: 4835920 - DNA, 21 bp, Homo sapiens
tagaggttcttgatttttaca

SEQ ID NO: 4835921 - DNA, 13 bp, Homo sapiens
tagagtatgtgta

SEQ ID NO: 4835922 - DNA, 16 bp, Homo sapiens
tagagtatgtgtatgt

SEQ ID NO: 4835923 - DNA, 16 bp, Homo sapiens
tagatatgagaaatat

SEQ ID NO: 4835924 - DNA, 16 bp, Homo sapiens
tagatgaggttgagct

SEQ ID NO: 4835925 - DNA, 16 bp, Homo sapiens
tagatgcctgaacttg

SEQ ID NO: 4835926 - DNA, 16 bp, Homo sapiens
tagatgtctgtgtata

SEQ ID NO: 4835927 - DNA, 17 bp, Homo sapiens
tagattaatggcactga

SEQ ID NO: 4835928 - DNA, 15 bp, Homo sapiens
tagattcacctgtaa

SEQ ID NO: 4835929 - DNA, 17 bp, Homo sapiens
tagattcacctgtaaaa

SEQ ID NO: 4835930 - DNA, 19 bp, Homo sapiens
tagattcctacttaaacaa

SEQ ID NO: 4835931 - DNA, 17 bp, Homo sapiens
tagattttcatgttctt

SEQ ID NO: 4835932 - DNA, 13 bp, Homo sapiens
tagatttttagat

SEQ ID NO: 4835933 - DNA, 19 bp, Homo sapiens
tagcaacaacttactaaat

SEQ ID NO: 4835934 - DNA, 18 bp, Homo sapiens
tagcaataagttgaatga

SEQ ID NO: 4835935 - DNA, 22 bp, Homo sapiens
tagcaataagttgaatgataat

SEQ ID NO: 4835936 - DNA, 12 bp, Homo sapiens
tagcacagtatt

SEQ ID NO: 4835937 - DNA, 18 bp, Homo sapiens
tagcacagtatttaacat

SEQ ID NO: 4835938 - DNA, 19 bp, Homo sapiens
tagcacagtatttaacatt

SEQ ID NO: 4835939 - DNA, 11 bp, Homo sapiens
tagcaccagct

SEQ ID NO: 4835940 - DNA, 15 bp, Homo sapiens
tagcaccatcaccct

SEQ ID NO: 4835941 - DNA, 20 bp, Homo sapiens
tagcactggtttgtttctca

SEQ ID NO: 4835942 - DNA, 21 bp, Homo sapiens
tagcactggtttgtttctcaa

SEQ ID NO: 4835943 - DNA, 15 bp, Homo sapiens
tagcagagtcattgt

SEQ ID NO: 4835944 - DNA, 13 bp, Homo sapiens
tagcaggaaatag

SEQ ID NO: 4835945 - DNA, 13 bp, Homo sapiens
tagcatataaatg

SEQ ID NO: 4835946 - DNA, 15 bp, Homo sapiens
tagcatataaatgtt

SEQ ID NO: 4835947 - DNA, 20 bp, Homo sapiens
tagcatataaatgtttatat

SEQ ID NO: 4835948 - DNA, 21 bp, Homo sapiens
tagcatataaatgtttatatt

SEQ ID NO: 4835949 - DNA, 20 bp, Homo sapiens
tagcatctgctcttctctta

SEQ ID NO: 4835950 - DNA, 14 bp, Homo sapiens
tagcatgagttctg

SEQ ID NO: 4835951 - DNA, 15 bp, Homo sapiens
tagcatgagttctgc

SEQ ID NO: 4835952 - DNA, 17 bp, Homo sapiens
tagcatgtaatattaaa

SEQ ID NO: 4835953 - DNA, 22 bp, Homo sapiens
tagcatgtaatattaaattcct

SEQ ID NO: 4835954 - DNA, 15 bp, Homo sapiens
tagcattgaaataat

SEQ ID NO: 4835955 - DNA, 14 bp, Homo sapiens
tagccaaccaggct

SEQ ID NO: 4835956 - DNA, 17 bp, Homo sapiens
tagccaacttaaacctg

SEQ ID NO: 4835957 - DNA, 17 bp, Homo sapiens
tagccaggcctcccgca

SEQ ID NO: 4835958 - DNA, 15 bp, Homo sapiens
tagcccaccctgctg

SEQ ID NO: 4835959 - DNA, 20 bp, Homo sapiens
tagccccaggcccgccctgc

SEQ ID NO: 4835960 - DNA, 21 bp, Homo sapiens
tagccccaggcccgccctgcc

SEQ ID NO: 4835961 - DNA, 23 bp, Homo sapiens
tagcccggccaaggacactgatg

SEQ ID NO: 4835962 - DNA, 16 bp, Homo sapiens
tagccctctttctctc

SEQ ID NO: 4835963 - DNA, 17 bp, Homo sapiens
tagccgggccccatggt

SEQ ID NO: 4835964 - DNA, 12 bp, Homo sapiens
tagcctggtctg

SEQ ID NO: 4835965 - DNA, 18 bp, Homo sapiens
tagcctggtctgtgcatt

SEQ ID NO: 4835966 - DNA, 19 bp, Homo sapiens
tagcgttgttttgtggata

SEQ ID NO: 4835967 - DNA, 17 bp, Homo sapiens
tagctagtttaaaatta

SEQ ID NO: 4835968 - DNA, 19 bp, Homo sapiens
tagctagtttaaaattatt

SEQ ID NO: 4835969 - DNA, 22 bp, Homo sapiens
tagctagtttaaaattattaaa

SEQ ID NO: 4835970 - DNA, 16 bp, Homo sapiens
tagctatgctgtatct

SEQ ID NO: 4835971 - DNA, 21 bp, Homo sapiens
tagctatgctgtatctgtgct

SEQ ID NO: 4835972 - DNA, 15 bp, Homo sapiens
tagctattactggat

SEQ ID NO: 4835973 - DNA, 18 bp, Homo sapiens
tagctcagaggagaggag

SEQ ID NO: 4835974 - DNA, 15 bp, Homo sapiens
tagctcccttgagct

SEQ ID NO: 4835975 - DNA, 19 bp, Homo sapiens
tagctgaaacctaaggcaa

SEQ ID NO: 4835976 - DNA, 16 bp, Homo sapiens
tagcttaatgacttac

SEQ ID NO: 4835977 - DNA, 16 bp, Homo sapiens
tagcttacctgacaca

SEQ ID NO: 4835978 - DNA, 19 bp, Homo sapiens
tagctttagagaagccata

SEQ ID NO: 4835979 - DNA, 19 bp, Homo sapiens
taggaaagcctcactgata

SEQ ID NO: 4835980 - DNA, 21 bp, Homo sapiens
taggaaagcctcactgatata

SEQ ID NO: 4835981 - DNA, 15 bp, Homo sapiens
taggaaataaatcta

SEQ ID NO: 4835982 - DNA, 17 bp, Homo sapiens
taggaaataaatctaaa

SEQ ID NO: 4835983 - DNA, 17 bp, Homo sapiens
taggaaattgaacctgg

SEQ ID NO: 4835984 - DNA, 14 bp, Homo sapiens
taggaatgctcaat

SEQ ID NO: 4835985 - DNA, 17 bp, Homo sapiens
taggacatctctgtaaa

SEQ ID NO: 4835986 - DNA, 18 bp, Homo sapiens
taggacatctctgtaaaa

SEQ ID NO: 4835987 - DNA, 15 bp, Homo sapiens
taggagcttccagat

SEQ ID NO: 4835988 - DNA, 16 bp, Homo sapiens
taggagggaaaccttt

SEQ ID NO: 4835989 - DNA, 18 bp, Homo sapiens
taggatcttcactgtctt

SEQ ID NO: 4835990 - DNA, 12 bp, Homo sapiens
taggcaggaagt

SEQ ID NO: 4835991 - DNA, 14 bp, Homo sapiens
taggcaggaagtca

SEQ ID NO: 4835992 - DNA, 22 bp, Homo sapiens
taggcaggaagtcaggagccag

SEQ ID NO: 4835993 - DNA, 23 bp, Homo sapiens
taggcaggaagtcaggagccagc

SEQ ID NO: 4835994 - DNA, 17 bp, Homo sapiens
taggcatactctccagg

SEQ ID NO: 4835995 - DNA, 18 bp, Homo sapiens
taggcatactctccagga

SEQ ID NO: 4835996 - DNA, 14 bp, Homo sapiens
taggctaagaaaga

SEQ ID NO: 4835997 - DNA, 20 bp, Homo sapiens
taggcttctatgtccaacag

SEQ ID NO: 4835998 - DNA, 20 bp, Homo sapiens
tagggaagaaaactatcctg

SEQ ID NO: 4835999 - DNA, 18 bp, Homo sapiens
tagggcaaagaatcaaca

SEQ ID NO: 4836000 - DNA, 20 bp, Homo sapiens
tagggccctgacaggccttc

SEQ ID NO: 4836001 - DNA, 17 bp, Homo sapiens
tagggctctaatttcct

SEQ ID NO: 4836002 - DNA, 17 bp, Homo sapiens
taggggcaaaaatttga

SEQ ID NO: 4836003 - DNA, 14 bp, Homo sapiens
taggggtgggggag

SEQ ID NO: 4836004 - DNA, 20 bp, Homo sapiens
taggggtgggggagaatggc

SEQ ID NO: 4836005 - DNA, 19 bp, Homo sapiens
tagggtaagtgagagaggg

SEQ ID NO: 4836006 - DNA, 20 bp, Homo sapiens
tagggttctatatttactgt

SEQ ID NO: 4836007 - DNA, 16 bp, Homo sapiens
tagggtttagccgggc

SEQ ID NO: 4836008 - DNA, 15 bp, Homo sapiens
taggtcaatgaaata

SEQ ID NO: 4836009 - DNA, 16 bp, Homo sapiens
taggtcaatgaaatat

SEQ ID NO: 4836010 - DNA, 15 bp, Homo sapiens
taggtctccacccct

SEQ ID NO: 4836011 - DNA, 20 bp, Homo sapiens
taggtctccacccctcaagc

SEQ ID NO: 4836012 - DNA, 15 bp, Homo sapiens
taggtctgcacacat

SEQ ID NO: 4836013 - DNA, 21 bp, Homo sapiens
taggtctgttgaagtgcatgt

SEQ ID NO: 4836014 - DNA, 23 bp, Homo sapiens
taggtgcccagtcttgagtgggc

SEQ ID NO: 4836015 - DNA, 18 bp, Homo sapiens
taggtttctaaaaagtca

SEQ ID NO: 4836016 - DNA, 21 bp, Homo sapiens
tagtaaataatgattcaatgt

SEQ ID NO: 4836017 - DNA, 13 bp, Homo sapiens
tagtaatctgtat

SEQ ID NO: 4836018 - DNA, 22 bp, Homo sapiens
tagtagcagagtcattgttaca

SEQ ID NO: 4836019 - DNA, 18 bp, Homo sapiens
tagtagctgataaagaaa

SEQ ID NO: 4836020 - DNA, 18 bp, Homo sapiens
tagtagtacttaatagta

SEQ ID NO: 4836021 - DNA, 22 bp, Homo sapiens
tagtagttgatgaccaatctct

SEQ ID NO: 4836022 - DNA, 22 bp, Homo sapiens
tagtatcactgctttttcctta

SEQ ID NO: 4836023 - DNA, 17 bp, Homo sapiens
tagtcaatcaaacaggg

SEQ ID NO: 4836024 - DNA, 21 bp, Homo sapiens
tagtcagcgcaggaatgcaca

SEQ ID NO: 4836025 - DNA, 16 bp, Homo sapiens
tagtcttgttgttcat

SEQ ID NO: 4836026 - DNA, 19 bp, Homo sapiens
tagtctttagctattactg

SEQ ID NO: 4836027 - DNA, 19 bp, Homo sapiens
tagtgaaaattttattgaa

SEQ ID NO: 4836028 - DNA, 15 bp, Homo sapiens
tagtgagatttgtat

SEQ ID NO: 4836029 - DNA, 20 bp, Homo sapiens
tagtgagatttgtatttata

SEQ ID NO: 4836030 - DNA, 23 bp, Homo sapiens
tagtgagtgtggcttagtaatag

SEQ ID NO: 4836031 - DNA, 19 bp, Homo sapiens
tagtgccaaaaggcccctt

SEQ ID NO: 4836032 - DNA, 20 bp, Homo sapiens
tagtgccaaaaggccccttc

SEQ ID NO: 4836033 - DNA, 21 bp, Homo sapiens
tagtgccaaaaggccccttcc

SEQ ID NO: 4836034 - DNA, 15 bp, Homo sapiens
tagtgccatggccag

SEQ ID NO: 4836035 - DNA, 15 bp, Homo sapiens
tagtgctaaacctat

SEQ ID NO: 4836036 - DNA, 22 bp, Homo sapiens
tagtgctaaacctatctgtatt

SEQ ID NO: 4836037 - DNA, 20 bp, Homo sapiens
tagtgtcccttacctggctt

SEQ ID NO: 4836038 - DNA, 13 bp, Homo sapiens
tagtgtgtccatg

SEQ ID NO: 4836039 - DNA, 14 bp, Homo sapiens
tagtgttattgcca

SEQ ID NO: 4836040 - DNA, 13 bp, Homo sapiens
tagtgttgaggag

SEQ ID NO: 4836041 - DNA, 17 bp, Homo sapiens
tagtgttgggtggagga

SEQ ID NO: 4836042 - DNA, 16 bp, Homo sapiens
tagtgttttcattctg

SEQ ID NO: 4836043 - DNA, 15 bp, Homo sapiens
tagttagcaggaaat

SEQ ID NO: 4836044 - DNA, 20 bp, Homo sapiens
tagttaggtgtgccaaacta

SEQ ID NO: 4836045 - DNA, 14 bp, Homo sapiens
tagttcagcaaaac

SEQ ID NO: 4836046 - DNA, 18 bp, Homo sapiens
tagttccattctatgact

SEQ ID NO: 4836047 - DNA, 23 bp, Homo sapiens
tagttctgcaataacagttttaa

SEQ ID NO: 4836048 - DNA, 20 bp, Homo sapiens
tagttgacttcaaatgtgta

SEQ ID NO: 4836049 - DNA, 15 bp, Homo sapiens
tagttgcaaagcatt

SEQ ID NO: 4836050 - DNA, 13 bp, Homo sapiens
tagttgtaaagat

SEQ ID NO: 4836051 - DNA, 15 bp, Homo sapiens
tagtttggcatttca

SEQ ID NO: 4836052 - DNA, 17 bp, Homo sapiens
tagttttcacattctta

SEQ ID NO: 4836053 - DNA, 22 bp, Homo sapiens
tataaaaaagaaaacttgtgtt

SEQ ID NO: 4836054 - DNA, 17 bp, Homo sapiens
tataaaaaatatatgta

SEQ ID NO: 4836055 - DNA, 20 bp, Homo sapiens
tataaaaaatatatgtaata

SEQ ID NO: 4836056 - DNA, 20 bp, Homo sapiens
tataaaaataattaaaacaa

SEQ ID NO: 4836057 - DNA, 20 bp, Homo sapiens
tataaaacagtgtttccagt

SEQ ID NO: 4836058 - DNA, 12 bp, Homo sapiens
tataaaagccca

SEQ ID NO: 4836059 - DNA, 19 bp, Homo sapiens
tataaaagcccatgcttaa

SEQ ID NO: 4836060 - DNA, 20 bp, Homo sapiens
tataaacacagtaagatagg

SEQ ID NO: 4836061 - DNA, 11 bp, Homo sapiens
tataaactgtg

SEQ ID NO: 4836062 - DNA, 12 bp, Homo sapiens
tataaatatcta

SEQ ID NO: 4836063 - DNA, 22 bp, Homo sapiens
tataaatgaatgaaatataaac

SEQ ID NO: 4836064 - DNA, 22 bp, Homo sapiens
tataaatggacttgcttcttgt

SEQ ID NO: 4836065 - DNA, 12 bp, Homo sapiens
tataaatgtgaa

SEQ ID NO: 4836066 - DNA, 16 bp, Homo sapiens
tataaatgtgtgtatg

SEQ ID NO: 4836067 - DNA, 20 bp, Homo sapiens
tataaatgtttatattgttt

SEQ ID NO: 4836068 - DNA, 23 bp, Homo sapiens
tataaattacatgcatgagcacc

SEQ ID NO: 4836069 - DNA, 19 bp, Homo sapiens
tataacattgtaaatgata

SEQ ID NO: 4836070 - DNA, 16 bp, Homo sapiens
tataagaaaaatgtga

SEQ ID NO: 4836071 - DNA, 12 bp, Homo sapiens
tataagagggaa

SEQ ID NO: 4836072 - DNA, 15 bp, Homo sapiens
tataagccaatgaag

SEQ ID NO: 4836073 - DNA, 18 bp, Homo sapiens
tataaggtaataaaactc

SEQ ID NO: 4836074 - DNA, 14 bp, Homo sapiens
tataagttgacctt

SEQ ID NO: 4836075 - DNA, 19 bp, Homo sapiens
tataatactttgtatacaa

SEQ ID NO: 4836076 - DNA, 21 bp, Homo sapiens
tataatctcttcttatacaga

SEQ ID NO: 4836077 - DNA, 18 bp, Homo sapiens
tataatggcctcttaaaa

SEQ ID NO: 4836078 - DNA, 15 bp, Homo sapiens
tataattcaccttct

SEQ ID NO: 4836079 - DNA, 22 bp, Homo sapiens
tataattgtcatgactttcaga

SEQ ID NO: 4836080 - DNA, 19 bp, Homo sapiens
tataattttaaaattgcag

SEQ ID NO: 4836081 - DNA, 19 bp, Homo sapiens
tataattttattgctggaa

SEQ ID NO: 4836082 - DNA, 14 bp, Homo sapiens
tatacaaagctgtc

SEQ ID NO: 4836083 - DNA, 19 bp, Homo sapiens
tatacaaagctgtcactca

SEQ ID NO: 4836084 - DNA, 21 bp, Homo sapiens
tatacaactttggaatttgaa

SEQ ID NO: 4836085 - DNA, 22 bp, Homo sapiens
tatacaactttggaatttgaag

SEQ ID NO: 4836086 - DNA, 13 bp, Homo sapiens
tatacaagtactg

SEQ ID NO: 4836087 - DNA, 23 bp, Homo sapiens
tatacaagtactggtaagattgt

SEQ ID NO: 4836088 - DNA, 22 bp, Homo sapiens
tatacaagtgtttctagtaaca

SEQ ID NO: 4836089 - DNA, 16 bp, Homo sapiens
tatacacatcataaac

SEQ ID NO: 4836090 - DNA, 14 bp, Homo sapiens
tatacagagcctgt

SEQ ID NO: 4836091 - DNA, 15 bp, Homo sapiens
tatacatatacacaa

SEQ ID NO: 4836092 - DNA, 14 bp, Homo sapiens
tatacatatgtatg

SEQ ID NO: 4836093 - DNA, 16 bp, Homo sapiens
tatacatattcaaagt

SEQ ID NO: 4836094 - DNA, 15 bp, Homo sapiens
tatacattatttctg

SEQ ID NO: 4836095 - DNA, 16 bp, Homo sapiens
tatacattatttctgt

SEQ ID NO: 4836096 - DNA, 23 bp, Homo sapiens
tatactatttattaaaaccattc

SEQ ID NO: 4836097 - DNA, 14 bp, Homo sapiens
tatactcatttgga

SEQ ID NO: 4836098 - DNA, 18 bp, Homo sapiens
tatactccttaaaaatgt

SEQ ID NO: 4836099 - DNA, 22 bp, Homo sapiens
tatagaataatgtgggaagaaa

SEQ ID NO: 4836100 - DNA, 16 bp, Homo sapiens
tatagagacttctaaa

SEQ ID NO: 4836101 - DNA, 21 bp, Homo sapiens
tatagagcacaatattaagtg

SEQ ID NO: 4836102 - DNA, 13 bp, Homo sapiens
tatagatgtctgt

SEQ ID NO: 4836103 - DNA, 15 bp, Homo sapiens
tatagatgtctgtgt

SEQ ID NO: 4836104 - DNA, 18 bp, Homo sapiens
tatagatgtctgtgtata

SEQ ID NO: 4836105 - DNA, 20 bp, Homo sapiens
tatagattctttattagtga

SEQ ID NO: 4836106 - DNA, 15 bp, Homo sapiens
tatagcatgtaatat

SEQ ID NO: 4836107 - DNA, 13 bp, Homo sapiens
tataggacaaggg

SEQ ID NO: 4836108 - DNA, 20 bp, Homo sapiens
tataggacttaatttagcag

SEQ ID NO: 4836109 - DNA, 13 bp, Homo sapiens
tatagggtttgtt

SEQ ID NO: 4836110 - DNA, 24 bp, Homo sapiens
tatagtctgtacttcagttctcat

SEQ ID NO: 4836111 - DNA, 14 bp, Homo sapiens
tatagtgtgttgtg

SEQ ID NO: 4836112 - DNA, 17 bp, Homo sapiens
tatagttactgtcctgt

SEQ ID NO: 4836113 - DNA, 12 bp, Homo sapiens
tatataaattat

SEQ ID NO: 4836114 - DNA, 14 bp, Homo sapiens
tatataaattatta

SEQ ID NO: 4836115 - DNA, 15 bp, Homo sapiens
tatataaattattac

SEQ ID NO: 4836116 - DNA, 22 bp, Homo sapiens
tatataaattattactttaaat

SEQ ID NO: 4836117 - DNA, 12 bp, Homo sapiens
tatataagcttt

SEQ ID NO: 4836118 - DNA, 18 bp, Homo sapiens
tatataattttattgctg

SEQ ID NO: 4836119 - DNA, 18 bp, Homo sapiens
tatatacaaagctgtcac

SEQ ID NO: 4836120 - DNA, 18 bp, Homo sapiens
tatatacagagcctgttt

SEQ ID NO: 4836121 - DNA, 21 bp, Homo sapiens
tatatacagagcctgttttaa

SEQ ID NO: 4836122 - DNA, 18 bp, Homo sapiens
tatatacatatacacaaa

SEQ ID NO: 4836123 - DNA, 22 bp, Homo sapiens
tatatacatattcaaagtatat

SEQ ID NO: 4836124 - DNA, 23 bp, Homo sapiens
tatatacatcacgttaaagtagg

SEQ ID NO: 4836125 - DNA, 20 bp, Homo sapiens
tatatacattagacacacat

SEQ ID NO: 4836126 - DNA, 20 bp, Homo sapiens
tatatagatgtctgtgtata

SEQ ID NO: 4836127 - DNA, 14 bp, Homo sapiens
tatatataaatatc

SEQ ID NO: 4836128 - DNA, 11 bp, Homo sapiens
tatatatacat

SEQ ID NO: 4836129 - DNA, 15 bp, Homo sapiens
tatatatacatgtat

SEQ ID NO: 4836130 - DNA, 15 bp, Homo sapiens
tatatatacattaga

SEQ ID NO: 4836131 - DNA, 13 bp, Homo sapiens
tatatatatatgt

SEQ ID NO: 4836132 - DNA, 16 bp, Homo sapiens
tatatatatatgtata

SEQ ID NO: 4836133 - DNA, 11 bp, Homo sapiens
tatatatgtac

SEQ ID NO: 4836134 - DNA, 13 bp, Homo sapiens
tatatatgtacag

SEQ ID NO: 4836135 - DNA, 15 bp, Homo sapiens
tatatatgtacagtt

SEQ ID NO: 4836136 - DNA, 21 bp, Homo sapiens
tatatatgtacagttatacat

SEQ ID NO: 4836137 - DNA, 22 bp, Homo sapiens
tatatatgtacagttatacata

SEQ ID NO: 4836138 - DNA, 18 bp, Homo sapiens
tatatattataagttgac

SEQ ID NO: 4836139 - DNA, 12 bp, Homo sapiens
tatatcagctct

SEQ ID NO: 4836140 - DNA, 17 bp, Homo sapiens
tatatcgttatcactgt

SEQ ID NO: 4836141 - DNA, 20 bp, Homo sapiens
tatatcgttatcactgtgca

SEQ ID NO: 4836142 - DNA, 16 bp, Homo sapiens
tatatgaagcagaatg

SEQ ID NO: 4836143 - DNA, 19 bp, Homo sapiens
tatatgacttcttgttcat

SEQ ID NO: 4836144 - DNA, 15 bp, Homo sapiens
tatatgatatgcatg

SEQ ID NO: 4836145 - DNA, 20 bp, Homo sapiens
tatatgcctatatttataaa

SEQ ID NO: 4836146 - DNA, 21 bp, Homo sapiens
tatatgcttttttgcaataag

SEQ ID NO: 4836147 - DNA, 16 bp, Homo sapiens
tatatgtatgtaaaaa

SEQ ID NO: 4836148 - DNA, 16 bp, Homo sapiens
tatatgtttggctgaa

SEQ ID NO: 4836149 - DNA, 12 bp, Homo sapiens
tatattaatata

SEQ ID NO: 4836150 - DNA, 18 bp, Homo sapiens
tatattataagttgacct

SEQ ID NO: 4836151 - DNA, 19 bp, Homo sapiens
tatattgttttataaatgg

SEQ ID NO: 4836152 - DNA, 20 bp, Homo sapiens
tatattgtttttatatatta

SEQ ID NO: 4836153 - DNA, 18 bp, Homo sapiens
tatatttataaaccagca

SEQ ID NO: 4836154 - DNA, 20 bp, Homo sapiens
tatatttatcatatttaata

SEQ ID NO: 4836155 - DNA, 18 bp, Homo sapiens
tatatttattattttcat

SEQ ID NO: 4836156 - DNA, 15 bp, Homo sapiens
tatattttgaaagga

SEQ ID NO: 4836157 - DNA, 15 bp, Homo sapiens
tatattttgaacaac

SEQ ID NO: 4836158 - DNA, 16 bp, Homo sapiens
tatatttttttaactt

SEQ ID NO: 4836159 - DNA, 13 bp, Homo sapiens
tatcaaaaaacag

SEQ ID NO: 4836160 - DNA, 19 bp, Homo sapiens
tatcaagtcccgaggcagc

SEQ ID NO: 4836161 - DNA, 16 bp, Homo sapiens
tatcagggcaagctca

SEQ ID NO: 4836162 - DNA, 24 bp, Homo sapiens
tatcagggcaagctcatagcacat

SEQ ID NO: 4836163 - DNA, 19 bp, Homo sapiens
tatcagtacaattctttgt

SEQ ID NO: 4836164 - DNA, 13 bp, Homo sapiens
tatcagtggttcg

SEQ ID NO: 4836165 - DNA, 21 bp, Homo sapiens
tatcagtggttcgggggaaat

SEQ ID NO: 4836166 - DNA, 15 bp, Homo sapiens
tatcagtgtttatgt

SEQ ID NO: 4836167 - DNA, 16 bp, Homo sapiens
tatcagttacagtggc

SEQ ID NO: 4836168 - DNA, 17 bp, Homo sapiens
tatcagttacagtggca

SEQ ID NO: 4836169 - DNA, 12 bp, Homo sapiens
tatcatatatgc

SEQ ID NO: 4836170 - DNA, 13 bp, Homo sapiens
tatcatatatgct

SEQ ID NO: 4836171 - DNA, 18 bp, Homo sapiens
tatcatcacgtatgttat

SEQ ID NO: 4836172 - DNA, 23 bp, Homo sapiens
tatcatgcacacaattagatttc

SEQ ID NO: 4836173 - DNA, 21 bp, Homo sapiens
tatcattatagcatgtaatat

SEQ ID NO: 4836174 - DNA, 20 bp, Homo sapiens
tatcattgtttgtcctttat

SEQ ID NO: 4836175 - DNA, 17 bp, Homo sapiens
tatcatttcataaaaat

SEQ ID NO: 4836176 - DNA, 15 bp, Homo sapiens
tatcatttcttaacc

SEQ ID NO: 4836177 - DNA, 21 bp, Homo sapiens
tatcattttccaattaattat

SEQ ID NO: 4836178 - DNA, 18 bp, Homo sapiens
tatcattttcctgggagt

SEQ ID NO: 4836179 - DNA, 23 bp, Homo sapiens
tatcctgttaggggaaaatagta

SEQ ID NO: 4836180 - DNA, 21 bp, Homo sapiens
tatccttttttattgaataac

SEQ ID NO: 4836181 - DNA, 19 bp, Homo sapiens
tatccttttttcctttcct

SEQ ID NO: 4836182 - DNA, 21 bp, Homo sapiens
tatccttttttcctttcctga

SEQ ID NO: 4836183 - DNA, 15 bp, Homo sapiens
tatcgttatcactgt

SEQ ID NO: 4836184 - DNA, 13 bp, Homo sapiens
tatctaattttta

SEQ ID NO: 4836185 - DNA, 16 bp, Homo sapiens
tatctagtaggtctgc

SEQ ID NO: 4836186 - DNA, 14 bp, Homo sapiens
tatctagtgctaaa

SEQ ID NO: 4836187 - DNA, 20 bp, Homo sapiens
tatctagtgtctaaaacact

SEQ ID NO: 4836188 - DNA, 18 bp, Homo sapiens
tatctatttatctgtctg

SEQ ID NO: 4836189 - DNA, 19 bp, Homo sapiens
tatctatttatctgtctga

SEQ ID NO: 4836190 - DNA, 21 bp, Homo sapiens
tatctatttatctgtctgagc

SEQ ID NO: 4836191 - DNA, 22 bp, Homo sapiens
tatctccagccaatttcaaaga

SEQ ID NO: 4836192 - DNA, 20 bp, Homo sapiens
tatctcgctagccatatatt

SEQ ID NO: 4836193 - DNA, 14 bp, Homo sapiens
tatctcggactttg

SEQ ID NO: 4836194 - DNA, 18 bp, Homo sapiens
tatctctttctctctttc

SEQ ID NO: 4836195 - DNA, 14 bp, Homo sapiens
tatctgaaaactgg

SEQ ID NO: 4836196 - DNA, 16 bp, Homo sapiens
tatctgaaaactggaa

SEQ ID NO: 4836197 - DNA, 18 bp, Homo sapiens
tatctgatgatgttctga

SEQ ID NO: 4836198 - DNA, 18 bp, Homo sapiens
tatctggattcaaattta

SEQ ID NO: 4836199 - DNA, 19 bp, Homo sapiens
tatctggattcaaatttat

SEQ ID NO: 4836200 - DNA, 14 bp, Homo sapiens
tatctgtattggca

SEQ ID NO: 4836201 - DNA, 15 bp, Homo sapiens
tatctgtattggcag

SEQ ID NO: 4836202 - DNA, 12 bp, Homo sapiens
tatctgtctgag

SEQ ID NO: 4836203 - DNA, 22 bp, Homo sapiens
tatctgtctgagccctgccctc

SEQ ID NO: 4836204 - DNA, 12 bp, Homo sapiens
tatctgtcttta

SEQ ID NO: 4836205 - DNA, 13 bp, Homo sapiens
tatctgtggtctt

SEQ ID NO: 4836206 - DNA, 15 bp, Homo sapiens
tatctgttctatgga

SEQ ID NO: 4836207 - DNA, 19 bp, Homo sapiens
tatctgttctatggaccaa

SEQ ID NO: 4836208 - DNA, 17 bp, Homo sapiens
tatctgtttgcttctaa

SEQ ID NO: 4836209 - DNA, 16 bp, Homo sapiens
tatcttaaacccacat

SEQ ID NO: 4836210 - DNA, 19 bp, Homo sapiens
tatcttaaacccacataaa

SEQ ID NO: 4836211 - DNA, 18 bp, Homo sapiens
tatcttcatgtaaattga

SEQ ID NO: 4836212 - DNA, 18 bp, Homo sapiens
tatcttccatatgctctt

SEQ ID NO: 4836213 - DNA, 13 bp, Homo sapiens
tatcttgaagaat

SEQ ID NO: 4836214 - DNA, 15 bp, Homo sapiens
tatctttaaaactta

SEQ ID NO: 4836215 - DNA, 13 bp, Homo sapiens
tatgaaagagaaa

SEQ ID NO: 4836216 - DNA, 14 bp, Homo sapiens
tatgaaagagaaaa

SEQ ID NO: 4836217 - DNA, 21 bp, Homo sapiens
tatgaaatatccttactttat

SEQ ID NO: 4836218 - DNA, 13 bp, Homo sapiens
tatgaaatgccag

SEQ ID NO: 4836219 - DNA, 14 bp, Homo sapiens
tatgaaatgccaga

SEQ ID NO: 4836220 - DNA, 19 bp, Homo sapiens
tatgaacgcacaacatgca

SEQ ID NO: 4836221 - DNA, 13 bp, Homo sapiens
tatgaagtaagtt

SEQ ID NO: 4836222 - DNA, 17 bp, Homo sapiens
tatgaatcgcagacgca

SEQ ID NO: 4836223 - DNA, 13 bp, Homo sapiens
tatgaccctgtgc

SEQ ID NO: 4836224 - DNA, 15 bp, Homo sapiens
tatgaccctgtgcct

SEQ ID NO: 4836225 - DNA, 17 bp, Homo sapiens
tatgactccagaatttc

SEQ ID NO: 4836226 - DNA, 13 bp, Homo sapiens
tatgacttcttgt

SEQ ID NO: 4836227 - DNA, 14 bp, Homo sapiens
tatgatatgcatgt

SEQ ID NO: 4836228 - DNA, 16 bp, Homo sapiens
tatgatctctgctttg

SEQ ID NO: 4836229 - DNA, 14 bp, Homo sapiens
tatgattccaatta

SEQ ID NO: 4836230 - DNA, 14 bp, Homo sapiens
tatgattctcctct

SEQ ID NO: 4836231 - DNA, 16 bp, Homo sapiens
tatgattctcctctcc

SEQ ID NO: 4836232 - DNA, 18 bp, Homo sapiens
tatgatttcatgattaga

SEQ ID NO: 4836233 - DNA, 15 bp, Homo sapiens
tatgatttgttcctt

SEQ ID NO: 4836234 - DNA, 21 bp, Homo sapiens
tatgatttgttcctttctgga

SEQ ID NO: 4836235 - DNA, 19 bp, Homo sapiens
tatgattttccctaaaaga

SEQ ID NO: 4836236 - DNA, 11 bp, Homo sapiens
tatgcatgtag

SEQ ID NO: 4836237 - DNA, 15 bp, Homo sapiens
tatgcatgtagcata

SEQ ID NO: 4836238 - DNA, 22 bp, Homo sapiens
tatgcatgtagcatataaatgt

SEQ ID NO: 4836239 - DNA, 17 bp, Homo sapiens
tatgcctgggcagaagg

SEQ ID NO: 4836240 - DNA, 19 bp, Homo sapiens
tatgcctgttgatctatgg

SEQ ID NO: 4836241 - DNA, 24 bp, Homo sapiens
tatgcctgttgatctatgggaaat

SEQ ID NO: 4836242 - DNA, 17 bp, Homo sapiens
tatgcggaattccacct

SEQ ID NO: 4836243 - DNA, 19 bp, Homo sapiens
tatgctctggaaaacctga

SEQ ID NO: 4836244 - DNA, 20 bp, Homo sapiens
tatgctggccagcaccctct

SEQ ID NO: 4836245 - DNA, 13 bp, Homo sapiens
tatgctgtgtgca

SEQ ID NO: 4836246 - DNA, 16 bp, Homo sapiens
tatgctgtgtgcagag

SEQ ID NO: 4836247 - DNA, 15 bp, Homo sapiens
tatggaaatcctgtt

SEQ ID NO: 4836248 - DNA, 14 bp, Homo sapiens
tatggaccaaatgt

SEQ ID NO: 4836249 - DNA, 18 bp, Homo sapiens
tatggatatgaaaaatga

SEQ ID NO: 4836250 - DNA, 16 bp, Homo sapiens
tatggattcacttcta

SEQ ID NO: 4836251 - DNA, 20 bp, Homo sapiens
tatggattcacttctattta

SEQ ID NO: 4836252 - DNA, 18 bp, Homo sapiens
tatggcaacgttcatgtt

SEQ ID NO: 4836253 - DNA, 23 bp, Homo sapiens
tatggcaagtttttggtaatgat

SEQ ID NO: 4836254 - DNA, 20 bp, Homo sapiens
tatggctgtatttttagaga

SEQ ID NO: 4836255 - DNA, 19 bp, Homo sapiens
tatggcttgtagggtgagg

SEQ ID NO: 4836256 - DNA, 15 bp, Homo sapiens
tatggctttgtgctt

SEQ ID NO: 4836257 - DNA, 23 bp, Homo sapiens
tatggggagaggaactccttggc

SEQ ID NO: 4836258 - DNA, 14 bp, Homo sapiens
tatggtaaataact

SEQ ID NO: 4836259 - DNA, 15 bp, Homo sapiens
tatggtaaataactg

SEQ ID NO: 4836260 - DNA, 18 bp, Homo sapiens
tatggtacctctgtctat

SEQ ID NO: 4836261 - DNA, 19 bp, Homo sapiens
tatggtagaaaaatttcac

SEQ ID NO: 4836262 - DNA, 22 bp, Homo sapiens
tatggtagaaaaatttcacgat

SEQ ID NO: 4836263 - DNA, 18 bp, Homo sapiens
tatggtatgctggccagc

SEQ ID NO: 4836264 - DNA, 19 bp, Homo sapiens
tatggtatgctggccagca

SEQ ID NO: 4836265 - DNA, 22 bp, Homo sapiens
tatggtattttcgtgcatttgt

SEQ ID NO: 4836266 - DNA, 15 bp, Homo sapiens
tatgtaagtttctaa

SEQ ID NO: 4836267 - DNA, 15 bp, Homo sapiens
tatgtaatatataca

SEQ ID NO: 4836268 - DNA, 16 bp, Homo sapiens
tatgtaatatatacat

SEQ ID NO: 4836269 - DNA, 21 bp, Homo sapiens
tatgtacaggctgagacacag

SEQ ID NO: 4836270 - DNA, 14 bp, Homo sapiens
tatgtacagttata

SEQ ID NO: 4836271 - DNA, 14 bp, Homo sapiens
tatgtatacacaca

SEQ ID NO: 4836272 - DNA, 18 bp, Homo sapiens
tatgtatatctgtgtaag

SEQ ID NO: 4836273 - DNA, 15 bp, Homo sapiens
tatgtattctcttct

SEQ ID NO: 4836274 - DNA, 20 bp, Homo sapiens
tatgtcagtccaataaatta

SEQ ID NO: 4836275 - DNA, 13 bp, Homo sapiens
tatgtcagttata

SEQ ID NO: 4836276 - DNA, 15 bp, Homo sapiens
tatgtctatgtgtat

SEQ ID NO: 4836277 - DNA, 17 bp, Homo sapiens
tatgtctatgtgtatat

SEQ ID NO: 4836278 - DNA, 22 bp, Homo sapiens
tatgtgaaaggatatgaatctg

SEQ ID NO: 4836279 - DNA, 19 bp, Homo sapiens
tatgtgccccttccccatg

SEQ ID NO: 4836280 - DNA, 16 bp, Homo sapiens
tatgtgcttgtgtgta

SEQ ID NO: 4836281 - DNA, 17 bp, Homo sapiens
tatgtgcttgtgtgtat

SEQ ID NO: 4836282 - DNA, 18 bp, Homo sapiens
tatgtgcttgtgtgtatg

SEQ ID NO: 4836283 - DNA, 19 bp, Homo sapiens
tatgtgcttgtgtgtatgt

SEQ ID NO: 4836284 - DNA, 23 bp, Homo sapiens
tatgtgcttgtgtgtatgtctat

SEQ ID NO: 4836285 - DNA, 15 bp, Homo sapiens
tatgtgtaatatcat

SEQ ID NO: 4836286 - DNA, 13 bp, Homo sapiens
tatgtgtatgtac

SEQ ID NO: 4836287 - DNA, 16 bp, Homo sapiens
tatgtgtcatgatttc

SEQ ID NO: 4836288 - DNA, 17 bp, Homo sapiens
tatgtgtgagtgtatgt

SEQ ID NO: 4836289 - DNA, 19 bp, Homo sapiens
tatgtgtgagtgtatgtat

SEQ ID NO: 4836290 - DNA, 22 bp, Homo sapiens
tatgtgtgagtgtatgtataca

SEQ ID NO: 4836291 - DNA, 16 bp, Homo sapiens
tatgtgtgtttctgtc

SEQ ID NO: 4836292 - DNA, 19 bp, Homo sapiens
tatgttgcatgaatccatc

SEQ ID NO: 4836293 - DNA, 13 bp, Homo sapiens
tatgttgctgaaa

SEQ ID NO: 4836294 - DNA, 16 bp, Homo sapiens
tatgtttaaaatggca

SEQ ID NO: 4836295 - DNA, 16 bp, Homo sapiens
tatgtttggctgaaat

SEQ ID NO: 4836296 - DNA, 20 bp, Homo sapiens
tattaaaaattaattcttta

SEQ ID NO: 4836297 - DNA, 13 bp, Homo sapiens
tattaaaatcaca

SEQ ID NO: 4836298 - DNA, 12 bp, Homo sapiens
tattaaatgcca

SEQ ID NO: 4836299 - DNA, 15 bp, Homo sapiens
tattaacaattaatt

SEQ ID NO: 4836300 - DNA, 18 bp, Homo sapiens
tattaactctgcatagac

SEQ ID NO: 4836301 - DNA, 20 bp, Homo sapiens
tattaactctgcatagacaa

SEQ ID NO: 4836302 - DNA, 23 bp, Homo sapiens
tattaactctgcatagacaaagg

SEQ ID NO: 4836303 - DNA, 16 bp, Homo sapiens
tattaatgaatgccca

SEQ ID NO: 4836304 - DNA, 22 bp, Homo sapiens
tattaatttagcctttaataat

SEQ ID NO: 4836305 - DNA, 18 bp, Homo sapiens
tattaccctcagaatatt

SEQ ID NO: 4836306 - DNA, 16 bp, Homo sapiens
tattagagtgccctta

SEQ ID NO: 4836307 - DNA, 14 bp, Homo sapiens
tattagcaccagct

SEQ ID NO: 4836308 - DNA, 20 bp, Homo sapiens
tattagccctgcattttcat

SEQ ID NO: 4836309 - DNA, 18 bp, Homo sapiens
tattagtaataaaacatt

SEQ ID NO: 4836310 - DNA, 20 bp, Homo sapiens
tattagtgaagtatgcacta

SEQ ID NO: 4836311 - DNA, 18 bp, Homo sapiens
tattataagttgaccttt

SEQ ID NO: 4836312 - DNA, 14 bp, Homo sapiens
tattatatatacat

SEQ ID NO: 4836313 - DNA, 15 bp, Homo sapiens
tattatatatacatt

SEQ ID NO: 4836314 - DNA, 19 bp, Homo sapiens
tattatatatgtatatctg

SEQ ID NO: 4836315 - DNA, 22 bp, Homo sapiens
tattatatatgtatatctgtgt

SEQ ID NO: 4836316 - DNA, 23 bp, Homo sapiens
tattatattaatataaaaacatt

SEQ ID NO: 4836317 - DNA, 18 bp, Homo sapiens
tattatcagtgaatataa

SEQ ID NO: 4836318 - DNA, 15 bp, Homo sapiens
tattatctagtaggt

SEQ ID NO: 4836319 - DNA, 23 bp, Homo sapiens
tattatcttaaacccacataaac

SEQ ID NO: 4836320 - DNA, 19 bp, Homo sapiens
tattatgatctctgctttg

SEQ ID NO: 4836321 - DNA, 13 bp, Homo sapiens
tattatgcttctt

SEQ ID NO: 4836322 - DNA, 19 bp, Homo sapiens
tattatgtcctgtgagatg

SEQ ID NO: 4836323 - DNA, 22 bp, Homo sapiens
tattatgtcctgtgagatgtgt

SEQ ID NO: 4836324 - DNA, 17 bp, Homo sapiens
tattatttagtaaaatt

SEQ ID NO: 4836325 - DNA, 15 bp, Homo sapiens
tattatttgaatgga

SEQ ID NO: 4836326 - DNA, 19 bp, Homo sapiens
tattattttctgtaattct

SEQ ID NO: 4836327 - DNA, 20 bp, Homo sapiens
tattcaaaaattatattttg

SEQ ID NO: 4836328 - DNA, 19 bp, Homo sapiens
tattcaaagtatatacaga

SEQ ID NO: 4836329 - DNA, 20 bp, Homo sapiens
tattcaaagtatatacagag

SEQ ID NO: 4836330 - DNA, 12 bp, Homo sapiens
tattcacacaca

SEQ ID NO: 4836331 - DNA, 14 bp, Homo sapiens
tattcagagatgta

SEQ ID NO: 4836332 - DNA, 17 bp, Homo sapiens
tattcccaaatctcaaa

SEQ ID NO: 4836333 - DNA, 21 bp, Homo sapiens
tattcccatggtagactgtga

SEQ ID NO: 4836334 - DNA, 14 bp, Homo sapiens
tattcctaattcct

SEQ ID NO: 4836335 - DNA, 16 bp, Homo sapiens
tattcctaattcctgt

SEQ ID NO: 4836336 - DNA, 15 bp, Homo sapiens
tattcctgcctttga

SEQ ID NO: 4836337 - DNA, 18 bp, Homo sapiens
tattccttggcccagcag

SEQ ID NO: 4836338 - DNA, 20 bp, Homo sapiens
tattcgtaagttctgtgcag

SEQ ID NO: 4836339 - DNA, 19 bp, Homo sapiens
tattctaagaaatatctgt

SEQ ID NO: 4836340 - DNA, 16 bp, Homo sapiens
tattctaaggagcaaa

SEQ ID NO: 4836341 - DNA, 19 bp, Homo sapiens
tattctcagaacaccaagt

SEQ ID NO: 4836342 - DNA, 11 bp, Homo sapiens
tattctccatg

SEQ ID NO: 4836343 - DNA, 14 bp, Homo sapiens
tattctcttctaca

SEQ ID NO: 4836344 - DNA, 16 bp, Homo sapiens
tattctgcagaaaatt

SEQ ID NO: 4836345 - DNA, 14 bp, Homo sapiens
tattcttccaagtt

SEQ ID NO: 4836346 - DNA, 17 bp, Homo sapiens
tattcttccaagttcat

SEQ ID NO: 4836347 - DNA, 23 bp, Homo sapiens
tattgaaaaaatattgtttaatg

SEQ ID NO: 4836348 - DNA, 11 bp, Homo sapiens
tattgaataac

SEQ ID NO: 4836349 - DNA, 23 bp, Homo sapiens
tattgacgacctacatctgaaat

SEQ ID NO: 4836350 - DNA, 21 bp, Homo sapiens
tattgagcagaattcattcat

SEQ ID NO: 4836351 - DNA, 14 bp, Homo sapiens
tattgatctgtatt

SEQ ID NO: 4836352 - DNA, 22 bp, Homo sapiens
tattgccaggaaaggagagtac

SEQ ID NO: 4836353 - DNA, 16 bp, Homo sapiens
tattgctgtctgaaaa

SEQ ID NO: 4836354 - DNA, 16 bp, Homo sapiens
tattggacagacacag

SEQ ID NO: 4836355 - DNA, 18 bp, Homo sapiens
tattggacagacacagag

SEQ ID NO: 4836356 - DNA, 15 bp, Homo sapiens
tattggtatactgtt

SEQ ID NO: 4836357 - DNA, 13 bp, Homo sapiens
tattggttctatt

SEQ ID NO: 4836358 - DNA, 20 bp, Homo sapiens
tattgtccttgtgtatcctg

SEQ ID NO: 4836359 - DNA, 14 bp, Homo sapiens
tattgtctgtaaat

SEQ ID NO: 4836360 - DNA, 22 bp, Homo sapiens
tattgtctgtaaatctaacatt

SEQ ID NO: 4836361 - DNA, 19 bp, Homo sapiens
tattgtgagatcctgtgat

SEQ ID NO: 4836362 - DNA, 14 bp, Homo sapiens
tattgtggttggtt

SEQ ID NO: 4836363 - DNA, 16 bp, Homo sapiens
tattgttacagctgaa

SEQ ID NO: 4836364 - DNA, 21 bp, Homo sapiens
tattgttcttgtaaaactgtg

SEQ ID NO: 4836365 - DNA, 23 bp, Homo sapiens
tattgttcttgtaaaactgtgac

SEQ ID NO: 4836366 - DNA, 14 bp, Homo sapiens
tattgttttataaa

SEQ ID NO: 4836367 - DNA, 23 bp, Homo sapiens
tattgtttttggatggcttaagc

SEQ ID NO: 4836368 - DNA, 14 bp, Homo sapiens
tatttaacattctt

SEQ ID NO: 4836369 - DNA, 16 bp, Homo sapiens
tatttacaagaagaac

SEQ ID NO: 4836370 - DNA, 14 bp, Homo sapiens
tatttacaatgtat

SEQ ID NO: 4836371 - DNA, 15 bp, Homo sapiens
tatttacaatgtatt

SEQ ID NO: 4836372 - DNA, 12 bp, Homo sapiens
tatttacttgtt

SEQ ID NO: 4836373 - DNA, 18 bp, Homo sapiens
tatttataaaccagcagc

SEQ ID NO: 4836374 - DNA, 15 bp, Homo sapiens
tatttataacattgt

SEQ ID NO: 4836375 - DNA, 17 bp, Homo sapiens
tatttataacattgtaa

SEQ ID NO: 4836376 - DNA, 20 bp, Homo sapiens
tatttataagaaaaatgtga

SEQ ID NO: 4836377 - DNA, 13 bp, Homo sapiens
tatttatatatga

SEQ ID NO: 4836378 - DNA, 17 bp, Homo sapiens
tatttatctgtctgagc

SEQ ID NO: 4836379 - DNA, 19 bp, Homo sapiens
tatttatctgtctgagccc

SEQ ID NO: 4836380 - DNA, 12 bp, Homo sapiens
tatttattaaac

SEQ ID NO: 4836381 - DNA, 16 bp, Homo sapiens
tatttcaatgtaatta

SEQ ID NO: 4836382 - DNA, 19 bp, Homo sapiens
tatttcaatgtaattaaac

SEQ ID NO: 4836383 - DNA, 21 bp, Homo sapiens
tatttcacttaaactttgtca

SEQ ID NO: 4836384 - DNA, 22 bp, Homo sapiens
tatttccatattaaaatcacaa

SEQ ID NO: 4836385 - DNA, 16 bp, Homo sapiens
tatttcggctatgtct

SEQ ID NO: 4836386 - DNA, 20 bp, Homo sapiens
tatttcggctatgtctcatg

SEQ ID NO: 4836387 - DNA, 14 bp, Homo sapiens
tatttcttcaaata

SEQ ID NO: 4836388 - DNA, 12 bp, Homo sapiens
tatttctttcat

SEQ ID NO: 4836389 - DNA, 17 bp, Homo sapiens
tatttgaggaaactcat

SEQ ID NO: 4836390 - DNA, 22 bp, Homo sapiens
tatttgaggaaactcatacagt

SEQ ID NO: 4836391 - DNA, 14 bp, Homo sapiens
tatttgatctggtg

SEQ ID NO: 4836392 - DNA, 15 bp, Homo sapiens
tatttgatctggtgc

SEQ ID NO: 4836393 - DNA, 15 bp, Homo sapiens
tatttgctaattaaa

SEQ ID NO: 4836394 - DNA, 23 bp, Homo sapiens
tatttgctaattaaaaagttaat

SEQ ID NO: 4836395 - DNA, 17 bp, Homo sapiens
tatttgctcataagtaa

SEQ ID NO: 4836396 - DNA, 23 bp, Homo sapiens
tatttgctcataagtaaatgtct

SEQ ID NO: 4836397 - DNA, 15 bp, Homo sapiens
tatttgcttatttat

SEQ ID NO: 4836398 - DNA, 16 bp, Homo sapiens
tatttgcttatttata

SEQ ID NO: 4836399 - DNA, 21 bp, Homo sapiens
tatttggacagccaagggcag

SEQ ID NO: 4836400 - DNA, 14 bp, Homo sapiens
tatttgtgtaactg

SEQ ID NO: 4836401 - DNA, 17 bp, Homo sapiens
tatttgtgtaactgaaa

SEQ ID NO: 4836402 - DNA, 21 bp, Homo sapiens
tattttagcagttctgcaaat

SEQ ID NO: 4836403 - DNA, 23 bp, Homo sapiens
tattttatactcatggaagagat

SEQ ID NO: 4836404 - DNA, 15 bp, Homo sapiens
tattttatttcaatg

SEQ ID NO: 4836405 - DNA, 23 bp, Homo sapiens
tattttcgtgcatttgtgagcca

SEQ ID NO: 4836406 - DNA, 12 bp, Homo sapiens
tattttctactt

SEQ ID NO: 4836407 - DNA, 17 bp, Homo sapiens
tattttctgtaattctt

SEQ ID NO: 4836408 - DNA, 22 bp, Homo sapiens
tattttcttcccatttgtaatg

SEQ ID NO: 4836409 - DNA, 20 bp, Homo sapiens
tattttgagccttattaaaa

SEQ ID NO: 4836410 - DNA, 19 bp, Homo sapiens
tattttggacgtgtgagga

SEQ ID NO: 4836411 - DNA, 18 bp, Homo sapiens
tattttgtaaaatgtatt

SEQ ID NO: 4836412 - DNA, 18 bp, Homo sapiens
tatttttaatttatgata

SEQ ID NO: 4836413 - DNA, 20 bp, Homo sapiens
tatttttaatttcctgtgag

SEQ ID NO: 4836414 - DNA, 18 bp, Homo sapiens
tatttttgctctccctcc

SEQ ID NO: 4836415 - DNA, 13 bp, Homo sapiens
tatttttgtaatt

SEQ ID NO: 4836416 - DNA, 16 bp, Homo sapiens
tatttttgtaattcct

SEQ ID NO: 4836417 - DNA, 17 bp, Homo sapiens
tattttttgtaactctt

SEQ ID NO: 4836418 - DNA, 17 bp, Homo sapiens
tatttttttaactttac

SEQ ID NO: 4836419 - DNA, 15 bp, Homo sapiens
tcaaaaatcatcaaa

SEQ ID NO: 4836420 - DNA, 16 bp, Homo sapiens
tcaaaaattgaagaga

SEQ ID NO: 4836421 - DNA, 17 bp, Homo sapiens
tcaaaataatctgaaat

SEQ ID NO: 4836422 - DNA, 19 bp, Homo sapiens
tcaaaatctagaagagtct

SEQ ID NO: 4836423 - DNA, 19 bp, Homo sapiens
tcaaacaaatcattttgat

SEQ ID NO: 4836424 - DNA, 15 bp, Homo sapiens
tcaaacactgcttaa

SEQ ID NO: 4836425 - DNA, 14 bp, Homo sapiens
tcaaacagtgtggc

SEQ ID NO: 4836426 - DNA, 13 bp, Homo sapiens
tcaaactgggtat

SEQ ID NO: 4836427 - DNA, 17 bp, Homo sapiens
tcaaactttcacctcag

SEQ ID NO: 4836428 - DNA, 17 bp, Homo sapiens
tcaaagaaccaggaggc

SEQ ID NO: 4836429 - DNA, 19 bp, Homo sapiens
tcaaagaggccagtacttt

SEQ ID NO: 4836430 - DNA, 13 bp, Homo sapiens
tcaaagtgtttaa

SEQ ID NO: 4836431 - DNA, 14 bp, Homo sapiens
tcaaagtgtttaat

SEQ ID NO: 4836432 - DNA, 22 bp, Homo sapiens
tcaaagtgtttaattgtataaa

SEQ ID NO: 4836433 - DNA, 20 bp, Homo sapiens
tcaaataaaaattctagatt

SEQ ID NO: 4836434 - DNA, 21 bp, Homo sapiens
tcaaataaccctgaatcagag

SEQ ID NO: 4836435 - DNA, 18 bp, Homo sapiens
tcaaatatctctatttaa

SEQ ID NO: 4836436 - DNA, 17 bp, Homo sapiens
tcaaatccatgtgtccc

SEQ ID NO: 4836437 - DNA, 19 bp, Homo sapiens
tcaaatgaataatgccttt

SEQ ID NO: 4836438 - DNA, 21 bp, Homo sapiens
tcaaatgaataatgcctttgt

SEQ ID NO: 4836439 - DNA, 13 bp, Homo sapiens
tcaaatgctaaat

SEQ ID NO: 4836440 - DNA, 20 bp, Homo sapiens
tcaaatgctactcagtatat

SEQ ID NO: 4836441 - DNA, 15 bp, Homo sapiens
tcaaatgtgtaactt

SEQ ID NO: 4836442 - DNA, 18 bp, Homo sapiens
tcaaatgttattcaataa

SEQ ID NO: 4836443 - DNA, 17 bp, Homo sapiens
tcaaattctgattatta

SEQ ID NO: 4836444 - DNA, 16 bp, Homo sapiens
tcaacaagaagaattt

SEQ ID NO: 4836445 - DNA, 18 bp, Homo sapiens
tcaacacacagtatagat

SEQ ID NO: 4836446 - DNA, 19 bp, Homo sapiens
tcaacagacctaagaaata

SEQ ID NO: 4836447 - DNA, 16 bp, Homo sapiens
tcaacagtgaacagct

SEQ ID NO: 4836448 - DNA, 15 bp, Homo sapiens
tcaacataacataag

SEQ ID NO: 4836449 - DNA, 22 bp, Homo sapiens
tcaaccacacctaaattaacaa

SEQ ID NO: 4836450 - DNA, 22 bp, Homo sapiens
tcaaccattgaagggggatgca

SEQ ID NO: 4836451 - DNA, 13 bp, Homo sapiens
tcaaccctgccct

SEQ ID NO: 4836452 - DNA, 11 bp, Homo sapiens
tcaacctacct

SEQ ID NO: 4836453 - DNA, 13 bp, Homo sapiens
tcaacctacctcg

SEQ ID NO: 4836454 - DNA, 22 bp, Homo sapiens
tcaacctacctcgagtggcgag

SEQ ID NO: 4836455 - DNA, 17 bp, Homo sapiens
tcaacctgaattaaagt

SEQ ID NO: 4836456 - DNA, 17 bp, Homo sapiens
tcaacctggtggcacca

SEQ ID NO: 4836457 - DNA, 19 bp, Homo sapiens
tcaacctggtggcaccaga

SEQ ID NO: 4836458 - DNA, 17 bp, Homo sapiens
tcaagaagatagttgta

SEQ ID NO: 4836459 - DNA, 19 bp, Homo sapiens
tcaagcaaagacagtttct

SEQ ID NO: 4836460 - DNA, 14 bp, Homo sapiens
tcaagcatgaagat

SEQ ID NO: 4836461 - DNA, 15 bp, Homo sapiens
tcaagcattgctaaa

SEQ ID NO: 4836462 - DNA, 18 bp, Homo sapiens
tcaagccaggagaccctg

SEQ ID NO: 4836463 - DNA, 19 bp, Homo sapiens
tcaagccaggagaccctgt

SEQ ID NO: 4836464 - DNA, 15 bp, Homo sapiens
tcaaggctgcagtga

SEQ ID NO: 4836465 - DNA, 22 bp, Homo sapiens
tcaaggtgaaggatctgtccga

SEQ ID NO: 4836466 - DNA, 12 bp, Homo sapiens
tcaaggtgctct

SEQ ID NO: 4836467 - DNA, 12 bp, Homo sapiens
tcaagtattact

SEQ ID NO: 4836468 - DNA, 15 bp, Homo sapiens
tcaagtcccgaggca

SEQ ID NO: 4836469 - DNA, 12 bp, Homo sapiens
tcaagtctgtga

SEQ ID NO: 4836470 - DNA, 16 bp, Homo sapiens
tcaagtggaaaccttg

SEQ ID NO: 4836471 - DNA, 15 bp, Homo sapiens
tcaagtgtgcctgct

SEQ ID NO: 4836472 - DNA, 15 bp, Homo sapiens
tcaagttgtgtgcta

SEQ ID NO: 4836473 - DNA, 14 bp, Homo sapiens
tcaatcaaacaggg

SEQ ID NO: 4836474 - DNA, 22 bp, Homo sapiens
tcaatcacaaaagtatattcaa

SEQ ID NO: 4836475 - DNA, 16 bp, Homo sapiens
tcaatcattgtacagt

SEQ ID NO: 4836476 - DNA, 15 bp, Homo sapiens
tcaatcattgtcaga

SEQ ID NO: 4836477 - DNA, 12 bp, Homo sapiens
tcaatgaaatat

SEQ ID NO: 4836478 - DNA, 21 bp, Homo sapiens
tcaatgaaatatttgcttatt

SEQ ID NO: 4836479 - DNA, 18 bp, Homo sapiens
tcaatgctatggactgca

SEQ ID NO: 4836480 - DNA, 20 bp, Homo sapiens
tcaatgctatggactgcaca

SEQ ID NO: 4836481 - DNA, 21 bp, Homo sapiens
tcaatgggtaaataaatgctg

SEQ ID NO: 4836482 - DNA, 11 bp, Homo sapiens
tcaatgtgaaa

SEQ ID NO: 4836483 - DNA, 12 bp, Homo sapiens
tcaatgtgaaat

SEQ ID NO: 4836484 - DNA, 21 bp, Homo sapiens
tcaatgtgaaataaagagttc

SEQ ID NO: 4836485 - DNA, 15 bp, Homo sapiens
tcaatgttaaatcta

SEQ ID NO: 4836486 - DNA, 17 bp, Homo sapiens
tcaatgttaaatctaca

SEQ ID NO: 4836487 - DNA, 20 bp, Homo sapiens
tcaatgttaaatctacaaac

SEQ ID NO: 4836488 - DNA, 13 bp, Homo sapiens
tcaattacaggaa

SEQ ID NO: 4836489 - DNA, 18 bp, Homo sapiens
tcaattacaggaagtact

SEQ ID NO: 4836490 - DNA, 21 bp, Homo sapiens
tcaattacaggaagtactgga

SEQ ID NO: 4836491 - DNA, 14 bp, Homo sapiens
tcaattttctttaa

SEQ ID NO: 4836492 - DNA, 15 bp, Homo sapiens
tcaatttttaactta

SEQ ID NO: 4836493 - DNA, 22 bp, Homo sapiens
tcaatttttaacttatctccag

SEQ ID NO: 4836494 - DNA, 23 bp, Homo sapiens
tcacaaaaggctggatgtgcttt

SEQ ID NO: 4836495 - DNA, 15 bp, Homo sapiens
tcacaaagctattta

SEQ ID NO: 4836496 - DNA, 18 bp, Homo sapiens
tcacaaagctatttaagt

SEQ ID NO: 4836497 - DNA, 18 bp, Homo sapiens
tcacaagccgtgttttat

SEQ ID NO: 4836498 - DNA, 18 bp, Homo sapiens
tcacacaaagtgaaatta

SEQ ID NO: 4836499 - DNA, 20 bp, Homo sapiens
tcacacaactgtggataaat

SEQ ID NO: 4836500 - DNA, 21 bp, Homo sapiens
tcacacacacacaatggcaag

SEQ ID NO: 4836501 - DNA, 14 bp, Homo sapiens
tcacacacatagat

SEQ ID NO: 4836502 - DNA, 14 bp, Homo sapiens
tcacacacatggaa

SEQ ID NO: 4836503 - DNA, 19 bp, Homo sapiens
tcacacagattcacctttt

SEQ ID NO: 4836504 - DNA, 13 bp, Homo sapiens
tcacaccctgcaa

SEQ ID NO: 4836505 - DNA, 16 bp, Homo sapiens
tcacaccggcactgtg

SEQ ID NO: 4836506 - DNA, 20 bp, Homo sapiens
tcacaccttacaaagccagc

SEQ ID NO: 4836507 - DNA, 22 bp, Homo sapiens
tcacaccttacaaagccagctc

SEQ ID NO: 4836508 - DNA, 15 bp, Homo sapiens
tcacacttgggctgg

SEQ ID NO: 4836509 - DNA, 16 bp, Homo sapiens
tcacagactgctgtct

SEQ ID NO: 4836510 - DNA, 17 bp, Homo sapiens
tcacagcacatgctggc

SEQ ID NO: 4836511 - DNA, 19 bp, Homo sapiens
tcacagcacatgctggcca

SEQ ID NO: 4836512 - DNA, 21 bp, Homo sapiens
tcacagcacatgctggccagc

SEQ ID NO: 4836513 - DNA, 16 bp, Homo sapiens
tcacagtgacccttcc

SEQ ID NO: 4836514 - DNA, 14 bp, Homo sapiens
tcacagtgggcggc

SEQ ID NO: 4836515 - DNA, 15 bp, Homo sapiens
tcacagttctctcct

SEQ ID NO: 4836516 - DNA, 20 bp, Homo sapiens
tcacagttctctccttcttc

SEQ ID NO: 4836517 - DNA, 19 bp, Homo sapiens
tcacatatcaagtcccgag

SEQ ID NO: 4836518 - DNA, 18 bp, Homo sapiens
tcacatgacatccacatg

SEQ ID NO: 4836519 - DNA, 15 bp, Homo sapiens
tcacattcctgaccc

SEQ ID NO: 4836520 - DNA, 22 bp, Homo sapiens
tcaccaacaacagtcagccagc

SEQ ID NO: 4836521 - DNA, 14 bp, Homo sapiens
tcaccacagctgca

SEQ ID NO: 4836522 - DNA, 18 bp, Homo sapiens
tcaccagctatctgtcat

SEQ ID NO: 4836523 - DNA, 16 bp, Homo sapiens
tcaccatgatcactta

SEQ ID NO: 4836524 - DNA, 17 bp, Homo sapiens
tcaccatgttgccaatc

SEQ ID NO: 4836525 - DNA, 15 bp, Homo sapiens
tcaccatttaatcat

SEQ ID NO: 4836526 - DNA, 21 bp, Homo sapiens
tcacccaccacccccatcatc

SEQ ID NO: 4836527 - DNA, 19 bp, Homo sapiens
tcacccaggttggagtgca

SEQ ID NO: 4836528 - DNA, 19 bp, Homo sapiens
tcaccccccgacctggctg

SEQ ID NO: 4836529 - DNA, 21 bp, Homo sapiens
tcaccccggcaggccctgcag

SEQ ID NO: 4836530 - DNA, 23 bp, Homo sapiens
tcaccccggcaggccctgcagtg

SEQ ID NO: 4836531 - DNA, 17 bp, Homo sapiens
tcaccccgttacagctc

SEQ ID NO: 4836532 - DNA, 23 bp, Homo sapiens
tcacccctaaaagaaaccctgca

SEQ ID NO: 4836533 - DNA, 14 bp, Homo sapiens
tcaccctctgtcct

SEQ ID NO: 4836534 - DNA, 18 bp, Homo sapiens
tcaccctctgtccttccc

SEQ ID NO: 4836535 - DNA, 20 bp, Homo sapiens
tcaccctctgtccttccccc

SEQ ID NO: 4836536 - DNA, 12 bp, Homo sapiens
tcaccctgccac

SEQ ID NO: 4836537 - DNA, 13 bp, Homo sapiens
tcaccctgccacc

SEQ ID NO: 4836538 - DNA, 19 bp, Homo sapiens
tcaccctgccaccctctgc

SEQ ID NO: 4836539 - DNA, 22 bp, Homo sapiens
tcaccctgccaccctctgctgc

SEQ ID NO: 4836540 - DNA, 17 bp, Homo sapiens
tcacccttgaaaactct

SEQ ID NO: 4836541 - DNA, 23 bp, Homo sapiens
tcaccgagaggaaaaaggcttct

SEQ ID NO: 4836542 - DNA, 19 bp, Homo sapiens
tcaccgattcttccttgcc

SEQ ID NO: 4836543 - DNA, 13 bp, Homo sapiens
tcaccgcattcca

SEQ ID NO: 4836544 - DNA, 14 bp, Homo sapiens
tcacctagctgctc

SEQ ID NO: 4836545 - DNA, 16 bp, Homo sapiens
tcacctatctggaaaa

SEQ ID NO: 4836546 - DNA, 15 bp, Homo sapiens
tcacctcacttgtgg

SEQ ID NO: 4836547 - DNA, 13 bp, Homo sapiens
tcacctccttctg

SEQ ID NO: 4836548 - DNA, 14 bp, Homo sapiens
tcacctccttctgc

SEQ ID NO: 4836549 - DNA, 15 bp, Homo sapiens
tcacctccttctgca

SEQ ID NO: 4836550 - DNA, 16 bp, Homo sapiens
tcacctccttctgcag

SEQ ID NO: 4836551 - DNA, 17 bp, Homo sapiens
tcacctccttctgcagt

SEQ ID NO: 4836552 - DNA, 15 bp, Homo sapiens
tcacctgaattatta

SEQ ID NO: 4836553 - DNA, 16 bp, Homo sapiens
tcacctggcttcccag

SEQ ID NO: 4836554 - DNA, 19 bp, Homo sapiens
tcacctggcttcccaggac

SEQ ID NO: 4836555 - DNA, 20 bp, Homo sapiens
tcacctggcttcccaggacc

SEQ ID NO: 4836556 - DNA, 21 bp, Homo sapiens
tcacctggcttcccaggaccc

SEQ ID NO: 4836557 - DNA, 14 bp, Homo sapiens
tcacctgtaaaact

SEQ ID NO: 4836558 - DNA, 18 bp, Homo sapiens
tcacctgtaaaactttat

SEQ ID NO: 4836559 - DNA, 21 bp, Homo sapiens
tcaccttccaggacccctggg

SEQ ID NO: 4836560 - DNA, 19 bp, Homo sapiens
tcaccttccctagttcttt

SEQ ID NO: 4836561 - DNA, 14 bp, Homo sapiens
tcaccttcctgggc

SEQ ID NO: 4836562 - DNA, 17 bp, Homo sapiens
tcaccttcctgggcagc

SEQ ID NO: 4836563 - DNA, 14 bp, Homo sapiens
tcacgattcatttt

SEQ ID NO: 4836564 - DNA, 20 bp, Homo sapiens
tcacgattcttaccctttct

SEQ ID NO: 4836565 - DNA, 17 bp, Homo sapiens
tcacgctgaatgagaag

SEQ ID NO: 4836566 - DNA, 13 bp, Homo sapiens
tcacggcatgttt

SEQ ID NO: 4836567 - DNA, 14 bp, Homo sapiens
tcacgggcccgctc

SEQ ID NO: 4836568 - DNA, 19 bp, Homo sapiens
tcactaaatatctagtgct

SEQ ID NO: 4836569 - DNA, 13 bp, Homo sapiens
tcactatggtatg

SEQ ID NO: 4836570 - DNA, 20 bp, Homo sapiens
tcactatggtatgctggcca

SEQ ID NO: 4836571 - DNA, 19 bp, Homo sapiens
tcactcatttatttccata

SEQ ID NO: 4836572 - DNA, 12 bp, Homo sapiens
tcactccactcc

SEQ ID NO: 4836573 - DNA, 18 bp, Homo sapiens
tcactccactcccctcat

SEQ ID NO: 4836574 - DNA, 20 bp, Homo sapiens
tcactccactcccctcatcc

SEQ ID NO: 4836575 - DNA, 15 bp, Homo sapiens
tcactccctgtcata

SEQ ID NO: 4836576 - DNA, 14 bp, Homo sapiens
tcactctgccaggg

SEQ ID NO: 4836577 - DNA, 17 bp, Homo sapiens
tcactctgtcagccagc

SEQ ID NO: 4836578 - DNA, 23 bp, Homo sapiens
tcactctgtcagccagccgccct

SEQ ID NO: 4836579 - DNA, 15 bp, Homo sapiens
tcactgaataaataa

SEQ ID NO: 4836580 - DNA, 20 bp, Homo sapiens
tcactgccactaaaatccac

SEQ ID NO: 4836581 - DNA, 17 bp, Homo sapiens
tcactgcccacctgcca

SEQ ID NO: 4836582 - DNA, 18 bp, Homo sapiens
tcactgcccgcacaccct

SEQ ID NO: 4836583 - DNA, 17 bp, Homo sapiens
tcactgcctttttttct

SEQ ID NO: 4836584 - DNA, 15 bp, Homo sapiens
tcactgtcttactca

SEQ ID NO: 4836585 - DNA, 11 bp, Homo sapiens
tcactgtgtct

SEQ ID NO: 4836586 - DNA, 12 bp, Homo sapiens
tcactgtgtctc

SEQ ID NO: 4836587 - DNA, 21 bp, Homo sapiens
tcacttaaactttgtcacttc

SEQ ID NO: 4836588 - DNA, 23 bp, Homo sapiens
tcacttaaactttgtcacttctg

SEQ ID NO: 4836589 - DNA, 13 bp, Homo sapiens
tcacttatcagtt

SEQ ID NO: 4836590 - DNA, 17 bp, Homo sapiens
tcacttctatttattta

SEQ ID NO: 4836591 - DNA, 18 bp, Homo sapiens
tcacttgtggcagcttcc

SEQ ID NO: 4836592 - DNA, 16 bp, Homo sapiens
tcacttgtttgtgttt

SEQ ID NO: 4836593 - DNA, 16 bp, Homo sapiens
tcacttttctcatctg

SEQ ID NO: 4836594 - DNA, 21 bp, Homo sapiens
tcacttttttataaattataa

SEQ ID NO: 4836595 - DNA, 19 bp, Homo sapiens
tcacttttttcctgtcaat

SEQ ID NO: 4836596 - DNA, 23 bp, Homo sapiens
tcagaaagggcagcccctcccca

SEQ ID NO: 4836597 - DNA, 14 bp, Homo sapiens
tcagaagaaaatta

SEQ ID NO: 4836598 - DNA, 22 bp, Homo sapiens
tcagaagatctttcttaataga

SEQ ID NO: 4836599 - DNA, 14 bp, Homo sapiens
tcagaagtgaaaaa

SEQ ID NO: 4836600 - DNA, 17 bp, Homo sapiens
tcagaagtgaaaaagac

SEQ ID NO: 4836601 - DNA, 22 bp, Homo sapiens
tcagaattgaaccgtcaatgtg

SEQ ID NO: 4836602 - DNA, 23 bp, Homo sapiens
tcagacacacggggcacccagcc

SEQ ID NO: 4836603 - DNA, 17 bp, Homo sapiens
tcagacacctagactct

SEQ ID NO: 4836604 - DNA, 20 bp, Homo sapiens
tcagacacctagactctaaa

SEQ ID NO: 4836605 - DNA, 14 bp, Homo sapiens
tcagactctctcct

SEQ ID NO: 4836606 - DNA, 16 bp, Homo sapiens
tcagactctctcctct

SEQ ID NO: 4836607 - DNA, 20 bp, Homo sapiens
tcagactctttagttgattt

SEQ ID NO: 4836608 - DNA, 15 bp, Homo sapiens
tcagactgcttcatt

SEQ ID NO: 4836609 - DNA, 17 bp, Homo sapiens
tcagactgcttcattgg

SEQ ID NO: 4836610 - DNA, 23 bp, Homo sapiens
tcagagatgtccatttttacaag

SEQ ID NO: 4836611 - DNA, 12 bp, Homo sapiens
tcagagcccagg

SEQ ID NO: 4836612 - DNA, 16 bp, Homo sapiens
tcagaggagaggagca

SEQ ID NO: 4836613 - DNA, 19 bp, Homo sapiens
tcagagtgtatttttgtaa

SEQ ID NO: 4836614 - DNA, 14 bp, Homo sapiens
tcagagttctctgt

SEQ ID NO: 4836615 - DNA, 13 bp, Homo sapiens
tcagataaatcat

SEQ ID NO: 4836616 - DNA, 14 bp, Homo sapiens
tcagataaatcatg

SEQ ID NO: 4836617 - DNA, 21 bp, Homo sapiens
tcagataaatcatgggcattg

SEQ ID NO: 4836618 - DNA, 12 bp, Homo sapiens
tcagatccctcg

SEQ ID NO: 4836619 - DNA, 16 bp, Homo sapiens
tcagatccctcggtca

SEQ ID NO: 4836620 - DNA, 15 bp, Homo sapiens
tcagatctgaagtag

SEQ ID NO: 4836621 - DNA, 22 bp, Homo sapiens
tcagatctgaagtagtgtgagt

SEQ ID NO: 4836622 - DNA, 16 bp, Homo sapiens
tcagattgtaaaggta

SEQ ID NO: 4836623 - DNA, 13 bp, Homo sapiens
tcagattgtatct

SEQ ID NO: 4836624 - DNA, 17 bp, Homo sapiens
tcagattgtatctgaac

SEQ ID NO: 4836625 - DNA, 14 bp, Homo sapiens
tcagcaaattcttg

SEQ ID NO: 4836626 - DNA, 20 bp, Homo sapiens
tcagcaaccctacagtatat

SEQ ID NO: 4836627 - DNA, 19 bp, Homo sapiens
tcagcaactgttagctggg

SEQ ID NO: 4836628 - DNA, 18 bp, Homo sapiens
tcagcaagacaatgacac

SEQ ID NO: 4836629 - DNA, 21 bp, Homo sapiens
tcagcaccgtggtgtgaggcc

SEQ ID NO: 4836630 - DNA, 23 bp, Homo sapiens
tcagcaccgtggtgtgaggcccc

SEQ ID NO: 4836631 - DNA, 11 bp, Homo sapiens
tcagcactgaa

SEQ ID NO: 4836632 - DNA, 16 bp, Homo sapiens
tcagcactgccaactc

SEQ ID NO: 4836633 - DNA, 13 bp, Homo sapiens
tcagcagacactc

SEQ ID NO: 4836634 - DNA, 15 bp, Homo sapiens
tcagcagacactcca

SEQ ID NO: 4836635 - DNA, 17 bp, Homo sapiens
tcagcagacactccagt

SEQ ID NO: 4836636 - DNA, 17 bp, Homo sapiens
tcagcagcggcagcagc

SEQ ID NO: 4836637 - DNA, 19 bp, Homo sapiens
tcagcagcggcagcagcag

SEQ ID NO: 4836638 - DNA, 23 bp, Homo sapiens
tcagcaggggggttgggttccag

SEQ ID NO: 4836639 - DNA, 17 bp, Homo sapiens
tcagcagttaccgagga

SEQ ID NO: 4836640 - DNA, 14 bp, Homo sapiens
tcagcatagagcta

SEQ ID NO: 4836641 - DNA, 19 bp, Homo sapiens
tcagcatcgtgtgggtccc

SEQ ID NO: 4836642 - DNA, 15 bp, Homo sapiens
tcagcattcccaatt

SEQ ID NO: 4836643 - DNA, 21 bp, Homo sapiens
tcagcattcccaattatcaaa

SEQ ID NO: 4836644 - DNA, 19 bp, Homo sapiens
tcagcccatgtcaatcaag

SEQ ID NO: 4836645 - DNA, 15 bp, Homo sapiens
tcagccccagacctg

SEQ ID NO: 4836646 - DNA, 14 bp, Homo sapiens
tcagccccagggcc

SEQ ID NO: 4836647 - DNA, 12 bp, Homo sapiens
tcagcgattcct

SEQ ID NO: 4836648 - DNA, 16 bp, Homo sapiens
tcagcgattcctgcca

SEQ ID NO: 4836649 - DNA, 19 bp, Homo sapiens
tcagcgggagtctcctcac

SEQ ID NO: 4836650 - DNA, 21 bp, Homo sapiens
tcagctccactctgaagtccc

SEQ ID NO: 4836651 - DNA, 12 bp, Homo sapiens
tcagctgcttct

SEQ ID NO: 4836652 - DNA, 19 bp, Homo sapiens
tcagctgtgaatctgttga

SEQ ID NO: 4836653 - DNA, 22 bp, Homo sapiens
tcaggaaaggaagatgtaagaa

SEQ ID NO: 4836654 - DNA, 18 bp, Homo sapiens
tcaggaaatatctgtgaa

SEQ ID NO: 4836655 - DNA, 15 bp, Homo sapiens
tcaggaagagaagga

SEQ ID NO: 4836656 - DNA, 16 bp, Homo sapiens
tcaggaatgggccaag

SEQ ID NO: 4836657 - DNA, 22 bp, Homo sapiens
tcaggaatgggccaagccaggg

SEQ ID NO: 4836658 - DNA, 15 bp, Homo sapiens
tcaggaccaccctgc

SEQ ID NO: 4836659 - DNA, 16 bp, Homo sapiens
tcaggaccaccctgcc

SEQ ID NO: 4836660 - DNA, 15 bp, Homo sapiens
tcaggagaaacccct

SEQ ID NO: 4836661 - DNA, 22 bp, Homo sapiens
tcaggagcacagccatagcaga

SEQ ID NO: 4836662 - DNA, 11 bp, Homo sapiens
tcaggccctgg

SEQ ID NO: 4836663 - DNA, 13 bp, Homo sapiens
tcaggccctggaa

SEQ ID NO: 4836664 - DNA, 22 bp, Homo sapiens
tcaggcctcacctggcttccca

SEQ ID NO: 4836665 - DNA, 23 bp, Homo sapiens
tcaggcctcacctggcttcccag

SEQ ID NO: 4836666 - DNA, 15 bp, Homo sapiens
tcaggctccccaaga

SEQ ID NO: 4836667 - DNA, 14 bp, Homo sapiens
tcaggctgcccagc

SEQ ID NO: 4836668 - DNA, 16 bp, Homo sapiens
tcaggctgcccagcgg

SEQ ID NO: 4836669 - DNA, 14 bp, Homo sapiens
tcagggaccaagga

SEQ ID NO: 4836670 - DNA, 12 bp, Homo sapiens
tcagggcccaga

SEQ ID NO: 4836671 - DNA, 14 bp, Homo sapiens
tcagggcccagagg

SEQ ID NO: 4836672 - DNA, 18 bp, Homo sapiens
tcagggcccagaggctga

SEQ ID NO: 4836673 - DNA, 14 bp, Homo sapiens
tcagggctgtgctt

SEQ ID NO: 4836674 - DNA, 22 bp, Homo sapiens
tcagggtacaggaaaaaacatt

SEQ ID NO: 4836675 - DNA, 15 bp, Homo sapiens
tcaggtaaactgatg

SEQ ID NO: 4836676 - DNA, 17 bp, Homo sapiens
tcaggtcccctggccct

SEQ ID NO: 4836677 - DNA, 21 bp, Homo sapiens
tcaggtgcctcccagccctgc

SEQ ID NO: 4836678 - DNA, 23 bp, Homo sapiens
tcaggtgcctcccagccctgccc

SEQ ID NO: 4836679 - DNA, 18 bp, Homo sapiens
tcaggtggcatttgcagg

SEQ ID NO: 4836680 - DNA, 21 bp, Homo sapiens
tcaggtttccggctactgaca

SEQ ID NO: 4836681 - DNA, 18 bp, Homo sapiens
tcagtaaaattatactgt

SEQ ID NO: 4836682 - DNA, 19 bp, Homo sapiens
tcagtagcattttaatagt

SEQ ID NO: 4836683 - DNA, 18 bp, Homo sapiens
tcagtagtgcctgtgatc

SEQ ID NO: 4836684 - DNA, 14 bp, Homo sapiens
tcagtattgagaca

SEQ ID NO: 4836685 - DNA, 18 bp, Homo sapiens
tcagtattgagacactgt

SEQ ID NO: 4836686 - DNA, 20 bp, Homo sapiens
tcagtattgagacactgtca

SEQ ID NO: 4836687 - DNA, 15 bp, Homo sapiens
tcagtcatcatctca

SEQ ID NO: 4836688 - DNA, 23 bp, Homo sapiens
tcagtccacccccattgtgaatg

SEQ ID NO: 4836689 - DNA, 18 bp, Homo sapiens
tcagtccctccctcctgg

SEQ ID NO: 4836690 - DNA, 19 bp, Homo sapiens
tcagtccctccctcctggc

SEQ ID NO: 4836691 - DNA, 21 bp, Homo sapiens
tcagtccctccctcctggctc

SEQ ID NO: 4836692 - DNA, 22 bp, Homo sapiens
tcagtccctccctcctggctca

SEQ ID NO: 4836693 - DNA, 17 bp, Homo sapiens
tcagtcgatattcccag

SEQ ID NO: 4836694 - DNA, 16 bp, Homo sapiens
tcagtctatgctgtgt

SEQ ID NO: 4836695 - DNA, 19 bp, Homo sapiens
tcagtgaagcccaggagga

SEQ ID NO: 4836696 - DNA, 17 bp, Homo sapiens
tcagtgctagcttattt

SEQ ID NO: 4836697 - DNA, 11 bp, Homo sapiens
tcagtggatca

SEQ ID NO: 4836698 - DNA, 17 bp, Homo sapiens
tcagtgtgactgatctc

SEQ ID NO: 4836699 - DNA, 15 bp, Homo sapiens
tcagtgttataaaat

SEQ ID NO: 4836700 - DNA, 18 bp, Homo sapiens
tcagtgttataaaatctg

SEQ ID NO: 4836701 - DNA, 22 bp, Homo sapiens
tcagttaggattaggtttagaa

SEQ ID NO: 4836702 - DNA, 18 bp, Homo sapiens
tcagttattttgtcaccc

SEQ ID NO: 4836703 - DNA, 19 bp, Homo sapiens
tcagttctcatcttgtaaa

SEQ ID NO: 4836704 - DNA, 18 bp, Homo sapiens
tcagttggaattgaagac

SEQ ID NO: 4836705 - DNA, 17 bp, Homo sapiens
tcagttggcctctgccc

SEQ ID NO: 4836706 - DNA, 18 bp, Homo sapiens
tcagtttgtgaagtgatt

SEQ ID NO: 4836707 - DNA, 22 bp, Homo sapiens
tcataaagtgagaaaactgtga

SEQ ID NO: 4836708 - DNA, 24 bp, Homo sapiens
tcataaattcaaacctaagttgct

SEQ ID NO: 4836709 - DNA, 19 bp, Homo sapiens
tcataactagagtatgtgt

SEQ ID NO: 4836710 - DNA, 12 bp, Homo sapiens
tcataatgactt

SEQ ID NO: 4836711 - DNA, 21 bp, Homo sapiens
tcatacaaaggacagtacaca

SEQ ID NO: 4836712 - DNA, 15 bp, Homo sapiens
tcatacttaaaaatt

SEQ ID NO: 4836713 - DNA, 22 bp, Homo sapiens
tcatacttgctccttgaataag

SEQ ID NO: 4836714 - DNA, 12 bp, Homo sapiens
tcatagcacatg

SEQ ID NO: 4836715 - DNA, 21 bp, Homo sapiens
tcatagcacatgttttacaaa

SEQ ID NO: 4836716 - DNA, 15 bp, Homo sapiens
tcatataatttgcca

SEQ ID NO: 4836717 - DNA, 22 bp, Homo sapiens
tcatatattttatgaatcagaa

SEQ ID NO: 4836718 - DNA, 14 bp, Homo sapiens
tcatatcatttctt

SEQ ID NO: 4836719 - DNA, 12 bp, Homo sapiens
tcatatctgtat

SEQ ID NO: 4836720 - DNA, 13 bp, Homo sapiens
tcatatgtgaaga

SEQ ID NO: 4836721 - DNA, 14 bp, Homo sapiens
tcatcaaagtgttt

SEQ ID NO: 4836722 - DNA, 17 bp, Homo sapiens
tcatcaaagtgtttaat

SEQ ID NO: 4836723 - DNA, 22 bp, Homo sapiens
tcatcaaagtgtttaattgtat

SEQ ID NO: 4836724 - DNA, 22 bp, Homo sapiens
tcatcaacaaaagggagaacat

SEQ ID NO: 4836725 - DNA, 20 bp, Homo sapiens
tcatcactgaaatccctcta

SEQ ID NO: 4836726 - DNA, 13 bp, Homo sapiens
tcatccatagaca

SEQ ID NO: 4836727 - DNA, 19 bp, Homo sapiens
tcatcctcctcagatcttc

SEQ ID NO: 4836728 - DNA, 19 bp, Homo sapiens
tcatcggaggctgggcccc

SEQ ID NO: 4836729 - DNA, 15 bp, Homo sapiens
tcatctacacatata

SEQ ID NO: 4836730 - DNA, 16 bp, Homo sapiens
tcatctcaaacactgc

SEQ ID NO: 4836731 - DNA, 18 bp, Homo sapiens
tcatctcagctcactgca

SEQ ID NO: 4836732 - DNA, 22 bp, Homo sapiens
tcatctcaggtggcatttgcag

SEQ ID NO: 4836733 - DNA, 15 bp, Homo sapiens
tcatctccaaatctt

SEQ ID NO: 4836734 - DNA, 22 bp, Homo sapiens
tcatctgaggagtccaaaatat

SEQ ID NO: 4836735 - DNA, 17 bp, Homo sapiens
tcatctggagtccctcc

SEQ ID NO: 4836736 - DNA, 20 bp, Homo sapiens
tcatctgtaaaaccaggctg

SEQ ID NO: 4836737 - DNA, 18 bp, Homo sapiens
tcatgaccactgggcctg

SEQ ID NO: 4836738 - DNA, 14 bp, Homo sapiens
tcatgattagacaa

SEQ ID NO: 4836739 - DNA, 14 bp, Homo sapiens
tcatgcccagcttg

SEQ ID NO: 4836740 - DNA, 17 bp, Homo sapiens
tcatgcgcagtccccag

SEQ ID NO: 4836741 - DNA, 14 bp, Homo sapiens
tcatgctccttaat

SEQ ID NO: 4836742 - DNA, 17 bp, Homo sapiens
tcatgctgcctgccatg

SEQ ID NO: 4836743 - DNA, 14 bp, Homo sapiens
tcatgctgtctgtg

SEQ ID NO: 4836744 - DNA, 14 bp, Homo sapiens
tcatgcttttctca

SEQ ID NO: 4836745 - DNA, 21 bp, Homo sapiens
tcatggatttattttttgtaa

SEQ ID NO: 4836746 - DNA, 23 bp, Homo sapiens
tcatggatttattttttgtaact

SEQ ID NO: 4836747 - DNA, 14 bp, Homo sapiens
tcatgtaaataaat

SEQ ID NO: 4836748 - DNA, 16 bp, Homo sapiens
tcatgtgagaaagcag

SEQ ID NO: 4836749 - DNA, 13 bp, Homo sapiens
tcatgttctgtgt

SEQ ID NO: 4836750 - DNA, 14 bp, Homo sapiens
tcatgttctgtgtc

SEQ ID NO: 4836751 - DNA, 15 bp, Homo sapiens
tcatgttctgtgtca

SEQ ID NO: 4836752 - DNA, 17 bp, Homo sapiens
tcatgttgatgtgtccg

SEQ ID NO: 4836753 - DNA, 14 bp, Homo sapiens
tcatgtttaagaaa

SEQ ID NO: 4836754 - DNA, 14 bp, Homo sapiens
tcatgtttctgcag

SEQ ID NO: 4836755 - DNA, 14 bp, Homo sapiens
tcatgttttgctaa

SEQ ID NO: 4836756 - DNA, 12 bp, Homo sapiens
tcattaaaacaa

SEQ ID NO: 4836757 - DNA, 22 bp, Homo sapiens
tcattaaccttatcataaattc

SEQ ID NO: 4836758 - DNA, 15 bp, Homo sapiens
tcattaattaacccc

SEQ ID NO: 4836759 - DNA, 13 bp, Homo sapiens
tcattagctgtga

SEQ ID NO: 4836760 - DNA, 17 bp, Homo sapiens
tcattagctgtgatttt

SEQ ID NO: 4836761 - DNA, 15 bp, Homo sapiens
tcattatagcatgta

SEQ ID NO: 4836762 - DNA, 18 bp, Homo sapiens
tcattatagcatgtaata

SEQ ID NO: 4836763 - DNA, 15 bp, Homo sapiens
tcattattaccactt

SEQ ID NO: 4836764 - DNA, 16 bp, Homo sapiens
tcattcatactcaaag

SEQ ID NO: 4836765 - DNA, 15 bp, Homo sapiens
tcattcatacttaaa

SEQ ID NO: 4836766 - DNA, 22 bp, Homo sapiens
tcattcgtgggcctgctgctct

SEQ ID NO: 4836767 - DNA, 13 bp, Homo sapiens
tcattctcatcca

SEQ ID NO: 4836768 - DNA, 14 bp, Homo sapiens
tcattctcatccaa

SEQ ID NO: 4836769 - DNA, 16 bp, Homo sapiens
tcattctccttgtaaa

SEQ ID NO: 4836770 - DNA, 15 bp, Homo sapiens
tcattgcactgcagt

SEQ ID NO: 4836771 - DNA, 17 bp, Homo sapiens
tcattgggaagtatgat

SEQ ID NO: 4836772 - DNA, 22 bp, Homo sapiens
tcattgggccatgtttaagtgt

SEQ ID NO: 4836773 - DNA, 16 bp, Homo sapiens
tcattggttacaaatt

SEQ ID NO: 4836774 - DNA, 14 bp, Homo sapiens
tcattgtacagttt

SEQ ID NO: 4836775 - DNA, 21 bp, Homo sapiens
tcattgtcagagatgttttca

SEQ ID NO: 4836776 - DNA, 20 bp, Homo sapiens
tcattgtttgtcctttatgt

SEQ ID NO: 4836777 - DNA, 20 bp, Homo sapiens
tcatttatgttatttatgat

SEQ ID NO: 4836778 - DNA, 12 bp, Homo sapiens
tcatttccagca

SEQ ID NO: 4836779 - DNA, 21 bp, Homo sapiens
tcatttccagcaaaatatatg

SEQ ID NO: 4836780 - DNA, 18 bp, Homo sapiens
tcatttggatataaatct

SEQ ID NO: 4836781 - DNA, 11 bp, Homo sapiens
tcattttctct

SEQ ID NO: 4836782 - DNA, 16 bp, Homo sapiens
tcattttctctcctcg

SEQ ID NO: 4836783 - DNA, 14 bp, Homo sapiens
tcattttgcttccc

SEQ ID NO: 4836784 - DNA, 18 bp, Homo sapiens
tcattttttttttatcag

SEQ ID NO: 4836785 - DNA, 16 bp, Homo sapiens
tccaaaagtactagca

SEQ ID NO: 4836786 - DNA, 22 bp, Homo sapiens
tccaaaagtactagcaataagt

SEQ ID NO: 4836787 - DNA, 14 bp, Homo sapiens
tccaaaagtgacca

SEQ ID NO: 4836788 - DNA, 17 bp, Homo sapiens
tccaaaagtgaccagca

SEQ ID NO: 4836789 - DNA, 15 bp, Homo sapiens
tccaaacctacctta

SEQ ID NO: 4836790 - DNA, 19 bp, Homo sapiens
tccaaacctaccttataga

SEQ ID NO: 4836791 - DNA, 16 bp, Homo sapiens
tccaaacttaacagat

SEQ ID NO: 4836792 - DNA, 22 bp, Homo sapiens
tccaaagcctgggcagaaatgt

SEQ ID NO: 4836793 - DNA, 21 bp, Homo sapiens
tccaaaggttgtacatagtgg

SEQ ID NO: 4836794 - DNA, 20 bp, Homo sapiens
tccaacaactccaggaaaac

SEQ ID NO: 4836795 - DNA, 21 bp, Homo sapiens
tccaacccatgcatggcctcc

SEQ ID NO: 4836796 - DNA, 18 bp, Homo sapiens
tccaagaccttacaacca

SEQ ID NO: 4836797 - DNA, 19 bp, Homo sapiens
tccaagagaattcacttta

SEQ ID NO: 4836798 - DNA, 20 bp, Homo sapiens
tccaagcatcagcaagacaa

SEQ ID NO: 4836799 - DNA, 12 bp, Homo sapiens
tccaagccctgg

SEQ ID NO: 4836800 - DNA, 14 bp, Homo sapiens
tccaagccctgggg

SEQ ID NO: 4836801 - DNA, 18 bp, Homo sapiens
tccaagccctggggcagg

SEQ ID NO: 4836802 - DNA, 19 bp, Homo sapiens
tccaagtcatgggagaaga

SEQ ID NO: 4836803 - DNA, 21 bp, Homo sapiens
tccaagtcatgggagaagagg

SEQ ID NO: 4836804 - DNA, 15 bp, Homo sapiens
tccaagtgtgtgtgc

SEQ ID NO: 4836805 - DNA, 18 bp, Homo sapiens
tccaagtgtgtgtgcaat

SEQ ID NO: 4836806 - DNA, 21 bp, Homo sapiens
tccaagttatttgatctggtg

SEQ ID NO: 4836807 - DNA, 17 bp, Homo sapiens
tccaatagtctgccaca

SEQ ID NO: 4836808 - DNA, 23 bp, Homo sapiens
tccaatgtggtggcaataaatgt

SEQ ID NO: 4836809 - DNA, 14 bp, Homo sapiens
tccaatgtttcaag

SEQ ID NO: 4836810 - DNA, 17 bp, Homo sapiens
tccacaaatgtcctcag

SEQ ID NO: 4836811 - DNA, 20 bp, Homo sapiens
tccacaaatgtcctcagagg

SEQ ID NO: 4836812 - DNA, 19 bp, Homo sapiens
tccacaagagcccaggcct

SEQ ID NO: 4836813 - DNA, 16 bp, Homo sapiens
tccacaattttgtctc

SEQ ID NO: 4836814 - DNA, 16 bp, Homo sapiens
tccacacacagcagct

SEQ ID NO: 4836815 - DNA, 17 bp, Homo sapiens
tccacacacagcagctc

SEQ ID NO: 4836816 - DNA, 20 bp, Homo sapiens
tccacacacagcagctccaa

SEQ ID NO: 4836817 - DNA, 23 bp, Homo sapiens
tccacacacagcagctccaacct

SEQ ID NO: 4836818 - DNA, 18 bp, Homo sapiens
tccacagagttactgcca

SEQ ID NO: 4836819 - DNA, 23 bp, Homo sapiens
tccacagggacacagtctggtgc

SEQ ID NO: 4836820 - DNA, 12 bp, Homo sapiens
tccacagtattg

SEQ ID NO: 4836821 - DNA, 17 bp, Homo sapiens
tccacagtattgttctt

SEQ ID NO: 4836822 - DNA, 15 bp, Homo sapiens
tccacatacactgca

SEQ ID NO: 4836823 - DNA, 17 bp, Homo sapiens
tccacatccccaccctc

SEQ ID NO: 4836824 - DNA, 21 bp, Homo sapiens
tccacatccccaccctcccct

SEQ ID NO: 4836825 - DNA, 22 bp, Homo sapiens
tccacatgcacatgtattctgt

SEQ ID NO: 4836826 - DNA, 12 bp, Homo sapiens
tccacatgctct

SEQ ID NO: 4836827 - DNA, 23 bp, Homo sapiens
tccacccccattgtgaatgttgt

SEQ ID NO: 4836828 - DNA, 14 bp, Homo sapiens
tccaccctcccctc

SEQ ID NO: 4836829 - DNA, 17 bp, Homo sapiens
tccaccctcccctcttc

SEQ ID NO: 4836830 - DNA, 13 bp, Homo sapiens
tccaccctgagga

SEQ ID NO: 4836831 - DNA, 17 bp, Homo sapiens
tccaccctgaggagtga

SEQ ID NO: 4836832 - DNA, 16 bp, Homo sapiens
tccaccgcagaaggaa

SEQ ID NO: 4836833 - DNA, 17 bp, Homo sapiens
tccacctggaaagccag

SEQ ID NO: 4836834 - DNA, 19 bp, Homo sapiens
tccacctggtggccctgcg

SEQ ID NO: 4836835 - DNA, 16 bp, Homo sapiens
tccaccttctgccaag

SEQ ID NO: 4836836 - DNA, 18 bp, Homo sapiens
tccaccttctgccaaggc

SEQ ID NO: 4836837 - DNA, 19 bp, Homo sapiens
tccaccttctgccaaggcc

SEQ ID NO: 4836838 - DNA, 20 bp, Homo sapiens
tccacgcctcctggccagac

SEQ ID NO: 4836839 - DNA, 21 bp, Homo sapiens
tccacgtgtttcgggccaggg

SEQ ID NO: 4836840 - DNA, 13 bp, Homo sapiens
tccactcccctca

SEQ ID NO: 4836841 - DNA, 13 bp, Homo sapiens
tccactcctccca

SEQ ID NO: 4836842 - DNA, 17 bp, Homo sapiens
tccactgcctctgcctt

SEQ ID NO: 4836843 - DNA, 18 bp, Homo sapiens
tccactgcctctgcctta

SEQ ID NO: 4836844 - DNA, 19 bp, Homo sapiens
tccactgcctctgccttag

SEQ ID NO: 4836845 - DNA, 23 bp, Homo sapiens
tccacttcagggttctaaccttt

SEQ ID NO: 4836846 - DNA, 17 bp, Homo sapiens
tccacttctctagagaa

SEQ ID NO: 4836847 - DNA, 12 bp, Homo sapiens
tccactttcctc

SEQ ID NO: 4836848 - DNA, 13 bp, Homo sapiens
tccactttcctct

SEQ ID NO: 4836849 - DNA, 17 bp, Homo sapiens
tccactttcctctctct

SEQ ID NO: 4836850 - DNA, 18 bp, Homo sapiens
tccagaaaaatcaatcat

SEQ ID NO: 4836851 - DNA, 14 bp, Homo sapiens
tccagaactgtctt

SEQ ID NO: 4836852 - DNA, 16 bp, Homo sapiens
tccagaagcagcagct

SEQ ID NO: 4836853 - DNA, 20 bp, Homo sapiens
tccagaatttcccaaagcag

SEQ ID NO: 4836854 - DNA, 20 bp, Homo sapiens
tccagacatacgaaacacaa

SEQ ID NO: 4836855 - DNA, 9 bp, Homo sapiens
tccagaccc

SEQ ID NO: 4836856 - DNA, 14 bp, Homo sapiens
tccagacccctacc

SEQ ID NO: 4836857 - DNA, 16 bp, Homo sapiens
tccagactcgagaggg

SEQ ID NO: 4836858 - DNA, 22 bp, Homo sapiens
tccagactcgagagggctgagc

SEQ ID NO: 4836859 - DNA, 22 bp, Homo sapiens
tccagacttcgctattcccagg

SEQ ID NO: 4836860 - DNA, 16 bp, Homo sapiens
tccagagacctgctcc

SEQ ID NO: 4836861 - DNA, 20 bp, Homo sapiens
tccagagacctgctccagat

SEQ ID NO: 4836862 - DNA, 10 bp, Homo sapiens
tccagagaga

SEQ ID NO: 4836863 - DNA, 13 bp, Homo sapiens
tccagagagaagc

SEQ ID NO: 4836864 - DNA, 17 bp, Homo sapiens
tccagagcactgctcca

SEQ ID NO: 4836865 - DNA, 16 bp, Homo sapiens
tccagattattttcta

SEQ ID NO: 4836866 - DNA, 19 bp, Homo sapiens
tccagcaggtgttttcctt

SEQ ID NO: 4836867 - DNA, 18 bp, Homo sapiens
tccagccctccgccagcc

SEQ ID NO: 4836868 - DNA, 21 bp, Homo sapiens
tccagccctccgccagccctg

SEQ ID NO: 4836869 - DNA, 16 bp, Homo sapiens
tccagccctgggcaca

SEQ ID NO: 4836870 - DNA, 21 bp, Homo sapiens
tccagccgcaaatccataccc

SEQ ID NO: 4836871 - DNA, 22 bp, Homo sapiens
tccagccttcttcccccagggt

SEQ ID NO: 4836872 - DNA, 20 bp, Homo sapiens
tccagcggggcttctgggcg

SEQ ID NO: 4836873 - DNA, 21 bp, Homo sapiens
tccagcggggcttctgggcgc

SEQ ID NO: 4836874 - DNA, 17 bp, Homo sapiens
tccagctcagtcccaca

SEQ ID NO: 4836875 - DNA, 19 bp, Homo sapiens
tccagctcagtcccacagc

SEQ ID NO: 4836876 - DNA, 13 bp, Homo sapiens
tccaggacccctg

SEQ ID NO: 4836877 - DNA, 20 bp, Homo sapiens
tccaggattgtccacaaatg

SEQ ID NO: 4836878 - DNA, 22 bp, Homo sapiens
tccaggattgtccacaaatgtc

SEQ ID NO: 4836879 - DNA, 12 bp, Homo sapiens
tccaggcccagc

SEQ ID NO: 4836880 - DNA, 20 bp, Homo sapiens
tccaggcccagcctggcccc

SEQ ID NO: 4836881 - DNA, 19 bp, Homo sapiens
tccaggctagtccggaccc

SEQ ID NO: 4836882 - DNA, 21 bp, Homo sapiens
tccaggctgggaggggaagag

SEQ ID NO: 4836883 - DNA, 18 bp, Homo sapiens
tccagggtccagccctcc

SEQ ID NO: 4836884 - DNA, 19 bp, Homo sapiens
tccaggttccatccaccac

SEQ ID NO: 4836885 - DNA, 14 bp, Homo sapiens
tccagtagctccgc

SEQ ID NO: 4836886 - DNA, 14 bp, Homo sapiens
tccagtataaatta

SEQ ID NO: 4836887 - DNA, 17 bp, Homo sapiens
tccagtataaattacat

SEQ ID NO: 4836888 - DNA, 22 bp, Homo sapiens
tccagtataaattacatgcatg

SEQ ID NO: 4836889 - DNA, 13 bp, Homo sapiens
tccagtcaggatg

SEQ ID NO: 4836890 - DNA, 18 bp, Homo sapiens
tccagtccccctatcctt

SEQ ID NO: 4836891 - DNA, 18 bp, Homo sapiens
tccagtgcagtagtgcca

SEQ ID NO: 4836892 - DNA, 21 bp, Homo sapiens
tccagtgctttatccacattg

SEQ ID NO: 4836893 - DNA, 14 bp, Homo sapiens
tccagttctgatga

SEQ ID NO: 4836894 - DNA, 21 bp, Homo sapiens
tccagtttctcttaagctgcc

SEQ ID NO: 4836895 - DNA, 15 bp, Homo sapiens
tccagtttgcccacc

SEQ ID NO: 4836896 - DNA, 22 bp, Homo sapiens
tccataccccctgccccagaga

SEQ ID NO: 4836897 - DNA, 14 bp, Homo sapiens
tccatagacacagt

SEQ ID NO: 4836898 - DNA, 23 bp, Homo sapiens
tccatagacacagtattgacttc

SEQ ID NO: 4836899 - DNA, 15 bp, Homo sapiens
tccatatcagctctg

SEQ ID NO: 4836900 - DNA, 13 bp, Homo sapiens
tccatatgctctt

SEQ ID NO: 4836901 - DNA, 14 bp, Homo sapiens
tccatcaaagccct

SEQ ID NO: 4836902 - DNA, 20 bp, Homo sapiens
tccatccacacacagcagct

SEQ ID NO: 4836903 - DNA, 21 bp, Homo sapiens
tccatccacacacagcagctc

SEQ ID NO: 4836904 - DNA, 22 bp, Homo sapiens
tccatccacacacagcagctcc

SEQ ID NO: 4836905 - DNA, 23 bp, Homo sapiens
tccatccacacacagcagctcca

SEQ ID NO: 4836906 - DNA, 13 bp, Homo sapiens
tccatccaccacc

SEQ ID NO: 4836907 - DNA, 17 bp, Homo sapiens
tccatccctggtgaaag

SEQ ID NO: 4836908 - DNA, 20 bp, Homo sapiens
tccatccctggtgaaagagt

SEQ ID NO: 4836909 - DNA, 13 bp, Homo sapiens
tccatccgtctct

SEQ ID NO: 4836910 - DNA, 17 bp, Homo sapiens
tccatccttttgcttca

SEQ ID NO: 4836911 - DNA, 22 bp, Homo sapiens
tccatcgatttgtattaatgta

SEQ ID NO: 4836912 - DNA, 19 bp, Homo sapiens
tccatctcttgtaccagcc

SEQ ID NO: 4836913 - DNA, 20 bp, Homo sapiens
tccatctcttgtaccagccc

SEQ ID NO: 4836914 - DNA, 12 bp, Homo sapiens
tccatgcacagg

SEQ ID NO: 4836915 - DNA, 21 bp, Homo sapiens
tccatgcacaggaaaagggca

SEQ ID NO: 4836916 - DNA, 13 bp, Homo sapiens
tccatgcaccaaa

SEQ ID NO: 4836917 - DNA, 20 bp, Homo sapiens
tccatgctcctcactgcccg

SEQ ID NO: 4836918 - DNA, 21 bp, Homo sapiens
tccatgctcctcactgcccgc

SEQ ID NO: 4836919 - DNA, 22 bp, Homo sapiens
tccatgctctttcaccctgcca

SEQ ID NO: 4836920 - DNA, 18 bp, Homo sapiens
tccatgctgtccctgtgg

SEQ ID NO: 4836921 - DNA, 22 bp, Homo sapiens
tccatgctgtccctgtgggctc

SEQ ID NO: 4836922 - DNA, 21 bp, Homo sapiens
tccatggtgaactgaagcaga

SEQ ID NO: 4836923 - DNA, 18 bp, Homo sapiens
tccatggtggtttcagaa

SEQ ID NO: 4836924 - DNA, 23 bp, Homo sapiens
tccatggtggtttcagaaagggc

SEQ ID NO: 4836925 - DNA, 16 bp, Homo sapiens
tccatgtgataattgt

SEQ ID NO: 4836926 - DNA, 18 bp, Homo sapiens
tccatgtgtcccccctgt

SEQ ID NO: 4836927 - DNA, 19 bp, Homo sapiens
tccatgtgtcccccctgtg

SEQ ID NO: 4836928 - DNA, 21 bp, Homo sapiens
tccatgtgtcccccctgtggt

SEQ ID NO: 4836929 - DNA, 22 bp, Homo sapiens
tccattaaacttctactgagca

SEQ ID NO: 4836930 - DNA, 23 bp, Homo sapiens
tccattaaacttctactgagcaa

SEQ ID NO: 4836931 - DNA, 21 bp, Homo sapiens
tccattaatgtagataaagca

SEQ ID NO: 4836932 - DNA, 19 bp, Homo sapiens
tccattaatttaaatgatt

SEQ ID NO: 4836933 - DNA, 21 bp, Homo sapiens
tccattaatttaaatgattta

SEQ ID NO: 4836934 - DNA, 22 bp, Homo sapiens
tccattaatttaaatgatttaa

SEQ ID NO: 4836935 - DNA, 18 bp, Homo sapiens
tccattcagtctgcagct

SEQ ID NO: 4836936 - DNA, 19 bp, Homo sapiens
tccattcagtctgcagcta

SEQ ID NO: 4836937 - DNA, 21 bp, Homo sapiens
tccattctatgactcttgtct

SEQ ID NO: 4836938 - DNA, 21 bp, Homo sapiens
tccatttaaaacaagctgata

SEQ ID NO: 4836939 - DNA, 17 bp, Homo sapiens
tccatttaaacccggct

SEQ ID NO: 4836940 - DNA, 15 bp, Homo sapiens
tccatttggatttta

SEQ ID NO: 4836941 - DNA, 21 bp, Homo sapiens
tccatttggattttaaacaaa

SEQ ID NO: 4836942 - DNA, 15 bp, Homo sapiens
tccattttggaaaat

SEQ ID NO: 4836943 - DNA, 15 bp, Homo sapiens
tccatttttacaagt

SEQ ID NO: 4836944 - DNA, 18 bp, Homo sapiens
tcccaaagcagtgcatgc

SEQ ID NO: 4836945 - DNA, 21 bp, Homo sapiens
tcccaaagtcctgggattaca

SEQ ID NO: 4836946 - DNA, 19 bp, Homo sapiens
tcccaacaatactttgtgt

SEQ ID NO: 4836947 - DNA, 17 bp, Homo sapiens
tcccaacagttttacct

SEQ ID NO: 4836948 - DNA, 23 bp, Homo sapiens
tcccaacctcccctggtcctgca

SEQ ID NO: 4836949 - DNA, 21 bp, Homo sapiens
tcccaacgtactcctcagacg

SEQ ID NO: 4836950 - DNA, 20 bp, Homo sapiens
tcccaactctggccttggtt

SEQ ID NO: 4836951 - DNA, 22 bp, Homo sapiens
tcccaagtcaaacagtgtggct

SEQ ID NO: 4836952 - DNA, 21 bp, Homo sapiens
tcccaattatcaaaaaacaga

SEQ ID NO: 4836953 - DNA, 21 bp, Homo sapiens
tcccacaaataagttcccatt

SEQ ID NO: 4836954 - DNA, 23 bp, Homo sapiens
tcccacaagactggtattctctt

SEQ ID NO: 4836955 - DNA, 16 bp, Homo sapiens
tcccacactgtgaact

SEQ ID NO: 4836956 - DNA, 17 bp, Homo sapiens
tcccacagccccttgct

SEQ ID NO: 4836957 - DNA, 17 bp, Homo sapiens
tcccacctccagtcccc

SEQ ID NO: 4836958 - DNA, 15 bp, Homo sapiens
tcccacctccctgcc

SEQ ID NO: 4836959 - DNA, 20 bp, Homo sapiens
tcccacctccctgcccaggc

SEQ ID NO: 4836960 - DNA, 17 bp, Homo sapiens
tcccacctcggacacca

SEQ ID NO: 4836961 - DNA, 15 bp, Homo sapiens
tcccacctgtcaacc

SEQ ID NO: 4836962 - DNA, 19 bp, Homo sapiens
tcccacgtagcaaatcgta

SEQ ID NO: 4836963 - DNA, 21 bp, Homo sapiens
tcccactgatatcacgggccc

SEQ ID NO: 4836964 - DNA, 21 bp, Homo sapiens
tcccacttcagcctcccaagc

SEQ ID NO: 4836965 - DNA, 20 bp, Homo sapiens
tcccacttccccatctgtgt

SEQ ID NO: 4836966 - DNA, 19 bp, Homo sapiens
tcccagaaccttgatgggg

SEQ ID NO: 4836967 - DNA, 20 bp, Homo sapiens
tcccagcaaagttttcagat

SEQ ID NO: 4836968 - DNA, 16 bp, Homo sapiens
tcccagccctgcccag

SEQ ID NO: 4836969 - DNA, 22 bp, Homo sapiens
tcccagcgcatggcgccccggg

SEQ ID NO: 4836970 - DNA, 11 bp, Homo sapiens
tcccagctgct

SEQ ID NO: 4836971 - DNA, 15 bp, Homo sapiens
tcccagctggcagcg

SEQ ID NO: 4836972 - DNA, 18 bp, Homo sapiens
tcccagctggcagcgcct

SEQ ID NO: 4836973 - DNA, 18 bp, Homo sapiens
tcccagctgtaccggcca

SEQ ID NO: 4836974 - DNA, 13 bp, Homo sapiens
tcccagcttcccg

SEQ ID NO: 4836975 - DNA, 13 bp, Homo sapiens
tcccaggaccctg

SEQ ID NO: 4836976 - DNA, 16 bp, Homo sapiens
tcccaggaccctgggt

SEQ ID NO: 4836977 - DNA, 16 bp, Homo sapiens
tcccaggcactctctt

SEQ ID NO: 4836978 - DNA, 12 bp, Homo sapiens
tcccaggcaggg

SEQ ID NO: 4836979 - DNA, 20 bp, Homo sapiens
tcccagggccgcttctcctg

SEQ ID NO: 4836980 - DNA, 12 bp, Homo sapiens
tcccagggtcct

SEQ ID NO: 4836981 - DNA, 19 bp, Homo sapiens
tcccagtccggtgccttcc

SEQ ID NO: 4836982 - DNA, 21 bp, Homo sapiens
tcccagtccggtgccttccac

SEQ ID NO: 4836983 - DNA, 12 bp, Homo sapiens
tcccagtgtctg

SEQ ID NO: 4836984 - DNA, 16 bp, Homo sapiens
tcccagtgtctggccc

SEQ ID NO: 4836985 - DNA, 22 bp, Homo sapiens
tcccatatgcctgggcagaagg

SEQ ID NO: 4836986 - DNA, 23 bp, Homo sapiens
tcccatttccttgtctaaagatc

SEQ ID NO: 4836987 - DNA, 14 bp, Homo sapiens
tccccaaggcactg

SEQ ID NO: 4836988 - DNA, 15 bp, Homo sapiens
tccccaatccaaccc

SEQ ID NO: 4836989 - DNA, 18 bp, Homo sapiens
tccccaccctcccctctc

SEQ ID NO: 4836990 - DNA, 16 bp, Homo sapiens
tccccatatataaatt

SEQ ID NO: 4836991 - DNA, 22 bp, Homo sapiens
tccccatatataaattattact

SEQ ID NO: 4836992 - DNA, 18 bp, Homo sapiens
tccccatcgccttctggc

SEQ ID NO: 4836993 - DNA, 20 bp, Homo sapiens
tccccatggaacagccctgc

SEQ ID NO: 4836994 - DNA, 17 bp, Homo sapiens
tcccccacgcctccatc

SEQ ID NO: 4836995 - DNA, 21 bp, Homo sapiens
tcccccacgcctccatccaca

SEQ ID NO: 4836996 - DNA, 17 bp, Homo sapiens
tcccccacggccgtccc

SEQ ID NO: 4836997 - DNA, 17 bp, Homo sapiens
tcccccaggctgcgcct

SEQ ID NO: 4836998 - DNA, 21 bp, Homo sapiens
tcccccaggctgcgcctgccc

SEQ ID NO: 4836999 - DNA, 18 bp, Homo sapiens
tcccccagggtcccctgc

SEQ ID NO: 4837000 - DNA, 21 bp, Homo sapiens
tcccccctgtggtctgtgtgt

SEQ ID NO: 4837001 - DNA, 19 bp, Homo sapiens
tcccccgcagacagacaga

SEQ ID NO: 4837002 - DNA, 20 bp, Homo sapiens
tccccctacagatcctccgc

SEQ ID NO: 4837003 - DNA, 22 bp, Homo sapiens
tccccctcagatgatctctcca

SEQ ID NO: 4837004 - DNA, 12 bp, Homo sapiens
tccccctcagct

SEQ ID NO: 4837005 - DNA, 20 bp, Homo sapiens
tccccgcactgggcttgggg

SEQ ID NO: 4837006 - DNA, 21 bp, Homo sapiens
tccccgcccgccctcctctgc

SEQ ID NO: 4837007 - DNA, 21 bp, Homo sapiens
tccccgccgccggaatgaatg

SEQ ID NO: 4837008 - DNA, 20 bp, Homo sapiens
tccccggacgcatgcagggc

SEQ ID NO: 4837009 - DNA, 18 bp, Homo sapiens
tccccggacgctggctcg

SEQ ID NO: 4837010 - DNA, 20 bp, Homo sapiens
tccccgtgcggcccgtgcgc

SEQ ID NO: 4837011 - DNA, 17 bp, Homo sapiens
tcccctaacctgggttg

SEQ ID NO: 4837012 - DNA, 14 bp, Homo sapiens
tcccctcactctgt

SEQ ID NO: 4837013 - DNA, 16 bp, Homo sapiens
tcccctcactctgtca

SEQ ID NO: 4837014 - DNA, 21 bp, Homo sapiens
tcccctccagacccctaccct

SEQ ID NO: 4837015 - DNA, 13 bp, Homo sapiens
tcccctcctcgcc

SEQ ID NO: 4837016 - DNA, 19 bp, Homo sapiens
tcccctcgcttcataggca

SEQ ID NO: 4837017 - DNA, 21 bp, Homo sapiens
tcccctcgcttcataggcaga

SEQ ID NO: 4837018 - DNA, 21 bp, Homo sapiens
tcccctctgccggtcccccat

SEQ ID NO: 4837019 - DNA, 16 bp, Homo sapiens
tcccctgcaagtggac

SEQ ID NO: 4837020 - DNA, 20 bp, Homo sapiens
tcccctggaagttgtccttt

SEQ ID NO: 4837021 - DNA, 19 bp, Homo sapiens
tcccctggcccttccttca

SEQ ID NO: 4837022 - DNA, 17 bp, Homo sapiens
tcccctggtcctgcact

SEQ ID NO: 4837023 - DNA, 18 bp, Homo sapiens
tcccctggtcctgcactg

SEQ ID NO: 4837024 - DNA, 14 bp, Homo sapiens
tcccctggtgcccc

SEQ ID NO: 4837025 - DNA, 17 bp, Homo sapiens
tcccctgtggtttgtta

SEQ ID NO: 4837026 - DNA, 12 bp, Homo sapiens
tcccgaggcagc

SEQ ID NO: 4837027 - DNA, 16 bp, Homo sapiens
tcccgaggcagcaaca

SEQ ID NO: 4837028 - DNA, 22 bp, Homo sapiens
tcccgaggcagcaacaggacca

SEQ ID NO: 4837029 - DNA, 18 bp, Homo sapiens
tcccgagggcgcctgggt

SEQ ID NO: 4837030 - DNA, 19 bp, Homo sapiens
tcccgagggcgcctgggtc

SEQ ID NO: 4837031 - DNA, 17 bp, Homo sapiens
tcccgcatgctgcctgc

SEQ ID NO: 4837032 - DNA, 15 bp, Homo sapiens
tcccgccagggagtg

SEQ ID NO: 4837033 - DNA, 17 bp, Homo sapiens
tcccggaggccttccct

SEQ ID NO: 4837034 - DNA, 14 bp, Homo sapiens
tcccggccccgcgc

SEQ ID NO: 4837035 - DNA, 19 bp, Homo sapiens
tcccggccccgcgcgtgcc

SEQ ID NO: 4837036 - DNA, 20 bp, Homo sapiens
tcccggggtgcccgtgtggc

SEQ ID NO: 4837037 - DNA, 22 bp, Homo sapiens
tcccggggtgcccgtgtggcct

SEQ ID NO: 4837038 - DNA, 23 bp, Homo sapiens
tcccggggtgcccgtgtggcctg

SEQ ID NO: 4837039 - DNA, 17 bp, Homo sapiens
tcccggtgtatgcagtg

SEQ ID NO: 4837040 - DNA, 15 bp, Homo sapiens
tcccggtgtgcagcg

SEQ ID NO: 4837041 - DNA, 13 bp, Homo sapiens
tccctaaacatag

SEQ ID NO: 4837042 - DNA, 15 bp, Homo sapiens
tccctaaacatagtg

SEQ ID NO: 4837043 - DNA, 19 bp, Homo sapiens
tccctaattctcttcgctg

SEQ ID NO: 4837044 - DNA, 20 bp, Homo sapiens
tccctaattctcttcgctgt

SEQ ID NO: 4837045 - DNA, 20 bp, Homo sapiens
tccctacttagacccagtca

SEQ ID NO: 4837046 - DNA, 13 bp, Homo sapiens
tccctagttcttt

SEQ ID NO: 4837047 - DNA, 16 bp, Homo sapiens
tccctcagccctcatt

SEQ ID NO: 4837048 - DNA, 15 bp, Homo sapiens
tccctcatgcagata

SEQ ID NO: 4837049 - DNA, 9 bp, Homo sapiens
tccctccac

SEQ ID NO: 4837050 - DNA, 12 bp, Homo sapiens
tccctccacacc

SEQ ID NO: 4837051 - DNA, 15 bp, Homo sapiens
tccctccacacctcc

SEQ ID NO: 4837052 - DNA, 18 bp, Homo sapiens
tccctccacacctccacc

SEQ ID NO: 4837053 - DNA, 19 bp, Homo sapiens
tccctccacacctccaccc

SEQ ID NO: 4837054 - DNA, 20 bp, Homo sapiens
tccctccacacctccacccg

SEQ ID NO: 4837055 - DNA, 14 bp, Homo sapiens
tccctccaccccag

SEQ ID NO: 4837056 - DNA, 19 bp, Homo sapiens
tccctccaccccagtcccc

SEQ ID NO: 4837057 - DNA, 21 bp, Homo sapiens
tccctccacgcttagggtctg

SEQ ID NO: 4837058 - DNA, 22 bp, Homo sapiens
tccctccacgcttagggtctgt

SEQ ID NO: 4837059 - DNA, 14 bp, Homo sapiens
tccctccactcctc

SEQ ID NO: 4837060 - DNA, 18 bp, Homo sapiens
tccctccactcctcccaa

SEQ ID NO: 4837061 - DNA, 15 bp, Homo sapiens
tccctccctccacac

SEQ ID NO: 4837062 - DNA, 17 bp, Homo sapiens
tccctccctccacacct

SEQ ID NO: 4837063 - DNA, 16 bp, Homo sapiens
tccctccctccctgct

SEQ ID NO: 4837064 - DNA, 18 bp, Homo sapiens
tccctccgaacgctgctc

SEQ ID NO: 4837065 - DNA, 22 bp, Homo sapiens
tccctcctcccccacgcctcca

SEQ ID NO: 4837066 - DNA, 16 bp, Homo sapiens
tccctcctggctcaca

SEQ ID NO: 4837067 - DNA, 20 bp, Homo sapiens
tccctcctggctcacagcca

SEQ ID NO: 4837068 - DNA, 17 bp, Homo sapiens
tccctctcgctcccctc

SEQ ID NO: 4837069 - DNA, 16 bp, Homo sapiens
tccctgaacactcatc

SEQ ID NO: 4837070 - DNA, 18 bp, Homo sapiens
tccctgaacactcatccc

SEQ ID NO: 4837071 - DNA, 17 bp, Homo sapiens
tccctgactccctgtgg

SEQ ID NO: 4837072 - DNA, 19 bp, Homo sapiens
tccctgactccctgtgggg

SEQ ID NO: 4837073 - DNA, 13 bp, Homo sapiens
tccctgacttccc

SEQ ID NO: 4837074 - DNA, 15 bp, Homo sapiens
tccctgacttcccag

SEQ ID NO: 4837075 - DNA, 19 bp, Homo sapiens
tccctgacttcccagctgg

SEQ ID NO: 4837076 - DNA, 14 bp, Homo sapiens
tccctgagggccct

SEQ ID NO: 4837077 - DNA, 16 bp, Homo sapiens
tccctgagggcccttc

SEQ ID NO: 4837078 - DNA, 19 bp, Homo sapiens
tccctgagggcccttccca

SEQ ID NO: 4837079 - DNA, 14 bp, Homo sapiens
tccctgcaaggtgc

SEQ ID NO: 4837080 - DNA, 12 bp, Homo sapiens
tccctgcagctt

SEQ ID NO: 4837081 - DNA, 12 bp, Homo sapiens
tccctgcccagg

SEQ ID NO: 4837082 - DNA, 15 bp, Homo sapiens
tccctgcgacggagg

SEQ ID NO: 4837083 - DNA, 18 bp, Homo sapiens
tccctgcgcgcagctggc

SEQ ID NO: 4837084 - DNA, 16 bp, Homo sapiens
tccctgctgagtggct

SEQ ID NO: 4837085 - DNA, 16 bp, Homo sapiens
tccctgctgccaggct

SEQ ID NO: 4837086 - DNA, 20 bp, Homo sapiens
tccctgggcccctccacgcc

SEQ ID NO: 4837087 - DNA, 16 bp, Homo sapiens
tccctggggaggaccc

SEQ ID NO: 4837088 - DNA, 21 bp, Homo sapiens
tccctggggaggacccctgcc

SEQ ID NO: 4837089 - DNA, 22 bp, Homo sapiens
tccctggggaggacccctgccc

SEQ ID NO: 4837090 - DNA, 13 bp, Homo sapiens
tccctggtgaaag

SEQ ID NO: 4837091 - DNA, 19 bp, Homo sapiens
tccctggtgaaagagtaaa

SEQ ID NO: 4837092 - DNA, 19 bp, Homo sapiens
tccctgtcccctcctcgcc

SEQ ID NO: 4837093 - DNA, 14 bp, Homo sapiens
tccctgtgggctca

SEQ ID NO: 4837094 - DNA, 21 bp, Homo sapiens
tccctgtgggctcacaccggc

SEQ ID NO: 4837095 - DNA, 22 bp, Homo sapiens
tccctgtgggggtggccatccc

SEQ ID NO: 4837096 - DNA, 12 bp, Homo sapiens
tccctgttcatt

SEQ ID NO: 4837097 - DNA, 17 bp, Homo sapiens
tcccttacgtgagtcct

SEQ ID NO: 4837098 - DNA, 21 bp, Homo sapiens
tcccttactttacctctctgt

SEQ ID NO: 4837099 - DNA, 13 bp, Homo sapiens
tcccttccactgc

SEQ ID NO: 4837100 - DNA, 17 bp, Homo sapiens
tcccttccactgcctct

SEQ ID NO: 4837101 - DNA, 18 bp, Homo sapiens
tcccttccactgcctctg

SEQ ID NO: 4837102 - DNA, 17 bp, Homo sapiens
tcccttcccttccactg

SEQ ID NO: 4837103 - DNA, 14 bp, Homo sapiens
tcccttccttatgc

SEQ ID NO: 4837104 - DNA, 21 bp, Homo sapiens
tcccttctctttggggctcct

SEQ ID NO: 4837105 - DNA, 18 bp, Homo sapiens
tcccttctggctgtcagt

SEQ ID NO: 4837106 - DNA, 23 bp, Homo sapiens
tcccttcttttcctgggtgctca

SEQ ID NO: 4837107 - DNA, 13 bp, Homo sapiens
tcccttggcccct

SEQ ID NO: 4837108 - DNA, 15 bp, Homo sapiens
tcccttggcccctct

SEQ ID NO: 4837109 - DNA, 16 bp, Homo sapiens
tcccttggcccctctc

SEQ ID NO: 4837110 - DNA, 17 bp, Homo sapiens
tcccttggcccctctct

SEQ ID NO: 4837111 - DNA, 18 bp, Homo sapiens
tccctttacagctctcct

SEQ ID NO: 4837112 - DNA, 20 bp, Homo sapiens
tccctttatcatgtgtttct

SEQ ID NO: 4837113 - DNA, 13 bp, Homo sapiens
tccctttccctgc

SEQ ID NO: 4837114 - DNA, 15 bp, Homo sapiens
tccctttttgaattg

SEQ ID NO: 4837115 - DNA, 17 bp, Homo sapiens
tccctttttgaattgtg

SEQ ID NO: 4837116 - DNA, 21 bp, Homo sapiens
tccctttttgaattgtgtgga

SEQ ID NO: 4837117 - DNA, 20 bp, Homo sapiens
tccgaaaaaaaaatgttcat

SEQ ID NO: 4837118 - DNA, 23 bp, Homo sapiens
tccgaacgctgctccatgcacag

SEQ ID NO: 4837119 - DNA, 19 bp, Homo sapiens
tccgaagaccttctgaaga

SEQ ID NO: 4837120 - DNA, 22 bp, Homo sapiens
tccgacagtcaagacggatcca

SEQ ID NO: 4837121 - DNA, 14 bp, Homo sapiens
tccgagattcagac

SEQ ID NO: 4837122 - DNA, 13 bp, Homo sapiens
tccgagcccctgt

SEQ ID NO: 4837123 - DNA, 17 bp, Homo sapiens
tccgagcccctgtttct

SEQ ID NO: 4837124 - DNA, 16 bp, Homo sapiens
tccgcacgcggccgct

SEQ ID NO: 4837125 - DNA, 18 bp, Homo sapiens
tccgcacgcggccgctct

SEQ ID NO: 4837126 - DNA, 14 bp, Homo sapiens
tccgccagccctgt

SEQ ID NO: 4837127 - DNA, 19 bp, Homo sapiens
tccgccccccggcctggcc

SEQ ID NO: 4837128 - DNA, 19 bp, Homo sapiens
tccgccccgtgctcctctg

SEQ ID NO: 4837129 - DNA, 22 bp, Homo sapiens
tccgccccgtgctcctctgccc

SEQ ID NO: 4837130 - DNA, 14 bp, Homo sapiens
tccgcccgcccacc

SEQ ID NO: 4837131 - DNA, 17 bp, Homo sapiens
tccgcggaggcccctga

SEQ ID NO: 4837132 - DNA, 19 bp, Homo sapiens
tccgcgtggttctgccact

SEQ ID NO: 4837133 - DNA, 16 bp, Homo sapiens
tccgctgtcgccccag

SEQ ID NO: 4837134 - DNA, 22 bp, Homo sapiens
tccggatggaatcacagccaat

SEQ ID NO: 4837135 - DNA, 12 bp, Homo sapiens
tccggccctgcc

SEQ ID NO: 4837136 - DNA, 15 bp, Homo sapiens
tccggccctgcccca

SEQ ID NO: 4837137 - DNA, 13 bp, Homo sapiens
tccggcctgcagc

SEQ ID NO: 4837138 - DNA, 17 bp, Homo sapiens
tccggcctgcagcccag

SEQ ID NO: 4837139 - DNA, 14 bp, Homo sapiens
tccgggcagagacc

SEQ ID NO: 4837140 - DNA, 18 bp, Homo sapiens
tccgggcagagaccaccg

SEQ ID NO: 4837141 - DNA, 22 bp, Homo sapiens
tccgggtgcgtgaccggcccgc

SEQ ID NO: 4837142 - DNA, 20 bp, Homo sapiens
tccgggtgtggcctcagccc

SEQ ID NO: 4837143 - DNA, 22 bp, Homo sapiens
tccgggtgtggcctcagccctc

SEQ ID NO: 4837144 - DNA, 14 bp, Homo sapiens
tccggtgccttcca

SEQ ID NO: 4837145 - DNA, 20 bp, Homo sapiens
tccggtgccttccaccctgc

SEQ ID NO: 4837146 - DNA, 12 bp, Homo sapiens
tccgtccgcccg

SEQ ID NO: 4837147 - DNA, 15 bp, Homo sapiens
tccgtccgcccgccc

SEQ ID NO: 4837148 - DNA, 17 bp, Homo sapiens
tccgtccgcccgcccac

SEQ ID NO: 4837149 - DNA, 15 bp, Homo sapiens
tccgtgagacacaag

SEQ ID NO: 4837150 - DNA, 20 bp, Homo sapiens
tccgtgagagtcatctcaaa

SEQ ID NO: 4837151 - DNA, 17 bp, Homo sapiens
tccgtgggcagctcctc

SEQ ID NO: 4837152 - DNA, 12 bp, Homo sapiens
tccgtgtctgtt

SEQ ID NO: 4837153 - DNA, 16 bp, Homo sapiens
tccgttcatctgagga

SEQ ID NO: 4837154 - DNA, 23 bp, Homo sapiens
tcctaaactgagacaatgccttg

SEQ ID NO: 4837155 - DNA, 23 bp, Homo sapiens
tcctaaataatatcctgaataac

SEQ ID NO: 4837156 - DNA, 20 bp, Homo sapiens
tcctaattctatgattaaac

SEQ ID NO: 4837157 - DNA, 21 bp, Homo sapiens
tcctaattctatgattaaact

SEQ ID NO: 4837158 - DNA, 14 bp, Homo sapiens
tcctacttaaacaa

SEQ ID NO: 4837159 - DNA, 16 bp, Homo sapiens
tcctacttaaacaaaa

SEQ ID NO: 4837160 - DNA, 22 bp, Homo sapiens
tcctacttaaacaaaaactttc

SEQ ID NO: 4837161 - DNA, 18 bp, Homo sapiens
tcctactttacatatgct

SEQ ID NO: 4837162 - DNA, 15 bp, Homo sapiens
tcctagtttgacctc

SEQ ID NO: 4837163 - DNA, 13 bp, Homo sapiens
tcctatccccgga

SEQ ID NO: 4837164 - DNA, 16 bp, Homo sapiens
tcctatgagagaagag

SEQ ID NO: 4837165 - DNA, 15 bp, Homo sapiens
tcctattaatttatt

SEQ ID NO: 4837166 - DNA, 19 bp, Homo sapiens
tcctcaaaaatcatcaaag

SEQ ID NO: 4837167 - DNA, 24 bp, Homo sapiens
tcctcaaaacaggcctgagcgatg

SEQ ID NO: 4837168 - DNA, 21 bp, Homo sapiens
tcctcactgagaaggccccag

SEQ ID NO: 4837169 - DNA, 23 bp, Homo sapiens
tcctcactgagaaggccccaggg

SEQ ID NO: 4837170 - DNA, 14 bp, Homo sapiens
tcctcactgccact

SEQ ID NO: 4837171 - DNA, 19 bp, Homo sapiens
tcctcagcaagtgctgagt

SEQ ID NO: 4837172 - DNA, 12 bp, Homo sapiens
tcctcagcccca

SEQ ID NO: 4837173 - DNA, 13 bp, Homo sapiens
tcctcagccccag

SEQ ID NO: 4837174 - DNA, 23 bp, Homo sapiens
tcctcagccccagggccctgctc

SEQ ID NO: 4837175 - DNA, 14 bp, Homo sapiens
tcctcatctccatg

SEQ ID NO: 4837176 - DNA, 15 bp, Homo sapiens
tcctcatctccatgc

SEQ ID NO: 4837177 - DNA, 23 bp, Homo sapiens
tcctcatggctgttatctgtctt

SEQ ID NO: 4837178 - DNA, 24 bp, Homo sapiens
tcctcatgtgagaaagcagatcat

SEQ ID NO: 4837179 - DNA, 17 bp, Homo sapiens
tcctccaaatgctgtcg

SEQ ID NO: 4837180 - DNA, 15 bp, Homo sapiens
tcctccagagcctgg

SEQ ID NO: 4837181 - DNA, 17 bp, Homo sapiens
tcctccagagcctgggc

SEQ ID NO: 4837182 - DNA, 18 bp, Homo sapiens
tcctccagagcctgggcg

SEQ ID NO: 4837183 - DNA, 13 bp, Homo sapiens
tcctccagccctg

SEQ ID NO: 4837184 - DNA, 16 bp, Homo sapiens
tcctccagccctgggc

SEQ ID NO: 4837185 - DNA, 21 bp, Homo sapiens
tcctccaggaggactgttcta

SEQ ID NO: 4837186 - DNA, 17 bp, Homo sapiens
tcctcccaactctggcc

SEQ ID NO: 4837187 - DNA, 18 bp, Homo sapiens
tcctcccaactctggcct

SEQ ID NO: 4837188 - DNA, 19 bp, Homo sapiens
tcctcccaactctggcctt

SEQ ID NO: 4837189 - DNA, 22 bp, Homo sapiens
tcctcccaactctggccttggt

SEQ ID NO: 4837190 - DNA, 20 bp, Homo sapiens
tcctcccacttcagcctccc

SEQ ID NO: 4837191 - DNA, 19 bp, Homo sapiens
tcctcccccacgcctccat

SEQ ID NO: 4837192 - DNA, 16 bp, Homo sapiens
tcctccccctcctcca

SEQ ID NO: 4837193 - DNA, 17 bp, Homo sapiens
tcctccccctcctccat

SEQ ID NO: 4837194 - DNA, 16 bp, Homo sapiens
tcctccgtgggcagct

SEQ ID NO: 4837195 - DNA, 18 bp, Homo sapiens
tcctccgtgggcagctcc

SEQ ID NO: 4837196 - DNA, 16 bp, Homo sapiens
tcctcctgtctcctct

SEQ ID NO: 4837197 - DNA, 21 bp, Homo sapiens
tcctccttttcacagttctct

SEQ ID NO: 4837198 - DNA, 17 bp, Homo sapiens
tcctcgccccccgcccg

SEQ ID NO: 4837199 - DNA, 13 bp, Homo sapiens
tcctcggcagctc

SEQ ID NO: 4837200 - DNA, 12 bp, Homo sapiens
tcctcggccctg

SEQ ID NO: 4837201 - DNA, 17 bp, Homo sapiens
tcctcggccctgtagcc

SEQ ID NO: 4837202 - DNA, 18 bp, Homo sapiens
tcctcggccctgtagccc

SEQ ID NO: 4837203 - DNA, 21 bp, Homo sapiens
tcctcggccctgtagccctgg

SEQ ID NO: 4837204 - DNA, 22 bp, Homo sapiens
tcctcggccctgtagccctggc

SEQ ID NO: 4837205 - DNA, 18 bp, Homo sapiens
tcctcgggcgcctgcgct

SEQ ID NO: 4837206 - DNA, 14 bp, Homo sapiens
tcctcggtggcatt

SEQ ID NO: 4837207 - DNA, 20 bp, Homo sapiens
tcctcggtggcatttgctga

SEQ ID NO: 4837208 - DNA, 16 bp, Homo sapiens
tcctcgtccggcctgc

SEQ ID NO: 4837209 - DNA, 16 bp, Homo sapiens
tcctctcgagcccaga

SEQ ID NO: 4837210 - DNA, 22 bp, Homo sapiens
tcctctcgagcccagatggaaa

SEQ ID NO: 4837211 - DNA, 14 bp, Homo sapiens
tcctctctctccct

SEQ ID NO: 4837212 - DNA, 17 bp, Homo sapiens
tcctctctctccctcca

SEQ ID NO: 4837213 - DNA, 18 bp, Homo sapiens
tcctctctctccctccac

SEQ ID NO: 4837214 - DNA, 21 bp, Homo sapiens
tcctctctctctctctctctg

SEQ ID NO: 4837215 - DNA, 23 bp, Homo sapiens
tcctctgacagctgtcctgagct

SEQ ID NO: 4837216 - DNA, 11 bp, Homo sapiens
tcctctgcccc

SEQ ID NO: 4837217 - DNA, 14 bp, Homo sapiens
tcctctgccccctc

SEQ ID NO: 4837218 - DNA, 15 bp, Homo sapiens
tcctctgccccctcc

SEQ ID NO: 4837219 - DNA, 19 bp, Homo sapiens
tcctctgccccctcccccg

SEQ ID NO: 4837220 - DNA, 13 bp, Homo sapiens
tcctctggggctc

SEQ ID NO: 4837221 - DNA, 12 bp, Homo sapiens
tcctctgtcagt

SEQ ID NO: 4837222 - DNA, 18 bp, Homo sapiens
tcctctgtcagtttgtga

SEQ ID NO: 4837223 - DNA, 15 bp, Homo sapiens
tcctcttagaagaat

SEQ ID NO: 4837224 - DNA, 20 bp, Homo sapiens
tcctcttcaccccggcaggc

SEQ ID NO: 4837225 - DNA, 15 bp, Homo sapiens
tcctgaaataaaact

SEQ ID NO: 4837226 - DNA, 22 bp, Homo sapiens
tcctgacagcgccatgtgtgtc

SEQ ID NO: 4837227 - DNA, 21 bp, Homo sapiens
tcctgaccccaagttatccac

SEQ ID NO: 4837228 - DNA, 14 bp, Homo sapiens
tcctgagcctgtct

SEQ ID NO: 4837229 - DNA, 16 bp, Homo sapiens
tcctgagcctgtctct

SEQ ID NO: 4837230 - DNA, 13 bp, Homo sapiens
tcctgatgtcttg

SEQ ID NO: 4837231 - DNA, 20 bp, Homo sapiens
tcctgattatttatcacata

SEQ ID NO: 4837232 - DNA, 12 bp, Homo sapiens
tcctgcaccctc

SEQ ID NO: 4837233 - DNA, 14 bp, Homo sapiens
tcctgcaccctctg

SEQ ID NO: 4837234 - DNA, 14 bp, Homo sapiens
tcctgcactgtccc

SEQ ID NO: 4837235 - DNA, 15 bp, Homo sapiens
tcctgcatccctcca

SEQ ID NO: 4837236 - DNA, 23 bp, Homo sapiens
tcctgcatgtcggggcccctgcg

SEQ ID NO: 4837237 - DNA, 13 bp, Homo sapiens
tcctgcccatgtg

SEQ ID NO: 4837238 - DNA, 16 bp, Homo sapiens
tcctgcccatgtgtcc

SEQ ID NO: 4837239 - DNA, 17 bp, Homo sapiens
tcctgcccatgtgtccc

SEQ ID NO: 4837240 - DNA, 19 bp, Homo sapiens
tcctgcccatgtgtcccct

SEQ ID NO: 4837241 - DNA, 17 bp, Homo sapiens
tcctgcgcctgcgcctc

SEQ ID NO: 4837242 - DNA, 19 bp, Homo sapiens
tcctgcgcctgcgcctcct

SEQ ID NO: 4837243 - DNA, 22 bp, Homo sapiens
tcctgcgcctgcgcctcctcct

SEQ ID NO: 4837244 - DNA, 16 bp, Homo sapiens
tcctgcgggttttaat

SEQ ID NO: 4837245 - DNA, 21 bp, Homo sapiens
tcctgcgggttttaatttatt

SEQ ID NO: 4837246 - DNA, 21 bp, Homo sapiens
tcctgctcacgtctgtgagtc

SEQ ID NO: 4837247 - DNA, 21 bp, Homo sapiens
tcctgctgctcgggaaggcct

SEQ ID NO: 4837248 - DNA, 14 bp, Homo sapiens
tcctggagttctgg

SEQ ID NO: 4837249 - DNA, 14 bp, Homo sapiens
tcctggattcctct

SEQ ID NO: 4837250 - DNA, 11 bp, Homo sapiens
tcctggcctga

SEQ ID NO: 4837251 - DNA, 16 bp, Homo sapiens
tcctggctcacagcca

SEQ ID NO: 4837252 - DNA, 17 bp, Homo sapiens
tcctggctcacagccac

SEQ ID NO: 4837253 - DNA, 15 bp, Homo sapiens
tcctgggagacccat

SEQ ID NO: 4837254 - DNA, 16 bp, Homo sapiens
tcctgggcagcccaga

SEQ ID NO: 4837255 - DNA, 17 bp, Homo sapiens
tcctgggggctgctgca

SEQ ID NO: 4837256 - DNA, 18 bp, Homo sapiens
tcctgggggtggcaggca

SEQ ID NO: 4837257 - DNA, 15 bp, Homo sapiens
tcctgggtgctcagg

SEQ ID NO: 4837258 - DNA, 16 bp, Homo sapiens
tcctgggtgctgtcat

SEQ ID NO: 4837259 - DNA, 13 bp, Homo sapiens
tcctgtaactgtt

SEQ ID NO: 4837260 - DNA, 19 bp, Homo sapiens
tcctgtaactgttacagta

SEQ ID NO: 4837261 - DNA, 14 bp, Homo sapiens
tcctgtcctgctca

SEQ ID NO: 4837262 - DNA, 13 bp, Homo sapiens
tcctgtcctggct

SEQ ID NO: 4837263 - DNA, 15 bp, Homo sapiens
tcctgtctcttggga

SEQ ID NO: 4837264 - DNA, 10 bp, Homo sapiens
tcctgtgagg

SEQ ID NO: 4837265 - DNA, 21 bp, Homo sapiens
tcctgtgaggatagagacttg

SEQ ID NO: 4837266 - DNA, 14 bp, Homo sapiens
tcctgtgctttctg

SEQ ID NO: 4837267 - DNA, 16 bp, Homo sapiens
tcctgtgctttctgca

SEQ ID NO: 4837268 - DNA, 20 bp, Homo sapiens
tcctgtgctttctgcatgct

SEQ ID NO: 4837269 - DNA, 14 bp, Homo sapiens
tcctgtgtcatctg

SEQ ID NO: 4837270 - DNA, 17 bp, Homo sapiens
tcctgtgtcatctgtca

SEQ ID NO: 4837271 - DNA, 19 bp, Homo sapiens
tccttaaaaatgtatgttg

SEQ ID NO: 4837272 - DNA, 19 bp, Homo sapiens
tccttaacagctgtattat

SEQ ID NO: 4837273 - DNA, 14 bp, Homo sapiens
tccttaataactat

SEQ ID NO: 4837274 - DNA, 20 bp, Homo sapiens
tccttacagaagggagtgaa

SEQ ID NO: 4837275 - DNA, 20 bp, Homo sapiens
tccttagaatactgtattgt

SEQ ID NO: 4837276 - DNA, 15 bp, Homo sapiens
tccttagtaaattcc

SEQ ID NO: 4837277 - DNA, 12 bp, Homo sapiens
tccttatgcata

SEQ ID NO: 4837278 - DNA, 13 bp, Homo sapiens
tccttcaaagtct

SEQ ID NO: 4837279 - DNA, 15 bp, Homo sapiens
tccttcactccctgt

SEQ ID NO: 4837280 - DNA, 22 bp, Homo sapiens
tccttcactccctgtcatagtt

SEQ ID NO: 4837281 - DNA, 15 bp, Homo sapiens
tccttcactctgaca

SEQ ID NO: 4837282 - DNA, 13 bp, Homo sapiens
tccttcagcaatc

SEQ ID NO: 4837283 - DNA, 16 bp, Homo sapiens
tccttcatgcttttct

SEQ ID NO: 4837284 - DNA, 13 bp, Homo sapiens
tccttcccaaggc

SEQ ID NO: 4837285 - DNA, 17 bp, Homo sapiens
tccttcccaaggcagct

SEQ ID NO: 4837286 - DNA, 14 bp, Homo sapiens
tccttcccccagca

SEQ ID NO: 4837287 - DNA, 22 bp, Homo sapiens
tccttcccgcagcaccagcctg

SEQ ID NO: 4837288 - DNA, 23 bp, Homo sapiens
tccttcccgcagcaccagcctga

SEQ ID NO: 4837289 - DNA, 21 bp, Homo sapiens
tccttctcatcttgcctcatt

SEQ ID NO: 4837290 - DNA, 13 bp, Homo sapiens
tccttctcccctc

SEQ ID NO: 4837291 - DNA, 16 bp, Homo sapiens
tccttcttgctcagtc

SEQ ID NO: 4837292 - DNA, 19 bp, Homo sapiens
tccttcttgctcagtccct

SEQ ID NO: 4837293 - DNA, 18 bp, Homo sapiens
tccttgaaatttctcagc

SEQ ID NO: 4837294 - DNA, 19 bp, Homo sapiens
tccttgattacataatgtt

SEQ ID NO: 4837295 - DNA, 17 bp, Homo sapiens
tccttgccacaatcact

SEQ ID NO: 4837296 - DNA, 18 bp, Homo sapiens
tccttgccttctttactc

SEQ ID NO: 4837297 - DNA, 14 bp, Homo sapiens
tccttgctttctct

SEQ ID NO: 4837298 - DNA, 15 bp, Homo sapiens
tccttggcaccaaag

SEQ ID NO: 4837299 - DNA, 13 bp, Homo sapiens
tccttggcccagc

SEQ ID NO: 4837300 - DNA, 15 bp, Homo sapiens
tccttggcccagcag

SEQ ID NO: 4837301 - DNA, 23 bp, Homo sapiens
tccttggcccagcagcggcccag

SEQ ID NO: 4837302 - DNA, 21 bp, Homo sapiens
tccttggttttgcctctttaa

SEQ ID NO: 4837303 - DNA, 23 bp, Homo sapiens
tccttgtacttgaataataacca

SEQ ID NO: 4837304 - DNA, 20 bp, Homo sapiens
tccttgtagacgcacctgct

SEQ ID NO: 4837305 - DNA, 20 bp, Homo sapiens
tccttgtctaaagatctttt

SEQ ID NO: 4837306 - DNA, 15 bp, Homo sapiens
tcctttaccctccac

SEQ ID NO: 4837307 - DNA, 16 bp, Homo sapiens
tcctttattttaaatg

SEQ ID NO: 4837308 - DNA, 13 bp, Homo sapiens
tcctttcatcctc

SEQ ID NO: 4837309 - DNA, 16 bp, Homo sapiens
tcctttcatcctcagc

SEQ ID NO: 4837310 - DNA, 18 bp, Homo sapiens
tcctttcatcctcagcaa

SEQ ID NO: 4837311 - DNA, 17 bp, Homo sapiens
tcctttccatcagcttt

SEQ ID NO: 4837312 - DNA, 21 bp, Homo sapiens
tcctttccatcagctttataa

SEQ ID NO: 4837313 - DNA, 15 bp, Homo sapiens
tcctttcctctcctc

SEQ ID NO: 4837314 - DNA, 17 bp, Homo sapiens
tcctttctgatcctctc

SEQ ID NO: 4837315 - DNA, 16 bp, Homo sapiens
tcctttcttccttcct

SEQ ID NO: 4837316 - DNA, 17 bp, Homo sapiens
tcctttcttccttcctt

SEQ ID NO: 4837317 - DNA, 13 bp, Homo sapiens
tccttttctcttt

SEQ ID NO: 4837318 - DNA, 18 bp, Homo sapiens
tccttttgcttcatctgg

SEQ ID NO: 4837319 - DNA, 22 bp, Homo sapiens
tccttttgcttcatctggagtc

SEQ ID NO: 4837320 - DNA, 21 bp, Homo sapiens
tcgaagaattggcagaagcag

SEQ ID NO: 4837321 - DNA, 14 bp, Homo sapiens
tcgagagggctgag

SEQ ID NO: 4837322 - DNA, 16 bp, Homo sapiens
tcgagagggctgagcc

SEQ ID NO: 4837323 - DNA, 18 bp, Homo sapiens
tcgagagggctgagcccc

SEQ ID NO: 4837324 - DNA, 19 bp, Homo sapiens
tcgagagggctgagcccct

SEQ ID NO: 4837325 - DNA, 22 bp, Homo sapiens
tcgagagggctgagcccctcct

SEQ ID NO: 4837326 - DNA, 18 bp, Homo sapiens
tcgagctctgtagcctgg

SEQ ID NO: 4837327 - DNA, 22 bp, Homo sapiens
tcgatgggggatgcttcatgtg

SEQ ID NO: 4837328 - DNA, 18 bp, Homo sapiens
tcgatttgtattaatgta

SEQ ID NO: 4837329 - DNA, 20 bp, Homo sapiens
tcgccccaggccctccctga

SEQ ID NO: 4837330 - DNA, 22 bp, Homo sapiens
tcgccccccgcccggcctccta

SEQ ID NO: 4837331 - DNA, 23 bp, Homo sapiens
tcgccccccgcccggcctcctag

SEQ ID NO: 4837332 - DNA, 14 bp, Homo sapiens
tcgccctgtgccct

SEQ ID NO: 4837333 - DNA, 12 bp, Homo sapiens
tcgccttctggc

SEQ ID NO: 4837334 - DNA, 13 bp, Homo sapiens
tcgcgcccctgtc

SEQ ID NO: 4837335 - DNA, 13 bp, Homo sapiens
tcgctattcccag

SEQ ID NO: 4837336 - DNA, 17 bp, Homo sapiens
tcgctattcccaggcag

SEQ ID NO: 4837337 - DNA, 18 bp, Homo sapiens
tcgctattcccaggcagg

SEQ ID NO: 4837338 - DNA, 13 bp, Homo sapiens
tcgctcagaagag

SEQ ID NO: 4837339 - DNA, 13 bp, Homo sapiens
tcgctgctggcct

SEQ ID NO: 4837340 - DNA, 23 bp, Homo sapiens
tcgctgtgatgcatgagctccct

SEQ ID NO: 4837341 - DNA, 23 bp, Homo sapiens
tcgcttcataggcagagcccgcc

SEQ ID NO: 4837342 - DNA, 15 bp, Homo sapiens
tcggaggctgggccc

SEQ ID NO: 4837343 - DNA, 20 bp, Homo sapiens
tcggccctgtagccctggcc

SEQ ID NO: 4837344 - DNA, 14 bp, Homo sapiens
tcggctgggcaggg

SEQ ID NO: 4837345 - DNA, 16 bp, Homo sapiens
tcggctgggcagggcc

SEQ ID NO: 4837346 - DNA, 19 bp, Homo sapiens
tcgggccgcctcctccaga

SEQ ID NO: 4837347 - DNA, 21 bp, Homo sapiens
tcgggctctctcacccagcct

SEQ ID NO: 4837348 - DNA, 14 bp, Homo sapiens
tcgggggaggagca

SEQ ID NO: 4837349 - DNA, 16 bp, Homo sapiens
tcgggggaggagcacc

SEQ ID NO: 4837350 - DNA, 17 bp, Homo sapiens
tcgggggaggagcaccc

SEQ ID NO: 4837351 - DNA, 22 bp, Homo sapiens
tcgggggaggagcacccccagc

SEQ ID NO: 4837352 - DNA, 23 bp, Homo sapiens
tcgggggaggagcacccccagcc

SEQ ID NO: 4837353 - DNA, 16 bp, Homo sapiens
tcgggggcggctctgg

SEQ ID NO: 4837354 - DNA, 13 bp, Homo sapiens
tcgtaagttctgt

SEQ ID NO: 4837355 - DNA, 16 bp, Homo sapiens
tcgtaagttctgtgca

SEQ ID NO: 4837356 - DNA, 14 bp, Homo sapiens
tcgtccggcctgca

SEQ ID NO: 4837357 - DNA, 17 bp, Homo sapiens
tcgtccggcctgcagcc

SEQ ID NO: 4837358 - DNA, 18 bp, Homo sapiens
tcgtccggcctgcagccc

SEQ ID NO: 4837359 - DNA, 13 bp, Homo sapiens
tcgtgcatgtaat

SEQ ID NO: 4837360 - DNA, 13 bp, Homo sapiens
tcgtgcatttgtg

SEQ ID NO: 4837361 - DNA, 17 bp, Homo sapiens
tcgtgccatgatctgta

SEQ ID NO: 4837362 - DNA, 17 bp, Homo sapiens
tcgtgtttcacagtggg

SEQ ID NO: 4837363 - DNA, 22 bp, Homo sapiens
tcgtgtttttggttttctcctt

SEQ ID NO: 4837364 - DNA, 13 bp, Homo sapiens
tcgttaagcagta

SEQ ID NO: 4837365 - DNA, 17 bp, Homo sapiens
tcgttaagcagtacatc

SEQ ID NO: 4837366 - DNA, 23 bp, Homo sapiens
tcgttaagcagtacatcttgtgc

SEQ ID NO: 4837367 - DNA, 19 bp, Homo sapiens
tctaaaacattaattgagg

SEQ ID NO: 4837368 - DNA, 22 bp, Homo sapiens
tctaaaacccttggtctgtgtt

SEQ ID NO: 4837369 - DNA, 13 bp, Homo sapiens
tctaaaactactg

SEQ ID NO: 4837370 - DNA, 16 bp, Homo sapiens
tctaaaaggaggacag

SEQ ID NO: 4837371 - DNA, 16 bp, Homo sapiens
tctaaaataaatgttt

SEQ ID NO: 4837372 - DNA, 18 bp, Homo sapiens
tctaaaccatgaaaagtt

SEQ ID NO: 4837373 - DNA, 22 bp, Homo sapiens
tctaaaccatgaaaagttttca

SEQ ID NO: 4837374 - DNA, 20 bp, Homo sapiens
tctaaacccaaataaatgtg

SEQ ID NO: 4837375 - DNA, 13 bp, Homo sapiens
tctaacagattag

SEQ ID NO: 4837376 - DNA, 13 bp, Homo sapiens
tctaaccaattgt

SEQ ID NO: 4837377 - DNA, 18 bp, Homo sapiens
tctaaccaattgtgagaa

SEQ ID NO: 4837378 - DNA, 12 bp, Homo sapiens
tctaactgtata

SEQ ID NO: 4837379 - DNA, 18 bp, Homo sapiens
tctaactgtatatttgta

SEQ ID NO: 4837380 - DNA, 16 bp, Homo sapiens
tctaagaaatatctgt

SEQ ID NO: 4837381 - DNA, 12 bp, Homo sapiens
tctaagaattca

SEQ ID NO: 4837382 - DNA, 22 bp, Homo sapiens
tctaagacattcaccaacaaca

SEQ ID NO: 4837383 - DNA, 23 bp, Homo sapiens
tctaagacattcaccaacaacag

SEQ ID NO: 4837384 - DNA, 16 bp, Homo sapiens
tctaagatcttgcctc

SEQ ID NO: 4837385 - DNA, 22 bp, Homo sapiens
tctaagggatccagagacctgc

SEQ ID NO: 4837386 - DNA, 20 bp, Homo sapiens
tctaagtcggttaaaatgga

SEQ ID NO: 4837387 - DNA, 18 bp, Homo sapiens
tctaagtgagatgtttgg

SEQ ID NO: 4837388 - DNA, 20 bp, Homo sapiens
tctaatatttattgctttat

SEQ ID NO: 4837389 - DNA, 13 bp, Homo sapiens
tctaatggaatat

SEQ ID NO: 4837390 - DNA, 19 bp, Homo sapiens
tctacaaacttttataaat

SEQ ID NO: 4837391 - DNA, 14 bp, Homo sapiens
tctacaacataatg

SEQ ID NO: 4837392 - DNA, 22 bp, Homo sapiens
tctacacatataaacacagtaa

SEQ ID NO: 4837393 - DNA, 13 bp, Homo sapiens
tctacagaaaaac

SEQ ID NO: 4837394 - DNA, 15 bp, Homo sapiens
tctaccttccagtca

SEQ ID NO: 4837395 - DNA, 11 bp, Homo sapiens
tctactgagca

SEQ ID NO: 4837396 - DNA, 13 bp, Homo sapiens
tctagaatactaa

SEQ ID NO: 4837397 - DNA, 21 bp, Homo sapiens
tctagaatactaataaaatac

SEQ ID NO: 4837398 - DNA, 16 bp, Homo sapiens
tctagagctatgcaca

SEQ ID NO: 4837399 - DNA, 13 bp, Homo sapiens
tctagcaactgtt

SEQ ID NO: 4837400 - DNA, 13 bp, Homo sapiens
tctagccagagga

SEQ ID NO: 4837401 - DNA, 13 bp, Homo sapiens
tctagccaggcct

SEQ ID NO: 4837402 - DNA, 16 bp, Homo sapiens
tctagccaggcctccc

SEQ ID NO: 4837403 - DNA, 21 bp, Homo sapiens
tctagccctctccctcagtcc

SEQ ID NO: 4837404 - DNA, 19 bp, Homo sapiens
tctagctatgctgtatctg

SEQ ID NO: 4837405 - DNA, 15 bp, Homo sapiens
tctaggggcaggtga

SEQ ID NO: 4837406 - DNA, 17 bp, Homo sapiens
tctagggttgctggagc

SEQ ID NO: 4837407 - DNA, 21 bp, Homo sapiens
tctagggttgctggagcctga

SEQ ID NO: 4837408 - DNA, 16 bp, Homo sapiens
tctagtaggtctgcac

SEQ ID NO: 4837409 - DNA, 21 bp, Homo sapiens
tctagtaggtctgcacacata

SEQ ID NO: 4837410 - DNA, 23 bp, Homo sapiens
tctagtcctggatgactcggtct

SEQ ID NO: 4837411 - DNA, 13 bp, Homo sapiens
tctagtgctaaac

SEQ ID NO: 4837412 - DNA, 15 bp, Homo sapiens
tctagtgctaaacct

SEQ ID NO: 4837413 - DNA, 17 bp, Homo sapiens
tctagttagcaggaaat

SEQ ID NO: 4837414 - DNA, 19 bp, Homo sapiens
tctagttgacttcaaatgt

SEQ ID NO: 4837415 - DNA, 18 bp, Homo sapiens
tctatatatacatataca

SEQ ID NO: 4837416 - DNA, 22 bp, Homo sapiens
tctatatatacatgtatagtga

SEQ ID NO: 4837417 - DNA, 14 bp, Homo sapiens
tctatatttactgt

SEQ ID NO: 4837418 - DNA, 17 bp, Homo sapiens
tctatatttactgttta

SEQ ID NO: 4837419 - DNA, 15 bp, Homo sapiens
tctatctaattttta

SEQ ID NO: 4837420 - DNA, 10 bp, Homo sapiens
tctatctact

SEQ ID NO: 4837421 - DNA, 16 bp, Homo sapiens
tctatctgggcctggg

SEQ ID NO: 4837422 - DNA, 18 bp, Homo sapiens
tctatctgggcctgggct

SEQ ID NO: 4837423 - DNA, 14 bp, Homo sapiens
tctatctggtatta

SEQ ID NO: 4837424 - DNA, 21 bp, Homo sapiens
tctatctggtattaaatgcca

SEQ ID NO: 4837425 - DNA, 16 bp, Homo sapiens
tctatgacaataaatt

SEQ ID NO: 4837426 - DNA, 15 bp, Homo sapiens
tctatgagacctccc

SEQ ID NO: 4837427 - DNA, 21 bp, Homo sapiens
tctatgagacctcccccaggg

SEQ ID NO: 4837428 - DNA, 11 bp, Homo sapiens
tctatgatata

SEQ ID NO: 4837429 - DNA, 16 bp, Homo sapiens
tctatggaccaaatgt

SEQ ID NO: 4837430 - DNA, 18 bp, Homo sapiens
tctatggaccaaatgtaa

SEQ ID NO: 4837431 - DNA, 22 bp, Homo sapiens
tctatggattcacttctattta

SEQ ID NO: 4837432 - DNA, 15 bp, Homo sapiens
tctatgtccaacaga

SEQ ID NO: 4837433 - DNA, 20 bp, Homo sapiens
tctatgtccaacagagtgga

SEQ ID NO: 4837434 - DNA, 16 bp, Homo sapiens
tctattatctgggttt

SEQ ID NO: 4837435 - DNA, 21 bp, Homo sapiens
tctattatctgggttttagaa

SEQ ID NO: 4837436 - DNA, 18 bp, Homo sapiens
tctattccttctggcctt

SEQ ID NO: 4837437 - DNA, 15 bp, Homo sapiens
tctattgtccaaagt

SEQ ID NO: 4837438 - DNA, 23 bp, Homo sapiens
tctatttaattttgacactgaaa

SEQ ID NO: 4837439 - DNA, 18 bp, Homo sapiens
tctatttgatttgcaaca

SEQ ID NO: 4837440 - DNA, 15 bp, Homo sapiens
tctattttgcagcag

SEQ ID NO: 4837441 - DNA, 18 bp, Homo sapiens
tctcaaaataaaaccaga

SEQ ID NO: 4837442 - DNA, 20 bp, Homo sapiens
tctcaaacactgcttaagga

SEQ ID NO: 4837443 - DNA, 22 bp, Homo sapiens
tctcaagcgctatccacagaac

SEQ ID NO: 4837444 - DNA, 19 bp, Homo sapiens
tctcaatcattgtcagaga

SEQ ID NO: 4837445 - DNA, 15 bp, Homo sapiens
tctcaatgcttttct

SEQ ID NO: 4837446 - DNA, 21 bp, Homo sapiens
tctcaatgttccattcagtct

SEQ ID NO: 4837447 - DNA, 14 bp, Homo sapiens
tctcaattgagtta

SEQ ID NO: 4837448 - DNA, 12 bp, Homo sapiens
tctcacacacat

SEQ ID NO: 4837449 - DNA, 18 bp, Homo sapiens
tctcacactctaactgta

SEQ ID NO: 4837450 - DNA, 15 bp, Homo sapiens
tctcacactggagga

SEQ ID NO: 4837451 - DNA, 14 bp, Homo sapiens
tctcacccagcctg

SEQ ID NO: 4837452 - DNA, 15 bp, Homo sapiens
tctcacccagcctgg

SEQ ID NO: 4837453 - DNA, 12 bp, Homo sapiens
tctcaccctctg

SEQ ID NO: 4837454 - DNA, 16 bp, Homo sapiens
tctcaccctctgtcct

SEQ ID NO: 4837455 - DNA, 16 bp, Homo sapiens
tctcacctagctgctc

SEQ ID NO: 4837456 - DNA, 15 bp, Homo sapiens
tctcacgattccagt

SEQ ID NO: 4837457 - DNA, 14 bp, Homo sapiens
tctcactgtattaa

SEQ ID NO: 4837458 - DNA, 21 bp, Homo sapiens
tctcactgtattaaagatgca

SEQ ID NO: 4837459 - DNA, 14 bp, Homo sapiens
tctcagaactcctg

SEQ ID NO: 4837460 - DNA, 22 bp, Homo sapiens
tctcagaactcctgtgtgtgga

SEQ ID NO: 4837461 - DNA, 23 bp, Homo sapiens
tctcagaactcctgtgtgtggaa

SEQ ID NO: 4837462 - DNA, 19 bp, Homo sapiens
tctcagaagtgaaaaagac

SEQ ID NO: 4837463 - DNA, 14 bp, Homo sapiens
tctcagatccctcg

SEQ ID NO: 4837464 - DNA, 13 bp, Homo sapiens
tctcagcactttg

SEQ ID NO: 4837465 - DNA, 14 bp, Homo sapiens
tctcagcgggagtc

SEQ ID NO: 4837466 - DNA, 18 bp, Homo sapiens
tctcagcgggagtctcct

SEQ ID NO: 4837467 - DNA, 20 bp, Homo sapiens
tctcagcgggagtctcctca

SEQ ID NO: 4837468 - DNA, 15 bp, Homo sapiens
tctcagctcactgca

SEQ ID NO: 4837469 - DNA, 16 bp, Homo sapiens
tctcagctccactctg

SEQ ID NO: 4837470 - DNA, 17 bp, Homo sapiens
tctcagctccactctga

SEQ ID NO: 4837471 - DNA, 14 bp, Homo sapiens
tctcaggaccaccc

SEQ ID NO: 4837472 - DNA, 13 bp, Homo sapiens
tctcaggccagct

SEQ ID NO: 4837473 - DNA, 21 bp, Homo sapiens
tctcaggccagctgcttgggc

SEQ ID NO: 4837474 - DNA, 14 bp, Homo sapiens
tctcagtcagtgtc

SEQ ID NO: 4837475 - DNA, 15 bp, Homo sapiens
tctcatacctctgac

SEQ ID NO: 4837476 - DNA, 16 bp, Homo sapiens
tctcatacctctgacc

SEQ ID NO: 4837477 - DNA, 10 bp, Homo sapiens
tctcatcatg

SEQ ID NO: 4837478 - DNA, 20 bp, Homo sapiens
tctcatctgtaaaaccaggc

SEQ ID NO: 4837479 - DNA, 16 bp, Homo sapiens
tctcatgctccttaat

SEQ ID NO: 4837480 - DNA, 13 bp, Homo sapiens
tctcattcttcta

SEQ ID NO: 4837481 - DNA, 13 bp, Homo sapiens
tctcattgccaag

SEQ ID NO: 4837482 - DNA, 14 bp, Homo sapiens
tctcattgccaagg

SEQ ID NO: 4837483 - DNA, 17 bp, Homo sapiens
tctccaagcactagcct

SEQ ID NO: 4837484 - DNA, 12 bp, Homo sapiens
tctccacccctc

SEQ ID NO: 4837485 - DNA, 16 bp, Homo sapiens
tctccacccctcaagc

SEQ ID NO: 4837486 - DNA, 20 bp, Homo sapiens
tctccacctcccccaaaccc

SEQ ID NO: 4837487 - DNA, 20 bp, Homo sapiens
tctccagaaaaatcaatcat

SEQ ID NO: 4837488 - DNA, 15 bp, Homo sapiens
tctccagctgatttt

SEQ ID NO: 4837489 - DNA, 11 bp, Homo sapiens
tctccaggccc

SEQ ID NO: 4837490 - DNA, 13 bp, Homo sapiens
tctccaggcccag

SEQ ID NO: 4837491 - DNA, 14 bp, Homo sapiens
tctccaggcccagc

SEQ ID NO: 4837492 - DNA, 19 bp, Homo sapiens
tctccaggcccagcctggc

SEQ ID NO: 4837493 - DNA, 20 bp, Homo sapiens
tctccaggcccagcctggcc

SEQ ID NO: 4837494 - DNA, 17 bp, Homo sapiens
tctccatctcttgtacc

SEQ ID NO: 4837495 - DNA, 23 bp, Homo sapiens
tctccattaaacttctactgagc

SEQ ID NO: 4837496 - DNA, 17 bp, Homo sapiens
tctccattcttttaaat

SEQ ID NO: 4837497 - DNA, 21 bp, Homo sapiens
tctcccaaataaactccttaa

SEQ ID NO: 4837498 - DNA, 19 bp, Homo sapiens
tctcccaactgctgcttaa

SEQ ID NO: 4837499 - DNA, 13 bp, Homo sapiens
tctcccctccaga

SEQ ID NO: 4837500 - DNA, 16 bp, Homo sapiens
tctcccctccagaccc

SEQ ID NO: 4837501 - DNA, 14 bp, Homo sapiens
tctcccgccattgg

SEQ ID NO: 4837502 - DNA, 18 bp, Homo sapiens
tctcccgccattggcctt

SEQ ID NO: 4837503 - DNA, 19 bp, Homo sapiens
tctccctaccctcttctca

SEQ ID NO: 4837504 - DNA, 22 bp, Homo sapiens
tctccctaccctcttctcagct

SEQ ID NO: 4837505 - DNA, 20 bp, Homo sapiens
tctccctccactcctcccaa

SEQ ID NO: 4837506 - DNA, 22 bp, Homo sapiens
tctccctcccttctttccttcc

SEQ ID NO: 4837507 - DNA, 16 bp, Homo sapiens
tctcccttcatccttc

SEQ ID NO: 4837508 - DNA, 13 bp, Homo sapiens
tctccgcccacgc

SEQ ID NO: 4837509 - DNA, 17 bp, Homo sapiens
tctccgccccccggcct

SEQ ID NO: 4837510 - DNA, 20 bp, Homo sapiens
tctccgccccccggcctggc

SEQ ID NO: 4837511 - DNA, 13 bp, Homo sapiens
tctccgccccgga

SEQ ID NO: 4837512 - DNA, 20 bp, Homo sapiens
tctccggatggaatcacagc

SEQ ID NO: 4837513 - DNA, 23 bp, Homo sapiens
tctccggatggaatcacagccaa

SEQ ID NO: 4837514 - DNA, 18 bp, Homo sapiens
tctccgggtgtggcctca

SEQ ID NO: 4837515 - DNA, 13 bp, Homo sapiens
tctcctcactgcc

SEQ ID NO: 4837516 - DNA, 15 bp, Homo sapiens
tctcctcactgccac

SEQ ID NO: 4837517 - DNA, 16 bp, Homo sapiens
tctcctcactgccact

SEQ ID NO: 4837518 - DNA, 17 bp, Homo sapiens
tctcctcgtccggcctg

SEQ ID NO: 4837519 - DNA, 20 bp, Homo sapiens
tctcctcgtccggcctgcag

SEQ ID NO: 4837520 - DNA, 19 bp, Homo sapiens
tctcctctctctccctcca

SEQ ID NO: 4837521 - DNA, 16 bp, Homo sapiens
tctcctgagcctgtct

SEQ ID NO: 4837522 - DNA, 18 bp, Homo sapiens
tctcctgagcctgtctct

SEQ ID NO: 4837523 - DNA, 20 bp, Homo sapiens
tctcctgagcctgtctctcc

SEQ ID NO: 4837524 - DNA, 15 bp, Homo sapiens
tctcctgcatccctc

SEQ ID NO: 4837525 - DNA, 19 bp, Homo sapiens
tctcctgcatccctccacc

SEQ ID NO: 4837526 - DNA, 19 bp, Homo sapiens
tctcctgcctcagcctccc

SEQ ID NO: 4837527 - DNA, 17 bp, Homo sapiens
tctcctgctcacccgcc

SEQ ID NO: 4837528 - DNA, 19 bp, Homo sapiens
tctcctgtaattttgtagt

SEQ ID NO: 4837529 - DNA, 12 bp, Homo sapiens
tctcctgtgcac

SEQ ID NO: 4837530 - DNA, 17 bp, Homo sapiens
tctcctgtttcccttcc

SEQ ID NO: 4837531 - DNA, 15 bp, Homo sapiens
tctccttaaccccca

SEQ ID NO: 4837532 - DNA, 16 bp, Homo sapiens
tctccttaacccccat

SEQ ID NO: 4837533 - DNA, 12 bp, Homo sapiens
tctccttcccaa

SEQ ID NO: 4837534 - DNA, 14 bp, Homo sapiens
tctccttcccaagg

SEQ ID NO: 4837535 - DNA, 19 bp, Homo sapiens
tctccttcccaaggcagct

SEQ ID NO: 4837536 - DNA, 18 bp, Homo sapiens
tctccttccttacccaaa

SEQ ID NO: 4837537 - DNA, 13 bp, Homo sapiens
tctccttgtactt

SEQ ID NO: 4837538 - DNA, 13 bp, Homo sapiens
tctcgagcccaga

SEQ ID NO: 4837539 - DNA, 20 bp, Homo sapiens
tctcggactttgcaggagtt

SEQ ID NO: 4837540 - DNA, 14 bp, Homo sapiens
tctcgggtgcattt

SEQ ID NO: 4837541 - DNA, 15 bp, Homo sapiens
tctcgtagaacctgc

SEQ ID NO: 4837542 - DNA, 19 bp, Homo sapiens
tctcgtagaacctgcgcac

SEQ ID NO: 4837543 - DNA, 21 bp, Homo sapiens
tctctaaaatgctgttctcaa

SEQ ID NO: 4837544 - DNA, 13 bp, Homo sapiens
tctctaccttcaa

SEQ ID NO: 4837545 - DNA, 15 bp, Homo sapiens
tctctatataaaaaa

SEQ ID NO: 4837546 - DNA, 16 bp, Homo sapiens
tctctcaaaatgtgcc

SEQ ID NO: 4837547 - DNA, 21 bp, Homo sapiens
tctctcaggccaaactcacct

SEQ ID NO: 4837548 - DNA, 21 bp, Homo sapiens
tctctccccatatataaatta

SEQ ID NO: 4837549 - DNA, 23 bp, Homo sapiens
tctctccccatatataaattatt

SEQ ID NO: 4837550 - DNA, 18 bp, Homo sapiens
tctctccctaccctcttc

SEQ ID NO: 4837551 - DNA, 12 bp, Homo sapiens
tctctccctcca

SEQ ID NO: 4837552 - DNA, 12 bp, Homo sapiens
tctctcctgctc

SEQ ID NO: 4837553 - DNA, 12 bp, Homo sapiens
tctctctaagac

SEQ ID NO: 4837554 - DNA, 17 bp, Homo sapiens
tctctctaagacaaatg

SEQ ID NO: 4837555 - DNA, 17 bp, Homo sapiens
tctctctatatatacat

SEQ ID NO: 4837556 - DNA, 18 bp, Homo sapiens
tctctctatatatacatg

SEQ ID NO: 4837557 - DNA, 21 bp, Homo sapiens
tctctctatatatacatgtat

SEQ ID NO: 4837558 - DNA, 14 bp, Homo sapiens
tctctctcccaact

SEQ ID NO: 4837559 - DNA, 13 bp, Homo sapiens
tctctctccctcc

SEQ ID NO: 4837560 - DNA, 14 bp, Homo sapiens
tctctctccctcca

SEQ ID NO: 4837561 - DNA, 11 bp, Homo sapiens
tctctctctct

SEQ ID NO: 4837562 - DNA, 16 bp, Homo sapiens
tctctctctctctctg

SEQ ID NO: 4837563 - DNA, 14 bp, Homo sapiens
tctctctctctctg

SEQ ID NO: 4837564 - DNA, 16 bp, Homo sapiens
tctctctctctctgtt

SEQ ID NO: 4837565 - DNA, 12 bp, Homo sapiens
tctctctctctg

SEQ ID NO: 4837566 - DNA, 13 bp, Homo sapiens
tctctctctctgt

SEQ ID NO: 4837567 - DNA, 14 bp, Homo sapiens
tctctctctctgtt

SEQ ID NO: 4837568 - DNA, 10 bp, Homo sapiens
tctctctctg

SEQ ID NO: 4837569 - DNA, 15 bp, Homo sapiens
tctctctggggccct

SEQ ID NO: 4837570 - DNA, 18 bp, Homo sapiens
tctctctggggccctggg

SEQ ID NO: 4837571 - DNA, 13 bp, Homo sapiens
tctctctgtgctg

SEQ ID NO: 4837572 - DNA, 10 bp, Homo sapiens
tctctctgtt

SEQ ID NO: 4837573 - DNA, 14 bp, Homo sapiens
tctctcttggtctc

SEQ ID NO: 4837574 - DNA, 19 bp, Homo sapiens
tctctgaactgcaacactg

SEQ ID NO: 4837575 - DNA, 21 bp, Homo sapiens
tctctgaactgcaacactgga

SEQ ID NO: 4837576 - DNA, 19 bp, Homo sapiens
tctctgagcagtggggagc

SEQ ID NO: 4837577 - DNA, 14 bp, Homo sapiens
tctctgatggcact

SEQ ID NO: 4837578 - DNA, 19 bp, Homo sapiens
tctctgatggcacttttga

SEQ ID NO: 4837579 - DNA, 13 bp, Homo sapiens
tctctggacctga

SEQ ID NO: 4837580 - DNA, 15 bp, Homo sapiens
tctctggcactttga

SEQ ID NO: 4837581 - DNA, 18 bp, Homo sapiens
tctctggggccctgggcc

SEQ ID NO: 4837582 - DNA, 23 bp, Homo sapiens
tctctggggccctgggcctcagt

SEQ ID NO: 4837583 - DNA, 17 bp, Homo sapiens
tctctggggtctgtgat

SEQ ID NO: 4837584 - DNA, 15 bp, Homo sapiens
tctctgtaaaaagca

SEQ ID NO: 4837585 - DNA, 13 bp, Homo sapiens
tctctgtgtggca

SEQ ID NO: 4837586 - DNA, 18 bp, Homo sapiens
tctctgtgtggcaaacat

SEQ ID NO: 4837587 - DNA, 19 bp, Homo sapiens
tctctgtgtggcaaacatt

SEQ ID NO: 4837588 - DNA, 23 bp, Homo sapiens
tctctgttccaagtgtgtgtgca

SEQ ID NO: 4837589 - DNA, 14 bp, Homo sapiens
tctcttaccccgtc

SEQ ID NO: 4837590 - DNA, 23 bp, Homo sapiens
tctcttcctctcttttttggggg

SEQ ID NO: 4837591 - DNA, 17 bp, Homo sapiens
tctcttcttactgtatt

SEQ ID NO: 4837592 - DNA, 17 bp, Homo sapiens
tctcttgggaagcagtt

SEQ ID NO: 4837593 - DNA, 21 bp, Homo sapiens
tctcttgggaagcagtttcag

SEQ ID NO: 4837594 - DNA, 18 bp, Homo sapiens
tctcttgtaccagcccag

SEQ ID NO: 4837595 - DNA, 18 bp, Homo sapiens
tctcttgtcattctcatc

SEQ ID NO: 4837596 - DNA, 16 bp, Homo sapiens
tctcttttttgggggg

SEQ ID NO: 4837597 - DNA, 15 bp, Homo sapiens
tctgaaaactgttta

SEQ ID NO: 4837598 - DNA, 19 bp, Homo sapiens
tctgaaactatagaataaa

SEQ ID NO: 4837599 - DNA, 15 bp, Homo sapiens
tctgaaagttttgat

SEQ ID NO: 4837600 - DNA, 16 bp, Homo sapiens
tctgaactgcaacact

SEQ ID NO: 4837601 - DNA, 20 bp, Homo sapiens
tctgaacttggcgctgcccc

SEQ ID NO: 4837602 - DNA, 21 bp, Homo sapiens
tctgaacttggcgctgcccct

SEQ ID NO: 4837603 - DNA, 16 bp, Homo sapiens
tctgaactttggaagc

SEQ ID NO: 4837604 - DNA, 13 bp, Homo sapiens
tctgaagatctca

SEQ ID NO: 4837605 - DNA, 15 bp, Homo sapiens
tctgaagatctcaga

SEQ ID NO: 4837606 - DNA, 17 bp, Homo sapiens
tctgaaggccttgttaa

SEQ ID NO: 4837607 - DNA, 19 bp, Homo sapiens
tctgaagtcccttcctgtc

SEQ ID NO: 4837608 - DNA, 21 bp, Homo sapiens
tctgaagtcccttcctgtcct

SEQ ID NO: 4837609 - DNA, 16 bp, Homo sapiens
tctgaagttggacagc

SEQ ID NO: 4837610 - DNA, 17 bp, Homo sapiens
tctgaatctctcaaaat

SEQ ID NO: 4837611 - DNA, 20 bp, Homo sapiens
tctgaatctctcaaaatgtg

SEQ ID NO: 4837612 - DNA, 20 bp, Homo sapiens
tctgacaagggctgacctgc

SEQ ID NO: 4837613 - DNA, 23 bp, Homo sapiens
tctgacaagggctgacctgcctc

SEQ ID NO: 4837614 - DNA, 14 bp, Homo sapiens
tctgacagctgtcc

SEQ ID NO: 4837615 - DNA, 23 bp, Homo sapiens
tctgaccgggcttcctccctcca

SEQ ID NO: 4837616 - DNA, 17 bp, Homo sapiens
tctgacggccctgcaat

SEQ ID NO: 4837617 - DNA, 14 bp, Homo sapiens
tctgagaagaggag

SEQ ID NO: 4837618 - DNA, 15 bp, Homo sapiens
tctgagaagaggagc

SEQ ID NO: 4837619 - DNA, 12 bp, Homo sapiens
tctgagaagatt

SEQ ID NO: 4837620 - DNA, 19 bp, Homo sapiens
tctgagactaaatgagagg

SEQ ID NO: 4837621 - DNA, 23 bp, Homo sapiens
tctgagcagacagggcgtcctct

SEQ ID NO: 4837622 - DNA, 22 bp, Homo sapiens
tctgagccctgccctcactcca

SEQ ID NO: 4837623 - DNA, 16 bp, Homo sapiens
tctgaggagtccaaaa

SEQ ID NO: 4837624 - DNA, 18 bp, Homo sapiens
tctgaggataccttccat

SEQ ID NO: 4837625 - DNA, 22 bp, Homo sapiens
tctgaggataccttccatctca

SEQ ID NO: 4837626 - DNA, 21 bp, Homo sapiens
tctgatacttatttataacat

SEQ ID NO: 4837627 - DNA, 14 bp, Homo sapiens
tctgatcctctctt

SEQ ID NO: 4837628 - DNA, 16 bp, Homo sapiens
tctgatgaagttgtac

SEQ ID NO: 4837629 - DNA, 21 bp, Homo sapiens
tctgatgatgttctgaaatgg

SEQ ID NO: 4837630 - DNA, 19 bp, Homo sapiens
tctgattggacctggccca

SEQ ID NO: 4837631 - DNA, 21 bp, Homo sapiens
tctgattgttcctccccagcc

SEQ ID NO: 4837632 - DNA, 22 bp, Homo sapiens
tctgatttattttgtatgaaat

SEQ ID NO: 4837633 - DNA, 20 bp, Homo sapiens
tctgcacacataacacacat

SEQ ID NO: 4837634 - DNA, 16 bp, Homo sapiens
tctgcactgaaaaggt

SEQ ID NO: 4837635 - DNA, 15 bp, Homo sapiens
tctgcagcctgagct

SEQ ID NO: 4837636 - DNA, 19 bp, Homo sapiens
tctgcagcctgagctccac

SEQ ID NO: 4837637 - DNA, 22 bp, Homo sapiens
tctgcagctatgcgcaatgtgg

SEQ ID NO: 4837638 - DNA, 20 bp, Homo sapiens
tctgcagctattcacacaca

SEQ ID NO: 4837639 - DNA, 19 bp, Homo sapiens
tctgcaggatgattgtaca

SEQ ID NO: 4837640 - DNA, 15 bp, Homo sapiens
tctgcatagacaaag

SEQ ID NO: 4837641 - DNA, 12 bp, Homo sapiens
tctgccaaggcc

SEQ ID NO: 4837642 - DNA, 21 bp, Homo sapiens
tctgccaaggccagcccacac

SEQ ID NO: 4837643 - DNA, 22 bp, Homo sapiens
tctgccacttagggagtgtgcc

SEQ ID NO: 4837644 - DNA, 11 bp, Homo sapiens
tctgccagggc

SEQ ID NO: 4837645 - DNA, 17 bp, Homo sapiens
tctgccagggcagtgct

SEQ ID NO: 4837646 - DNA, 19 bp, Homo sapiens
tctgccatgtttttgcaaa

SEQ ID NO: 4837647 - DNA, 13 bp, Homo sapiens
tctgccccctccc

SEQ ID NO: 4837648 - DNA, 14 bp, Homo sapiens
tctgccccctcccc

SEQ ID NO: 4837649 - DNA, 20 bp, Homo sapiens
tctgccccctcccccgcaga

SEQ ID NO: 4837650 - DNA, 24 bp, Homo sapiens
tctgccccctcccccgcagacaga

SEQ ID NO: 4837651 - DNA, 12 bp, Homo sapiens
tctgcccctccg

SEQ ID NO: 4837652 - DNA, 17 bp, Homo sapiens
tctgccccttgacccca

SEQ ID NO: 4837653 - DNA, 22 bp, Homo sapiens
tctgccgcagccctgcagaggg

SEQ ID NO: 4837654 - DNA, 22 bp, Homo sapiens
tctgccggtcccccatgccacc

SEQ ID NO: 4837655 - DNA, 23 bp, Homo sapiens
tctgccggtcccccatgccacca

SEQ ID NO: 4837656 - DNA, 16 bp, Homo sapiens
tctgccttagaggagc

SEQ ID NO: 4837657 - DNA, 17 bp, Homo sapiens
tctgcgacgatccccat

SEQ ID NO: 4837658 - DNA, 18 bp, Homo sapiens
tctgcgacgatccccatg

SEQ ID NO: 4837659 - DNA, 13 bp, Homo sapiens
tctgcgccccagc

SEQ ID NO: 4837660 - DNA, 12 bp, Homo sapiens
tctgctccatgc

SEQ ID NO: 4837661 - DNA, 23 bp, Homo sapiens
tctgctccatgcagatctagcca

SEQ ID NO: 4837662 - DNA, 16 bp, Homo sapiens
tctgctgcacagtagt

SEQ ID NO: 4837663 - DNA, 14 bp, Homo sapiens
tctgctgcctccaa

SEQ ID NO: 4837664 - DNA, 18 bp, Homo sapiens
tctgcttaggcccctcag

SEQ ID NO: 4837665 - DNA, 18 bp, Homo sapiens
tctggaaaaaaaaaaata

SEQ ID NO: 4837666 - DNA, 19 bp, Homo sapiens
tctggaaaaaaaaaaatat

SEQ ID NO: 4837667 - DNA, 22 bp, Homo sapiens
tctggaaagagctgttttggat

SEQ ID NO: 4837668 - DNA, 14 bp, Homo sapiens
tctggaagagggag

SEQ ID NO: 4837669 - DNA, 22 bp, Homo sapiens
tctggaagagggaggggccctg

SEQ ID NO: 4837670 - DNA, 16 bp, Homo sapiens
tctggagcccctatcc

SEQ ID NO: 4837671 - DNA, 22 bp, Homo sapiens
tctggagcccgcctgcgccccc

SEQ ID NO: 4837672 - DNA, 18 bp, Homo sapiens
tctggaggtacgaaaaga

SEQ ID NO: 4837673 - DNA, 13 bp, Homo sapiens
tctggattcaaat

SEQ ID NO: 4837674 - DNA, 15 bp, Homo sapiens
tctggcaatcttgcc

SEQ ID NO: 4837675 - DNA, 13 bp, Homo sapiens
tctggcacctggc

SEQ ID NO: 4837676 - DNA, 23 bp, Homo sapiens
tctggcagagttgaagacagagc

SEQ ID NO: 4837677 - DNA, 13 bp, Homo sapiens
tctggcccagcca

SEQ ID NO: 4837678 - DNA, 16 bp, Homo sapiens
tctggcccagccatgg

SEQ ID NO: 4837679 - DNA, 21 bp, Homo sapiens
tctggcccagccatggctgga

SEQ ID NO: 4837680 - DNA, 18 bp, Homo sapiens
tctggccgctgcagtcag

SEQ ID NO: 4837681 - DNA, 12 bp, Homo sapiens
tctggcctggcc

SEQ ID NO: 4837682 - DNA, 16 bp, Homo sapiens
tctggcctggcctggc

SEQ ID NO: 4837683 - DNA, 21 bp, Homo sapiens
tctggcctggcctggccctgc

SEQ ID NO: 4837684 - DNA, 20 bp, Homo sapiens
tctggccttggttcctccag

SEQ ID NO: 4837685 - DNA, 20 bp, Homo sapiens
tctggctgtacgtctggtgt

SEQ ID NO: 4837686 - DNA, 13 bp, Homo sapiens
tctggctgtggcc

SEQ ID NO: 4837687 - DNA, 19 bp, Homo sapiens
tctggctgtggcccctcct

SEQ ID NO: 4837688 - DNA, 18 bp, Homo sapiens
tctgggcctgggctaggg

SEQ ID NO: 4837689 - DNA, 15 bp, Homo sapiens
tctggggagggacac

SEQ ID NO: 4837690 - DNA, 13 bp, Homo sapiens
tctggggccctgg

SEQ ID NO: 4837691 - DNA, 15 bp, Homo sapiens
tctggggccctgggc

SEQ ID NO: 4837692 - DNA, 20 bp, Homo sapiens
tctggggccctgggcctcag

SEQ ID NO: 4837693 - DNA, 14 bp, Homo sapiens
tctggggctctagg

SEQ ID NO: 4837694 - DNA, 14 bp, Homo sapiens
tctggggtggggct

SEQ ID NO: 4837695 - DNA, 19 bp, Homo sapiens
tctggggtggggcttggaa

SEQ ID NO: 4837696 - DNA, 18 bp, Homo sapiens
tctgggttttagaaattc

SEQ ID NO: 4837697 - DNA, 22 bp, Homo sapiens
tctgggttttagaaattctata

SEQ ID NO: 4837698 - DNA, 22 bp, Homo sapiens
tctggtccttagtaaattccta

SEQ ID NO: 4837699 - DNA, 17 bp, Homo sapiens
tctgtaaaaccaggctg

SEQ ID NO: 4837700 - DNA, 23 bp, Homo sapiens
tctgtaacatcactatccatgca

SEQ ID NO: 4837701 - DNA, 17 bp, Homo sapiens
tctgtaatatttacaat

SEQ ID NO: 4837702 - DNA, 18 bp, Homo sapiens
tctgtaatatttacaatg

SEQ ID NO: 4837703 - DNA, 22 bp, Homo sapiens
tctgtaatatttacaatgtatt

SEQ ID NO: 4837704 - DNA, 21 bp, Homo sapiens
tctgtaatcacactctcttct

SEQ ID NO: 4837705 - DNA, 23 bp, Homo sapiens
tctgtaatcacactctcttctta

SEQ ID NO: 4837706 - DNA, 18 bp, Homo sapiens
tctgtaattcttctcctt

SEQ ID NO: 4837707 - DNA, 18 bp, Homo sapiens
tctgtacgaggcttctct

SEQ ID NO: 4837708 - DNA, 19 bp, Homo sapiens
tctgtacgaggcttctcta

SEQ ID NO: 4837709 - DNA, 18 bp, Homo sapiens
tctgtactatctagtgtc

SEQ ID NO: 4837710 - DNA, 20 bp, Homo sapiens
tctgtagccaacttaaacct

SEQ ID NO: 4837711 - DNA, 18 bp, Homo sapiens
tctgtagcctggtctgtg

SEQ ID NO: 4837712 - DNA, 19 bp, Homo sapiens
tctgtagcctggtctgtgc

SEQ ID NO: 4837713 - DNA, 15 bp, Homo sapiens
tctgtatatagatgt

SEQ ID NO: 4837714 - DNA, 22 bp, Homo sapiens
tctgtattaagctccagtgctt

SEQ ID NO: 4837715 - DNA, 20 bp, Homo sapiens
tctgtatttaatggttttta

SEQ ID NO: 4837716 - DNA, 13 bp, Homo sapiens
tctgtcagccagc

SEQ ID NO: 4837717 - DNA, 17 bp, Homo sapiens
tctgtcagccagccgcc

SEQ ID NO: 4837718 - DNA, 16 bp, Homo sapiens
tctgtcagcttcccaa

SEQ ID NO: 4837719 - DNA, 16 bp, Homo sapiens
tctgtcagtttgtgaa

SEQ ID NO: 4837720 - DNA, 16 bp, Homo sapiens
tctgtcatctctctgg

SEQ ID NO: 4837721 - DNA, 17 bp, Homo sapiens
tctgtcatctctctggg

SEQ ID NO: 4837722 - DNA, 18 bp, Homo sapiens
tctgtcatctctctgggg

SEQ ID NO: 4837723 - DNA, 22 bp, Homo sapiens
tctgtccctaaacatagtggta

SEQ ID NO: 4837724 - DNA, 23 bp, Homo sapiens
tctgtccctaaacatagtggtat

SEQ ID NO: 4837725 - DNA, 14 bp, Homo sapiens
tctgtcctgcgcct

SEQ ID NO: 4837726 - DNA, 22 bp, Homo sapiens
tctgtccttccaacctgttcac

SEQ ID NO: 4837727 - DNA, 13 bp, Homo sapiens
tctgtccttcccc

SEQ ID NO: 4837728 - DNA, 11 bp, Homo sapiens
tctgtctgagc

SEQ ID NO: 4837729 - DNA, 14 bp, Homo sapiens
tctgtctgagccct

SEQ ID NO: 4837730 - DNA, 17 bp, Homo sapiens
tctgtctgagccctgcc

SEQ ID NO: 4837731 - DNA, 20 bp, Homo sapiens
tctgtctgagccctgccctc

SEQ ID NO: 4837732 - DNA, 13 bp, Homo sapiens
tctgtctttatga

SEQ ID NO: 4837733 - DNA, 14 bp, Homo sapiens
tctgtctttatgat

SEQ ID NO: 4837734 - DNA, 15 bp, Homo sapiens
tctgtgaaatatcat

SEQ ID NO: 4837735 - DNA, 23 bp, Homo sapiens
tctgtgatgtcagtagtgcctgt

SEQ ID NO: 4837736 - DNA, 20 bp, Homo sapiens
tctgtgcagtttggtatgaa

SEQ ID NO: 4837737 - DNA, 21 bp, Homo sapiens
tctgtgcagtttggtatgaaa

SEQ ID NO: 4837738 - DNA, 22 bp, Homo sapiens
tctgtgcatctggcctgggggc

SEQ ID NO: 4837739 - DNA, 18 bp, Homo sapiens
tctgtggagcgtccttgt

SEQ ID NO: 4837740 - DNA, 21 bp, Homo sapiens
tctgtggagcgtccttgtccc

SEQ ID NO: 4837741 - DNA, 23 bp, Homo sapiens
tctgtggagcgtccttgtccccg

SEQ ID NO: 4837742 - DNA, 21 bp, Homo sapiens
tctgtggcttcccatgtcttt

SEQ ID NO: 4837743 - DNA, 16 bp, Homo sapiens
tctgtgggactggccc

SEQ ID NO: 4837744 - DNA, 14 bp, Homo sapiens
tctgtgtatacata

SEQ ID NO: 4837745 - DNA, 16 bp, Homo sapiens
tctgtgtatacatatg

SEQ ID NO: 4837746 - DNA, 19 bp, Homo sapiens
tctgtgtatacatatgtat

SEQ ID NO: 4837747 - DNA, 14 bp, Homo sapiens
tctgtgtcacgtga

SEQ ID NO: 4837748 - DNA, 15 bp, Homo sapiens
tctgtgtcacgtgac

SEQ ID NO: 4837749 - DNA, 19 bp, Homo sapiens
tctgtgtggcaaacattta

SEQ ID NO: 4837750 - DNA, 14 bp, Homo sapiens
tctgttatacacag

SEQ ID NO: 4837751 - DNA, 15 bp, Homo sapiens
tctgttccaagtgtg

SEQ ID NO: 4837752 - DNA, 18 bp, Homo sapiens
tctgttccaagtgtgtgt

SEQ ID NO: 4837753 - DNA, 14 bp, Homo sapiens
tctgttccctgctg

SEQ ID NO: 4837754 - DNA, 23 bp, Homo sapiens
tctgttccctgctgggtgggaat

SEQ ID NO: 4837755 - DNA, 13 bp, Homo sapiens
tctgttctatgga

SEQ ID NO: 4837756 - DNA, 16 bp, Homo sapiens
tctgttgtaatatcag

SEQ ID NO: 4837757 - DNA, 20 bp, Homo sapiens
tctgtttaccctccctgtcc

SEQ ID NO: 4837758 - DNA, 17 bp, Homo sapiens
tctgtttgaattttcaa

SEQ ID NO: 4837759 - DNA, 20 bp, Homo sapiens
tcttaaaaattatctttaaa

SEQ ID NO: 4837760 - DNA, 19 bp, Homo sapiens
tcttaaaagctatcttcat

SEQ ID NO: 4837761 - DNA, 19 bp, Homo sapiens
tcttaaacccacataaaca

SEQ ID NO: 4837762 - DNA, 20 bp, Homo sapiens
tcttaactaatgtaaatatt

SEQ ID NO: 4837763 - DNA, 22 bp, Homo sapiens
tcttaagattccattttggaaa

SEQ ID NO: 4837764 - DNA, 20 bp, Homo sapiens
tcttaagctgcccaatttca

SEQ ID NO: 4837765 - DNA, 22 bp, Homo sapiens
tcttaagctgcccaatttcaca

SEQ ID NO: 4837766 - DNA, 21 bp, Homo sapiens
tcttaaggacagtgttcaaat

SEQ ID NO: 4837767 - DNA, 23 bp, Homo sapiens
tcttaaggacagtgttcaaattc

SEQ ID NO: 4837768 - DNA, 15 bp, Homo sapiens
tcttaatgtctcaaa

SEQ ID NO: 4837769 - DNA, 19 bp, Homo sapiens
tcttacaactgactgactt

SEQ ID NO: 4837770 - DNA, 15 bp, Homo sapiens
tcttacccacttccc

SEQ ID NO: 4837771 - DNA, 20 bp, Homo sapiens
tcttacccacttccctgcaa

SEQ ID NO: 4837772 - DNA, 21 bp, Homo sapiens
tcttacccacttccctgcaag

SEQ ID NO: 4837773 - DNA, 16 bp, Homo sapiens
tcttacccttcaatgt

SEQ ID NO: 4837774 - DNA, 13 bp, Homo sapiens
tcttaccctttct

SEQ ID NO: 4837775 - DNA, 14 bp, Homo sapiens
tcttacctcatttg

SEQ ID NO: 4837776 - DNA, 20 bp, Homo sapiens
tcttacctgtaatagcctca

SEQ ID NO: 4837777 - DNA, 15 bp, Homo sapiens
tcttacgctctctgt

SEQ ID NO: 4837778 - DNA, 13 bp, Homo sapiens
tcttactgttttg

SEQ ID NO: 4837779 - DNA, 18 bp, Homo sapiens
tcttagaagaatattgta

SEQ ID NO: 4837780 - DNA, 16 bp, Homo sapiens
tcttagcttttctgca

SEQ ID NO: 4837781 - DNA, 16 bp, Homo sapiens
tcttatttatatatga

SEQ ID NO: 4837782 - DNA, 11 bp, Homo sapiens
tcttcaccccg

SEQ ID NO: 4837783 - DNA, 15 bp, Homo sapiens
tcttcaccccggcag

SEQ ID NO: 4837784 - DNA, 20 bp, Homo sapiens
tcttcaccccggcaggccct

SEQ ID NO: 4837785 - DNA, 21 bp, Homo sapiens
tcttcaccccggcaggccctg

SEQ ID NO: 4837786 - DNA, 23 bp, Homo sapiens
tcttcaccccggcaggccctgca

SEQ ID NO: 4837787 - DNA, 18 bp, Homo sapiens
tcttcacctcacttgtgg

SEQ ID NO: 4837788 - DNA, 23 bp, Homo sapiens
tcttcactgtcttactcaagata

SEQ ID NO: 4837789 - DNA, 14 bp, Homo sapiens
tcttcatacaaagg

SEQ ID NO: 4837790 - DNA, 18 bp, Homo sapiens
tcttcatccatagacaca

SEQ ID NO: 4837791 - DNA, 23 bp, Homo sapiens
tcttcatgtaaattgactgtact

SEQ ID NO: 4837792 - DNA, 19 bp, Homo sapiens
tcttcattttttttaattg

SEQ ID NO: 4837793 - DNA, 17 bp, Homo sapiens
tcttccaacatgtgatg

SEQ ID NO: 4837794 - DNA, 24 bp, Homo sapiens
tcttccaacatgtgatgtgttgct

SEQ ID NO: 4837795 - DNA, 21 bp, Homo sapiens
tcttccacaagagcccaggcc

SEQ ID NO: 4837796 - DNA, 18 bp, Homo sapiens
tcttcccacctgtcaacc

SEQ ID NO: 4837797 - DNA, 13 bp, Homo sapiens
tcttcccatttgt

SEQ ID NO: 4837798 - DNA, 24 bp, Homo sapiens
tcttcccatttgtaatgtatctta

SEQ ID NO: 4837799 - DNA, 19 bp, Homo sapiens
tcttccccaaggcactgag

SEQ ID NO: 4837800 - DNA, 20 bp, Homo sapiens
tcttccccaaggcactgagc

SEQ ID NO: 4837801 - DNA, 23 bp, Homo sapiens
tcttcccccttcccctgcgccct

SEQ ID NO: 4837802 - DNA, 12 bp, Homo sapiens
tcttccctagct

SEQ ID NO: 4837803 - DNA, 17 bp, Homo sapiens
tcttccctctcgctccc

SEQ ID NO: 4837804 - DNA, 21 bp, Homo sapiens
tcttccctgcttcacgattct

SEQ ID NO: 4837805 - DNA, 18 bp, Homo sapiens
tcttcctaccaaatataa

SEQ ID NO: 4837806 - DNA, 22 bp, Homo sapiens
tcttcctaccaaatataaactt

SEQ ID NO: 4837807 - DNA, 16 bp, Homo sapiens
tcttcctccaaagcct

SEQ ID NO: 4837808 - DNA, 17 bp, Homo sapiens
tcttcctgcctctctca

SEQ ID NO: 4837809 - DNA, 13 bp, Homo sapiens
tcttcctgtaatc

SEQ ID NO: 4837810 - DNA, 22 bp, Homo sapiens
tcttccttcctttctctctttc

SEQ ID NO: 4837811 - DNA, 17 bp, Homo sapiens
tcttccttgccacaatc

SEQ ID NO: 4837812 - DNA, 20 bp, Homo sapiens
tcttccttgccacaatcact

SEQ ID NO: 4837813 - DNA, 16 bp, Homo sapiens
tcttcggtggccttga

SEQ ID NO: 4837814 - DNA, 20 bp, Homo sapiens
tcttcggtggccttgagtct

SEQ ID NO: 4837815 - DNA, 16 bp, Homo sapiens
tcttcgtggattgttt

SEQ ID NO: 4837816 - DNA, 15 bp, Homo sapiens
tcttctcctttgtca

SEQ ID NO: 4837817 - DNA, 19 bp, Homo sapiens
tcttctcctttgtcaaatg

SEQ ID NO: 4837818 - DNA, 21 bp, Homo sapiens
tcttctcctttgtcaaatggt

SEQ ID NO: 4837819 - DNA, 13 bp, Homo sapiens
tcttctgttctca

SEQ ID NO: 4837820 - DNA, 14 bp, Homo sapiens
tcttctttaatttt

SEQ ID NO: 4837821 - DNA, 22 bp, Homo sapiens
tcttgaagacttttctttcagc

SEQ ID NO: 4837822 - DNA, 13 bp, Homo sapiens
tcttgaataaact

SEQ ID NO: 4837823 - DNA, 17 bp, Homo sapiens
tcttgaattgtaaggaa

SEQ ID NO: 4837824 - DNA, 21 bp, Homo sapiens
tcttgaattgtaaggaatgat

SEQ ID NO: 4837825 - DNA, 19 bp, Homo sapiens
tcttgacaggcgccgcctc

SEQ ID NO: 4837826 - DNA, 15 bp, Homo sapiens
tcttgagcagctgaa

SEQ ID NO: 4837827 - DNA, 15 bp, Homo sapiens
tcttgagtgggcccc

SEQ ID NO: 4837828 - DNA, 21 bp, Homo sapiens
tcttgagtgggccccctctct

SEQ ID NO: 4837829 - DNA, 19 bp, Homo sapiens
tcttgagtttcatttttca

SEQ ID NO: 4837830 - DNA, 16 bp, Homo sapiens
tcttgcaagctccagt

SEQ ID NO: 4837831 - DNA, 22 bp, Homo sapiens
tcttgcaagctccagtagctcc

SEQ ID NO: 4837832 - DNA, 12 bp, Homo sapiens
tcttgcactgta

SEQ ID NO: 4837833 - DNA, 17 bp, Homo sapiens
tcttgccgaggagccag

SEQ ID NO: 4837834 - DNA, 22 bp, Homo sapiens
tcttgcctcattttgcttccca

SEQ ID NO: 4837835 - DNA, 17 bp, Homo sapiens
tcttgcggcaccgccca

SEQ ID NO: 4837836 - DNA, 12 bp, Homo sapiens
tcttggagagga

SEQ ID NO: 4837837 - DNA, 14 bp, Homo sapiens
tcttggagaggagg

SEQ ID NO: 4837838 - DNA, 15 bp, Homo sapiens
tcttgggaagcagtt

SEQ ID NO: 4837839 - DNA, 20 bp, Homo sapiens
tcttgggaagcagtttcaga

SEQ ID NO: 4837840 - DNA, 14 bp, Homo sapiens
tcttgggattcctc

SEQ ID NO: 4837841 - DNA, 17 bp, Homo sapiens
tcttgggggcagaccag

SEQ ID NO: 4837842 - DNA, 23 bp, Homo sapiens
tcttgggggcagaccagagagct

SEQ ID NO: 4837843 - DNA, 20 bp, Homo sapiens
tcttgggggtggggctgcat

SEQ ID NO: 4837844 - DNA, 16 bp, Homo sapiens
tcttgggtctatgcct

SEQ ID NO: 4837845 - DNA, 21 bp, Homo sapiens
tcttggtcacaaagctattta

SEQ ID NO: 4837846 - DNA, 12 bp, Homo sapiens
tcttggtctctt

SEQ ID NO: 4837847 - DNA, 15 bp, Homo sapiens
tcttgtaaaactgtg

SEQ ID NO: 4837848 - DNA, 20 bp, Homo sapiens
tcttgtaaaactgtgacatt

SEQ ID NO: 4837849 - DNA, 21 bp, Homo sapiens
tcttgtaaaactgtgacattc

SEQ ID NO: 4837850 - DNA, 23 bp, Homo sapiens
tcttgtaaaactgtgacattcca

SEQ ID NO: 4837851 - DNA, 20 bp, Homo sapiens
tcttgtatctggattcaaat

SEQ ID NO: 4837852 - DNA, 18 bp, Homo sapiens
tcttgtattttcttccca

SEQ ID NO: 4837853 - DNA, 12 bp, Homo sapiens
tcttgtcattct

SEQ ID NO: 4837854 - DNA, 17 bp, Homo sapiens
tcttgtcattctcatcc

SEQ ID NO: 4837855 - DNA, 21 bp, Homo sapiens
tcttgtgtgtttattgtcaaa

SEQ ID NO: 4837856 - DNA, 19 bp, Homo sapiens
tcttgttatggtagaaaaa

SEQ ID NO: 4837857 - DNA, 14 bp, Homo sapiens
tcttgttgataaaa

SEQ ID NO: 4837858 - DNA, 13 bp, Homo sapiens
tcttgttgttcat

SEQ ID NO: 4837859 - DNA, 16 bp, Homo sapiens
tcttgtttaccaaaga

SEQ ID NO: 4837860 - DNA, 21 bp, Homo sapiens
tctttaaccagtctgaagttt

SEQ ID NO: 4837861 - DNA, 15 bp, Homo sapiens
tctttactaacactg

SEQ ID NO: 4837862 - DNA, 21 bp, Homo sapiens
tctttactcggcgtgctcctt

SEQ ID NO: 4837863 - DNA, 12 bp, Homo sapiens
tctttatgattt

SEQ ID NO: 4837864 - DNA, 14 bp, Homo sapiens
tctttatgatttca

SEQ ID NO: 4837865 - DNA, 17 bp, Homo sapiens
tctttcaatccacagta

SEQ ID NO: 4837866 - DNA, 16 bp, Homo sapiens
tctttcaattctgtga

SEQ ID NO: 4837867 - DNA, 16 bp, Homo sapiens
tctttcagccaagaat

SEQ ID NO: 4837868 - DNA, 19 bp, Homo sapiens
tctttcagccaagaattct

SEQ ID NO: 4837869 - DNA, 20 bp, Homo sapiens
tctttcagccaagaattctt

SEQ ID NO: 4837870 - DNA, 23 bp, Homo sapiens
tctttcatcaatcattgtacagt

SEQ ID NO: 4837871 - DNA, 19 bp, Homo sapiens
tctttccaaaggttgtaca

SEQ ID NO: 4837872 - DNA, 16 bp, Homo sapiens
tctttccccactgaag

SEQ ID NO: 4837873 - DNA, 22 bp, Homo sapiens
tctttcctcctcatgaaagcag

SEQ ID NO: 4837874 - DNA, 12 bp, Homo sapiens
tctttcctctta

SEQ ID NO: 4837875 - DNA, 11 bp, Homo sapiens
tctttccttcc

SEQ ID NO: 4837876 - DNA, 20 bp, Homo sapiens
tctttcctttcatcctcagc

SEQ ID NO: 4837877 - DNA, 14 bp, Homo sapiens
tctttctctctgtg

SEQ ID NO: 4837878 - DNA, 17 bp, Homo sapiens
tctttctctctttccat

SEQ ID NO: 4837879 - DNA, 22 bp, Homo sapiens
tctttcttaatagaaagtcaga

SEQ ID NO: 4837880 - DNA, 21 bp, Homo sapiens
tctttcttcaattaatggaaa

SEQ ID NO: 4837881 - DNA, 11 bp, Homo sapiens
tctttcttttc

SEQ ID NO: 4837882 - DNA, 17 bp, Homo sapiens
tctttcttttgtgcata

SEQ ID NO: 4837883 - DNA, 19 bp, Homo sapiens
tctttgagggactgcctct

SEQ ID NO: 4837884 - DNA, 23 bp, Homo sapiens
tctttgagggactgcctctgcca

SEQ ID NO: 4837885 - DNA, 16 bp, Homo sapiens
tctttgcattcgtcct

SEQ ID NO: 4837886 - DNA, 19 bp, Homo sapiens
tctttgctgtttatatata

SEQ ID NO: 4837887 - DNA, 14 bp, Homo sapiens
tctttggttcctca

SEQ ID NO: 4837888 - DNA, 17 bp, Homo sapiens
tctttgtcaatgctcta

SEQ ID NO: 4837889 - DNA, 14 bp, Homo sapiens
tctttgtgacagga

SEQ ID NO: 4837890 - DNA, 20 bp, Homo sapiens
tctttgtgacaggaaagccc

SEQ ID NO: 4837891 - DNA, 22 bp, Homo sapiens
tctttgtggggcttggcgtgga

SEQ ID NO: 4837892 - DNA, 14 bp, Homo sapiens
tctttgttgcttaa

SEQ ID NO: 4837893 - DNA, 12 bp, Homo sapiens
tcttttaactgc

SEQ ID NO: 4837894 - DNA, 19 bp, Homo sapiens
tcttttcccatcaccagaa

SEQ ID NO: 4837895 - DNA, 23 bp, Homo sapiens
tcttttgaatcaatctggcttct

SEQ ID NO: 4837896 - DNA, 21 bp, Homo sapiens
tctttttattaggttaagtct

SEQ ID NO: 4837897 - DNA, 14 bp, Homo sapiens
tcttttttcaatgt

SEQ ID NO: 4837898 - DNA, 20 bp, Homo sapiens
tcttttttcaatgtactgta

SEQ ID NO: 4837899 - DNA, 21 bp, Homo sapiens
tctttttttaagtgttctgtg

SEQ ID NO: 4837900 - DNA, 17 bp, Homo sapiens
tcttttttttttcgtct

SEQ ID NO: 4837901 - DNA, 23 bp, Homo sapiens
tgaaaaaaagggaaaacaaatat

SEQ ID NO: 4837902 - DNA, 12 bp, Homo sapiens
tgaaaaagtgtt

SEQ ID NO: 4837903 - DNA, 19 bp, Homo sapiens
tgaaaaagtgtttttacat

SEQ ID NO: 4837904 - DNA, 20 bp, Homo sapiens
tgaaaaagtgtttttacata

SEQ ID NO: 4837905 - DNA, 15 bp, Homo sapiens
tgaaaaatctgaatt

SEQ ID NO: 4837906 - DNA, 19 bp, Homo sapiens
tgaaaaatctgaatttcta

SEQ ID NO: 4837907 - DNA, 17 bp, Homo sapiens
tgaaaacctctttcgga

SEQ ID NO: 4837908 - DNA, 16 bp, Homo sapiens
tgaaaactaagttctc

SEQ ID NO: 4837909 - DNA, 13 bp, Homo sapiens
tgaaaactggaat

SEQ ID NO: 4837910 - DNA, 12 bp, Homo sapiens
tgaaaagttttc

SEQ ID NO: 4837911 - DNA, 22 bp, Homo sapiens
tgaaaagttttcaagcattgct

SEQ ID NO: 4837912 - DNA, 20 bp, Homo sapiens
tgaaaatggctgaagaaaca

SEQ ID NO: 4837913 - DNA, 12 bp, Homo sapiens
tgaaaattcttg

SEQ ID NO: 4837914 - DNA, 18 bp, Homo sapiens
tgaaaattttattgaata

SEQ ID NO: 4837915 - DNA, 22 bp, Homo sapiens
tgaaacaaatatactcatttgg

SEQ ID NO: 4837916 - DNA, 19 bp, Homo sapiens
tgaaacacacagtgaccaa

SEQ ID NO: 4837917 - DNA, 19 bp, Homo sapiens
tgaaacactcgtgtgcatg

SEQ ID NO: 4837918 - DNA, 17 bp, Homo sapiens
tgaaactgtatttactt

SEQ ID NO: 4837919 - DNA, 15 bp, Homo sapiens
tgaaagacagtaaag

SEQ ID NO: 4837920 - DNA, 17 bp, Homo sapiens
tgaaagagaaaatgctt

SEQ ID NO: 4837921 - DNA, 18 bp, Homo sapiens
tgaaagagaaaatgcttt

SEQ ID NO: 4837922 - DNA, 21 bp, Homo sapiens
tgaaagagaaaatgctttctc

SEQ ID NO: 4837923 - DNA, 22 bp, Homo sapiens
tgaaagcagcacacattgtgtt

SEQ ID NO: 4837924 - DNA, 12 bp, Homo sapiens
tgaaaggaaaga

SEQ ID NO: 4837925 - DNA, 17 bp, Homo sapiens
tgaaaggaaagaggctc

SEQ ID NO: 4837926 - DNA, 18 bp, Homo sapiens
tgaaaggtagacttttat

SEQ ID NO: 4837927 - DNA, 21 bp, Homo sapiens
tgaaagtcaagtctacctgcc

SEQ ID NO: 4837928 - DNA, 17 bp, Homo sapiens
tgaaagttgtgatctgt

SEQ ID NO: 4837929 - DNA, 18 bp, Homo sapiens
tgaaataaagagttctcc

SEQ ID NO: 4837930 - DNA, 22 bp, Homo sapiens
tgaaataacagccttaaatcct

SEQ ID NO: 4837931 - DNA, 18 bp, Homo sapiens
tgaaataaccgtaaaggt

SEQ ID NO: 4837932 - DNA, 23 bp, Homo sapiens
tgaaataaccgtaaaggtttatt

SEQ ID NO: 4837933 - DNA, 22 bp, Homo sapiens
tgaaatacttgaaaacttctca

SEQ ID NO: 4837934 - DNA, 16 bp, Homo sapiens
tgaaatataaactgtg

SEQ ID NO: 4837935 - DNA, 17 bp, Homo sapiens
tgaaatataaactgtga

SEQ ID NO: 4837936 - DNA, 23 bp, Homo sapiens
tgaaatataaactgtgagataaa

SEQ ID NO: 4837937 - DNA, 23 bp, Homo sapiens
tgaaatatcatcacgtatgttat

SEQ ID NO: 4837938 - DNA, 14 bp, Homo sapiens
tgaaatatttgctt

SEQ ID NO: 4837939 - DNA, 17 bp, Homo sapiens
tgaaatattttctactt

SEQ ID NO: 4837940 - DNA, 15 bp, Homo sapiens
tgaaatccaaaatag

SEQ ID NO: 4837941 - DNA, 15 bp, Homo sapiens
tgaaatctacaacat

SEQ ID NO: 4837942 - DNA, 15 bp, Homo sapiens
tgaaatgccaagact

SEQ ID NO: 4837943 - DNA, 13 bp, Homo sapiens
tgaaatgccagac

SEQ ID NO: 4837944 - DNA, 16 bp, Homo sapiens
tgaaattagtattttg

SEQ ID NO: 4837945 - DNA, 17 bp, Homo sapiens
tgaaattagtattttga

SEQ ID NO: 4837946 - DNA, 19 bp, Homo sapiens
tgaaattagtattttgagc

SEQ ID NO: 4837947 - DNA, 14 bp, Homo sapiens
tgaaattatatctg

SEQ ID NO: 4837948 - DNA, 15 bp, Homo sapiens
tgaaattatatctgt

SEQ ID NO: 4837949 - DNA, 18 bp, Homo sapiens
tgaaattatgtcaaatgg

SEQ ID NO: 4837950 - DNA, 19 bp, Homo sapiens
tgaaattatgtcaaatgga

SEQ ID NO: 4837951 - DNA, 20 bp, Homo sapiens
tgaaattatgtcaaatggat

SEQ ID NO: 4837952 - DNA, 14 bp, Homo sapiens
tgaaattcacaaag

SEQ ID NO: 4837953 - DNA, 18 bp, Homo sapiens
tgaaattcacaaagttaa

SEQ ID NO: 4837954 - DNA, 11 bp, Homo sapiens
tgaaatttaag

SEQ ID NO: 4837955 - DNA, 13 bp, Homo sapiens
tgaaatttctcag

SEQ ID NO: 4837956 - DNA, 16 bp, Homo sapiens
tgaaattttctagaat

SEQ ID NO: 4837957 - DNA, 17 bp, Homo sapiens
tgaaattttctgtacag

SEQ ID NO: 4837958 - DNA, 18 bp, Homo sapiens
tgaaatttttatttgtat

SEQ ID NO: 4837959 - DNA, 20 bp, Homo sapiens
tgaacaactcgaatcactca

SEQ ID NO: 4837960 - DNA, 20 bp, Homo sapiens
tgaacaagccacgttgcaga

SEQ ID NO: 4837961 - DNA, 15 bp, Homo sapiens
tgaacacaaagcctg

SEQ ID NO: 4837962 - DNA, 16 bp, Homo sapiens
tgaacaccactttgtc

SEQ ID NO: 4837963 - DNA, 23 bp, Homo sapiens
tgaacaccactttgtctctgaga

SEQ ID NO: 4837964 - DNA, 16 bp, Homo sapiens
tgaacactgcaccctc

SEQ ID NO: 4837965 - DNA, 12 bp, Homo sapiens
tgaacagggcaa

SEQ ID NO: 4837966 - DNA, 20 bp, Homo sapiens
tgaacagggcaaaatgaact

SEQ ID NO: 4837967 - DNA, 13 bp, Homo sapiens
tgaacatgtttta

SEQ ID NO: 4837968 - DNA, 16 bp, Homo sapiens
tgaaccgtcaatgtga

SEQ ID NO: 4837969 - DNA, 18 bp, Homo sapiens
tgaaccgtcaatgtgaaa

SEQ ID NO: 4837970 - DNA, 20 bp, Homo sapiens
tgaacgatccttcaaagtct

SEQ ID NO: 4837971 - DNA, 20 bp, Homo sapiens
tgaacgcacaacatgcacat

SEQ ID NO: 4837972 - DNA, 21 bp, Homo sapiens
tgaactatcagggcaagctca

SEQ ID NO: 4837973 - DNA, 15 bp, Homo sapiens
tgaactcacagactg

SEQ ID NO: 4837974 - DNA, 16 bp, Homo sapiens
tgaactcacagactgc

SEQ ID NO: 4837975 - DNA, 15 bp, Homo sapiens
tgaactgaagcagag

SEQ ID NO: 4837976 - DNA, 17 bp, Homo sapiens
tgaactgaagcagagtc

SEQ ID NO: 4837977 - DNA, 14 bp, Homo sapiens
tgaactggccccag

SEQ ID NO: 4837978 - DNA, 16 bp, Homo sapiens
tgaactggccccagct

SEQ ID NO: 4837979 - DNA, 14 bp, Homo sapiens
tgaacttggcgctg

SEQ ID NO: 4837980 - DNA, 14 bp, Homo sapiens
tgaactttggaagc

SEQ ID NO: 4837981 - DNA, 13 bp, Homo sapiens
tgaagaaacacag

SEQ ID NO: 4837982 - DNA, 15 bp, Homo sapiens
tgaagaaacacagca

SEQ ID NO: 4837983 - DNA, 21 bp, Homo sapiens
tgaagaaacacagcatgcatt

SEQ ID NO: 4837984 - DNA, 11 bp, Homo sapiens
tgaagaatatt

SEQ ID NO: 4837985 - DNA, 13 bp, Homo sapiens
tgaagaatattgt

SEQ ID NO: 4837986 - DNA, 21 bp, Homo sapiens
tgaagaattaatgacaacaaa

SEQ ID NO: 4837987 - DNA, 21 bp, Homo sapiens
tgaagacaccagagtgtatgc

SEQ ID NO: 4837988 - DNA, 16 bp, Homo sapiens
tgaagacagagctaca

SEQ ID NO: 4837989 - DNA, 16 bp, Homo sapiens
tgaagaccctatctcc

SEQ ID NO: 4837990 - DNA, 22 bp, Homo sapiens
tgaagacttttctttcagccaa

SEQ ID NO: 4837991 - DNA, 21 bp, Homo sapiens
tgaagagagatatatctgaaa

SEQ ID NO: 4837992 - DNA, 21 bp, Homo sapiens
tgaagatctcagataaagtga

SEQ ID NO: 4837993 - DNA, 21 bp, Homo sapiens
tgaagatgcattttaaatgtc

SEQ ID NO: 4837994 - DNA, 22 bp, Homo sapiens
tgaagatgcattttaaatgtct

SEQ ID NO: 4837995 - DNA, 13 bp, Homo sapiens
tgaagcccaggag

SEQ ID NO: 4837996 - DNA, 13 bp, Homo sapiens
tgaagcctttatc

SEQ ID NO: 4837997 - DNA, 18 bp, Homo sapiens
tgaaggaaagaatatgga

SEQ ID NO: 4837998 - DNA, 13 bp, Homo sapiens
tgaaggagaggag

SEQ ID NO: 4837999 - DNA, 19 bp, Homo sapiens
tgaaggatctgtccgacag

SEQ ID NO: 4838000 - DNA, 13 bp, Homo sapiens
tgaagggaaatca

SEQ ID NO: 4838001 - DNA, 21 bp, Homo sapiens
tgaagggaaatcaatttaaag

SEQ ID NO: 4838002 - DNA, 14 bp, Homo sapiens
tgaaggggaaaacc

SEQ ID NO: 4838003 - DNA, 18 bp, Homo sapiens
tgaaggggaaaacctcag

SEQ ID NO: 4838004 - DNA, 12 bp, Homo sapiens
tgaaggggccag

SEQ ID NO: 4838005 - DNA, 17 bp, Homo sapiens
tgaaggggccagaccac

SEQ ID NO: 4838006 - DNA, 13 bp, Homo sapiens
tgaaggggctggt

SEQ ID NO: 4838007 - DNA, 17 bp, Homo sapiens
tgaaggggctggtggag

SEQ ID NO: 4838008 - DNA, 17 bp, Homo sapiens
tgaagtagtgtgagtgt

SEQ ID NO: 4838009 - DNA, 17 bp, Homo sapiens
tgaagtctttgtacaga

SEQ ID NO: 4838010 - DNA, 18 bp, Homo sapiens
tgaagtgattgacatttt

SEQ ID NO: 4838011 - DNA, 14 bp, Homo sapiens
tgaagttggacagc

SEQ ID NO: 4838012 - DNA, 15 bp, Homo sapiens
tgaagtttcatttat

SEQ ID NO: 4838013 - DNA, 14 bp, Homo sapiens
tgaataaaatgttt

SEQ ID NO: 4838014 - DNA, 15 bp, Homo sapiens
tgaataacaacaatt

SEQ ID NO: 4838015 - DNA, 13 bp, Homo sapiens
tgaatataaatgt

SEQ ID NO: 4838016 - DNA, 14 bp, Homo sapiens
tgaatataaatgta

SEQ ID NO: 4838017 - DNA, 21 bp, Homo sapiens
tgaatataaatgtgtgtatgt

SEQ ID NO: 4838018 - DNA, 13 bp, Homo sapiens
tgaatatgtgtaa

SEQ ID NO: 4838019 - DNA, 18 bp, Homo sapiens
tgaatcaatctggcttct

SEQ ID NO: 4838020 - DNA, 21 bp, Homo sapiens
tgaatcactgcacctctttgt

SEQ ID NO: 4838021 - DNA, 21 bp, Homo sapiens
tgaatcagaataaccttcaaa

SEQ ID NO: 4838022 - DNA, 15 bp, Homo sapiens
tgaatcagaggcaga

SEQ ID NO: 4838023 - DNA, 15 bp, Homo sapiens
tgaatccatcgattt

SEQ ID NO: 4838024 - DNA, 17 bp, Homo sapiens
tgaatccatcgatttgt

SEQ ID NO: 4838025 - DNA, 19 bp, Homo sapiens
tgaatctctaaaatgctgt

SEQ ID NO: 4838026 - DNA, 20 bp, Homo sapiens
tgaatctctaaaatgctgtt

SEQ ID NO: 4838027 - DNA, 19 bp, Homo sapiens
tgaatctgagagatgctgt

SEQ ID NO: 4838028 - DNA, 16 bp, Homo sapiens
tgaatgaaatataaac

SEQ ID NO: 4838029 - DNA, 21 bp, Homo sapiens
tgaatgaaatataaactgtga

SEQ ID NO: 4838030 - DNA, 15 bp, Homo sapiens
tgaatgacatcaaca

SEQ ID NO: 4838031 - DNA, 17 bp, Homo sapiens
tgaatgagcattctgca

SEQ ID NO: 4838032 - DNA, 15 bp, Homo sapiens
tgaatgcagtataaa

SEQ ID NO: 4838033 - DNA, 12 bp, Homo sapiens
tgaatgctattt

SEQ ID NO: 4838034 - DNA, 14 bp, Homo sapiens
tgaatggttgcaaa

SEQ ID NO: 4838035 - DNA, 18 bp, Homo sapiens
tgaatggttgcaaagtgt

SEQ ID NO: 4838036 - DNA, 21 bp, Homo sapiens
tgaatgttgtcctgtgtcatc

SEQ ID NO: 4838037 - DNA, 13 bp, Homo sapiens
tgaattaaagtct

SEQ ID NO: 4838038 - DNA, 14 bp, Homo sapiens
tgaattattaatga

SEQ ID NO: 4838039 - DNA, 18 bp, Homo sapiens
tgaattattaatgaatgc

SEQ ID NO: 4838040 - DNA, 16 bp, Homo sapiens
tgaattggctgccaag

SEQ ID NO: 4838041 - DNA, 22 bp, Homo sapiens
tgaattggctgccaagagtcca

SEQ ID NO: 4838042 - DNA, 14 bp, Homo sapiens
tgaattgttatgta

SEQ ID NO: 4838043 - DNA, 15 bp, Homo sapiens
tgaattttaaaagca

SEQ ID NO: 4838044 - DNA, 15 bp, Homo sapiens
tgaattttaaaatgc

SEQ ID NO: 4838045 - DNA, 18 bp, Homo sapiens
tgaattttttcctaccat

SEQ ID NO: 4838046 - DNA, 19 bp, Homo sapiens
tgacaaagaaaatgagaat

SEQ ID NO: 4838047 - DNA, 16 bp, Homo sapiens
tgacaagggctgacct

SEQ ID NO: 4838048 - DNA, 21 bp, Homo sapiens
tgacaagtgacttatttgctc

SEQ ID NO: 4838049 - DNA, 17 bp, Homo sapiens
tgacaagtttaaaggct

SEQ ID NO: 4838050 - DNA, 14 bp, Homo sapiens
tgacacaactcatc

SEQ ID NO: 4838051 - DNA, 22 bp, Homo sapiens
tgacacaatggtagctctgaag

SEQ ID NO: 4838052 - DNA, 23 bp, Homo sapiens
tgacacactcaccatttaatcat

SEQ ID NO: 4838053 - DNA, 19 bp, Homo sapiens
tgacacctgccgctgcttg

SEQ ID NO: 4838054 - DNA, 20 bp, Homo sapiens
tgacacttttcatatcattt

SEQ ID NO: 4838055 - DNA, 20 bp, Homo sapiens
tgacagcatttcagctgtga

SEQ ID NO: 4838056 - DNA, 16 bp, Homo sapiens
tgacaggaaagccctc

SEQ ID NO: 4838057 - DNA, 18 bp, Homo sapiens
tgacaggaaagccctccc

SEQ ID NO: 4838058 - DNA, 19 bp, Homo sapiens
tgacaggaaagccctcccc

SEQ ID NO: 4838059 - DNA, 23 bp, Homo sapiens
tgacaggccttcctcctctcaaa

SEQ ID NO: 4838060 - DNA, 18 bp, Homo sapiens
tgacaggcgccgcctcgc

SEQ ID NO: 4838061 - DNA, 15 bp, Homo sapiens
tgacagtagcatact

SEQ ID NO: 4838062 - DNA, 17 bp, Homo sapiens
tgacagtggttatattt

SEQ ID NO: 4838063 - DNA, 15 bp, Homo sapiens
tgacagttacttaca

SEQ ID NO: 4838064 - DNA, 18 bp, Homo sapiens
tgacagttacttacacac

SEQ ID NO: 4838065 - DNA, 20 bp, Homo sapiens
tgacagttacttacacacct

SEQ ID NO: 4838066 - DNA, 16 bp, Homo sapiens
tgacatcagcactgcc

SEQ ID NO: 4838067 - DNA, 11 bp, Homo sapiens
tgacatgcact

SEQ ID NO: 4838068 - DNA, 13 bp, Homo sapiens
tgacatgcactga

SEQ ID NO: 4838069 - DNA, 14 bp, Homo sapiens
tgacatgcactgac

SEQ ID NO: 4838070 - DNA, 15 bp, Homo sapiens
tgacatgcactgacc

SEQ ID NO: 4838071 - DNA, 21 bp, Homo sapiens
tgacatgcactgacccttcca

SEQ ID NO: 4838072 - DNA, 22 bp, Homo sapiens
tgacatgctaacctctctgaac

SEQ ID NO: 4838073 - DNA, 13 bp, Homo sapiens
tgacatgttttat

SEQ ID NO: 4838074 - DNA, 14 bp, Homo sapiens
tgacattgtcagaa

SEQ ID NO: 4838075 - DNA, 23 bp, Homo sapiens
tgacattttgtagctagtttaaa

SEQ ID NO: 4838076 - DNA, 14 bp, Homo sapiens
tgaccaagtataaa

SEQ ID NO: 4838077 - DNA, 15 bp, Homo sapiens
tgaccaatctctgtg

SEQ ID NO: 4838078 - DNA, 17 bp, Homo sapiens
tgaccaatctctgtgac

SEQ ID NO: 4838079 - DNA, 15 bp, Homo sapiens
tgaccagactgtggg

SEQ ID NO: 4838080 - DNA, 16 bp, Homo sapiens
tgaccagactgtgggt

SEQ ID NO: 4838081 - DNA, 19 bp, Homo sapiens
tgaccagcaccatctctcc

SEQ ID NO: 4838082 - DNA, 15 bp, Homo sapiens
tgaccagcataccag

SEQ ID NO: 4838083 - DNA, 14 bp, Homo sapiens
tgaccccacacgcc

SEQ ID NO: 4838084 - DNA, 21 bp, Homo sapiens
tgaccctcacttttctcatct

SEQ ID NO: 4838085 - DNA, 20 bp, Homo sapiens
tgaccctgaaatattttcta

SEQ ID NO: 4838086 - DNA, 14 bp, Homo sapiens
tgaccctgtgcccc

SEQ ID NO: 4838087 - DNA, 16 bp, Homo sapiens
tgaccctgtgccccgc

SEQ ID NO: 4838088 - DNA, 16 bp, Homo sapiens
tgaccctgtgcctgtg

SEQ ID NO: 4838089 - DNA, 22 bp, Homo sapiens
tgacccttcccaatcagcactg

SEQ ID NO: 4838090 - DNA, 23 bp, Homo sapiens
tgacccttcccaatcagcactga

SEQ ID NO: 4838091 - DNA, 18 bp, Homo sapiens
tgaccggcccgccacctt

SEQ ID NO: 4838092 - DNA, 14 bp, Homo sapiens
tgaccgtgaggcca

SEQ ID NO: 4838093 - DNA, 16 bp, Homo sapiens
tgaccgtgaggccaga

SEQ ID NO: 4838094 - DNA, 15 bp, Homo sapiens
tgacctaccctggac

SEQ ID NO: 4838095 - DNA, 19 bp, Homo sapiens
tgacctctcacttttttat

SEQ ID NO: 4838096 - DNA, 16 bp, Homo sapiens
tgacctgacacctgcc

SEQ ID NO: 4838097 - DNA, 19 bp, Homo sapiens
tgacctgacacctgccgct

SEQ ID NO: 4838098 - DNA, 17 bp, Homo sapiens
tgacctgatttccattt

SEQ ID NO: 4838099 - DNA, 14 bp, Homo sapiens
tgaccttcatgacc

SEQ ID NO: 4838100 - DNA, 14 bp, Homo sapiens
tgaccttcctctgg

SEQ ID NO: 4838101 - DNA, 19 bp, Homo sapiens
tgaccttcctctggggctc

SEQ ID NO: 4838102 - DNA, 24 bp, Homo sapiens
tgaccttcctctggggctctaggg

SEQ ID NO: 4838103 - DNA, 14 bp, Homo sapiens
tgacctttatttat

SEQ ID NO: 4838104 - DNA, 21 bp, Homo sapiens
tgacctttttaatccaggccc

SEQ ID NO: 4838105 - DNA, 12 bp, Homo sapiens
tgacggccctgc

SEQ ID NO: 4838106 - DNA, 15 bp, Homo sapiens
tgacggccctgcaat

SEQ ID NO: 4838107 - DNA, 18 bp, Homo sapiens
tgacggtattatgcttct

SEQ ID NO: 4838108 - DNA, 14 bp, Homo sapiens
tgacgtgtgtggtc

SEQ ID NO: 4838109 - DNA, 20 bp, Homo sapiens
tgactaatccttaataacta

SEQ ID NO: 4838110 - DNA, 22 bp, Homo sapiens
tgactcagtgcagggacagcct

SEQ ID NO: 4838111 - DNA, 22 bp, Homo sapiens
tgactccaaccattcaaaaatt

SEQ ID NO: 4838112 - DNA, 17 bp, Homo sapiens
tgactccagaatttccc

SEQ ID NO: 4838113 - DNA, 19 bp, Homo sapiens
tgactccagaatttcccaa

SEQ ID NO: 4838114 - DNA, 23 bp, Homo sapiens
tgactccagaatttcccaaagca

SEQ ID NO: 4838115 - DNA, 15 bp, Homo sapiens
tgactccctgtgggg

SEQ ID NO: 4838116 - DNA, 16 bp, Homo sapiens
tgactctggctgccaa

SEQ ID NO: 4838117 - DNA, 17 bp, Homo sapiens
tgactctggctgccaag

SEQ ID NO: 4838118 - DNA, 16 bp, Homo sapiens
tgactgtcccaccggg

SEQ ID NO: 4838119 - DNA, 16 bp, Homo sapiens
tgactgttctcttact

SEQ ID NO: 4838120 - DNA, 15 bp, Homo sapiens
tgacttcaaatgtgt

SEQ ID NO: 4838121 - DNA, 16 bp, Homo sapiens
tgacttcaaatgtgta

SEQ ID NO: 4838122 - DNA, 20 bp, Homo sapiens
tgacttcaaatgtgtaactt

SEQ ID NO: 4838123 - DNA, 22 bp, Homo sapiens
tgacttcaaatgtgtaacttta

SEQ ID NO: 4838124 - DNA, 17 bp, Homo sapiens
tgacttcagactctctc

SEQ ID NO: 4838125 - DNA, 20 bp, Homo sapiens
tgacttcagactctctcctc

SEQ ID NO: 4838126 - DNA, 16 bp, Homo sapiens
tgacttcttgttcatg

SEQ ID NO: 4838127 - DNA, 22 bp, Homo sapiens
tgacttctttactaacactggc

SEQ ID NO: 4838128 - DNA, 23 bp, Homo sapiens
tgacttctttactaacactggct

SEQ ID NO: 4838129 - DNA, 13 bp, Homo sapiens
tgacttgccactg

SEQ ID NO: 4838130 - DNA, 20 bp, Homo sapiens
tgactttcagattgtatctg

SEQ ID NO: 4838131 - DNA, 15 bp, Homo sapiens
tgagaaatataaaaa

SEQ ID NO: 4838132 - DNA, 20 bp, Homo sapiens
tgagaaatcatgttgttcga

SEQ ID NO: 4838133 - DNA, 21 bp, Homo sapiens
tgagaaattgtgccaaagata

SEQ ID NO: 4838134 - DNA, 22 bp, Homo sapiens
tgagaactgtgaatatgtgtaa

SEQ ID NO: 4838135 - DNA, 17 bp, Homo sapiens
tgagaagtacagggcag

SEQ ID NO: 4838136 - DNA, 19 bp, Homo sapiens
tgagaatcgacctcactgt

SEQ ID NO: 4838137 - DNA, 15 bp, Homo sapiens
tgagaatctgtgcag

SEQ ID NO: 4838138 - DNA, 14 bp, Homo sapiens
tgagaatgtcattt

SEQ ID NO: 4838139 - DNA, 16 bp, Homo sapiens
tgagaatgtcatttgc

SEQ ID NO: 4838140 - DNA, 20 bp, Homo sapiens
tgagaatgtcatttgctaat

SEQ ID NO: 4838141 - DNA, 15 bp, Homo sapiens
tgagaattgagggga

SEQ ID NO: 4838142 - DNA, 16 bp, Homo sapiens
tgagacaatgccttgt

SEQ ID NO: 4838143 - DNA, 20 bp, Homo sapiens
tgagacacagcccagagact

SEQ ID NO: 4838144 - DNA, 21 bp, Homo sapiens
tgagacacagcccagagactg

SEQ ID NO: 4838145 - DNA, 19 bp, Homo sapiens
tgagacagaatctcagtct

SEQ ID NO: 4838146 - DNA, 15 bp, Homo sapiens
tgagaccaagtctct

SEQ ID NO: 4838147 - DNA, 16 bp, Homo sapiens
tgagacctcccccagg

SEQ ID NO: 4838148 - DNA, 17 bp, Homo sapiens
tgagacctcccccaggg

SEQ ID NO: 4838149 - DNA, 21 bp, Homo sapiens
tgagacctcccccagggaggg

SEQ ID NO: 4838150 - DNA, 15 bp, Homo sapiens
tgagactaaatgaga

SEQ ID NO: 4838151 - DNA, 19 bp, Homo sapiens
tgagacttcctattaattt

SEQ ID NO: 4838152 - DNA, 17 bp, Homo sapiens
tgagagaagccacgctg

SEQ ID NO: 4838153 - DNA, 21 bp, Homo sapiens
tgagagaagccacgctgtcct

SEQ ID NO: 4838154 - DNA, 22 bp, Homo sapiens
tgagagaagccacgctgtcctc

SEQ ID NO: 4838155 - DNA, 13 bp, Homo sapiens
tgagagcagcctc

SEQ ID NO: 4838156 - DNA, 14 bp, Homo sapiens
tgagagcagggctg

SEQ ID NO: 4838157 - DNA, 20 bp, Homo sapiens
tgagagcctccaggttcctc

SEQ ID NO: 4838158 - DNA, 21 bp, Homo sapiens
tgagagcctttggtgaataac

SEQ ID NO: 4838159 - DNA, 18 bp, Homo sapiens
tgagaggagcgtgtccta

SEQ ID NO: 4838160 - DNA, 23 bp, Homo sapiens
tgagaggcatccagtatcttgaa

SEQ ID NO: 4838161 - DNA, 14 bp, Homo sapiens
tgagagtagggccc

SEQ ID NO: 4838162 - DNA, 17 bp, Homo sapiens
tgagagtagggccctga

SEQ ID NO: 4838163 - DNA, 14 bp, Homo sapiens
tgagagtcatctca

SEQ ID NO: 4838164 - DNA, 14 bp, Homo sapiens
tgagataaatatca

SEQ ID NO: 4838165 - DNA, 17 bp, Homo sapiens
tgagataaatatcatta

SEQ ID NO: 4838166 - DNA, 18 bp, Homo sapiens
tgagatactttgcattgt

SEQ ID NO: 4838167 - DNA, 18 bp, Homo sapiens
tgagatagcttagtgtct

SEQ ID NO: 4838168 - DNA, 23 bp, Homo sapiens
tgagatcctcaaaaatcatcaaa

SEQ ID NO: 4838169 - DNA, 20 bp, Homo sapiens
tgagatggtgccccctgggg

SEQ ID NO: 4838170 - DNA, 17 bp, Homo sapiens
tgagatgtttagtagct

SEQ ID NO: 4838171 - DNA, 20 bp, Homo sapiens
tgagattggaaaaaattaga

SEQ ID NO: 4838172 - DNA, 19 bp, Homo sapiens
tgagatttgtatttatatt

SEQ ID NO: 4838173 - DNA, 15 bp, Homo sapiens
tgagcagaattcatt

SEQ ID NO: 4838174 - DNA, 17 bp, Homo sapiens
tgagcaggaaggcctgg

SEQ ID NO: 4838175 - DNA, 19 bp, Homo sapiens
tgagcaggaaggcctgggt

SEQ ID NO: 4838176 - DNA, 21 bp, Homo sapiens
tgagcagtggggagcgggggc

SEQ ID NO: 4838177 - DNA, 21 bp, Homo sapiens
tgagcagttgttatattcatt

SEQ ID NO: 4838178 - DNA, 15 bp, Homo sapiens
tgagccaaagagaaa

SEQ ID NO: 4838179 - DNA, 23 bp, Homo sapiens
tgagccaaagagaaaagattaaa

SEQ ID NO: 4838180 - DNA, 16 bp, Homo sapiens
tgagccacagtggggc

SEQ ID NO: 4838181 - DNA, 20 bp, Homo sapiens
tgagccccctgcacccaccc

SEQ ID NO: 4838182 - DNA, 21 bp, Homo sapiens
tgagccccctgcacccacccc

SEQ ID NO: 4838183 - DNA, 22 bp, Homo sapiens
tgagccccctgcacccacccct

SEQ ID NO: 4838184 - DNA, 21 bp, Homo sapiens
tgagcccctccctcctgtgtt

SEQ ID NO: 4838185 - DNA, 14 bp, Homo sapiens
tgagcccctcctct

SEQ ID NO: 4838186 - DNA, 17 bp, Homo sapiens
tgagcccctcctctcct

SEQ ID NO: 4838187 - DNA, 17 bp, Homo sapiens
tgagccctgccctcact

SEQ ID NO: 4838188 - DNA, 13 bp, Homo sapiens
tgagcctgtctct

SEQ ID NO: 4838189 - DNA, 20 bp, Homo sapiens
tgagcgccccgcccccaccc

SEQ ID NO: 4838190 - DNA, 23 bp, Homo sapiens
tgagcgccccgcccccaccccta

SEQ ID NO: 4838191 - DNA, 21 bp, Homo sapiens
tgagctaccaggaagaggggc

SEQ ID NO: 4838192 - DNA, 17 bp, Homo sapiens
tgagctggttttctctg

SEQ ID NO: 4838193 - DNA, 16 bp, Homo sapiens
tgaggaaactcataca

SEQ ID NO: 4838194 - DNA, 23 bp, Homo sapiens
tgaggaaggaggggaagctgcag

SEQ ID NO: 4838195 - DNA, 17 bp, Homo sapiens
tgaggacataaatcttc

SEQ ID NO: 4838196 - DNA, 16 bp, Homo sapiens
tgaggaccctcccagg

SEQ ID NO: 4838197 - DNA, 17 bp, Homo sapiens
tgaggaccctcccaggt

SEQ ID NO: 4838198 - DNA, 17 bp, Homo sapiens
tgaggacggggcagagc

SEQ ID NO: 4838199 - DNA, 21 bp, Homo sapiens
tgaggactgttggctgattgg

SEQ ID NO: 4838200 - DNA, 14 bp, Homo sapiens
tgaggatgatgtac

SEQ ID NO: 4838201 - DNA, 15 bp, Homo sapiens
tgaggccaaatgagt

SEQ ID NO: 4838202 - DNA, 20 bp, Homo sapiens
tgaggccaaatgagttccct

SEQ ID NO: 4838203 - DNA, 14 bp, Homo sapiens
tgaggccagagaca

SEQ ID NO: 4838204 - DNA, 20 bp, Homo sapiens
tgaggccagagacacaagcc

SEQ ID NO: 4838205 - DNA, 18 bp, Homo sapiens
tgaggctggataggagag

SEQ ID NO: 4838206 - DNA, 19 bp, Homo sapiens
tgaggctggcggggtctgc

SEQ ID NO: 4838207 - DNA, 14 bp, Homo sapiens
tgagggaaaacata

SEQ ID NO: 4838208 - DNA, 17 bp, Homo sapiens
tgagggaacagagaggt

SEQ ID NO: 4838209 - DNA, 16 bp, Homo sapiens
tgagggactgcctctg

SEQ ID NO: 4838210 - DNA, 21 bp, Homo sapiens
tgagggcagggttctagaagg

SEQ ID NO: 4838211 - DNA, 16 bp, Homo sapiens
tgaggggaggtggcca

SEQ ID NO: 4838212 - DNA, 21 bp, Homo sapiens
tgaggttgagctatgatatgt

SEQ ID NO: 4838213 - DNA, 15 bp, Homo sapiens
tgagtagcatatata

SEQ ID NO: 4838214 - DNA, 11 bp, Homo sapiens
tgagtcctggc

SEQ ID NO: 4838215 - DNA, 22 bp, Homo sapiens
tgagtcctggcatgggaatgaa

SEQ ID NO: 4838216 - DNA, 14 bp, Homo sapiens
tgagtcggctgggc

SEQ ID NO: 4838217 - DNA, 15 bp, Homo sapiens
tgagtcggctgggca

SEQ ID NO: 4838218 - DNA, 16 bp, Homo sapiens
tgagtcggctgggcag

SEQ ID NO: 4838219 - DNA, 14 bp, Homo sapiens
tgagtgagggcata

SEQ ID NO: 4838220 - DNA, 12 bp, Homo sapiens
tgagtggacagc

SEQ ID NO: 4838221 - DNA, 15 bp, Homo sapiens
tgagtggacagcagc

SEQ ID NO: 4838222 - DNA, 22 bp, Homo sapiens
tgagtgtacatttatgtgtgaa

SEQ ID NO: 4838223 - DNA, 14 bp, Homo sapiens
tgagtgtatgtata

SEQ ID NO: 4838224 - DNA, 22 bp, Homo sapiens
tgagtgtatgtatacacacaca

SEQ ID NO: 4838225 - DNA, 15 bp, Homo sapiens
tgagttctgcacata

SEQ ID NO: 4838226 - DNA, 20 bp, Homo sapiens
tgagttctgcacatacagat

SEQ ID NO: 4838227 - DNA, 15 bp, Homo sapiens
tgagttcttcctgta

SEQ ID NO: 4838228 - DNA, 17 bp, Homo sapiens
tgagttcttcctgtaat

SEQ ID NO: 4838229 - DNA, 19 bp, Homo sapiens
tgagttggttacctattgc

SEQ ID NO: 4838230 - DNA, 14 bp, Homo sapiens
tgataataaaattc

SEQ ID NO: 4838231 - DNA, 21 bp, Homo sapiens
tgataataaaattcattccat

SEQ ID NO: 4838232 - DNA, 21 bp, Homo sapiens
tgatacttatttataacattg

SEQ ID NO: 4838233 - DNA, 23 bp, Homo sapiens
tgatagaagaaggactgaagaaa

SEQ ID NO: 4838234 - DNA, 15 bp, Homo sapiens
tgatagcactggttt

SEQ ID NO: 4838235 - DNA, 16 bp, Homo sapiens
tgatagcactggtttg

SEQ ID NO: 4838236 - DNA, 22 bp, Homo sapiens
tgatagtgtttcgttaagcagt

SEQ ID NO: 4838237 - DNA, 23 bp, Homo sapiens
tgatagtgtttcgttaagcagta

SEQ ID NO: 4838238 - DNA, 16 bp, Homo sapiens
tgatataactttagaa

SEQ ID NO: 4838239 - DNA, 11 bp, Homo sapiens
tgatatcagga

SEQ ID NO: 4838240 - DNA, 11 bp, Homo sapiens
tgatatgcatg

SEQ ID NO: 4838241 - DNA, 16 bp, Homo sapiens
tgatatgcatgtagca

SEQ ID NO: 4838242 - DNA, 17 bp, Homo sapiens
tgatatgcatgtagcat

SEQ ID NO: 4838243 - DNA, 20 bp, Homo sapiens
tgatatgtctttaaaatgat

SEQ ID NO: 4838244 - DNA, 12 bp, Homo sapiens
tgatatgtgctt

SEQ ID NO: 4838245 - DNA, 20 bp, Homo sapiens
tgatatgtgcttgtgtgtat

SEQ ID NO: 4838246 - DNA, 21 bp, Homo sapiens
tgatatgtgcttgtgtgtatg

SEQ ID NO: 4838247 - DNA, 15 bp, Homo sapiens
tgatatgtgtaatat

SEQ ID NO: 4838248 - DNA, 19 bp, Homo sapiens
tgatatgtgtaatatcatt

SEQ ID NO: 4838249 - DNA, 22 bp, Homo sapiens
tgatattctaagaaatatctgt

SEQ ID NO: 4838250 - DNA, 13 bp, Homo sapiens
tgatattttaaaa

SEQ ID NO: 4838251 - DNA, 13 bp, Homo sapiens
tgatcaaaatgca

SEQ ID NO: 4838252 - DNA, 23 bp, Homo sapiens
tgatcaaggagggagaaaggcaa

SEQ ID NO: 4838253 - DNA, 24 bp, Homo sapiens
tgatcactttctgaaattcacaaa

SEQ ID NO: 4838254 - DNA, 18 bp, Homo sapiens
tgatcagtgtgataagga

SEQ ID NO: 4838255 - DNA, 20 bp, Homo sapiens
tgatcccccaaacagcatgt

SEQ ID NO: 4838256 - DNA, 16 bp, Homo sapiens
tgatcgtgtgttgcca

SEQ ID NO: 4838257 - DNA, 18 bp, Homo sapiens
tgatctcagcatcctgga

SEQ ID NO: 4838258 - DNA, 14 bp, Homo sapiens
tgatctgtattaag

SEQ ID NO: 4838259 - DNA, 21 bp, Homo sapiens
tgatctgtattaagctccagt

SEQ ID NO: 4838260 - DNA, 16 bp, Homo sapiens
tgatgaataaaatgtt

SEQ ID NO: 4838261 - DNA, 17 bp, Homo sapiens
tgatgaataaaatgttt

SEQ ID NO: 4838262 - DNA, 22 bp, Homo sapiens
tgatgaatcagtcctagaatgt

SEQ ID NO: 4838263 - DNA, 22 bp, Homo sapiens
tgatgaatttaccatcaaacaa

SEQ ID NO: 4838264 - DNA, 14 bp, Homo sapiens
tgatgagacaacac

SEQ ID NO: 4838265 - DNA, 17 bp, Homo sapiens
tgatgagacaacacaca

SEQ ID NO: 4838266 - DNA, 18 bp, Homo sapiens
tgatgagacaacacacac

SEQ ID NO: 4838267 - DNA, 13 bp, Homo sapiens
tgatgaggcattt

SEQ ID NO: 4838268 - DNA, 15 bp, Homo sapiens
tgatgatgttctgaa

SEQ ID NO: 4838269 - DNA, 15 bp, Homo sapiens
tgatgctagttctta

SEQ ID NO: 4838270 - DNA, 14 bp, Homo sapiens
tgatggagaaggaa

SEQ ID NO: 4838271 - DNA, 16 bp, Homo sapiens
tgatgggcaaggggcc

SEQ ID NO: 4838272 - DNA, 23 bp, Homo sapiens
tgatggtagaaattttatctctt

SEQ ID NO: 4838273 - DNA, 20 bp, Homo sapiens
tgatgtattattatatatgt

SEQ ID NO: 4838274 - DNA, 13 bp, Homo sapiens
tgatgtgatttat

SEQ ID NO: 4838275 - DNA, 17 bp, Homo sapiens
tgatgtgatttatgcat

SEQ ID NO: 4838276 - DNA, 22 bp, Homo sapiens
tgatgtgtccgtgaaagttgtg

SEQ ID NO: 4838277 - DNA, 17 bp, Homo sapiens
tgattaactcagtcctg

SEQ ID NO: 4838278 - DNA, 11 bp, Homo sapiens
tgattaaggac

SEQ ID NO: 4838279 - DNA, 18 bp, Homo sapiens
tgattaaggactacagaa

SEQ ID NO: 4838280 - DNA, 21 bp, Homo sapiens
tgattaaggactacagaattg

SEQ ID NO: 4838281 - DNA, 13 bp, Homo sapiens
tgattaagtatat

SEQ ID NO: 4838282 - DNA, 14 bp, Homo sapiens
tgattacctgaaag

SEQ ID NO: 4838283 - DNA, 17 bp, Homo sapiens
tgattagtgcaataaaa

SEQ ID NO: 4838284 - DNA, 11 bp, Homo sapiens
tgattatgaaa

SEQ ID NO: 4838285 - DNA, 18 bp, Homo sapiens
tgattattacaacaagca

SEQ ID NO: 4838286 - DNA, 11 bp, Homo sapiens
tgattcaatgt

SEQ ID NO: 4838287 - DNA, 13 bp, Homo sapiens
tgattcaatgtga

SEQ ID NO: 4838288 - DNA, 19 bp, Homo sapiens
tgattcaatgtgaatttta

SEQ ID NO: 4838289 - DNA, 15 bp, Homo sapiens
tgattctcctctccc

SEQ ID NO: 4838290 - DNA, 22 bp, Homo sapiens
tgattctttcaatccacagtat

SEQ ID NO: 4838291 - DNA, 20 bp, Homo sapiens
tgattgacattttgtagcta

SEQ ID NO: 4838292 - DNA, 21 bp, Homo sapiens
tgattgagagcagcctcttga

SEQ ID NO: 4838293 - DNA, 20 bp, Homo sapiens
tgattggaaaataataaaag

SEQ ID NO: 4838294 - DNA, 13 bp, Homo sapiens
tgattgttcctcc

SEQ ID NO: 4838295 - DNA, 17 bp, Homo sapiens
tgattgtttgatgaata

SEQ ID NO: 4838296 - DNA, 21 bp, Homo sapiens
tgatttaaacttcttaactgg

SEQ ID NO: 4838297 - DNA, 16 bp, Homo sapiens
tgatttaagcatttta

SEQ ID NO: 4838298 - DNA, 18 bp, Homo sapiens
tgatttaagcattttact

SEQ ID NO: 4838299 - DNA, 14 bp, Homo sapiens
tgatttaattctta

SEQ ID NO: 4838300 - DNA, 17 bp, Homo sapiens
tgatttactaacagtaa

SEQ ID NO: 4838301 - DNA, 19 bp, Homo sapiens
tgatttactaacagtaact

SEQ ID NO: 4838302 - DNA, 15 bp, Homo sapiens
tgatttaggcttcta

SEQ ID NO: 4838303 - DNA, 18 bp, Homo sapiens
tgatttattttgtatgaa

SEQ ID NO: 4838304 - DNA, 18 bp, Homo sapiens
tgatttccatccaaacct

SEQ ID NO: 4838305 - DNA, 23 bp, Homo sapiens
tgatttctcaccctctgtccttc

SEQ ID NO: 4838306 - DNA, 18 bp, Homo sapiens
tgatttgcaacactgcca

SEQ ID NO: 4838307 - DNA, 19 bp, Homo sapiens
tgatttgtaaaacagtggt

SEQ ID NO: 4838308 - DNA, 15 bp, Homo sapiens
tgatttgttcctttc

SEQ ID NO: 4838309 - DNA, 17 bp, Homo sapiens
tgatttgttcctttctg

SEQ ID NO: 4838310 - DNA, 13 bp, Homo sapiens
tgattttaacttt

SEQ ID NO: 4838311 - DNA, 20 bp, Homo sapiens
tgattttccccctaattctt

SEQ ID NO: 4838312 - DNA, 19 bp, Homo sapiens
tgatttttgttgattaaaa

SEQ ID NO: 4838313 - DNA, 20 bp, Homo sapiens
tgcaaaaatgaattcacccc

SEQ ID NO: 4838314 - DNA, 14 bp, Homo sapiens
tgcaaagcacacct

SEQ ID NO: 4838315 - DNA, 18 bp, Homo sapiens
tgcaaagtgttgtcttat

SEQ ID NO: 4838316 - DNA, 14 bp, Homo sapiens
tgcaaatagaaaac

SEQ ID NO: 4838317 - DNA, 17 bp, Homo sapiens
tgcaaatagaaaacagg

SEQ ID NO: 4838318 - DNA, 14 bp, Homo sapiens
tgcaaatctggctt

SEQ ID NO: 4838319 - DNA, 20 bp, Homo sapiens
tgcaaatgaaggaatgcaat

SEQ ID NO: 4838320 - DNA, 22 bp, Homo sapiens
tgcaaatgaaggaatgcaataa

SEQ ID NO: 4838321 - DNA, 16 bp, Homo sapiens
tgcaacactgccaaac

SEQ ID NO: 4838322 - DNA, 20 bp, Homo sapiens
tgcaacactgccaaacatca

SEQ ID NO: 4838323 - DNA, 15 bp, Homo sapiens
tgcaaccactgcaat

SEQ ID NO: 4838324 - DNA, 14 bp, Homo sapiens
tgcaacccatgagc

SEQ ID NO: 4838325 - DNA, 14 bp, Homo sapiens
tgcaagaagaatat

SEQ ID NO: 4838326 - DNA, 17 bp, Homo sapiens
tgcaagaagaatataaa

SEQ ID NO: 4838327 - DNA, 13 bp, Homo sapiens
tgcaaggcccaca

SEQ ID NO: 4838328 - DNA, 17 bp, Homo sapiens
tgcaaggcccacaggag

SEQ ID NO: 4838329 - DNA, 17 bp, Homo sapiens
tgcaaggtgcacctgcc

SEQ ID NO: 4838330 - DNA, 18 bp, Homo sapiens
tgcaaggtgcacctgccc

SEQ ID NO: 4838331 - DNA, 23 bp, Homo sapiens
tgcaataaactcagtcaaatgta

SEQ ID NO: 4838332 - DNA, 13 bp, Homo sapiens
tgcaataaagagt

SEQ ID NO: 4838333 - DNA, 22 bp, Homo sapiens
tgcaataaagagtaaatatact

SEQ ID NO: 4838334 - DNA, 12 bp, Homo sapiens
tgcaataacagt

SEQ ID NO: 4838335 - DNA, 23 bp, Homo sapiens
tgcaatactaacgaccgacgccc

SEQ ID NO: 4838336 - DNA, 14 bp, Homo sapiens
tgcaatctgtccag

SEQ ID NO: 4838337 - DNA, 15 bp, Homo sapiens
tgcaatgcatctgaa

SEQ ID NO: 4838338 - DNA, 22 bp, Homo sapiens
tgcaatgtctgtccctaaacat

SEQ ID NO: 4838339 - DNA, 12 bp, Homo sapiens
tgcaattcaact

SEQ ID NO: 4838340 - DNA, 18 bp, Homo sapiens
tgcaattgtttaagaatc

SEQ ID NO: 4838341 - DNA, 20 bp, Homo sapiens
tgcaattgtttaagaatcat

SEQ ID NO: 4838342 - DNA, 17 bp, Homo sapiens
tgcaatttgtttgtgct

SEQ ID NO: 4838343 - DNA, 17 bp, Homo sapiens
tgcacaaacagaggccg

SEQ ID NO: 4838344 - DNA, 20 bp, Homo sapiens
tgcacaaacagaggccgcca

SEQ ID NO: 4838345 - DNA, 21 bp, Homo sapiens
tgcacacacacgcgtccacat

SEQ ID NO: 4838346 - DNA, 23 bp, Homo sapiens
tgcacacacagtctgttcagagg

SEQ ID NO: 4838347 - DNA, 15 bp, Homo sapiens
tgcacacacctgcct

SEQ ID NO: 4838348 - DNA, 13 bp, Homo sapiens
tgcacacataaca

SEQ ID NO: 4838349 - DNA, 18 bp, Homo sapiens
tgcacaccaaattgctga

SEQ ID NO: 4838350 - DNA, 21 bp, Homo sapiens
tgcacaccaaattgctgagat

SEQ ID NO: 4838351 - DNA, 17 bp, Homo sapiens
tgcacagtagtgttggg

SEQ ID NO: 4838352 - DNA, 18 bp, Homo sapiens
tgcacagtggtccagggt

SEQ ID NO: 4838353 - DNA, 17 bp, Homo sapiens
tgcacatggattcagtt

SEQ ID NO: 4838354 - DNA, 14 bp, Homo sapiens
tgcacccacccctg

SEQ ID NO: 4838355 - DNA, 16 bp, Homo sapiens
tgcacccacccctgcc

SEQ ID NO: 4838356 - DNA, 16 bp, Homo sapiens
tgcacctgccccaggc

SEQ ID NO: 4838357 - DNA, 15 bp, Homo sapiens
tgcacctgcttctca

SEQ ID NO: 4838358 - DNA, 20 bp, Homo sapiens
tgcacgcggactccggggtt

SEQ ID NO: 4838359 - DNA, 18 bp, Homo sapiens
tgcactcttttgagcagt

SEQ ID NO: 4838360 - DNA, 12 bp, Homo sapiens
tgcactgaccct

SEQ ID NO: 4838361 - DNA, 17 bp, Homo sapiens
tgcactgccctccgccc

SEQ ID NO: 4838362 - DNA, 17 bp, Homo sapiens
tgcactggccttctgat

SEQ ID NO: 4838363 - DNA, 18 bp, Homo sapiens
tgcactttttttctatat

SEQ ID NO: 4838364 - DNA, 21 bp, Homo sapiens
tgcagaaatgtggatgctctt

SEQ ID NO: 4838365 - DNA, 14 bp, Homo sapiens
tgcagaccctcaga

SEQ ID NO: 4838366 - DNA, 19 bp, Homo sapiens
tgcagagtatacaagtgtt

SEQ ID NO: 4838367 - DNA, 18 bp, Homo sapiens
tgcagatctagccaggcc

SEQ ID NO: 4838368 - DNA, 19 bp, Homo sapiens
tgcagatctagccaggcct

SEQ ID NO: 4838369 - DNA, 17 bp, Homo sapiens
tgcagatgactggaaac

SEQ ID NO: 4838370 - DNA, 21 bp, Homo sapiens
tgcagcagagagaaataaaac

SEQ ID NO: 4838371 - DNA, 19 bp, Homo sapiens
tgcagcagtaccatcccac

SEQ ID NO: 4838372 - DNA, 22 bp, Homo sapiens
tgcagcagtaccatcccactga

SEQ ID NO: 4838373 - DNA, 15 bp, Homo sapiens
tgcagccgccttcct

SEQ ID NO: 4838374 - DNA, 17 bp, Homo sapiens
tgcagctaatttgtgaa

SEQ ID NO: 4838375 - DNA, 20 bp, Homo sapiens
tgcagctatgcgcaatgtgg

SEQ ID NO: 4838376 - DNA, 18 bp, Homo sapiens
tgcagctattcacacaca

SEQ ID NO: 4838377 - DNA, 23 bp, Homo sapiens
tgcagcttgggagagcccctggg

SEQ ID NO: 4838378 - DNA, 20 bp, Homo sapiens
tgcaggaaagaaatcagctt

SEQ ID NO: 4838379 - DNA, 14 bp, Homo sapiens
tgcaggaatcaaaa

SEQ ID NO: 4838380 - DNA, 15 bp, Homo sapiens
tgcaggagttccttt

SEQ ID NO: 4838381 - DNA, 15 bp, Homo sapiens
tgcaggcagcctgca

SEQ ID NO: 4838382 - DNA, 17 bp, Homo sapiens
tgcaggcagcctgcaga

SEQ ID NO: 4838383 - DNA, 20 bp, Homo sapiens
tgcaggctaaagtgattcct

SEQ ID NO: 4838384 - DNA, 20 bp, Homo sapiens
tgcagggacagcctgcacag

SEQ ID NO: 4838385 - DNA, 18 bp, Homo sapiens
tgcagggcccccacagga

SEQ ID NO: 4838386 - DNA, 18 bp, Homo sapiens
tgcaggtgaccagaatga

SEQ ID NO: 4838387 - DNA, 14 bp, Homo sapiens
tgcaggtggggttt

SEQ ID NO: 4838388 - DNA, 20 bp, Homo sapiens
tgcaggttggaccccagaga

SEQ ID NO: 4838389 - DNA, 12 bp, Homo sapiens
tgcaggttttct

SEQ ID NO: 4838390 - DNA, 18 bp, Homo sapiens
tgcagtagagagcaaaga

SEQ ID NO: 4838391 - DNA, 23 bp, Homo sapiens
tgcagtatccgcgagcctgcttg

SEQ ID NO: 4838392 - DNA, 15 bp, Homo sapiens
tgcagtattctgtag

SEQ ID NO: 4838393 - DNA, 18 bp, Homo sapiens
tgcagtcatcaacaaaag

SEQ ID NO: 4838394 - DNA, 16 bp, Homo sapiens
tgcagtcatcagaagt

SEQ ID NO: 4838395 - DNA, 17 bp, Homo sapiens
tgcagtgtatttaatgt

SEQ ID NO: 4838396 - DNA, 16 bp, Homo sapiens
tgcagttaattcttgc

SEQ ID NO: 4838397 - DNA, 18 bp, Homo sapiens
tgcagttagcacagagga

SEQ ID NO: 4838398 - DNA, 21 bp, Homo sapiens
tgcagttatttaccagaagtt

SEQ ID NO: 4838399 - DNA, 22 bp, Homo sapiens
tgcagttatttaccagaagttt

SEQ ID NO: 4838400 - DNA, 18 bp, Homo sapiens
tgcagtttggtatgaaac

SEQ ID NO: 4838401 - DNA, 19 bp, Homo sapiens
tgcagtttggtatgaaaca

SEQ ID NO: 4838402 - DNA, 20 bp, Homo sapiens
tgcagtttggtatgaaacaa

SEQ ID NO: 4838403 - DNA, 12 bp, Homo sapiens
tgcatagacaaa

SEQ ID NO: 4838404 - DNA, 13 bp, Homo sapiens
tgcatagacaagt

SEQ ID NO: 4838405 - DNA, 16 bp, Homo sapiens
tgcatagacaagtgtt

SEQ ID NO: 4838406 - DNA, 19 bp, Homo sapiens
tgcatcatcttgaacatta

SEQ ID NO: 4838407 - DNA, 18 bp, Homo sapiens
tgcatcccttggcccctc

SEQ ID NO: 4838408 - DNA, 19 bp, Homo sapiens
tgcatcccttggcccctct

SEQ ID NO: 4838409 - DNA, 20 bp, Homo sapiens
tgcatcccttggcccctctc

SEQ ID NO: 4838410 - DNA, 19 bp, Homo sapiens
tgcatcctcagccccaggg

SEQ ID NO: 4838411 - DNA, 21 bp, Homo sapiens
tgcatcctcagccccagggcc

SEQ ID NO: 4838412 - DNA, 13 bp, Homo sapiens
tgcatctgaaagt

SEQ ID NO: 4838413 - DNA, 13 bp, Homo sapiens
tgcatctggccta

SEQ ID NO: 4838414 - DNA, 23 bp, Homo sapiens
tgcatctggcctatgaccctgtg

SEQ ID NO: 4838415 - DNA, 18 bp, Homo sapiens
tgcatctgtggcctgggg

SEQ ID NO: 4838416 - DNA, 19 bp, Homo sapiens
tgcatctgtggcctggggc

SEQ ID NO: 4838417 - DNA, 17 bp, Homo sapiens
tgcatgagaatgtcatt

SEQ ID NO: 4838418 - DNA, 12 bp, Homo sapiens
tgcatgagcacc

SEQ ID NO: 4838419 - DNA, 20 bp, Homo sapiens
tgcatgagctccctcgctgt

SEQ ID NO: 4838420 - DNA, 14 bp, Homo sapiens
tgcatgattagtgc

SEQ ID NO: 4838421 - DNA, 23 bp, Homo sapiens
tgcatgcagggcccccacaggag

SEQ ID NO: 4838422 - DNA, 14 bp, Homo sapiens
tgcatgctgtccct

SEQ ID NO: 4838423 - DNA, 16 bp, Homo sapiens
tgcatgctgtccctta

SEQ ID NO: 4838424 - DNA, 18 bp, Homo sapiens
tgcatgctgtcccttacg

SEQ ID NO: 4838425 - DNA, 21 bp, Homo sapiens
tgcatgctgtcccttacgtga

SEQ ID NO: 4838426 - DNA, 14 bp, Homo sapiens
tgcatggcctccca

SEQ ID NO: 4838427 - DNA, 16 bp, Homo sapiens
tgcatggcctcccagc

SEQ ID NO: 4838428 - DNA, 19 bp, Homo sapiens
tgcatggcctcccagccac

SEQ ID NO: 4838429 - DNA, 12 bp, Homo sapiens
tgcatgtagcat

SEQ ID NO: 4838430 - DNA, 16 bp, Homo sapiens
tgcatgtagcatataa

SEQ ID NO: 4838431 - DNA, 17 bp, Homo sapiens
tgcatgtagcatataaa

SEQ ID NO: 4838432 - DNA, 16 bp, Homo sapiens
tgcatgtcggggcccc

SEQ ID NO: 4838433 - DNA, 19 bp, Homo sapiens
tgcatgtcggggcccctgc

SEQ ID NO: 4838434 - DNA, 17 bp, Homo sapiens
tgcatgttaaaataatt

SEQ ID NO: 4838435 - DNA, 22 bp, Homo sapiens
tgcattactattaactctgcat

SEQ ID NO: 4838436 - DNA, 17 bp, Homo sapiens
tgcattcagatctgaag

SEQ ID NO: 4838437 - DNA, 18 bp, Homo sapiens
tgcattcattcatcctct

SEQ ID NO: 4838438 - DNA, 20 bp, Homo sapiens
tgcattcattcatcctctta

SEQ ID NO: 4838439 - DNA, 16 bp, Homo sapiens
tgcattgtggctgtca

SEQ ID NO: 4838440 - DNA, 19 bp, Homo sapiens
tgcatttagcatgagttct

SEQ ID NO: 4838441 - DNA, 15 bp, Homo sapiens
tgcatttatgcatga

SEQ ID NO: 4838442 - DNA, 21 bp, Homo sapiens
tgcatttgagagaagccacgc

SEQ ID NO: 4838443 - DNA, 16 bp, Homo sapiens
tgcattttaaatgtct

SEQ ID NO: 4838444 - DNA, 14 bp, Homo sapiens
tgcattttaccatc

SEQ ID NO: 4838445 - DNA, 21 bp, Homo sapiens
tgccaaaatgtcaatttttaa

SEQ ID NO: 4838446 - DNA, 16 bp, Homo sapiens
tgccaaacatcagtca

SEQ ID NO: 4838447 - DNA, 15 bp, Homo sapiens
tgccaaggcatcccc

SEQ ID NO: 4838448 - DNA, 22 bp, Homo sapiens
tgccacatcgcagcccctgttg

SEQ ID NO: 4838449 - DNA, 21 bp, Homo sapiens
tgccacatggccgctgcccac

SEQ ID NO: 4838450 - DNA, 18 bp, Homo sapiens
tgccacattgcttcatta

SEQ ID NO: 4838451 - DNA, 19 bp, Homo sapiens
tgccacattgcttcattaa

SEQ ID NO: 4838452 - DNA, 18 bp, Homo sapiens
tgccaccacccaccccaa

SEQ ID NO: 4838453 - DNA, 21 bp, Homo sapiens
tgccacccaccccaagctgct

SEQ ID NO: 4838454 - DNA, 16 bp, Homo sapiens
tgccaccctctgctgc

SEQ ID NO: 4838455 - DNA, 15 bp, Homo sapiens
tgccagacagagatc

SEQ ID NO: 4838456 - DNA, 20 bp, Homo sapiens
tgccagacttctaaaataaa

SEQ ID NO: 4838457 - DNA, 13 bp, Homo sapiens
tgccagctggtga

SEQ ID NO: 4838458 - DNA, 18 bp, Homo sapiens
tgccagctggtgaatcca

SEQ ID NO: 4838459 - DNA, 21 bp, Homo sapiens
tgccaggctcccactgcccct

SEQ ID NO: 4838460 - DNA, 19 bp, Homo sapiens
tgccaggctggagtgcagt

SEQ ID NO: 4838461 - DNA, 15 bp, Homo sapiens
tgccagggggtttga

SEQ ID NO: 4838462 - DNA, 13 bp, Homo sapiens
tgccagtggtgga

SEQ ID NO: 4838463 - DNA, 16 bp, Homo sapiens
tgccagtggtggaggt

SEQ ID NO: 4838464 - DNA, 19 bp, Homo sapiens
tgccataacttgtttgtaa

SEQ ID NO: 4838465 - DNA, 14 bp, Homo sapiens
tgccatgatctgta

SEQ ID NO: 4838466 - DNA, 13 bp, Homo sapiens
tgccatggatgat

SEQ ID NO: 4838467 - DNA, 21 bp, Homo sapiens
tgccatggatgattcttttcc

SEQ ID NO: 4838468 - DNA, 17 bp, Homo sapiens
tgccatgtaggctaaga

SEQ ID NO: 4838469 - DNA, 18 bp, Homo sapiens
tgccattttttgtctgtg

SEQ ID NO: 4838470 - DNA, 22 bp, Homo sapiens
tgcccacccgtgttctcctcca

SEQ ID NO: 4838471 - DNA, 12 bp, Homo sapiens
tgcccaccctgg

SEQ ID NO: 4838472 - DNA, 16 bp, Homo sapiens
tgcccacctgccaggc

SEQ ID NO: 4838473 - DNA, 20 bp, Homo sapiens
tgcccagcggctcttcctgg

SEQ ID NO: 4838474 - DNA, 18 bp, Homo sapiens
tgcccaggaagtaatttt

SEQ ID NO: 4838475 - DNA, 16 bp, Homo sapiens
tgcccaggcagtcttt

SEQ ID NO: 4838476 - DNA, 21 bp, Homo sapiens
tgcccaggcagtctttgctca

SEQ ID NO: 4838477 - DNA, 20 bp, Homo sapiens
tgcccaggccggccagcctc

SEQ ID NO: 4838478 - DNA, 22 bp, Homo sapiens
tgcccaggccggccagcctcac

SEQ ID NO: 4838479 - DNA, 15 bp, Homo sapiens
tgcccagtcttgagt

SEQ ID NO: 4838480 - DNA, 19 bp, Homo sapiens
tgcccagtcttgagtgggc

SEQ ID NO: 4838481 - DNA, 23 bp, Homo sapiens
tgcccagttagcccggccaagga

SEQ ID NO: 4838482 - DNA, 14 bp, Homo sapiens
tgcccatgtgtccc

SEQ ID NO: 4838483 - DNA, 18 bp, Homo sapiens
tgcccatgtgtcccctca

SEQ ID NO: 4838484 - DNA, 17 bp, Homo sapiens
tgccccacacaggcctg

SEQ ID NO: 4838485 - DNA, 20 bp, Homo sapiens
tgccccacacaggcctggcc

SEQ ID NO: 4838486 - DNA, 23 bp, Homo sapiens
tgccccacacaggcctggcccag

SEQ ID NO: 4838487 - DNA, 13 bp, Homo sapiens
tgccccagagaag

SEQ ID NO: 4838488 - DNA, 20 bp, Homo sapiens
tgccccagagaagcctcagt

SEQ ID NO: 4838489 - DNA, 21 bp, Homo sapiens
tgccccaggctcaggctgccc

SEQ ID NO: 4838490 - DNA, 23 bp, Homo sapiens
tgccccaggctcaggctgcccag

SEQ ID NO: 4838491 - DNA, 13 bp, Homo sapiens
tgcccccacagat

SEQ ID NO: 4838492 - DNA, 15 bp, Homo sapiens
tgcccccacagatcc

SEQ ID NO: 4838493 - DNA, 16 bp, Homo sapiens
tgcccccacagatcca

SEQ ID NO: 4838494 - DNA, 20 bp, Homo sapiens
tgcccccacagatccatcct

SEQ ID NO: 4838495 - DNA, 14 bp, Homo sapiens
tgccccccatgccc

SEQ ID NO: 4838496 - DNA, 15 bp, Homo sapiens
tgccccccatgccct

SEQ ID NO: 4838497 - DNA, 14 bp, Homo sapiens
tgccccccttccca

SEQ ID NO: 4838498 - DNA, 15 bp, Homo sapiens
tgccccccttcccac

SEQ ID NO: 4838499 - DNA, 19 bp, Homo sapiens
tgccccccttcccacccct

SEQ ID NO: 4838500 - DNA, 20 bp, Homo sapiens
tgccccccttcccaccccta

SEQ ID NO: 4838501 - DNA, 18 bp, Homo sapiens
tgccccctcccccgcaga

SEQ ID NO: 4838502 - DNA, 14 bp, Homo sapiens
tgccccgcctcccg

SEQ ID NO: 4838503 - DNA, 16 bp, Homo sapiens
tgccccgcctcccggg

SEQ ID NO: 4838504 - DNA, 19 bp, Homo sapiens
tgccccgcctcccggggtg

SEQ ID NO: 4838505 - DNA, 18 bp, Homo sapiens
tgcccctccgtccccagg

SEQ ID NO: 4838506 - DNA, 14 bp, Homo sapiens
tgcccctcttagaa

SEQ ID NO: 4838507 - DNA, 17 bp, Homo sapiens
tgcccctggcagcccct

SEQ ID NO: 4838508 - DNA, 22 bp, Homo sapiens
tgccccttctaggggcaggtga

SEQ ID NO: 4838509 - DNA, 17 bp, Homo sapiens
tgccccttgaccccaca

SEQ ID NO: 4838510 - DNA, 20 bp, Homo sapiens
tgccccttgaccccacacgc

SEQ ID NO: 4838511 - DNA, 14 bp, Homo sapiens
tgcccgcacagcag

SEQ ID NO: 4838512 - DNA, 17 bp, Homo sapiens
tgcccgcacagcagcct

SEQ ID NO: 4838513 - DNA, 19 bp, Homo sapiens
tgcccgcgcccgccgcctc

SEQ ID NO: 4838514 - DNA, 16 bp, Homo sapiens
tgcccgtgtggcctgg

SEQ ID NO: 4838515 - DNA, 19 bp, Homo sapiens
tgcccgtgtggcctgggtc

SEQ ID NO: 4838516 - DNA, 15 bp, Homo sapiens
tgccctattataatt

SEQ ID NO: 4838517 - DNA, 15 bp, Homo sapiens
tgccctcactccact

SEQ ID NO: 4838518 - DNA, 19 bp, Homo sapiens
tgccctcactccactcccc

SEQ ID NO: 4838519 - DNA, 11 bp, Homo sapiens
tgccctccccc

SEQ ID NO: 4838520 - DNA, 12 bp, Homo sapiens
tgccctccccca

SEQ ID NO: 4838521 - DNA, 19 bp, Homo sapiens
tgccctccctgctgccagg

SEQ ID NO: 4838522 - DNA, 18 bp, Homo sapiens
tgccctccgcccttccct

SEQ ID NO: 4838523 - DNA, 14 bp, Homo sapiens
tgccctctgccact

SEQ ID NO: 4838524 - DNA, 19 bp, Homo sapiens
tgccctgcgtcccttctct

SEQ ID NO: 4838525 - DNA, 13 bp, Homo sapiens
tgccctggcctac

SEQ ID NO: 4838526 - DNA, 23 bp, Homo sapiens
tgccctggcctaccacagctgcc

SEQ ID NO: 4838527 - DNA, 21 bp, Homo sapiens
tgccctgtagctccttagcta

SEQ ID NO: 4838528 - DNA, 14 bp, Homo sapiens
tgccctgtttccaa

SEQ ID NO: 4838529 - DNA, 14 bp, Homo sapiens
tgcccttaaaataa

SEQ ID NO: 4838530 - DNA, 21 bp, Homo sapiens
tgcccttaaaataatgattta

SEQ ID NO: 4838531 - DNA, 22 bp, Homo sapiens
tgcccttaatatccctggagtt

SEQ ID NO: 4838532 - DNA, 21 bp, Homo sapiens
tgccgaaacccttgactgtta

SEQ ID NO: 4838533 - DNA, 20 bp, Homo sapiens
tgccgcctgggaatcaggat

SEQ ID NO: 4838534 - DNA, 16 bp, Homo sapiens
tgccgctgccgctgca

SEQ ID NO: 4838535 - DNA, 22 bp, Homo sapiens
tgccgcttaaacatttccctgc

SEQ ID NO: 4838536 - DNA, 16 bp, Homo sapiens
tgccggtggggccagc

SEQ ID NO: 4838537 - DNA, 19 bp, Homo sapiens
tgccggtggggccagcgct

SEQ ID NO: 4838538 - DNA, 19 bp, Homo sapiens
tgccgtctttggttcctca

SEQ ID NO: 4838539 - DNA, 18 bp, Homo sapiens
tgccgtgggcaaggatac

SEQ ID NO: 4838540 - DNA, 13 bp, Homo sapiens
tgcctacattagt

SEQ ID NO: 4838541 - DNA, 14 bp, Homo sapiens
tgcctcaagagaag

SEQ ID NO: 4838542 - DNA, 16 bp, Homo sapiens
tgcctcattttgcttc

SEQ ID NO: 4838543 - DNA, 20 bp, Homo sapiens
tgcctcattttgcttcccat

SEQ ID NO: 4838544 - DNA, 14 bp, Homo sapiens
tgcctccagaacct

SEQ ID NO: 4838545 - DNA, 15 bp, Homo sapiens
tgcctcccagccctg

SEQ ID NO: 4838546 - DNA, 19 bp, Homo sapiens
tgcctcccagccctgccca

SEQ ID NO: 4838547 - DNA, 17 bp, Homo sapiens
tgcctccgggcctcggc

SEQ ID NO: 4838548 - DNA, 20 bp, Homo sapiens
tgcctccgggcctcggcctg

SEQ ID NO: 4838549 - DNA, 22 bp, Homo sapiens
tgcctccgggcctcggcctggc

SEQ ID NO: 4838550 - DNA, 18 bp, Homo sapiens
tgcctctgatatgggact

SEQ ID NO: 4838551 - DNA, 13 bp, Homo sapiens
tgcctctgcctta

SEQ ID NO: 4838552 - DNA, 17 bp, Homo sapiens
tgcctctttcctcctca

SEQ ID NO: 4838553 - DNA, 20 bp, Homo sapiens
tgcctctttcctcctcatga

SEQ ID NO: 4838554 - DNA, 16 bp, Homo sapiens
tgcctgcctccggccc

SEQ ID NO: 4838555 - DNA, 16 bp, Homo sapiens
tgcctgctatccagcc

SEQ ID NO: 4838556 - DNA, 15 bp, Homo sapiens
tgcctggcgggcagc

SEQ ID NO: 4838557 - DNA, 19 bp, Homo sapiens
tgcctggcgggcagcccct

SEQ ID NO: 4838558 - DNA, 20 bp, Homo sapiens
tgcctggcgggcagcccctg

SEQ ID NO: 4838559 - DNA, 16 bp, Homo sapiens
tgcctgttgggccagg

SEQ ID NO: 4838560 - DNA, 17 bp, Homo sapiens
tgcctgttgggccagga

SEQ ID NO: 4838561 - DNA, 14 bp, Homo sapiens
tgccttaattctta

SEQ ID NO: 4838562 - DNA, 14 bp, Homo sapiens
tgccttagaggagc

SEQ ID NO: 4838563 - DNA, 16 bp, Homo sapiens
tgccttatattatttt

SEQ ID NO: 4838564 - DNA, 24 bp, Homo sapiens
tgccttcatggaactcagctgtct

SEQ ID NO: 4838565 - DNA, 17 bp, Homo sapiens
tgccttctgacggccct

SEQ ID NO: 4838566 - DNA, 22 bp, Homo sapiens
tgccttctgacggccctgcaat

SEQ ID NO: 4838567 - DNA, 18 bp, Homo sapiens
tgcctttaggcaggaagt

SEQ ID NO: 4838568 - DNA, 11 bp, Homo sapiens
tgcctttcaaa

SEQ ID NO: 4838569 - DNA, 13 bp, Homo sapiens
tgcgcaatgtggc

SEQ ID NO: 4838570 - DNA, 20 bp, Homo sapiens
tgcgcaccccgttcccagcg

SEQ ID NO: 4838571 - DNA, 20 bp, Homo sapiens
tgcgcagccgcgctctgccc

SEQ ID NO: 4838572 - DNA, 21 bp, Homo sapiens
tgcgcagccgcgctctgcccc

SEQ ID NO: 4838573 - DNA, 16 bp, Homo sapiens
tgcgccccccagtgga

SEQ ID NO: 4838574 - DNA, 14 bp, Homo sapiens
tgcgcccctgccca

SEQ ID NO: 4838575 - DNA, 18 bp, Homo sapiens
tgcgcccctgcccagcac

SEQ ID NO: 4838576 - DNA, 14 bp, Homo sapiens
tgcgccctccctcc

SEQ ID NO: 4838577 - DNA, 15 bp, Homo sapiens
tgcgccctccctccc

SEQ ID NO: 4838578 - DNA, 19 bp, Homo sapiens
tgcgccctgacatgctaac

SEQ ID NO: 4838579 - DNA, 14 bp, Homo sapiens
tgcgcctcctcctg

SEQ ID NO: 4838580 - DNA, 14 bp, Homo sapiens
tgcgcctgcccgcc

SEQ ID NO: 4838581 - DNA, 17 bp, Homo sapiens
tgcgcctgcccgcccgc

SEQ ID NO: 4838582 - DNA, 17 bp, Homo sapiens
tgcgcctgcgcctcctc

SEQ ID NO: 4838583 - DNA, 12 bp, Homo sapiens
tgcgctagagca

SEQ ID NO: 4838584 - DNA, 21 bp, Homo sapiens
tgcgctagagcattctggggt

SEQ ID NO: 4838585 - DNA, 13 bp, Homo sapiens
tgcgctcctctgc

SEQ ID NO: 4838586 - DNA, 16 bp, Homo sapiens
tgcgctcctctgcagc

SEQ ID NO: 4838587 - DNA, 20 bp, Homo sapiens
tgcgctcctctgcagcctga

SEQ ID NO: 4838588 - DNA, 14 bp, Homo sapiens
tgcgctcctggctt

SEQ ID NO: 4838589 - DNA, 16 bp, Homo sapiens
tgcgctcttcaccagg

SEQ ID NO: 4838590 - DNA, 18 bp, Homo sapiens
tgcgctcttcaccaggaa

SEQ ID NO: 4838591 - DNA, 20 bp, Homo sapiens
tgcgctcttcaccaggaaga

SEQ ID NO: 4838592 - DNA, 16 bp, Homo sapiens
tgcggaccggagcggc

SEQ ID NO: 4838593 - DNA, 22 bp, Homo sapiens
tgcggaccggagcggctgagga

SEQ ID NO: 4838594 - DNA, 16 bp, Homo sapiens
tgcggcaccgcccacc

SEQ ID NO: 4838595 - DNA, 17 bp, Homo sapiens
tgcggcaccgcccaccc

SEQ ID NO: 4838596 - DNA, 20 bp, Homo sapiens
tgcgggcttcctcctggtgt

SEQ ID NO: 4838597 - DNA, 13 bp, Homo sapiens
tgcggtgtgtctc

SEQ ID NO: 4838598 - DNA, 22 bp, Homo sapiens
tgcgtccgcacgcggccgctct

SEQ ID NO: 4838599 - DNA, 17 bp, Homo sapiens
tgcgtgaccggcccgcc

SEQ ID NO: 4838600 - DNA, 22 bp, Homo sapiens
tgcgtgaccggcccgccacctt

SEQ ID NO: 4838601 - DNA, 23 bp, Homo sapiens
tgcgtgaccggcccgccaccttg

SEQ ID NO: 4838602 - DNA, 12 bp, Homo sapiens
tgcgtggctccc

SEQ ID NO: 4838603 - DNA, 19 bp, Homo sapiens
tgcgtgtggccctgtggga

SEQ ID NO: 4838604 - DNA, 20 bp, Homo sapiens
tgcgtgtggccctgtgggag

SEQ ID NO: 4838605 - DNA, 21 bp, Homo sapiens
tgcgtgtggccctgtgggagt

SEQ ID NO: 4838606 - DNA, 19 bp, Homo sapiens
tgcgtgtgttctctccgga

SEQ ID NO: 4838607 - DNA, 17 bp, Homo sapiens
tgctaaacctatctgta

SEQ ID NO: 4838608 - DNA, 20 bp, Homo sapiens
tgctaaacctatctgtattg

SEQ ID NO: 4838609 - DNA, 16 bp, Homo sapiens
tgctaacctgtggaaa

SEQ ID NO: 4838610 - DNA, 17 bp, Homo sapiens
tgctaagtggaagacag

SEQ ID NO: 4838611 - DNA, 23 bp, Homo sapiens
tgctaatgaattttaaaagcata

SEQ ID NO: 4838612 - DNA, 20 bp, Homo sapiens
tgctaatttatgaagatagt

SEQ ID NO: 4838613 - DNA, 13 bp, Homo sapiens
tgctagtgagctg

SEQ ID NO: 4838614 - DNA, 18 bp, Homo sapiens
tgctagtgagctgggcat

SEQ ID NO: 4838615 - DNA, 23 bp, Homo sapiens
tgctatatttgtgatataggaat

SEQ ID NO: 4838616 - DNA, 15 bp, Homo sapiens
tgctatccagccgca

SEQ ID NO: 4838617 - DNA, 13 bp, Homo sapiens
tgctatgtctgtg

SEQ ID NO: 4838618 - DNA, 17 bp, Homo sapiens
tgctatgtctgtgatgt

SEQ ID NO: 4838619 - DNA, 16 bp, Homo sapiens
tgctattaatatttgt

SEQ ID NO: 4838620 - DNA, 21 bp, Homo sapiens
tgctattaatatttgtttagt

SEQ ID NO: 4838621 - DNA, 18 bp, Homo sapiens
tgctattcgtaagttctg

SEQ ID NO: 4838622 - DNA, 14 bp, Homo sapiens
tgctattgtttata

SEQ ID NO: 4838623 - DNA, 14 bp, Homo sapiens
tgctatttgtgtaa

SEQ ID NO: 4838624 - DNA, 20 bp, Homo sapiens
tgctatttgtgtaactgaaa

SEQ ID NO: 4838625 - DNA, 15 bp, Homo sapiens
tgctcaaaatgcaaa

SEQ ID NO: 4838626 - DNA, 14 bp, Homo sapiens
tgctcaatgtgctg

SEQ ID NO: 4838627 - DNA, 19 bp, Homo sapiens
tgctcaccaagctgttcca

SEQ ID NO: 4838628 - DNA, 23 bp, Homo sapiens
tgctcacgtctgtgagtctgtcc

SEQ ID NO: 4838629 - DNA, 12 bp, Homo sapiens
tgctcaggcctc

SEQ ID NO: 4838630 - DNA, 20 bp, Homo sapiens
tgctcaggcctcacctggct

SEQ ID NO: 4838631 - DNA, 23 bp, Homo sapiens
tgctcaggctccccaagacttga

SEQ ID NO: 4838632 - DNA, 13 bp, Homo sapiens
tgctcagggcatg

SEQ ID NO: 4838633 - DNA, 18 bp, Homo sapiens
tgctcagggcatgcttat

SEQ ID NO: 4838634 - DNA, 13 bp, Homo sapiens
tgctcagtattga

SEQ ID NO: 4838635 - DNA, 13 bp, Homo sapiens
tgctcagtggatc

SEQ ID NO: 4838636 - DNA, 19 bp, Homo sapiens
tgctcagtggatcacacac

SEQ ID NO: 4838637 - DNA, 22 bp, Homo sapiens
tgctcataactagagtatgtgt

SEQ ID NO: 4838638 - DNA, 19 bp, Homo sapiens
tgctcataagtaaatgtct

SEQ ID NO: 4838639 - DNA, 21 bp, Homo sapiens
tgctcataagtaaatgtcttc

SEQ ID NO: 4838640 - DNA, 15 bp, Homo sapiens
tgctcatctacacat

SEQ ID NO: 4838641 - DNA, 13 bp, Homo sapiens
tgctccagatcct

SEQ ID NO: 4838642 - DNA, 18 bp, Homo sapiens
tgctccatgcacaggaaa

SEQ ID NO: 4838643 - DNA, 22 bp, Homo sapiens
tgctccatgcagatctagccag

SEQ ID NO: 4838644 - DNA, 23 bp, Homo sapiens
tgctccatgcagatctagccagg

SEQ ID NO: 4838645 - DNA, 15 bp, Homo sapiens
tgctccattcctgag

SEQ ID NO: 4838646 - DNA, 19 bp, Homo sapiens
tgctcccggctctgaggct

SEQ ID NO: 4838647 - DNA, 13 bp, Homo sapiens
tgctccctcatgc

SEQ ID NO: 4838648 - DNA, 20 bp, Homo sapiens
tgctcctagtttgacctcac

SEQ ID NO: 4838649 - DNA, 15 bp, Homo sapiens
tgctcctctgcccgc

SEQ ID NO: 4838650 - DNA, 11 bp, Homo sapiens
tgctcctggga

SEQ ID NO: 4838651 - DNA, 19 bp, Homo sapiens
tgctcgggaaggcctgagg

SEQ ID NO: 4838652 - DNA, 21 bp, Homo sapiens
tgctcgtatctccttgattac

SEQ ID NO: 4838653 - DNA, 13 bp, Homo sapiens
tgctctccatctc

SEQ ID NO: 4838654 - DNA, 18 bp, Homo sapiens
tgctctccattcttttaa

SEQ ID NO: 4838655 - DNA, 15 bp, Homo sapiens
tgctctcccaggtga

SEQ ID NO: 4838656 - DNA, 14 bp, Homo sapiens
tgctctccttcact

SEQ ID NO: 4838657 - DNA, 20 bp, Homo sapiens
tgctctccttcactctgaca

SEQ ID NO: 4838658 - DNA, 13 bp, Homo sapiens
tgctctctaagaa

SEQ ID NO: 4838659 - DNA, 17 bp, Homo sapiens
tgctctctaagaattca

SEQ ID NO: 4838660 - DNA, 20 bp, Homo sapiens
tgctctctcattcccaggca

SEQ ID NO: 4838661 - DNA, 18 bp, Homo sapiens
tgctctgctggtcttcaa

SEQ ID NO: 4838662 - DNA, 20 bp, Homo sapiens
tgctctggaaaacctgaggc

SEQ ID NO: 4838663 - DNA, 21 bp, Homo sapiens
tgctctggaaaacctgaggcc

SEQ ID NO: 4838664 - DNA, 18 bp, Homo sapiens
tgctctgttttgcatgga

SEQ ID NO: 4838665 - DNA, 18 bp, Homo sapiens
tgctcttaagtaccagaa

SEQ ID NO: 4838666 - DNA, 19 bp, Homo sapiens
tgctcttctcattttttcc

SEQ ID NO: 4838667 - DNA, 22 bp, Homo sapiens
tgctcttctcattttttcctga

SEQ ID NO: 4838668 - DNA, 13 bp, Homo sapiens
tgctcttctctta

SEQ ID NO: 4838669 - DNA, 22 bp, Homo sapiens
tgctcttctcttacgctctctg

SEQ ID NO: 4838670 - DNA, 20 bp, Homo sapiens
tgctctttcaccctgccacc

SEQ ID NO: 4838671 - DNA, 20 bp, Homo sapiens
tgctgaaaaccatctggcct

SEQ ID NO: 4838672 - DNA, 22 bp, Homo sapiens
tgctgaaaaccatctggcctgg

SEQ ID NO: 4838673 - DNA, 23 bp, Homo sapiens
tgctgaaaaccatctggcctggc

SEQ ID NO: 4838674 - DNA, 18 bp, Homo sapiens
tgctgaataacaacaatt

SEQ ID NO: 4838675 - DNA, 14 bp, Homo sapiens
tgctgaccttctgc

SEQ ID NO: 4838676 - DNA, 22 bp, Homo sapiens
tgctgagatgtttagtagctga

SEQ ID NO: 4838677 - DNA, 19 bp, Homo sapiens
tgctgagtctgtgaataaa

SEQ ID NO: 4838678 - DNA, 16 bp, Homo sapiens
tgctgcactgccctcc

SEQ ID NO: 4838679 - DNA, 18 bp, Homo sapiens
tgctgccaggctcccact

SEQ ID NO: 4838680 - DNA, 17 bp, Homo sapiens
tgctgccccacaacaca

SEQ ID NO: 4838681 - DNA, 18 bp, Homo sapiens
tgctgccctgatgcgtct

SEQ ID NO: 4838682 - DNA, 14 bp, Homo sapiens
tgctgcctccaagt

SEQ ID NO: 4838683 - DNA, 13 bp, Homo sapiens
tgctgcctgccat

SEQ ID NO: 4838684 - DNA, 23 bp, Homo sapiens
tgctgcctgcccgcacagcagcc

SEQ ID NO: 4838685 - DNA, 12 bp, Homo sapiens
tgctgcctgcct

SEQ ID NO: 4838686 - DNA, 23 bp, Homo sapiens
tgctgccttctgacggccctgca

SEQ ID NO: 4838687 - DNA, 24 bp, Homo sapiens
tgctgctccctttatcatgtgttt

SEQ ID NO: 4838688 - DNA, 16 bp, Homo sapiens
tgctgctcgggaaggc

SEQ ID NO: 4838689 - DNA, 19 bp, Homo sapiens
tgctgctcgggaaggcctg

SEQ ID NO: 4838690 - DNA, 20 bp, Homo sapiens
tgctgctctctaagaattca

SEQ ID NO: 4838691 - DNA, 22 bp, Homo sapiens
tgctgctgagcacatctcttca

SEQ ID NO: 4838692 - DNA, 18 bp, Homo sapiens
tgctgcttaaaatgcaag

SEQ ID NO: 4838693 - DNA, 17 bp, Homo sapiens
tgctgcttctccctggg

SEQ ID NO: 4838694 - DNA, 18 bp, Homo sapiens
tgctggaaaactgccaca

SEQ ID NO: 4838695 - DNA, 19 bp, Homo sapiens
tgctggaaaactgccacaa

SEQ ID NO: 4838696 - DNA, 13 bp, Homo sapiens
tgctggccagcac

SEQ ID NO: 4838697 - DNA, 19 bp, Homo sapiens
tgctggccagcaccctctc

SEQ ID NO: 4838698 - DNA, 18 bp, Homo sapiens
tgctggccagcctggggc

SEQ ID NO: 4838699 - DNA, 21 bp, Homo sapiens
tgctggccagcctggggcctg

SEQ ID NO: 4838700 - DNA, 16 bp, Homo sapiens
tgctgtatacaaacag

SEQ ID NO: 4838701 - DNA, 11 bp, Homo sapiens
tgctgtatttg

SEQ ID NO: 4838702 - DNA, 19 bp, Homo sapiens
tgctgtcatgcccagcttg

SEQ ID NO: 4838703 - DNA, 14 bp, Homo sapiens
tgctgtccctgtgg

SEQ ID NO: 4838704 - DNA, 15 bp, Homo sapiens
tgctgtccctgtggg

SEQ ID NO: 4838705 - DNA, 23 bp, Homo sapiens
tgctgtccctgtgggctcacacc

SEQ ID NO: 4838706 - DNA, 19 bp, Homo sapiens
tgctgtcccttacgtgagt

SEQ ID NO: 4838707 - DNA, 17 bp, Homo sapiens
tgctgtcccttttcctt

SEQ ID NO: 4838708 - DNA, 14 bp, Homo sapiens
tgctgtctgaaaaa

SEQ ID NO: 4838709 - DNA, 21 bp, Homo sapiens
tgctgtcttactaataggtct

SEQ ID NO: 4838710 - DNA, 17 bp, Homo sapiens
tgctgtgacaggcagtg

SEQ ID NO: 4838711 - DNA, 13 bp, Homo sapiens
tgctgtggcatca

SEQ ID NO: 4838712 - DNA, 10 bp, Homo sapiens
tgctgtgggc

SEQ ID NO: 4838713 - DNA, 14 bp, Homo sapiens
tgctgtgggcagca

SEQ ID NO: 4838714 - DNA, 16 bp, Homo sapiens
tgctgttgattctttc

SEQ ID NO: 4838715 - DNA, 23 bp, Homo sapiens
tgctgtttaccgcccacccagca

SEQ ID NO: 4838716 - DNA, 20 bp, Homo sapiens
tgcttaacctttttatttca

SEQ ID NO: 4838717 - DNA, 19 bp, Homo sapiens
tgcttaatctagagctatg

SEQ ID NO: 4838718 - DNA, 21 bp, Homo sapiens
tgcttaatctagagctatgca

SEQ ID NO: 4838719 - DNA, 20 bp, Homo sapiens
tgcttagtgtcccttacctg

SEQ ID NO: 4838720 - DNA, 16 bp, Homo sapiens
tgcttatgtcatttct

SEQ ID NO: 4838721 - DNA, 13 bp, Homo sapiens
tgcttatttatat

SEQ ID NO: 4838722 - DNA, 19 bp, Homo sapiens
tgcttatttatattcagag

SEQ ID NO: 4838723 - DNA, 18 bp, Homo sapiens
tgcttcattaaaacaaga

SEQ ID NO: 4838724 - DNA, 19 bp, Homo sapiens
tgcttcattaaaacaagag

SEQ ID NO: 4838725 - DNA, 19 bp, Homo sapiens
tgcttcccacctccctgcc

SEQ ID NO: 4838726 - DNA, 14 bp, Homo sapiens
tgcttcccatctga

SEQ ID NO: 4838727 - DNA, 22 bp, Homo sapiens
tgcttctaagggatccagagac

SEQ ID NO: 4838728 - DNA, 22 bp, Homo sapiens
tgcttctaatatttattgcttt

SEQ ID NO: 4838729 - DNA, 23 bp, Homo sapiens
tgcttctactccatggtgaactg

SEQ ID NO: 4838730 - DNA, 14 bp, Homo sapiens
tgcttctccacctc

SEQ ID NO: 4838731 - DNA, 13 bp, Homo sapiens
tgcttctcccgcc

SEQ ID NO: 4838732 - DNA, 18 bp, Homo sapiens
tgcttctcccgccattgg

SEQ ID NO: 4838733 - DNA, 23 bp, Homo sapiens
tgcttctcccgccattggcctta

SEQ ID NO: 4838734 - DNA, 14 bp, Homo sapiens
tgcttctccctggg

SEQ ID NO: 4838735 - DNA, 16 bp, Homo sapiens
tgcttctccctgggga

SEQ ID NO: 4838736 - DNA, 16 bp, Homo sapiens
tgcttctctaaaacag

SEQ ID NO: 4838737 - DNA, 15 bp, Homo sapiens
tgcttctgctgccct

SEQ ID NO: 4838738 - DNA, 19 bp, Homo sapiens
tgcttcttacgaacgccac

SEQ ID NO: 4838739 - DNA, 17 bp, Homo sapiens
tgcttcttgtgtttgaa

SEQ ID NO: 4838740 - DNA, 21 bp, Homo sapiens
tgcttcttgtgtttgaaacac

SEQ ID NO: 4838741 - DNA, 18 bp, Homo sapiens
tgcttgagcatgcccaaa

SEQ ID NO: 4838742 - DNA, 22 bp, Homo sapiens
tgcttgagcatgcccaaatata

SEQ ID NO: 4838743 - DNA, 13 bp, Homo sapiens
tgcttgagtggac

SEQ ID NO: 4838744 - DNA, 22 bp, Homo sapiens
tgcttgatttgaccactgacag

SEQ ID NO: 4838745 - DNA, 15 bp, Homo sapiens
tgcttgctggaaaac

SEQ ID NO: 4838746 - DNA, 18 bp, Homo sapiens
tgcttgctggaaaactgc

SEQ ID NO: 4838747 - DNA, 19 bp, Homo sapiens
tgcttgctggaaaactgcc

SEQ ID NO: 4838748 - DNA, 22 bp, Homo sapiens
tgcttgctggaaaactgccaca

SEQ ID NO: 4838749 - DNA, 16 bp, Homo sapiens
tgcttgggcttcatcc

SEQ ID NO: 4838750 - DNA, 17 bp, Homo sapiens
tgcttgtcattctgcta

SEQ ID NO: 4838751 - DNA, 18 bp, Homo sapiens
tgcttgtgaaaggaaaga

SEQ ID NO: 4838752 - DNA, 14 bp, Homo sapiens
tgcttgtgtgtatg

SEQ ID NO: 4838753 - DNA, 16 bp, Homo sapiens
tgcttgtgtgtatgtc

SEQ ID NO: 4838754 - DNA, 17 bp, Homo sapiens
tgcttgtgtgtatgtct

SEQ ID NO: 4838755 - DNA, 18 bp, Homo sapiens
tgcttgtgtgtatgtcta

SEQ ID NO: 4838756 - DNA, 22 bp, Homo sapiens
tgcttgtgtgtatgtctatgtg

SEQ ID NO: 4838757 - DNA, 12 bp, Homo sapiens
tgctttataaat

SEQ ID NO: 4838758 - DNA, 14 bp, Homo sapiens
tgctttataaataa

SEQ ID NO: 4838759 - DNA, 21 bp, Homo sapiens
tgctttatccacattgtagcc

SEQ ID NO: 4838760 - DNA, 23 bp, Homo sapiens
tgctttcaagatctaaatcatat

SEQ ID NO: 4838761 - DNA, 19 bp, Homo sapiens
tgctttcatccaactggaa

SEQ ID NO: 4838762 - DNA, 16 bp, Homo sapiens
tgctttccaacacaca

SEQ ID NO: 4838763 - DNA, 21 bp, Homo sapiens
tgctttccgcgtggttctgcc

SEQ ID NO: 4838764 - DNA, 21 bp, Homo sapiens
tgctttgagcccacaggagct

SEQ ID NO: 4838765 - DNA, 23 bp, Homo sapiens
tgctttggggcttatcagaactc

SEQ ID NO: 4838766 - DNA, 16 bp, Homo sapiens
tgctttgtttccttct

SEQ ID NO: 4838767 - DNA, 21 bp, Homo sapiens
tgctttgttttggctgctctc

SEQ ID NO: 4838768 - DNA, 14 bp, Homo sapiens
tgcttttctcatgg

SEQ ID NO: 4838769 - DNA, 13 bp, Homo sapiens
tgcttttttgcaa

SEQ ID NO: 4838770 - DNA, 13 bp, Homo sapiens
tggaaaaatgcca

SEQ ID NO: 4838771 - DNA, 19 bp, Homo sapiens
tggaaaacctgaggccaaa

SEQ ID NO: 4838772 - DNA, 15 bp, Homo sapiens
tggaaaactcacaga

SEQ ID NO: 4838773 - DNA, 22 bp, Homo sapiens
tggaaaactgccacaagcacaa

SEQ ID NO: 4838774 - DNA, 18 bp, Homo sapiens
tggaaaataataaaagaa

SEQ ID NO: 4838775 - DNA, 21 bp, Homo sapiens
tggaaaatgttctgacagcat

SEQ ID NO: 4838776 - DNA, 15 bp, Homo sapiens
tggaaagagctgttt

SEQ ID NO: 4838777 - DNA, 11 bp, Homo sapiens
tggaaagccag

SEQ ID NO: 4838778 - DNA, 13 bp, Homo sapiens
tggaaagccaggt

SEQ ID NO: 4838779 - DNA, 22 bp, Homo sapiens
tggaaatcctgttacttaaata

SEQ ID NO: 4838780 - DNA, 19 bp, Homo sapiens
tggaaatttgtgtgcttca

SEQ ID NO: 4838781 - DNA, 23 bp, Homo sapiens
tggaaatttgtgtgcttcacaca

SEQ ID NO: 4838782 - DNA, 12 bp, Homo sapiens
tggaacagccct

SEQ ID NO: 4838783 - DNA, 18 bp, Homo sapiens
tggaaccatggaggagga

SEQ ID NO: 4838784 - DNA, 16 bp, Homo sapiens
tggaagacagagatgg

SEQ ID NO: 4838785 - DNA, 11 bp, Homo sapiens
tggaagacagc

SEQ ID NO: 4838786 - DNA, 19 bp, Homo sapiens
tggaagagagaaagcatat

SEQ ID NO: 4838787 - DNA, 23 bp, Homo sapiens
tggaagagagaaagcatattgac

SEQ ID NO: 4838788 - DNA, 22 bp, Homo sapiens
tggaagagctgctgtatttgag

SEQ ID NO: 4838789 - DNA, 14 bp, Homo sapiens
tggaaggcacccgc

SEQ ID NO: 4838790 - DNA, 22 bp, Homo sapiens
tggaaggctttattcttccaag

SEQ ID NO: 4838791 - DNA, 17 bp, Homo sapiens
tggaagggaccccagat

SEQ ID NO: 4838792 - DNA, 18 bp, Homo sapiens
tggaagggcaggagctca

SEQ ID NO: 4838793 - DNA, 18 bp, Homo sapiens
tggaagggccttctccac

SEQ ID NO: 4838794 - DNA, 20 bp, Homo sapiens
tggaagggcgctgagggcag

SEQ ID NO: 4838795 - DNA, 15 bp, Homo sapiens
tggaaggtgatgggg

SEQ ID NO: 4838796 - DNA, 20 bp, Homo sapiens
tggaagtactataatttacc

SEQ ID NO: 4838797 - DNA, 13 bp, Homo sapiens
tggaagtatagat

SEQ ID NO: 4838798 - DNA, 16 bp, Homo sapiens
tggaagttttacttga

SEQ ID NO: 4838799 - DNA, 17 bp, Homo sapiens
tggaataaggagaatga

SEQ ID NO: 4838800 - DNA, 14 bp, Homo sapiens
tggaatatctactt

SEQ ID NO: 4838801 - DNA, 18 bp, Homo sapiens
tggaatctactagaacct

SEQ ID NO: 4838802 - DNA, 21 bp, Homo sapiens
tggaattattagcaccagctt

SEQ ID NO: 4838803 - DNA, 18 bp, Homo sapiens
tggaattctgcttctctt

SEQ ID NO: 4838804 - DNA, 19 bp, Homo sapiens
tggacactacacgtttcaa

SEQ ID NO: 4838805 - DNA, 21 bp, Homo sapiens
tggacagatgggtgtcccctg

SEQ ID NO: 4838806 - DNA, 18 bp, Homo sapiens
tggacagcaaaaccattg

SEQ ID NO: 4838807 - DNA, 22 bp, Homo sapiens
tggacagcaaaaccattgcttc

SEQ ID NO: 4838808 - DNA, 18 bp, Homo sapiens
tggacagccaagggcaga

SEQ ID NO: 4838809 - DNA, 22 bp, Homo sapiens
tggacagtgcctaactccttac

SEQ ID NO: 4838810 - DNA, 19 bp, Homo sapiens
tggacatgcacagctaaca

SEQ ID NO: 4838811 - DNA, 20 bp, Homo sapiens
tggacctctactttccaggc

SEQ ID NO: 4838812 - DNA, 19 bp, Homo sapiens
tggacgagtgagctaccag

SEQ ID NO: 4838813 - DNA, 23 bp, Homo sapiens
tggacgagtgagctaccaggaag

SEQ ID NO: 4838814 - DNA, 17 bp, Homo sapiens
tggacgtgggctccagg

SEQ ID NO: 4838815 - DNA, 19 bp, Homo sapiens
tggacgtgttatgactcca

SEQ ID NO: 4838816 - DNA, 22 bp, Homo sapiens
tggactaaccccaacgcacagg

SEQ ID NO: 4838817 - DNA, 23 bp, Homo sapiens
tggactaagtggaacgttctcta

SEQ ID NO: 4838818 - DNA, 16 bp, Homo sapiens
tggactacctataaat

SEQ ID NO: 4838819 - DNA, 17 bp, Homo sapiens
tggactcgcgagagggt

SEQ ID NO: 4838820 - DNA, 14 bp, Homo sapiens
tggactcttccctc

SEQ ID NO: 4838821 - DNA, 17 bp, Homo sapiens
tggactgatggttgctt

SEQ ID NO: 4838822 - DNA, 14 bp, Homo sapiens
tggactgcacaaaa

SEQ ID NO: 4838823 - DNA, 19 bp, Homo sapiens
tggactgggtgggccccac

SEQ ID NO: 4838824 - DNA, 23 bp, Homo sapiens
tggacttgcttcttgtgtttgaa

SEQ ID NO: 4838825 - DNA, 21 bp, Homo sapiens
tggagaaacaacaaataagtc

SEQ ID NO: 4838826 - DNA, 14 bp, Homo sapiens
tggagaaggaaggc

SEQ ID NO: 4838827 - DNA, 14 bp, Homo sapiens
tggagaagtgtgtt

SEQ ID NO: 4838828 - DNA, 15 bp, Homo sapiens
tggagaggcggcctc

SEQ ID NO: 4838829 - DNA, 17 bp, Homo sapiens
tggagaggggacttgga

SEQ ID NO: 4838830 - DNA, 13 bp, Homo sapiens
tggagcagagacg

SEQ ID NO: 4838831 - DNA, 17 bp, Homo sapiens
tggagcagagacggcag

SEQ ID NO: 4838832 - DNA, 22 bp, Homo sapiens
tggagcagtacatgggaaagga

SEQ ID NO: 4838833 - DNA, 14 bp, Homo sapiens
tggagcctggcaca

SEQ ID NO: 4838834 - DNA, 21 bp, Homo sapiens
tggagcctggcacaggactga

SEQ ID NO: 4838835 - DNA, 18 bp, Homo sapiens
tggagcgtccttgtcccc

SEQ ID NO: 4838836 - DNA, 21 bp, Homo sapiens
tggagctgaggactctcacga

SEQ ID NO: 4838837 - DNA, 22 bp, Homo sapiens
tggaggagggggtacagtcctg

SEQ ID NO: 4838838 - DNA, 18 bp, Homo sapiens
tggaggatggacgagtga

SEQ ID NO: 4838839 - DNA, 20 bp, Homo sapiens
tggaggcctggtctggagcc

SEQ ID NO: 4838840 - DNA, 12 bp, Homo sapiens
tggaggctggac

SEQ ID NO: 4838841 - DNA, 13 bp, Homo sapiens
tggaggctggacc

SEQ ID NO: 4838842 - DNA, 16 bp, Homo sapiens
tggaggtacaggatat

SEQ ID NO: 4838843 - DNA, 12 bp, Homo sapiens
tggaggtgatga

SEQ ID NO: 4838844 - DNA, 14 bp, Homo sapiens
tggaggtggggagg

SEQ ID NO: 4838845 - DNA, 19 bp, Homo sapiens
tggaggtggggagggcctc

SEQ ID NO: 4838846 - DNA, 14 bp, Homo sapiens
tggagtagagtcag

SEQ ID NO: 4838847 - DNA, 19 bp, Homo sapiens
tggagtattattattttaa

SEQ ID NO: 4838848 - DNA, 15 bp, Homo sapiens
tggagtcagggctgt

SEQ ID NO: 4838849 - DNA, 17 bp, Homo sapiens
tggagtctgaaggagag

SEQ ID NO: 4838850 - DNA, 18 bp, Homo sapiens
tggagtctgaaggagagg

SEQ ID NO: 4838851 - DNA, 18 bp, Homo sapiens
tggagtgccacatggccg

SEQ ID NO: 4838852 - DNA, 20 bp, Homo sapiens
tggagtggaggggtcagcag

SEQ ID NO: 4838853 - DNA, 12 bp, Homo sapiens
tggagtgtcacc

SEQ ID NO: 4838854 - DNA, 14 bp, Homo sapiens
tggagttcctcatc

SEQ ID NO: 4838855 - DNA, 12 bp, Homo sapiens
tggataagaaaa

SEQ ID NO: 4838856 - DNA, 20 bp, Homo sapiens
tggataagaaaaatgcttga

SEQ ID NO: 4838857 - DNA, 17 bp, Homo sapiens
tggatactggggggcag

SEQ ID NO: 4838858 - DNA, 18 bp, Homo sapiens
tggatactggggggcagg

SEQ ID NO: 4838859 - DNA, 19 bp, Homo sapiens
tggatactggggggcaggc

SEQ ID NO: 4838860 - DNA, 19 bp, Homo sapiens
tggataggagcttccagat

SEQ ID NO: 4838861 - DNA, 14 bp, Homo sapiens
tggatataaatctt

SEQ ID NO: 4838862 - DNA, 15 bp, Homo sapiens
tggatataaatctta

SEQ ID NO: 4838863 - DNA, 16 bp, Homo sapiens
tggatatgaaagagaa

SEQ ID NO: 4838864 - DNA, 14 bp, Homo sapiens
tggatcaagtatta

SEQ ID NO: 4838865 - DNA, 12 bp, Homo sapiens
tggatcaggaaa

SEQ ID NO: 4838866 - DNA, 18 bp, Homo sapiens
tggatccttgtcagttgt

SEQ ID NO: 4838867 - DNA, 17 bp, Homo sapiens
tggatctgctccatgca

SEQ ID NO: 4838868 - DNA, 18 bp, Homo sapiens
tggatctggagtctgaag

SEQ ID NO: 4838869 - DNA, 16 bp, Homo sapiens
tggatgacaaagaaaa

SEQ ID NO: 4838870 - DNA, 13 bp, Homo sapiens
tggatgattcttt

SEQ ID NO: 4838871 - DNA, 17 bp, Homo sapiens
tggatgtaatatagggt

SEQ ID NO: 4838872 - DNA, 15 bp, Homo sapiens
tggatgtcatatctt

SEQ ID NO: 4838873 - DNA, 13 bp, Homo sapiens
tggatgtgctttc

SEQ ID NO: 4838874 - DNA, 14 bp, Homo sapiens
tggattcccctgga

SEQ ID NO: 4838875 - DNA, 16 bp, Homo sapiens
tggattcctctaagat

SEQ ID NO: 4838876 - DNA, 17 bp, Homo sapiens
tggattcctctaagatc

SEQ ID NO: 4838877 - DNA, 18 bp, Homo sapiens
tggattgtattgtgagat

SEQ ID NO: 4838878 - DNA, 19 bp, Homo sapiens
tggatttattttttgtaac

SEQ ID NO: 4838879 - DNA, 21 bp, Homo sapiens
tggatttattttttgtaactc

SEQ ID NO: 4838880 - DNA, 16 bp, Homo sapiens
tggatttgacacactc

SEQ ID NO: 4838881 - DNA, 15 bp, Homo sapiens
tggattttaaacaaa

SEQ ID NO: 4838882 - DNA, 19 bp, Homo sapiens
tggattttaaacaaaattt

SEQ ID NO: 4838883 - DNA, 23 bp, Homo sapiens
tggattttcaaagattgttggca

SEQ ID NO: 4838884 - DNA, 12 bp, Homo sapiens
tggcaaacattt

SEQ ID NO: 4838885 - DNA, 16 bp, Homo sapiens
tggcaagaaatcccct

SEQ ID NO: 4838886 - DNA, 15 bp, Homo sapiens
tggcaagctcttcat

SEQ ID NO: 4838887 - DNA, 20 bp, Homo sapiens
tggcaataaatgtcccaaat

SEQ ID NO: 4838888 - DNA, 23 bp, Homo sapiens
tggcaataaatgtcccaaataaa

SEQ ID NO: 4838889 - DNA, 14 bp, Homo sapiens
tggcacaggactga

SEQ ID NO: 4838890 - DNA, 20 bp, Homo sapiens
tggcaccaaagatgcagccg

SEQ ID NO: 4838891 - DNA, 14 bp, Homo sapiens
tggcacccaccact

SEQ ID NO: 4838892 - DNA, 12 bp, Homo sapiens
tggcacctggcg

SEQ ID NO: 4838893 - DNA, 10 bp, Homo sapiens
tggcactgat

SEQ ID NO: 4838894 - DNA, 13 bp, Homo sapiens
tggcacttttgag

SEQ ID NO: 4838895 - DNA, 18 bp, Homo sapiens
tggcacttttgagctcct

SEQ ID NO: 4838896 - DNA, 17 bp, Homo sapiens
tggcagagttgaagaca

SEQ ID NO: 4838897 - DNA, 22 bp, Homo sapiens
tggcagagttgaagacagagct

SEQ ID NO: 4838898 - DNA, 13 bp, Homo sapiens
tggcagatggggg

SEQ ID NO: 4838899 - DNA, 12 bp, Homo sapiens
tggcagcccctg

SEQ ID NO: 4838900 - DNA, 14 bp, Homo sapiens
tggcagcgcccagc

SEQ ID NO: 4838901 - DNA, 14 bp, Homo sapiens
tggcagcgcctccc

SEQ ID NO: 4838902 - DNA, 22 bp, Homo sapiens
tggcagcgcctcccgccgcctc

SEQ ID NO: 4838903 - DNA, 21 bp, Homo sapiens
tggcaggcacacagcagcccc

SEQ ID NO: 4838904 - DNA, 11 bp, Homo sapiens
tggcagtattg

SEQ ID NO: 4838905 - DNA, 16 bp, Homo sapiens
tggcatattgataata

SEQ ID NO: 4838906 - DNA, 12 bp, Homo sapiens
tggcatgggaat

SEQ ID NO: 4838907 - DNA, 22 bp, Homo sapiens
tggcatgggaatgaatgtcagt

SEQ ID NO: 4838908 - DNA, 12 bp, Homo sapiens
tggcatgtgaaa

SEQ ID NO: 4838909 - DNA, 20 bp, Homo sapiens
tggcatttagcacagtattt

SEQ ID NO: 4838910 - DNA, 12 bp, Homo sapiens
tggcatttgcag

SEQ ID NO: 4838911 - DNA, 18 bp, Homo sapiens
tggccaagtgtacatttg

SEQ ID NO: 4838912 - DNA, 13 bp, Homo sapiens
tggccagcaccct

SEQ ID NO: 4838913 - DNA, 21 bp, Homo sapiens
tggccagcaccctctcctggg

SEQ ID NO: 4838914 - DNA, 15 bp, Homo sapiens
tggccagcctggggc

SEQ ID NO: 4838915 - DNA, 19 bp, Homo sapiens
tggccagtatcctggattc

SEQ ID NO: 4838916 - DNA, 19 bp, Homo sapiens
tggccatcatttcattcgt

SEQ ID NO: 4838917 - DNA, 22 bp, Homo sapiens
tggccatccctgggcccctcca

SEQ ID NO: 4838918 - DNA, 12 bp, Homo sapiens
tggcccacccct

SEQ ID NO: 4838919 - DNA, 13 bp, Homo sapiens
tggcccacccctc

SEQ ID NO: 4838920 - DNA, 18 bp, Homo sapiens
tggcccacccctcttccc

SEQ ID NO: 4838921 - DNA, 21 bp, Homo sapiens
tggcccacccctcttccccct

SEQ ID NO: 4838922 - DNA, 20 bp, Homo sapiens
tggcccagcagcggcccaga

SEQ ID NO: 4838923 - DNA, 22 bp, Homo sapiens
tggcccagcagcggcccagatt

SEQ ID NO: 4838924 - DNA, 10 bp, Homo sapiens
tggcccagcc

SEQ ID NO: 4838925 - DNA, 14 bp, Homo sapiens
tggcccagccatgg

SEQ ID NO: 4838926 - DNA, 15 bp, Homo sapiens
tggcccagtgcaatc

SEQ ID NO: 4838927 - DNA, 20 bp, Homo sapiens
tggcccatagaaacatgaca

SEQ ID NO: 4838928 - DNA, 23 bp, Homo sapiens
tggcccatagaaacatgacactg

SEQ ID NO: 4838929 - DNA, 13 bp, Homo sapiens
tggccccaaatgt

SEQ ID NO: 4838930 - DNA, 16 bp, Homo sapiens
tggccccacctgagcc

SEQ ID NO: 4838931 - DNA, 12 bp, Homo sapiens
tggccccagctg

SEQ ID NO: 4838932 - DNA, 20 bp, Homo sapiens
tggccccctcgcgcccctgt

SEQ ID NO: 4838933 - DNA, 14 bp, Homo sapiens
tggcccctctctgt

SEQ ID NO: 4838934 - DNA, 23 bp, Homo sapiens
tggcccctctctgtttaccctcc

SEQ ID NO: 4838935 - DNA, 18 bp, Homo sapiens
tggcccggtcccagtccg

SEQ ID NO: 4838936 - DNA, 12 bp, Homo sapiens
tggccctgccct

SEQ ID NO: 4838937 - DNA, 15 bp, Homo sapiens
tggccctgccctccc

SEQ ID NO: 4838938 - DNA, 22 bp, Homo sapiens
tggccctgccctcccccacggc

SEQ ID NO: 4838939 - DNA, 21 bp, Homo sapiens
tggccctgccctctccttcct

SEQ ID NO: 4838940 - DNA, 23 bp, Homo sapiens
tggccctgcggggcggcatccga

SEQ ID NO: 4838941 - DNA, 17 bp, Homo sapiens
tggccgattagaaggca

SEQ ID NO: 4838942 - DNA, 16 bp, Homo sapiens
tggccgcaacttccca

SEQ ID NO: 4838943 - DNA, 20 bp, Homo sapiens
tggccgcaacttcccaggcc

SEQ ID NO: 4838944 - DNA, 21 bp, Homo sapiens
tggccgcaacttcccaggccg

SEQ ID NO: 4838945 - DNA, 18 bp, Homo sapiens
tggccgctgctgtgacag

SEQ ID NO: 4838946 - DNA, 14 bp, Homo sapiens
tggccgctgggaga

SEQ ID NO: 4838947 - DNA, 23 bp, Homo sapiens
tggccggcccacgtcctgggtgc

SEQ ID NO: 4838948 - DNA, 15 bp, Homo sapiens
tggccggtccacccc

SEQ ID NO: 4838949 - DNA, 12 bp, Homo sapiens
tggcctaccaca

SEQ ID NO: 4838950 - DNA, 18 bp, Homo sapiens
tggcctagcccaccctgc

SEQ ID NO: 4838951 - DNA, 20 bp, Homo sapiens
tggcctagcccaccctgctg

SEQ ID NO: 4838952 - DNA, 22 bp, Homo sapiens
tggcctagcccaccctgctgcc

SEQ ID NO: 4838953 - DNA, 17 bp, Homo sapiens
tggcctaggatcttcac

SEQ ID NO: 4838954 - DNA, 22 bp, Homo sapiens
tggcctaggatcttcactgtct

SEQ ID NO: 4838955 - DNA, 12 bp, Homo sapiens
tggcctcccagc

SEQ ID NO: 4838956 - DNA, 16 bp, Homo sapiens
tggcctcccagccacc

SEQ ID NO: 4838957 - DNA, 18 bp, Homo sapiens
tggcctcccagccacccg

SEQ ID NO: 4838958 - DNA, 15 bp, Homo sapiens
tggcctctgcccctc

SEQ ID NO: 4838959 - DNA, 21 bp, Homo sapiens
tggcctctgcccctcttccct

SEQ ID NO: 4838960 - DNA, 19 bp, Homo sapiens
tggcctgagaagagtcgag

SEQ ID NO: 4838961 - DNA, 13 bp, Homo sapiens
tggcctggccctg

SEQ ID NO: 4838962 - DNA, 15 bp, Homo sapiens
tggcctggccctgcc

SEQ ID NO: 4838963 - DNA, 16 bp, Homo sapiens
tggcctggccctgccc

SEQ ID NO: 4838964 - DNA, 18 bp, Homo sapiens
tggcctggccctgccctg

SEQ ID NO: 4838965 - DNA, 20 bp, Homo sapiens
tggcctggccctgccctgag

SEQ ID NO: 4838966 - DNA, 15 bp, Homo sapiens
tggcctggcctggcc

SEQ ID NO: 4838967 - DNA, 16 bp, Homo sapiens
tggcctggcctggccc

SEQ ID NO: 4838968 - DNA, 18 bp, Homo sapiens
tggcctgggtcctcggcc

SEQ ID NO: 4838969 - DNA, 22 bp, Homo sapiens
tggcctgggtcctcggccctgt

SEQ ID NO: 4838970 - DNA, 20 bp, Homo sapiens
tggcctgtccctagggctct

SEQ ID NO: 4838971 - DNA, 18 bp, Homo sapiens
tggccttaactggccctc

SEQ ID NO: 4838972 - DNA, 20 bp, Homo sapiens
tggccttaactggccctcgg

SEQ ID NO: 4838973 - DNA, 19 bp, Homo sapiens
tggccttggttcctccagc

SEQ ID NO: 4838974 - DNA, 22 bp, Homo sapiens
tggcgcatagtgtgctcggaca

SEQ ID NO: 4838975 - DNA, 14 bp, Homo sapiens
tggcgctgcccctg

SEQ ID NO: 4838976 - DNA, 15 bp, Homo sapiens
tggcgctgcccctgg

SEQ ID NO: 4838977 - DNA, 16 bp, Homo sapiens
tggcgggcagcccctg

SEQ ID NO: 4838978 - DNA, 18 bp, Homo sapiens
tggcgggcagcccctgct

SEQ ID NO: 4838979 - DNA, 19 bp, Homo sapiens
tggcggggtctgctcctgg

SEQ ID NO: 4838980 - DNA, 15 bp, Homo sapiens
tggcgtggagcaggc

SEQ ID NO: 4838981 - DNA, 20 bp, Homo sapiens
tggctaaatgcctaataaac

SEQ ID NO: 4838982 - DNA, 14 bp, Homo sapiens
tggctaaattcatg

SEQ ID NO: 4838983 - DNA, 16 bp, Homo sapiens
tggctagtctgtgcct

SEQ ID NO: 4838984 - DNA, 13 bp, Homo sapiens
tggctattgtcct

SEQ ID NO: 4838985 - DNA, 15 bp, Homo sapiens
tggctattgtccttg

SEQ ID NO: 4838986 - DNA, 19 bp, Homo sapiens
tggctattgtccttgtgta

SEQ ID NO: 4838987 - DNA, 13 bp, Homo sapiens
tggctcacagcca

SEQ ID NO: 4838988 - DNA, 14 bp, Homo sapiens
tggctcacagccac

SEQ ID NO: 4838989 - DNA, 16 bp, Homo sapiens
tggctcacagccacca

SEQ ID NO: 4838990 - DNA, 15 bp, Homo sapiens
tggctccatgctcct

SEQ ID NO: 4838991 - DNA, 14 bp, Homo sapiens
tggctcccagcaga

SEQ ID NO: 4838992 - DNA, 19 bp, Homo sapiens
tggctcctctgttatttgt

SEQ ID NO: 4838993 - DNA, 16 bp, Homo sapiens
tggctcgtgtttcaca

SEQ ID NO: 4838994 - DNA, 19 bp, Homo sapiens
tggctcgtgtttcacagtg

SEQ ID NO: 4838995 - DNA, 12 bp, Homo sapiens
tggctgaaatta

SEQ ID NO: 4838996 - DNA, 14 bp, Homo sapiens
tggctgaaattatg

SEQ ID NO: 4838997 - DNA, 19 bp, Homo sapiens
tggctgaagaaacacagca

SEQ ID NO: 4838998 - DNA, 13 bp, Homo sapiens
tggctgattggaa

SEQ ID NO: 4838999 - DNA, 16 bp, Homo sapiens
tggctgattggaaaat

SEQ ID NO: 4839000 - DNA, 14 bp, Homo sapiens
tggctgctctccat

SEQ ID NO: 4839001 - DNA, 13 bp, Homo sapiens
tggctgctgcagt

SEQ ID NO: 4839002 - DNA, 15 bp, Homo sapiens
tggctggagccccat

SEQ ID NO: 4839003 - DNA, 17 bp, Homo sapiens
tggctggagccccatcg

SEQ ID NO: 4839004 - DNA, 16 bp, Homo sapiens
tggctggatgtgcatc

SEQ ID NO: 4839005 - DNA, 20 bp, Homo sapiens
tggctgggtcgcccctcctc

SEQ ID NO: 4839006 - DNA, 19 bp, Homo sapiens
tggctgggtttgggcagtg

SEQ ID NO: 4839007 - DNA, 19 bp, Homo sapiens
tggctgtcaaatccatgtg

SEQ ID NO: 4839008 - DNA, 23 bp, Homo sapiens
tggctgtcaaatccatgtgtccc

SEQ ID NO: 4839009 - DNA, 18 bp, Homo sapiens
tggctgtcccctgcaagt

SEQ ID NO: 4839010 - DNA, 23 bp, Homo sapiens
tggctgtggcccctccttctccc

SEQ ID NO: 4839011 - DNA, 14 bp, Homo sapiens
tggctgtgtctccc

SEQ ID NO: 4839012 - DNA, 19 bp, Homo sapiens
tggctgttatctgtcttta

SEQ ID NO: 4839013 - DNA, 13 bp, Homo sapiens
tggcttagtaaat

SEQ ID NO: 4839014 - DNA, 23 bp, Homo sapiens
tggcttcaccgcattccaggggc

SEQ ID NO: 4839015 - DNA, 12 bp, Homo sapiens
tggcttcccagg

SEQ ID NO: 4839016 - DNA, 13 bp, Homo sapiens
tggcttcccagga

SEQ ID NO: 4839017 - DNA, 17 bp, Homo sapiens
tggcttcccatgtcttt

SEQ ID NO: 4839018 - DNA, 13 bp, Homo sapiens
tggcttcctcctg

SEQ ID NO: 4839019 - DNA, 16 bp, Homo sapiens
tggcttctggcacctg

SEQ ID NO: 4839020 - DNA, 23 bp, Homo sapiens
tggcttggattaatattcatagt

SEQ ID NO: 4839021 - DNA, 22 bp, Homo sapiens
tggcttgtagggtgaggcgtgg

SEQ ID NO: 4839022 - DNA, 20 bp, Homo sapiens
tggcttttaaacctgttcct

SEQ ID NO: 4839023 - DNA, 15 bp, Homo sapiens
tgggaaaggcagggc

SEQ ID NO: 4839024 - DNA, 20 bp, Homo sapiens
tgggaaattcttgcactgta

SEQ ID NO: 4839025 - DNA, 23 bp, Homo sapiens
tgggaaattgctccattcctgag

SEQ ID NO: 4839026 - DNA, 13 bp, Homo sapiens
tgggaactctgac

SEQ ID NO: 4839027 - DNA, 13 bp, Homo sapiens
tgggaatggggtg

SEQ ID NO: 4839028 - DNA, 22 bp, Homo sapiens
tgggacagaggagcaaggttta

SEQ ID NO: 4839029 - DNA, 14 bp, Homo sapiens
tgggacagccactg

SEQ ID NO: 4839030 - DNA, 18 bp, Homo sapiens
tgggaccccattccagtc

SEQ ID NO: 4839031 - DNA, 15 bp, Homo sapiens
tgggacggaagtggc

SEQ ID NO: 4839032 - DNA, 16 bp, Homo sapiens
tgggactggcccaccc

SEQ ID NO: 4839033 - DNA, 17 bp, Homo sapiens
tgggagaaaagccagat

SEQ ID NO: 4839034 - DNA, 19 bp, Homo sapiens
tgggagagaagagaatgca

SEQ ID NO: 4839035 - DNA, 14 bp, Homo sapiens
tgggagagcccctg

SEQ ID NO: 4839036 - DNA, 18 bp, Homo sapiens
tgggagagcccctggggc

SEQ ID NO: 4839037 - DNA, 19 bp, Homo sapiens
tgggagagcccctggggcc

SEQ ID NO: 4839038 - DNA, 15 bp, Homo sapiens
tgggagaggagaggc

SEQ ID NO: 4839039 - DNA, 18 bp, Homo sapiens
tgggagaggagaggctgc

SEQ ID NO: 4839040 - DNA, 21 bp, Homo sapiens
tgggagtcaagtgtgcctgct

SEQ ID NO: 4839041 - DNA, 16 bp, Homo sapiens
tgggagtccactttcc

SEQ ID NO: 4839042 - DNA, 19 bp, Homo sapiens
tgggagtccactttcctct

SEQ ID NO: 4839043 - DNA, 17 bp, Homo sapiens
tgggatccagagagaag

SEQ ID NO: 4839044 - DNA, 19 bp, Homo sapiens
tgggatccagagagaagca

SEQ ID NO: 4839045 - DNA, 18 bp, Homo sapiens
tgggcaaaggccccctct

SEQ ID NO: 4839046 - DNA, 18 bp, Homo sapiens
tgggcaaggcctttggct

SEQ ID NO: 4839047 - DNA, 19 bp, Homo sapiens
tgggcacatagcataggct

SEQ ID NO: 4839048 - DNA, 22 bp, Homo sapiens
tgggcacatagcataggctggg

SEQ ID NO: 4839049 - DNA, 20 bp, Homo sapiens
tgggcagaaggaagacttca

SEQ ID NO: 4839050 - DNA, 15 bp, Homo sapiens
tgggcagaggaaagc

SEQ ID NO: 4839051 - DNA, 16 bp, Homo sapiens
tgggcagaggaaagca

SEQ ID NO: 4839052 - DNA, 22 bp, Homo sapiens
tgggcagcaccctcccccgcag

SEQ ID NO: 4839053 - DNA, 15 bp, Homo sapiens
tgggcagcccagaga

SEQ ID NO: 4839054 - DNA, 15 bp, Homo sapiens
tgggcagtggagagg

SEQ ID NO: 4839055 - DNA, 13 bp, Homo sapiens
tgggccaggagcc

SEQ ID NO: 4839056 - DNA, 18 bp, Homo sapiens
tgggccaggagcctcctg

SEQ ID NO: 4839057 - DNA, 18 bp, Homo sapiens
tgggcccaaggcccccac

SEQ ID NO: 4839058 - DNA, 18 bp, Homo sapiens
tgggccccccagctcagg

SEQ ID NO: 4839059 - DNA, 18 bp, Homo sapiens
tgggcccctccacgcctc

SEQ ID NO: 4839060 - DNA, 23 bp, Homo sapiens
tgggcccctccacgcctcctggc

SEQ ID NO: 4839061 - DNA, 13 bp, Homo sapiens
tgggccctaggca

SEQ ID NO: 4839062 - DNA, 14 bp, Homo sapiens
tgggccctaggcat

SEQ ID NO: 4839063 - DNA, 16 bp, Homo sapiens
tgggcccttagaatgt

SEQ ID NO: 4839064 - DNA, 22 bp, Homo sapiens
tgggccgaacctgatacctgcc

SEQ ID NO: 4839065 - DNA, 21 bp, Homo sapiens
tgggcctcccgtccgtccgcc

SEQ ID NO: 4839066 - DNA, 15 bp, Homo sapiens
tgggctccagagtag

SEQ ID NO: 4839067 - DNA, 21 bp, Homo sapiens
tgggctgcaaaatgaagacac

SEQ ID NO: 4839068 - DNA, 23 bp, Homo sapiens
tgggctgctggaaaggcccggag

SEQ ID NO: 4839069 - DNA, 16 bp, Homo sapiens
tgggctgtctgtcacc

SEQ ID NO: 4839070 - DNA, 18 bp, Homo sapiens
tgggctgtctgtcaccag

SEQ ID NO: 4839071 - DNA, 19 bp, Homo sapiens
tgggctgtctgtcaccagc

SEQ ID NO: 4839072 - DNA, 14 bp, Homo sapiens
tgggctgtgaggac

SEQ ID NO: 4839073 - DNA, 15 bp, Homo sapiens
tgggcttaatataaa

SEQ ID NO: 4839074 - DNA, 21 bp, Homo sapiens
tgggcttggggaccagagctg

SEQ ID NO: 4839075 - DNA, 22 bp, Homo sapiens
tgggcttggggaccagagctgc

SEQ ID NO: 4839076 - DNA, 17 bp, Homo sapiens
tggggaactcccccaga

SEQ ID NO: 4839077 - DNA, 22 bp, Homo sapiens
tggggaagattagaaagaatta

SEQ ID NO: 4839078 - DNA, 15 bp, Homo sapiens
tggggaaggggcctg

SEQ ID NO: 4839079 - DNA, 20 bp, Homo sapiens
tggggaaggggcctgggctg

SEQ ID NO: 4839080 - DNA, 16 bp, Homo sapiens
tggggacctcaggcct

SEQ ID NO: 4839081 - DNA, 18 bp, Homo sapiens
tggggacgggggctgctt

SEQ ID NO: 4839082 - DNA, 15 bp, Homo sapiens
tggggacttcccggg

SEQ ID NO: 4839083 - DNA, 15 bp, Homo sapiens
tggggagaggaactc

SEQ ID NO: 4839084 - DNA, 20 bp, Homo sapiens
tggggaggacccctgccctc

SEQ ID NO: 4839085 - DNA, 19 bp, Homo sapiens
tggggagggcctctggaca

SEQ ID NO: 4839086 - DNA, 14 bp, Homo sapiens
tggggagggtgggc

SEQ ID NO: 4839087 - DNA, 17 bp, Homo sapiens
tggggcccatggcccca

SEQ ID NO: 4839088 - DNA, 20 bp, Homo sapiens
tggggcccatggccccagct

SEQ ID NO: 4839089 - DNA, 15 bp, Homo sapiens
tggggccctgggcct

SEQ ID NO: 4839090 - DNA, 17 bp, Homo sapiens
tggggccctgggcctca

SEQ ID NO: 4839091 - DNA, 14 bp, Homo sapiens
tggggcttatcaga

SEQ ID NO: 4839092 - DNA, 15 bp, Homo sapiens
tggggcttggaaggg

SEQ ID NO: 4839093 - DNA, 22 bp, Homo sapiens
tggggcttggaagggcgctgag

SEQ ID NO: 4839094 - DNA, 19 bp, Homo sapiens
tgggggacgcccagccccc

SEQ ID NO: 4839095 - DNA, 22 bp, Homo sapiens
tgggggacgcccagcccccacc

SEQ ID NO: 4839096 - DNA, 20 bp, Homo sapiens
tgggggaggcttccagctca

SEQ ID NO: 4839097 - DNA, 16 bp, Homo sapiens
tgggggagtggccaca

SEQ ID NO: 4839098 - DNA, 11 bp, Homo sapiens
tgggggctgct

SEQ ID NO: 4839099 - DNA, 16 bp, Homo sapiens
tgggggctgctgcact

SEQ ID NO: 4839100 - DNA, 11 bp, Homo sapiens
tggggggagaa

SEQ ID NO: 4839101 - DNA, 18 bp, Homo sapiens
tggggggcacagccagaa

SEQ ID NO: 4839102 - DNA, 22 bp, Homo sapiens
tggggggccatgttcccagaac

SEQ ID NO: 4839103 - DNA, 19 bp, Homo sapiens
tgggggtggccatccctgg

SEQ ID NO: 4839104 - DNA, 12 bp, Homo sapiens
tgggggttttta

SEQ ID NO: 4839105 - DNA, 13 bp, Homo sapiens
tggggtagagagg

SEQ ID NO: 4839106 - DNA, 17 bp, Homo sapiens
tggggtagagaggacag

SEQ ID NO: 4839107 - DNA, 22 bp, Homo sapiens
tggggtctctgagcagtgggga

SEQ ID NO: 4839108 - DNA, 21 bp, Homo sapiens
tggggtcttagggtacagccc

SEQ ID NO: 4839109 - DNA, 16 bp, Homo sapiens
tggggtgctggggctg

SEQ ID NO: 4839110 - DNA, 17 bp, Homo sapiens
tggggtgctggggctgc

SEQ ID NO: 4839111 - DNA, 16 bp, Homo sapiens
tggggtggggcttgga

SEQ ID NO: 4839112 - DNA, 17 bp, Homo sapiens
tggggtggggcttggaa

SEQ ID NO: 4839113 - DNA, 20 bp, Homo sapiens
tgggtaaataaatgctgctt

SEQ ID NO: 4839114 - DNA, 20 bp, Homo sapiens
tgggtaagggactccagaag

SEQ ID NO: 4839115 - DNA, 22 bp, Homo sapiens
tgggtagtgccatggccaggag

SEQ ID NO: 4839116 - DNA, 16 bp, Homo sapiens
tgggtcaactccaagg

SEQ ID NO: 4839117 - DNA, 18 bp, Homo sapiens
tgggtcaccttcctgggc

SEQ ID NO: 4839118 - DNA, 12 bp, Homo sapiens
tgggtccaggag

SEQ ID NO: 4839119 - DNA, 12 bp, Homo sapiens
tgggtccccctc

SEQ ID NO: 4839120 - DNA, 13 bp, Homo sapiens
tgggtccccctcc

SEQ ID NO: 4839121 - DNA, 14 bp, Homo sapiens
tgggtccccctcct

SEQ ID NO: 4839122 - DNA, 15 bp, Homo sapiens
tgggtccccctcctg

SEQ ID NO: 4839123 - DNA, 18 bp, Homo sapiens
tgggtccccctcctgcac

SEQ ID NO: 4839124 - DNA, 20 bp, Homo sapiens
tgggtccctgcgtctcctgc

SEQ ID NO: 4839125 - DNA, 14 bp, Homo sapiens
tgggtcctcccagc

SEQ ID NO: 4839126 - DNA, 13 bp, Homo sapiens
tgggtcctgctgc

SEQ ID NO: 4839127 - DNA, 14 bp, Homo sapiens
tgggtcgcccctcc

SEQ ID NO: 4839128 - DNA, 23 bp, Homo sapiens
tgggtgctgtcatgcccagcttg

SEQ ID NO: 4839129 - DNA, 23 bp, Homo sapiens
tgggtgtttgggaaaggcagggc

SEQ ID NO: 4839130 - DNA, 23 bp, Homo sapiens
tgggttaacagtaaatatacact

SEQ ID NO: 4839131 - DNA, 21 bp, Homo sapiens
tgggttcccacgtagcaaatc

SEQ ID NO: 4839132 - DNA, 21 bp, Homo sapiens
tgggttgttgcagagtaaatc

SEQ ID NO: 4839133 - DNA, 12 bp, Homo sapiens
tgggtttccctg

SEQ ID NO: 4839134 - DNA, 14 bp, Homo sapiens
tgggtttccctgcg

SEQ ID NO: 4839135 - DNA, 15 bp, Homo sapiens
tgggtttgggcagtg

SEQ ID NO: 4839136 - DNA, 23 bp, Homo sapiens
tgggtttttaaaaaaaatattct

SEQ ID NO: 4839137 - DNA, 13 bp, Homo sapiens
tggtaccagagcc

SEQ ID NO: 4839138 - DNA, 21 bp, Homo sapiens
tggtaccagccctggggctgg

SEQ ID NO: 4839139 - DNA, 18 bp, Homo sapiens
tggtagaaactttggaag

SEQ ID NO: 4839140 - DNA, 19 bp, Homo sapiens
tggtagctctgaagggagg

SEQ ID NO: 4839141 - DNA, 17 bp, Homo sapiens
tggtatgaaacaaatat

SEQ ID NO: 4839142 - DNA, 18 bp, Homo sapiens
tggtatttactgcaatgt

SEQ ID NO: 4839143 - DNA, 15 bp, Homo sapiens
tggtcacagacccct

SEQ ID NO: 4839144 - DNA, 20 bp, Homo sapiens
tggtcagcgattcctgccaa

SEQ ID NO: 4839145 - DNA, 23 bp, Homo sapiens
tggtcagcgattcctgccaagta

SEQ ID NO: 4839146 - DNA, 18 bp, Homo sapiens
tggtcatttggtggctct

SEQ ID NO: 4839147 - DNA, 13 bp, Homo sapiens
tggtccacacacc

SEQ ID NO: 4839148 - DNA, 16 bp, Homo sapiens
tggtccagggtccagc

SEQ ID NO: 4839149 - DNA, 17 bp, Homo sapiens
tggtcccacttccccat

SEQ ID NO: 4839150 - DNA, 13 bp, Homo sapiens
tggtcctgcactg

SEQ ID NO: 4839151 - DNA, 14 bp, Homo sapiens
tggtctggagcccc

SEQ ID NO: 4839152 - DNA, 15 bp, Homo sapiens
tggtctggagcccct

SEQ ID NO: 4839153 - DNA, 17 bp, Homo sapiens
tggtctggagcccctat

SEQ ID NO: 4839154 - DNA, 16 bp, Homo sapiens
tggtctgtgtgtgaca

SEQ ID NO: 4839155 - DNA, 16 bp, Homo sapiens
tggtcttaactaatgt

SEQ ID NO: 4839156 - DNA, 12 bp, Homo sapiens
tggtcttggaga

SEQ ID NO: 4839157 - DNA, 17 bp, Homo sapiens
tggtcttggagaggagg

SEQ ID NO: 4839158 - DNA, 19 bp, Homo sapiens
tggtcttgtttaatatttg

SEQ ID NO: 4839159 - DNA, 22 bp, Homo sapiens
tggtgaaagagtaaaaccaaag

SEQ ID NO: 4839160 - DNA, 14 bp, Homo sapiens
tggtgactgtccca

SEQ ID NO: 4839161 - DNA, 15 bp, Homo sapiens
tggtgactgtcccac

SEQ ID NO: 4839162 - DNA, 14 bp, Homo sapiens
tggtgagaggcatc

SEQ ID NO: 4839163 - DNA, 15 bp, Homo sapiens
tggtggcagagtgga

SEQ ID NO: 4839164 - DNA, 22 bp, Homo sapiens
tggtggcggcggcacttcaagc

SEQ ID NO: 4839165 - DNA, 21 bp, Homo sapiens
tggtgggagcacagctttcct

SEQ ID NO: 4839166 - DNA, 15 bp, Homo sapiens
tggtgggctccagag

SEQ ID NO: 4839167 - DNA, 16 bp, Homo sapiens
tggtggtgaaggggct

SEQ ID NO: 4839168 - DNA, 16 bp, Homo sapiens
tggtggtttcagaaag

SEQ ID NO: 4839169 - DNA, 17 bp, Homo sapiens
tggtgtagctgtcctct

SEQ ID NO: 4839170 - DNA, 15 bp, Homo sapiens
tggtgtcctgcatgt

SEQ ID NO: 4839171 - DNA, 19 bp, Homo sapiens
tggtgtcctgcatgtatgc

SEQ ID NO: 4839172 - DNA, 14 bp, Homo sapiens
tggtgtgaggcccc

SEQ ID NO: 4839173 - DNA, 20 bp, Homo sapiens
tggtgtgaggcccccggagg

SEQ ID NO: 4839174 - DNA, 23 bp, Homo sapiens
tggttaaccgggactacagaagt

SEQ ID NO: 4839175 - DNA, 15 bp, Homo sapiens
tggttacaaattttt

SEQ ID NO: 4839176 - DNA, 15 bp, Homo sapiens
tggttacctattgct

SEQ ID NO: 4839177 - DNA, 16 bp, Homo sapiens
tggttacctattgctg

SEQ ID NO: 4839178 - DNA, 24 bp, Homo sapiens
tggttagtgcatgtcacatgacat

SEQ ID NO: 4839179 - DNA, 13 bp, Homo sapiens
tggttatgtccca

SEQ ID NO: 4839180 - DNA, 21 bp, Homo sapiens
tggttatgtcccatgaccttg

SEQ ID NO: 4839181 - DNA, 14 bp, Homo sapiens
tggttcctcatggc

SEQ ID NO: 4839182 - DNA, 17 bp, Homo sapiens
tggttcgggggaaatag

SEQ ID NO: 4839183 - DNA, 23 bp, Homo sapiens
tggttgcaattgtttaagaatca

SEQ ID NO: 4839184 - DNA, 15 bp, Homo sapiens
tggttggaggcctgg

SEQ ID NO: 4839185 - DNA, 22 bp, Homo sapiens
tggttggaggcctggtctggag

SEQ ID NO: 4839186 - DNA, 19 bp, Homo sapiens
tggttggttagtgcatgtc

SEQ ID NO: 4839187 - DNA, 18 bp, Homo sapiens
tggtttccacatgctctg

SEQ ID NO: 4839188 - DNA, 15 bp, Homo sapiens
tggtttctgtttgaa

SEQ ID NO: 4839189 - DNA, 23 bp, Homo sapiens
tggtttctgtttgaattttcaaa

SEQ ID NO: 4839190 - DNA, 13 bp, Homo sapiens
tggttttctcctt

SEQ ID NO: 4839191 - DNA, 20 bp, Homo sapiens
tggttttctccttcccaagg

SEQ ID NO: 4839192 - DNA, 21 bp, Homo sapiens
tggttttgtaaaattccatgg

SEQ ID NO: 4839193 - DNA, 20 bp, Homo sapiens
tggtttttctgttccctgct

SEQ ID NO: 4839194 - DNA, 12 bp, Homo sapiens
tgtaaaacagtg

SEQ ID NO: 4839195 - DNA, 12 bp, Homo sapiens
tgtaaaactgtg

SEQ ID NO: 4839196 - DNA, 13 bp, Homo sapiens
tgtaaaactttat

SEQ ID NO: 4839197 - DNA, 14 bp, Homo sapiens
tgtaaaactttatt

SEQ ID NO: 4839198 - DNA, 18 bp, Homo sapiens
tgtaaaactttattttat

SEQ ID NO: 4839199 - DNA, 14 bp, Homo sapiens
tgtaaaagagctgt

SEQ ID NO: 4839200 - DNA, 15 bp, Homo sapiens
tgtaaaagagctgtt

SEQ ID NO: 4839201 - DNA, 14 bp, Homo sapiens
tgtaaaatactatt

SEQ ID NO: 4839202 - DNA, 15 bp, Homo sapiens
tgtaaaatagtctca

SEQ ID NO: 4839203 - DNA, 15 bp, Homo sapiens
tgtaaaatgtattat

SEQ ID NO: 4839204 - DNA, 15 bp, Homo sapiens
tgtaaaattccatgg

SEQ ID NO: 4839205 - DNA, 15 bp, Homo sapiens
tgtaaacatcataaa

SEQ ID NO: 4839206 - DNA, 17 bp, Homo sapiens
tgtaaacatcataaata

SEQ ID NO: 4839207 - DNA, 20 bp, Homo sapiens
tgtaaacatcataaatagta

SEQ ID NO: 4839208 - DNA, 22 bp, Homo sapiens
tgtaaaggtaggtgcatgcctt

SEQ ID NO: 4839209 - DNA, 15 bp, Homo sapiens
tgtaaataaaaatag

SEQ ID NO: 4839210 - DNA, 17 bp, Homo sapiens
tgtaaataaaaatagct

SEQ ID NO: 4839211 - DNA, 19 bp, Homo sapiens
tgtaaatattgctgtctga

SEQ ID NO: 4839212 - DNA, 18 bp, Homo sapiens
tgtaaccacaactttcac

SEQ ID NO: 4839213 - DNA, 13 bp, Homo sapiens
tgtaactctttgg

SEQ ID NO: 4839214 - DNA, 15 bp, Homo sapiens
tgtaactgttacagt

SEQ ID NO: 4839215 - DNA, 19 bp, Homo sapiens
tgtaagacacgtgcaacag

SEQ ID NO: 4839216 - DNA, 15 bp, Homo sapiens
tgtaagcaattctaa

SEQ ID NO: 4839217 - DNA, 17 bp, Homo sapiens
tgtaagcaattctaagt

SEQ ID NO: 4839218 - DNA, 21 bp, Homo sapiens
tgtaagcaattctaagtgaga

SEQ ID NO: 4839219 - DNA, 13 bp, Homo sapiens
tgtaaggaatgat

SEQ ID NO: 4839220 - DNA, 12 bp, Homo sapiens
tgtaagtttcta

SEQ ID NO: 4839221 - DNA, 15 bp, Homo sapiens
tgtaatataagacaa

SEQ ID NO: 4839222 - DNA, 15 bp, Homo sapiens
tgtaatatatacata

SEQ ID NO: 4839223 - DNA, 19 bp, Homo sapiens
tgtaatatcagttacagtg

SEQ ID NO: 4839224 - DNA, 21 bp, Homo sapiens
tgtaatatcagttacagtggc

SEQ ID NO: 4839225 - DNA, 23 bp, Homo sapiens
tgtaatatcagttacagtggcag

SEQ ID NO: 4839226 - DNA, 13 bp, Homo sapiens
tgtaatatttaca

SEQ ID NO: 4839227 - DNA, 15 bp, Homo sapiens
tgtaatattttgctg

SEQ ID NO: 4839228 - DNA, 17 bp, Homo sapiens
tgtaatcacactctctt

SEQ ID NO: 4839229 - DNA, 14 bp, Homo sapiens
tgtaatcataaata

SEQ ID NO: 4839230 - DNA, 14 bp, Homo sapiens
tgtaatgtatctta

SEQ ID NO: 4839231 - DNA, 13 bp, Homo sapiens
tgtaattgattgt

SEQ ID NO: 4839232 - DNA, 18 bp, Homo sapiens
tgtacaaaatatccaagc

SEQ ID NO: 4839233 - DNA, 19 bp, Homo sapiens
tgtacaaaatatccaagcc

SEQ ID NO: 4839234 - DNA, 20 bp, Homo sapiens
tgtacaccactttcccacac

SEQ ID NO: 4839235 - DNA, 22 bp, Homo sapiens
tgtacagtttgtttacacacgt

SEQ ID NO: 4839236 - DNA, 20 bp, Homo sapiens
tgtacatagtggtcatttgg

SEQ ID NO: 4839237 - DNA, 15 bp, Homo sapiens
tgtaccagcccaggc

SEQ ID NO: 4839238 - DNA, 16 bp, Homo sapiens
tgtaccatgttaaaga

SEQ ID NO: 4839239 - DNA, 17 bp, Homo sapiens
tgtaccggccactgcaa

SEQ ID NO: 4839240 - DNA, 17 bp, Homo sapiens
tgtacgaggcttctcta

SEQ ID NO: 4839241 - DNA, 17 bp, Homo sapiens
tgtactacatttgcatg

SEQ ID NO: 4839242 - DNA, 22 bp, Homo sapiens
tgtactacatttgcatgccttt

SEQ ID NO: 4839243 - DNA, 13 bp, Homo sapiens
tgtactaccccag

SEQ ID NO: 4839244 - DNA, 18 bp, Homo sapiens
tgtactgatgattgtttg

SEQ ID NO: 4839245 - DNA, 16 bp, Homo sapiens
tgtactgtaaagaatt

SEQ ID NO: 4839246 - DNA, 16 bp, Homo sapiens
tgtacttcagttctca

SEQ ID NO: 4839247 - DNA, 24 bp, Homo sapiens
tgtacttcagttctcatcttgtaa

SEQ ID NO: 4839248 - DNA, 13 bp, Homo sapiens
tgtagcatataaa

SEQ ID NO: 4839249 - DNA, 15 bp, Homo sapiens
tgtagcatataaatg

SEQ ID NO: 4839250 - DNA, 14 bp, Homo sapiens
tgtagccctggccc

SEQ ID NO: 4839251 - DNA, 15 bp, Homo sapiens
tgtagccctggcccg

SEQ ID NO: 4839252 - DNA, 19 bp, Homo sapiens
tgtagccctggcccggtcc

SEQ ID NO: 4839253 - DNA, 23 bp, Homo sapiens
tgtagccctggcccggtcccagt

SEQ ID NO: 4839254 - DNA, 17 bp, Homo sapiens
tgtagcctaatattcat

SEQ ID NO: 4839255 - DNA, 20 bp, Homo sapiens
tgtagcctaatattcatgct

SEQ ID NO: 4839256 - DNA, 19 bp, Homo sapiens
tgtagcctggtctgtgcat

SEQ ID NO: 4839257 - DNA, 18 bp, Homo sapiens
tgtagctagtttaaaatt

SEQ ID NO: 4839258 - DNA, 19 bp, Homo sapiens
tgtagctctgaatgctatt

SEQ ID NO: 4839259 - DNA, 22 bp, Homo sapiens
tgtaggaaaattttcttcttta

SEQ ID NO: 4839260 - DNA, 21 bp, Homo sapiens
tgtataaaaaagaaaacttgt

SEQ ID NO: 4839261 - DNA, 15 bp, Homo sapiens
tgtataatactttgt

SEQ ID NO: 4839262 - DNA, 17 bp, Homo sapiens
tgtataatactttgtat

SEQ ID NO: 4839263 - DNA, 15 bp, Homo sapiens
tgtatacaaacaggt

SEQ ID NO: 4839264 - DNA, 14 bp, Homo sapiens
tgtatacacacaca

SEQ ID NO: 4839265 - DNA, 15 bp, Homo sapiens
tgtatacatatgtat

SEQ ID NO: 4839266 - DNA, 21 bp, Homo sapiens
tgtatacatatgtatgtgtga

SEQ ID NO: 4839267 - DNA, 23 bp, Homo sapiens
tgtatacatatgtatgtgtgagt

SEQ ID NO: 4839268 - DNA, 14 bp, Homo sapiens
tgtatatcagctct

SEQ ID NO: 4839269 - DNA, 22 bp, Homo sapiens
tgtatatcagctctaaagcaga

SEQ ID NO: 4839270 - DNA, 13 bp, Homo sapiens
tgtatatgttatt

SEQ ID NO: 4839271 - DNA, 19 bp, Homo sapiens
tgtatatttgtatgatatt

SEQ ID NO: 4839272 - DNA, 15 bp, Homo sapiens
tgtatcagtgtttat

SEQ ID NO: 4839273 - DNA, 20 bp, Homo sapiens
tgtatcccttctcacagcac

SEQ ID NO: 4839274 - DNA, 19 bp, Homo sapiens
tgtatcctccattgtatct

SEQ ID NO: 4839275 - DNA, 20 bp, Homo sapiens
tgtatctgaactcacagact

SEQ ID NO: 4839276 - DNA, 17 bp, Homo sapiens
tgtatcttatttatata

SEQ ID NO: 4839277 - DNA, 18 bp, Homo sapiens
tgtatcttatttatatat

SEQ ID NO: 4839278 - DNA, 16 bp, Homo sapiens
tgtatgaaatatatgt

SEQ ID NO: 4839279 - DNA, 18 bp, Homo sapiens
tgtatgaaatatatgtga

SEQ ID NO: 4839280 - DNA, 13 bp, Homo sapiens
tgtatgcatacaa

SEQ ID NO: 4839281 - DNA, 12 bp, Homo sapiens
tgtatgtaaaaa

SEQ ID NO: 4839282 - DNA, 15 bp, Homo sapiens
tgtatgtaaataggt

SEQ ID NO: 4839283 - DNA, 16 bp, Homo sapiens
tgtatgtacttacatg

SEQ ID NO: 4839284 - DNA, 19 bp, Homo sapiens
tgtatgtacttacatgggt

SEQ ID NO: 4839285 - DNA, 14 bp, Homo sapiens
tgtatgtctatgtg

SEQ ID NO: 4839286 - DNA, 16 bp, Homo sapiens
tgtatgtctatgtgta

SEQ ID NO: 4839287 - DNA, 17 bp, Homo sapiens
tgtatgtctatgtgtat

SEQ ID NO: 4839288 - DNA, 18 bp, Homo sapiens
tgtattaaagatgcaggt

SEQ ID NO: 4839289 - DNA, 21 bp, Homo sapiens
tgtattacataaataaattaa

SEQ ID NO: 4839290 - DNA, 15 bp, Homo sapiens
tgtattatgtcctgt

SEQ ID NO: 4839291 - DNA, 17 bp, Homo sapiens
tgtattgaaaaaatatt

SEQ ID NO: 4839292 - DNA, 15 bp, Homo sapiens
tgtattggcagcaca

SEQ ID NO: 4839293 - DNA, 16 bp, Homo sapiens
tgtattgttagatgtt

SEQ ID NO: 4839294 - DNA, 15 bp, Homo sapiens
tgtatttatattaga

SEQ ID NO: 4839295 - DNA, 17 bp, Homo sapiens
tgtatttgtagtgttat

SEQ ID NO: 4839296 - DNA, 13 bp, Homo sapiens
tgtattttaataa

SEQ ID NO: 4839297 - DNA, 18 bp, Homo sapiens
tgtattttaataaagatt

SEQ ID NO: 4839298 - DNA, 21 bp, Homo sapiens
tgtattttcttcccatttgta

SEQ ID NO: 4839299 - DNA, 20 bp, Homo sapiens
tgtatttttgtaattcctct

SEQ ID NO: 4839300 - DNA, 16 bp, Homo sapiens
tgtcaaagtggtgaga

SEQ ID NO: 4839301 - DNA, 19 bp, Homo sapiens
tgtcaaagtggtgagaggc

SEQ ID NO: 4839302 - DNA, 22 bp, Homo sapiens
tgtcaaatggtattttttgtga

SEQ ID NO: 4839303 - DNA, 16 bp, Homo sapiens
tgtcaacctgaattaa

SEQ ID NO: 4839304 - DNA, 20 bp, Homo sapiens
tgtcaacctgaattaaagtc

SEQ ID NO: 4839305 - DNA, 23 bp, Homo sapiens
tgtcaacctgaattaaagtctac

SEQ ID NO: 4839306 - DNA, 21 bp, Homo sapiens
tgtcaacttcagttgaaaaga

SEQ ID NO: 4839307 - DNA, 17 bp, Homo sapiens
tgtcaatgctatggact

SEQ ID NO: 4839308 - DNA, 18 bp, Homo sapiens
tgtcaatgctctaacaaa

SEQ ID NO: 4839309 - DNA, 16 bp, Homo sapiens
tgtcacgtgaccctgt

SEQ ID NO: 4839310 - DNA, 18 bp, Homo sapiens
tgtcacgtgaccctgtgc

SEQ ID NO: 4839311 - DNA, 13 bp, Homo sapiens
tgtcacttttttc

SEQ ID NO: 4839312 - DNA, 11 bp, Homo sapiens
tgtcagaatgt

SEQ ID NO: 4839313 - DNA, 17 bp, Homo sapiens
tgtcagccagccgccct

SEQ ID NO: 4839314 - DNA, 22 bp, Homo sapiens
tgtcagccagccgccctgggct

SEQ ID NO: 4839315 - DNA, 13 bp, Homo sapiens
tgtcagcgtttct

SEQ ID NO: 4839316 - DNA, 14 bp, Homo sapiens
tgtcagcttcccaa

SEQ ID NO: 4839317 - DNA, 14 bp, Homo sapiens
tgtcaggctctgaa

SEQ ID NO: 4839318 - DNA, 12 bp, Homo sapiens
tgtcagtgtgac

SEQ ID NO: 4839319 - DNA, 20 bp, Homo sapiens
tgtcagtgtgactgatctct

SEQ ID NO: 4839320 - DNA, 14 bp, Homo sapiens
tgtcagtttgtgaa

SEQ ID NO: 4839321 - DNA, 18 bp, Homo sapiens
tgtcataactagagcacg

SEQ ID NO: 4839322 - DNA, 23 bp, Homo sapiens
tgtcatctctctggggccctggg

SEQ ID NO: 4839323 - DNA, 14 bp, Homo sapiens
tgtcatctgtcagc

SEQ ID NO: 4839324 - DNA, 20 bp, Homo sapiens
tgtcatgatttcaatgattg

SEQ ID NO: 4839325 - DNA, 19 bp, Homo sapiens
tgtcatgcccagcttggag

SEQ ID NO: 4839326 - DNA, 14 bp, Homo sapiens
tgtcatgtgcagat

SEQ ID NO: 4839327 - DNA, 19 bp, Homo sapiens
tgtcattagaattgaatta

SEQ ID NO: 4839328 - DNA, 14 bp, Homo sapiens
tgtcattctgctaa

SEQ ID NO: 4839329 - DNA, 18 bp, Homo sapiens
tgtcattttcagatcctt

SEQ ID NO: 4839330 - DNA, 22 bp, Homo sapiens
tgtccaaaactgtattgaaaaa

SEQ ID NO: 4839331 - DNA, 20 bp, Homo sapiens
tgtccaacaactccaggaaa

SEQ ID NO: 4839332 - DNA, 21 bp, Homo sapiens
tgtccaacaactccaggaaaa

SEQ ID NO: 4839333 - DNA, 14 bp, Homo sapiens
tgtccaacagagtg

SEQ ID NO: 4839334 - DNA, 16 bp, Homo sapiens
tgtccaagcatcagca

SEQ ID NO: 4839335 - DNA, 14 bp, Homo sapiens
tgtccacaaatgtc

SEQ ID NO: 4839336 - DNA, 15 bp, Homo sapiens
tgtccacaaatgtcc

SEQ ID NO: 4839337 - DNA, 20 bp, Homo sapiens
tgtccacaaatgtcctcaga

SEQ ID NO: 4839338 - DNA, 17 bp, Homo sapiens
tgtccacactaccagtt

SEQ ID NO: 4839339 - DNA, 16 bp, Homo sapiens
tgtccaccttctgcca

SEQ ID NO: 4839340 - DNA, 20 bp, Homo sapiens
tgtccaccttctgccaaggc

SEQ ID NO: 4839341 - DNA, 15 bp, Homo sapiens
tgtccagagtctctt

SEQ ID NO: 4839342 - DNA, 17 bp, Homo sapiens
tgtccatccgtctctgt

SEQ ID NO: 4839343 - DNA, 16 bp, Homo sapiens
tgtccatttttacaag

SEQ ID NO: 4839344 - DNA, 22 bp, Homo sapiens
tgtcccacccccagcagctcac

SEQ ID NO: 4839345 - DNA, 17 bp, Homo sapiens
tgtcccagtgtctggcc

SEQ ID NO: 4839346 - DNA, 19 bp, Homo sapiens
tgtcccagtgtctggccca

SEQ ID NO: 4839347 - DNA, 15 bp, Homo sapiens
tgtcccccctgtggt

SEQ ID NO: 4839348 - DNA, 18 bp, Homo sapiens
tgtcccccctgtggtctg

SEQ ID NO: 4839349 - DNA, 17 bp, Homo sapiens
tgtccctagggctctcc

SEQ ID NO: 4839350 - DNA, 14 bp, Homo sapiens
tgtccctgcagggc

SEQ ID NO: 4839351 - DNA, 15 bp, Homo sapiens
tgtccctgtgggctc

SEQ ID NO: 4839352 - DNA, 20 bp, Homo sapiens
tgtccctgtgggctcacacc

SEQ ID NO: 4839353 - DNA, 15 bp, Homo sapiens
tgtcccttacctggc

SEQ ID NO: 4839354 - DNA, 19 bp, Homo sapiens
tgtcccttacgtgagtcct

SEQ ID NO: 4839355 - DNA, 23 bp, Homo sapiens
tgtcccttacgtgagtcctggca

SEQ ID NO: 4839356 - DNA, 12 bp, Homo sapiens
tgtcccttcccc

SEQ ID NO: 4839357 - DNA, 12 bp, Homo sapiens
tgtcccttttcc

SEQ ID NO: 4839358 - DNA, 20 bp, Homo sapiens
tgtccgcgtcctttcctctc

SEQ ID NO: 4839359 - DNA, 23 bp, Homo sapiens
tgtccgtcctgctcgccctgtgc

SEQ ID NO: 4839360 - DNA, 15 bp, Homo sapiens
tgtccgtctgtcctg

SEQ ID NO: 4839361 - DNA, 18 bp, Homo sapiens
tgtccgtctgtcctgcgc

SEQ ID NO: 4839362 - DNA, 14 bp, Homo sapiens
tgtcctacacttga

SEQ ID NO: 4839363 - DNA, 15 bp, Homo sapiens
tgtcctatccctgga

SEQ ID NO: 4839364 - DNA, 21 bp, Homo sapiens
tgtcctcagagggtccctagg

SEQ ID NO: 4839365 - DNA, 22 bp, Homo sapiens
tgtcctcagagggtccctaggt

SEQ ID NO: 4839366 - DNA, 18 bp, Homo sapiens
tgtcctcaggtgaataac

SEQ ID NO: 4839367 - DNA, 23 bp, Homo sapiens
tgtcctcatgtgagaaagcagat

SEQ ID NO: 4839368 - DNA, 21 bp, Homo sapiens
tgtcctctcagaactcctgtg

SEQ ID NO: 4839369 - DNA, 11 bp, Homo sapiens
tgtcctgactg

SEQ ID NO: 4839370 - DNA, 13 bp, Homo sapiens
tgtcctgcgcctg

SEQ ID NO: 4839371 - DNA, 16 bp, Homo sapiens
tgtcctgcgcctgcgc

SEQ ID NO: 4839372 - DNA, 17 bp, Homo sapiens
tgtcctgctcacgtctg

SEQ ID NO: 4839373 - DNA, 14 bp, Homo sapiens
tgtcctgtgctttc

SEQ ID NO: 4839374 - DNA, 23 bp, Homo sapiens
tgtcctgtgctttctgcatgctt

SEQ ID NO: 4839375 - DNA, 19 bp, Homo sapiens
tgtcctgtgtcatctgtca

SEQ ID NO: 4839376 - DNA, 15 bp, Homo sapiens
tgtcctgttgattaa

SEQ ID NO: 4839377 - DNA, 16 bp, Homo sapiens
tgtccttcccccagca

SEQ ID NO: 4839378 - DNA, 13 bp, Homo sapiens
tgtcctttatgta

SEQ ID NO: 4839379 - DNA, 15 bp, Homo sapiens
tgtcgccccaggccc

SEQ ID NO: 4839380 - DNA, 16 bp, Homo sapiens
tgtcgccccaggccct

SEQ ID NO: 4839381 - DNA, 23 bp, Homo sapiens
tgtcgccccaggccctccctgac

SEQ ID NO: 4839382 - DNA, 22 bp, Homo sapiens
tgtcgggcccgcactcaggagc

SEQ ID NO: 4839383 - DNA, 23 bp, Homo sapiens
tgtcgggcccgcactcaggagca

SEQ ID NO: 4839384 - DNA, 21 bp, Homo sapiens
tgtctaaccaattgtgagaat

SEQ ID NO: 4839385 - DNA, 13 bp, Homo sapiens
tgtctataaatgg

SEQ ID NO: 4839386 - DNA, 23 bp, Homo sapiens
tgtctataaatggtgtcataact

SEQ ID NO: 4839387 - DNA, 15 bp, Homo sapiens
tgtctatgtgtatat

SEQ ID NO: 4839388 - DNA, 16 bp, Homo sapiens
tgtctatgtgtatata

SEQ ID NO: 4839389 - DNA, 18 bp, Homo sapiens
tgtctatgtgtatatatt

SEQ ID NO: 4839390 - DNA, 14 bp, Homo sapiens
tgtctcaaaataaa

SEQ ID NO: 4839391 - DNA, 18 bp, Homo sapiens
tgtctcacgattccagtg

SEQ ID NO: 4839392 - DNA, 20 bp, Homo sapiens
tgtctcatgttttatatgat

SEQ ID NO: 4839393 - DNA, 15 bp, Homo sapiens
tgtctcctctgtcag

SEQ ID NO: 4839394 - DNA, 17 bp, Homo sapiens
tgtctcctcttctttgt

SEQ ID NO: 4839395 - DNA, 22 bp, Homo sapiens
tgtctctctggcaatcttgccc

SEQ ID NO: 4839396 - DNA, 23 bp, Homo sapiens
tgtctctcttcggtggccttgag

SEQ ID NO: 4839397 - DNA, 18 bp, Homo sapiens
tgtctctcttttgctctc

SEQ ID NO: 4839398 - DNA, 13 bp, Homo sapiens
tgtctctgagagt

SEQ ID NO: 4839399 - DNA, 13 bp, Homo sapiens
tgtctctgaggac

SEQ ID NO: 4839400 - DNA, 20 bp, Homo sapiens
tgtctgaaaaagtgttttta

SEQ ID NO: 4839401 - DNA, 13 bp, Homo sapiens
tgtctgagccctg

SEQ ID NO: 4839402 - DNA, 13 bp, Homo sapiens
tgtctgcaggcca

SEQ ID NO: 4839403 - DNA, 13 bp, Homo sapiens
tgtctgctgcctc

SEQ ID NO: 4839404 - DNA, 15 bp, Homo sapiens
tgtctgctgcctcca

SEQ ID NO: 4839405 - DNA, 22 bp, Homo sapiens
tgtctgctgcctccaagtcatg

SEQ ID NO: 4839406 - DNA, 18 bp, Homo sapiens
tgtctggctgtggcccct

SEQ ID NO: 4839407 - DNA, 20 bp, Homo sapiens
tgtctggctgtggcccctcc

SEQ ID NO: 4839408 - DNA, 22 bp, Homo sapiens
tgtctgtaaatctaacattatt

SEQ ID NO: 4839409 - DNA, 13 bp, Homo sapiens
tgtctgtaagaga

SEQ ID NO: 4839410 - DNA, 21 bp, Homo sapiens
tgtcttactaataggtctgga

SEQ ID NO: 4839411 - DNA, 20 bp, Homo sapiens
tgtcttagtcataccatcca

SEQ ID NO: 4839412 - DNA, 22 bp, Homo sapiens
tgtcttcaaccctgccctgcac

SEQ ID NO: 4839413 - DNA, 21 bp, Homo sapiens
tgtcttcaatttgtataaaat

SEQ ID NO: 4839414 - DNA, 15 bp, Homo sapiens
tgtcttcatgttgat

SEQ ID NO: 4839415 - DNA, 19 bp, Homo sapiens
tgtcttttaaaaactcctg

SEQ ID NO: 4839416 - DNA, 13 bp, Homo sapiens
tgtcttttgtcat

SEQ ID NO: 4839417 - DNA, 17 bp, Homo sapiens
tgtcttttgttctctct

SEQ ID NO: 4839418 - DNA, 13 bp, Homo sapiens
tgtgaaaagtaaa

SEQ ID NO: 4839419 - DNA, 13 bp, Homo sapiens
tgtgaaactgaga

SEQ ID NO: 4839420 - DNA, 16 bp, Homo sapiens
tgtgaaactgagacca

SEQ ID NO: 4839421 - DNA, 14 bp, Homo sapiens
tgtgaaatatcatc

SEQ ID NO: 4839422 - DNA, 14 bp, Homo sapiens
tgtgaaatgtaact

SEQ ID NO: 4839423 - DNA, 15 bp, Homo sapiens
tgtgaagaaacattt

SEQ ID NO: 4839424 - DNA, 16 bp, Homo sapiens
tgtgaagcctttatct

SEQ ID NO: 4839425 - DNA, 14 bp, Homo sapiens
tgtgaagtgattga

SEQ ID NO: 4839426 - DNA, 16 bp, Homo sapiens
tgtgaagtgattgaca

SEQ ID NO: 4839427 - DNA, 17 bp, Homo sapiens
tgtgaagtgattgacat

SEQ ID NO: 4839428 - DNA, 15 bp, Homo sapiens
tgtgaatataaatgt

SEQ ID NO: 4839429 - DNA, 14 bp, Homo sapiens
tgtgaatctgttga

SEQ ID NO: 4839430 - DNA, 17 bp, Homo sapiens
tgtgaatggttgcaaag

SEQ ID NO: 4839431 - DNA, 14 bp, Homo sapiens
tgtgacaccaccac

SEQ ID NO: 4839432 - DNA, 19 bp, Homo sapiens
tgtgacaccaccactgtgt

SEQ ID NO: 4839433 - DNA, 16 bp, Homo sapiens
tgtgacattccacaga

SEQ ID NO: 4839434 - DNA, 16 bp, Homo sapiens
tgtgacctgacacctg

SEQ ID NO: 4839435 - DNA, 13 bp, Homo sapiens
tgtgactcgctta

SEQ ID NO: 4839436 - DNA, 20 bp, Homo sapiens
tgtgactcgcttagctgaaa

SEQ ID NO: 4839437 - DNA, 23 bp, Homo sapiens
tgtgactcgcttagctgaaacct

SEQ ID NO: 4839438 - DNA, 16 bp, Homo sapiens
tgtgactgatctctcg

SEQ ID NO: 4839439 - DNA, 14 bp, Homo sapiens
tgtgacttctctct

SEQ ID NO: 4839440 - DNA, 13 bp, Homo sapiens
tgtgagaactgtg

SEQ ID NO: 4839441 - DNA, 12 bp, Homo sapiens
tgtgagataaat

SEQ ID NO: 4839442 - DNA, 13 bp, Homo sapiens
tgtgagataaata

SEQ ID NO: 4839443 - DNA, 14 bp, Homo sapiens
tgtgagataaatat

SEQ ID NO: 4839444 - DNA, 15 bp, Homo sapiens
tgtgagataaatatc

SEQ ID NO: 4839445 - DNA, 16 bp, Homo sapiens
tgtgagccaaagagaa

SEQ ID NO: 4839446 - DNA, 15 bp, Homo sapiens
tgtgaggacagggcc

SEQ ID NO: 4839447 - DNA, 20 bp, Homo sapiens
tgtgaggatagagacttgca

SEQ ID NO: 4839448 - DNA, 22 bp, Homo sapiens
tgtgagggcaaaccaggctgca

SEQ ID NO: 4839449 - DNA, 14 bp, Homo sapiens
tgtgagtcacttct

SEQ ID NO: 4839450 - DNA, 14 bp, Homo sapiens
tgtgagtctgtcct

SEQ ID NO: 4839451 - DNA, 21 bp, Homo sapiens
tgtgagtctgtcctttcccac

SEQ ID NO: 4839452 - DNA, 13 bp, Homo sapiens
tgtgagtgtatgt

SEQ ID NO: 4839453 - DNA, 22 bp, Homo sapiens
tgtgagtgtatgtatacacaca

SEQ ID NO: 4839454 - DNA, 14 bp, Homo sapiens
tgtgagtgttagaa

SEQ ID NO: 4839455 - DNA, 15 bp, Homo sapiens
tgtgataattgtaaa

SEQ ID NO: 4839456 - DNA, 16 bp, Homo sapiens
tgtgatcgtgtgttgc

SEQ ID NO: 4839457 - DNA, 21 bp, Homo sapiens
tgtgatgatagcactggtttg

SEQ ID NO: 4839458 - DNA, 14 bp, Homo sapiens
tgtgatgcaggaag

SEQ ID NO: 4839459 - DNA, 13 bp, Homo sapiens
tgtgatttatgca

SEQ ID NO: 4839460 - DNA, 15 bp, Homo sapiens
tgtgatttatgcatt

SEQ ID NO: 4839461 - DNA, 16 bp, Homo sapiens
tgtgcagagtatacaa

SEQ ID NO: 4839462 - DNA, 14 bp, Homo sapiens
tgtgcatctggcct

SEQ ID NO: 4839463 - DNA, 21 bp, Homo sapiens
tgtgcatctggcctatgaccc

SEQ ID NO: 4839464 - DNA, 18 bp, Homo sapiens
tgtgcatctggcctgggg

SEQ ID NO: 4839465 - DNA, 20 bp, Homo sapiens
tgtgcatgagaatgtcattt

SEQ ID NO: 4839466 - DNA, 20 bp, Homo sapiens
tgtgcatgcaaaaatgaatt

SEQ ID NO: 4839467 - DNA, 19 bp, Homo sapiens
tgtgccaaaatgtcaattt

SEQ ID NO: 4839468 - DNA, 14 bp, Homo sapiens
tgtgccaaagatag

SEQ ID NO: 4839469 - DNA, 20 bp, Homo sapiens
tgtgccaaagatagcagaag

SEQ ID NO: 4839470 - DNA, 22 bp, Homo sapiens
tgtgccctgtagctccttagct

SEQ ID NO: 4839471 - DNA, 20 bp, Homo sapiens
tgtgccgtctttggttcctc

SEQ ID NO: 4839472 - DNA, 19 bp, Homo sapiens
tgtgcctctctctcccaac

SEQ ID NO: 4839473 - DNA, 19 bp, Homo sapiens
tgtgcctgtgtttcatgtt

SEQ ID NO: 4839474 - DNA, 21 bp, Homo sapiens
tgtgcctgtgtttcatgttct

SEQ ID NO: 4839475 - DNA, 16 bp, Homo sapiens
tgtgctattaatattt

SEQ ID NO: 4839476 - DNA, 21 bp, Homo sapiens
tgtgctattcgtaagttctgt

SEQ ID NO: 4839477 - DNA, 22 bp, Homo sapiens
tgtgctattcgtaagttctgtg

SEQ ID NO: 4839478 - DNA, 16 bp, Homo sapiens
tgtgctcatcagaaac

SEQ ID NO: 4839479 - DNA, 17 bp, Homo sapiens
tgtgctcgctctgcatg

SEQ ID NO: 4839480 - DNA, 15 bp, Homo sapiens
tgtgctcggacacag

SEQ ID NO: 4839481 - DNA, 15 bp, Homo sapiens
tgtgctgtgggcagc

SEQ ID NO: 4839482 - DNA, 16 bp, Homo sapiens
tgtgctgtgggcagca

SEQ ID NO: 4839483 - DNA, 22 bp, Homo sapiens
tgtgctgtgggcagcaccctcc

SEQ ID NO: 4839484 - DNA, 17 bp, Homo sapiens
tgtgctgttgattcttt

SEQ ID NO: 4839485 - DNA, 16 bp, Homo sapiens
tgtgcttcacacaaag

SEQ ID NO: 4839486 - DNA, 12 bp, Homo sapiens
tgtgcttccgag

SEQ ID NO: 4839487 - DNA, 21 bp, Homo sapiens
tgtgcttctaatatttattgc

SEQ ID NO: 4839488 - DNA, 23 bp, Homo sapiens
tgtgcttctaatatttattgctt

SEQ ID NO: 4839489 - DNA, 22 bp, Homo sapiens
tgtgcttgtgtgtatgtctatg

SEQ ID NO: 4839490 - DNA, 12 bp, Homo sapiens
tgtgctttcatg

SEQ ID NO: 4839491 - DNA, 14 bp, Homo sapiens
tgtgctttcatgtt

SEQ ID NO: 4839492 - DNA, 13 bp, Homo sapiens
tgtggaccttccc

SEQ ID NO: 4839493 - DNA, 13 bp, Homo sapiens
tgtggagtggagg

SEQ ID NO: 4839494 - DNA, 17 bp, Homo sapiens
tgtggagttcatcttga

SEQ ID NO: 4839495 - DNA, 18 bp, Homo sapiens
tgtggataagaaaaatgc

SEQ ID NO: 4839496 - DNA, 14 bp, Homo sapiens
tgtggatgaaaaaa

SEQ ID NO: 4839497 - DNA, 13 bp, Homo sapiens
tgtggcacgtaag

SEQ ID NO: 4839498 - DNA, 12 bp, Homo sapiens
tgtggcccctcc

SEQ ID NO: 4839499 - DNA, 17 bp, Homo sapiens
tgtggcccctccttctc

SEQ ID NO: 4839500 - DNA, 13 bp, Homo sapiens
tgtggcctcagcc

SEQ ID NO: 4839501 - DNA, 15 bp, Homo sapiens
tgtggcctcagccct

SEQ ID NO: 4839502 - DNA, 16 bp, Homo sapiens
tgtggcctgggtcctc

SEQ ID NO: 4839503 - DNA, 14 bp, Homo sapiens
tgtggcttggaaca

SEQ ID NO: 4839504 - DNA, 14 bp, Homo sapiens
tgtgggactggccc

SEQ ID NO: 4839505 - DNA, 17 bp, Homo sapiens
tgtgggcagcaccctcc

SEQ ID NO: 4839506 - DNA, 19 bp, Homo sapiens
tgtgggcagcaccctcccc

SEQ ID NO: 4839507 - DNA, 13 bp, Homo sapiens
tgtggggagggtg

SEQ ID NO: 4839508 - DNA, 18 bp, Homo sapiens
tgtggggcttggcgtgga

SEQ ID NO: 4839509 - DNA, 16 bp, Homo sapiens
tgtgggggtggccatc

SEQ ID NO: 4839510 - DNA, 20 bp, Homo sapiens
tgtgggggtggccatccctg

SEQ ID NO: 4839511 - DNA, 21 bp, Homo sapiens
tgtgggggtggccatccctgg

SEQ ID NO: 4839512 - DNA, 16 bp, Homo sapiens
tgtgggtccctaagca

SEQ ID NO: 4839513 - DNA, 13 bp, Homo sapiens
tgtgggtccctgc

SEQ ID NO: 4839514 - DNA, 20 bp, Homo sapiens
tgtgtaatatcatttcataa

SEQ ID NO: 4839515 - DNA, 21 bp, Homo sapiens
tgtgtaatttcctgctcctcc

SEQ ID NO: 4839516 - DNA, 21 bp, Homo sapiens
tgtgtagtagctcgtgtgctt

SEQ ID NO: 4839517 - DNA, 19 bp, Homo sapiens
tgtgtatacatatgtatgt

SEQ ID NO: 4839518 - DNA, 14 bp, Homo sapiens
tgtgtatatattat

SEQ ID NO: 4839519 - DNA, 23 bp, Homo sapiens
tgtgtatatattatatatacatt

SEQ ID NO: 4839520 - DNA, 14 bp, Homo sapiens
tgtgtatgatccaa

SEQ ID NO: 4839521 - DNA, 19 bp, Homo sapiens
tgtgtcccagtgtctggcc

SEQ ID NO: 4839522 - DNA, 21 bp, Homo sapiens
tgtgtcccatgcataacacac

SEQ ID NO: 4839523 - DNA, 14 bp, Homo sapiens
tgtgtcccctcact

SEQ ID NO: 4839524 - DNA, 18 bp, Homo sapiens
tgtgtcctaaatgcaaag

SEQ ID NO: 4839525 - DNA, 16 bp, Homo sapiens
tgtgtcctttaaaaaa

SEQ ID NO: 4839526 - DNA, 18 bp, Homo sapiens
tgtgtctccagctgattt

SEQ ID NO: 4839527 - DNA, 17 bp, Homo sapiens
tgtgtcttcaatttgta

SEQ ID NO: 4839528 - DNA, 15 bp, Homo sapiens
tgtgtgaattccttt

SEQ ID NO: 4839529 - DNA, 21 bp, Homo sapiens
tgtgtgacaccaccactgtgt

SEQ ID NO: 4839530 - DNA, 22 bp, Homo sapiens
tgtgtgacaccaccactgtgtc

SEQ ID NO: 4839531 - DNA, 23 bp, Homo sapiens
tgtgtgagtcacttctacgcata

SEQ ID NO: 4839532 - DNA, 15 bp, Homo sapiens
tgtgtgagtgtatgt

SEQ ID NO: 4839533 - DNA, 23 bp, Homo sapiens
tgtgtgcaatgttccgttcatct

SEQ ID NO: 4839534 - DNA, 19 bp, Homo sapiens
tgtgtggaaggcacccgcc

SEQ ID NO: 4839535 - DNA, 21 bp, Homo sapiens
tgtgtgggtttactctgtgct

SEQ ID NO: 4839536 - DNA, 15 bp, Homo sapiens
tgtgtgtgaattcct

SEQ ID NO: 4839537 - DNA, 15 bp, Homo sapiens
tgtgtgtgcaatgtt

SEQ ID NO: 4839538 - DNA, 15 bp, Homo sapiens
tgtgttaacttatgt

SEQ ID NO: 4839539 - DNA, 19 bp, Homo sapiens
tgtgttaacttatgtctct

SEQ ID NO: 4839540 - DNA, 19 bp, Homo sapiens
tgtgttaatcttaatgtat

SEQ ID NO: 4839541 - DNA, 12 bp, Homo sapiens
tgtgttactgat

SEQ ID NO: 4839542 - DNA, 19 bp, Homo sapiens
tgtgttctcaacacacagt

SEQ ID NO: 4839543 - DNA, 19 bp, Homo sapiens
tgtgttgccattttgtctg

SEQ ID NO: 4839544 - DNA, 18 bp, Homo sapiens
tgtgttggtatttactgc

SEQ ID NO: 4839545 - DNA, 22 bp, Homo sapiens
tgtgttggtatttactgcaatg

SEQ ID NO: 4839546 - DNA, 13 bp, Homo sapiens
tgtgttgtgcttt

SEQ ID NO: 4839547 - DNA, 13 bp, Homo sapiens
tgtgtttattgtc

SEQ ID NO: 4839548 - DNA, 16 bp, Homo sapiens
tgtgtttcatgttctg

SEQ ID NO: 4839549 - DNA, 19 bp, Homo sapiens
tgtgtttcatgttctgtgt

SEQ ID NO: 4839550 - DNA, 16 bp, Homo sapiens
tgtgttttcttcgtgg

SEQ ID NO: 4839551 - DNA, 19 bp, Homo sapiens
tgtgttttcttcgtggatt

SEQ ID NO: 4839552 - DNA, 23 bp, Homo sapiens
tgtgttttcttcgtggattgttt

SEQ ID NO: 4839553 - DNA, 10 bp, Homo sapiens
tgttaaaata

SEQ ID NO: 4839554 - DNA, 13 bp, Homo sapiens
tgttaaaatatag

SEQ ID NO: 4839555 - DNA, 21 bp, Homo sapiens
tgttaaagaggcgtcttgtat

SEQ ID NO: 4839556 - DNA, 22 bp, Homo sapiens
tgttaaagaggcgtcttgtatt

SEQ ID NO: 4839557 - DNA, 14 bp, Homo sapiens
tgttaaatctacaa

SEQ ID NO: 4839558 - DNA, 19 bp, Homo sapiens
tgttaaatctacaaacttt

SEQ ID NO: 4839559 - DNA, 13 bp, Homo sapiens
tgttaaatgataa

SEQ ID NO: 4839560 - DNA, 15 bp, Homo sapiens
tgttaacttattcaa

SEQ ID NO: 4839561 - DNA, 18 bp, Homo sapiens
tgttaagggaagctgata

SEQ ID NO: 4839562 - DNA, 21 bp, Homo sapiens
tgttaagggaagctgatacag

SEQ ID NO: 4839563 - DNA, 21 bp, Homo sapiens
tgttaatatcactcattaatt

SEQ ID NO: 4839564 - DNA, 17 bp, Homo sapiens
tgttaatcttaatgtat

SEQ ID NO: 4839565 - DNA, 16 bp, Homo sapiens
tgttacaggtgtacta

SEQ ID NO: 4839566 - DNA, 13 bp, Homo sapiens
tgttacttaaata

SEQ ID NO: 4839567 - DNA, 16 bp, Homo sapiens
tgttacttaaatagca

SEQ ID NO: 4839568 - DNA, 14 bp, Homo sapiens
tgttagaaaaaact

SEQ ID NO: 4839569 - DNA, 12 bp, Homo sapiens
tgttagatgttt

SEQ ID NO: 4839570 - DNA, 17 bp, Homo sapiens
tgttagatgtttgttga

SEQ ID NO: 4839571 - DNA, 12 bp, Homo sapiens
tgttaggggaaa

SEQ ID NO: 4839572 - DNA, 16 bp, Homo sapiens
tgttaggggaaaatag

SEQ ID NO: 4839573 - DNA, 13 bp, Homo sapiens
tgttataaaatct

SEQ ID NO: 4839574 - DNA, 17 bp, Homo sapiens
tgttataaaatctgtat

SEQ ID NO: 4839575 - DNA, 20 bp, Homo sapiens
tgttataaaatctgtattgc

SEQ ID NO: 4839576 - DNA, 21 bp, Homo sapiens
tgttataaaatctgtattgct

SEQ ID NO: 4839577 - DNA, 20 bp, Homo sapiens
tgttatacaaccttcattta

SEQ ID NO: 4839578 - DNA, 13 bp, Homo sapiens
tgttatctgtctt

SEQ ID NO: 4839579 - DNA, 15 bp, Homo sapiens
tgttatggtagaaaa

SEQ ID NO: 4839580 - DNA, 14 bp, Homo sapiens
tgttatgtaaacat

SEQ ID NO: 4839581 - DNA, 19 bp, Homo sapiens
tgttatgtaaacatcataa

SEQ ID NO: 4839582 - DNA, 19 bp, Homo sapiens
tgttattcaataactattg

SEQ ID NO: 4839583 - DNA, 21 bp, Homo sapiens
tgttattcaataactattgct

SEQ ID NO: 4839584 - DNA, 16 bp, Homo sapiens
tgttattttgtacgtg

SEQ ID NO: 4839585 - DNA, 21 bp, Homo sapiens
tgttcaaagaacccccctccc

SEQ ID NO: 4839586 - DNA, 23 bp, Homo sapiens
tgttcaaagaacccccctcccca

SEQ ID NO: 4839587 - DNA, 15 bp, Homo sapiens
tgttcaaattctgat

SEQ ID NO: 4839588 - DNA, 18 bp, Homo sapiens
tgttcaaattctgattat

SEQ ID NO: 4839589 - DNA, 17 bp, Homo sapiens
tgttcaacttaatgaag

SEQ ID NO: 4839590 - DNA, 13 bp, Homo sapiens
tgttcacacacac

SEQ ID NO: 4839591 - DNA, 18 bp, Homo sapiens
tgttcacacacacacaat

SEQ ID NO: 4839592 - DNA, 18 bp, Homo sapiens
tgttcaccttctgtgcat

SEQ ID NO: 4839593 - DNA, 15 bp, Homo sapiens
tgttcacgtgactcc

SEQ ID NO: 4839594 - DNA, 19 bp, Homo sapiens
tgttcacgtgactcctcaa

SEQ ID NO: 4839595 - DNA, 14 bp, Homo sapiens
tgttcagtcacttg

SEQ ID NO: 4839596 - DNA, 12 bp, Homo sapiens
tgttccctgctg

SEQ ID NO: 4839597 - DNA, 19 bp, Homo sapiens
tgttccgttcatctgagga

SEQ ID NO: 4839598 - DNA, 20 bp, Homo sapiens
tgttccgttcatctgaggag

SEQ ID NO: 4839599 - DNA, 21 bp, Homo sapiens
tgttcctatattccaggttta

SEQ ID NO: 4839600 - DNA, 17 bp, Homo sapiens
tgttcctgactgttctc

SEQ ID NO: 4839601 - DNA, 22 bp, Homo sapiens
tgttcctgactgttctcttact

SEQ ID NO: 4839602 - DNA, 19 bp, Homo sapiens
tgttcgcttggctccatgc

SEQ ID NO: 4839603 - DNA, 18 bp, Homo sapiens
tgttctatggaccaaatg

SEQ ID NO: 4839604 - DNA, 21 bp, Homo sapiens
tgttctatggaccaaatgtaa

SEQ ID NO: 4839605 - DNA, 22 bp, Homo sapiens
tgttctatggaccaaatgtaaa

SEQ ID NO: 4839606 - DNA, 20 bp, Homo sapiens
tgttctcaacacacagtata

SEQ ID NO: 4839607 - DNA, 13 bp, Homo sapiens
tgttctcaatcat

SEQ ID NO: 4839608 - DNA, 14 bp, Homo sapiens
tgttctcaatgctt

SEQ ID NO: 4839609 - DNA, 21 bp, Homo sapiens
tgttctcaatgcttttctagc

SEQ ID NO: 4839610 - DNA, 23 bp, Homo sapiens
tgttctccgggtgtggcctcagc

SEQ ID NO: 4839611 - DNA, 20 bp, Homo sapiens
tgttctgatgaggcatttta

SEQ ID NO: 4839612 - DNA, 14 bp, Homo sapiens
tgttctgcactgaa

SEQ ID NO: 4839613 - DNA, 12 bp, Homo sapiens
tgttctgtgcaa

SEQ ID NO: 4839614 - DNA, 11 bp, Homo sapiens
tgttctgtggc

SEQ ID NO: 4839615 - DNA, 21 bp, Homo sapiens
tgttctgtgtcacgtgaccct

SEQ ID NO: 4839616 - DNA, 13 bp, Homo sapiens
tgttcttcaatgt

SEQ ID NO: 4839617 - DNA, 12 bp, Homo sapiens
tgttcttgtaaa

SEQ ID NO: 4839618 - DNA, 19 bp, Homo sapiens
tgttcttgtaaaactgtga

SEQ ID NO: 4839619 - DNA, 21 bp, Homo sapiens
tgttcttgtaaaactgtgaca

SEQ ID NO: 4839620 - DNA, 19 bp, Homo sapiens
tgttctttcacccttttct

SEQ ID NO: 4839621 - DNA, 23 bp, Homo sapiens
tgttctttcctttcatcctcagc

SEQ ID NO: 4839622 - DNA, 15 bp, Homo sapiens
tgttgaagtgcatgt

SEQ ID NO: 4839623 - DNA, 16 bp, Homo sapiens
tgttgaagtgcatgtt

SEQ ID NO: 4839624 - DNA, 15 bp, Homo sapiens
tgttgattctttcaa

SEQ ID NO: 4839625 - DNA, 14 bp, Homo sapiens
tgttgctgaaacac

SEQ ID NO: 4839626 - DNA, 23 bp, Homo sapiens
tgttggataataactagatctcc

SEQ ID NO: 4839627 - DNA, 16 bp, Homo sapiens
tgttgggccaggagcc

SEQ ID NO: 4839628 - DNA, 16 bp, Homo sapiens
tgttgggcctttttcc

SEQ ID NO: 4839629 - DNA, 18 bp, Homo sapiens
tgttgggtggaggatgga

SEQ ID NO: 4839630 - DNA, 14 bp, Homo sapiens
tgttggtatttact

SEQ ID NO: 4839631 - DNA, 19 bp, Homo sapiens
tgttggtttagcgttgttt

SEQ ID NO: 4839632 - DNA, 15 bp, Homo sapiens
tgttgtaatatcagt

SEQ ID NO: 4839633 - DNA, 22 bp, Homo sapiens
tgttgtaatattttgctgctga

SEQ ID NO: 4839634 - DNA, 17 bp, Homo sapiens
tgttgtacaattactgt

SEQ ID NO: 4839635 - DNA, 20 bp, Homo sapiens
tgttgtacaattactgtgag

SEQ ID NO: 4839636 - DNA, 16 bp, Homo sapiens
tgttgtattcctgcct

SEQ ID NO: 4839637 - DNA, 15 bp, Homo sapiens
tgttgtgctttcaag

SEQ ID NO: 4839638 - DNA, 20 bp, Homo sapiens
tgttgtgttacaataagtgt

SEQ ID NO: 4839639 - DNA, 13 bp, Homo sapiens
tgttgtttaagtg

SEQ ID NO: 4839640 - DNA, 18 bp, Homo sapiens
tgtttaagaatcatggat

SEQ ID NO: 4839641 - DNA, 19 bp, Homo sapiens
tgtttaattgtataaaaca

SEQ ID NO: 4839642 - DNA, 15 bp, Homo sapiens
tgtttaccaaagaag

SEQ ID NO: 4839643 - DNA, 19 bp, Homo sapiens
tgtttacttgaatagtatt

SEQ ID NO: 4839644 - DNA, 22 bp, Homo sapiens
tgtttatgtgctattaatattt

SEQ ID NO: 4839645 - DNA, 15 bp, Homo sapiens
tgtttcatgttctgt

SEQ ID NO: 4839646 - DNA, 18 bp, Homo sapiens
tgtttcatgttctgtgtc

SEQ ID NO: 4839647 - DNA, 12 bp, Homo sapiens
tgtttccagtga

SEQ ID NO: 4839648 - DNA, 15 bp, Homo sapiens
tgtttccagtgacac

SEQ ID NO: 4839649 - DNA, 18 bp, Homo sapiens
tgtttcccttcccttcca

SEQ ID NO: 4839650 - DNA, 12 bp, Homo sapiens
tgtttcttctca

SEQ ID NO: 4839651 - DNA, 16 bp, Homo sapiens
tgtttgtaaaaatgta

SEQ ID NO: 4839652 - DNA, 14 bp, Homo sapiens
tgtttgtaagcaat

SEQ ID NO: 4839653 - DNA, 14 bp, Homo sapiens
tgtttgtcctttat

SEQ ID NO: 4839654 - DNA, 19 bp, Homo sapiens
tgtttgtcctttatgtatt

SEQ ID NO: 4839655 - DNA, 22 bp, Homo sapiens
tgttttacaaagaaacaaaata

SEQ ID NO: 4839656 - DNA, 14 bp, Homo sapiens
tgttttatgactaa

SEQ ID NO: 4839657 - DNA, 19 bp, Homo sapiens
tgttttcatgtaaataaat

SEQ ID NO: 4839658 - DNA, 15 bp, Homo sapiens
tgttttcattctggt

SEQ ID NO: 4839659 - DNA, 11 bp, Homo sapiens
tgttttgctaa

SEQ ID NO: 4839660 - DNA, 17 bp, Homo sapiens
tgttttggctgctctcc

SEQ ID NO: 4839661 - DNA, 14 bp, Homo sapiens
tgttttgtggataa

SEQ ID NO: 4839662 - DNA, 12 bp, Homo sapiens
tgtttttatata

SEQ ID NO: 4839663 - DNA, 22 bp, Homo sapiens
tgtttttatatattataagttg

SEQ ID NO: 4839664 - DNA, 14 bp, Homo sapiens
tgtttttgaagaag

SEQ ID NO: 4839665 - DNA, 21 bp, Homo sapiens
tgttttttcattgtgttttct

SEQ ID NO: 4839666 - DNA, 15 bp, Homo sapiens
tgttttttctttata

SEQ ID NO: 4839667 - DNA, 19 bp, Homo sapiens
ttaaaaaaataatataaat

SEQ ID NO: 4839668 - DNA, 23 bp, Homo sapiens
ttaaaaaaatcccatttatgcaa

SEQ ID NO: 4839669 - DNA, 18 bp, Homo sapiens
ttaaaaaatgaatagtac

SEQ ID NO: 4839670 - DNA, 18 bp, Homo sapiens
ttaaaaagaccatgcatt

SEQ ID NO: 4839671 - DNA, 20 bp, Homo sapiens
ttaaaaagttaatcttcatg

SEQ ID NO: 4839672 - DNA, 19 bp, Homo sapiens
ttaaaaagttgcacattag

SEQ ID NO: 4839673 - DNA, 13 bp, Homo sapiens
ttaaaaattaatt

SEQ ID NO: 4839674 - DNA, 16 bp, Homo sapiens
ttaaaacaagagacca

SEQ ID NO: 4839675 - DNA, 16 bp, Homo sapiens
ttaaaagctatcttca

SEQ ID NO: 4839676 - DNA, 23 bp, Homo sapiens
ttaaaatatagtgttgtgttaca

SEQ ID NO: 4839677 - DNA, 17 bp, Homo sapiens
ttaaaatattttcttaa

SEQ ID NO: 4839678 - DNA, 13 bp, Homo sapiens
ttaaaattagtga

SEQ ID NO: 4839679 - DNA, 15 bp, Homo sapiens
ttaaaattagtgaga

SEQ ID NO: 4839680 - DNA, 17 bp, Homo sapiens
ttaaaattagtgagatt

SEQ ID NO: 4839681 - DNA, 13 bp, Homo sapiens
ttaaaattattaa

SEQ ID NO: 4839682 - DNA, 23 bp, Homo sapiens
ttaaacaaaatttatgtcatttt

SEQ ID NO: 4839683 - DNA, 17 bp, Homo sapiens
ttaaacccacataaaca

SEQ ID NO: 4839684 - DNA, 21 bp, Homo sapiens
ttaaacccacataaacacttc

SEQ ID NO: 4839685 - DNA, 16 bp, Homo sapiens
ttaaacctgtgctttc

SEQ ID NO: 4839686 - DNA, 13 bp, Homo sapiens
ttaaacctgttcc

SEQ ID NO: 4839687 - DNA, 15 bp, Homo sapiens
ttaaacctgttcctg

SEQ ID NO: 4839688 - DNA, 16 bp, Homo sapiens
ttaaacctgttcctga

SEQ ID NO: 4839689 - DNA, 22 bp, Homo sapiens
ttaaacctgttcctgactgttc

SEQ ID NO: 4839690 - DNA, 18 bp, Homo sapiens
ttaaactgggaaatgaga

SEQ ID NO: 4839691 - DNA, 12 bp, Homo sapiens
ttaaacttcagc

SEQ ID NO: 4839692 - DNA, 15 bp, Homo sapiens
ttaaacttcagcaac

SEQ ID NO: 4839693 - DNA, 12 bp, Homo sapiens
ttaaagaaaggc

SEQ ID NO: 4839694 - DNA, 19 bp, Homo sapiens
ttaaagaacagctaacaat

SEQ ID NO: 4839695 - DNA, 19 bp, Homo sapiens
ttaaagaggcgtcttgtat

SEQ ID NO: 4839696 - DNA, 20 bp, Homo sapiens
ttaaagaggcgtcttgtatt

SEQ ID NO: 4839697 - DNA, 23 bp, Homo sapiens
ttaaagaggcgtcttgtattttc

SEQ ID NO: 4839698 - DNA, 14 bp, Homo sapiens
ttaaagatgcaggt

SEQ ID NO: 4839699 - DNA, 20 bp, Homo sapiens
ttaaaggtctcccacaagac

SEQ ID NO: 4839700 - DNA, 16 bp, Homo sapiens
ttaaagtctacactgc

SEQ ID NO: 4839701 - DNA, 19 bp, Homo sapiens
ttaaagtctacactgcctt

SEQ ID NO: 4839702 - DNA, 17 bp, Homo sapiens
ttaaatatatgtatgta

SEQ ID NO: 4839703 - DNA, 13 bp, Homo sapiens
ttaaatgaaatac

SEQ ID NO: 4839704 - DNA, 16 bp, Homo sapiens
ttaaatgatttaaatt

SEQ ID NO: 4839705 - DNA, 22 bp, Homo sapiens
ttaaatgtagcttcagtcatta

SEQ ID NO: 4839706 - DNA, 14 bp, Homo sapiens
ttaaattatatgat

SEQ ID NO: 4839707 - DNA, 15 bp, Homo sapiens
ttaaattatatgata

SEQ ID NO: 4839708 - DNA, 15 bp, Homo sapiens
ttaaatttattaaat

SEQ ID NO: 4839709 - DNA, 13 bp, Homo sapiens
ttaacagctgtat

SEQ ID NO: 4839710 - DNA, 15 bp, Homo sapiens
ttaacagctgtatta

SEQ ID NO: 4839711 - DNA, 17 bp, Homo sapiens
ttaacagtaaatataca

SEQ ID NO: 4839712 - DNA, 15 bp, Homo sapiens
ttaacatagcagctg

SEQ ID NO: 4839713 - DNA, 15 bp, Homo sapiens
ttaacatcaaagact

SEQ ID NO: 4839714 - DNA, 22 bp, Homo sapiens
ttaaccagtctgaagtttcatt

SEQ ID NO: 4839715 - DNA, 13 bp, Homo sapiens
ttaacccagtgtt

SEQ ID NO: 4839716 - DNA, 18 bp, Homo sapiens
ttaaccccataattagat

SEQ ID NO: 4839717 - DNA, 16 bp, Homo sapiens
ttaactccgtttccaa

SEQ ID NO: 4839718 - DNA, 12 bp, Homo sapiens
ttaactctgcat

SEQ ID NO: 4839719 - DNA, 15 bp, Homo sapiens
ttaacttatctccag

SEQ ID NO: 4839720 - DNA, 18 bp, Homo sapiens
ttaacttatgtctcttgt

SEQ ID NO: 4839721 - DNA, 11 bp, Homo sapiens
ttaagaatcat

SEQ ID NO: 4839722 - DNA, 15 bp, Homo sapiens
ttaagaatcatggat

SEQ ID NO: 4839723 - DNA, 11 bp, Homo sapiens
ttaagcacatt

SEQ ID NO: 4839724 - DNA, 22 bp, Homo sapiens
ttaagcattttactgtctgtaa

SEQ ID NO: 4839725 - DNA, 16 bp, Homo sapiens
ttaaggactacagaat

SEQ ID NO: 4839726 - DNA, 12 bp, Homo sapiens
ttaagtaagttt

SEQ ID NO: 4839727 - DNA, 13 bp, Homo sapiens
ttaagtagatttc

SEQ ID NO: 4839728 - DNA, 17 bp, Homo sapiens
ttaagtctatctggtat

SEQ ID NO: 4839729 - DNA, 18 bp, Homo sapiens
ttaagtcttactgttttg

SEQ ID NO: 4839730 - DNA, 16 bp, Homo sapiens
ttaagtggactgtatt

SEQ ID NO: 4839731 - DNA, 18 bp, Homo sapiens
ttaagtggactgtatttc

SEQ ID NO: 4839732 - DNA, 16 bp, Homo sapiens
ttaagtgttctgtggc

SEQ ID NO: 4839733 - DNA, 23 bp, Homo sapiens
ttaataactatggtaaataactg

SEQ ID NO: 4839734 - DNA, 13 bp, Homo sapiens
ttaatagtttcta

SEQ ID NO: 4839735 - DNA, 19 bp, Homo sapiens
ttaatagtttctaaaccat

SEQ ID NO: 4839736 - DNA, 14 bp, Homo sapiens
ttaatatactcctt

SEQ ID NO: 4839737 - DNA, 15 bp, Homo sapiens
ttaatatcactcatt

SEQ ID NO: 4839738 - DNA, 17 bp, Homo sapiens
ttaatatcactcattaa

SEQ ID NO: 4839739 - DNA, 20 bp, Homo sapiens
ttaatatcactcattaatta

SEQ ID NO: 4839740 - DNA, 17 bp, Homo sapiens
ttaatatccctggagtt

SEQ ID NO: 4839741 - DNA, 15 bp, Homo sapiens
ttaatcagaagaaaa

SEQ ID NO: 4839742 - DNA, 12 bp, Homo sapiens
ttaatccagaga

SEQ ID NO: 4839743 - DNA, 14 bp, Homo sapiens
ttaatccagagaac

SEQ ID NO: 4839744 - DNA, 13 bp, Homo sapiens
ttaatctagagct

SEQ ID NO: 4839745 - DNA, 14 bp, Homo sapiens
ttaatctagagcta

SEQ ID NO: 4839746 - DNA, 22 bp, Homo sapiens
ttaatctagagctatgcacacc

SEQ ID NO: 4839747 - DNA, 12 bp, Homo sapiens
ttaatctcttgt

SEQ ID NO: 4839748 - DNA, 16 bp, Homo sapiens
ttaatcttaatgtata

SEQ ID NO: 4839749 - DNA, 19 bp, Homo sapiens
ttaatgaaaaatctgaatt

SEQ ID NO: 4839750 - DNA, 21 bp, Homo sapiens
ttaatgaaaaatctgaatttc

SEQ ID NO: 4839751 - DNA, 12 bp, Homo sapiens
ttaatggttttt

SEQ ID NO: 4839752 - DNA, 14 bp, Homo sapiens
ttaatgtagataaa

SEQ ID NO: 4839753 - DNA, 15 bp, Homo sapiens
ttaatgtagataaag

SEQ ID NO: 4839754 - DNA, 18 bp, Homo sapiens
ttaatgtttagtcagtgt

SEQ ID NO: 4839755 - DNA, 16 bp, Homo sapiens
ttaatgtttgtaagca

SEQ ID NO: 4839756 - DNA, 22 bp, Homo sapiens
ttaattaaaacacaacatcttt

SEQ ID NO: 4839757 - DNA, 15 bp, Homo sapiens
ttaattaaacaaatt

SEQ ID NO: 4839758 - DNA, 18 bp, Homo sapiens
ttaattcttacctcattt

SEQ ID NO: 4839759 - DNA, 23 bp, Homo sapiens
ttaattgaaaagaagtagtgtct

SEQ ID NO: 4839760 - DNA, 13 bp, Homo sapiens
ttaattgaaatac

SEQ ID NO: 4839761 - DNA, 18 bp, Homo sapiens
ttaattgaaatacctatt

SEQ ID NO: 4839762 - DNA, 23 bp, Homo sapiens
ttaatttagcagtccatttttga

SEQ ID NO: 4839763 - DNA, 16 bp, Homo sapiens
ttaatttcctgtgagg

SEQ ID NO: 4839764 - DNA, 21 bp, Homo sapiens
ttaatttctgccatttcatgt

SEQ ID NO: 4839765 - DNA, 13 bp, Homo sapiens
ttaatttgaaata

SEQ ID NO: 4839766 - DNA, 17 bp, Homo sapiens
ttacaaacctctcagca

SEQ ID NO: 4839767 - DNA, 12 bp, Homo sapiens
ttacaaagccag

SEQ ID NO: 4839768 - DNA, 20 bp, Homo sapiens
ttacaaatgatttcgtgact

SEQ ID NO: 4839769 - DNA, 20 bp, Homo sapiens
ttacaaatttttactcaggc

SEQ ID NO: 4839770 - DNA, 12 bp, Homo sapiens
ttacaacaagca

SEQ ID NO: 4839771 - DNA, 13 bp, Homo sapiens
ttacaacaagcaa

SEQ ID NO: 4839772 - DNA, 20 bp, Homo sapiens
ttacaacaagcaaactgaaa

SEQ ID NO: 4839773 - DNA, 16 bp, Homo sapiens
ttacaactgactgact

SEQ ID NO: 4839774 - DNA, 19 bp, Homo sapiens
ttacaagttatagtactag

SEQ ID NO: 4839775 - DNA, 13 bp, Homo sapiens
ttacagaaacacg

SEQ ID NO: 4839776 - DNA, 20 bp, Homo sapiens
ttacagacaataaaatggaa

SEQ ID NO: 4839777 - DNA, 18 bp, Homo sapiens
ttacagctctcctccagc

SEQ ID NO: 4839778 - DNA, 14 bp, Homo sapiens
ttacaggaagtact

SEQ ID NO: 4839779 - DNA, 22 bp, Homo sapiens
ttacaggaagtactggagaaaa

SEQ ID NO: 4839780 - DNA, 16 bp, Homo sapiens
ttacaggtgtactatg

SEQ ID NO: 4839781 - DNA, 17 bp, Homo sapiens
ttacaggtgtactatgg

SEQ ID NO: 4839782 - DNA, 22 bp, Homo sapiens
ttacagtaggagtgagaaattt

SEQ ID NO: 4839783 - DNA, 14 bp, Homo sapiens
ttacagtgaagaaa

SEQ ID NO: 4839784 - DNA, 11 bp, Homo sapiens
ttacataacag

SEQ ID NO: 4839785 - DNA, 15 bp, Homo sapiens
ttacataattgccaa

SEQ ID NO: 4839786 - DNA, 16 bp, Homo sapiens
ttacataattgccaat

SEQ ID NO: 4839787 - DNA, 19 bp, Homo sapiens
ttacataattgccaataat

SEQ ID NO: 4839788 - DNA, 16 bp, Homo sapiens
ttacatgcatgagcac

SEQ ID NO: 4839789 - DNA, 17 bp, Homo sapiens
ttacatgcatgagcacc

SEQ ID NO: 4839790 - DNA, 23 bp, Homo sapiens
ttacattgccgtggcatcttaaa

SEQ ID NO: 4839791 - DNA, 22 bp, Homo sapiens
ttaccagaagtttaaatctttg

SEQ ID NO: 4839792 - DNA, 19 bp, Homo sapiens
ttaccatttgttaatatca

SEQ ID NO: 4839793 - DNA, 21 bp, Homo sapiens
ttacccagtgggacagaggag

SEQ ID NO: 4839794 - DNA, 19 bp, Homo sapiens
ttaccctccctgtcccctg

SEQ ID NO: 4839795 - DNA, 12 bp, Homo sapiens
ttaccgcccacc

SEQ ID NO: 4839796 - DNA, 17 bp, Homo sapiens
ttacctcaacaagaaga

SEQ ID NO: 4839797 - DNA, 13 bp, Homo sapiens
ttacctcatttgc

SEQ ID NO: 4839798 - DNA, 23 bp, Homo sapiens
ttacctcgggatggttggttagt

SEQ ID NO: 4839799 - DNA, 17 bp, Homo sapiens
ttacctctctgtcatgt

SEQ ID NO: 4839800 - DNA, 19 bp, Homo sapiens
ttacctgtaatagcctcac

SEQ ID NO: 4839801 - DNA, 21 bp, Homo sapiens
ttacctgtaatagcctcacct

SEQ ID NO: 4839802 - DNA, 22 bp, Homo sapiens
ttacctgtaatagcctcacctt

SEQ ID NO: 4839803 - DNA, 14 bp, Homo sapiens
ttactaaatctact

SEQ ID NO: 4839804 - DNA, 14 bp, Homo sapiens
ttactaacactggc

SEQ ID NO: 4839805 - DNA, 16 bp, Homo sapiens
ttactaaccaccattt

SEQ ID NO: 4839806 - DNA, 15 bp, Homo sapiens
ttactatagcaaagt

SEQ ID NO: 4839807 - DNA, 18 bp, Homo sapiens
ttactatagcaaagtagt

SEQ ID NO: 4839808 - DNA, 22 bp, Homo sapiens
ttactatagcaaagtagtactt

SEQ ID NO: 4839809 - DNA, 17 bp, Homo sapiens
ttactattaactctgca

SEQ ID NO: 4839810 - DNA, 23 bp, Homo sapiens
ttactattaactctgcatagaca

SEQ ID NO: 4839811 - DNA, 17 bp, Homo sapiens
ttactcggcgtgctcct

SEQ ID NO: 4839812 - DNA, 23 bp, Homo sapiens
ttactctgtgctaagttgtctta

SEQ ID NO: 4839813 - DNA, 16 bp, Homo sapiens
ttactgttcttattgt

SEQ ID NO: 4839814 - DNA, 16 bp, Homo sapiens
ttacttaaagcttgtt

SEQ ID NO: 4839815 - DNA, 18 bp, Homo sapiens
ttacttaaagcttgtttg

SEQ ID NO: 4839816 - DNA, 22 bp, Homo sapiens
ttacttaaatagcatctgctct

SEQ ID NO: 4839817 - DNA, 19 bp, Homo sapiens
ttacttacacacctgagaa

SEQ ID NO: 4839818 - DNA, 16 bp, Homo sapiens
ttacttagaatttatc

SEQ ID NO: 4839819 - DNA, 23 bp, Homo sapiens
ttactttaggtagtagaatctca

SEQ ID NO: 4839820 - DNA, 14 bp, Homo sapiens
ttactttcctctga

SEQ ID NO: 4839821 - DNA, 20 bp, Homo sapiens
ttagaaaaaactggaaacat

SEQ ID NO: 4839822 - DNA, 15 bp, Homo sapiens
ttagaaagaattagc

SEQ ID NO: 4839823 - DNA, 21 bp, Homo sapiens
ttagaaatttattcttatctt

SEQ ID NO: 4839824 - DNA, 13 bp, Homo sapiens
ttagaatattaaa

SEQ ID NO: 4839825 - DNA, 18 bp, Homo sapiens
ttagaatcaagtctgtga

SEQ ID NO: 4839826 - DNA, 20 bp, Homo sapiens
ttagaatcaagtctgtgaaa

SEQ ID NO: 4839827 - DNA, 13 bp, Homo sapiens
ttagaatggggct

SEQ ID NO: 4839828 - DNA, 16 bp, Homo sapiens
ttagagattaatttgt

SEQ ID NO: 4839829 - DNA, 18 bp, Homo sapiens
ttagagattaatttgtgt

SEQ ID NO: 4839830 - DNA, 19 bp, Homo sapiens
ttagcacagtatttaacat

SEQ ID NO: 4839831 - DNA, 18 bp, Homo sapiens
ttagcagttctgcaaata

SEQ ID NO: 4839832 - DNA, 15 bp, Homo sapiens
ttagcgttctgtttc

SEQ ID NO: 4839833 - DNA, 16 bp, Homo sapiens
ttagcgttgttttgtg

SEQ ID NO: 4839834 - DNA, 17 bp, Homo sapiens
ttagcgttgttttgtgg

SEQ ID NO: 4839835 - DNA, 21 bp, Homo sapiens
ttagctcagaggagaggagca

SEQ ID NO: 4839836 - DNA, 15 bp, Homo sapiens
ttaggaatgctcaat

SEQ ID NO: 4839837 - DNA, 21 bp, Homo sapiens
ttaggcaggaagtcaggagcc

SEQ ID NO: 4839838 - DNA, 22 bp, Homo sapiens
ttaggcaggaagtcaggagcca

SEQ ID NO: 4839839 - DNA, 16 bp, Homo sapiens
ttagggaaatccaact

SEQ ID NO: 4839840 - DNA, 17 bp, Homo sapiens
ttaggggaaaatagtag

SEQ ID NO: 4839841 - DNA, 17 bp, Homo sapiens
ttagggtacagcccagg

SEQ ID NO: 4839842 - DNA, 13 bp, Homo sapiens
ttagggtctgtcc

SEQ ID NO: 4839843 - DNA, 19 bp, Homo sapiens
ttaggtagtagaatctcag

SEQ ID NO: 4839844 - DNA, 15 bp, Homo sapiens
ttaggtgaggaagca

SEQ ID NO: 4839845 - DNA, 17 bp, Homo sapiens
ttagtaaaattatctgt

SEQ ID NO: 4839846 - DNA, 15 bp, Homo sapiens
ttagtaaattcctaa

SEQ ID NO: 4839847 - DNA, 16 bp, Homo sapiens
ttagtagctgataaag

SEQ ID NO: 4839848 - DNA, 14 bp, Homo sapiens
ttagtatttttact

SEQ ID NO: 4839849 - DNA, 14 bp, Homo sapiens
ttagtcctcacctt

SEQ ID NO: 4839850 - DNA, 14 bp, Homo sapiens
ttagtgttttcatt

SEQ ID NO: 4839851 - DNA, 22 bp, Homo sapiens
ttagtgttttcattctggtcct

SEQ ID NO: 4839852 - DNA, 22 bp, Homo sapiens
ttataaatggaggtacaggata

SEQ ID NO: 4839853 - DNA, 18 bp, Homo sapiens
ttataaatgttttaaaga

SEQ ID NO: 4839854 - DNA, 11 bp, Homo sapiens
ttataaattaa

SEQ ID NO: 4839855 - DNA, 13 bp, Homo sapiens
ttataaattaaat

SEQ ID NO: 4839856 - DNA, 15 bp, Homo sapiens
ttataaattaaatat

SEQ ID NO: 4839857 - DNA, 14 bp, Homo sapiens
ttataacattgtaa

SEQ ID NO: 4839858 - DNA, 15 bp, Homo sapiens
ttataacattgtaaa

SEQ ID NO: 4839859 - DNA, 18 bp, Homo sapiens
ttataagagggaacaaat

SEQ ID NO: 4839860 - DNA, 23 bp, Homo sapiens
ttataagagggaacaaattttca

SEQ ID NO: 4839861 - DNA, 23 bp, Homo sapiens
ttataagctatgtcactaccctc

SEQ ID NO: 4839862 - DNA, 17 bp, Homo sapiens
ttataagttgaccttta

SEQ ID NO: 4839863 - DNA, 16 bp, Homo sapiens
ttataatcagaatgga

SEQ ID NO: 4839864 - DNA, 13 bp, Homo sapiens
ttataatggctct

SEQ ID NO: 4839865 - DNA, 15 bp, Homo sapiens
ttataattgtcatga

SEQ ID NO: 4839866 - DNA, 21 bp, Homo sapiens
ttataattgtcatgactttca

SEQ ID NO: 4839867 - DNA, 18 bp, Homo sapiens
ttatacacagttccacaa

SEQ ID NO: 4839868 - DNA, 15 bp, Homo sapiens
ttatagtctgtactt

SEQ ID NO: 4839869 - DNA, 19 bp, Homo sapiens
ttatatacaaagctgtcac

SEQ ID NO: 4839870 - DNA, 22 bp, Homo sapiens
ttatatcagactgctttgagaa

SEQ ID NO: 4839871 - DNA, 19 bp, Homo sapiens
ttatattagagtgccctta

SEQ ID NO: 4839872 - DNA, 20 bp, Homo sapiens
ttatattattttctgtaatt

SEQ ID NO: 4839873 - DNA, 16 bp, Homo sapiens
ttatattctgcagaaa

SEQ ID NO: 4839874 - DNA, 12 bp, Homo sapiens
ttatatttcaac

SEQ ID NO: 4839875 - DNA, 15 bp, Homo sapiens
ttatattttgaacaa

SEQ ID NO: 4839876 - DNA, 16 bp, Homo sapiens
ttatcaaaaaacagaa

SEQ ID NO: 4839877 - DNA, 20 bp, Homo sapiens
ttatcaaaaaacagaaaaac

SEQ ID NO: 4839878 - DNA, 21 bp, Homo sapiens
ttatcaaaaaacagaaaaaca

SEQ ID NO: 4839879 - DNA, 23 bp, Homo sapiens
ttatcagtgaatataaatgtact

SEQ ID NO: 4839880 - DNA, 20 bp, Homo sapiens
ttatcagtttgctaatgttt

SEQ ID NO: 4839881 - DNA, 22 bp, Homo sapiens
ttatccactacaggttttatga

SEQ ID NO: 4839882 - DNA, 13 bp, Homo sapiens
ttatcctcaagtt

SEQ ID NO: 4839883 - DNA, 20 bp, Homo sapiens
ttatctagtaggtctgcaca

SEQ ID NO: 4839884 - DNA, 13 bp, Homo sapiens
ttatctccagcca

SEQ ID NO: 4839885 - DNA, 18 bp, Homo sapiens
ttatctctttctctcttt

SEQ ID NO: 4839886 - DNA, 11 bp, Homo sapiens
ttatctgtctg

SEQ ID NO: 4839887 - DNA, 13 bp, Homo sapiens
ttatctgtcttta

SEQ ID NO: 4839888 - DNA, 13 bp, Homo sapiens
ttatctgttctat

SEQ ID NO: 4839889 - DNA, 16 bp, Homo sapiens
ttatctgttctatgga

SEQ ID NO: 4839890 - DNA, 22 bp, Homo sapiens
ttatctgttctatggaccaaat

SEQ ID NO: 4839891 - DNA, 17 bp, Homo sapiens
ttatcttaaacccacat

SEQ ID NO: 4839892 - DNA, 22 bp, Homo sapiens
ttatcttctggactatagctgt

SEQ ID NO: 4839893 - DNA, 13 bp, Homo sapiens
ttatgaagatagt

SEQ ID NO: 4839894 - DNA, 15 bp, Homo sapiens
ttatgaatcgcagac

SEQ ID NO: 4839895 - DNA, 18 bp, Homo sapiens
ttatgaatcgcagacgca

SEQ ID NO: 4839896 - DNA, 16 bp, Homo sapiens
ttatgacgtgcacaaa

SEQ ID NO: 4839897 - DNA, 14 bp, Homo sapiens
ttatgactaatcct

SEQ ID NO: 4839898 - DNA, 15 bp, Homo sapiens
ttatgactaatcctt

SEQ ID NO: 4839899 - DNA, 18 bp, Homo sapiens
ttatgactaatccttaat

SEQ ID NO: 4839900 - DNA, 22 bp, Homo sapiens
ttatgatttcatgattagacaa

SEQ ID NO: 4839901 - DNA, 11 bp, Homo sapiens
ttatgcatgag

SEQ ID NO: 4839902 - DNA, 17 bp, Homo sapiens
ttatggagtgtcaccag

SEQ ID NO: 4839903 - DNA, 17 bp, Homo sapiens
ttatggatatgaaaaat

SEQ ID NO: 4839904 - DNA, 22 bp, Homo sapiens
ttatggtattttcgtgcatttg

SEQ ID NO: 4839905 - DNA, 23 bp, Homo sapiens
ttatggtattttcgtgcatttgt

SEQ ID NO: 4839906 - DNA, 18 bp, Homo sapiens
ttatgtcattttcagatc

SEQ ID NO: 4839907 - DNA, 17 bp, Homo sapiens
ttatgtcctgtgagatg

SEQ ID NO: 4839908 - DNA, 22 bp, Homo sapiens
ttatgtcctgtgagatgtgtat

SEQ ID NO: 4839909 - DNA, 15 bp, Homo sapiens
ttatgtgctattaat

SEQ ID NO: 4839910 - DNA, 14 bp, Homo sapiens
ttatgtttaaaatg

SEQ ID NO: 4839911 - DNA, 18 bp, Homo sapiens
ttatgtttaaaatggcat

SEQ ID NO: 4839912 - DNA, 19 bp, Homo sapiens
ttatgtttaaaatggcatt

SEQ ID NO: 4839913 - DNA, 21 bp, Homo sapiens
ttattaaaatattttcttaat

SEQ ID NO: 4839914 - DNA, 22 bp, Homo sapiens
ttattaaaatattttcttaatt

SEQ ID NO: 4839915 - DNA, 12 bp, Homo sapiens
ttattaaacttc

SEQ ID NO: 4839916 - DNA, 15 bp, Homo sapiens
ttattaaacttcagc

SEQ ID NO: 4839917 - DNA, 12 bp, Homo sapiens
ttattaaatgta

SEQ ID NO: 4839918 - DNA, 18 bp, Homo sapiens
ttattaaatgtagcttca

SEQ ID NO: 4839919 - DNA, 16 bp, Homo sapiens
ttattaaatttattaa

SEQ ID NO: 4839920 - DNA, 21 bp, Homo sapiens
ttattaaatttattaaatgtt

SEQ ID NO: 4839921 - DNA, 20 bp, Homo sapiens
ttattacaacaagcaaactg

SEQ ID NO: 4839922 - DNA, 12 bp, Homo sapiens
ttattagcagct

SEQ ID NO: 4839923 - DNA, 18 bp, Homo sapiens
ttattaggttaagtctca

SEQ ID NO: 4839924 - DNA, 15 bp, Homo sapiens
ttattattattatat

SEQ ID NO: 4839925 - DNA, 18 bp, Homo sapiens
ttattattttcatataat

SEQ ID NO: 4839926 - DNA, 19 bp, Homo sapiens
ttattattttcatataatt

SEQ ID NO: 4839927 - DNA, 17 bp, Homo sapiens
ttattcctaattcctgt

SEQ ID NO: 4839928 - DNA, 21 bp, Homo sapiens
ttattcctaattcctgtatgt

SEQ ID NO: 4839929 - DNA, 19 bp, Homo sapiens
ttattctcagaacaccaag

SEQ ID NO: 4839930 - DNA, 14 bp, Homo sapiens
ttattcttccaagt

SEQ ID NO: 4839931 - DNA, 12 bp, Homo sapiens
ttattgaataac

SEQ ID NO: 4839932 - DNA, 15 bp, Homo sapiens
ttattgattaagtat

SEQ ID NO: 4839933 - DNA, 18 bp, Homo sapiens
ttattgattaagtatatc

SEQ ID NO: 4839934 - DNA, 17 bp, Homo sapiens
ttattgggcttaatata

SEQ ID NO: 4839935 - DNA, 17 bp, Homo sapiens
ttattgtcaaagtggtg

SEQ ID NO: 4839936 - DNA, 18 bp, Homo sapiens
ttattgtcaaagtggtga

SEQ ID NO: 4839937 - DNA, 16 bp, Homo sapiens
ttatttattaaacttc

SEQ ID NO: 4839938 - DNA, 15 bp, Homo sapiens
ttatttctaaaacat

SEQ ID NO: 4839939 - DNA, 17 bp, Homo sapiens
ttatttctgtatataga

SEQ ID NO: 4839940 - DNA, 20 bp, Homo sapiens
ttatttgctcataagtaaat

SEQ ID NO: 4839941 - DNA, 20 bp, Homo sapiens
ttattttagcagttctgcaa

SEQ ID NO: 4839942 - DNA, 14 bp, Homo sapiens
ttattttctgtaat

SEQ ID NO: 4839943 - DNA, 15 bp, Homo sapiens
ttattttctgtaatt

SEQ ID NO: 4839944 - DNA, 22 bp, Homo sapiens
ttattttgattgtttgatgaat

SEQ ID NO: 4839945 - DNA, 15 bp, Homo sapiens
ttatttttctgttac

SEQ ID NO: 4839946 - DNA, 16 bp, Homo sapiens
ttattttttgtaactc

SEQ ID NO: 4839947 - DNA, 21 bp, Homo sapiens
ttcaaacagttccataccaag

SEQ ID NO: 4839948 - DNA, 20 bp, Homo sapiens
ttcaaagaacccccctcccc

SEQ ID NO: 4839949 - DNA, 21 bp, Homo sapiens
ttcaaagaacccccctcccca

SEQ ID NO: 4839950 - DNA, 19 bp, Homo sapiens
ttcaaaggagcaagaactt

SEQ ID NO: 4839951 - DNA, 15 bp, Homo sapiens
ttcaaagtatataca

SEQ ID NO: 4839952 - DNA, 17 bp, Homo sapiens
ttcaaagtatatacaga

SEQ ID NO: 4839953 - DNA, 11 bp, Homo sapiens
ttcaaagtctc

SEQ ID NO: 4839954 - DNA, 20 bp, Homo sapiens
ttcaaagtctcaatgaaata

SEQ ID NO: 4839955 - DNA, 15 bp, Homo sapiens
ttcaaataaccctga

SEQ ID NO: 4839956 - DNA, 19 bp, Homo sapiens
ttcaaatgtgtaactttat

SEQ ID NO: 4839957 - DNA, 20 bp, Homo sapiens
ttcaaattctgattattaca

SEQ ID NO: 4839958 - DNA, 23 bp, Homo sapiens
ttcaaattctgattattacaaca

SEQ ID NO: 4839959 - DNA, 21 bp, Homo sapiens
ttcaacaggttttcctgaaga

SEQ ID NO: 4839960 - DNA, 14 bp, Homo sapiens
ttcaaccctgccct

SEQ ID NO: 4839961 - DNA, 22 bp, Homo sapiens
ttcaacctggtggcaccagatg

SEQ ID NO: 4839962 - DNA, 18 bp, Homo sapiens
ttcaagcgattctcctgc

SEQ ID NO: 4839963 - DNA, 20 bp, Homo sapiens
ttcaaggcacattgaaatac

SEQ ID NO: 4839964 - DNA, 21 bp, Homo sapiens
ttcaagttgcagtcagaagat

SEQ ID NO: 4839965 - DNA, 23 bp, Homo sapiens
ttcaatagccccatctctcctgc

SEQ ID NO: 4839966 - DNA, 19 bp, Homo sapiens
ttcaatcattttgggaaat

SEQ ID NO: 4839967 - DNA, 22 bp, Homo sapiens
ttcaatccccataatgcttctt

SEQ ID NO: 4839968 - DNA, 15 bp, Homo sapiens
ttcaatctgtgaagc

SEQ ID NO: 4839969 - DNA, 23 bp, Homo sapiens
ttcaatctgtgaagcctttatct

SEQ ID NO: 4839970 - DNA, 21 bp, Homo sapiens
ttcaatgcaatgcatctgaaa

SEQ ID NO: 4839971 - DNA, 16 bp, Homo sapiens
ttcaatgctacaaaat

SEQ ID NO: 4839972 - DNA, 18 bp, Homo sapiens
ttcaatgggtaaataaat

SEQ ID NO: 4839973 - DNA, 22 bp, Homo sapiens
ttcaatgggtaaataaatgctg

SEQ ID NO: 4839974 - DNA, 23 bp, Homo sapiens
ttcaatgggtaaataaatgctgc

SEQ ID NO: 4839975 - DNA, 16 bp, Homo sapiens
ttcaatgtaattaaac

SEQ ID NO: 4839976 - DNA, 17 bp, Homo sapiens
ttcaatgtgaaactgag

SEQ ID NO: 4839977 - DNA, 16 bp, Homo sapiens
ttcaatgtgaatttta

SEQ ID NO: 4839978 - DNA, 14 bp, Homo sapiens
ttcaattaatggaa

SEQ ID NO: 4839979 - DNA, 14 bp, Homo sapiens
ttcacaaaatgcaa

SEQ ID NO: 4839980 - DNA, 22 bp, Homo sapiens
ttcacacacacacaatggcaag

SEQ ID NO: 4839981 - DNA, 16 bp, Homo sapiens
ttcacactgtgcgttt

SEQ ID NO: 4839982 - DNA, 22 bp, Homo sapiens
ttcacactgtgcgttttagagt

SEQ ID NO: 4839983 - DNA, 15 bp, Homo sapiens
ttcacagttctctcc

SEQ ID NO: 4839984 - DNA, 12 bp, Homo sapiens
ttcacattcctg

SEQ ID NO: 4839985 - DNA, 18 bp, Homo sapiens
ttcaccaacaacagtcag

SEQ ID NO: 4839986 - DNA, 21 bp, Homo sapiens
ttcaccacaaccctgttgcta

SEQ ID NO: 4839987 - DNA, 17 bp, Homo sapiens
ttcaccatgttgccaat

SEQ ID NO: 4839988 - DNA, 22 bp, Homo sapiens
ttcaccccggcaggccctgcag

SEQ ID NO: 4839989 - DNA, 10 bp, Homo sapiens
ttcacccctc

SEQ ID NO: 4839990 - DNA, 15 bp, Homo sapiens
ttcacccctcccacc

SEQ ID NO: 4839991 - DNA, 14 bp, Homo sapiens
ttcaccctgccacc

SEQ ID NO: 4839992 - DNA, 15 bp, Homo sapiens
ttcaccgcattccag

SEQ ID NO: 4839993 - DNA, 17 bp, Homo sapiens
ttcaccgcattccaggg

SEQ ID NO: 4839994 - DNA, 13 bp, Homo sapiens
ttcacctgtaaaa

SEQ ID NO: 4839995 - DNA, 17 bp, Homo sapiens
ttcacctgtaaaacttt

SEQ ID NO: 4839996 - DNA, 17 bp, Homo sapiens
ttcaccttctgtgcatc

SEQ ID NO: 4839997 - DNA, 23 bp, Homo sapiens
ttcactacccatcggtgtccatt

SEQ ID NO: 4839998 - DNA, 16 bp, Homo sapiens
ttcactataatgtgaa

SEQ ID NO: 4839999 - DNA, 22 bp, Homo sapiens
ttcactgaataaataagtaaat

SEQ ID NO: 4840000 - DNA, 15 bp, Homo sapiens
ttcacttctatttat

SEQ ID NO: 4840001 - DNA, 22 bp, Homo sapiens
ttcagaaacaaagcatttgact

SEQ ID NO: 4840002 - DNA, 17 bp, Homo sapiens
ttcagactctctcctct

SEQ ID NO: 4840003 - DNA, 18 bp, Homo sapiens
ttcagagatgtaccatgt

SEQ ID NO: 4840004 - DNA, 14 bp, Homo sapiens
ttcagataaatcat

SEQ ID NO: 4840005 - DNA, 17 bp, Homo sapiens
ttcagataaatcatggg

SEQ ID NO: 4840006 - DNA, 14 bp, Homo sapiens
ttcagatccttcca

SEQ ID NO: 4840007 - DNA, 17 bp, Homo sapiens
ttcagatccttccaaac

SEQ ID NO: 4840008 - DNA, 14 bp, Homo sapiens
ttcagatgctttag

SEQ ID NO: 4840009 - DNA, 15 bp, Homo sapiens
ttcagattgtatctg

SEQ ID NO: 4840010 - DNA, 23 bp, Homo sapiens
ttcagattgtatctgaactcaca

SEQ ID NO: 4840011 - DNA, 16 bp, Homo sapiens
ttcaggtcccctggcc

SEQ ID NO: 4840012 - DNA, 17 bp, Homo sapiens
ttcaggtcccctggccc

SEQ ID NO: 4840013 - DNA, 15 bp, Homo sapiens
ttcagtagctccttg

SEQ ID NO: 4840014 - DNA, 20 bp, Homo sapiens
ttcagtcacttgtttgtgtt

SEQ ID NO: 4840015 - DNA, 16 bp, Homo sapiens
ttcagtcattaaatta

SEQ ID NO: 4840016 - DNA, 17 bp, Homo sapiens
ttcagtctatgctgtgt

SEQ ID NO: 4840017 - DNA, 14 bp, Homo sapiens
ttcagtctgcagct

SEQ ID NO: 4840018 - DNA, 15 bp, Homo sapiens
ttcatactcaaagag

SEQ ID NO: 4840019 - DNA, 14 bp, Homo sapiens
ttcatacttaaaaa

SEQ ID NO: 4840020 - DNA, 18 bp, Homo sapiens
ttcatacttaaaaattta

SEQ ID NO: 4840021 - DNA, 23 bp, Homo sapiens
ttcatagataccattttgaaata

SEQ ID NO: 4840022 - DNA, 13 bp, Homo sapiens
ttcataggcagag

SEQ ID NO: 4840023 - DNA, 17 bp, Homo sapiens
ttcatatttttcaaaat

SEQ ID NO: 4840024 - DNA, 19 bp, Homo sapiens
ttcatatttttcaaaatag

SEQ ID NO: 4840025 - DNA, 21 bp, Homo sapiens
ttcatcaagtagcgttggaga

SEQ ID NO: 4840026 - DNA, 16 bp, Homo sapiens
ttcatcaatcattgta

SEQ ID NO: 4840027 - DNA, 22 bp, Homo sapiens
ttcatcaatcattgtacagttt

SEQ ID NO: 4840028 - DNA, 23 bp, Homo sapiens
ttcatccagtttgttctccgggt

SEQ ID NO: 4840029 - DNA, 15 bp, Homo sapiens
ttcatcccagggtat

SEQ ID NO: 4840030 - DNA, 21 bp, Homo sapiens
ttcatccctctggggctgttc

SEQ ID NO: 4840031 - DNA, 20 bp, Homo sapiens
ttcatctcaggtggcatttg

SEQ ID NO: 4840032 - DNA, 15 bp, Homo sapiens
ttcatctgaggagtc

SEQ ID NO: 4840033 - DNA, 22 bp, Homo sapiens
ttcatctggagtccctcctccc

SEQ ID NO: 4840034 - DNA, 21 bp, Homo sapiens
ttcatcttgaattgtaaggaa

SEQ ID NO: 4840035 - DNA, 14 bp, Homo sapiens
ttcatgattagaca

SEQ ID NO: 4840036 - DNA, 20 bp, Homo sapiens
ttcatgctgcctgccatgtg

SEQ ID NO: 4840037 - DNA, 19 bp, Homo sapiens
ttcatgcttttctcatggt

SEQ ID NO: 4840038 - DNA, 20 bp, Homo sapiens
ttcatgtccagagctcattt

SEQ ID NO: 4840039 - DNA, 16 bp, Homo sapiens
ttcatgttttgctaat

SEQ ID NO: 4840040 - DNA, 13 bp, Homo sapiens
ttcattaaaacaa

SEQ ID NO: 4840041 - DNA, 18 bp, Homo sapiens
ttcatttaggtgaggaag

SEQ ID NO: 4840042 - DNA, 16 bp, Homo sapiens
ttcatttgcacaagta

SEQ ID NO: 4840043 - DNA, 18 bp, Homo sapiens
ttccaaatacattccagt

SEQ ID NO: 4840044 - DNA, 16 bp, Homo sapiens
ttccaacacacaatta

SEQ ID NO: 4840045 - DNA, 17 bp, Homo sapiens
ttccaacctgttcacgt

SEQ ID NO: 4840046 - DNA, 19 bp, Homo sapiens
ttccaacctgttcacgtga

SEQ ID NO: 4840047 - DNA, 17 bp, Homo sapiens
ttccaagtgtgtgtgca

SEQ ID NO: 4840048 - DNA, 22 bp, Homo sapiens
ttccacaagagcccaggcctcc

SEQ ID NO: 4840049 - DNA, 19 bp, Homo sapiens
ttccaccctgccctggcct

SEQ ID NO: 4840050 - DNA, 20 bp, Homo sapiens
ttccaccttaaattaaacaa

SEQ ID NO: 4840051 - DNA, 21 bp, Homo sapiens
ttccagctaagcctgatgatg

SEQ ID NO: 4840052 - DNA, 11 bp, Homo sapiens
ttccagctcag

SEQ ID NO: 4840053 - DNA, 13 bp, Homo sapiens
ttccagctcagtc

SEQ ID NO: 4840054 - DNA, 15 bp, Homo sapiens
ttccagctcagtccc

SEQ ID NO: 4840055 - DNA, 20 bp, Homo sapiens
ttccagctcagtcccacagc

SEQ ID NO: 4840056 - DNA, 18 bp, Homo sapiens
ttccagctttctctttgt

SEQ ID NO: 4840057 - DNA, 21 bp, Homo sapiens
ttccagtaaggaatgatattg

SEQ ID NO: 4840058 - DNA, 13 bp, Homo sapiens
ttccagtgctgct

SEQ ID NO: 4840059 - DNA, 14 bp, Homo sapiens
ttccagtgctgctc

SEQ ID NO: 4840060 - DNA, 22 bp, Homo sapiens
ttccatagtttaggtactcaaa

SEQ ID NO: 4840061 - DNA, 14 bp, Homo sapiens
ttccatatgctctt

SEQ ID NO: 4840062 - DNA, 18 bp, Homo sapiens
ttccatattaaaatcaca

SEQ ID NO: 4840063 - DNA, 13 bp, Homo sapiens
ttccatcagcttt

SEQ ID NO: 4840064 - DNA, 18 bp, Homo sapiens
ttccatccaaacctacct

SEQ ID NO: 4840065 - DNA, 14 bp, Homo sapiens
ttccatccaccacc

SEQ ID NO: 4840066 - DNA, 18 bp, Homo sapiens
ttccatctcaacctacct

SEQ ID NO: 4840067 - DNA, 19 bp, Homo sapiens
ttccatctcccttggttgt

SEQ ID NO: 4840068 - DNA, 16 bp, Homo sapiens
ttccatgacagtagca

SEQ ID NO: 4840069 - DNA, 18 bp, Homo sapiens
ttccatgacagtagcata

SEQ ID NO: 4840070 - DNA, 20 bp, Homo sapiens
ttccatggaaccatggagga

SEQ ID NO: 4840071 - DNA, 21 bp, Homo sapiens
ttccatttggattttaaacaa

SEQ ID NO: 4840072 - DNA, 14 bp, Homo sapiens
ttccattttggaaa

SEQ ID NO: 4840073 - DNA, 15 bp, Homo sapiens
ttcccaacctcccct

SEQ ID NO: 4840074 - DNA, 16 bp, Homo sapiens
ttcccaacctgctcat

SEQ ID NO: 4840075 - DNA, 17 bp, Homo sapiens
ttcccaatcagcactga

SEQ ID NO: 4840076 - DNA, 19 bp, Homo sapiens
ttcccaatcagcactgaaa

SEQ ID NO: 4840077 - DNA, 20 bp, Homo sapiens
ttcccaattatcaaaaaaca

SEQ ID NO: 4840078 - DNA, 12 bp, Homo sapiens
ttcccaccccta

SEQ ID NO: 4840079 - DNA, 21 bp, Homo sapiens
ttcccacctccctgcccaggc

SEQ ID NO: 4840080 - DNA, 20 bp, Homo sapiens
ttcccagcgcatggcgcccc

SEQ ID NO: 4840081 - DNA, 17 bp, Homo sapiens
ttcccaggcagggaggg

SEQ ID NO: 4840082 - DNA, 19 bp, Homo sapiens
ttcccagggccgcttctcc

SEQ ID NO: 4840083 - DNA, 20 bp, Homo sapiens
ttcccagggccgcttctcct

SEQ ID NO: 4840084 - DNA, 14 bp, Homo sapiens
ttcccatcaccaga

SEQ ID NO: 4840085 - DNA, 20 bp, Homo sapiens
ttcccatggtagactgtgac

SEQ ID NO: 4840086 - DNA, 13 bp, Homo sapiens
ttcccatttgtaa

SEQ ID NO: 4840087 - DNA, 14 bp, Homo sapiens
ttcccatttgtaat

SEQ ID NO: 4840088 - DNA, 15 bp, Homo sapiens
ttcccatttgtaatg

SEQ ID NO: 4840089 - DNA, 20 bp, Homo sapiens
ttcccatttgtaatgtatct

SEQ ID NO: 4840090 - DNA, 18 bp, Homo sapiens
ttccccatcgccttctgg

SEQ ID NO: 4840091 - DNA, 19 bp, Homo sapiens
ttccccatcgccttctggg

SEQ ID NO: 4840092 - DNA, 21 bp, Homo sapiens
ttccccatcgccttctgggga

SEQ ID NO: 4840093 - DNA, 18 bp, Homo sapiens
ttccccattgccttctgg

SEQ ID NO: 4840094 - DNA, 19 bp, Homo sapiens
ttccccattgccttctggg

SEQ ID NO: 4840095 - DNA, 21 bp, Homo sapiens
ttcccctgcgccctccctccc

SEQ ID NO: 4840096 - DNA, 19 bp, Homo sapiens
ttccccttctgtgtcacag

SEQ ID NO: 4840097 - DNA, 15 bp, Homo sapiens
ttcccgcagcaccag

SEQ ID NO: 4840098 - DNA, 19 bp, Homo sapiens
ttccctctcgctcccctct

SEQ ID NO: 4840099 - DNA, 11 bp, Homo sapiens
ttccctgctga

SEQ ID NO: 4840100 - DNA, 15 bp, Homo sapiens
ttccctgctgagtgg

SEQ ID NO: 4840101 - DNA, 17 bp, Homo sapiens
ttcccttcttttcctgg

SEQ ID NO: 4840102 - DNA, 23 bp, Homo sapiens
ttcccttcttttcctgggtgctc

SEQ ID NO: 4840103 - DNA, 19 bp, Homo sapiens
ttccgaagaccttctgaag

SEQ ID NO: 4840104 - DNA, 14 bp, Homo sapiens
ttccgcctcactgg

SEQ ID NO: 4840105 - DNA, 22 bp, Homo sapiens
ttccgctgtcgccccaggccct

SEQ ID NO: 4840106 - DNA, 17 bp, Homo sapiens
ttccgtgagacacaaga

SEQ ID NO: 4840107 - DNA, 14 bp, Homo sapiens
ttcctaagtttctt

SEQ ID NO: 4840108 - DNA, 17 bp, Homo sapiens
ttcctacggtacaagct

SEQ ID NO: 4840109 - DNA, 21 bp, Homo sapiens
ttcctataccggagctccagt

SEQ ID NO: 4840110 - DNA, 22 bp, Homo sapiens
ttcctcatggctgttatctgtc

SEQ ID NO: 4840111 - DNA, 16 bp, Homo sapiens
ttcctccaaagcctgg

SEQ ID NO: 4840112 - DNA, 19 bp, Homo sapiens
ttcctcctcatgaaagcag

SEQ ID NO: 4840113 - DNA, 17 bp, Homo sapiens
ttcctcctgtctcctct

SEQ ID NO: 4840114 - DNA, 12 bp, Homo sapiens
ttcctctctctc

SEQ ID NO: 4840115 - DNA, 19 bp, Homo sapiens
ttcctcttagaagaatatt

SEQ ID NO: 4840116 - DNA, 21 bp, Homo sapiens
ttcctcttagaagaatattgt

SEQ ID NO: 4840117 - DNA, 15 bp, Homo sapiens
ttcctgactgttctc

SEQ ID NO: 4840118 - DNA, 22 bp, Homo sapiens
ttcctgctcctccagtacaata

SEQ ID NO: 4840119 - DNA, 16 bp, Homo sapiens
ttcctggacagtgaga

SEQ ID NO: 4840120 - DNA, 18 bp, Homo sapiens
ttcctgggagtgggagtc

SEQ ID NO: 4840121 - DNA, 18 bp, Homo sapiens
ttccttaacagctgtatt

SEQ ID NO: 4840122 - DNA, 19 bp, Homo sapiens
ttccttaacagctgtatta

SEQ ID NO: 4840123 - DNA, 15 bp, Homo sapiens
ttccttacccaaact

SEQ ID NO: 4840124 - DNA, 14 bp, Homo sapiens
ttccttcacccacc

SEQ ID NO: 4840125 - DNA, 10 bp, Homo sapiens
ttccttcctt

SEQ ID NO: 4840126 - DNA, 17 bp, Homo sapiens
ttccttcctttctctct

SEQ ID NO: 4840127 - DNA, 19 bp, Homo sapiens
ttccttgaccttcctctgg

SEQ ID NO: 4840128 - DNA, 13 bp, Homo sapiens
ttccttgccttct

SEQ ID NO: 4840129 - DNA, 14 bp, Homo sapiens
ttccttggcccagc

SEQ ID NO: 4840130 - DNA, 15 bp, Homo sapiens
ttccttgtctaaaga

SEQ ID NO: 4840131 - DNA, 18 bp, Homo sapiens
ttcctttcatcctcagca

SEQ ID NO: 4840132 - DNA, 13 bp, Homo sapiens
ttcctttctggaa

SEQ ID NO: 4840133 - DNA, 13 bp, Homo sapiens
ttcctttcttcct

SEQ ID NO: 4840134 - DNA, 23 bp, Homo sapiens
ttcgatcgtttcacatctgtata

SEQ ID NO: 4840135 - DNA, 14 bp, Homo sapiens
ttcgctattcccag

SEQ ID NO: 4840136 - DNA, 16 bp, Homo sapiens
ttcgctattcccaggc

SEQ ID NO: 4840137 - DNA, 18 bp, Homo sapiens
ttcggatcgctccgccgt

SEQ ID NO: 4840138 - DNA, 18 bp, Homo sapiens
ttcggctatgtctcatgt

SEQ ID NO: 4840139 - DNA, 12 bp, Homo sapiens
ttcggtctcctt

SEQ ID NO: 4840140 - DNA, 19 bp, Homo sapiens
ttcggtggccttgagtctc

SEQ ID NO: 4840141 - DNA, 14 bp, Homo sapiens
ttcgtaagttctgt

SEQ ID NO: 4840142 - DNA, 16 bp, Homo sapiens
ttcgtaagttctgtgc

SEQ ID NO: 4840143 - DNA, 17 bp, Homo sapiens
ttcgtaagttctgtgca

SEQ ID NO: 4840144 - DNA, 11 bp, Homo sapiens
ttcgtgcattt

SEQ ID NO: 4840145 - DNA, 18 bp, Homo sapiens
ttcgtgggcctgctgctc

SEQ ID NO: 4840146 - DNA, 15 bp, Homo sapiens
ttctaaaaagtcaga

SEQ ID NO: 4840147 - DNA, 20 bp, Homo sapiens
ttctaaaaagtcagatgttt

SEQ ID NO: 4840148 - DNA, 15 bp, Homo sapiens
ttctaaaactactgc

SEQ ID NO: 4840149 - DNA, 17 bp, Homo sapiens
ttctaaagctgccagcc

SEQ ID NO: 4840150 - DNA, 18 bp, Homo sapiens
ttctaaaggtttcactgt

SEQ ID NO: 4840151 - DNA, 20 bp, Homo sapiens
ttctaagggatccagagacc

SEQ ID NO: 4840152 - DNA, 18 bp, Homo sapiens
ttctaatatttattgctt

SEQ ID NO: 4840153 - DNA, 19 bp, Homo sapiens
ttctaatatttattgcttt

SEQ ID NO: 4840154 - DNA, 14 bp, Homo sapiens
ttctaatccatgtg

SEQ ID NO: 4840155 - DNA, 21 bp, Homo sapiens
ttctacaatacaacacattga

SEQ ID NO: 4840156 - DNA, 22 bp, Homo sapiens
ttctacatgcaaatctggctta

SEQ ID NO: 4840157 - DNA, 16 bp, Homo sapiens
ttctacgcataaacta

SEQ ID NO: 4840158 - DNA, 16 bp, Homo sapiens
ttctagtaacagtatt

SEQ ID NO: 4840159 - DNA, 14 bp, Homo sapiens
ttctatatttactg

SEQ ID NO: 4840160 - DNA, 17 bp, Homo sapiens
ttctatatttactgttt

SEQ ID NO: 4840161 - DNA, 17 bp, Homo sapiens
ttctatctactgatttg

SEQ ID NO: 4840162 - DNA, 15 bp, Homo sapiens
ttctatgacaataaa

SEQ ID NO: 4840163 - DNA, 15 bp, Homo sapiens
ttctatgattaaact

SEQ ID NO: 4840164 - DNA, 22 bp, Homo sapiens
ttctatgattaaactgggaaat

SEQ ID NO: 4840165 - DNA, 15 bp, Homo sapiens
ttctatggattcact

SEQ ID NO: 4840166 - DNA, 17 bp, Homo sapiens
ttctatggattcacttc

SEQ ID NO: 4840167 - DNA, 20 bp, Homo sapiens
ttctatggattcacttctat

SEQ ID NO: 4840168 - DNA, 22 bp, Homo sapiens
ttctatggattcacttctattt

SEQ ID NO: 4840169 - DNA, 23 bp, Homo sapiens
ttctatggcatattgataataaa

SEQ ID NO: 4840170 - DNA, 18 bp, Homo sapiens
ttctattgtgctttctat

SEQ ID NO: 4840171 - DNA, 21 bp, Homo sapiens
ttctcaagcgctatccacaga

SEQ ID NO: 4840172 - DNA, 20 bp, Homo sapiens
ttctcaatcattgtcagaga

SEQ ID NO: 4840173 - DNA, 12 bp, Homo sapiens
ttctcacagcac

SEQ ID NO: 4840174 - DNA, 22 bp, Homo sapiens
ttctcacagcacatgctggcca

SEQ ID NO: 4840175 - DNA, 17 bp, Homo sapiens
ttctcaccctctgtcct

SEQ ID NO: 4840176 - DNA, 21 bp, Homo sapiens
ttctcagaagtgaaaaagact

SEQ ID NO: 4840177 - DNA, 18 bp, Homo sapiens
ttctcagccttggttcct

SEQ ID NO: 4840178 - DNA, 16 bp, Homo sapiens
ttctcagctccactct

SEQ ID NO: 4840179 - DNA, 17 bp, Homo sapiens
ttctcagctccactctg

SEQ ID NO: 4840180 - DNA, 18 bp, Homo sapiens
ttctcagctccactctga

SEQ ID NO: 4840181 - DNA, 23 bp, Homo sapiens
ttctcatctgtaaaaccaggctg

SEQ ID NO: 4840182 - DNA, 12 bp, Homo sapiens
ttctcatcttgt

SEQ ID NO: 4840183 - DNA, 16 bp, Homo sapiens
ttctcatcttgtaaat

SEQ ID NO: 4840184 - DNA, 18 bp, Homo sapiens
ttctcatggtattatcta

SEQ ID NO: 4840185 - DNA, 22 bp, Homo sapiens
ttctcatttatgttatttatga

SEQ ID NO: 4840186 - DNA, 13 bp, Homo sapiens
ttctccacctccc

SEQ ID NO: 4840187 - DNA, 14 bp, Homo sapiens
ttctccacctcccc

SEQ ID NO: 4840188 - DNA, 12 bp, Homo sapiens
ttctccattaaa

SEQ ID NO: 4840189 - DNA, 20 bp, Homo sapiens
ttctccattaaacttctact

SEQ ID NO: 4840190 - DNA, 19 bp, Homo sapiens
ttctcccctccagacccct

SEQ ID NO: 4840191 - DNA, 15 bp, Homo sapiens
ttctcccgccattgg

SEQ ID NO: 4840192 - DNA, 16 bp, Homo sapiens
ttctcccgccattggc

SEQ ID NO: 4840193 - DNA, 18 bp, Homo sapiens
ttctcccgccattggcct

SEQ ID NO: 4840194 - DNA, 21 bp, Homo sapiens
ttctccgggtgtggcctcagc

SEQ ID NO: 4840195 - DNA, 10 bp, Homo sapiens
ttctccttcc

SEQ ID NO: 4840196 - DNA, 12 bp, Homo sapiens
ttctccttccca

SEQ ID NO: 4840197 - DNA, 23 bp, Homo sapiens
ttctctccggatggaatcacagc

SEQ ID NO: 4840198 - DNA, 11 bp, Homo sapiens
ttctctctgtg

SEQ ID NO: 4840199 - DNA, 23 bp, Homo sapiens
ttctctctgtgtggcaaacattt

SEQ ID NO: 4840200 - DNA, 14 bp, Homo sapiens
ttctcttactgccg

SEQ ID NO: 4840201 - DNA, 15 bp, Homo sapiens
ttctgaaaactgttt

SEQ ID NO: 4840202 - DNA, 22 bp, Homo sapiens
ttctgaacttggcgctgcccct

SEQ ID NO: 4840203 - DNA, 15 bp, Homo sapiens
ttctgacggccctgc

SEQ ID NO: 4840204 - DNA, 18 bp, Homo sapiens
ttctgatgaaatgttaac

SEQ ID NO: 4840205 - DNA, 13 bp, Homo sapiens
ttctgatgaagtt

SEQ ID NO: 4840206 - DNA, 18 bp, Homo sapiens
ttctgatgaggcatttta

SEQ ID NO: 4840207 - DNA, 15 bp, Homo sapiens
ttctgattattacaa

SEQ ID NO: 4840208 - DNA, 22 bp, Homo sapiens
ttctgattattacaacaagcaa

SEQ ID NO: 4840209 - DNA, 19 bp, Homo sapiens
ttctgcaaatagaaaacag

SEQ ID NO: 4840210 - DNA, 15 bp, Homo sapiens
ttctgcaataacagt

SEQ ID NO: 4840211 - DNA, 13 bp, Homo sapiens
ttctgcacataca

SEQ ID NO: 4840212 - DNA, 15 bp, Homo sapiens
ttctgcagtcagact

SEQ ID NO: 4840213 - DNA, 16 bp, Homo sapiens
ttctgcagtcagactg

SEQ ID NO: 4840214 - DNA, 14 bp, Homo sapiens
ttctgctaatttat

SEQ ID NO: 4840215 - DNA, 23 bp, Homo sapiens
ttctggaattgggctccgtggtg

SEQ ID NO: 4840216 - DNA, 13 bp, Homo sapiens
ttctgggaagaaa

SEQ ID NO: 4840217 - DNA, 22 bp, Homo sapiens
ttctgggacaggcaccatgctg

SEQ ID NO: 4840218 - DNA, 19 bp, Homo sapiens
ttctggggagggacacaga

SEQ ID NO: 4840219 - DNA, 21 bp, Homo sapiens
ttctggggagggacacagagg

SEQ ID NO: 4840220 - DNA, 16 bp, Homo sapiens
ttctggggtggggctt

SEQ ID NO: 4840221 - DNA, 20 bp, Homo sapiens
ttctgtaatatttacaatgt

SEQ ID NO: 4840222 - DNA, 12 bp, Homo sapiens
ttctgtaattct

SEQ ID NO: 4840223 - DNA, 22 bp, Homo sapiens
ttctgtcattggttacaaattt

SEQ ID NO: 4840224 - DNA, 12 bp, Homo sapiens
ttctgtgcagtt

SEQ ID NO: 4840225 - DNA, 14 bp, Homo sapiens
ttctgtgcatctgg

SEQ ID NO: 4840226 - DNA, 23 bp, Homo sapiens
ttctgtgcatctggcctgggggc

SEQ ID NO: 4840227 - DNA, 12 bp, Homo sapiens
ttctgtgtcacg

SEQ ID NO: 4840228 - DNA, 20 bp, Homo sapiens
ttcttaaggacagtgttcaa

SEQ ID NO: 4840229 - DNA, 16 bp, Homo sapiens
ttcttaccgaaatgaa

SEQ ID NO: 4840230 - DNA, 19 bp, Homo sapiens
ttcttaccgaaatgaaaat

SEQ ID NO: 4840231 - DNA, 19 bp, Homo sapiens
ttcttacgaacgccacggc

SEQ ID NO: 4840232 - DNA, 23 bp, Homo sapiens
ttcttcaaaatataaaatgccaa

SEQ ID NO: 4840233 - DNA, 19 bp, Homo sapiens
ttcttcaatgtgaaactga

SEQ ID NO: 4840234 - DNA, 21 bp, Homo sapiens
ttcttccacaagagcccaggc

SEQ ID NO: 4840235 - DNA, 20 bp, Homo sapiens
ttcttcccatttgtaatgta

SEQ ID NO: 4840236 - DNA, 21 bp, Homo sapiens
ttcttccccaaggcactgagc

SEQ ID NO: 4840237 - DNA, 11 bp, Homo sapiens
ttcttccttcc

SEQ ID NO: 4840238 - DNA, 12 bp, Homo sapiens
ttcttccttcct

SEQ ID NO: 4840239 - DNA, 14 bp, Homo sapiens
ttcttccttccttt

SEQ ID NO: 4840240 - DNA, 18 bp, Homo sapiens
ttcttctaaaactactgc

SEQ ID NO: 4840241 - DNA, 20 bp, Homo sapiens
ttcttctaaaactactgcct

SEQ ID NO: 4840242 - DNA, 16 bp, Homo sapiens
ttcttctattgtgctt

SEQ ID NO: 4840243 - DNA, 11 bp, Homo sapiens
ttcttctcatt

SEQ ID NO: 4840244 - DNA, 21 bp, Homo sapiens
ttcttctcctttgtcaaatgg

SEQ ID NO: 4840245 - DNA, 16 bp, Homo sapiens
ttcttctctctgtgct

SEQ ID NO: 4840246 - DNA, 14 bp, Homo sapiens
ttcttctgtaatat

SEQ ID NO: 4840247 - DNA, 15 bp, Homo sapiens
ttcttctgtaatatt

SEQ ID NO: 4840248 - DNA, 15 bp, Homo sapiens
ttcttgcaagctcca

SEQ ID NO: 4840249 - DNA, 16 bp, Homo sapiens
ttcttgcaagctccag

SEQ ID NO: 4840250 - DNA, 18 bp, Homo sapiens
ttcttgcaagctccagta

SEQ ID NO: 4840251 - DNA, 11 bp, Homo sapiens
ttcttgcaata

SEQ ID NO: 4840252 - DNA, 14 bp, Homo sapiens
ttcttgcaataaga

SEQ ID NO: 4840253 - DNA, 21 bp, Homo sapiens
ttcttgcggcaccgcccaccc

SEQ ID NO: 4840254 - DNA, 22 bp, Homo sapiens
ttcttgcggcaccgcccaccca

SEQ ID NO: 4840255 - DNA, 16 bp, Homo sapiens
ttcttggtatgatcat

SEQ ID NO: 4840256 - DNA, 14 bp, Homo sapiens
ttcttgtaaaactg

SEQ ID NO: 4840257 - DNA, 18 bp, Homo sapiens
ttcttgtaaaactgtgac

SEQ ID NO: 4840258 - DNA, 19 bp, Homo sapiens
ttcttgtaaaactgtgaca

SEQ ID NO: 4840259 - DNA, 20 bp, Homo sapiens
ttcttgtaaaactgtgacat

SEQ ID NO: 4840260 - DNA, 14 bp, Homo sapiens
ttcttgtatctgga

SEQ ID NO: 4840261 - DNA, 21 bp, Homo sapiens
ttcttgtgtgtttattgtcaa

SEQ ID NO: 4840262 - DNA, 17 bp, Homo sapiens
ttcttgtgtttgaaaca

SEQ ID NO: 4840263 - DNA, 18 bp, Homo sapiens
ttcttgtgtttgaaacac

SEQ ID NO: 4840264 - DNA, 16 bp, Homo sapiens
ttctttataaaccata

SEQ ID NO: 4840265 - DNA, 15 bp, Homo sapiens
ttctttataatggct

SEQ ID NO: 4840266 - DNA, 19 bp, Homo sapiens
ttctttataatggctctgg

SEQ ID NO: 4840267 - DNA, 16 bp, Homo sapiens
ttctttatcacatgtt

SEQ ID NO: 4840268 - DNA, 16 bp, Homo sapiens
ttctttttgactgatt

SEQ ID NO: 4840269 - DNA, 22 bp, Homo sapiens
ttcttttttcaatgtactgtat

SEQ ID NO: 4840270 - DNA, 22 bp, Homo sapiens
ttgaaaactctcagtcagtgtc

SEQ ID NO: 4840271 - DNA, 13 bp, Homo sapiens
ttgaaactgtatt

SEQ ID NO: 4840272 - DNA, 16 bp, Homo sapiens
ttgaaattatatctgt

SEQ ID NO: 4840273 - DNA, 17 bp, Homo sapiens
ttgaaattatatctgtg

SEQ ID NO: 4840274 - DNA, 19 bp, Homo sapiens
ttgaaattatatctgtggt

SEQ ID NO: 4840275 - DNA, 15 bp, Homo sapiens
ttgaaatttctcagc

SEQ ID NO: 4840276 - DNA, 18 bp, Homo sapiens
ttgaaattttctgtacag

SEQ ID NO: 4840277 - DNA, 16 bp, Homo sapiens
ttgaaccgtcaatgtg

SEQ ID NO: 4840278 - DNA, 23 bp, Homo sapiens
ttgaacctggggttttgacttgc

SEQ ID NO: 4840279 - DNA, 18 bp, Homo sapiens
ttgaagaatattgttaaa

SEQ ID NO: 4840280 - DNA, 15 bp, Homo sapiens
ttgaagggaaatcaa

SEQ ID NO: 4840281 - DNA, 17 bp, Homo sapiens
ttgaagggaaatcaatt

SEQ ID NO: 4840282 - DNA, 15 bp, Homo sapiens
ttgaagggcccagga

SEQ ID NO: 4840283 - DNA, 18 bp, Homo sapiens
ttgaagtgcatgttaaaa

SEQ ID NO: 4840284 - DNA, 12 bp, Homo sapiens
ttgaatgataat

SEQ ID NO: 4840285 - DNA, 15 bp, Homo sapiens
ttgacactgaaataa

SEQ ID NO: 4840286 - DNA, 13 bp, Homo sapiens
ttgacagttactt

SEQ ID NO: 4840287 - DNA, 14 bp, Homo sapiens
ttgacagttactta

SEQ ID NO: 4840288 - DNA, 18 bp, Homo sapiens
ttgacagttacttacaca

SEQ ID NO: 4840289 - DNA, 13 bp, Homo sapiens
ttgacatcaactg

SEQ ID NO: 4840290 - DNA, 14 bp, Homo sapiens
ttgacattttgtag

SEQ ID NO: 4840291 - DNA, 22 bp, Homo sapiens
ttgacctcacagtgacccttcc

SEQ ID NO: 4840292 - DNA, 21 bp, Homo sapiens
ttgacctttatttattaaact

SEQ ID NO: 4840293 - DNA, 14 bp, Homo sapiens
ttgactaagaaatg

SEQ ID NO: 4840294 - DNA, 10 bp, Homo sapiens
ttgactgtta

SEQ ID NO: 4840295 - DNA, 16 bp, Homo sapiens
ttgacttcaaatgtgt

SEQ ID NO: 4840296 - DNA, 14 bp, Homo sapiens
ttgacttgccactg

SEQ ID NO: 4840297 - DNA, 16 bp, Homo sapiens
ttgacttgccactgcc

SEQ ID NO: 4840298 - DNA, 16 bp, Homo sapiens
ttgagacactgtcaag

SEQ ID NO: 4840299 - DNA, 16 bp, Homo sapiens
ttgagacttcaagctt

SEQ ID NO: 4840300 - DNA, 18 bp, Homo sapiens
ttgagagaagccacgctg

SEQ ID NO: 4840301 - DNA, 23 bp, Homo sapiens
ttgagagaagccacgctgtcctc

SEQ ID NO: 4840302 - DNA, 18 bp, Homo sapiens
ttgagcaaggcaagaagt

SEQ ID NO: 4840303 - DNA, 23 bp, Homo sapiens
ttgagcaaggcaagaagtgggat

SEQ ID NO: 4840304 - DNA, 14 bp, Homo sapiens
ttgagcagaattca

SEQ ID NO: 4840305 - DNA, 22 bp, Homo sapiens
ttgagcagtaaatgtatattga

SEQ ID NO: 4840306 - DNA, 16 bp, Homo sapiens
ttgagctcctaagctg

SEQ ID NO: 4840307 - DNA, 18 bp, Homo sapiens
ttgagctggttttctctg

SEQ ID NO: 4840308 - DNA, 18 bp, Homo sapiens
ttgaggaccctcccaggt

SEQ ID NO: 4840309 - DNA, 20 bp, Homo sapiens
ttgagggactgcctctgcca

SEQ ID NO: 4840310 - DNA, 14 bp, Homo sapiens
ttgaggggaggtgg

SEQ ID NO: 4840311 - DNA, 15 bp, Homo sapiens
ttgagggttccatgg

SEQ ID NO: 4840312 - DNA, 12 bp, Homo sapiens
ttgagtaaaact

SEQ ID NO: 4840313 - DNA, 21 bp, Homo sapiens
ttgagtggacagcagctggac

SEQ ID NO: 4840314 - DNA, 15 bp, Homo sapiens
ttgagtgggccccct

SEQ ID NO: 4840315 - DNA, 16 bp, Homo sapiens
ttgagtgggccccctc

SEQ ID NO: 4840316 - DNA, 18 bp, Homo sapiens
ttgagtgggccccctctc

SEQ ID NO: 4840317 - DNA, 15 bp, Homo sapiens
ttgagtgttcatcag

SEQ ID NO: 4840318 - DNA, 18 bp, Homo sapiens
ttgagttcttcctgtaat

SEQ ID NO: 4840319 - DNA, 17 bp, Homo sapiens
ttgagtttcatttttca

SEQ ID NO: 4840320 - DNA, 23 bp, Homo sapiens
ttgagtttgctgtatacaaacag

SEQ ID NO: 4840321 - DNA, 15 bp, Homo sapiens
ttgatacttgtaact

SEQ ID NO: 4840322 - DNA, 16 bp, Homo sapiens
ttgatacttgtaactt

SEQ ID NO: 4840323 - DNA, 18 bp, Homo sapiens
ttgatacttgtaactttt

SEQ ID NO: 4840324 - DNA, 19 bp, Homo sapiens
ttgatacttgtaacttttt

SEQ ID NO: 4840325 - DNA, 23 bp, Homo sapiens
ttgatatcctctttgagtgaagc

SEQ ID NO: 4840326 - DNA, 19 bp, Homo sapiens
ttgatattgtgtaggaaat

SEQ ID NO: 4840327 - DNA, 16 bp, Homo sapiens
ttgatatttaaaagat

SEQ ID NO: 4840328 - DNA, 20 bp, Homo sapiens
ttgatctctgttctttcata

SEQ ID NO: 4840329 - DNA, 13 bp, Homo sapiens
ttgatctcttttt

SEQ ID NO: 4840330 - DNA, 13 bp, Homo sapiens
ttgatctgtatta

SEQ ID NO: 4840331 - DNA, 22 bp, Homo sapiens
ttgatgaataaaatgtttattt

SEQ ID NO: 4840332 - DNA, 19 bp, Homo sapiens
ttgatgtattattatatat

SEQ ID NO: 4840333 - DNA, 23 bp, Homo sapiens
ttgattacataatgttagtagca

SEQ ID NO: 4840334 - DNA, 13 bp, Homo sapiens
ttgattcaaataa

SEQ ID NO: 4840335 - DNA, 21 bp, Homo sapiens
ttgattttccccctaattctt

SEQ ID NO: 4840336 - DNA, 16 bp, Homo sapiens
ttgcaacactgccaaa

SEQ ID NO: 4840337 - DNA, 21 bp, Homo sapiens
ttgcaaccttgtactttacaa

SEQ ID NO: 4840338 - DNA, 12 bp, Homo sapiens
ttgcaataagat

SEQ ID NO: 4840339 - DNA, 22 bp, Homo sapiens
ttgcaataaggatttattctca

SEQ ID NO: 4840340 - DNA, 14 bp, Homo sapiens
ttgcaattgtttaa

SEQ ID NO: 4840341 - DNA, 19 bp, Homo sapiens
ttgcacatggattcagttt

SEQ ID NO: 4840342 - DNA, 13 bp, Homo sapiens
ttgcacattagga

SEQ ID NO: 4840343 - DNA, 21 bp, Homo sapiens
ttgcactaaaagtgatgtgat

SEQ ID NO: 4840344 - DNA, 15 bp, Homo sapiens
ttgcacttctgttat

SEQ ID NO: 4840345 - DNA, 20 bp, Homo sapiens
ttgcaggaagagatgctcta

SEQ ID NO: 4840346 - DNA, 11 bp, Homo sapiens
ttgcaggaagg

SEQ ID NO: 4840347 - DNA, 15 bp, Homo sapiens
ttgcaggagttcctt

SEQ ID NO: 4840348 - DNA, 19 bp, Homo sapiens
ttgcaggagttcctttccc

SEQ ID NO: 4840349 - DNA, 22 bp, Homo sapiens
ttgcaggagttcctttccctcc

SEQ ID NO: 4840350 - DNA, 14 bp, Homo sapiens
ttgcagtcagaaga

SEQ ID NO: 4840351 - DNA, 19 bp, Homo sapiens
ttgcagtcagaagatcttt

SEQ ID NO: 4840352 - DNA, 17 bp, Homo sapiens
ttgcagtcatcagaagt

SEQ ID NO: 4840353 - DNA, 14 bp, Homo sapiens
ttgcagttagactc

SEQ ID NO: 4840354 - DNA, 17 bp, Homo sapiens
ttgcatgccttttgggt

SEQ ID NO: 4840355 - DNA, 19 bp, Homo sapiens
ttgccatttgtatactttt

SEQ ID NO: 4840356 - DNA, 21 bp, Homo sapiens
ttgcctcattttgcttcccat

SEQ ID NO: 4840357 - DNA, 23 bp, Homo sapiens
ttgcctccaggaccttgcttcct

SEQ ID NO: 4840358 - DNA, 15 bp, Homo sapiens
ttgcctgaagaaaca

SEQ ID NO: 4840359 - DNA, 16 bp, Homo sapiens
ttgcctttaggcagga

SEQ ID NO: 4840360 - DNA, 18 bp, Homo sapiens
ttgcctttaggcaggaag

SEQ ID NO: 4840361 - DNA, 23 bp, Homo sapiens
ttgcctttaggcaggaagtcagg

SEQ ID NO: 4840362 - DNA, 13 bp, Homo sapiens
ttgcgctctgggt

SEQ ID NO: 4840363 - DNA, 13 bp, Homo sapiens
ttgctaaagtcag

SEQ ID NO: 4840364 - DNA, 20 bp, Homo sapiens
ttgctaagtgaggatgaaaa

SEQ ID NO: 4840365 - DNA, 21 bp, Homo sapiens
ttgctacatcagagtgtattt

SEQ ID NO: 4840366 - DNA, 22 bp, Homo sapiens
ttgctacatcagagtgtatttt

SEQ ID NO: 4840367 - DNA, 20 bp, Homo sapiens
ttgctagcaacaacttacta

SEQ ID NO: 4840368 - DNA, 16 bp, Homo sapiens
ttgctattgtttatag

SEQ ID NO: 4840369 - DNA, 21 bp, Homo sapiens
ttgctcaccaagctgttccac

SEQ ID NO: 4840370 - DNA, 15 bp, Homo sapiens
ttgctcataagtaaa

SEQ ID NO: 4840371 - DNA, 15 bp, Homo sapiens
ttgctccattcctga

SEQ ID NO: 4840372 - DNA, 15 bp, Homo sapiens
ttgctccttgaataa

SEQ ID NO: 4840373 - DNA, 19 bp, Homo sapiens
ttgctcctttccatcagct

SEQ ID NO: 4840374 - DNA, 18 bp, Homo sapiens
ttgctctctcattcccag

SEQ ID NO: 4840375 - DNA, 21 bp, Homo sapiens
ttgctcttaagtaccagaagc

SEQ ID NO: 4840376 - DNA, 21 bp, Homo sapiens
ttgctgaataacaacaattta

SEQ ID NO: 4840377 - DNA, 14 bp, Homo sapiens
ttgctggaaaactg

SEQ ID NO: 4840378 - DNA, 17 bp, Homo sapiens
ttgctggaaaactgcca

SEQ ID NO: 4840379 - DNA, 19 bp, Homo sapiens
ttgctggaaaactgccaca

SEQ ID NO: 4840380 - DNA, 22 bp, Homo sapiens
ttgctggaaaactgccacaagc

SEQ ID NO: 4840381 - DNA, 17 bp, Homo sapiens
ttgctgtatacaaacag

SEQ ID NO: 4840382 - DNA, 17 bp, Homo sapiens
ttgctgtttatatatat

SEQ ID NO: 4840383 - DNA, 17 bp, Homo sapiens
ttgcttaatctagagct

SEQ ID NO: 4840384 - DNA, 14 bp, Homo sapiens
ttgcttatttatat

SEQ ID NO: 4840385 - DNA, 14 bp, Homo sapiens
ttgcttcatctgga

SEQ ID NO: 4840386 - DNA, 15 bp, Homo sapiens
ttgcttcatctggag

SEQ ID NO: 4840387 - DNA, 23 bp, Homo sapiens
ttgcttccttctcatcttgcctc

SEQ ID NO: 4840388 - DNA, 19 bp, Homo sapiens
ttgcttcttgtgtttgaaa

SEQ ID NO: 4840389 - DNA, 17 bp, Homo sapiens
ttgcttggactacctat

SEQ ID NO: 4840390 - DNA, 23 bp, Homo sapiens
ttggaacagacctcactgctttg

SEQ ID NO: 4840391 - DNA, 11 bp, Homo sapiens
ttggaaggaac

SEQ ID NO: 4840392 - DNA, 19 bp, Homo sapiens
ttggaaggaacgtcccctg

SEQ ID NO: 4840393 - DNA, 23 bp, Homo sapiens
ttggaagggcgctgagggcaggg

SEQ ID NO: 4840394 - DNA, 13 bp, Homo sapiens
ttggaattcaatg

SEQ ID NO: 4840395 - DNA, 13 bp, Homo sapiens
ttggaattctgct

SEQ ID NO: 4840396 - DNA, 14 bp, Homo sapiens
ttggaattctgctt

SEQ ID NO: 4840397 - DNA, 14 bp, Homo sapiens
ttggaatttgctta

SEQ ID NO: 4840398 - DNA, 23 bp, Homo sapiens
ttggacagcaaaaccattgcttc

SEQ ID NO: 4840399 - DNA, 19 bp, Homo sapiens
ttggagaggaggtgtggag

SEQ ID NO: 4840400 - DNA, 22 bp, Homo sapiens
ttggagcagagacggcagcccc

SEQ ID NO: 4840401 - DNA, 23 bp, Homo sapiens
ttggagtgccacatggccgctgc

SEQ ID NO: 4840402 - DNA, 14 bp, Homo sapiens
ttggagtgccacgt

SEQ ID NO: 4840403 - DNA, 21 bp, Homo sapiens
ttggataataactagatctcc

SEQ ID NO: 4840404 - DNA, 20 bp, Homo sapiens
ttggataggagcttccagat

SEQ ID NO: 4840405 - DNA, 21 bp, Homo sapiens
ttggatggcttaagcctgtgt

SEQ ID NO: 4840406 - DNA, 22 bp, Homo sapiens
ttggatggcttaagcctgtgta

SEQ ID NO: 4840407 - DNA, 20 bp, Homo sapiens
ttggattggtaccagagcct

SEQ ID NO: 4840408 - DNA, 11 bp, Homo sapiens
ttggcaccaaa

SEQ ID NO: 4840409 - DNA, 11 bp, Homo sapiens
ttggcccagca

SEQ ID NO: 4840410 - DNA, 19 bp, Homo sapiens
ttggccgattagaaggcag

SEQ ID NO: 4840411 - DNA, 14 bp, Homo sapiens
ttggccggctggcc

SEQ ID NO: 4840412 - DNA, 23 bp, Homo sapiens
ttggcctagcccaccctgctgcc

SEQ ID NO: 4840413 - DNA, 13 bp, Homo sapiens
ttggcctctgccc

SEQ ID NO: 4840414 - DNA, 16 bp, Homo sapiens
ttggccttaactggcc

SEQ ID NO: 4840415 - DNA, 16 bp, Homo sapiens
ttggctagtctgtgcc

SEQ ID NO: 4840416 - DNA, 19 bp, Homo sapiens
ttggctagtctgtgcctca

SEQ ID NO: 4840417 - DNA, 15 bp, Homo sapiens
ttggctgaaattatg

SEQ ID NO: 4840418 - DNA, 15 bp, Homo sapiens
ttgggaaacactttg

SEQ ID NO: 4840419 - DNA, 19 bp, Homo sapiens
ttgggaagcagtttcagat

SEQ ID NO: 4840420 - DNA, 20 bp, Homo sapiens
ttgggacggaagtggcctga

SEQ ID NO: 4840421 - DNA, 22 bp, Homo sapiens
ttgggattcctcccctggaagt

SEQ ID NO: 4840422 - DNA, 18 bp, Homo sapiens
ttgggcccttagaatgtg

SEQ ID NO: 4840423 - DNA, 19 bp, Homo sapiens
ttggggaagaacgaagcca

SEQ ID NO: 4840424 - DNA, 19 bp, Homo sapiens
ttggggaaggggcctgggc

SEQ ID NO: 4840425 - DNA, 22 bp, Homo sapiens
ttggggaaggggcctgggctgt

SEQ ID NO: 4840426 - DNA, 23 bp, Homo sapiens
ttggggctcctttcccctctcat

SEQ ID NO: 4840427 - DNA, 20 bp, Homo sapiens
ttggggcttatcagaactcc

SEQ ID NO: 4840428 - DNA, 15 bp, Homo sapiens
ttgggggtttttaat

SEQ ID NO: 4840429 - DNA, 16 bp, Homo sapiens
ttggggtagagaggac

SEQ ID NO: 4840430 - DNA, 12 bp, Homo sapiens
ttgggtggagga

SEQ ID NO: 4840431 - DNA, 16 bp, Homo sapiens
ttgggttttcttccct

SEQ ID NO: 4840432 - DNA, 19 bp, Homo sapiens
ttggtaacttgctgtgaaa

SEQ ID NO: 4840433 - DNA, 17 bp, Homo sapiens
ttggtatttactgcaat

SEQ ID NO: 4840434 - DNA, 22 bp, Homo sapiens
ttggtcacaaagctatttaagt

SEQ ID NO: 4840435 - DNA, 16 bp, Homo sapiens
ttggtctctttctttc

SEQ ID NO: 4840436 - DNA, 18 bp, Homo sapiens
ttggtctgtgttctcaac

SEQ ID NO: 4840437 - DNA, 12 bp, Homo sapiens
ttggtgaataac

SEQ ID NO: 4840438 - DNA, 23 bp, Homo sapiens
ttggttccacaatcatctattga

SEQ ID NO: 4840439 - DNA, 14 bp, Homo sapiens
ttggttgcaattgt

SEQ ID NO: 4840440 - DNA, 19 bp, Homo sapiens
ttggttttgcatgtctgca

SEQ ID NO: 4840441 - DNA, 13 bp, Homo sapiens
ttgtaaaacagtg

SEQ ID NO: 4840442 - DNA, 13 bp, Homo sapiens
ttgtaaaactgtg

SEQ ID NO: 4840443 - DNA, 19 bp, Homo sapiens
ttgtaaaactgtgacattc

SEQ ID NO: 4840444 - DNA, 23 bp, Homo sapiens
ttgtaaaactgtgacattccaca

SEQ ID NO: 4840445 - DNA, 18 bp, Homo sapiens
ttgtaaaatgtattatgt

SEQ ID NO: 4840446 - DNA, 15 bp, Homo sapiens
ttgtaaaattccatg

SEQ ID NO: 4840447 - DNA, 13 bp, Homo sapiens
ttgtaaagatatt

SEQ ID NO: 4840448 - DNA, 19 bp, Homo sapiens
ttgtaaagatattgtatct

SEQ ID NO: 4840449 - DNA, 20 bp, Homo sapiens
ttgtaaagatattgtatctc

SEQ ID NO: 4840450 - DNA, 22 bp, Homo sapiens
ttgtaaagatattgtatctcct

SEQ ID NO: 4840451 - DNA, 23 bp, Homo sapiens
ttgtaaagatattgtatctcctt

SEQ ID NO: 4840452 - DNA, 19 bp, Homo sapiens
ttgtaaataatgcttaaca

SEQ ID NO: 4840453 - DNA, 12 bp, Homo sapiens
ttgtaactcttt

SEQ ID NO: 4840454 - DNA, 16 bp, Homo sapiens
ttgtaactctttggct

SEQ ID NO: 4840455 - DNA, 21 bp, Homo sapiens
ttgtaactctttggctattgt

SEQ ID NO: 4840456 - DNA, 15 bp, Homo sapiens
ttgtaatataagaca

SEQ ID NO: 4840457 - DNA, 13 bp, Homo sapiens
ttgtaatatcagt

SEQ ID NO: 4840458 - DNA, 19 bp, Homo sapiens
ttgtaatatcagttacagt

SEQ ID NO: 4840459 - DNA, 14 bp, Homo sapiens
ttgtaatgtatctt

SEQ ID NO: 4840460 - DNA, 20 bp, Homo sapiens
ttgtacagtttgtttacaca

SEQ ID NO: 4840461 - DNA, 18 bp, Homo sapiens
ttgtaccagcccaggcaa

SEQ ID NO: 4840462 - DNA, 15 bp, Homo sapiens
ttgtacgtgttatta

SEQ ID NO: 4840463 - DNA, 16 bp, Homo sapiens
ttgtacgttaattaaa

SEQ ID NO: 4840464 - DNA, 14 bp, Homo sapiens
ttgtacttgaataa

SEQ ID NO: 4840465 - DNA, 16 bp, Homo sapiens
ttgtagcctaatattc

SEQ ID NO: 4840466 - DNA, 18 bp, Homo sapiens
ttgtagcctaatattcat

SEQ ID NO: 4840467 - DNA, 22 bp, Homo sapiens
ttgtagcctaatattcatgctg

SEQ ID NO: 4840468 - DNA, 16 bp, Homo sapiens
ttgtagctagtttaaa

SEQ ID NO: 4840469 - DNA, 19 bp, Homo sapiens
ttgtaggtcaatgaaatat

SEQ ID NO: 4840470 - DNA, 20 bp, Homo sapiens
ttgtagtagttgatgaccaa

SEQ ID NO: 4840471 - DNA, 13 bp, Homo sapiens
ttgtataaaacag

SEQ ID NO: 4840472 - DNA, 17 bp, Homo sapiens
ttgtatgaaatatatgt

SEQ ID NO: 4840473 - DNA, 22 bp, Homo sapiens
ttgtattagtaataaaacatta

SEQ ID NO: 4840474 - DNA, 16 bp, Homo sapiens
ttgtattatcagtgaa

SEQ ID NO: 4840475 - DNA, 23 bp, Homo sapiens
ttgtattatcagtgaatataaat

SEQ ID NO: 4840476 - DNA, 14 bp, Homo sapiens
ttgtattatcatat

SEQ ID NO: 4840477 - DNA, 19 bp, Homo sapiens
ttgtattatcatatatgct

SEQ ID NO: 4840478 - DNA, 20 bp, Homo sapiens
ttgtattcctgcctttgatg

SEQ ID NO: 4840479 - DNA, 18 bp, Homo sapiens
ttgtattgttagatgttt

SEQ ID NO: 4840480 - DNA, 11 bp, Homo sapiens
ttgtattttaa

SEQ ID NO: 4840481 - DNA, 21 bp, Homo sapiens
ttgtcatgactttcagattgt

SEQ ID NO: 4840482 - DNA, 21 bp, Homo sapiens
ttgtccacaaatgtcctcaga

SEQ ID NO: 4840483 - DNA, 20 bp, Homo sapiens
ttgtccattccaatacattg

SEQ ID NO: 4840484 - DNA, 20 bp, Homo sapiens
ttgtcctgtgtcatctgtca

SEQ ID NO: 4840485 - DNA, 16 bp, Homo sapiens
ttgtccttgtgtatcc

SEQ ID NO: 4840486 - DNA, 16 bp, Homo sapiens
ttgtcctttatgtatt

SEQ ID NO: 4840487 - DNA, 17 bp, Homo sapiens
ttgtcctttatgtattc

SEQ ID NO: 4840488 - DNA, 18 bp, Homo sapiens
ttgtctcacgattccagt

SEQ ID NO: 4840489 - DNA, 16 bp, Homo sapiens
ttgtctgaaattttct

SEQ ID NO: 4840490 - DNA, 15 bp, Homo sapiens
ttgtctgctgcctcc

SEQ ID NO: 4840491 - DNA, 16 bp, Homo sapiens
ttgtctgctgcctcca

SEQ ID NO: 4840492 - DNA, 16 bp, Homo sapiens
ttgtctggctgtggcc

SEQ ID NO: 4840493 - DNA, 13 bp, Homo sapiens
ttgtctgtaaatc

SEQ ID NO: 4840494 - DNA, 14 bp, Homo sapiens
ttgtcttacaactg

SEQ ID NO: 4840495 - DNA, 16 bp, Homo sapiens
ttgtcttacaactgac

SEQ ID NO: 4840496 - DNA, 23 bp, Homo sapiens
ttgtcttattcctaattcctgta

SEQ ID NO: 4840497 - DNA, 20 bp, Homo sapiens
ttgtgaaaggaaagaggctc

SEQ ID NO: 4840498 - DNA, 20 bp, Homo sapiens
ttgtgaaagtggcaagctct

SEQ ID NO: 4840499 - DNA, 21 bp, Homo sapiens
ttgtgaagaaacatttatctt

SEQ ID NO: 4840500 - DNA, 22 bp, Homo sapiens
ttgtgaatggttgcaaagtgtt

SEQ ID NO: 4840501 - DNA, 16 bp, Homo sapiens
ttgtgaatgttgtcct

SEQ ID NO: 4840502 - DNA, 17 bp, Homo sapiens
ttgtgacaggaaagccc

SEQ ID NO: 4840503 - DNA, 16 bp, Homo sapiens
ttgtgagccaaagaga

SEQ ID NO: 4840504 - DNA, 14 bp, Homo sapiens
ttgtgatctgttgt

SEQ ID NO: 4840505 - DNA, 14 bp, Homo sapiens
ttgtgccaaagata

SEQ ID NO: 4840506 - DNA, 19 bp, Homo sapiens
ttgtgccaaagatagcaga

SEQ ID NO: 4840507 - DNA, 16 bp, Homo sapiens
ttgtgccctgtagctc

SEQ ID NO: 4840508 - DNA, 21 bp, Homo sapiens
ttgtgcggtgtgtctccagct

SEQ ID NO: 4840509 - DNA, 21 bp, Homo sapiens
ttgtgctgtgggcagcaccct

SEQ ID NO: 4840510 - DNA, 15 bp, Homo sapiens
ttgtggataagaaaa

SEQ ID NO: 4840511 - DNA, 22 bp, Homo sapiens
ttgtggctgtcaaatccatgtg

SEQ ID NO: 4840512 - DNA, 16 bp, Homo sapiens
ttgtgtatcctgacag

SEQ ID NO: 4840513 - DNA, 14 bp, Homo sapiens
ttgtgtcttttgtt

SEQ ID NO: 4840514 - DNA, 22 bp, Homo sapiens
ttgtgtgagggcaaaccaggct

SEQ ID NO: 4840515 - DNA, 17 bp, Homo sapiens
ttgtgtgcttcacacaa

SEQ ID NO: 4840516 - DNA, 16 bp, Homo sapiens
ttgtgtggagaagtgt

SEQ ID NO: 4840517 - DNA, 23 bp, Homo sapiens
ttgtgtgggtttactctgtgcta

SEQ ID NO: 4840518 - DNA, 12 bp, Homo sapiens
ttgtgtgtatgt

SEQ ID NO: 4840519 - DNA, 19 bp, Homo sapiens
ttgtgttacaataagtgtt

SEQ ID NO: 4840520 - DNA, 18 bp, Homo sapiens
ttgtgttggtatttactg

SEQ ID NO: 4840521 - DNA, 15 bp, Homo sapiens
ttgtgttttgtccaa

SEQ ID NO: 4840522 - DNA, 22 bp, Homo sapiens
ttgttaatatcactcattaatt

SEQ ID NO: 4840523 - DNA, 13 bp, Homo sapiens
ttgttacaatttt

SEQ ID NO: 4840524 - DNA, 22 bp, Homo sapiens
ttgttaggggtgggggagaatg

SEQ ID NO: 4840525 - DNA, 14 bp, Homo sapiens
ttgttattaaatgt

SEQ ID NO: 4840526 - DNA, 15 bp, Homo sapiens
ttgttattaaatgta

SEQ ID NO: 4840527 - DNA, 21 bp, Homo sapiens
ttgttcaaagaacccccctcc

SEQ ID NO: 4840528 - DNA, 15 bp, Homo sapiens
ttgttcaaatgcatt

SEQ ID NO: 4840529 - DNA, 13 bp, Homo sapiens
ttgttcctttctg

SEQ ID NO: 4840530 - DNA, 23 bp, Homo sapiens
ttgttcgatcgtttcacatctgt

SEQ ID NO: 4840531 - DNA, 22 bp, Homo sapiens
ttgttctccgggtgtggcctca

SEQ ID NO: 4840532 - DNA, 14 bp, Homo sapiens
ttgttctctcttgg

SEQ ID NO: 4840533 - DNA, 15 bp, Homo sapiens
ttgttgtattcctgc

SEQ ID NO: 4840534 - DNA, 14 bp, Homo sapiens
ttgtttaatgcaaa

SEQ ID NO: 4840535 - DNA, 12 bp, Homo sapiens
ttgtttaattgt

SEQ ID NO: 4840536 - DNA, 14 bp, Homo sapiens
ttgtttaattgtag

SEQ ID NO: 4840537 - DNA, 18 bp, Homo sapiens
ttgtttgtaaaagagctg

SEQ ID NO: 4840538 - DNA, 19 bp, Homo sapiens
ttgtttgttaataaagtgc

SEQ ID NO: 4840539 - DNA, 12 bp, Homo sapiens
ttgttttttcat

SEQ ID NO: 4840540 - DNA, 17 bp, Homo sapiens
ttgttttttctttataa

SEQ ID NO: 4840541 - DNA, 20 bp, Homo sapiens
tttaaaaaaaatattctgtc

SEQ ID NO: 4840542 - DNA, 19 bp, Homo sapiens
tttaaaaaaataatataaa

SEQ ID NO: 4840543 - DNA, 22 bp, Homo sapiens
tttaaaaaaataatataaatga

SEQ ID NO: 4840544 - DNA, 14 bp, Homo sapiens
tttaaaaaatgaat

SEQ ID NO: 4840545 - DNA, 16 bp, Homo sapiens
tttaaaagatccattt

SEQ ID NO: 4840546 - DNA, 19 bp, Homo sapiens
tttaaaatggcatttagca

SEQ ID NO: 4840547 - DNA, 14 bp, Homo sapiens
tttaaaattattaa

SEQ ID NO: 4840548 - DNA, 21 bp, Homo sapiens
tttaaaattattaaaaattat

SEQ ID NO: 4840549 - DNA, 23 bp, Homo sapiens
tttaaacaaaatttatgtcattt

SEQ ID NO: 4840550 - DNA, 16 bp, Homo sapiens
tttaaatcagatacct

SEQ ID NO: 4840551 - DNA, 19 bp, Homo sapiens
tttaaatctttgttaaaat

SEQ ID NO: 4840552 - DNA, 22 bp, Homo sapiens
tttaaatctttgttaaaatata

SEQ ID NO: 4840553 - DNA, 23 bp, Homo sapiens
tttaaatctttgttaaaatatag

SEQ ID NO: 4840554 - DNA, 18 bp, Homo sapiens
tttaacatagcagctggt

SEQ ID NO: 4840555 - DNA, 22 bp, Homo sapiens
tttaacatagcagctggttaac

SEQ ID NO: 4840556 - DNA, 20 bp, Homo sapiens
tttaacgtgaggtttcagta

SEQ ID NO: 4840557 - DNA, 14 bp, Homo sapiens
tttaactttaccat

SEQ ID NO: 4840558 - DNA, 21 bp, Homo sapiens
tttaagaaatgagaaattgtg

SEQ ID NO: 4840559 - DNA, 13 bp, Homo sapiens
tttaagaatcatg

SEQ ID NO: 4840560 - DNA, 21 bp, Homo sapiens
tttaagcacaaaaaatttaag

SEQ ID NO: 4840561 - DNA, 21 bp, Homo sapiens
tttaagcattttactgtctgt

SEQ ID NO: 4840562 - DNA, 17 bp, Homo sapiens
tttaagccaatataatg

SEQ ID NO: 4840563 - DNA, 14 bp, Homo sapiens
tttaagtagatttc

SEQ ID NO: 4840564 - DNA, 16 bp, Homo sapiens
tttaagtggactgtat

SEQ ID NO: 4840565 - DNA, 17 bp, Homo sapiens
tttaagtggactgtatt

SEQ ID NO: 4840566 - DNA, 18 bp, Homo sapiens
tttaagtggactgtattt

SEQ ID NO: 4840567 - DNA, 22 bp, Homo sapiens
tttaagtggactgtatttcggc

SEQ ID NO: 4840568 - DNA, 22 bp, Homo sapiens
tttaatatactccttaaaaatg

SEQ ID NO: 4840569 - DNA, 10 bp, Homo sapiens
tttaatcatt

SEQ ID NO: 4840570 - DNA, 14 bp, Homo sapiens
tttaatctcttgtc

SEQ ID NO: 4840571 - DNA, 17 bp, Homo sapiens
tttaatctttgtgacag

SEQ ID NO: 4840572 - DNA, 17 bp, Homo sapiens
tttaatgtttgtaagca

SEQ ID NO: 4840573 - DNA, 21 bp, Homo sapiens
tttaattcttaccgaaatgaa

SEQ ID NO: 4840574 - DNA, 14 bp, Homo sapiens
tttaatttatttca

SEQ ID NO: 4840575 - DNA, 17 bp, Homo sapiens
tttaatttcctgtgagg

SEQ ID NO: 4840576 - DNA, 18 bp, Homo sapiens
tttaatttcctgtgagga

SEQ ID NO: 4840577 - DNA, 12 bp, Homo sapiens
tttacaaagaaa

SEQ ID NO: 4840578 - DNA, 15 bp, Homo sapiens
tttacaatgtattaa

SEQ ID NO: 4840579 - DNA, 20 bp, Homo sapiens
tttacagtgaagaaagcctg

SEQ ID NO: 4840580 - DNA, 20 bp, Homo sapiens
tttaccatcaaacaaatcat

SEQ ID NO: 4840581 - DNA, 21 bp, Homo sapiens
tttaccatgctcaatgaaaag

SEQ ID NO: 4840582 - DNA, 22 bp, Homo sapiens
tttacccagtgggacagaggag

SEQ ID NO: 4840583 - DNA, 16 bp, Homo sapiens
tttactaacactggct

SEQ ID NO: 4840584 - DNA, 17 bp, Homo sapiens
tttactaacagtaactg

SEQ ID NO: 4840585 - DNA, 17 bp, Homo sapiens
tttactcaggctttcta

SEQ ID NO: 4840586 - DNA, 19 bp, Homo sapiens
tttactgtctgtaagagaa

SEQ ID NO: 4840587 - DNA, 21 bp, Homo sapiens
tttagaatattaaaaattaat

SEQ ID NO: 4840588 - DNA, 19 bp, Homo sapiens
tttagactaagggcaggaa

SEQ ID NO: 4840589 - DNA, 21 bp, Homo sapiens
tttagagtatgcaagaagaat

SEQ ID NO: 4840590 - DNA, 13 bp, Homo sapiens
tttagcacagtat

SEQ ID NO: 4840591 - DNA, 18 bp, Homo sapiens
tttagcagttctgcaaat

SEQ ID NO: 4840592 - DNA, 13 bp, Homo sapiens
tttagctgtgcag

SEQ ID NO: 4840593 - DNA, 23 bp, Homo sapiens
tttagtaaaattatctgttctat

SEQ ID NO: 4840594 - DNA, 12 bp, Homo sapiens
tttataaatgaa

SEQ ID NO: 4840595 - DNA, 14 bp, Homo sapiens
tttataaatgaaga

SEQ ID NO: 4840596 - DNA, 18 bp, Homo sapiens
tttataaattaaatatat

SEQ ID NO: 4840597 - DNA, 15 bp, Homo sapiens
tttataacaattgat

SEQ ID NO: 4840598 - DNA, 20 bp, Homo sapiens
tttataacattgtaaatgat

SEQ ID NO: 4840599 - DNA, 15 bp, Homo sapiens
tttataataaactgt

SEQ ID NO: 4840600 - DNA, 23 bp, Homo sapiens
tttatatattataagttgacctt

SEQ ID NO: 4840601 - DNA, 15 bp, Homo sapiens
tttatatgattaaat

SEQ ID NO: 4840602 - DNA, 19 bp, Homo sapiens
tttatatgattaaattatc

SEQ ID NO: 4840603 - DNA, 22 bp, Homo sapiens
tttatattcagagatgtaccat

SEQ ID NO: 4840604 - DNA, 11 bp, Homo sapiens
tttatccacat

SEQ ID NO: 4840605 - DNA, 14 bp, Homo sapiens
tttatccacattgt

SEQ ID NO: 4840606 - DNA, 16 bp, Homo sapiens
tttatctcttcttcct

SEQ ID NO: 4840607 - DNA, 23 bp, Homo sapiens
tttatctgtctgagccctgccct

SEQ ID NO: 4840608 - DNA, 14 bp, Homo sapiens
tttatgaagatagt

SEQ ID NO: 4840609 - DNA, 17 bp, Homo sapiens
tttatgatttcatgatt

SEQ ID NO: 4840610 - DNA, 20 bp, Homo sapiens
tttatgcatgagaactaaat

SEQ ID NO: 4840611 - DNA, 10 bp, Homo sapiens
tttatgcatt

SEQ ID NO: 4840612 - DNA, 11 bp, Homo sapiens
tttatgcattt

SEQ ID NO: 4840613 - DNA, 15 bp, Homo sapiens
tttatgcatttatgc

SEQ ID NO: 4840614 - DNA, 19 bp, Homo sapiens
tttatgcatttatgcatga

SEQ ID NO: 4840615 - DNA, 17 bp, Homo sapiens
tttatgtcattttcaga

SEQ ID NO: 4840616 - DNA, 13 bp, Homo sapiens
tttattaaatgtt

SEQ ID NO: 4840617 - DNA, 14 bp, Homo sapiens
tttattaaatttat

SEQ ID NO: 4840618 - DNA, 15 bp, Homo sapiens
tttattattttcata

SEQ ID NO: 4840619 - DNA, 15 bp, Homo sapiens
tttattttagcagtt

SEQ ID NO: 4840620 - DNA, 21 bp, Homo sapiens
tttattttatataataaagta

SEQ ID NO: 4840621 - DNA, 21 bp, Homo sapiens
tttattttgtatgaaatatat

SEQ ID NO: 4840622 - DNA, 13 bp, Homo sapiens
tttatttttctgt

SEQ ID NO: 4840623 - DNA, 15 bp, Homo sapiens
tttatttttctgtta

SEQ ID NO: 4840624 - DNA, 14 bp, Homo sapiens
tttattttttgtaa

SEQ ID NO: 4840625 - DNA, 17 bp, Homo sapiens
tttattttttgtaactc

SEQ ID NO: 4840626 - DNA, 19 bp, Homo sapiens
tttcaaagtgcacacacac

SEQ ID NO: 4840627 - DNA, 22 bp, Homo sapiens
tttcaagatctaaatcatatat

SEQ ID NO: 4840628 - DNA, 15 bp, Homo sapiens
tttcaaggcacattg

SEQ ID NO: 4840629 - DNA, 16 bp, Homo sapiens
tttcaaggcacattga

SEQ ID NO: 4840630 - DNA, 12 bp, Homo sapiens
tttcaagttgca

SEQ ID NO: 4840631 - DNA, 15 bp, Homo sapiens
tttcacgattcattt

SEQ ID NO: 4840632 - DNA, 19 bp, Homo sapiens
tttcacttaaactttgtca

SEQ ID NO: 4840633 - DNA, 23 bp, Homo sapiens
tttcagaaagggcagcccctccc

SEQ ID NO: 4840634 - DNA, 16 bp, Homo sapiens
tttcagataaatcatg

SEQ ID NO: 4840635 - DNA, 17 bp, Homo sapiens
tttcagataaatcatgg

SEQ ID NO: 4840636 - DNA, 16 bp, Homo sapiens
tttcaggtgctcaaaa

SEQ ID NO: 4840637 - DNA, 12 bp, Homo sapiens
tttcataaaaat

SEQ ID NO: 4840638 - DNA, 14 bp, Homo sapiens
tttcataggaagac

SEQ ID NO: 4840639 - DNA, 19 bp, Homo sapiens
tttcataggaagacacatt

SEQ ID NO: 4840640 - DNA, 23 bp, Homo sapiens
tttcatataggaatagaaacatg

SEQ ID NO: 4840641 - DNA, 17 bp, Homo sapiens
tttcatatttttcaaaa

SEQ ID NO: 4840642 - DNA, 18 bp, Homo sapiens
tttcatatttttcaaaat

SEQ ID NO: 4840643 - DNA, 17 bp, Homo sapiens
tttcatccagtttgttc

SEQ ID NO: 4840644 - DNA, 19 bp, Homo sapiens
tttcatgattagacaatgt

SEQ ID NO: 4840645 - DNA, 14 bp, Homo sapiens
tttcatgtaaataa

SEQ ID NO: 4840646 - DNA, 16 bp, Homo sapiens
tttcatgttctgtgtc

SEQ ID NO: 4840647 - DNA, 15 bp, Homo sapiens
tttcattctggtcct

SEQ ID NO: 4840648 - DNA, 16 bp, Homo sapiens
tttcattctggtcctt

SEQ ID NO: 4840649 - DNA, 18 bp, Homo sapiens
tttcatttaggtgaggaa

SEQ ID NO: 4840650 - DNA, 16 bp, Homo sapiens
tttcatttttcatttt

SEQ ID NO: 4840651 - DNA, 12 bp, Homo sapiens
tttccagaattg

SEQ ID NO: 4840652 - DNA, 14 bp, Homo sapiens
tttccagtgctgct

SEQ ID NO: 4840653 - DNA, 15 bp, Homo sapiens
tttccagtgctgctc

SEQ ID NO: 4840654 - DNA, 14 bp, Homo sapiens
tttccatcagcttt

SEQ ID NO: 4840655 - DNA, 16 bp, Homo sapiens
tttcccacactgtgaa

SEQ ID NO: 4840656 - DNA, 18 bp, Homo sapiens
tttcccacactgtgaact

SEQ ID NO: 4840657 - DNA, 18 bp, Homo sapiens
tttccccaattatcctcc

SEQ ID NO: 4840658 - DNA, 13 bp, Homo sapiens
tttccccactgaa

SEQ ID NO: 4840659 - DNA, 18 bp, Homo sapiens
tttcccctgtggtttgtt

SEQ ID NO: 4840660 - DNA, 16 bp, Homo sapiens
tttccctcagaaaatg

SEQ ID NO: 4840661 - DNA, 18 bp, Homo sapiens
tttccgaagaccttctga

SEQ ID NO: 4840662 - DNA, 20 bp, Homo sapiens
tttcctcctcccaacagttt

SEQ ID NO: 4840663 - DNA, 16 bp, Homo sapiens
tttcctctcctctctg

SEQ ID NO: 4840664 - DNA, 17 bp, Homo sapiens
tttcctctcctctctgg

SEQ ID NO: 4840665 - DNA, 18 bp, Homo sapiens
tttcctgatcaaggtgct

SEQ ID NO: 4840666 - DNA, 15 bp, Homo sapiens
tttcctgctcctcca

SEQ ID NO: 4840667 - DNA, 12 bp, Homo sapiens
tttcctgggagt

SEQ ID NO: 4840668 - DNA, 13 bp, Homo sapiens
tttcctgggtgct

SEQ ID NO: 4840669 - DNA, 12 bp, Homo sapiens
tttcctgtcaat

SEQ ID NO: 4840670 - DNA, 12 bp, Homo sapiens
tttcctgtgagg

SEQ ID NO: 4840671 - DNA, 13 bp, Homo sapiens
tttcctgtgagga

SEQ ID NO: 4840672 - DNA, 19 bp, Homo sapiens
tttcctttcatcctcagca

SEQ ID NO: 4840673 - DNA, 21 bp, Homo sapiens
tttcctttgacctctcacttt

SEQ ID NO: 4840674 - DNA, 20 bp, Homo sapiens
tttcgacgcttaacctttcc

SEQ ID NO: 4840675 - DNA, 23 bp, Homo sapiens
tttcgtgtttttggttttctcct

SEQ ID NO: 4840676 - DNA, 14 bp, Homo sapiens
tttcgttaagcagt

SEQ ID NO: 4840677 - DNA, 15 bp, Homo sapiens
tttcgttaagcagta

SEQ ID NO: 4840678 - DNA, 15 bp, Homo sapiens
tttctaaaaagtcag

SEQ ID NO: 4840679 - DNA, 17 bp, Homo sapiens
tttctaaaaagtcagat

SEQ ID NO: 4840680 - DNA, 20 bp, Homo sapiens
tttctaaaaagtcagatgtt

SEQ ID NO: 4840681 - DNA, 23 bp, Homo sapiens
tttctaaaacccttggtctgtgt

SEQ ID NO: 4840682 - DNA, 17 bp, Homo sapiens
tttctaaatttgataat

SEQ ID NO: 4840683 - DNA, 14 bp, Homo sapiens
tttctactttaaat

SEQ ID NO: 4840684 - DNA, 15 bp, Homo sapiens
tttctagaatactaa

SEQ ID NO: 4840685 - DNA, 14 bp, Homo sapiens
tttctatatttgga

SEQ ID NO: 4840686 - DNA, 17 bp, Homo sapiens
tttctatggattcactt

SEQ ID NO: 4840687 - DNA, 18 bp, Homo sapiens
tttctatggattcacttc

SEQ ID NO: 4840688 - DNA, 14 bp, Homo sapiens
tttctattccttct

SEQ ID NO: 4840689 - DNA, 22 bp, Homo sapiens
tttctcacactctaactgtata

SEQ ID NO: 4840690 - DNA, 16 bp, Homo sapiens
tttctccattaaactt

SEQ ID NO: 4840691 - DNA, 23 bp, Homo sapiens
tttctcctggaaaacctcagcat

SEQ ID NO: 4840692 - DNA, 14 bp, Homo sapiens
tttctccttcccaa

SEQ ID NO: 4840693 - DNA, 23 bp, Homo sapiens
tttctcgggtgcatttgagagaa

SEQ ID NO: 4840694 - DNA, 12 bp, Homo sapiens
tttctctctgtg

SEQ ID NO: 4840695 - DNA, 13 bp, Homo sapiens
tttctcttaagct

SEQ ID NO: 4840696 - DNA, 15 bp, Homo sapiens
tttctctttgttctt

SEQ ID NO: 4840697 - DNA, 10 bp, Homo sapiens
tttctgctta

SEQ ID NO: 4840698 - DNA, 23 bp, Homo sapiens
tttctgttggtcttaactaatgt

SEQ ID NO: 4840699 - DNA, 16 bp, Homo sapiens
tttctgtttgaatttt

SEQ ID NO: 4840700 - DNA, 12 bp, Homo sapiens
tttcttcaaaat

SEQ ID NO: 4840701 - DNA, 20 bp, Homo sapiens
tttcttcccatttgtaatgt

SEQ ID NO: 4840702 - DNA, 17 bp, Homo sapiens
tttcttctctctgtgct

SEQ ID NO: 4840703 - DNA, 21 bp, Homo sapiens
tttcttctttaatttttctgt

SEQ ID NO: 4840704 - DNA, 13 bp, Homo sapiens
tttcttgcaagct

SEQ ID NO: 4840705 - DNA, 15 bp, Homo sapiens
tttcttttgtgcata

SEQ ID NO: 4840706 - DNA, 22 bp, Homo sapiens
tttgaaacacacagtgaccaag

SEQ ID NO: 4840707 - DNA, 16 bp, Homo sapiens
tttgaacaactcgaat

SEQ ID NO: 4840708 - DNA, 17 bp, Homo sapiens
tttgaagaagggaaatt

SEQ ID NO: 4840709 - DNA, 19 bp, Homo sapiens
tttgaatcaatctggcttc

SEQ ID NO: 4840710 - DNA, 21 bp, Homo sapiens
tttgaattgtgtggagaagtg

SEQ ID NO: 4840711 - DNA, 13 bp, Homo sapiens
tttgaattttcaa

SEQ ID NO: 4840712 - DNA, 19 bp, Homo sapiens
tttgacattgtcagaatgt

SEQ ID NO: 4840713 - DNA, 14 bp, Homo sapiens
tttgactgattgtt

SEQ ID NO: 4840714 - DNA, 20 bp, Homo sapiens
tttgacttgccactgccata

SEQ ID NO: 4840715 - DNA, 14 bp, Homo sapiens
tttgaggaaactca

SEQ ID NO: 4840716 - DNA, 18 bp, Homo sapiens
tttgaggaccctcccagg

SEQ ID NO: 4840717 - DNA, 21 bp, Homo sapiens
tttgagggactgcctctgcca

SEQ ID NO: 4840718 - DNA, 13 bp, Homo sapiens
tttgagtaaaact

SEQ ID NO: 4840719 - DNA, 13 bp, Homo sapiens
tttgagtgcctta

SEQ ID NO: 4840720 - DNA, 21 bp, Homo sapiens
tttgatctggtgcgtgtggcc

SEQ ID NO: 4840721 - DNA, 17 bp, Homo sapiens
tttgatgaataaaatgt

SEQ ID NO: 4840722 - DNA, 16 bp, Homo sapiens
tttgatggctatgttt

SEQ ID NO: 4840723 - DNA, 16 bp, Homo sapiens
tttgatttgcaacact

SEQ ID NO: 4840724 - DNA, 19 bp, Homo sapiens
tttgcaaccttgtacttta

SEQ ID NO: 4840725 - DNA, 22 bp, Homo sapiens
tttgcaagagtgatgggaaaga

SEQ ID NO: 4840726 - DNA, 21 bp, Homo sapiens
tttgcaggtgaccagaatgag

SEQ ID NO: 4840727 - DNA, 14 bp, Homo sapiens
tttgcatgtctgca

SEQ ID NO: 4840728 - DNA, 21 bp, Homo sapiens
tttgcccggggggaaaaagat

SEQ ID NO: 4840729 - DNA, 12 bp, Homo sapiens
tttgcctccaga

SEQ ID NO: 4840730 - DNA, 17 bp, Homo sapiens
tttgcctttaggcagga

SEQ ID NO: 4840731 - DNA, 12 bp, Homo sapiens
tttgctaatgct

SEQ ID NO: 4840732 - DNA, 19 bp, Homo sapiens
tttgctaattaaaaagtta

SEQ ID NO: 4840733 - DNA, 12 bp, Homo sapiens
tttgctctgtgg

SEQ ID NO: 4840734 - DNA, 15 bp, Homo sapiens
tttgctgattgtctg

SEQ ID NO: 4840735 - DNA, 18 bp, Homo sapiens
tttgctgtatacaaacag

SEQ ID NO: 4840736 - DNA, 23 bp, Homo sapiens
tttgctgtatacaaacaggtgct

SEQ ID NO: 4840737 - DNA, 13 bp, Homo sapiens
tttgcttatttat

SEQ ID NO: 4840738 - DNA, 13 bp, Homo sapiens
tttggaagaattc

SEQ ID NO: 4840739 - DNA, 16 bp, Homo sapiens
tttggaagttttactt

SEQ ID NO: 4840740 - DNA, 14 bp, Homo sapiens
tttggaattcaatg

SEQ ID NO: 4840741 - DNA, 16 bp, Homo sapiens
tttggacgtgtgagga

SEQ ID NO: 4840742 - DNA, 16 bp, Homo sapiens
tttggattttaaacaa

SEQ ID NO: 4840743 - DNA, 21 bp, Homo sapiens
tttggcattatctctttctct

SEQ ID NO: 4840744 - DNA, 19 bp, Homo sapiens
tttgggaaaggcagggccc

SEQ ID NO: 4840745 - DNA, 19 bp, Homo sapiens
tttgggctgaatgtatgta

SEQ ID NO: 4840746 - DNA, 13 bp, Homo sapiens
tttggggaagaac

SEQ ID NO: 4840747 - DNA, 18 bp, Homo sapiens
tttggggcttatcagaac

SEQ ID NO: 4840748 - DNA, 15 bp, Homo sapiens
tttggtatgaaacaa

SEQ ID NO: 4840749 - DNA, 13 bp, Homo sapiens
tttggtgaataac

SEQ ID NO: 4840750 - DNA, 15 bp, Homo sapiens
tttgtaaaagagctg

SEQ ID NO: 4840751 - DNA, 22 bp, Homo sapiens
tttgtaaaagagctgttctttt

SEQ ID NO: 4840752 - DNA, 20 bp, Homo sapiens
tttgtaaccacaactttcac

SEQ ID NO: 4840753 - DNA, 17 bp, Homo sapiens
tttgtaactattcttca

SEQ ID NO: 4840754 - DNA, 17 bp, Homo sapiens
tttgtaatataagacaa

SEQ ID NO: 4840755 - DNA, 22 bp, Homo sapiens
tttgtacaatggggacttcccg

SEQ ID NO: 4840756 - DNA, 17 bp, Homo sapiens
tttgtacgtgttattat

SEQ ID NO: 4840757 - DNA, 22 bp, Homo sapiens
tttgtattagtaataaaacatt

SEQ ID NO: 4840758 - DNA, 12 bp, Homo sapiens
tttgtcacttct

SEQ ID NO: 4840759 - DNA, 18 bp, Homo sapiens
tttgtgaagtgattgaca

SEQ ID NO: 4840760 - DNA, 14 bp, Homo sapiens
tttgtgctgtgggc

SEQ ID NO: 4840761 - DNA, 22 bp, Homo sapiens
tttgtgctgtgggcagcaccct

SEQ ID NO: 4840762 - DNA, 18 bp, Homo sapiens
tttgtggataagaaaaat

SEQ ID NO: 4840763 - DNA, 13 bp, Homo sapiens
tttgtgtgcttca

SEQ ID NO: 4840764 - DNA, 13 bp, Homo sapiens
tttgttaaaatat

SEQ ID NO: 4840765 - DNA, 15 bp, Homo sapiens
tttgttcaccttctg

SEQ ID NO: 4840766 - DNA, 10 bp, Homo sapiens
tttgttctgt

SEQ ID NO: 4840767 - DNA, 21 bp, Homo sapiens
tttgttgcagttaattcttgc

SEQ ID NO: 4840768 - DNA, 12 bp, Homo sapiens
tttgtttgctgc

SEQ ID NO: 4840769 - DNA, 15 bp, Homo sapiens
tttgtttgtgcttct

SEQ ID NO: 4840770 - DNA, 19 bp, Homo sapiens
ttttaaaaagttgcacatt

SEQ ID NO: 4840771 - DNA, 23 bp, Homo sapiens
ttttaaaagcatatataaaacaa

SEQ ID NO: 4840772 - DNA, 22 bp, Homo sapiens
ttttaacatagcagctggttaa

SEQ ID NO: 4840773 - DNA, 12 bp, Homo sapiens
ttttaagaaaca

SEQ ID NO: 4840774 - DNA, 22 bp, Homo sapiens
ttttaagccaatataatgggct

SEQ ID NO: 4840775 - DNA, 13 bp, Homo sapiens
ttttaataaaagt

SEQ ID NO: 4840776 - DNA, 13 bp, Homo sapiens
ttttaatctcttg

SEQ ID NO: 4840777 - DNA, 19 bp, Homo sapiens
ttttaattgaaaagaagta

SEQ ID NO: 4840778 - DNA, 17 bp, Homo sapiens
ttttaatttcctgtgag

SEQ ID NO: 4840779 - DNA, 23 bp, Homo sapiens
ttttaccatcacacatgttcaga

SEQ ID NO: 4840780 - DNA, 18 bp, Homo sapiens
ttttactcaggctttcta

SEQ ID NO: 4840781 - DNA, 22 bp, Homo sapiens
ttttactcaggctttctattgg

SEQ ID NO: 4840782 - DNA, 15 bp, Homo sapiens
ttttactgtctgtaa

SEQ ID NO: 4840783 - DNA, 18 bp, Homo sapiens
ttttacttgattaaggac

SEQ ID NO: 4840784 - DNA, 12 bp, Homo sapiens
ttttagaaattc

SEQ ID NO: 4840785 - DNA, 17 bp, Homo sapiens
ttttagaaattctataa

SEQ ID NO: 4840786 - DNA, 23 bp, Homo sapiens
ttttagagattaatttgtgtaga

SEQ ID NO: 4840787 - DNA, 13 bp, Homo sapiens
ttttagattccta

SEQ ID NO: 4840788 - DNA, 21 bp, Homo sapiens
ttttataaatggaggtacagg

SEQ ID NO: 4840789 - DNA, 13 bp, Homo sapiens
ttttataaattaa

SEQ ID NO: 4840790 - DNA, 15 bp, Homo sapiens
ttttataaattaaat

SEQ ID NO: 4840791 - DNA, 19 bp, Homo sapiens
ttttataaggctgactctt

SEQ ID NO: 4840792 - DNA, 13 bp, Homo sapiens
ttttatagtgtgt

SEQ ID NO: 4840793 - DNA, 17 bp, Homo sapiens
ttttatataataaagta

SEQ ID NO: 4840794 - DNA, 13 bp, Homo sapiens
ttttatctcttct

SEQ ID NO: 4840795 - DNA, 17 bp, Homo sapiens
ttttatctcttcttcct

SEQ ID NO: 4840796 - DNA, 17 bp, Homo sapiens
ttttatgactaatcctt

SEQ ID NO: 4840797 - DNA, 18 bp, Homo sapiens
ttttatgagacttcctat

SEQ ID NO: 4840798 - DNA, 20 bp, Homo sapiens
ttttattaggttaagtctca

SEQ ID NO: 4840799 - DNA, 22 bp, Homo sapiens
ttttattaggttaagtctcaat

SEQ ID NO: 4840800 - DNA, 14 bp, Homo sapiens
ttttatttcaatgt

SEQ ID NO: 4840801 - DNA, 14 bp, Homo sapiens
ttttcaaagattgt

SEQ ID NO: 4840802 - DNA, 18 bp, Homo sapiens
ttttcaatgtactgtatt

SEQ ID NO: 4840803 - DNA, 19 bp, Homo sapiens
ttttcagattgtaaaggta

SEQ ID NO: 4840804 - DNA, 16 bp, Homo sapiens
ttttccagctgagcat

SEQ ID NO: 4840805 - DNA, 17 bp, Homo sapiens
ttttcccacctctttgg

SEQ ID NO: 4840806 - DNA, 17 bp, Homo sapiens
ttttcctgggtgctcag

SEQ ID NO: 4840807 - DNA, 15 bp, Homo sapiens
ttttccttcttagat

SEQ ID NO: 4840808 - DNA, 15 bp, Homo sapiens
ttttcgtgcatttgt

SEQ ID NO: 4840809 - DNA, 12 bp, Homo sapiens
ttttctacttta

SEQ ID NO: 4840810 - DNA, 24 bp, Homo sapiens
ttttctagcaactgttggataata

SEQ ID NO: 4840811 - DNA, 14 bp, Homo sapiens
ttttctatatttgg

SEQ ID NO: 4840812 - DNA, 20 bp, Homo sapiens
ttttctattccttctggcct

SEQ ID NO: 4840813 - DNA, 11 bp, Homo sapiens
ttttctccttc

SEQ ID NO: 4840814 - DNA, 19 bp, Homo sapiens
ttttctgtaattcttctcc

SEQ ID NO: 4840815 - DNA, 13 bp, Homo sapiens
ttttcttctcatt

SEQ ID NO: 4840816 - DNA, 18 bp, Homo sapiens
ttttcttctcattcttct

SEQ ID NO: 4840817 - DNA, 16 bp, Homo sapiens
ttttgaagaagggaaa

SEQ ID NO: 4840818 - DNA, 18 bp, Homo sapiens
ttttgaagtgagaaaatg

SEQ ID NO: 4840819 - DNA, 19 bp, Homo sapiens
ttttgaagtgagaaaatga

SEQ ID NO: 4840820 - DNA, 19 bp, Homo sapiens
ttttgagccttattaaaat

SEQ ID NO: 4840821 - DNA, 22 bp, Homo sapiens
ttttgagctcctaagctgccag

SEQ ID NO: 4840822 - DNA, 17 bp, Homo sapiens
ttttgatacttgtaact

SEQ ID NO: 4840823 - DNA, 23 bp, Homo sapiens
ttttgatgtattattatatatgt

SEQ ID NO: 4840824 - DNA, 13 bp, Homo sapiens
ttttgcctttggt

SEQ ID NO: 4840825 - DNA, 12 bp, Homo sapiens
ttttgtaactct

SEQ ID NO: 4840826 - DNA, 15 bp, Homo sapiens
ttttgtaactctttg

SEQ ID NO: 4840827 - DNA, 16 bp, Homo sapiens
ttttgtaattcctcta

SEQ ID NO: 4840828 - DNA, 21 bp, Homo sapiens
ttttgtacgtgttattattat

SEQ ID NO: 4840829 - DNA, 18 bp, Homo sapiens
ttttgtacgttaattaaa

SEQ ID NO: 4840830 - DNA, 19 bp, Homo sapiens
ttttgtacgttaattaaac

SEQ ID NO: 4840831 - DNA, 17 bp, Homo sapiens
ttttgttcaccttctgt

SEQ ID NO: 4840832 - DNA, 13 bp, Homo sapiens
tttttaatctctt

SEQ ID NO: 4840833 - DNA, 22 bp, Homo sapiens
tttttaatctcttgtcattctc

SEQ ID NO: 4840834 - DNA, 14 bp, Homo sapiens
tttttaatttatga

SEQ ID NO: 4840835 - DNA, 21 bp, Homo sapiens
tttttactcaggctttctatt

SEQ ID NO: 4840836 - DNA, 18 bp, Homo sapiens
tttttatcccgccaggga

SEQ ID NO: 4840837 - DNA, 18 bp, Homo sapiens
tttttcattgtgttttct

SEQ ID NO: 4840838 - DNA, 14 bp, Homo sapiens
tttttccagaattg

SEQ ID NO: 4840839 - DNA, 15 bp, Homo sapiens
tttttccagaattga

SEQ ID NO: 4840840 - DNA, 14 bp, Homo sapiens
tttttcctgtcaat

SEQ ID NO: 4840841 - DNA, 19 bp, Homo sapiens
tttttcctgtgaacacata

SEQ ID NO: 4840842 - DNA, 15 bp, Homo sapiens
tttttcctttcctga

SEQ ID NO: 4840843 - DNA, 15 bp, Homo sapiens
tttttctatattatt

SEQ ID NO: 4840844 - DNA, 19 bp, Homo sapiens
tttttctgttccctgctgg

SEQ ID NO: 4840845 - DNA, 16 bp, Homo sapiens
tttttgagacagagtc

SEQ ID NO: 4840846 - DNA, 14 bp, Homo sapiens
tttttgcaataagg

SEQ ID NO: 4840847 - DNA, 23 bp, Homo sapiens
tttttgccctgcgtcccttctct

SEQ ID NO: 4840848 - DNA, 21 bp, Homo sapiens
tttttggatggcttaagcctg

SEQ ID NO: 4840849 - DNA, 18 bp, Homo sapiens
tttttggttgcaattgtt

SEQ ID NO: 4840850 - DNA, 19 bp, Homo sapiens
tttttggttttctccttcc

SEQ ID NO: 4840851 - DNA, 13 bp, Homo sapiens
tttttgtaactct

SEQ ID NO: 4840852 - DNA, 16 bp, Homo sapiens
tttttgtaattcctct

SEQ ID NO: 4840853 - DNA, 14 bp, Homo sapiens
ttttttctggtaag

SEQ ID NO: 4840854 - DNA, 12 bp, Homo sapiens
ttttttgcaata

SEQ ID NO: 4840855 - DNA, 11 bp, Homo sapiens
ttttttgtaac

SEQ ID NO: 4840856 - DNA, 15 bp, Homo sapiens
aaaatactattctga

SEQ ID NO: 4840857 - DNA, 23 bp, Homo sapiens
aaaccatgaagagatttttcatg

SEQ ID NO: 4840858 - DNA, 21 bp, Homo sapiens
aaagataaattatatcaattt

SEQ ID NO: 4840859 - DNA, 18 bp, Homo sapiens
aaaggttcctttgttccc

SEQ ID NO: 4840860 - DNA, 17 bp, Homo sapiens
aaagtcaatgttttcag

SEQ ID NO: 4840861 - DNA, 18 bp, Homo sapiens
aaagtcaatgttttcagt

SEQ ID NO: 4840862 - DNA, 14 bp, Homo sapiens
aaataatcattctt

SEQ ID NO: 4840863 - DNA, 21 bp, Homo sapiens
aaatcatgaagatatttttcc

SEQ ID NO: 4840864 - DNA, 14 bp, Homo sapiens
aaattaaatgaatt

SEQ ID NO: 4840865 - DNA, 23 bp, Homo sapiens
aaccatgaagagatttttcatga

SEQ ID NO: 4840866 - DNA, 22 bp, Homo sapiens
aagaaaatctattttgtaactt

SEQ ID NO: 4840867 - DNA, 18 bp, Homo sapiens
aagacaccgttcattcag

SEQ ID NO: 4840868 - DNA, 13 bp, Homo sapiens
aagagatttttca

SEQ ID NO: 4840869 - DNA, 17 bp, Homo sapiens
aagatatttttcatgat

SEQ ID NO: 4840870 - DNA, 13 bp, Homo sapiens
aagatatttttcc

SEQ ID NO: 4840871 - DNA, 16 bp, Homo sapiens
aagatttccatataaa

SEQ ID NO: 4840872 - DNA, 18 bp, Homo sapiens
aagcatgtattcagcttt

SEQ ID NO: 4840873 - DNA, 21 bp, Homo sapiens
aagggccttgagcatctggat

SEQ ID NO: 4840874 - DNA, 22 bp, Homo sapiens
aagtctgtgagattcattcatg

SEQ ID NO: 4840875 - DNA, 20 bp, Homo sapiens
aatagttttattaataaaca

SEQ ID NO: 4840876 - DNA, 20 bp, Homo sapiens
aatattttgctagtttttga

SEQ ID NO: 4840877 - DNA, 18 bp, Homo sapiens
aatattttttcttttcta

SEQ ID NO: 4840878 - DNA, 20 bp, Homo sapiens
aatcatgaagatatttttcc

SEQ ID NO: 4840879 - DNA, 17 bp, Homo sapiens
aatctattttgtaactt

SEQ ID NO: 4840880 - DNA, 22 bp, Homo sapiens
aatgtgtattacaaatattttg

SEQ ID NO: 4840881 - DNA, 12 bp, Homo sapiens
aatgttcatcat

SEQ ID NO: 4840882 - DNA, 16 bp, Homo sapiens
aattttgatgaacaaa

SEQ ID NO: 4840883 - DNA, 22 bp, Homo sapiens
acaaaagtttcatccttttcat

SEQ ID NO: 4840884 - DNA, 17 bp, Homo sapiens
acagcaattcctcaggc

SEQ ID NO: 4840885 - DNA, 20 bp, Homo sapiens
acagtttaataccacagctt

SEQ ID NO: 4840886 - DNA, 15 bp, Homo sapiens
acatttattttcatt

SEQ ID NO: 4840887 - DNA, 19 bp, Homo sapiens
accatgaagagatttttca

SEQ ID NO: 4840888 - DNA, 19 bp, Homo sapiens
accttgctttgatggaata

SEQ ID NO: 4840889 - DNA, 14 bp, Homo sapiens
actactaaactggg

SEQ ID NO: 4840890 - DNA, 21 bp, Homo sapiens
actatagtccagctttgttct

SEQ ID NO: 4840891 - DNA, 16 bp, Homo sapiens
actcctaggaaaatac

SEQ ID NO: 4840892 - DNA, 22 bp, Homo sapiens
agaaagtcttatttattcatat

SEQ ID NO: 4840893 - DNA, 17 bp, Homo sapiens
agacaccgttcattcag

SEQ ID NO: 4840894 - DNA, 18 bp, Homo sapiens
agacctctgtgcacttat

SEQ ID NO: 4840895 - DNA, 13 bp, Homo sapiens
agataatccctgt

SEQ ID NO: 4840896 - DNA, 17 bp, Homo sapiens
agatttttcatgatttt

SEQ ID NO: 4840897 - DNA, 19 bp, Homo sapiens
agcatctggattctgccta

SEQ ID NO: 4840898 - DNA, 18 bp, Homo sapiens
agccgttcctcctgcccg

SEQ ID NO: 4840899 - DNA, 22 bp, Homo sapiens
aggagatccagggcaaggccat

SEQ ID NO: 4840900 - DNA, 17 bp, Homo sapiens
aggttcctttgttccct

SEQ ID NO: 4840901 - DNA, 15 bp, Homo sapiens
agtaatttgtagatt

SEQ ID NO: 4840902 - DNA, 15 bp, Homo sapiens
agtccaactactaaa

SEQ ID NO: 4840903 - DNA, 18 bp, Homo sapiens
agtctatcaatcaactta

SEQ ID NO: 4840904 - DNA, 18 bp, Homo sapiens
agtctgtgagattcattc

SEQ ID NO: 4840905 - DNA, 16 bp, Homo sapiens
agtgattgtatgaatt

SEQ ID NO: 4840906 - DNA, 19 bp, Homo sapiens
agttatgccgctagataca

SEQ ID NO: 4840907 - DNA, 17 bp, Homo sapiens
ataagacggatttattt

SEQ ID NO: 4840908 - DNA, 21 bp, Homo sapiens
ataagacggatttatttttcc

SEQ ID NO: 4840909 - DNA, 12 bp, Homo sapiens
ataagtttattt

SEQ ID NO: 4840910 - DNA, 13 bp, Homo sapiens
atacacacagtta

SEQ ID NO: 4840911 - DNA, 22 bp, Homo sapiens
atagtcatgtaagctgaaaata

SEQ ID NO: 4840912 - DNA, 17 bp, Homo sapiens
atagtccagctttgttc

SEQ ID NO: 4840913 - DNA, 16 bp, Homo sapiens
atagttttattaataa

SEQ ID NO: 4840914 - DNA, 15 bp, Homo sapiens
atatgggacattttt

SEQ ID NO: 4840915 - DNA, 17 bp, Homo sapiens
atatgggacatttttga

SEQ ID NO: 4840916 - DNA, 12 bp, Homo sapiens
atattttaaata

SEQ ID NO: 4840917 - DNA, 17 bp, Homo sapiens
atcataagatatttttc

SEQ ID NO: 4840918 - DNA, 19 bp, Homo sapiens
atcattcttatttcatgaa

SEQ ID NO: 4840919 - DNA, 17 bp, Homo sapiens
atcgcttcatgtaacta

SEQ ID NO: 4840920 - DNA, 14 bp, Homo sapiens
atgcacatccctgg

SEQ ID NO: 4840921 - DNA, 20 bp, Homo sapiens
atgcaccctcatacacagaa

SEQ ID NO: 4840922 - DNA, 14 bp, Homo sapiens
atgtaactagaatt

SEQ ID NO: 4840923 - DNA, 17 bp, Homo sapiens
atgtaagctgaaaatat

SEQ ID NO: 4840924 - DNA, 22 bp, Homo sapiens
atgtaataaggttgaacacttt

SEQ ID NO: 4840925 - DNA, 22 bp, Homo sapiens
atgtaggaaagaccatttttcc

SEQ ID NO: 4840926 - DNA, 18 bp, Homo sapiens
atgtgtattacaaatatt

SEQ ID NO: 4840927 - DNA, 14 bp, Homo sapiens
atgtttagtaaact

SEQ ID NO: 4840928 - DNA, 14 bp, Homo sapiens
atgttttgacattt

SEQ ID NO: 4840929 - DNA, 22 bp, Homo sapiens
attaaaggttcctttgttccct

SEQ ID NO: 4840930 - DNA, 21 bp, Homo sapiens
attaagatatgggacattttt

SEQ ID NO: 4840931 - DNA, 22 bp, Homo sapiens
attcctgtggatgtaaagtgat

SEQ ID NO: 4840932 - DNA, 15 bp, Homo sapiens
attctgcctaataaa

SEQ ID NO: 4840933 - DNA, 20 bp, Homo sapiens
attgtggggatgatgaaata

SEQ ID NO: 4840934 - DNA, 22 bp, Homo sapiens
atttccatataaatattagaaa

SEQ ID NO: 4840935 - DNA, 22 bp, Homo sapiens
atttgcagctgagagaaaataa

SEQ ID NO: 4840936 - DNA, 13 bp, Homo sapiens
attttaataatat

SEQ ID NO: 4840937 - DNA, 20 bp, Homo sapiens
attttgaaatcatgaagata

SEQ ID NO: 4840938 - DNA, 16 bp, Homo sapiens
atttttacattctgaa

SEQ ID NO: 4840939 - DNA, 12 bp, Homo sapiens
caatatttttct

SEQ ID NO: 4840940 - DNA, 16 bp, Homo sapiens
cacagcaattcctcag

SEQ ID NO: 4840941 - DNA, 18 bp, Homo sapiens
cacagcaattcctcaggc

SEQ ID NO: 4840942 - DNA, 22 bp, Homo sapiens
caccaagttggaacatccttgg

SEQ ID NO: 4840943 - DNA, 14 bp, Homo sapiens
caccgttcattcag

SEQ ID NO: 4840944 - DNA, 17 bp, Homo sapiens
cagctgagagaaaataa

SEQ ID NO: 4840945 - DNA, 15 bp, Homo sapiens
cagggcaaggccatt

SEQ ID NO: 4840946 - DNA, 17 bp, Homo sapiens
caggtatagactcctga

SEQ ID NO: 4840947 - DNA, 17 bp, Homo sapiens
catctggattctgccta

SEQ ID NO: 4840948 - DNA, 18 bp, Homo sapiens
catgaagagatttttcat

SEQ ID NO: 4840949 - DNA, 17 bp, Homo sapiens
catgtaagctgaaaata

SEQ ID NO: 4840950 - DNA, 18 bp, Homo sapiens
catgtaagctgaaaatat

SEQ ID NO: 4840951 - DNA, 21 bp, Homo sapiens
cattcttatttcatgaaaatt

SEQ ID NO: 4840952 - DNA, 22 bp, Homo sapiens
cattgtatagttggaatcatat

SEQ ID NO: 4840953 - DNA, 20 bp, Homo sapiens
catttttgtattttgtttaa

SEQ ID NO: 4840954 - DNA, 18 bp, Homo sapiens
ccaatttctattaaaggt

SEQ ID NO: 4840955 - DNA, 20 bp, Homo sapiens
ccaatttctattaaaggttc

SEQ ID NO: 4840956 - DNA, 22 bp, Homo sapiens
ccacaaatgggaaaaccagact

SEQ ID NO: 4840957 - DNA, 18 bp, Homo sapiens
ccagatgcacatccctgg

SEQ ID NO: 4840958 - DNA, 22 bp, Homo sapiens
ccatgaagagatttttcatgat

SEQ ID NO: 4840959 - DNA, 21 bp, Homo sapiens
ccatgcaccctcatacacaga

SEQ ID NO: 4840960 - DNA, 14 bp, Homo sapiens
ccctaagtccaact

SEQ ID NO: 4840961 - DNA, 17 bp, Homo sapiens
ccctgctcccacagaac

SEQ ID NO: 4840962 - DNA, 13 bp, Homo sapiens
ccgagaagaacag

SEQ ID NO: 4840963 - DNA, 13 bp, Homo sapiens
cctaagtccaact

SEQ ID NO: 4840964 - DNA, 13 bp, Homo sapiens
ccttgagcatctg

SEQ ID NO: 4840965 - DNA, 14 bp, Homo sapiens
ccttgagcatctgg

SEQ ID NO: 4840966 - DNA, 12 bp, Homo sapiens
cctttgttccct

SEQ ID NO: 4840967 - DNA, 12 bp, Homo sapiens
ccttttccatgc

SEQ ID NO: 4840968 - DNA, 19 bp, Homo sapiens
ctaagtccaactactaaac

SEQ ID NO: 4840969 - DNA, 19 bp, Homo sapiens
ctaataaaaaacatttatt

SEQ ID NO: 4840970 - DNA, 22 bp, Homo sapiens
ctaatgacatcaccacagttta

SEQ ID NO: 4840971 - DNA, 21 bp, Homo sapiens
ctatagtccagctttgttctt

SEQ ID NO: 4840972 - DNA, 23 bp, Homo sapiens
ctattaaaggttcctttgttccc

SEQ ID NO: 4840973 - DNA, 22 bp, Homo sapiens
ctatttgttgatgcttgtgtca

SEQ ID NO: 4840974 - DNA, 21 bp, Homo sapiens
ctcatatccagtattgttcct

SEQ ID NO: 4840975 - DNA, 15 bp, Homo sapiens
ctcctaggaaaatac

SEQ ID NO: 4840976 - DNA, 14 bp, Homo sapiens
ctgagagaaaataa

SEQ ID NO: 4840977 - DNA, 23 bp, Homo sapiens
ctgccggttcttaaatccatcct

SEQ ID NO: 4840978 - DNA, 20 bp, Homo sapiens
ctggattctgcctaataaaa

SEQ ID NO: 4840979 - DNA, 17 bp, Homo sapiens
cttatttcatgaaaatt

SEQ ID NO: 4840980 - DNA, 15 bp, Homo sapiens
cttcacaaattctca

SEQ ID NO: 4840981 - DNA, 13 bp, Homo sapiens
cttcttttgtgaa

SEQ ID NO: 4840982 - DNA, 13 bp, Homo sapiens
cttgagcatctgg

SEQ ID NO: 4840983 - DNA, 16 bp, Homo sapiens
ctttaccttttttctt

SEQ ID NO: 4840984 - DNA, 20 bp, Homo sapiens
ctttctcttttcctctacca

SEQ ID NO: 4840985 - DNA, 20 bp, Homo sapiens
ctttttaccaagtttcaggt

SEQ ID NO: 4840986 - DNA, 16 bp, Homo sapiens
gaaagaccatttttcc

SEQ ID NO: 4840987 - DNA, 20 bp, Homo sapiens
gacagcctccccctgtcccc

SEQ ID NO: 4840988 - DNA, 22 bp, Homo sapiens
gagcaccgcctgtgaaatacca

SEQ ID NO: 4840989 - DNA, 21 bp, Homo sapiens
gattttgaaaccatgaagaga

SEQ ID NO: 4840990 - DNA, 17 bp, Homo sapiens
gcaccctcatacacaga

SEQ ID NO: 4840991 - DNA, 20 bp, Homo sapiens
gcaccctcatacacagaaac

SEQ ID NO: 4840992 - DNA, 15 bp, Homo sapiens
gcagtatgaaaataa

SEQ ID NO: 4840993 - DNA, 15 bp, Homo sapiens
gccttgagcatctgg

SEQ ID NO: 4840994 - DNA, 18 bp, Homo sapiens
gctgcagtatgaaaataa

SEQ ID NO: 4840995 - DNA, 12 bp, Homo sapiens
ggaaaaccagac

SEQ ID NO: 4840996 - DNA, 17 bp, Homo sapiens
ggaaattggaagagcac

SEQ ID NO: 4840997 - DNA, 10 bp, Homo sapiens
ggtccttcaa

SEQ ID NO: 4840998 - DNA, 15 bp, Homo sapiens
ggttcctttgttccc

SEQ ID NO: 4840999 - DNA, 16 bp, Homo sapiens
ggttcctttgttccct

SEQ ID NO: 4841000 - DNA, 22 bp, Homo sapiens
gtaaagtatcaggatactatat

SEQ ID NO: 4841001 - DNA, 14 bp, Homo sapiens
gtccaactactaaa

SEQ ID NO: 4841002 - DNA, 13 bp, Homo sapiens
gtctattctagtc

SEQ ID NO: 4841003 - DNA, 17 bp, Homo sapiens
gtctgtttataaacatt

SEQ ID NO: 4841004 - DNA, 14 bp, Homo sapiens
gttccctaagtcca

SEQ ID NO: 4841005 - DNA, 23 bp, Homo sapiens
gttccctaagtccaactactaaa

SEQ ID NO: 4841006 - DNA, 15 bp, Homo sapiens
gttcctttgttccct

SEQ ID NO: 4841007 - DNA, 17 bp, Homo sapiens
gttttggtggttttagt

SEQ ID NO: 4841008 - DNA, 20 bp, Homo sapiens
taaagtatcaggatactata

SEQ ID NO: 4841009 - DNA, 15 bp, Homo sapiens
taaagtgatatttcc

SEQ ID NO: 4841010 - DNA, 22 bp, Homo sapiens
taaatattttttcttttctatt

SEQ ID NO: 4841011 - DNA, 15 bp, Homo sapiens
taactttctctatga

SEQ ID NO: 4841012 - DNA, 17 bp, Homo sapiens
taagatatttttcatga

SEQ ID NO: 4841013 - DNA, 18 bp, Homo sapiens
taagatatttttcatgat

SEQ ID NO: 4841014 - DNA, 19 bp, Homo sapiens
taagatatttttcatgatt

SEQ ID NO: 4841015 - DNA, 13 bp, Homo sapiens
taagctgaaaata

SEQ ID NO: 4841016 - DNA, 19 bp, Homo sapiens
taagtccaactactaaact

SEQ ID NO: 4841017 - DNA, 13 bp, Homo sapiens
taataaacattct

SEQ ID NO: 4841018 - DNA, 15 bp, Homo sapiens
taataaggttgaaca

SEQ ID NO: 4841019 - DNA, 16 bp, Homo sapiens
taataccacagctttt

SEQ ID NO: 4841020 - DNA, 21 bp, Homo sapiens
taatgttgtatgtcttgttta

SEQ ID NO: 4841021 - DNA, 13 bp, Homo sapiens
tacactatcttaa

SEQ ID NO: 4841022 - DNA, 15 bp, Homo sapiens
tacattaattatcta

SEQ ID NO: 4841023 - DNA, 20 bp, Homo sapiens
tacatttatagttgtaacta

SEQ ID NO: 4841024 - DNA, 16 bp, Homo sapiens
taccaagtttcaggta

SEQ ID NO: 4841025 - DNA, 21 bp, Homo sapiens
taccaagtttcaggtattaag

SEQ ID NO: 4841026 - DNA, 17 bp, Homo sapiens
tactactgaatctctaa

SEQ ID NO: 4841027 - DNA, 20 bp, Homo sapiens
tactcactttctagattaag

SEQ ID NO: 4841028 - DNA, 18 bp, Homo sapiens
tagaaagagatacagagg

SEQ ID NO: 4841029 - DNA, 18 bp, Homo sapiens
tagatacatgctttttaa

SEQ ID NO: 4841030 - DNA, 18 bp, Homo sapiens
tagccaatatttttctta

SEQ ID NO: 4841031 - DNA, 23 bp, Homo sapiens
tagtccagctttgttcttcttaa

SEQ ID NO: 4841032 - DNA, 18 bp, Homo sapiens
tatcgcttcatgtaacta

SEQ ID NO: 4841033 - DNA, 17 bp, Homo sapiens
tatctagtttaattaat

SEQ ID NO: 4841034 - DNA, 22 bp, Homo sapiens
tatgttttgacatttttagttt

SEQ ID NO: 4841035 - DNA, 21 bp, Homo sapiens
tattcatattttctttcaaaa

SEQ ID NO: 4841036 - DNA, 22 bp, Homo sapiens
tattcctgtggatgtaaagtga

SEQ ID NO: 4841037 - DNA, 10 bp, Homo sapiens
tattctagtc

SEQ ID NO: 4841038 - DNA, 17 bp, Homo sapiens
tatttcatgaaaattgt

SEQ ID NO: 4841039 - DNA, 21 bp, Homo sapiens
tatttccccaacatgtaataa

SEQ ID NO: 4841040 - DNA, 21 bp, Homo sapiens
tattttgttttgtgcagagat

SEQ ID NO: 4841041 - DNA, 21 bp, Homo sapiens
tatttttaatatatactatga

SEQ ID NO: 4841042 - DNA, 18 bp, Homo sapiens
tatttttacattctgaat

SEQ ID NO: 4841043 - DNA, 21 bp, Homo sapiens
tcaagcaaacagcttcacaaa

SEQ ID NO: 4841044 - DNA, 15 bp, Homo sapiens
tcaggtattaagaaa

SEQ ID NO: 4841045 - DNA, 19 bp, Homo sapiens
tcatgaagatatttttcca

SEQ ID NO: 4841046 - DNA, 22 bp, Homo sapiens
tcatgctaattatataatattt

SEQ ID NO: 4841047 - DNA, 18 bp, Homo sapiens
tcatgtaagctgaaaata

SEQ ID NO: 4841048 - DNA, 14 bp, Homo sapiens
tcattcttatttca

SEQ ID NO: 4841049 - DNA, 16 bp, Homo sapiens
tcctgaaagacaatat

SEQ ID NO: 4841050 - DNA, 18 bp, Homo sapiens
tcctgctaagttaatgtt

SEQ ID NO: 4841051 - DNA, 15 bp, Homo sapiens
tccttccaccaagtt

SEQ ID NO: 4841052 - DNA, 18 bp, Homo sapiens
tcctttgttccctaagtc

SEQ ID NO: 4841053 - DNA, 22 bp, Homo sapiens
tctattgttgtacacagaaata

SEQ ID NO: 4841054 - DNA, 18 bp, Homo sapiens
tcttatttcatgaaaatt

SEQ ID NO: 4841055 - DNA, 19 bp, Homo sapiens
tcttgctgtccaatttcta

SEQ ID NO: 4841056 - DNA, 16 bp, Homo sapiens
tgaaaagataaattat

SEQ ID NO: 4841057 - DNA, 21 bp, Homo sapiens
tgaaataccaacctgaagaca

SEQ ID NO: 4841058 - DNA, 12 bp, Homo sapiens
tgaacctgccct

SEQ ID NO: 4841059 - DNA, 23 bp, Homo sapiens
tgaactagggtggtgcatttttg

SEQ ID NO: 4841060 - DNA, 20 bp, Homo sapiens
tgaagggccttgagcatctg

SEQ ID NO: 4841061 - DNA, 23 bp, Homo sapiens
tgaagggccttgagcatctggat

SEQ ID NO: 4841062 - DNA, 23 bp, Homo sapiens
tgaagtacccgttcacatttttg

SEQ ID NO: 4841063 - DNA, 12 bp, Homo sapiens
tgctgtccaatt

SEQ ID NO: 4841064 - DNA, 17 bp, Homo sapiens
tggaaattggaagagca

SEQ ID NO: 4841065 - DNA, 21 bp, Homo sapiens
tgtaactatagtccagctttg

SEQ ID NO: 4841066 - DNA, 17 bp, Homo sapiens
tgtaactttctctatga

SEQ ID NO: 4841067 - DNA, 18 bp, Homo sapiens
tgtaactttctctatgaa

SEQ ID NO: 4841068 - DNA, 14 bp, Homo sapiens
tgtaagctgaaaat

SEQ ID NO: 4841069 - DNA, 21 bp, Homo sapiens
tgtccaatttctattaaaggt

SEQ ID NO: 4841070 - DNA, 20 bp, Homo sapiens
tgttctttggaaatacacag

SEQ ID NO: 4841071 - DNA, 13 bp, Homo sapiens
ttaatgtgtatta

SEQ ID NO: 4841072 - DNA, 15 bp, Homo sapiens
ttatagttgtaacta

SEQ ID NO: 4841073 - DNA, 14 bp, Homo sapiens
ttattaataaacat

SEQ ID NO: 4841074 - DNA, 17 bp, Homo sapiens
ttcacatttttgtattt

SEQ ID NO: 4841075 - DNA, 15 bp, Homo sapiens
ttcatgattttgaaa

SEQ ID NO: 4841076 - DNA, 23 bp, Homo sapiens
ttcctcagttcatccattctatt

SEQ ID NO: 4841077 - DNA, 14 bp, Homo sapiens
ttctaatagtttta

SEQ ID NO: 4841078 - DNA, 13 bp, Homo sapiens
ttctattaaaggt

SEQ ID NO: 4841079 - DNA, 15 bp, Homo sapiens
ttctcttttcctttg

SEQ ID NO: 4841080 - DNA, 17 bp, Homo sapiens
ttcttaaagtcaagatt

SEQ ID NO: 4841081 - DNA, 14 bp, Homo sapiens
ttcttatttcatga

SEQ ID NO: 4841082 - DNA, 12 bp, Homo sapiens
ttgagcatctgg

SEQ ID NO: 4841083 - DNA, 13 bp, Homo sapiens
ttgctgtccaatt

SEQ ID NO: 4841084 - DNA, 22 bp, Homo sapiens
ttgctgtccaatttctattaaa

SEQ ID NO: 4841085 - DNA, 11 bp, Homo sapiens
ttgtgcagaga

SEQ ID NO: 4841086 - DNA, 15 bp, Homo sapiens
tttaaaaaccttgta

SEQ ID NO: 4841087 - DNA, 16 bp, Homo sapiens
tttattaataaacatt

SEQ ID NO: 4841088 - DNA, 21 bp, Homo sapiens
tttcgtctgtttataaacatt

SEQ ID NO: 4841089 - DNA, 16 bp, Homo sapiens
tttctagattaagata

SEQ ID NO: 4841090 - DNA, 14 bp, Homo sapiens
tttctttcaaaatt

SEQ ID NO: 4841091 - DNA, 22 bp, Homo sapiens
tttgtaagttaggtaactgtat

SEQ ID NO: 4841092 - DNA, 22 bp, Homo sapiens
ttttaaaaattaaatcaacctt

SEQ ID NO: 4841093 - DNA, 13 bp, Homo sapiens
ttttcttttctat

SEQ ID NO: 4841094 - DNA, 20 bp, Homo sapiens
ttttggtggttttagtgatt

SEQ ID NO: 4841095 - DNA, 17 bp, Homo sapiens
agatatgggacattttt

SEQ ID NO: 4841096 - DNA, 15 bp, Homo sapiens
agatattaccagttt

SEQ ID NO: 4841097 - DNA, 19 bp, Homo sapiens
agatatttttcatgatttt

SEQ ID NO: 4841098 - DNA, 19 bp, Homo sapiens
agatatttttccatttttt

SEQ ID NO: 4841099 - DNA, 14 bp, Homo sapiens
agccaatatttttc

SEQ ID NO: 4841100 - DNA, 21 bp, Homo sapiens
tatgaagggccttgagcatct

SEQ ID NO: 4841101 - DNA, 23 bp, Homo sapiens
tatgaagggccttgagcatctgg

SEQ ID NO: 4841102 - DNA, 22 bp, Homo sapiens
tattaaaggttcctttgttccc

SEQ ID NO: 4841103 - DNA, 19 bp, Homo sapiens
tattaataaacattctatc

SEQ ID NO: 4841104 - DNA, 19 bp, Homo sapiens
tattcagctttagtagata

SEQ ID NO: 4841105 - DNA, 24 bp, Homo sapiens
tcaaaattagtgctttttgtgtca

SEQ ID NO: 4841106 - DNA, 16 bp, Homo sapiens
tcacttaattgctaca

SEQ ID NO: 4841107 - DNA, 18 bp, Homo sapiens
tcataagatatttttcat

SEQ ID NO: 4841108 - DNA, 21 bp, Homo sapiens
tcataagatatttttcatgat

SEQ ID NO: 4841109 - DNA, 15 bp, Homo sapiens
tcatattttctttca

SEQ ID NO: 4841110 - DNA, 14 bp, Homo sapiens
tcatccattctatt

SEQ ID NO: 4841111 - DNA, 14 bp, Homo sapiens
tcatgattttgaaa

SEQ ID NO: 4841112 - DNA, 19 bp, Homo sapiens
tcatgtaagctgaaaatat

SEQ ID NO: 4841113 - DNA, 18 bp, Homo sapiens
tccaatttctattaaagg

SEQ ID NO: 4841114 - DNA, 13 bp, Homo sapiens
tccatataaatat

SEQ ID NO: 4841115 - DNA, 19 bp, Homo sapiens
tccatataaatattagaaa

SEQ ID NO: 4841116 - DNA, 18 bp, Homo sapiens
tccccaacatgtaataag

SEQ ID NO: 4841117 - DNA, 16 bp, Homo sapiens
tcctaattttgagaaa

SEQ ID NO: 4841118 - DNA, 20 bp, Homo sapiens
tcctacattaattatctagt

SEQ ID NO: 4841119 - DNA, 14 bp, Homo sapiens
tcctaggaaaatac

SEQ ID NO: 4841120 - DNA, 12 bp, Homo sapiens
tcctttgttccc

SEQ ID NO: 4841121 - DNA, 19 bp, Homo sapiens
tcgctttcttgctgtccaa

SEQ ID NO: 4841122 - DNA, 23 bp, Homo sapiens
tctatgaactctgttttctttct

SEQ ID NO: 4841123 - DNA, 11 bp, Homo sapiens
tctattaaagg

SEQ ID NO: 4841124 - DNA, 24 bp, Homo sapiens
tctattttgtaactttctctatga

SEQ ID NO: 4841125 - DNA, 12 bp, Homo sapiens
tctcttgatttt

SEQ ID NO: 4841126 - DNA, 14 bp, Homo sapiens
tctgacctccatga

SEQ ID NO: 4841127 - DNA, 19 bp, Homo sapiens
tctgggctgtctattctag

SEQ ID NO: 4841128 - DNA, 15 bp, Homo sapiens
tcttcttttgtgaag

SEQ ID NO: 4841129 - DNA, 20 bp, Homo sapiens
tctttaacttaattgctatg

SEQ ID NO: 4841130 - DNA, 15 bp, Homo sapiens
tgaagatatttttcc

SEQ ID NO: 4841131 - DNA, 19 bp, Homo sapiens
tgaagggccttgagcatct

SEQ ID NO: 4841132 - DNA, 22 bp, Homo sapiens
tgacctccatgactgcacagta

SEQ ID NO: 4841133 - DNA, 19 bp, Homo sapiens
tgaggaaagcatgtattca

SEQ ID NO: 4841134 - DNA, 22 bp, Homo sapiens
tgcacttatttatgaacctgcc

SEQ ID NO: 4841135 - DNA, 16 bp, Homo sapiens
tgcagtatgaaaataa

SEQ ID NO: 4841136 - DNA, 20 bp, Homo sapiens
tgccatgtagggttccctta

SEQ ID NO: 4841137 - DNA, 20 bp, Homo sapiens
tgctatgttttgacattttt

SEQ ID NO: 4841138 - DNA, 18 bp, Homo sapiens
tggattctgcctaataaa

SEQ ID NO: 4841139 - DNA, 21 bp, Homo sapiens
tgggtagaaagagatacagag

SEQ ID NO: 4841140 - DNA, 17 bp, Homo sapiens
tgtgcacttatttatga

SEQ ID NO: 4841141 - DNA, 19 bp, Homo sapiens
tgtttagtaaactcaataa

SEQ ID NO: 4841142 - DNA, 16 bp, Homo sapiens
tgtttataaacattgt

SEQ ID NO: 4841143 - DNA, 16 bp, Homo sapiens
ttaatctgtatttccc

SEQ ID NO: 4841144 - DNA, 13 bp, Homo sapiens
ttacattctgaat

SEQ ID NO: 4841145 - DNA, 15 bp, Homo sapiens
ttaccttattgcact

SEQ ID NO: 4841146 - DNA, 23 bp, Homo sapiens
ttatgaagggccttgagcatctg

SEQ ID NO: 4841147 - DNA, 22 bp, Homo sapiens
ttcattcatgtcatgtgtacaa

SEQ ID NO: 4841148 - DNA, 11 bp, Homo sapiens
ttcctttgttc

SEQ ID NO: 4841149 - DNA, 19 bp, Homo sapiens
ttcgtctgtttataaacat

SEQ ID NO: 4841150 - DNA, 12 bp, Homo sapiens
ttctattaaagg

SEQ ID NO: 4841151 - DNA, 15 bp, Homo sapiens
ttctattgttgtaca

SEQ ID NO: 4841152 - DNA, 16 bp, Homo sapiens
ttcttatttcatgaaa

SEQ ID NO: 4841153 - DNA, 23 bp, Homo sapiens
ttgggtagaaagagatacagagg

SEQ ID NO: 4841154 - DNA, 23 bp, Homo sapiens
tttagtagatattaccagttttc

SEQ ID NO: 4841155 - DNA, 19 bp, Homo sapiens
tttcctaagtgattgtatg

SEQ ID NO: 4841156 - DNA, 13 bp, Homo sapiens
tttctattaaagg

SEQ ID NO: 4841157 - DNA, 19 bp, Homo sapiens
tttctgggctgtctattct

SEQ ID NO: 4841158 - DNA, 21 bp, Homo sapiens
tttgcagctgagagaaaataa

SEQ ID NO: 4841159 - DNA, 16 bp, Homo sapiens
tttggctagtccttgt

SEQ ID NO: 4841160 - DNA, 18 bp, Homo sapiens
ttttagtgattttaataa

SEQ ID NO: 4841161 - DNA, 11 bp, Homo sapiens
ttttgagaaag

SEQ ID NO: 4841162 - DNA, 11 bp, Homo sapiens
tttttcatgat

SEQ ID NO: 4841163 - DNA, 18 bp, Homo sapiens
tttttcatgattttgaaa

SEQ ID NO: 4841164 - DNA, 12 bp, Homo sapiens
agctgaaaatat

SEQ ID NO: 4841165 - DNA, 16 bp, Homo sapiens
agctgagagaaaataa

SEQ ID NO: 4841166 - DNA, 12 bp, Homo sapiens
agctttgttctt

SEQ ID NO: 4841167 - DNA, 14 bp, Homo sapiens
aggctaagctgccg

SEQ ID NO: 4841168 - DNA, 17 bp, Homo sapiens
agggccttgagcatctg

SEQ ID NO: 4841169 - DNA, 13 bp, Homo sapiens
agtatgaaaataa

SEQ ID NO: 4841170 - DNA, 23 bp, Homo sapiens
agtcaatgttttcagttctcttg

SEQ ID NO: 4841171 - DNA, 23 bp, Homo sapiens
agttttattaataaacattctat

SEQ ID NO: 4841172 - DNA, 20 bp, Homo sapiens
ataaaaaacatttattttca

SEQ ID NO: 4841173 - DNA, 18 bp, Homo sapiens
ataagtttatttcttaaa

SEQ ID NO: 4841174 - DNA, 15 bp, Homo sapiens
atactatattttagg

SEQ ID NO: 4841175 - DNA, 22 bp, Homo sapiens
atataaatattagaaacagctt

SEQ ID NO: 4841176 - DNA, 19 bp, Homo sapiens
atatactcactttctagat

SEQ ID NO: 4841177 - DNA, 21 bp, Homo sapiens
atatttttcatgattttgaaa

SEQ ID NO: 4841178 - DNA, 20 bp, Homo sapiens
atgaagagatttttcatgat

SEQ ID NO: 4841179 - DNA, 22 bp, Homo sapiens
atgaagatatttttccattttt

SEQ ID NO: 4841180 - DNA, 22 bp, Homo sapiens
atgaagggccttgagcatctgg

SEQ ID NO: 4841181 - DNA, 18 bp, Homo sapiens
atgacatcaccacagttt

SEQ ID NO: 4841182 - DNA, 13 bp, Homo sapiens
atgggacattttt

SEQ ID NO: 4841183 - DNA, 16 bp, Homo sapiens
atgtaaagtgatattt

SEQ ID NO: 4841184 - DNA, 24 bp, Homo sapiens
atgtattcagctttagtagatatt

SEQ ID NO: 4841185 - DNA, 21 bp, Homo sapiens
attaaaggttcctttgttccc

SEQ ID NO: 4841186 - DNA, 15 bp, Homo sapiens
attaagaaaatctat

SEQ ID NO: 4841187 - DNA, 19 bp, Homo sapiens
attatatcaatttcctcat

SEQ ID NO: 4841188 - DNA, 15 bp, Homo sapiens
attctatctattcct

SEQ ID NO: 4841189 - DNA, 15 bp, Homo sapiens
attctgcaagcaatc

SEQ ID NO: 4841190 - DNA, 17 bp, Homo sapiens
attcttatttcatgaaa

SEQ ID NO: 4841191 - DNA, 21 bp, Homo sapiens
attgtggggatgatgaaataa

SEQ ID NO: 4841192 - DNA, 14 bp, Homo sapiens
atttcatgaaaatt

SEQ ID NO: 4841193 - DNA, 14 bp, Homo sapiens
attttgatgaacaa

SEQ ID NO: 4841194 - DNA, 17 bp, Homo sapiens
attttgtaactttctct

SEQ ID NO: 4841195 - DNA, 15 bp, Homo sapiens
attttgtttaaatta

SEQ ID NO: 4841196 - DNA, 18 bp, Homo sapiens
atttttaatatatactat

SEQ ID NO: 4841197 - DNA, 19 bp, Homo sapiens
atttttaatatatactatg

SEQ ID NO: 4841198 - DNA, 16 bp, Homo sapiens
caaagcaataatagta

SEQ ID NO: 4841199 - DNA, 11 bp, Homo sapiens
caactactaaa

SEQ ID NO: 4841200 - DNA, 16 bp, Homo sapiens
cacagaaaccaatttt

SEQ ID NO: 4841201 - DNA, 15 bp, Homo sapiens
cagataatccctgta

SEQ ID NO: 4841202 - DNA, 23 bp, Homo sapiens
cagcctccccctgtcccctctat

SEQ ID NO: 4841203 - DNA, 17 bp, Homo sapiens
cagctttttaccaagtt

SEQ ID NO: 4841204 - DNA, 21 bp, Homo sapiens
cataagaagaccctatttccc

SEQ ID NO: 4841205 - DNA, 17 bp, Homo sapiens
cataagatatttttcat

SEQ ID NO: 4841206 - DNA, 23 bp, Homo sapiens
catagtcatgtaagctgaaaata

SEQ ID NO: 4841207 - DNA, 19 bp, Homo sapiens
catccatgttccgagaaga

SEQ ID NO: 4841208 - DNA, 23 bp, Homo sapiens
catcccaaaatcataagatattt

SEQ ID NO: 4841209 - DNA, 24 bp, Homo sapiens
catgattttgaaatcatgaagata

SEQ ID NO: 4841210 - DNA, 14 bp, Homo sapiens
catgctaattatat

SEQ ID NO: 4841211 - DNA, 23 bp, Homo sapiens
catgtaagctgaaaatatggcaa

SEQ ID NO: 4841212 - DNA, 14 bp, Homo sapiens
cattctattgttaa

SEQ ID NO: 4841213 - DNA, 17 bp, Homo sapiens
ccaactactaaactggg

SEQ ID NO: 4841214 - DNA, 22 bp, Homo sapiens
ccacagctttttaccaagtttc

SEQ ID NO: 4841215 - DNA, 16 bp, Homo sapiens
ccacaggcccacagta

SEQ ID NO: 4841216 - DNA, 20 bp, Homo sapiens
ccctaagtccaactactaaa

SEQ ID NO: 4841217 - DNA, 22 bp, Homo sapiens
cctaatgacatcaccacagttt

SEQ ID NO: 4841218 - DNA, 19 bp, Homo sapiens
cctccatgactgcacagta

SEQ ID NO: 4841219 - DNA, 14 bp, Homo sapiens
cctccccctgtccc

SEQ ID NO: 4841220 - DNA, 19 bp, Homo sapiens
cctttgttccctaagtcca

SEQ ID NO: 4841221 - DNA, 16 bp, Homo sapiens
ctaattatataatatt

SEQ ID NO: 4841222 - DNA, 18 bp, Homo sapiens
ctaattatataatatttt

SEQ ID NO: 4841223 - DNA, 14 bp, Homo sapiens
ctagaatttcttta

SEQ ID NO: 4841224 - DNA, 12 bp, Homo sapiens
ctaggaaaatac

SEQ ID NO: 4841225 - DNA, 19 bp, Homo sapiens
ctatgaactctgttttctt

SEQ ID NO: 4841226 - DNA, 21 bp, Homo sapiens
ctatgacctcgccctccacaa

SEQ ID NO: 4841227 - DNA, 13 bp, Homo sapiens
ctgggggatatta

SEQ ID NO: 4841228 - DNA, 22 bp, Homo sapiens
ctgtccaatttctattaaaggt

SEQ ID NO: 4841229 - DNA, 12 bp, Homo sapiens
cttgctgtccaa

SEQ ID NO: 4841230 - DNA, 13 bp, Homo sapiens
ctttaaatgaata

SEQ ID NO: 4841231 - DNA, 18 bp, Homo sapiens
gaaaataatcattcttat

SEQ ID NO: 4841232 - DNA, 16 bp, Homo sapiens
gaaagagatacagagg

SEQ ID NO: 4841233 - DNA, 22 bp, Homo sapiens
gaagggccttgagcatctggat

SEQ ID NO: 4841234 - DNA, 18 bp, Homo sapiens
gactacttgggagcaccg

SEQ ID NO: 4841235 - DNA, 22 bp, Homo sapiens
gagcacaagaggagatccaggg

SEQ ID NO: 4841236 - DNA, 15 bp, Homo sapiens
gagtctatcaatcaa

SEQ ID NO: 4841237 - DNA, 21 bp, Homo sapiens
gataatgtgatattatacata

SEQ ID NO: 4841238 - DNA, 18 bp, Homo sapiens
gatatttttccatttttt

SEQ ID NO: 4841239 - DNA, 12 bp, Homo sapiens
gatgtaaagtga

SEQ ID NO: 4841240 - DNA, 21 bp, Homo sapiens
gattttgaaatcatgaagata

SEQ ID NO: 4841241 - DNA, 13 bp, Homo sapiens
gcacatccctgga

SEQ ID NO: 4841242 - DNA, 21 bp, Homo sapiens
gccagatgcacatccctggaa

SEQ ID NO: 4841243 - DNA, 11 bp, Homo sapiens
gcctaataaaa

SEQ ID NO: 4841244 - DNA, 14 bp, Homo sapiens
gcctggttagaggc

SEQ ID NO: 4841245 - DNA, 19 bp, Homo sapiens
gctcccacagaacacagca

SEQ ID NO: 4841246 - DNA, 22 bp, Homo sapiens
ggaaaaccagactacttgggag

SEQ ID NO: 4841247 - DNA, 18 bp, Homo sapiens
ggattctgcctaataaaa

SEQ ID NO: 4841248 - DNA, 14 bp, Homo sapiens
ggatttatttttcc

SEQ ID NO: 4841249 - DNA, 16 bp, Homo sapiens
ggcaacgcacaaaaca

SEQ ID NO: 4841250 - DNA, 21 bp, Homo sapiens
ggccagatgcacatccctgga

SEQ ID NO: 4841251 - DNA, 16 bp, Homo sapiens
ggcctatctaaactgg

SEQ ID NO: 4841252 - DNA, 15 bp, Homo sapiens
ggccttgagcatctg

SEQ ID NO: 4841253 - DNA, 17 bp, Homo sapiens
gggccttgagcatctgg

SEQ ID NO: 4841254 - DNA, 15 bp, Homo sapiens
ggtggaacaagcaca

SEQ ID NO: 4841255 - DNA, 20 bp, Homo sapiens
ggttcctttgttccctaagt

SEQ ID NO: 4841256 - DNA, 18 bp, Homo sapiens
gtattaagaaaatctatt

SEQ ID NO: 4841257 - DNA, 13 bp, Homo sapiens
gtccaactactaa

SEQ ID NO: 4841258 - DNA, 17 bp, Homo sapiens
gtccaatttctattaaa

SEQ ID NO: 4841259 - DNA, 19 bp, Homo sapiens
gtccaatttctattaaagg

SEQ ID NO: 4841260 - DNA, 20 bp, Homo sapiens
gttatttttacattctgaat

SEQ ID NO: 4841261 - DNA, 12 bp, Homo sapiens
gttcacattttt

SEQ ID NO: 4841262 - DNA, 16 bp, Homo sapiens
gttcatccattctatt

SEQ ID NO: 4841263 - DNA, 14 bp, Homo sapiens
gtttatttcttaaa

SEQ ID NO: 4841264 - DNA, 16 bp, Homo sapiens
taaaggttcctttgtt

SEQ ID NO: 4841265 - DNA, 20 bp, Homo sapiens
taaaggttcctttgttccct

SEQ ID NO: 4841266 - DNA, 21 bp, Homo sapiens
taagatatgggacatttttga

SEQ ID NO: 4841267 - DNA, 15 bp, Homo sapiens
taagatatttttcat

SEQ ID NO: 4841268 - DNA, 16 bp, Homo sapiens
taagtccaactactaa

SEQ ID NO: 4841269 - DNA, 17 bp, Homo sapiens
taagtccaactactaaa

SEQ ID NO: 4841270 - DNA, 23 bp, Homo sapiens
taataaaaaacatttattttcat

SEQ ID NO: 4841271 - DNA, 21 bp, Homo sapiens
taatgttgggtagaaagagat

SEQ ID NO: 4841272 - DNA, 13 bp, Homo sapiens
tacagttaagttt

SEQ ID NO: 4841273 - DNA, 16 bp, Homo sapiens
tactactgaatctcta

SEQ ID NO: 4841274 - DNA, 22 bp, Homo sapiens
tagaagccccgttataactcct

SEQ ID NO: 4841275 - DNA, 14 bp, Homo sapiens
tagtactaactcct

SEQ ID NO: 4841276 - DNA, 13 bp, Homo sapiens
tatagtccagctt

SEQ ID NO: 4841277 - DNA, 19 bp, Homo sapiens
ctttaacttaattgctatg

SEQ ID NO: 4841278 - DNA, 11 bp, Homo sapiens
ctttgttccct

SEQ ID NO: 4841279 - DNA, 17 bp, Homo sapiens
gaacagataatccctgt

SEQ ID NO: 4841280 - DNA, 18 bp, Homo sapiens
gaagagatttttcatgat

SEQ ID NO: 4841281 - DNA, 14 bp, Homo sapiens
gaagatatttttcc

SEQ ID NO: 4841282 - DNA, 20 bp, Homo sapiens
gaagggccttgagcatctgg

SEQ ID NO: 4841283 - DNA, 18 bp, Homo sapiens
gacagcctccccctgtcc

SEQ ID NO: 4841284 - DNA, 20 bp, Homo sapiens
gactacttgggagcaccgcc

SEQ ID NO: 4841285 - DNA, 18 bp, Homo sapiens
gagatccagggcaaggcc

SEQ ID NO: 4841286 - DNA, 12 bp, Homo sapiens
gagatttttcat

SEQ ID NO: 4841287 - DNA, 21 bp, Homo sapiens
gagcatctggattctgcctaa

SEQ ID NO: 4841288 - DNA, 16 bp, Homo sapiens
gatatgggacattttt

SEQ ID NO: 4841289 - DNA, 17 bp, Homo sapiens
gatatgggacatttttg

SEQ ID NO: 4841290 - DNA, 16 bp, Homo sapiens
gatgcacatccctgga

SEQ ID NO: 4841291 - DNA, 17 bp, Homo sapiens
gattctgcctaataaaa

SEQ ID NO: 4841292 - DNA, 22 bp, Homo sapiens
gccagatgcacatccctggaag

SEQ ID NO: 4841293 - DNA, 12 bp, Homo sapiens
gctgaccagaca

SEQ ID NO: 4841294 - DNA, 15 bp, Homo sapiens
gctgagagaaaataa

SEQ ID NO: 4841295 - DNA, 23 bp, Homo sapiens
gctgtccaatttctattaaaggt

SEQ ID NO: 4841296 - DNA, 17 bp, Homo sapiens
ggattctgcctaataaa

SEQ ID NO: 4841297 - DNA, 16 bp, Homo sapiens
ggccttgagcatctgg

SEQ ID NO: 4841298 - DNA, 13 bp, Homo sapiens
ggctgaaagacag

SEQ ID NO: 4841299 - DNA, 16 bp, Homo sapiens
gggccttgagcatctg

SEQ ID NO: 4841300 - DNA, 17 bp, Homo sapiens
ggtagaggatgaggaaa

SEQ ID NO: 4841301 - DNA, 22 bp, Homo sapiens
gtactaactcctaggaaaatac

SEQ ID NO: 4841302 - DNA, 20 bp, Homo sapiens
gtcatgtaagctgaaaatat

SEQ ID NO: 4841303 - DNA, 15 bp, Homo sapiens
gtcatgtttaagaaa

SEQ ID NO: 4841304 - DNA, 14 bp, Homo sapiens
gtccaatttctatt

SEQ ID NO: 4841305 - DNA, 13 bp, Homo sapiens
gtccttcaaaggc

SEQ ID NO: 4841306 - DNA, 19 bp, Homo sapiens
gttatttttacattctgaa

SEQ ID NO: 4841307 - DNA, 16 bp, Homo sapiens
gtttcatccttttcat

SEQ ID NO: 4841308 - DNA, 17 bp, Homo sapiens
gttttgacatttttagt

SEQ ID NO: 4841309 - DNA, 16 bp, Homo sapiens
taaaaagtcaatgttt

SEQ ID NO: 4841310 - DNA, 15 bp, Homo sapiens
taaaggttcctttgt

SEQ ID NO: 4841311 - DNA, 16 bp, Homo sapiens
taaagtgatatttccc

SEQ ID NO: 4841312 - DNA, 23 bp, Homo sapiens
taactatagtccagctttgttct

SEQ ID NO: 4841313 - DNA, 20 bp, Homo sapiens
taagacggatttatttttcc

SEQ ID NO: 4841314 - DNA, 19 bp, Homo sapiens
taagatatgggacattttt

SEQ ID NO: 4841315 - DNA, 23 bp, Homo sapiens
taagtccaactactaaactgggg

SEQ ID NO: 4841316 - DNA, 15 bp, Homo sapiens
taatacacacagtta

SEQ ID NO: 4841317 - DNA, 20 bp, Homo sapiens
taatcattcttatttcatga

SEQ ID NO: 4841318 - DNA, 13 bp, Homo sapiens
taatgtgatatta

SEQ ID NO: 4841319 - DNA, 17 bp, Homo sapiens
tacccgttcacattttt

SEQ ID NO: 4841320 - DNA, 14 bp, Homo sapiens
tactcagaattaag

SEQ ID NO: 4841321 - DNA, 17 bp, Homo sapiens
tagaaagagatacagag

SEQ ID NO: 4841322 - DNA, 22 bp, Homo sapiens
tagatgctctatgtgcttgtaa

SEQ ID NO: 4841323 - DNA, 19 bp, Homo sapiens
taggaaagaccatttttcc

SEQ ID NO: 4841324 - DNA, 17 bp, Homo sapiens
tatactcactttctaga

SEQ ID NO: 4841325 - DNA, 19 bp, Homo sapiens
tatttcttaaatctagtaa

SEQ ID NO: 4841326 - DNA, 12 bp, Homo sapiens
tatttttcatga

SEQ ID NO: 4841327 - DNA, 20 bp, Homo sapiens
tatttttcatgattttgaaa

SEQ ID NO: 4841328 - DNA, 22 bp, Homo sapiens
tcaaacagtacactatcttaat

SEQ ID NO: 4841329 - DNA, 14 bp, Homo sapiens
tcactttctagatt

SEQ ID NO: 4841330 - DNA, 19 bp, Homo sapiens
tcatccattctattgttaa

SEQ ID NO: 4841331 - DNA, 11 bp, Homo sapiens
tcatgaaaatt

SEQ ID NO: 4841332 - DNA, 21 bp, Homo sapiens
tcatgattttgaaatcatgaa

SEQ ID NO: 4841333 - DNA, 14 bp, Homo sapiens
tcatgtttaagaaa

SEQ ID NO: 4841334 - DNA, 20 bp, Homo sapiens
tccagtcaggcctatctaaa

SEQ ID NO: 4841335 - DNA, 21 bp, Homo sapiens
tccatgcaccctcatacacag

SEQ ID NO: 4841336 - DNA, 21 bp, Homo sapiens
tccctaagtccaactactaaa

SEQ ID NO: 4841337 - DNA, 13 bp, Homo sapiens
tcctagatgctct

SEQ ID NO: 4841338 - DNA, 13 bp, Homo sapiens
tcctttgttccct

SEQ ID NO: 4841339 - DNA, 16 bp, Homo sapiens
tcgcttcatgtaacta

SEQ ID NO: 4841340 - DNA, 21 bp, Homo sapiens
tctaaactggattcacagctc

SEQ ID NO: 4841341 - DNA, 22 bp, Homo sapiens
tctagtttaattaatctgtaat

SEQ ID NO: 4841342 - DNA, 12 bp, Homo sapiens
tctattaaaggt

SEQ ID NO: 4841343 - DNA, 14 bp, Homo sapiens
tctattaaaggttc

SEQ ID NO: 4841344 - DNA, 23 bp, Homo sapiens
tctattgttgtacacagaaatac

SEQ ID NO: 4841345 - DNA, 20 bp, Homo sapiens
aagagaacccacgaacattc

SEQ ID NO: 4841346 - DNA, 17 bp, Homo sapiens
aagagatttttcatgat

SEQ ID NO: 4841347 - DNA, 19 bp, Homo sapiens
aagggccttgagcatctgg

SEQ ID NO: 4841348 - DNA, 18 bp, Homo sapiens
aaggttcctttgttccct

SEQ ID NO: 4841349 - DNA, 20 bp, Homo sapiens
aagtacccgttcacattttt

SEQ ID NO: 4841350 - DNA, 18 bp, Homo sapiens
aagtcaatgttttcagtt

SEQ ID NO: 4841351 - DNA, 18 bp, Homo sapiens
aagtgattgtatgaattt

SEQ ID NO: 4841352 - DNA, 13 bp, Homo sapiens
aatattagaaaca

SEQ ID NO: 4841353 - DNA, 13 bp, Homo sapiens
aatatttttctta

SEQ ID NO: 4841354 - DNA, 17 bp, Homo sapiens
aatcactaaaaatgatc

SEQ ID NO: 4841355 - DNA, 14 bp, Homo sapiens
aatctattttgtaa

SEQ ID NO: 4841356 - DNA, 12 bp, Homo sapiens
aatgctttcgat

SEQ ID NO: 4841357 - DNA, 14 bp, Homo sapiens
aatgttgaattttg

SEQ ID NO: 4841358 - DNA, 12 bp, Homo sapiens
aattattgtaca

SEQ ID NO: 4841359 - DNA, 15 bp, Homo sapiens
aatttctattaaagg

SEQ ID NO: 4841360 - DNA, 16 bp, Homo sapiens
aatttctattaaaggt

SEQ ID NO: 4841361 - DNA, 21 bp, Homo sapiens
acaaatctcaagcaaacagct

SEQ ID NO: 4841362 - DNA, 22 bp, Homo sapiens
acacagtgctgaccagacagcc

SEQ ID NO: 4841363 - DNA, 18 bp, Homo sapiens
acaccgttcattcaggca

SEQ ID NO: 4841364 - DNA, 19 bp, Homo sapiens
acagcaattcctcaggcta

SEQ ID NO: 4841365 - DNA, 20 bp, Homo sapiens
acagtgctgaccagacagcc

SEQ ID NO: 4841366 - DNA, 23 bp, Homo sapiens
accaagtttcaggtattaagaaa

SEQ ID NO: 4841367 - DNA, 21 bp, Homo sapiens
accatgtaaagaacataaata

SEQ ID NO: 4841368 - DNA, 18 bp, Homo sapiens
acccacaggcccacagta

SEQ ID NO: 4841369 - DNA, 15 bp, Homo sapiens
acggatttatttttc

SEQ ID NO: 4841370 - DNA, 15 bp, Homo sapiens
actcactttctagat

SEQ ID NO: 4841371 - DNA, 21 bp, Homo sapiens
acttgctgcagtatgaaaata

SEQ ID NO: 4841372 - DNA, 19 bp, Homo sapiens
agaaagtcttatttattca

SEQ ID NO: 4841373 - DNA, 20 bp, Homo sapiens
agaacacagcaattcctcag

SEQ ID NO: 4841374 - DNA, 19 bp, Homo sapiens
agacaccgttcattcaggc

SEQ ID NO: 4841375 - DNA, 16 bp, Homo sapiens
agatatttttcatgat

SEQ ID NO: 4841376 - DNA, 18 bp, Homo sapiens
agatttccatataaatat

SEQ ID NO: 4841377 - DNA, 18 bp, Homo sapiens
agctttgttcttcttaaa

SEQ ID NO: 4841378 - DNA, 18 bp, Homo sapiens
aggatactatattttagg

SEQ ID NO: 4841379 - DNA, 18 bp, Homo sapiens
agggccttgagcatctgg

SEQ ID NO: 4841380 - DNA, 22 bp, Homo sapiens
agggtcatatcactcaggccct

SEQ ID NO: 4841381 - DNA, 19 bp, Homo sapiens
agtacccgttcacattttt

SEQ ID NO: 4841382 - DNA, 12 bp, Homo sapiens
agtatgaaaata

SEQ ID NO: 4841383 - DNA, 23 bp, Homo sapiens
agtatgcttgaaaagataaatta

SEQ ID NO: 4841384 - DNA, 21 bp, Homo sapiens
agtctgtgagattcattcatg

SEQ ID NO: 4841385 - DNA, 20 bp, Homo sapiens
agttaacacctttaaagtgt

SEQ ID NO: 4841386 - DNA, 17 bp, Homo sapiens
agttcatccattctatt

SEQ ID NO: 4841387 - DNA, 15 bp, Homo sapiens
ataaaaaacatttat

SEQ ID NO: 4841388 - DNA, 13 bp, Homo sapiens
ataaacattgtat

SEQ ID NO: 4841389 - DNA, 18 bp, Homo sapiens
ataagatatttttcatga

SEQ ID NO: 4841390 - DNA, 14 bp, Homo sapiens
ataagtttatttct

SEQ ID NO: 4841391 - DNA, 22 bp, Homo sapiens
ataagtttatttcttaaatcta

SEQ ID NO: 4841392 - DNA, 19 bp, Homo sapiens
ataatatattttaaatatt

SEQ ID NO: 4841393 - DNA, 18 bp, Homo sapiens
ataatatttttaatatat

SEQ ID NO: 4841394 - DNA, 13 bp, Homo sapiens
atagttgtaacta

SEQ ID NO: 4841395 - DNA, 16 bp, Homo sapiens
atataaatattagaaa

SEQ ID NO: 4841396 - DNA, 14 bp, Homo sapiens
atattaatattcct

SEQ ID NO: 4841397 - DNA, 23 bp, Homo sapiens
atcattcttatttcatgaaaatt

SEQ ID NO: 4841398 - DNA, 13 bp, Homo sapiens
atcctgctaagtt

SEQ ID NO: 4841399 - DNA, 20 bp, Homo sapiens
atcgatttttaaaaattaaa

SEQ ID NO: 4841400 - DNA, 22 bp, Homo sapiens
atctaaactggattcacagctc

SEQ ID NO: 4841401 - DNA, 19 bp, Homo sapiens
atctattcctggtagaata

SEQ ID NO: 4841402 - DNA, 21 bp, Homo sapiens
atgaagggccttgagcatctg

SEQ ID NO: 4841403 - DNA, 19 bp, Homo sapiens
atgtaaagaacataaataa

SEQ ID NO: 4841404 - DNA, 16 bp, Homo sapiens
atgtaagctgaaaata

SEQ ID NO: 4841405 - DNA, 21 bp, Homo sapiens
atgtcatgtgtacaaaagttt

SEQ ID NO: 4841406 - DNA, 16 bp, Homo sapiens
atgttttgacattttt

SEQ ID NO: 4841407 - DNA, 24 bp, Homo sapiens
attaagtctgtgagattcattcat

SEQ ID NO: 4841408 - DNA, 16 bp, Homo sapiens
attcatattttctttc

SEQ ID NO: 4841409 - DNA, 20 bp, Homo sapiens
attcatattttctttcaaaa

SEQ ID NO: 4841410 - DNA, 22 bp, Homo sapiens
attgctatgttttgacattttt

SEQ ID NO: 4841411 - DNA, 15 bp, Homo sapiens
attttcattattcct

SEQ ID NO: 4841412 - DNA, 14 bp, Homo sapiens
attttctttcaaaa

SEQ ID NO: 4841413 - DNA, 20 bp, Homo sapiens
atttttcctccactgaacta

SEQ ID NO: 4841414 - DNA, 14 bp, Homo sapiens
caaagcaataatag

SEQ ID NO: 4841415 - DNA, 21 bp, Homo sapiens
ttttcatgattttgaaaccat

SEQ ID NO: 4841416 - DNA, 13 bp, Homo sapiens
ttttcctaagtga

SEQ ID NO: 4841417 - DNA, 20 bp, Homo sapiens
ttttcctaagtgattgtatg

SEQ ID NO: 4841418 - DNA, 21 bp, Homo sapiens
ttttgaaaccatgaagagatt

SEQ ID NO: 4841419 - DNA, 17 bp, Homo sapiens
atttattcatattttct

SEQ ID NO: 4841420 - DNA, 19 bp, Homo sapiens
atttcctaattttgagaaa

SEQ ID NO: 4841421 - DNA, 21 bp, Homo sapiens
atttcgtctgtttataaacat

SEQ ID NO: 4841422 - DNA, 14 bp, Homo sapiens
atttctattaaagg

SEQ ID NO: 4841423 - DNA, 15 bp, Homo sapiens
atttctattaaaggt

SEQ ID NO: 4841424 - DNA, 21 bp, Homo sapiens
atttgcagctgagagaaaata

SEQ ID NO: 4841425 - DNA, 22 bp, Homo sapiens
attttgagaaagtcttatttat

SEQ ID NO: 4841426 - DNA, 17 bp, Homo sapiens
atttttacattctgaat

SEQ ID NO: 4841427 - DNA, 19 bp, Homo sapiens
atttttcatgattttgaaa

SEQ ID NO: 4841428 - DNA, 18 bp, Homo sapiens
caaaagtttcatcctttt

SEQ ID NO: 4841429 - DNA, 14 bp, Homo sapiens
caagaggagatcca

SEQ ID NO: 4841430 - DNA, 13 bp, Homo sapiens
caatcaaataata

SEQ ID NO: 4841431 - DNA, 13 bp, Homo sapiens
caatgttcatcat

SEQ ID NO: 4841432 - DNA, 16 bp, Homo sapiens
caatttctattaaagg

SEQ ID NO: 4841433 - DNA, 20 bp, Homo sapiens
cacttatttatgaacctgcc

SEQ ID NO: 4841434 - DNA, 16 bp, Homo sapiens
cagagataaagacctt

SEQ ID NO: 4841435 - DNA, 13 bp, Homo sapiens
caggcccacagta

SEQ ID NO: 4841436 - DNA, 23 bp, Homo sapiens
cagtgctgaccagacagcctccc

SEQ ID NO: 4841437 - DNA, 18 bp, Homo sapiens
catatccagtattgttcc

SEQ ID NO: 4841438 - DNA, 14 bp, Homo sapiens
catattgtgtgtaa

SEQ ID NO: 4841439 - DNA, 23 bp, Homo sapiens
catctggattctgcctaataaaa

SEQ ID NO: 4841440 - DNA, 17 bp, Homo sapiens
catgaagatatttttcc

SEQ ID NO: 4841441 - DNA, 16 bp, Homo sapiens
catgcaccctcataca

SEQ ID NO: 4841442 - DNA, 20 bp, Homo sapiens
catgcaccctcatacacaga

SEQ ID NO: 4841443 - DNA, 19 bp, Homo sapiens
catgctgaaggctgaaaga

SEQ ID NO: 4841444 - DNA, 16 bp, Homo sapiens
ccagactacttgggag

SEQ ID NO: 4841445 - DNA, 14 bp, Homo sapiens
ccgttcacattttt

SEQ ID NO: 4841446 - DNA, 18 bp, Homo sapiens
cctgtggatgtaaagtga

SEQ ID NO: 4841447 - DNA, 11 bp, Homo sapiens
cctttgttccc

SEQ ID NO: 4841448 - DNA, 17 bp, Homo sapiens
cgtctgtttataaacat

SEQ ID NO: 4841449 - DNA, 18 bp, Homo sapiens
ctaagtccaactactaaa

SEQ ID NO: 4841450 - DNA, 22 bp, Homo sapiens
ctacatgatctagagccagtta

SEQ ID NO: 4841451 - DNA, 18 bp, Homo sapiens
ctatgttttgacattttt

SEQ ID NO: 4841452 - DNA, 20 bp, Homo sapiens
ctctatgaactctgttttct

SEQ ID NO: 4841453 - DNA, 20 bp, Homo sapiens
ctctgtgcacttatttatga

SEQ ID NO: 4841454 - DNA, 13 bp, Homo sapiens
ctcttgattttca

SEQ ID NO: 4841455 - DNA, 16 bp, Homo sapiens
ctgcagtatgaaaata

SEQ ID NO: 4841456 - DNA, 13 bp, Homo sapiens
ctgtctattctag

SEQ ID NO: 4841457 - DNA, 17 bp, Homo sapiens
ctgttgaatttcccaca

SEQ ID NO: 4841458 - DNA, 21 bp, Homo sapiens
cttactgatttttaagttatt

SEQ ID NO: 4841459 - DNA, 21 bp, Homo sapiens
cttatattaatattcctcagt

SEQ ID NO: 4841460 - DNA, 23 bp, Homo sapiens
cttccaccaagttggaacatcct

SEQ ID NO: 4841461 - DNA, 12 bp, Homo sapiens
cttgagcatctg

SEQ ID NO: 4841462 - DNA, 21 bp, Homo sapiens
cttgctgcagtatgaaaataa

SEQ ID NO: 4841463 - DNA, 16 bp, Homo sapiens
cttgtgtcaaacagta

SEQ ID NO: 4841464 - DNA, 16 bp, Homo sapiens
ctttcttgctgtccaa

SEQ ID NO: 4841465 - DNA, 14 bp, Homo sapiens
ctttggtccttcaa

SEQ ID NO: 4841466 - DNA, 16 bp, Homo sapiens
gaaattggaagagcac

SEQ ID NO: 4841467 - DNA, 18 bp, Homo sapiens
gaacagataatccctgta

SEQ ID NO: 4841468 - DNA, 15 bp, Homo sapiens
gaagagatttttcat

SEQ ID NO: 4841469 - DNA, 18 bp, Homo sapiens
gaagggccttgagcatct

SEQ ID NO: 4841470 - DNA, 19 bp, Homo sapiens
gaagggccttgagcatctg

SEQ ID NO: 4841471 - DNA, 21 bp, Homo sapiens
gaagtacccgttcacattttt

SEQ ID NO: 4841472 - DNA, 23 bp, Homo sapiens
gaatattttgttttgtgcagaga

SEQ ID NO: 4841473 - DNA, 17 bp, Homo sapiens
gaatttcccacataccc

SEQ ID NO: 4841474 - DNA, 23 bp, Homo sapiens
gacatccatgttccgagaagaac

SEQ ID NO: 4841475 - DNA, 15 bp, Homo sapiens
gatgcacatccctgg

SEQ ID NO: 4841476 - DNA, 16 bp, Homo sapiens
gattctgcctaataaa

SEQ ID NO: 4841477 - DNA, 23 bp, Homo sapiens
gcatctggattctgcctaataaa

SEQ ID NO: 4841478 - DNA, 13 bp, Homo sapiens
gccttgagcatct

SEQ ID NO: 4841479 - DNA, 14 bp, Homo sapiens
gccttgagcatctg

SEQ ID NO: 4841480 - DNA, 19 bp, Homo sapiens
gctatgttttgacattttt

SEQ ID NO: 4841481 - DNA, 13 bp, Homo sapiens
gctcccacagaac

SEQ ID NO: 4841482 - DNA, 11 bp, Homo sapiens
gctgaaaatat

SEQ ID NO: 4841483 - DNA, 20 bp, Homo sapiens
ggccagatgcacatccctgg

SEQ ID NO: 4841484 - DNA, 23 bp, Homo sapiens
ggccagatgcacatccctggaag

SEQ ID NO: 4841485 - DNA, 15 bp, Homo sapiens
gggggatattatgaa

SEQ ID NO: 4841486 - DNA, 20 bp, Homo sapiens
ggtagaaagagatacagagg

SEQ ID NO: 4841487 - DNA, 16 bp, Homo sapiens
gtatagactcctgaaa

SEQ ID NO: 4841488 - DNA, 15 bp, Homo sapiens
gtcaatgttttcagt

SEQ ID NO: 4841489 - DNA, 15 bp, Homo sapiens
gtccaactactaaac

SEQ ID NO: 4841490 - DNA, 22 bp, Homo sapiens
gtccaatttctattaaaggttc

SEQ ID NO: 4841491 - DNA, 22 bp, Homo sapiens
gtgaaataccaacctgaagaca

SEQ ID NO: 4841492 - DNA, 17 bp, Homo sapiens
gttagccaatatttttc

SEQ ID NO: 4841493 - DNA, 14 bp, Homo sapiens
gttcctttgttccc

SEQ ID NO: 4841494 - DNA, 14 bp, Homo sapiens
gttttgacattttt

SEQ ID NO: 4841495 - DNA, 14 bp, Homo sapiens
taaaaaacatttat

SEQ ID NO: 4841496 - DNA, 15 bp, Homo sapiens
taaagaacataaata

SEQ ID NO: 4841497 - DNA, 19 bp, Homo sapiens
taaaggttcctttgttccc

SEQ ID NO: 4841498 - DNA, 15 bp, Homo sapiens
taacttaattgctat

SEQ ID NO: 4841499 - DNA, 14 bp, Homo sapiens
taagatatttttca

SEQ ID NO: 4841500 - DNA, 14 bp, Homo sapiens
taagctgaaaatat

SEQ ID NO: 4841501 - DNA, 16 bp, Homo sapiens
taagtgattgtatgaa

SEQ ID NO: 4841502 - DNA, 20 bp, Homo sapiens
taagttatttttacattctg

SEQ ID NO: 4841503 - DNA, 17 bp, Homo sapiens
taagtttatttcttaaa

SEQ ID NO: 4841504 - DNA, 16 bp, Homo sapiens
taatattcctcagttc

SEQ ID NO: 4841505 - DNA, 22 bp, Homo sapiens
taatcattcttatttcatgaaa

SEQ ID NO: 4841506 - DNA, 20 bp, Homo sapiens
taatgacatcaccacagttt

SEQ ID NO: 4841507 - DNA, 19 bp, Homo sapiens
taatgtgtattacaaatat

SEQ ID NO: 4841508 - DNA, 20 bp, Homo sapiens
taatgttgtatgtcttgttt

SEQ ID NO: 4841509 - DNA, 18 bp, Homo sapiens
tacacagaaatacagtta

SEQ ID NO: 4841510 - DNA, 19 bp, Homo sapiens
tagatatccacttgagaca

SEQ ID NO: 4841511 - DNA, 21 bp, Homo sapiens
taggtcttaatacacacagtt

SEQ ID NO: 4841512 - DNA, 22 bp, Homo sapiens
tagtccagctttgttcttctta

SEQ ID NO: 4841513 - DNA, 22 bp, Homo sapiens
tagttagccaatatttttctta

SEQ ID NO: 4841514 - DNA, 12 bp, Homo sapiens
tatatcttgttt

SEQ ID NO: 4841515 - DNA, 23 bp, Homo sapiens
tatctaaactggattcacagctc

SEQ ID NO: 4841516 - DNA, 22 bp, Homo sapiens
tatctagtttaattaatctgta

SEQ ID NO: 4841517 - DNA, 22 bp, Homo sapiens
tatgaagggccttgagcatctg

SEQ ID NO: 4841518 - DNA, 15 bp, Homo sapiens
tcaatgttttcagtt

SEQ ID NO: 4841519 - DNA, 14 bp, Homo sapiens
tcagccatgtattt

SEQ ID NO: 4841520 - DNA, 17 bp, Homo sapiens
tcaggtattaagaaaat

SEQ ID NO: 4841521 - DNA, 19 bp, Homo sapiens
tcagttctcttgattttca

SEQ ID NO: 4841522 - DNA, 13 bp, Homo sapiens
tcatacacagaaa

SEQ ID NO: 4841523 - DNA, 18 bp, Homo sapiens
tcatattttctttcaaaa

SEQ ID NO: 4841524 - DNA, 22 bp, Homo sapiens
tcatcatgtatcgcttcatgta

SEQ ID NO: 4841525 - DNA, 20 bp, Homo sapiens
tcatgtgtacaaaagtttca

SEQ ID NO: 4841526 - DNA, 16 bp, Homo sapiens
tcatgtttaagaaatt

SEQ ID NO: 4841527 - DNA, 18 bp, Homo sapiens
tcattcttatttcatgaa

SEQ ID NO: 4841528 - DNA, 13 bp, Homo sapiens
tccaactactaaa

SEQ ID NO: 4841529 - DNA, 21 bp, Homo sapiens
tccagctttgttcttcttaaa

SEQ ID NO: 4841530 - DNA, 12 bp, Homo sapiens
tccatataaata

SEQ ID NO: 4841531 - DNA, 18 bp, Homo sapiens
tccctggaaggacatcca

SEQ ID NO: 4841532 - DNA, 13 bp, Homo sapiens
aaaaaacatttat

SEQ ID NO: 4841533 - DNA, 20 bp, Homo sapiens
aaaatctattttgtaacttt

SEQ ID NO: 4841534 - DNA, 17 bp, Homo sapiens
aaaattaaatcaacctt

SEQ ID NO: 4841535 - DNA, 15 bp, Homo sapiens
aaagaccatttttcc

SEQ ID NO: 4841536 - DNA, 15 bp, Homo sapiens
aaaggttcctttgtt

SEQ ID NO: 4841537 - DNA, 21 bp, Homo sapiens
aaaggttcctttgttccctaa

SEQ ID NO: 4841538 - DNA, 23 bp, Homo sapiens
aaataagacggatttatttttcc

SEQ ID NO: 4841539 - DNA, 17 bp, Homo sapiens
aaatattagaaacagct

SEQ ID NO: 4841540 - DNA, 18 bp, Homo sapiens
aacacagcaattcctcag

SEQ ID NO: 4841541 - DNA, 20 bp, Homo sapiens
aaccatgtaaagaacataaa

SEQ ID NO: 4841542 - DNA, 22 bp, Homo sapiens
aacttgctgcagtatgaaaata

SEQ ID NO: 4841543 - DNA, 14 bp, Homo sapiens
aagagatacagagg

SEQ ID NO: 4841544 - DNA, 14 bp, Homo sapiens
aagagatttttcat

SEQ ID NO: 4841545 - DNA, 15 bp, Homo sapiens
aagagatttttcatg

SEQ ID NO: 4841546 - DNA, 12 bp, Homo sapiens
aagctgaaaata

SEQ ID NO: 4841547 - DNA, 18 bp, Homo sapiens
aagggccttgagcatctg

SEQ ID NO: 4841548 - DNA, 18 bp, Homo sapiens
aagtacccgttcacattt

SEQ ID NO: 4841549 - DNA, 17 bp, Homo sapiens
aagtcaatgttttcagt

SEQ ID NO: 4841550 - DNA, 16 bp, Homo sapiens
aagtccaactactaaa

SEQ ID NO: 4841551 - DNA, 13 bp, Homo sapiens
aagtgattgtatg

SEQ ID NO: 4841552 - DNA, 22 bp, Homo sapiens
aataaaaaacatttattttcat

SEQ ID NO: 4841553 - DNA, 17 bp, Homo sapiens
aataatatattttaaat

SEQ ID NO: 4841554 - DNA, 20 bp, Homo sapiens
aatcataagatatttttcat

SEQ ID NO: 4841555 - DNA, 18 bp, Homo sapiens
aatgacatcaccacagtt

SEQ ID NO: 4841556 - DNA, 16 bp, Homo sapiens
aatgtgatattataca

SEQ ID NO: 4841557 - DNA, 21 bp, Homo sapiens
aattattgtacatttatagtt

SEQ ID NO: 4841558 - DNA, 15 bp, Homo sapiens
acagcaattcctcag

SEQ ID NO: 4841559 - DNA, 21 bp, Homo sapiens
accagactacttgggagcacc

SEQ ID NO: 4841560 - DNA, 23 bp, Homo sapiens
accagactacttgggagcaccgc

SEQ ID NO: 4841561 - DNA, 16 bp, Homo sapiens
acccgttcacattttt

SEQ ID NO: 4841562 - DNA, 20 bp, Homo sapiens
actaactcctaggaaaatac

SEQ ID NO: 4841563 - DNA, 17 bp, Homo sapiens
agaaaataatcattctt

SEQ ID NO: 4841564 - DNA, 13 bp, Homo sapiens
agagatacagagg

SEQ ID NO: 4841565 - DNA, 12 bp, Homo sapiens
agatatttttca

SEQ ID NO: 4841566 - DNA, 13 bp, Homo sapiens
agatatttttcat

SEQ ID NO: 4841567 - DNA, 23 bp, Homo sapiens
agtactaactcctaggaaaatac

SEQ ID NO: 4841568 - DNA, 20 bp, Homo sapiens
agtcatgtaagctgaaaata

SEQ ID NO: 4841569 - DNA, 22 bp, Homo sapiens
agttttcctaagtgattgtatg

SEQ ID NO: 4841570 - DNA, 15 bp, Homo sapiens
ataagatatttttca

SEQ ID NO: 4841571 - DNA, 16 bp, Homo sapiens
ataagatatttttcat

SEQ ID NO: 4841572 - DNA, 13 bp, Homo sapiens
atcaatcaactta

SEQ ID NO: 4841573 - DNA, 13 bp, Homo sapiens
atcaccacagttt

SEQ ID NO: 4841574 - DNA, 18 bp, Homo sapiens
atcatgaagatatttttc

SEQ ID NO: 4841575 - DNA, 20 bp, Homo sapiens
atcattcttatttcatgaaa

SEQ ID NO: 4841576 - DNA, 19 bp, Homo sapiens
atcctgatgaggtttctac

SEQ ID NO: 4841577 - DNA, 16 bp, Homo sapiens
atcttaattattgtac

SEQ ID NO: 4841578 - DNA, 16 bp, Homo sapiens
atgaagagatttttca

SEQ ID NO: 4841579 - DNA, 16 bp, Homo sapiens
atgagatattaaacca

SEQ ID NO: 4841580 - DNA, 22 bp, Homo sapiens
atgtgtacaaaagtttcatcct

SEQ ID NO: 4841581 - DNA, 17 bp, Homo sapiens
attaaaggttcctttgt

SEQ ID NO: 4841582 - DNA, 17 bp, Homo sapiens
attaatattcctcagtt

SEQ ID NO: 4841583 - DNA, 14 bp, Homo sapiens
attctgcctaataa

SEQ ID NO: 4841584 - DNA, 16 bp, Homo sapiens
attctgcctaataaaa

SEQ ID NO: 4841585 - DNA, 21 bp, Homo sapiens
attgttgtacacagaaataca

SEQ ID NO: 4841586 - DNA, 13 bp, Homo sapiens
tcctggtagaata

SEQ ID NO: 4841587 - DNA, 20 bp, Homo sapiens
tcctttgttccctaagtcca

SEQ ID NO: 4841588 - DNA, 18 bp, Homo sapiens
tcgtctgtttataaacat

SEQ ID NO: 4841589 - DNA, 18 bp, Homo sapiens
tctacaaaatcctgatga

SEQ ID NO: 4841590 - DNA, 17 bp, Homo sapiens
tctatgtgcttgtaaaa

SEQ ID NO: 4841591 - DNA, 20 bp, Homo sapiens
tctggattctgcctaataaa

SEQ ID NO: 4841592 - DNA, 13 bp, Homo sapiens
tctgtcacttaat

SEQ ID NO: 4841593 - DNA, 19 bp, Homo sapiens
tctgtgagattcattcatg

SEQ ID NO: 4841594 - DNA, 14 bp, Homo sapiens
tcttatttcatgaa

SEQ ID NO: 4841595 - DNA, 18 bp, Homo sapiens
tgaagtacccgttcacat

SEQ ID NO: 4841596 - DNA, 21 bp, Homo sapiens
tgagaaagtcttatttattca

SEQ ID NO: 4841597 - DNA, 13 bp, Homo sapiens
tgagagaaaataa

SEQ ID NO: 4841598 - DNA, 22 bp, Homo sapiens
tgagataatgtgatattataca

SEQ ID NO: 4841599 - DNA, 19 bp, Homo sapiens
tgatatttccccatggttt

SEQ ID NO: 4841600 - DNA, 17 bp, Homo sapiens
tgatctagagccagtta

SEQ ID NO: 4841601 - DNA, 15 bp, Homo sapiens
tgattttgaaatcat

SEQ ID NO: 4841602 - DNA, 12 bp, Homo sapiens
tgcacatccctg

SEQ ID NO: 4841603 - DNA, 19 bp, Homo sapiens
tgcagctgagagaaaataa

SEQ ID NO: 4841604 - DNA, 20 bp, Homo sapiens
tgctctatgtgcttgtaaaa

SEQ ID NO: 4841605 - DNA, 15 bp, Homo sapiens
tggaaatacacagtg

SEQ ID NO: 4841606 - DNA, 16 bp, Homo sapiens
tggaaattggaagagc

SEQ ID NO: 4841607 - DNA, 14 bp, Homo sapiens
tggaacatccttgg

SEQ ID NO: 4841608 - DNA, 19 bp, Homo sapiens
tgtaactatagtccagctt

SEQ ID NO: 4841609 - DNA, 16 bp, Homo sapiens
tgtaagctgaaaatat

SEQ ID NO: 4841610 - DNA, 14 bp, Homo sapiens
tgtattcagcttta

SEQ ID NO: 4841611 - DNA, 14 bp, Homo sapiens
ttaattattgtaca

SEQ ID NO: 4841612 - DNA, 18 bp, Homo sapiens
ttatttttacattctgaa

SEQ ID NO: 4841613 - DNA, 23 bp, Homo sapiens
ttccccatggttttaatctgtat

SEQ ID NO: 4841614 - DNA, 21 bp, Homo sapiens
ttcctgtggatgtaaagtgat

SEQ ID NO: 4841615 - DNA, 18 bp, Homo sapiens
ttcctttgttccctaagt

SEQ ID NO: 4841616 - DNA, 18 bp, Homo sapiens
ttctacaaaatcctgatg

SEQ ID NO: 4841617 - DNA, 14 bp, Homo sapiens
ttctttaacttaat

SEQ ID NO: 4841618 - DNA, 18 bp, Homo sapiens
ttgaattttgatgaacaa

SEQ ID NO: 4841619 - DNA, 17 bp, Homo sapiens
ttgctcctaatgttgaa

SEQ ID NO: 4841620 - DNA, 22 bp, Homo sapiens
ttgtgaagtacccgttcacatt

SEQ ID NO: 4841621 - DNA, 17 bp, Homo sapiens
ttgtggggatgatgaaa

SEQ ID NO: 4841622 - DNA, 14 bp, Homo sapiens
ttgttcttcttaaa

SEQ ID NO: 4841623 - DNA, 16 bp, Homo sapiens
ttgttttgtgcagaga

SEQ ID NO: 4841624 - DNA, 14 bp, Homo sapiens
tttaatgagataat

SEQ ID NO: 4841625 - DNA, 12 bp, Homo sapiens
tttaccaagttt

SEQ ID NO: 4841626 - DNA, 23 bp, Homo sapiens
tttccatgcaccctcatacacag

SEQ ID NO: 4841627 - DNA, 14 bp, Homo sapiens
tttctaatgagata

SEQ ID NO: 4841628 - DNA, 14 bp, Homo sapiens
tttctattaaaggt

SEQ ID NO: 4841629 - DNA, 21 bp, Homo sapiens
tttctgggctgtctattctag

SEQ ID NO: 4841630 - DNA, 13 bp, Homo sapiens
tttgctagttttt

SEQ ID NO: 4841631 - DNA, 21 bp, Homo sapiens
tttggtccttcaaaggcttgt

SEQ ID NO: 4841632 - DNA, 17 bp, Homo sapiens
tttgtattttgtttaaa

SEQ ID NO: 4841633 - DNA, 14 bp, Homo sapiens
tttgtgtgtagtct

SEQ ID NO: 4841634 - DNA, 22 bp, Homo sapiens
tttgtgtttcagccatgtattt

SEQ ID NO: 4841635 - DNA, 15 bp, Homo sapiens
tttgttcttcttaaa

SEQ ID NO: 4841636 - DNA, 13 bp, Homo sapiens
ttttaccaagttt

SEQ ID NO: 4841637 - DNA, 20 bp, Homo sapiens
ttttagtttaaaaaccttgt

SEQ ID NO: 4841638 - DNA, 21 bp, Homo sapiens
ttttcatgattttgaaatcat

SEQ ID NO: 4841639 - DNA, 23 bp, Homo sapiens
ttttgatgaacaaaatttcctaa

SEQ ID NO: 4841640 - DNA, 22 bp, Homo sapiens
aaaaaccttgtatatcttgttt

SEQ ID NO: 4841641 - DNA, 12 bp, Homo sapiens
aaacattctatc

SEQ ID NO: 4841642 - DNA, 16 bp, Homo sapiens
aaatattttgctagtt

SEQ ID NO: 4841643 - DNA, 21 bp, Homo sapiens
aaatattttttcttttctatt

SEQ ID NO: 4841644 - DNA, 22 bp, Homo sapiens
aaatcataagatatttttcatg

SEQ ID NO: 4841645 - DNA, 15 bp, Homo sapiens
aaattatatcaattt

SEQ ID NO: 4841646 - DNA, 17 bp, Homo sapiens
aacatttattttcattg

SEQ ID NO: 4841647 - DNA, 24 bp, Homo sapiens
aaccatgaagagatttttcatgat

SEQ ID NO: 4841648 - DNA, 16 bp, Homo sapiens
aacgggccctcctccc

SEQ ID NO: 4841649 - DNA, 13 bp, Homo sapiens
aagacaatataat

SEQ ID NO: 4841650 - DNA, 16 bp, Homo sapiens
aagatatgggacattt

SEQ ID NO: 4841651 - DNA, 19 bp, Homo sapiens
aagatatgggacatttttg

SEQ ID NO: 4841652 - DNA, 15 bp, Homo sapiens
aagatatttttcatg

SEQ ID NO: 4841653 - DNA, 14 bp, Homo sapiens
aataaggttgaaca

SEQ ID NO: 4841654 - DNA, 21 bp, Homo sapiens
aatagatatccacttgagaca

SEQ ID NO: 4841655 - DNA, 21 bp, Homo sapiens
aatagttttattaataaacat

SEQ ID NO: 4841656 - DNA, 22 bp, Homo sapiens
aatagttttattaataaacatt

SEQ ID NO: 4841657 - DNA, 17 bp, Homo sapiens
aatatttttaatatata

SEQ ID NO: 4841658 - DNA, 23 bp, Homo sapiens
aatcataagatatttttcatgat

SEQ ID NO: 4841659 - DNA, 23 bp, Homo sapiens
aattgctatgttttgacattttt

SEQ ID NO: 4841660 - DNA, 22 bp, Homo sapiens
aattgctttaccttttttctta

SEQ ID NO: 4841661 - DNA, 21 bp, Homo sapiens
aattgtggggatgatgaaata

SEQ ID NO: 4841662 - DNA, 14 bp, Homo sapiens
aattttgatgaaca

SEQ ID NO: 4841663 - DNA, 14 bp, Homo sapiens
acacagaaaccaat

SEQ ID NO: 4841664 - DNA, 16 bp, Homo sapiens
acatcaccacagttta

SEQ ID NO: 4841665 - DNA, 19 bp, Homo sapiens
accaacctgaagacaccgt

SEQ ID NO: 4841666 - DNA, 23 bp, Homo sapiens
accaagttggaacatccttggaa

SEQ ID NO: 4841667 - DNA, 20 bp, Homo sapiens
accatgaagagatttttcat

SEQ ID NO: 4841668 - DNA, 24 bp, Homo sapiens
accatgaagagatttttcatgatt

SEQ ID NO: 4841669 - DNA, 18 bp, Homo sapiens
accctcatacacagaaac

SEQ ID NO: 4841670 - DNA, 17 bp, Homo sapiens
actacttgggagcaccg

SEQ ID NO: 4841671 - DNA, 14 bp, Homo sapiens
acttaattgctaca

SEQ ID NO: 4841672 - DNA, 17 bp, Homo sapiens
acttatttatgaacctg

SEQ ID NO: 4841673 - DNA, 22 bp, Homo sapiens
acttgctgcagtatgaaaataa

SEQ ID NO: 4841674 - DNA, 15 bp, Homo sapiens
actttctagattaag

SEQ ID NO: 4841675 - DNA, 13 bp, Homo sapiens
agagatttttcat

SEQ ID NO: 4841676 - DNA, 19 bp, Homo sapiens
agataatgtgatattatac

SEQ ID NO: 4841677 - DNA, 15 bp, Homo sapiens
aaaaacatttatttt

SEQ ID NO: 4841678 - DNA, 14 bp, Homo sapiens
aaagagatacagag

SEQ ID NO: 4841679 - DNA, 19 bp, Homo sapiens
aaaggttcctttgttccct

SEQ ID NO: 4841680 - DNA, 23 bp, Homo sapiens
aaataacaaatctcaagcaaaca

SEQ ID NO: 4841681 - DNA, 14 bp, Homo sapiens
aaatattagaaaca

SEQ ID NO: 4841682 - DNA, 21 bp, Homo sapiens
aaattagttagccaatatttt

SEQ ID NO: 4841683 - DNA, 16 bp, Homo sapiens
aacagcttctcaattt

SEQ ID NO: 4841684 - DNA, 21 bp, Homo sapiens
aaccatgaagagatttttcat

SEQ ID NO: 4841685 - DNA, 19 bp, Homo sapiens
aacccacaggcccacagta

SEQ ID NO: 4841686 - DNA, 20 bp, Homo sapiens
aacttgctgcagtatgaaaa

SEQ ID NO: 4841687 - DNA, 13 bp, Homo sapiens
aagaccatttttc

SEQ ID NO: 4841688 - DNA, 12 bp, Homo sapiens
tctcaatttcta

SEQ ID NO: 4841689 - DNA, 13 bp, Homo sapiens
tctgcctaataaa

SEQ ID NO: 4841690 - DNA, 14 bp, Homo sapiens
tctgcctaataaaa

SEQ ID NO: 4841691 - DNA, 20 bp, Homo sapiens
tctgtatttccccaacatgt

SEQ ID NO: 4841692 - DNA, 23 bp, Homo sapiens
tctgtatttccccaacatgtaat

SEQ ID NO: 4841693 - DNA, 17 bp, Homo sapiens
tctgtgagattcattca

SEQ ID NO: 4841694 - DNA, 23 bp, Homo sapiens
tctgttttctttctaatgagata

SEQ ID NO: 4841695 - DNA, 16 bp, Homo sapiens
tcttatttcatgaaaa

SEQ ID NO: 4841696 - DNA, 13 bp, Homo sapiens
tcttgctgtccaa

SEQ ID NO: 4841697 - DNA, 15 bp, Homo sapiens
tgaagagatttttca

SEQ ID NO: 4841698 - DNA, 16 bp, Homo sapiens
tgaagagatttttcat

SEQ ID NO: 4841699 - DNA, 21 bp, Homo sapiens
tgaagggccttgagcatctgg

SEQ ID NO: 4841700 - DNA, 17 bp, Homo sapiens
tgacatcaccacagttt

SEQ ID NO: 4841701 - DNA, 16 bp, Homo sapiens
tgattttaataatata

SEQ ID NO: 4841702 - DNA, 15 bp, Homo sapiens
tgattttgaaaccat

SEQ ID NO: 4841703 - DNA, 15 bp, Homo sapiens
tgcagtatgaaaata

SEQ ID NO: 4841704 - DNA, 12 bp, Homo sapiens
tgcctaataaaa

SEQ ID NO: 4841705 - DNA, 23 bp, Homo sapiens
tgctgtccaatttctattaaagg

SEQ ID NO: 4841706 - DNA, 14 bp, Homo sapiens
tggaaatacacagt

SEQ ID NO: 4841707 - DNA, 15 bp, Homo sapiens
tggctagtccttgtt

SEQ ID NO: 4841708 - DNA, 23 bp, Homo sapiens
tgtatttccccaacatgtaataa

SEQ ID NO: 4841709 - DNA, 20 bp, Homo sapiens
ttaaaggttcctttgttccc

SEQ ID NO: 4841710 - DNA, 18 bp, Homo sapiens
ttaacacctttaaagtgt

SEQ ID NO: 4841711 - DNA, 15 bp, Homo sapiens
ttaataccacagctt

SEQ ID NO: 4841712 - DNA, 22 bp, Homo sapiens
ttatgaagggccttgagcatct

SEQ ID NO: 4841713 - DNA, 15 bp, Homo sapiens
ttattaataaacatt

SEQ ID NO: 4841714 - DNA, 15 bp, Homo sapiens
ttatttcatgaaaat

SEQ ID NO: 4841715 - DNA, 17 bp, Homo sapiens
ttcatgattttgaaatc

SEQ ID NO: 4841716 - DNA, 13 bp, Homo sapiens
ttcccaattgctt

SEQ ID NO: 4841717 - DNA, 13 bp, Homo sapiens
ttcctaagtgatt

SEQ ID NO: 4841718 - DNA, 13 bp, Homo sapiens
ttcctttgttccc

SEQ ID NO: 4841719 - DNA, 14 bp, Homo sapiens
ttctgcctaataaa

SEQ ID NO: 4841720 - DNA, 19 bp, Homo sapiens
ttctgcctaataaaaaaca

SEQ ID NO: 4841721 - DNA, 18 bp, Homo sapiens
ttgctgcagtatgaaaat

SEQ ID NO: 4841722 - DNA, 19 bp, Homo sapiens
ttgtgtcatgtttaagaaa

SEQ ID NO: 4841723 - DNA, 21 bp, Homo sapiens
tttagtagatattaccagttt

SEQ ID NO: 4841724 - DNA, 21 bp, Homo sapiens
tttattaataaacattctatc

SEQ ID NO: 4841725 - DNA, 22 bp, Homo sapiens
tttatttttccatttacaacaa

SEQ ID NO: 4841726 - DNA, 16 bp, Homo sapiens
tttcatgattttgaaa

SEQ ID NO: 4841727 - DNA, 16 bp, Homo sapiens
tttctattaaaggttc

SEQ ID NO: 4841728 - DNA, 20 bp, Homo sapiens
tttcttactgatttttaagt

SEQ ID NO: 4841729 - DNA, 21 bp, Homo sapiens
tttgtgtcatgtttaagaaat

SEQ ID NO: 4841730 - DNA, 18 bp, Homo sapiens
ttttaaatattttttctt

SEQ ID NO: 4841731 - DNA, 15 bp, Homo sapiens
ttttacattctgaat

SEQ ID NO: 4841732 - DNA, 12 bp, Homo sapiens
ttttattaataa

SEQ ID NO: 4841733 - DNA, 19 bp, Homo sapiens
ttttattaataaacattct

SEQ ID NO: 4841734 - DNA, 22 bp, Homo sapiens
ttttattaataaacattctatc

SEQ ID NO: 4841735 - DNA, 14 bp, Homo sapiens
caacttactactga

SEQ ID NO: 4841736 - DNA, 20 bp, Homo sapiens
caatttctacaaaatcctga

SEQ ID NO: 4841737 - DNA, 19 bp, Homo sapiens
caatttctattaaaggttc

SEQ ID NO: 4841738 - DNA, 23 bp, Homo sapiens
caccaagttggaacatccttgga

SEQ ID NO: 4841739 - DNA, 14 bp, Homo sapiens
cacctttaaagtgt

SEQ ID NO: 4841740 - DNA, 22 bp, Homo sapiens
caggcaacgcacaaaacagaaa

SEQ ID NO: 4841741 - DNA, 13 bp, Homo sapiens
cagtatgaaaata

SEQ ID NO: 4841742 - DNA, 14 bp, Homo sapiens
cagtatgaaaataa

SEQ ID NO: 4841743 - DNA, 13 bp, Homo sapiens
catcaccacagtt

SEQ ID NO: 4841744 - DNA, 18 bp, Homo sapiens
catccatgttccgagaag

SEQ ID NO: 4841745 - DNA, 20 bp, Homo sapiens
catttctagcgcatggcctg

SEQ ID NO: 4841746 - DNA, 13 bp, Homo sapiens
catttttgtattt

SEQ ID NO: 4841747 - DNA, 20 bp, Homo sapiens
ccaaaatcataagatatttt

SEQ ID NO: 4841748 - DNA, 18 bp, Homo sapiens
ccatgaagagatttttca

SEQ ID NO: 4841749 - DNA, 11 bp, Homo sapiens
ccatttttcct

SEQ ID NO: 4841750 - DNA, 23 bp, Homo sapiens
cccctaatgacatcaccacagtt

SEQ ID NO: 4841751 - DNA, 21 bp, Homo sapiens
ccctggaaggacatccatgtt

SEQ ID NO: 4841752 - DNA, 20 bp, Homo sapiens
cctggaaggacatccatgtt

SEQ ID NO: 4841753 - DNA, 22 bp, Homo sapiens
cctggaaggacatccatgttcc

SEQ ID NO: 4841754 - DNA, 17 bp, Homo sapiens
cctggtagaatagatat

SEQ ID NO: 4841755 - DNA, 12 bp, Homo sapiens
ccttgagcatct

SEQ ID NO: 4841756 - DNA, 16 bp, Homo sapiens
cggatttatttttcca

SEQ ID NO: 4841757 - DNA, 20 bp, Homo sapiens
ctaagtccaactactaaact

SEQ ID NO: 4841758 - DNA, 15 bp, Homo sapiens
ctaataaaaaacatt

SEQ ID NO: 4841759 - DNA, 23 bp, Homo sapiens
ctaatagttttattaataaacat

SEQ ID NO: 4841760 - DNA, 16 bp, Homo sapiens
ctagtactaactccta

SEQ ID NO: 4841761 - DNA, 12 bp, Homo sapiens
ctagtccttgtt

SEQ ID NO: 4841762 - DNA, 21 bp, Homo sapiens
ctatatactcactttctagat

SEQ ID NO: 4841763 - DNA, 22 bp, Homo sapiens
ctatgtaggaaagaccattttt

SEQ ID NO: 4841764 - DNA, 23 bp, Homo sapiens
ctatgtaggaaagaccatttttc

SEQ ID NO: 4841765 - DNA, 19 bp, Homo sapiens
ctatgttttgacattttta

SEQ ID NO: 4841766 - DNA, 13 bp, Homo sapiens
ctattaaaggttc

SEQ ID NO: 4841767 - DNA, 18 bp, Homo sapiens
ctcagttcatccattcta

SEQ ID NO: 4841768 - DNA, 20 bp, Homo sapiens
ctcagttcatccattctatt

SEQ ID NO: 4841769 - DNA, 22 bp, Homo sapiens
ctcctagtactaactcctagga

SEQ ID NO: 4841770 - DNA, 22 bp, Homo sapiens
ctcttttcctttggtccttcaa

SEQ ID NO: 4841771 - DNA, 15 bp, Homo sapiens
ctgaaagacaatata

SEQ ID NO: 4841772 - DNA, 23 bp, Homo sapiens
ctgaagacaccgttcattcaggc

SEQ ID NO: 4841773 - DNA, 17 bp, Homo sapiens
ctgcagtatgaaaataa

SEQ ID NO: 4841774 - DNA, 12 bp, Homo sapiens
ctgcctaataaa

SEQ ID NO: 4841775 - DNA, 19 bp, Homo sapiens
ctgtccaatttctattaaa

SEQ ID NO: 4841776 - DNA, 17 bp, Homo sapiens
cttaatacacacagtta

SEQ ID NO: 4841777 - DNA, 21 bp, Homo sapiens
cttatttattcatattttctt

SEQ ID NO: 4841778 - DNA, 17 bp, Homo sapiens
cttgtatatcttgtttt

SEQ ID NO: 4841779 - DNA, 20 bp, Homo sapiens
tcacaccccacctgcgcttc

SEQ ID NO: 4841780 - DNA, 18 bp, Homo sapiens
tccaggcctactcctgtc

SEQ ID NO: 4841781 - DNA, 12 bp, Homo sapiens
tcctgtcttctg

SEQ ID NO: 4841782 - DNA, 22 bp, Homo sapiens
tctagctgaattgagcctaaaa

SEQ ID NO: 4841783 - DNA, 12 bp, Homo sapiens
tcttctgctttg

SEQ ID NO: 4841784 - DNA, 13 bp, Homo sapiens
tcttctgctttgt

SEQ ID NO: 4841785 - DNA, 21 bp, Homo sapiens
tcttctgctttgttgtgtgcc

SEQ ID NO: 4841786 - DNA, 23 bp, Homo sapiens
tcttctgctttgttgtgtgcctc

SEQ ID NO: 4841787 - DNA, 16 bp, Homo sapiens
tgagcctaaaaataaa

SEQ ID NO: 4841788 - DNA, 18 bp, Homo sapiens
tgagcctaaaaataaagc

SEQ ID NO: 4841789 - DNA, 20 bp, Homo sapiens
tgcctaggattcacacccca

SEQ ID NO: 4841790 - DNA, 22 bp, Homo sapiens
tgcgcttcacttgggtccaggc

SEQ ID NO: 4841791 - DNA, 18 bp, Homo sapiens
tgctttgttgtgtgcctc

SEQ ID NO: 4841792 - DNA, 17 bp, Homo sapiens
tgggtccaggcctactc

SEQ ID NO: 4841793 - DNA, 18 bp, Homo sapiens
tgggtccaggcctactcc

SEQ ID NO: 4841794 - DNA, 11 bp, Homo sapiens
tgtcttctgct

SEQ ID NO: 4841795 - DNA, 15 bp, Homo sapiens
tgtcttctgctttgt

SEQ ID NO: 4841796 - DNA, 18 bp, Homo sapiens
tgtgtgcctctagctgaa

SEQ ID NO: 4841797 - DNA, 20 bp, Homo sapiens
tgtgtgcctctagctgaatt

SEQ ID NO: 4841798 - DNA, 17 bp, Homo sapiens
ttgtgtgcctctagctg

SEQ ID NO: 4841799 - DNA, 23 bp, Homo sapiens
ttgtgtgcctctagctgaattga

SEQ ID NO: 4841800 - DNA, 14 bp, Homo sapiens
ttgttgtgtgcctc

SEQ ID NO: 4841801 - DNA, 11 bp, Homo sapiens
aaaaataaagc

SEQ ID NO: 4841802 - DNA, 11 bp, Homo sapiens
aaaataaagca

SEQ ID NO: 4841803 - DNA, 17 bp, Homo sapiens
aattgagcctaaaaata

SEQ ID NO: 4841804 - DNA, 23 bp, Homo sapiens
aattgagcctaaaaataaagcac

SEQ ID NO: 4841805 - DNA, 11 bp, Homo sapiens
accccacctgc

SEQ ID NO: 4841806 - DNA, 12 bp, Homo sapiens
accccacctgcg

SEQ ID NO: 4841807 - DNA, 13 bp, Homo sapiens
acctgcgcttcac

SEQ ID NO: 4841808 - DNA, 14 bp, Homo sapiens
acctgcgcttcact

SEQ ID NO: 4841809 - DNA, 15 bp, Homo sapiens
actcctgtcttctgc

SEQ ID NO: 4841810 - DNA, 18 bp, Homo sapiens
actcctgtcttctgcttt

SEQ ID NO: 4841811 - DNA, 18 bp, Homo sapiens
aggattcacaccccacct

SEQ ID NO: 4841812 - DNA, 13 bp, Homo sapiens
aggcctactcctg

SEQ ID NO: 4841813 - DNA, 17 bp, Homo sapiens
aggcctactcctgtctt

SEQ ID NO: 4841814 - DNA, 15 bp, Homo sapiens
cacaccccacctgcg

SEQ ID NO: 4841815 - DNA, 16 bp, Homo sapiens
cacaccccacctgcgc

SEQ ID NO: 4841816 - DNA, 17 bp, Homo sapiens
cacaccccacctgcgct

SEQ ID NO: 4841817 - DNA, 13 bp, Homo sapiens
caccccacctgcg

SEQ ID NO: 4841818 - DNA, 18 bp, Homo sapiens
caggcctactcctgtctt

SEQ ID NO: 4841819 - DNA, 19 bp, Homo sapiens
caggcctactcctgtcttc

SEQ ID NO: 4841820 - DNA, 23 bp, Homo sapiens
ccaaatacatgataaatgtatca

SEQ ID NO: 4841821 - DNA, 17 bp, Homo sapiens
ccccacctgcgcttcac

SEQ ID NO: 4841822 - DNA, 14 bp, Homo sapiens
cctaaaaataaagc

SEQ ID NO: 4841823 - DNA, 16 bp, Homo sapiens
cctactcctgtcttct

SEQ ID NO: 4841824 - DNA, 19 bp, Homo sapiens
cctaggattcacaccccac

SEQ ID NO: 4841825 - DNA, 16 bp, Homo sapiens
cctgtcttctgctttg

SEQ ID NO: 4841826 - DNA, 22 bp, Homo sapiens
ctactcctgtcttctgctttgt

SEQ ID NO: 4841827 - DNA, 21 bp, Homo sapiens
ctaggattcacaccccacctg

SEQ ID NO: 4841828 - DNA, 13 bp, Homo sapiens
ctcctgtcttctg

SEQ ID NO: 4841829 - DNA, 20 bp, Homo sapiens
ctgctttgttgtgtgcctct

SEQ ID NO: 4841830 - DNA, 16 bp, Homo sapiens
ctgtcttctgctttgt

SEQ ID NO: 4841831 - DNA, 18 bp, Homo sapiens
ctgtcttctgctttgttg

SEQ ID NO: 4841832 - DNA, 20 bp, Homo sapiens
cttctgctttgttgtgtgcc

SEQ ID NO: 4841833 - DNA, 19 bp, Homo sapiens
gaattgagcctaaaaataa

SEQ ID NO: 4841834 - DNA, 15 bp, Homo sapiens
gagcctaaaaataaa

SEQ ID NO: 4841835 - DNA, 13 bp, Homo sapiens
gcctactcctgtc

SEQ ID NO: 4841836 - DNA, 16 bp, Homo sapiens
gcctactcctgtcttc

SEQ ID NO: 4841837 - DNA, 22 bp, Homo sapiens
gcctaggattcacaccccacct

SEQ ID NO: 4841838 - DNA, 13 bp, Homo sapiens
gctgaattgagcc

SEQ ID NO: 4841839 - DNA, 21 bp, Homo sapiens
gctgaattgagcctaaaaata

SEQ ID NO: 4841840 - DNA, 22 bp, Homo sapiens
gctgaattgagcctaaaaataa

SEQ ID NO: 4841841 - DNA, 17 bp, Homo sapiens
gctgcctaggattcaca

SEQ ID NO: 4841842 - DNA, 12 bp, Homo sapiens
ggcctactcctg

SEQ ID NO: 4841843 - DNA, 20 bp, Homo sapiens
gggtccaggcctactcctgt

SEQ ID NO: 4841844 - DNA, 22 bp, Homo sapiens
ggtccaggcctactcctgtctt

SEQ ID NO: 4841845 - DNA, 15 bp, Homo sapiens
gtccaggcctactcc

SEQ ID NO: 4841846 - DNA, 20 bp, Homo sapiens
gtccaggcctactcctgtct

SEQ ID NO: 4841847 - DNA, 24 bp, Homo sapiens
gtccaggcctactcctgtcttctg

SEQ ID NO: 4841848 - DNA, 14 bp, Homo sapiens
gtcttctgctttgt

SEQ ID NO: 4841849 - DNA, 11 bp, Homo sapiens
gtgtgcctcta

SEQ ID NO: 4841850 - DNA, 13 bp, Homo sapiens
gtgtgcctctagc

SEQ ID NO: 4841851 - DNA, 23 bp, Homo sapiens
gtgtgcctctagctgaattgagc

SEQ ID NO: 4841852 - DNA, 21 bp, Homo sapiens
gttgtgtgcctctagctgaat

SEQ ID NO: 4841853 - DNA, 19 bp, Homo sapiens
taaaaataaagcacaaacc

SEQ ID NO: 4841854 - DNA, 19 bp, Homo sapiens
tactcctgtcttctgcttt

SEQ ID NO: 4841855 - DNA, 12 bp, Homo sapiens
taggattcacac

SEQ ID NO: 4841856 - DNA, 20 bp, Homo sapiens
taggattcacaccccacctg

SEQ ID NO: 4841857 - DNA, 22 bp, Homo sapiens
taggattcacaccccacctgcg

SEQ ID NO: 4841858 - DNA, 12 bp, Homo sapiens
tcacaccccacc

SEQ ID NO: 4841859 - DNA, 12 bp, Homo sapiens
acaccccacctg

SEQ ID NO: 4841860 - DNA, 21 bp, Homo sapiens
acaccccacctgcgcttcact

SEQ ID NO: 4841861 - DNA, 21 bp, Homo sapiens
acttgggtccaggcctactcc

SEQ ID NO: 4841862 - DNA, 14 bp, Homo sapiens
agcctaaaaataaa

SEQ ID NO: 4841863 - DNA, 17 bp, Homo sapiens
agcctaaaaataaagca

SEQ ID NO: 4841864 - DNA, 14 bp, Homo sapiens
aggattcacacccc

SEQ ID NO: 4841865 - DNA, 19 bp, Homo sapiens
aggattcacaccccacctg

SEQ ID NO: 4841866 - DNA, 20 bp, Homo sapiens
aggattcacaccccacctgc

SEQ ID NO: 4841867 - DNA, 21 bp, Homo sapiens
aggattcacaccccacctgcg

SEQ ID NO: 4841868 - DNA, 22 bp, Homo sapiens
aggattcacaccccacctgcgc

SEQ ID NO: 4841869 - DNA, 21 bp, Homo sapiens
attgagcctaaaaataaagca

SEQ ID NO: 4841870 - DNA, 14 bp, Homo sapiens
cacaccccacctgc

SEQ ID NO: 4841871 - DNA, 12 bp, Homo sapiens
caccccacctgc

SEQ ID NO: 4841872 - DNA, 16 bp, Homo sapiens
caccccacctgcgctt

SEQ ID NO: 4841873 - DNA, 22 bp, Homo sapiens
cacttgggtccaggcctactcc

SEQ ID NO: 4841874 - DNA, 23 bp, Homo sapiens
cagctgcctaggattcacacccc

SEQ ID NO: 4841875 - DNA, 17 bp, Homo sapiens
ccaggcctactcctgtc

SEQ ID NO: 4841876 - DNA, 18 bp, Homo sapiens
ccaggcctactcctgtct

SEQ ID NO: 4841877 - DNA, 23 bp, Homo sapiens
ccaggcctactcctgtcttctgc

SEQ ID NO: 4841878 - DNA, 12 bp, Homo sapiens
cccacctgcgct

SEQ ID NO: 4841879 - DNA, 11 bp, Homo sapiens
cctaaaaataa

SEQ ID NO: 4841880 - DNA, 12 bp, Homo sapiens
cctaaaaataaa

SEQ ID NO: 4841881 - DNA, 15 bp, Homo sapiens
cctaaaaataaagca

SEQ ID NO: 4841882 - DNA, 19 bp, Homo sapiens
cctactcctgtcttctgct

SEQ ID NO: 4841883 - DNA, 22 bp, Homo sapiens
cctactcctgtcttctgctttg

SEQ ID NO: 4841884 - DNA, 14 bp, Homo sapiens
cctgtcttctgctt

SEQ ID NO: 4841885 - DNA, 13 bp, Homo sapiens
ctactcctgtctt

SEQ ID NO: 4841886 - DNA, 20 bp, Homo sapiens
ctactcctgtcttctgcttt

SEQ ID NO: 4841887 - DNA, 21 bp, Homo sapiens
ctactcctgtcttctgctttg

SEQ ID NO: 4841888 - DNA, 19 bp, Homo sapiens
ctaggattcacaccccacc

SEQ ID NO: 4841889 - DNA, 22 bp, Homo sapiens
ctaggattcacaccccacctgc

SEQ ID NO: 4841890 - DNA, 14 bp, Homo sapiens
ctcctgtcttctgc

SEQ ID NO: 4841891 - DNA, 16 bp, Homo sapiens
ctcctgtcttctgctt

SEQ ID NO: 4841892 - DNA, 17 bp, Homo sapiens
ctcctgtcttctgcttt

SEQ ID NO: 4841893 - DNA, 18 bp, Homo sapiens
ctcctgtcttctgctttg

SEQ ID NO: 4841894 - DNA, 11 bp, Homo sapiens
ctctagctgaa

SEQ ID NO: 4841895 - DNA, 21 bp, Homo sapiens
ctgaattgagcctaaaaataa

SEQ ID NO: 4841896 - DNA, 22 bp, Homo sapiens
ctgaattgagcctaaaaataaa

SEQ ID NO: 4841897 - DNA, 17 bp, Homo sapiens
ctgctttgttgtgtgcc

SEQ ID NO: 4841898 - DNA, 15 bp, Homo sapiens
ctgtcttctgctttg

SEQ ID NO: 4841899 - DNA, 22 bp, Homo sapiens
cttctgctttgttgtgtgcctc

SEQ ID NO: 4841900 - DNA, 13 bp, Homo sapiens
ctttgttgtgtgc

SEQ ID NO: 4841901 - DNA, 15 bp, Homo sapiens
gcctaaaaataaagc

SEQ ID NO: 4841902 - DNA, 23 bp, Homo sapiens
gcctaggattcacaccccacctg

SEQ ID NO: 4841903 - DNA, 11 bp, Homo sapiens
gcctctagctg

SEQ ID NO: 4841904 - DNA, 17 bp, Homo sapiens
gctttgttgtgtgcctc

SEQ ID NO: 4841905 - DNA, 18 bp, Homo sapiens
gctttgttgtgtgcctct

SEQ ID NO: 4841906 - DNA, 22 bp, Homo sapiens
gctttgttgtgtgcctctagct

SEQ ID NO: 4841907 - DNA, 23 bp, Homo sapiens
gctttgttgtgtgcctctagctg

SEQ ID NO: 4841908 - DNA, 17 bp, Homo sapiens
ggcctactcctgtcttc

SEQ ID NO: 4841909 - DNA, 23 bp, Homo sapiens
gtccaggcctactcctgtcttct

SEQ ID NO: 4841910 - DNA, 12 bp, Homo sapiens
gtcttctgcttt

SEQ ID NO: 4841911 - DNA, 22 bp, Homo sapiens
gtcttctgctttgttgtgtgcc

SEQ ID NO: 4841912 - DNA, 14 bp, Homo sapiens
gtgtgcctctagct

SEQ ID NO: 4841913 - DNA, 16 bp, Homo sapiens
gtgtgcctctagctga

SEQ ID NO: 4841914 - DNA, 13 bp, Homo sapiens
tactcctgtcttc

SEQ ID NO: 4841915 - DNA, 17 bp, Homo sapiens
tactcctgtcttctgct

SEQ ID NO: 4841916 - DNA, 22 bp, Homo sapiens
tactcctgtcttctgctttgtt

SEQ ID NO: 4841917 - DNA, 15 bp, Homo sapiens
tcacaccccacctgc

SEQ ID NO: 4841918 - DNA, 17 bp, Homo sapiens
tcacaccccacctgcgc

SEQ ID NO: 4841919 - DNA, 17 bp, Homo sapiens
gagcctaaaaataaagc

SEQ ID NO: 4841920 - DNA, 19 bp, Homo sapiens
gagcctaaaaataaagcac

SEQ ID NO: 4841921 - DNA, 18 bp, Homo sapiens
gattcacaccccacctgc

SEQ ID NO: 4841922 - DNA, 19 bp, Homo sapiens
gattcacaccccacctgcg

SEQ ID NO: 4841923 - DNA, 23 bp, Homo sapiens
gcctactcctgtcttctgctttg

SEQ ID NO: 4841924 - DNA, 13 bp, Homo sapiens
gcctctagctgaa

SEQ ID NO: 4841925 - DNA, 15 bp, Homo sapiens
gctttgttgtgtgcc

SEQ ID NO: 4841926 - DNA, 21 bp, Homo sapiens
gctttgttgtgtgcctctagc

SEQ ID NO: 4841927 - DNA, 19 bp, Homo sapiens
ggattcacaccccacctgc

SEQ ID NO: 4841928 - DNA, 20 bp, Homo sapiens
ggattcacaccccacctgcg

SEQ ID NO: 4841929 - DNA, 14 bp, Homo sapiens
ggcctactcctgtc

SEQ ID NO: 4841930 - DNA, 15 bp, Homo sapiens
ggcctactcctgtct

SEQ ID NO: 4841931 - DNA, 14 bp, Homo sapiens
gtgcctctagctga

SEQ ID NO: 4841932 - DNA, 15 bp, Homo sapiens
gtgcctctagctgaa

SEQ ID NO: 4841933 - DNA, 10 bp, Homo sapiens
gttgtgtgcc

SEQ ID NO: 4841934 - DNA, 21 bp, Homo sapiens
tactcctgtcttctgctttgt

SEQ ID NO: 4841935 - DNA, 13 bp, Homo sapiens
tcacaccccacct

SEQ ID NO: 4841936 - DNA, 14 bp, Homo sapiens
tcacaccccacctg

SEQ ID NO: 4841937 - DNA, 16 bp, Homo sapiens
tccaggcctactcctg

SEQ ID NO: 4841938 - DNA, 19 bp, Homo sapiens
tcctgtcttctgctttgtt

SEQ ID NO: 4841939 - DNA, 18 bp, Homo sapiens
tctgctttgttgtgtgcc

SEQ ID NO: 4841940 - DNA, 20 bp, Homo sapiens
tgagcctaaaaataaagcac

SEQ ID NO: 4841941 - DNA, 23 bp, Homo sapiens
tgcctaggattcacaccccacct

SEQ ID NO: 4841942 - DNA, 12 bp, Homo sapiens
tgcctctagctg

SEQ ID NO: 4841943 - DNA, 14 bp, Homo sapiens
tgcctctagctgaa

SEQ ID NO: 4841944 - DNA, 20 bp, Homo sapiens
tgctttgttgtgtgcctcta

SEQ ID NO: 4841945 - DNA, 21 bp, Homo sapiens
tgctttgttgtgtgcctctag

SEQ ID NO: 4841946 - DNA, 24 bp, Homo sapiens
tgctttgttgtgtgcctctagctg

SEQ ID NO: 4841947 - DNA, 18 bp, Homo sapiens
tgtgcctctagctgaatt

SEQ ID NO: 4841948 - DNA, 17 bp, Homo sapiens
tgtgtgcctctagctga

SEQ ID NO: 4841949 - DNA, 15 bp, Homo sapiens
ttcacaccccacctg

SEQ ID NO: 4841950 - DNA, 19 bp, Homo sapiens
ttcacaccccacctgcgct

SEQ ID NO: 4841951 - DNA, 22 bp, Homo sapiens
ttctgctttgttgtgtgcctct

SEQ ID NO: 4841952 - DNA, 23 bp, Homo sapiens
ttctgctttgttgtgtgcctcta

SEQ ID NO: 4841953 - DNA, 14 bp, Homo sapiens
ttgagcctaaaaat

SEQ ID NO: 4841954 - DNA, 17 bp, Homo sapiens
ttgagcctaaaaataaa

SEQ ID NO: 4841955 - DNA, 21 bp, Homo sapiens
tttgttgtgtgcctctagctg

SEQ ID NO: 4841956 - DNA, 12 bp, Homo sapiens
aaaaataaagca

SEQ ID NO: 4841957 - DNA, 16 bp, Homo sapiens
acaccccacctgcgct

SEQ ID NO: 4841958 - DNA, 16 bp, Homo sapiens
actcctgtcttctgct

SEQ ID NO: 4841959 - DNA, 17 bp, Homo sapiens
actcctgtcttctgctt

SEQ ID NO: 4841960 - DNA, 19 bp, Homo sapiens
actcctgtcttctgctttg

SEQ ID NO: 4841961 - DNA, 20 bp, Homo sapiens
actcctgtcttctgctttgt

SEQ ID NO: 4841962 - DNA, 13 bp, Homo sapiens
agcctaaaaataa

SEQ ID NO: 4841963 - DNA, 23 bp, Homo sapiens
agcctaaaaataaagcacaaacc

SEQ ID NO: 4841964 - DNA, 20 bp, Homo sapiens
agctgaattgagcctaaaaa

SEQ ID NO: 4841965 - DNA, 16 bp, Homo sapiens
attcacaccccacctg

SEQ ID NO: 4841966 - DNA, 17 bp, Homo sapiens
attcacaccccacctgc

SEQ ID NO: 4841967 - DNA, 17 bp, Homo sapiens
attgagcctaaaaataa

SEQ ID NO: 4841968 - DNA, 22 bp, Homo sapiens
attgagcctaaaaataaagcac

SEQ ID NO: 4841969 - DNA, 13 bp, Homo sapiens
cacaccccacctg

SEQ ID NO: 4841970 - DNA, 19 bp, Homo sapiens
cacaccccacctgcgcttc

SEQ ID NO: 4841971 - DNA, 15 bp, Homo sapiens
cacctgcgcttcact

SEQ ID NO: 4841972 - DNA, 19 bp, Homo sapiens
cacttgggtccaggcctac

SEQ ID NO: 4841973 - DNA, 15 bp, Homo sapiens
caggcctactcctgt

SEQ ID NO: 4841974 - DNA, 17 bp, Homo sapiens
caggcctactcctgtct

SEQ ID NO: 4841975 - DNA, 16 bp, Homo sapiens
ccaggcctactcctgt

SEQ ID NO: 4841976 - DNA, 21 bp, Homo sapiens
ccaggcctactcctgtcttct

SEQ ID NO: 4841977 - DNA, 18 bp, Homo sapiens
cctactcctgtcttctgc

SEQ ID NO: 4841978 - DNA, 20 bp, Homo sapiens
cctactcctgtcttctgctt

SEQ ID NO: 4841979 - DNA, 18 bp, Homo sapiens
cctaggattcacacccca

SEQ ID NO: 4841980 - DNA, 20 bp, Homo sapiens
cctaggattcacaccccacc

SEQ ID NO: 4841981 - DNA, 10 bp, Homo sapiens
cctctagctg

SEQ ID NO: 4841982 - DNA, 11 bp, Homo sapiens
cctctagctga

SEQ ID NO: 4841983 - DNA, 23 bp, Homo sapiens
cctctagctgaattgagcctaaa

SEQ ID NO: 4841984 - DNA, 21 bp, Homo sapiens
cctgtcttctgctttgttgtg

SEQ ID NO: 4841985 - DNA, 15 bp, Homo sapiens
ctaaaaataaagcac

SEQ ID NO: 4841986 - DNA, 14 bp, Homo sapiens
ctactcctgtcttc

SEQ ID NO: 4841987 - DNA, 17 bp, Homo sapiens
ctactcctgtcttctgc

SEQ ID NO: 4841988 - DNA, 20 bp, Homo sapiens
ctaggattcacaccccacct

SEQ ID NO: 4841989 - DNA, 12 bp, Homo sapiens
ctctagctgaat

SEQ ID NO: 4841990 - DNA, 13 bp, Homo sapiens
ctctagctgaatt

SEQ ID NO: 4841991 - DNA, 15 bp, Homo sapiens
ctctagctgaattga

SEQ ID NO: 4841992 - DNA, 20 bp, Homo sapiens
ctgaattgagcctaaaaata

SEQ ID NO: 4841993 - DNA, 23 bp, Homo sapiens
ctgcctaggattcacaccccacc

SEQ ID NO: 4841994 - DNA, 23 bp, Homo sapiens
ctgctttgttgtgtgcctctagc

SEQ ID NO: 4841995 - DNA, 14 bp, Homo sapiens
ctgtcttctgcttt

SEQ ID NO: 4841996 - DNA, 23 bp, Homo sapiens
ctgtcttctgctttgttgtgtgc

SEQ ID NO: 4841997 - DNA, 12 bp, Homo sapiens
cttctgctttgt

SEQ ID NO: 4841998 - DNA, 15 bp, Homo sapiens
cttctgctttgttgt

SEQ ID NO: 4841999 - DNA, 22 bp, Homo sapiens
ctttgttgtgtgcctctagctg

SEQ ID NO: 4842000 - DNA, 23 bp, Homo sapiens
gaagccagctgcctaggattcac

SEQ ID NO: 4842001 - DNA, 18 bp, Homo sapiens
tcacaccccacctgcgct

SEQ ID NO: 4842002 - DNA, 13 bp, Homo sapiens
tcctgtcttctgc

SEQ ID NO: 4842003 - DNA, 15 bp, Homo sapiens
tcctgtcttctgctt

SEQ ID NO: 4842004 - DNA, 16 bp, Homo sapiens
tcctgtcttctgcttt

SEQ ID NO: 4842005 - DNA, 15 bp, Homo sapiens
tctgctttgttgtgt

SEQ ID NO: 4842006 - DNA, 17 bp, Homo sapiens
tgaattgagcctaaaaa

SEQ ID NO: 4842007 - DNA, 18 bp, Homo sapiens
tgaattgagcctaaaaat

SEQ ID NO: 4842008 - DNA, 20 bp, Homo sapiens
tgaattgagcctaaaaataa

SEQ ID NO: 4842009 - DNA, 13 bp, Homo sapiens
tgagcctaaaaat

SEQ ID NO: 4842010 - DNA, 14 bp, Homo sapiens
tgagcctaaaaata

SEQ ID NO: 4842011 - DNA, 14 bp, Homo sapiens
tgcgcttcacttgg

SEQ ID NO: 4842012 - DNA, 15 bp, Homo sapiens
tgcgcttcacttggg

SEQ ID NO: 4842013 - DNA, 16 bp, Homo sapiens
tgcgcttcacttgggt

SEQ ID NO: 4842014 - DNA, 16 bp, Homo sapiens
tgctttgttgtgtgcc

SEQ ID NO: 4842015 - DNA, 21 bp, Homo sapiens
tgggtccaggcctactcctgt

SEQ ID NO: 4842016 - DNA, 14 bp, Homo sapiens
tgtcttctgctttg

SEQ ID NO: 4842017 - DNA, 14 bp, Homo sapiens
tgtgcctctagctg

SEQ ID NO: 4842018 - DNA, 16 bp, Homo sapiens
tgtgcctctagctgaa

SEQ ID NO: 4842019 - DNA, 20 bp, Homo sapiens
tgtgcctctagctgaattga

SEQ ID NO: 4842020 - DNA, 16 bp, Homo sapiens
tgtgtgcctctagctg

SEQ ID NO: 4842021 - DNA, 14 bp, Homo sapiens
tgttgtgtgcctct

SEQ ID NO: 4842022 - DNA, 14 bp, Homo sapiens
ttcacaccccacct

SEQ ID NO: 4842023 - DNA, 16 bp, Homo sapiens
ttcacaccccacctgc

SEQ ID NO: 4842024 - DNA, 17 bp, Homo sapiens
ttcacaccccacctgcg

SEQ ID NO: 4842025 - DNA, 12 bp, Homo sapiens
ttctgctttgtt

SEQ ID NO: 4842026 - DNA, 20 bp, Homo sapiens
ttctgctttgttgtgtgcct

SEQ ID NO: 4842027 - DNA, 21 bp, Homo sapiens
ttgagcctaaaaataaagcac

SEQ ID NO: 4842028 - DNA, 13 bp, Homo sapiens
tttgttgtgtgcc

SEQ ID NO: 4842029 - DNA, 18 bp, Homo sapiens
aaaaagtgtttatcttca

SEQ ID NO: 4842030 - DNA, 13 bp, Homo sapiens
acaccccacctgc

SEQ ID NO: 4842031 - DNA, 14 bp, Homo sapiens
acaccccacctgcg

SEQ ID NO: 4842032 - DNA, 12 bp, Homo sapiens
agccagctgcct

SEQ ID NO: 4842033 - DNA, 16 bp, Homo sapiens
agcctaaaaataaagc

SEQ ID NO: 4842034 - DNA, 18 bp, Homo sapiens
agcctaaaaataaagcac

SEQ ID NO: 4842035 - DNA, 15 bp, Homo sapiens
agctgaattgagcct

SEQ ID NO: 4842036 - DNA, 21 bp, Homo sapiens
agctgaattgagcctaaaaat

SEQ ID NO: 4842037 - DNA, 17 bp, Homo sapiens
aggattcacaccccacc

SEQ ID NO: 4842038 - DNA, 14 bp, Homo sapiens
aggcctactcctgt

SEQ ID NO: 4842039 - DNA, 15 bp, Homo sapiens
aggcctactcctgtc

SEQ ID NO: 4842040 - DNA, 14 bp, Homo sapiens
attcacaccccacc

SEQ ID NO: 4842041 - DNA, 15 bp, Homo sapiens
attcacaccccacct

SEQ ID NO: 4842042 - DNA, 18 bp, Homo sapiens
attcacaccccacctgcg

SEQ ID NO: 4842043 - DNA, 15 bp, Homo sapiens
attgagcctaaaaat

SEQ ID NO: 4842044 - DNA, 12 bp, Homo sapiens
cacaccccacct

SEQ ID NO: 4842045 - DNA, 16 bp, Homo sapiens
caggcctactcctgtc

SEQ ID NO: 4842046 - DNA, 20 bp, Homo sapiens
caggcctactcctgtcttct

SEQ ID NO: 4842047 - DNA, 18 bp, Homo sapiens
ccagctgcctaggattca

SEQ ID NO: 4842048 - DNA, 11 bp, Homo sapiens
ccccacctgcg

SEQ ID NO: 4842049 - DNA, 14 bp, Homo sapiens
ccccacctgcgctt

SEQ ID NO: 4842050 - DNA, 15 bp, Homo sapiens
cctactcctgtcttc

SEQ ID NO: 4842051 - DNA, 22 bp, Homo sapiens
cctaggattcacaccccacctg

SEQ ID NO: 4842052 - DNA, 23 bp, Homo sapiens
cctaggattcacaccccacctgc

SEQ ID NO: 4842053 - DNA, 12 bp, Homo sapiens
cctctagctgaa

SEQ ID NO: 4842054 - DNA, 13 bp, Homo sapiens
cctgtcttctgct

SEQ ID NO: 4842055 - DNA, 15 bp, Homo sapiens
cctgtcttctgcttt

SEQ ID NO: 4842056 - DNA, 17 bp, Homo sapiens
cctgtcttctgctttgt

SEQ ID NO: 4842057 - DNA, 13 bp, Homo sapiens
ctaaaaataaagc

SEQ ID NO: 4842058 - DNA, 14 bp, Homo sapiens
ctaaaaataaagca

SEQ ID NO: 4842059 - DNA, 16 bp, Homo sapiens
ctactcctgtcttctg

SEQ ID NO: 4842060 - DNA, 19 bp, Homo sapiens
ctactcctgtcttctgctt

SEQ ID NO: 4842061 - DNA, 10 bp, Homo sapiens
ctagctgaat

SEQ ID NO: 4842062 - DNA, 23 bp, Homo sapiens
ctaggattcacaccccacctgcg

SEQ ID NO: 4842063 - DNA, 23 bp, Homo sapiens
ctgaattgagcctaaaaataaag

SEQ ID NO: 4842064 - DNA, 21 bp, Homo sapiens
ctgcctaggattcacacccca

SEQ ID NO: 4842065 - DNA, 21 bp, Homo sapiens
ctgctttgttgtgtgcctcta

SEQ ID NO: 4842066 - DNA, 13 bp, Homo sapiens
ctgtcttctgctt

SEQ ID NO: 4842067 - DNA, 11 bp, Homo sapiens
cttctgctttg

SEQ ID NO: 4842068 - DNA, 17 bp, Homo sapiens
ctttgttgtgtgcctct

SEQ ID NO: 4842069 - DNA, 18 bp, Homo sapiens
ctttgttgtgtgcctcta

SEQ ID NO: 4842070 - DNA, 18 bp, Homo sapiens
gaagccagctgcctagga

SEQ ID NO: 4842071 - DNA, 16 bp, Homo sapiens
gattcacaccccacct

SEQ ID NO: 4842072 - DNA, 17 bp, Homo sapiens
gattcacaccccacctg

SEQ ID NO: 4842073 - DNA, 14 bp, Homo sapiens
gccagctgcctagg

SEQ ID NO: 4842074 - DNA, 15 bp, Homo sapiens
gcctactcctgtctt

SEQ ID NO: 4842075 - DNA, 22 bp, Homo sapiens
gcctactcctgtcttctgcttt

SEQ ID NO: 4842076 - DNA, 18 bp, Homo sapiens
gcctaggattcacacccc

SEQ ID NO: 4842077 - DNA, 21 bp, Homo sapiens
gcctaggattcacaccccacc

SEQ ID NO: 4842078 - DNA, 21 bp, Homo sapiens
gcgcttcacttgggtccaggc

SEQ ID NO: 4842079 - DNA, 19 bp, Homo sapiens
gctttgttgtgtgcctcta

SEQ ID NO: 4842080 - DNA, 17 bp, Homo sapiens
ggattcacaccccacct

SEQ ID NO: 4842081 - DNA, 20 bp, Homo sapiens
ggcctactcctgtcttctgc

SEQ ID NO: 4842082 - DNA, 23 bp, Homo sapiens
ggcctactcctgtcttctgcttt

SEQ ID NO: 4842083 - DNA, 20 bp, Homo sapiens
ggtccaggcctactcctgtc

SEQ ID NO: 4842084 - DNA, 19 bp, Homo sapiens
gtccaggcctactcctgtc

SEQ ID NO: 4842085 - DNA, 21 bp, Homo sapiens
gtccaggcctactcctgtctt

SEQ ID NO: 4842086 - DNA, 13 bp, Homo sapiens
gtcttctgctttg

SEQ ID NO: 4842087 - DNA, 13 bp, Homo sapiens
gtgcctctagctg

SEQ ID NO: 4842088 - DNA, 16 bp, Homo sapiens
gtgcctctagctgaat

SEQ ID NO: 4842089 - DNA, 17 bp, Homo sapiens
gtgtgcctctagctgaa

SEQ ID NO: 4842090 - DNA, 12 bp, Homo sapiens
taaaaataaagc

SEQ ID NO: 4842091 - DNA, 15 bp, Homo sapiens
tactcctgtcttctg

SEQ ID NO: 4842092 - DNA, 20 bp, Homo sapiens
tactcctgtcttctgctttg

SEQ ID NO: 4842093 - DNA, 21 bp, Homo sapiens
taggattcacaccccacctgc

SEQ ID NO: 4842094 - DNA, 16 bp, Homo sapiens
tcacaccccacctgcg

SEQ ID NO: 4842095 - DNA, 14 bp, Homo sapiens
tcctgtcttctgct

SEQ ID NO: 4842096 - DNA, 17 bp, Homo sapiens
tcctgtcttctgctttg

SEQ ID NO: 4842097 - DNA, 10 bp, Homo sapiens
tctagctgaa

SEQ ID NO: 4842098 - DNA, 22 bp, Homo sapiens
tctgctttgttgtgtgcctcta

SEQ ID NO: 4842099 - DNA, 22 bp, Homo sapiens
tgcctaggattcacaccccacc

SEQ ID NO: 4842100 - DNA, 13 bp, Homo sapiens
tgcctctagctga

SEQ ID NO: 4842101 - DNA, 11 bp, Homo sapiens
tgcgcttcact

SEQ ID NO: 4842102 - DNA, 15 bp, Homo sapiens
tgctttgttgtgtgc

SEQ ID NO: 4842103 - DNA, 19 bp, Homo sapiens
tgctttgttgtgtgcctct

SEQ ID NO: 4842104 - DNA, 23 bp, Homo sapiens
tgctttgttgtgtgcctctagct

SEQ ID NO: 4842105 - DNA, 23 bp, Homo sapiens
tgggtccaggcctactcctgtct

SEQ ID NO: 4842106 - DNA, 13 bp, Homo sapiens
tgtcttctgcttt

SEQ ID NO: 4842107 - DNA, 23 bp, Homo sapiens
tgtcttctgctttgttgtgtgcc

SEQ ID NO: 4842108 - DNA, 15 bp, Homo sapiens
tgtgcctctagctga

SEQ ID NO: 4842109 - DNA, 15 bp, Homo sapiens
tgttgtgtgcctcta

SEQ ID NO: 4842110 - DNA, 21 bp, Homo sapiens
tgttgtgtgcctctagctgaa

SEQ ID NO: 4842111 - DNA, 11 bp, Homo sapiens
ttctgctttgt

SEQ ID NO: 4842112 - DNA, 19 bp, Homo sapiens
ttctgctttgttgtgtgcc

SEQ ID NO: 4842113 - DNA, 20 bp, Homo sapiens
ttgtgtgcctctagctgaat

SEQ ID NO: 4842114 - DNA, 23 bp, Homo sapiens
tttgttgtgtgcctctagctgaa

SEQ ID NO: 4842115 - DNA, 20 bp, Homo sapiens
agccgggaaagaagagccgg

SEQ ID NO: 4842116 - DNA, 12 bp, Homo sapiens
atcattaaagtt

SEQ ID NO: 4842117 - DNA, 13 bp, Homo sapiens
atcattaaagttc

SEQ ID NO: 4842118 - DNA, 23 bp, Homo sapiens
atcctagtctctatcattaaagt

SEQ ID NO: 4842119 - DNA, 19 bp, Homo sapiens
attaaagttctagtgaccg

SEQ ID NO: 4842120 - DNA, 13 bp, Homo sapiens
cagctgccccggg

SEQ ID NO: 4842121 - DNA, 12 bp, Homo sapiens
cattaaagttct

SEQ ID NO: 4842122 - DNA, 14 bp, Homo sapiens
ccggagcctccagc

SEQ ID NO: 4842123 - DNA, 14 bp, Homo sapiens
cgggaaagaagagc

SEQ ID NO: 4842124 - DNA, 13 bp, Homo sapiens
ctatcattaaagt

SEQ ID NO: 4842125 - DNA, 14 bp, Homo sapiens
ctatcattaaagtt

SEQ ID NO: 4842126 - DNA, 16 bp, Homo sapiens
ctatcattaaagttct

SEQ ID NO: 4842127 - DNA, 15 bp, Homo sapiens
ctctatcattaaagt

SEQ ID NO: 4842128 - DNA, 19 bp, Homo sapiens
gaaagaagagccggagcct

SEQ ID NO: 4842129 - DNA, 23 bp, Homo sapiens
gcatcctagtctctatcattaaa

SEQ ID NO: 4842130 - DNA, 18 bp, Homo sapiens
gcccccgggccgacggag

SEQ ID NO: 4842131 - DNA, 20 bp, Homo sapiens
gggcgctcgcttccgcatcc

SEQ ID NO: 4842132 - DNA, 12 bp, Homo sapiens
tatcattaaagt

SEQ ID NO: 4842133 - DNA, 13 bp, Homo sapiens
tatcattaaagtt

SEQ ID NO: 4842134 - DNA, 14 bp, Homo sapiens
tatcattaaagttc

SEQ ID NO: 4842135 - DNA, 13 bp, Homo sapiens
tcattaaagttct

SEQ ID NO: 4842136 - DNA, 16 bp, Homo sapiens
tccagctgccccgggg

SEQ ID NO: 4842137 - DNA, 14 bp, Homo sapiens
tctatcattaaagt

SEQ ID NO: 4842138 - DNA, 16 bp, Homo sapiens
aaagttctagtgaccg

SEQ ID NO: 4842139 - DNA, 20 bp, Homo sapiens
agaagagccggagcctccag

SEQ ID NO: 4842140 - DNA, 20 bp, Homo sapiens
agctgccccggggaggggcg

SEQ ID NO: 4842141 - DNA, 16 bp, Homo sapiens
agtctctatcattaaa

SEQ ID NO: 4842142 - DNA, 18 bp, Homo sapiens
agtctctatcattaaagt

SEQ ID NO: 4842143 - DNA, 19 bp, Homo sapiens
agtctctatcattaaagtt

SEQ ID NO: 4842144 - DNA, 11 bp, Homo sapiens
atcattaaagt

SEQ ID NO: 4842145 - DNA, 14 bp, Homo sapiens
atcattaaagttct

SEQ ID NO: 4842146 - DNA, 12 bp, Homo sapiens
attaaagttcta

SEQ ID NO: 4842147 - DNA, 14 bp, Homo sapiens
ccgacggagccggg

SEQ ID NO: 4842148 - DNA, 15 bp, Homo sapiens
cctagtctctatcat

SEQ ID NO: 4842149 - DNA, 20 bp, Homo sapiens
cggagccgggaaagaagagc

SEQ ID NO: 4842150 - DNA, 22 bp, Homo sapiens
ctagtctctatcattaaagttc

SEQ ID NO: 4842151 - DNA, 17 bp, Homo sapiens
ctatcattaaagttcta

SEQ ID NO: 4842152 - DNA, 13 bp, Homo sapiens
ctctatcattaaa

SEQ ID NO: 4842153 - DNA, 18 bp, Homo sapiens
ctctatcattaaagttct

SEQ ID NO: 4842154 - DNA, 17 bp, Homo sapiens
cttccgcatcctagtct

SEQ ID NO: 4842155 - DNA, 18 bp, Homo sapiens
cttccgcatcctagtctc

SEQ ID NO: 4842156 - DNA, 22 bp, Homo sapiens
gagccgggaaagaagagccgga

SEQ ID NO: 4842157 - DNA, 11 bp, Homo sapiens
gcatcctagtc

SEQ ID NO: 4842158 - DNA, 18 bp, Homo sapiens
gcctccagctgccccggg

SEQ ID NO: 4842159 - DNA, 21 bp, Homo sapiens
ggagccgggaaagaagagccg

SEQ ID NO: 4842160 - DNA, 14 bp, Homo sapiens
ggccgacggagccg

SEQ ID NO: 4842161 - DNA, 18 bp, Homo sapiens
gtctctatcattaaagtt

SEQ ID NO: 4842162 - DNA, 20 bp, Homo sapiens
gtctctatcattaaagttct

SEQ ID NO: 4842163 - DNA, 20 bp, Homo sapiens
tagtctctatcattaaagtt

SEQ ID NO: 4842164 - DNA, 15 bp, Homo sapiens
tatcattaaagttct

SEQ ID NO: 4842165 - DNA, 12 bp, Homo sapiens
tcattaaagttc

SEQ ID NO: 4842166 - DNA, 14 bp, Homo sapiens
tcattaaagttcta

SEQ ID NO: 4842167 - DNA, 15 bp, Homo sapiens
tcgcttccgcatcct

SEQ ID NO: 4842168 - DNA, 15 bp, Homo sapiens
tctatcattaaagtt

SEQ ID NO: 4842169 - DNA, 16 bp, Homo sapiens
tctatcattaaagttc

SEQ ID NO: 4842170 - DNA, 14 bp, Homo sapiens
tctctatcattaaa

SEQ ID NO: 4842171 - DNA, 17 bp, Homo sapiens
tctctatcattaaagtt

SEQ ID NO: 4842172 - DNA, 18 bp, Homo sapiens
tctctatcattaaagttc

SEQ ID NO: 4842173 - DNA, 19 bp, Homo sapiens
tgccccggggaggggcgct

SEQ ID NO: 4842174 - DNA, 19 bp, Homo sapiens
aagagccggagcctccagc

SEQ ID NO: 4842175 - DNA, 17 bp, Homo sapiens
agtctctatcattaaag

SEQ ID NO: 4842176 - DNA, 20 bp, Homo sapiens
atcctagtctctatcattaa

SEQ ID NO: 4842177 - DNA, 22 bp, Homo sapiens
caaggcccccgggccgacggag

SEQ ID NO: 4842178 - DNA, 23 bp, Homo sapiens
cccccgggccgacggagccggga

SEQ ID NO: 4842179 - DNA, 16 bp, Homo sapiens
ccgcatcctagtctct

SEQ ID NO: 4842180 - DNA, 15 bp, Homo sapiens
ccggggaggggcgct

SEQ ID NO: 4842181 - DNA, 14 bp, Homo sapiens
cctagtctctatca

SEQ ID NO: 4842182 - DNA, 16 bp, Homo sapiens
cctagtctctatcatt

SEQ ID NO: 4842183 - DNA, 15 bp, Homo sapiens
cgcatcctagtctct

SEQ ID NO: 4842184 - DNA, 19 bp, Homo sapiens
cgcatcctagtctctatca

SEQ ID NO: 4842185 - DNA, 19 bp, Homo sapiens
cgggccgacggagccggga

SEQ ID NO: 4842186 - DNA, 20 bp, Homo sapiens
ctagtctctatcattaaagt

SEQ ID NO: 4842187 - DNA, 23 bp, Homo sapiens
ctgccccggggaggggcgctcgc

SEQ ID NO: 4842188 - DNA, 12 bp, Homo sapiens
gagccggagcct

SEQ ID NO: 4842189 - DNA, 16 bp, Homo sapiens
gagccggagcctccag

SEQ ID NO: 4842190 - DNA, 15 bp, Homo sapiens
ggaaagaagagccgg

SEQ ID NO: 4842191 - DNA, 16 bp, Homo sapiens
ggccgacggagccggg

SEQ ID NO: 4842192 - DNA, 13 bp, Homo sapiens
ggggaggggcgct

SEQ ID NO: 4842193 - DNA, 16 bp, Homo sapiens
gtctctatcattaaag

SEQ ID NO: 4842194 - DNA, 19 bp, Homo sapiens
gtctctatcattaaagttc

SEQ ID NO: 4842195 - DNA, 21 bp, Homo sapiens
tagtctctatcattaaagttc

SEQ ID NO: 4842196 - DNA, 23 bp, Homo sapiens
tcctagtctctatcattaaagtt

SEQ ID NO: 4842197 - DNA, 13 bp, Homo sapiens
tctctatcattaa

SEQ ID NO: 4842198 - DNA, 21 bp, Homo sapiens
aaagaagagccggagcctcca

SEQ ID NO: 4842199 - DNA, 14 bp, Homo sapiens
aagagccggagcct

SEQ ID NO: 4842200 - DNA, 21 bp, Homo sapiens
agccggagcctccagctgccc

SEQ ID NO: 4842201 - DNA, 17 bp, Homo sapiens
agcctccagctgccccg

SEQ ID NO: 4842202 - DNA, 20 bp, Homo sapiens
aggggcgctcgcttccgcat

SEQ ID NO: 4842203 - DNA, 15 bp, Homo sapiens
agtctctatcattaa

SEQ ID NO: 4842204 - DNA, 20 bp, Homo sapiens
agtctctatcattaaagttc

SEQ ID NO: 4842205 - DNA, 21 bp, Homo sapiens
agtctctatcattaaagttct

SEQ ID NO: 4842206 - DNA, 15 bp, Homo sapiens
atcattaaagttcta

SEQ ID NO: 4842207 - DNA, 12 bp, Homo sapiens
cagctgccccgg

SEQ ID NO: 4842208 - DNA, 13 bp, Homo sapiens
catcctagtctct

SEQ ID NO: 4842209 - DNA, 20 bp, Homo sapiens
catcctagtctctatcatta

SEQ ID NO: 4842210 - DNA, 18 bp, Homo sapiens
cccccgggccgacggagc

SEQ ID NO: 4842211 - DNA, 21 bp, Homo sapiens
ccgcatcctagtctctatcat

SEQ ID NO: 4842212 - DNA, 16 bp, Homo sapiens
ccggagcctccagctg

SEQ ID NO: 4842213 - DNA, 22 bp, Homo sapiens
ccgggaaagaagagccggagcc

SEQ ID NO: 4842214 - DNA, 21 bp, Homo sapiens
cctagtctctatcattaaagt

SEQ ID NO: 4842215 - DNA, 16 bp, Homo sapiens
cgcatcctagtctcta

SEQ ID NO: 4842216 - DNA, 21 bp, Homo sapiens
cgctcgcttccgcatcctagt

SEQ ID NO: 4842217 - DNA, 21 bp, Homo sapiens
ctagtctctatcattaaagtt

SEQ ID NO: 4842218 - DNA, 15 bp, Homo sapiens
ctatcattaaagttc

SEQ ID NO: 4842219 - DNA, 16 bp, Homo sapiens
ctctatcattaaagtt

SEQ ID NO: 4842220 - DNA, 15 bp, Homo sapiens
cttccgcatcctagt

SEQ ID NO: 4842221 - DNA, 16 bp, Homo sapiens
gaagagccggagcctc

SEQ ID NO: 4842222 - DNA, 14 bp, Homo sapiens
gacggagccgggaa

SEQ ID NO: 4842223 - DNA, 14 bp, Homo sapiens
gcttccgcatccta

SEQ ID NO: 4842224 - DNA, 18 bp, Homo sapiens
ggaaagaagagccggagc

SEQ ID NO: 4842225 - DNA, 17 bp, Homo sapiens
gtctctatcattaaagt

SEQ ID NO: 4842226 - DNA, 15 bp, Homo sapiens
tctctatcattaaag

SEQ ID NO: 4842227 - DNA, 16 bp, Homo sapiens
tctctatcattaaagt

SEQ ID NO: 4842228 - DNA, 15 bp, Homo sapiens
aagaagaaggccaga

SEQ ID NO: 4842229 - DNA, 13 bp, Homo sapiens
aagaagaagttca

SEQ ID NO: 4842230 - DNA, 23 bp, Homo sapiens
aagaagagcgagagatcaaagat

SEQ ID NO: 4842231 - DNA, 14 bp, Homo sapiens
aagaagatgagcct

SEQ ID NO: 4842232 - DNA, 16 bp, Homo sapiens
aagaaggccagagagg

SEQ ID NO: 4842233 - DNA, 20 bp, Homo sapiens
aagaaggccagagagggaaa

SEQ ID NO: 4842234 - DNA, 18 bp, Homo sapiens
aagaatcagacagcagga

SEQ ID NO: 4842235 - DNA, 13 bp, Homo sapiens
aagaatgtttctg

SEQ ID NO: 4842236 - DNA, 19 bp, Homo sapiens
aagaattctgattgatttg

SEQ ID NO: 4842237 - DNA, 20 bp, Homo sapiens
aagacaaatattcctttgca

SEQ ID NO: 4842238 - DNA, 19 bp, Homo sapiens
aagacactgcagaaaccct

SEQ ID NO: 4842239 - DNA, 15 bp, Homo sapiens
aagaccctcccatgg

SEQ ID NO: 4842240 - DNA, 22 bp, Homo sapiens
aagacctgaaagagaggactgg

SEQ ID NO: 4842241 - DNA, 21 bp, Homo sapiens
aagactatatatataaatgta

SEQ ID NO: 4842242 - DNA, 22 bp, Homo sapiens
aagactatatatataaatgtat

SEQ ID NO: 4842243 - DNA, 19 bp, Homo sapiens
aagactggatttgcagaag

SEQ ID NO: 4842244 - DNA, 13 bp, Homo sapiens
aagactggcccag

SEQ ID NO: 4842245 - DNA, 20 bp, Homo sapiens
aagactggcccagtgccagc

SEQ ID NO: 4842246 - DNA, 20 bp, Homo sapiens
aagagaaacctgccaaggag

SEQ ID NO: 4842247 - DNA, 11 bp, Homo sapiens
aagagaatgag

SEQ ID NO: 4842248 - DNA, 18 bp, Homo sapiens
aagagacagagacaagta

SEQ ID NO: 4842249 - DNA, 21 bp, Homo sapiens
aagagagttctggatgtctgg

SEQ ID NO: 4842250 - DNA, 22 bp, Homo sapiens
aagagagttctggatgtctggc

SEQ ID NO: 4842251 - DNA, 23 bp, Homo sapiens
aagagagttctggatgtctggct

SEQ ID NO: 4842252 - DNA, 19 bp, Homo sapiens
aagaggcaagctgaaattt

SEQ ID NO: 4842253 - DNA, 19 bp, Homo sapiens
aagagggacataagataaa

SEQ ID NO: 4842254 - DNA, 14 bp, Homo sapiens
aagagtcagacatt

SEQ ID NO: 4842255 - DNA, 18 bp, Homo sapiens
aagagtttcagtttgttg

SEQ ID NO: 4842256 - DNA, 21 bp, Homo sapiens
aagagtttcagtttgttggaa

SEQ ID NO: 4842257 - DNA, 18 bp, Homo sapiens
aagataaaatgatgttat

SEQ ID NO: 4842258 - DNA, 20 bp, Homo sapiens
aagatagtcttggaagctgt

SEQ ID NO: 4842259 - DNA, 15 bp, Homo sapiens
aagatattctttagt

SEQ ID NO: 4842260 - DNA, 12 bp, Homo sapiens
aagatgcagaag

SEQ ID NO: 4842261 - DNA, 17 bp, Homo sapiens
aagatggttaaacattt

SEQ ID NO: 4842262 - DNA, 18 bp, Homo sapiens
aagatgtgttcttatttt

SEQ ID NO: 4842263 - DNA, 21 bp, Homo sapiens
aagattctatgttaatatttt

SEQ ID NO: 4842264 - DNA, 19 bp, Homo sapiens
aagcaaaggtgcactccag

SEQ ID NO: 4842265 - DNA, 20 bp, Homo sapiens
aagcaaaggtgcactccaga

SEQ ID NO: 4842266 - DNA, 16 bp, Homo sapiens
aagcaaatgttgggaa

SEQ ID NO: 4842267 - DNA, 18 bp, Homo sapiens
aagcaataggtagctggg

SEQ ID NO: 4842268 - DNA, 18 bp, Homo sapiens
aagcaccaacctccagac

SEQ ID NO: 4842269 - DNA, 19 bp, Homo sapiens
aagcaccaacctccagact

SEQ ID NO: 4842270 - DNA, 23 bp, Homo sapiens
aagcactcctgcttaatcttcaa

SEQ ID NO: 4842271 - DNA, 21 bp, Homo sapiens
aagcactggccttgcctccag

SEQ ID NO: 4842272 - DNA, 22 bp, Homo sapiens
aagcactggccttgcctccagg

SEQ ID NO: 4842273 - DNA, 15 bp, Homo sapiens
aagcagtattttggt

SEQ ID NO: 4842274 - DNA, 17 bp, Homo sapiens
aagcagttcctgtccca

SEQ ID NO: 4842275 - DNA, 20 bp, Homo sapiens
aagcatagataatattgttt

SEQ ID NO: 4842276 - DNA, 20 bp, Homo sapiens
aagccacagcagagcattgt

SEQ ID NO: 4842277 - DNA, 14 bp, Homo sapiens
aagccaccgggaga

SEQ ID NO: 4842278 - DNA, 22 bp, Homo sapiens
aagccagccaagctttaaatta

SEQ ID NO: 4842279 - DNA, 14 bp, Homo sapiens
aagccaggctcagg

SEQ ID NO: 4842280 - DNA, 16 bp, Homo sapiens
aagccaggctcaggag

SEQ ID NO: 4842281 - DNA, 18 bp, Homo sapiens
aagccatagatgctggct

SEQ ID NO: 4842282 - DNA, 14 bp, Homo sapiens
aagccctggggcag

SEQ ID NO: 4842283 - DNA, 14 bp, Homo sapiens
aagccgcagacctg

SEQ ID NO: 4842284 - DNA, 19 bp, Homo sapiens
aagccgcagacctggagct

SEQ ID NO: 4842285 - DNA, 22 bp, Homo sapiens
aagcgaagtctttgccttctct

SEQ ID NO: 4842286 - DNA, 19 bp, Homo sapiens
aagctcaaatgaaatgtat

SEQ ID NO: 4842287 - DNA, 21 bp, Homo sapiens
aggccaccccctatcctctga

SEQ ID NO: 4842288 - DNA, 23 bp, Homo sapiens
aggccaccccctatcctctgagt

SEQ ID NO: 4842289 - DNA, 12 bp, Homo sapiens
aggccagaaagg

SEQ ID NO: 4842290 - DNA, 22 bp, Homo sapiens
aggccagaaaggtgtgaggaga

SEQ ID NO: 4842291 - DNA, 22 bp, Homo sapiens
aggccagagagggaaaaggcag

SEQ ID NO: 4842292 - DNA, 12 bp, Homo sapiens
aggccagccttg

SEQ ID NO: 4842293 - DNA, 23 bp, Homo sapiens
aggccccactttcaagaatcaga

SEQ ID NO: 4842294 - DNA, 13 bp, Homo sapiens
aggcctcccaagc

SEQ ID NO: 4842295 - DNA, 14 bp, Homo sapiens
aggcctcccaagct

SEQ ID NO: 4842296 - DNA, 12 bp, Homo sapiens
aggcctctggga

SEQ ID NO: 4842297 - DNA, 20 bp, Homo sapiens
aggcctgcttgactttccag

SEQ ID NO: 4842298 - DNA, 18 bp, Homo sapiens
aggccttatctgaaaggc

SEQ ID NO: 4842299 - DNA, 15 bp, Homo sapiens
aggccttcctcctct

SEQ ID NO: 4842300 - DNA, 23 bp, Homo sapiens
aggccttcctcctctcaaacctg

SEQ ID NO: 4842301 - DNA, 17 bp, Homo sapiens
aggctactgtaatgctg

SEQ ID NO: 4842302 - DNA, 21 bp, Homo sapiens
aggctactgtaatgctgcctc

SEQ ID NO: 4842303 - DNA, 15 bp, Homo sapiens
aggctattaaaaaag

SEQ ID NO: 4842304 - DNA, 14 bp, Homo sapiens
aggctattttctaa

SEQ ID NO: 4842305 - DNA, 18 bp, Homo sapiens
aggctattttctaaagac

SEQ ID NO: 4842306 - DNA, 19 bp, Homo sapiens
aggctattttctaaagact

SEQ ID NO: 4842307 - DNA, 16 bp, Homo sapiens
aggctcaggagaagcc

SEQ ID NO: 4842308 - DNA, 17 bp, Homo sapiens
aggctcaggagaagcca

SEQ ID NO: 4842309 - DNA, 22 bp, Homo sapiens
aggctcaggagaagccagtgtc

SEQ ID NO: 4842310 - DNA, 23 bp, Homo sapiens
aggctcaggagaagccagtgtct

SEQ ID NO: 4842311 - DNA, 22 bp, Homo sapiens
aggctccgggcaccaggggcca

SEQ ID NO: 4842312 - DNA, 12 bp, Homo sapiens
aggctcctcctt

SEQ ID NO: 4842313 - DNA, 19 bp, Homo sapiens
aggctcctccttgcccaga

SEQ ID NO: 4842314 - DNA, 18 bp, Homo sapiens
aggctcctctaggccctg

SEQ ID NO: 4842315 - DNA, 15 bp, Homo sapiens
aggctctcaccccca

SEQ ID NO: 4842316 - DNA, 13 bp, Homo sapiens
aggctgagaaagc

SEQ ID NO: 4842317 - DNA, 19 bp, Homo sapiens
aggctgcagaggcacctca

SEQ ID NO: 4842318 - DNA, 18 bp, Homo sapiens
aggctgggcctcccctgg

SEQ ID NO: 4842319 - DNA, 12 bp, Homo sapiens
aggctggggaca

SEQ ID NO: 4842320 - DNA, 13 bp, Homo sapiens
aggctggggacac

SEQ ID NO: 4842321 - DNA, 21 bp, Homo sapiens
aggctggggacacaggatcct

SEQ ID NO: 4842322 - DNA, 20 bp, Homo sapiens
aggctgtgtttagattgtat

SEQ ID NO: 4842323 - DNA, 22 bp, Homo sapiens
aggcttgtttacctttctctct

SEQ ID NO: 4842324 - DNA, 15 bp, Homo sapiens
aggctttgggtggct

SEQ ID NO: 4842325 - DNA, 14 bp, Homo sapiens
agggaaaaggcagg

SEQ ID NO: 4842326 - DNA, 22 bp, Homo sapiens
agggaagacctgaaagagagga

SEQ ID NO: 4842327 - DNA, 20 bp, Homo sapiens
agggaagatgacctgcccca

SEQ ID NO: 4842328 - DNA, 19 bp, Homo sapiens
agggaatctagcccaacct

SEQ ID NO: 4842329 - DNA, 16 bp, Homo sapiens
agggaatggccacaaa

SEQ ID NO: 4842330 - DNA, 20 bp, Homo sapiens
agggaccaggtttgcaggag

SEQ ID NO: 4842331 - DNA, 22 bp, Homo sapiens
agggaccccagatacctgtgag

SEQ ID NO: 4842332 - DNA, 19 bp, Homo sapiens
agggactacccatagacat

SEQ ID NO: 4842333 - DNA, 19 bp, Homo sapiens
agggactccaagccctggg

SEQ ID NO: 4842334 - DNA, 14 bp, Homo sapiens
agggagcattgcag

SEQ ID NO: 4842335 - DNA, 13 bp, Homo sapiens
agggaggggaggc

SEQ ID NO: 4842336 - DNA, 14 bp, Homo sapiens
agggaggggccctg

SEQ ID NO: 4842337 - DNA, 16 bp, Homo sapiens
agggaggggccctgtc

SEQ ID NO: 4842338 - DNA, 13 bp, Homo sapiens
agggagtttttga

SEQ ID NO: 4842339 - DNA, 20 bp, Homo sapiens
agggattctgggcttggggt

SEQ ID NO: 4842340 - DNA, 23 bp, Homo sapiens
agggattctgggcttggggtgtg

SEQ ID NO: 4842341 - DNA, 23 bp, Homo sapiens
agggcagaaccaagaacataaac

SEQ ID NO: 4842342 - DNA, 16 bp, Homo sapiens
agggcagcaggccaga

SEQ ID NO: 4842343 - DNA, 22 bp, Homo sapiens
agggcagcaggccagagaaagc

SEQ ID NO: 4842344 - DNA, 23 bp, Homo sapiens
agggcagcaggccagagaaagca

SEQ ID NO: 4842345 - DNA, 15 bp, Homo sapiens
agggcataaagtaaa

SEQ ID NO: 4842346 - DNA, 19 bp, Homo sapiens
agggcataaagtaaataca

SEQ ID NO: 4842347 - DNA, 15 bp, Homo sapiens
agggcctcagtctgg

SEQ ID NO: 4842348 - DNA, 21 bp, Homo sapiens
agggcgaccccgtcacagcct

SEQ ID NO: 4842349 - DNA, 14 bp, Homo sapiens
agggctctccaagc

SEQ ID NO: 4842350 - DNA, 15 bp, Homo sapiens
agggctgtcattgca

SEQ ID NO: 4842351 - DNA, 13 bp, Homo sapiens
aggggaagaatga

SEQ ID NO: 4842352 - DNA, 15 bp, Homo sapiens
aggggaagaatgaaa

SEQ ID NO: 4842353 - DNA, 17 bp, Homo sapiens
aggggaaggagaagtaa

SEQ ID NO: 4842354 - DNA, 20 bp, Homo sapiens
aggggagagagcagagaagt

SEQ ID NO: 4842355 - DNA, 14 bp, Homo sapiens
aggggagccagctg

SEQ ID NO: 4842356 - DNA, 19 bp, Homo sapiens
aggggagccagctgcttga

SEQ ID NO: 4842357 - DNA, 21 bp, Homo sapiens
aggggccaacctcaggctcct

SEQ ID NO: 4842358 - DNA, 16 bp, Homo sapiens
aggggccctgtcactg

SEQ ID NO: 4842359 - DNA, 13 bp, Homo sapiens
aggggcctgggct

SEQ ID NO: 4842360 - DNA, 14 bp, Homo sapiens
aggggcctgggctg

SEQ ID NO: 4842361 - DNA, 18 bp, Homo sapiens
aggggcctgggctgtgag

SEQ ID NO: 4842362 - DNA, 21 bp, Homo sapiens
aggggcctgggctgtgaggac

SEQ ID NO: 4842363 - DNA, 12 bp, Homo sapiens
aggggcgcggga

SEQ ID NO: 4842364 - DNA, 15 bp, Homo sapiens
aggggctctgtggca

SEQ ID NO: 4842365 - DNA, 21 bp, Homo sapiens
aggggctgtggccgtctcctc

SEQ ID NO: 4842366 - DNA, 15 bp, Homo sapiens
aggggtcccccctca

SEQ ID NO: 4842367 - DNA, 20 bp, Homo sapiens
agggtggttcaacaaagaaa

SEQ ID NO: 4842368 - DNA, 17 bp, Homo sapiens
agggttggagtgctctt

SEQ ID NO: 4842369 - DNA, 21 bp, Homo sapiens
agggtttacatgaagcagaac

SEQ ID NO: 4842370 - DNA, 13 bp, Homo sapiens
aggtaaacaaaga

SEQ ID NO: 4842371 - DNA, 23 bp, Homo sapiens
aggtaacgtattggacctgccca

SEQ ID NO: 4842372 - DNA, 17 bp, Homo sapiens
aggtagaatgttttcaa

SEQ ID NO: 4842373 - DNA, 17 bp, Homo sapiens
aggtagcactctcagag

SEQ ID NO: 4842374 - DNA, 14 bp, Homo sapiens
aggtagctggggag

SEQ ID NO: 4842375 - DNA, 17 bp, Homo sapiens
aggtagctggggagccc

SEQ ID NO: 4842376 - DNA, 20 bp, Homo sapiens
aggtccaaattcaccttccc

SEQ ID NO: 4842377 - DNA, 22 bp, Homo sapiens
aggtccaaattcaccttcccct

SEQ ID NO: 4842378 - DNA, 13 bp, Homo sapiens
aggtcctctcagt

SEQ ID NO: 4842379 - DNA, 13 bp, Homo sapiens
aggtctagagaga

SEQ ID NO: 4842380 - DNA, 13 bp, Homo sapiens
aggtctgactcca

SEQ ID NO: 4842381 - DNA, 15 bp, Homo sapiens
aggtgaaatccctgc

SEQ ID NO: 4842382 - DNA, 14 bp, Homo sapiens
aggtgaactccagg

SEQ ID NO: 4842383 - DNA, 16 bp, Homo sapiens
aggtgaactccaggca

SEQ ID NO: 4842384 - DNA, 22 bp, Homo sapiens
aggtgaaggctctcacccccat

SEQ ID NO: 4842385 - DNA, 15 bp, Homo sapiens
aggtgataagggaaa

SEQ ID NO: 4842386 - DNA, 20 bp, Homo sapiens
aggtgctaatttgttttgga

SEQ ID NO: 4842387 - DNA, 18 bp, Homo sapiens
aggtgcttttggcagaga

SEQ ID NO: 4842388 - DNA, 21 bp, Homo sapiens
aggtgcttttggcagagacca

SEQ ID NO: 4842389 - DNA, 21 bp, Homo sapiens
aggtggatactggggggcagg

SEQ ID NO: 4842390 - DNA, 19 bp, Homo sapiens
aggtggccagcccgcagag

SEQ ID NO: 4842391 - DNA, 15 bp, Homo sapiens
aggtggggtgctggg

SEQ ID NO: 4842392 - DNA, 19 bp, Homo sapiens
aggtggggtgctggggctg

SEQ ID NO: 4842393 - DNA, 18 bp, Homo sapiens
aggtgtgaggagagagga

SEQ ID NO: 4842394 - DNA, 23 bp, Homo sapiens
aggtgtgaggagagaggaggaaa

SEQ ID NO: 4842395 - DNA, 12 bp, Homo sapiens
aggttaaaaaaa

SEQ ID NO: 4842396 - DNA, 15 bp, Homo sapiens
aggttagtgacattt

SEQ ID NO: 4842397 - DNA, 14 bp, Homo sapiens
aggttatggggaga

SEQ ID NO: 4842398 - DNA, 20 bp, Homo sapiens
aggttctgtagagccaatta

SEQ ID NO: 4842399 - DNA, 15 bp, Homo sapiens
aggttcttcagaagt

SEQ ID NO: 4842400 - DNA, 21 bp, Homo sapiens
aggttgagaggaggacttggt

SEQ ID NO: 4842401 - DNA, 14 bp, Homo sapiens
aggtttgaaggaga

SEQ ID NO: 4842402 - DNA, 16 bp, Homo sapiens
aggtttttttccttct

SEQ ID NO: 4842403 - DNA, 21 bp, Homo sapiens
agtaagaataccacatcaaat

SEQ ID NO: 4842404 - DNA, 16 bp, Homo sapiens
agtaagttatctttga

SEQ ID NO: 4842405 - DNA, 18 bp, Homo sapiens
agtaatatttatatattt

SEQ ID NO: 4842406 - DNA, 20 bp, Homo sapiens
agtaatcagattactgcttt

SEQ ID NO: 4842407 - DNA, 12 bp, Homo sapiens
agtaatttcagt

SEQ ID NO: 4842408 - DNA, 19 bp, Homo sapiens
agtaatttcagtgtaaagt

SEQ ID NO: 4842409 - DNA, 15 bp, Homo sapiens
atgagcttgattaaa

SEQ ID NO: 4842410 - DNA, 15 bp, Homo sapiens
atgaggaaaattctt

SEQ ID NO: 4842411 - DNA, 19 bp, Homo sapiens
atgaggaaaattcttaaaa

SEQ ID NO: 4842412 - DNA, 16 bp, Homo sapiens
atgaggatccagggca

SEQ ID NO: 4842413 - DNA, 22 bp, Homo sapiens
atgaggatccagggcagcaggc

SEQ ID NO: 4842414 - DNA, 18 bp, Homo sapiens
atgaggctcagagaggta

SEQ ID NO: 4842415 - DNA, 13 bp, Homo sapiens
atgagtagccagg

SEQ ID NO: 4842416 - DNA, 19 bp, Homo sapiens
atgagtccttgatttcaaa

SEQ ID NO: 4842417 - DNA, 18 bp, Homo sapiens
atgagtttcactgtactg

SEQ ID NO: 4842418 - DNA, 23 bp, Homo sapiens
atgagtttcactgtactgcatgt

SEQ ID NO: 4842419 - DNA, 14 bp, Homo sapiens
atgatgctttggaa

SEQ ID NO: 4842420 - DNA, 15 bp, Homo sapiens
atgatgctttggaag

SEQ ID NO: 4842421 - DNA, 14 bp, Homo sapiens
atgatgtacagatt

SEQ ID NO: 4842422 - DNA, 13 bp, Homo sapiens
atgatttcacagt

SEQ ID NO: 4842423 - DNA, 21 bp, Homo sapiens
atgatttccctccagagaaag

SEQ ID NO: 4842424 - DNA, 22 bp, Homo sapiens
atgttaatattttaggtgtaaa

SEQ ID NO: 4842425 - DNA, 23 bp, Homo sapiens
atgttatacatcaatatgtatat

SEQ ID NO: 4842426 - DNA, 17 bp, Homo sapiens
atgttcccaaaacaatg

SEQ ID NO: 4842427 - DNA, 12 bp, Homo sapiens
atgttccccagg

SEQ ID NO: 4842428 - DNA, 16 bp, Homo sapiens
atgttctgtgactgaa

SEQ ID NO: 4842429 - DNA, 21 bp, Homo sapiens
atgttgggaaagtatttactt

SEQ ID NO: 4842430 - DNA, 19 bp, Homo sapiens
atgtttattaaatgcttca

SEQ ID NO: 4842431 - DNA, 20 bp, Homo sapiens
atgtttattaaatgcttcat

SEQ ID NO: 4842432 - DNA, 12 bp, Homo sapiens
atgtttctggat

SEQ ID NO: 4842433 - DNA, 16 bp, Homo sapiens
atgtttcttttaaaga

SEQ ID NO: 4842434 - DNA, 18 bp, Homo sapiens
atgtttgcctcataatag

SEQ ID NO: 4842435 - DNA, 16 bp, Homo sapiens
atgttttcaaaaggta

SEQ ID NO: 4842436 - DNA, 22 bp, Homo sapiens
atgttttcaaaaggtattatac

SEQ ID NO: 4842437 - DNA, 23 bp, Homo sapiens
atgtttttgttttaaaacgtgta

SEQ ID NO: 4842438 - DNA, 13 bp, Homo sapiens
attaaaaaacaat

SEQ ID NO: 4842439 - DNA, 14 bp, Homo sapiens
attaaaaaacaatt

SEQ ID NO: 4842440 - DNA, 22 bp, Homo sapiens
attaaaaaagagacatccaaat

SEQ ID NO: 4842441 - DNA, 22 bp, Homo sapiens
attaaaaacgaaaacctgacta

SEQ ID NO: 4842442 - DNA, 16 bp, Homo sapiens
attaaaactaaatttc

SEQ ID NO: 4842443 - DNA, 13 bp, Homo sapiens
attaaaatatttc

SEQ ID NO: 4842444 - DNA, 13 bp, Homo sapiens
attaaacaaagtt

SEQ ID NO: 4842445 - DNA, 20 bp, Homo sapiens
attaaacaaagtttcagagt

SEQ ID NO: 4842446 - DNA, 21 bp, Homo sapiens
attaactatcttctttggact

SEQ ID NO: 4842447 - DNA, 14 bp, Homo sapiens
attaaggaaatgtt

SEQ ID NO: 4842448 - DNA, 15 bp, Homo sapiens
attaaggggaagaat

SEQ ID NO: 4842449 - DNA, 14 bp, Homo sapiens
attaatatattaaa

SEQ ID NO: 4842450 - DNA, 18 bp, Homo sapiens
attaatatccctacatgt

SEQ ID NO: 4842451 - DNA, 20 bp, Homo sapiens
attaatatccctacatgtat

SEQ ID NO: 4842452 - DNA, 17 bp, Homo sapiens
attaatgcctgcttttt

SEQ ID NO: 4842453 - DNA, 20 bp, Homo sapiens
attaatggtttattctttgc

SEQ ID NO: 4842454 - DNA, 23 bp, Homo sapiens
attacaaagttaaaattgttatc

SEQ ID NO: 4842455 - DNA, 12 bp, Homo sapiens
attacaccacag

SEQ ID NO: 4842456 - DNA, 17 bp, Homo sapiens
attaccctacagacagc

SEQ ID NO: 4842457 - DNA, 14 bp, Homo sapiens
attacctccatcca

SEQ ID NO: 4842458 - DNA, 15 bp, Homo sapiens
attacctgtggatat

SEQ ID NO: 4842459 - DNA, 16 bp, Homo sapiens
attacctgtggatatt

SEQ ID NO: 4842460 - DNA, 17 bp, Homo sapiens
attactagataaaatgt

SEQ ID NO: 4842461 - DNA, 15 bp, Homo sapiens
attactgacatttct

SEQ ID NO: 4842462 - DNA, 16 bp, Homo sapiens
attactgacatttctt

SEQ ID NO: 4842463 - DNA, 17 bp, Homo sapiens
attactgcaatcactgt

SEQ ID NO: 4842464 - DNA, 21 bp, Homo sapiens
attactttggggctaatttaa

SEQ ID NO: 4842465 - DNA, 22 bp, Homo sapiens
attagaaattacctgtggatat

SEQ ID NO: 4842466 - DNA, 18 bp, Homo sapiens
attagacttgaaatacgt

SEQ ID NO: 4842467 - DNA, 23 bp, Homo sapiens
attagagtcaactacacaaagca

SEQ ID NO: 4842468 - DNA, 19 bp, Homo sapiens
attagatcaaatagttgca

SEQ ID NO: 4842469 - DNA, 21 bp, Homo sapiens
attagatcaaatagttgcata

SEQ ID NO: 4842470 - DNA, 19 bp, Homo sapiens
attagatcctaagatgtgt

SEQ ID NO: 4842471 - DNA, 15 bp, Homo sapiens
attagcaaggcagag

SEQ ID NO: 4842472 - DNA, 15 bp, Homo sapiens
attaggaagtgttta

SEQ ID NO: 4842473 - DNA, 19 bp, Homo sapiens
attagtcctaattcaatcc

SEQ ID NO: 4842474 - DNA, 21 bp, Homo sapiens
attagttttgaagattctatg

SEQ ID NO: 4842475 - DNA, 18 bp, Homo sapiens
attataaaggataaagaa

SEQ ID NO: 4842476 - DNA, 12 bp, Homo sapiens
attataactgta

SEQ ID NO: 4842477 - DNA, 22 bp, Homo sapiens
attatacatgtgatacattttt

SEQ ID NO: 4842478 - DNA, 18 bp, Homo sapiens
attatatattgcaaggtg

SEQ ID NO: 4842479 - DNA, 20 bp, Homo sapiens
attatctcctttgaagaagg

SEQ ID NO: 4842480 - DNA, 23 bp, Homo sapiens
attatgagattggttttcctgtg

SEQ ID NO: 4842481 - DNA, 15 bp, Homo sapiens
attatgtaaataact

SEQ ID NO: 4842482 - DNA, 17 bp, Homo sapiens
attatgttaatatttct

SEQ ID NO: 4842483 - DNA, 23 bp, Homo sapiens
attattaaattgtaaaactccaa

SEQ ID NO: 4842484 - DNA, 17 bp, Homo sapiens
attattattaaaaatat

SEQ ID NO: 4842485 - DNA, 19 bp, Homo sapiens
attatttaagactaaaagt

SEQ ID NO: 4842486 - DNA, 15 bp, Homo sapiens
attatttaattgtcc

SEQ ID NO: 4842487 - DNA, 22 bp, Homo sapiens
attatttgattatttaagacta

SEQ ID NO: 4842488 - DNA, 18 bp, Homo sapiens
attcaactttgtaaaaat

SEQ ID NO: 4842489 - DNA, 12 bp, Homo sapiens
attcagagaaat

SEQ ID NO: 4842490 - DNA, 12 bp, Homo sapiens
attcagatgtat

SEQ ID NO: 4842491 - DNA, 20 bp, Homo sapiens
attcatggcatgcttaaatt

SEQ ID NO: 4842492 - DNA, 14 bp, Homo sapiens
attcattagttttg

SEQ ID NO: 4842493 - DNA, 15 bp, Homo sapiens
attcattagttttga

SEQ ID NO: 4842494 - DNA, 22 bp, Homo sapiens
attcattctgaaccctccaaag

SEQ ID NO: 4842495 - DNA, 14 bp, Homo sapiens
attccaaaatatta

SEQ ID NO: 4842496 - DNA, 16 bp, Homo sapiens
attccagatctttcag

SEQ ID NO: 4842497 - DNA, 21 bp, Homo sapiens
attccagatctttcagaaata

SEQ ID NO: 4842498 - DNA, 14 bp, Homo sapiens
attccagatttgtt

SEQ ID NO: 4842499 - DNA, 23 bp, Homo sapiens
attccagctgtcactctgtgcct

SEQ ID NO: 4842500 - DNA, 16 bp, Homo sapiens
attcccaaatcctaga

SEQ ID NO: 4842501 - DNA, 14 bp, Homo sapiens
attcccagcctgac

SEQ ID NO: 4842502 - DNA, 18 bp, Homo sapiens
attccccagtgactccag

SEQ ID NO: 4842503 - DNA, 17 bp, Homo sapiens
attcctccagctgggat

SEQ ID NO: 4842504 - DNA, 11 bp, Homo sapiens
attcctccctc

SEQ ID NO: 4842505 - DNA, 14 bp, Homo sapiens
attctaaatacatg

SEQ ID NO: 4842506 - DNA, 16 bp, Homo sapiens
attctattctccagac

SEQ ID NO: 4842507 - DNA, 11 bp, Homo sapiens
attctccagac

SEQ ID NO: 4842508 - DNA, 16 bp, Homo sapiens
attctcccagctctag

SEQ ID NO: 4842509 - DNA, 20 bp, Homo sapiens
attctcccagctctagcctc

SEQ ID NO: 4842510 - DNA, 17 bp, Homo sapiens
attctgaaccctccaaa

SEQ ID NO: 4842511 - DNA, 20 bp, Homo sapiens
attctgaaccctccaaagga

SEQ ID NO: 4842512 - DNA, 21 bp, Homo sapiens
attctgaaccctccaaaggaa

SEQ ID NO: 4842513 - DNA, 14 bp, Homo sapiens
attctgaagtatga

SEQ ID NO: 4842514 - DNA, 23 bp, Homo sapiens
attctgaattaattaatttggag

SEQ ID NO: 4842515 - DNA, 16 bp, Homo sapiens
attctggctttaagcc

SEQ ID NO: 4842516 - DNA, 18 bp, Homo sapiens
attctgggcttggggtgt

SEQ ID NO: 4842517 - DNA, 22 bp, Homo sapiens
attcttcctaatgtcagaacag

SEQ ID NO: 4842518 - DNA, 18 bp, Homo sapiens
attcttgtgggagacagc

SEQ ID NO: 4842519 - DNA, 20 bp, Homo sapiens
attcttgtgggagacagcag

SEQ ID NO: 4842520 - DNA, 19 bp, Homo sapiens
attcttgttgctgtacaaa

SEQ ID NO: 4842521 - DNA, 22 bp, Homo sapiens
attcttgttgctgtacaaaagc

SEQ ID NO: 4842522 - DNA, 19 bp, Homo sapiens
attctttagcttacctggg

SEQ ID NO: 4842523 - DNA, 17 bp, Homo sapiens
attctttgcaatactgc

SEQ ID NO: 4842524 - DNA, 16 bp, Homo sapiens
attctttttgaaatgt

SEQ ID NO: 4842525 - DNA, 13 bp, Homo sapiens
attgaagtttcaa

SEQ ID NO: 4842526 - DNA, 15 bp, Homo sapiens
attgacttttataaa

SEQ ID NO: 4842527 - DNA, 13 bp, Homo sapiens
attgagaaatgtg

SEQ ID NO: 4842528 - DNA, 17 bp, Homo sapiens
attgaggggaggtggcc

SEQ ID NO: 4842529 - DNA, 13 bp, Homo sapiens
attgagtattgtt

SEQ ID NO: 4842530 - DNA, 14 bp, Homo sapiens
attgagtattgttt

SEQ ID NO: 4842531 - DNA, 17 bp, Homo sapiens
attgagttccagttgaa

SEQ ID NO: 4842532 - DNA, 19 bp, Homo sapiens
attgattgggaaaacattt

SEQ ID NO: 4842533 - DNA, 20 bp, Homo sapiens
attgattgggaaaacatttg

SEQ ID NO: 4842534 - DNA, 22 bp, Homo sapiens
attgattgggaaaacatttgct

SEQ ID NO: 4842535 - DNA, 14 bp, Homo sapiens
attgcaacagactg

SEQ ID NO: 4842536 - DNA, 14 bp, Homo sapiens
attgcaataaagta

SEQ ID NO: 4842537 - DNA, 23 bp, Homo sapiens
attgcaccatactccttgcttcc

SEQ ID NO: 4842538 - DNA, 14 bp, Homo sapiens
attgcagcctaaga

SEQ ID NO: 4842539 - DNA, 15 bp, Homo sapiens
attgcagcctaagaa

SEQ ID NO: 4842540 - DNA, 15 bp, Homo sapiens
attgcatactttgta

SEQ ID NO: 4842541 - DNA, 19 bp, Homo sapiens
attgcatcactgtatcatt

SEQ ID NO: 4842542 - DNA, 15 bp, Homo sapiens
attgctctggagcag

SEQ ID NO: 4842543 - DNA, 22 bp, Homo sapiens
attgctgataccatatgaatga

SEQ ID NO: 4842544 - DNA, 23 bp, Homo sapiens
agtccgcagttgtagcagaaacc

SEQ ID NO: 4842545 - DNA, 19 bp, Homo sapiens
agtcctaaaagttctcaat

SEQ ID NO: 4842546 - DNA, 14 bp, Homo sapiens
agtccttaggctac

SEQ ID NO: 4842547 - DNA, 15 bp, Homo sapiens
agtccttaggctact

SEQ ID NO: 4842548 - DNA, 16 bp, Homo sapiens
agtctccagaagaaaa

SEQ ID NO: 4842549 - DNA, 20 bp, Homo sapiens
agtctccagaagaaaatttg

SEQ ID NO: 4842550 - DNA, 21 bp, Homo sapiens
agtctccagaagaaaatttgc

SEQ ID NO: 4842551 - DNA, 16 bp, Homo sapiens
agtctgagggaaacca

SEQ ID NO: 4842552 - DNA, 18 bp, Homo sapiens
agtctgggatattcttta

SEQ ID NO: 4842553 - DNA, 17 bp, Homo sapiens
agtctgtactaaacagt

SEQ ID NO: 4842554 - DNA, 16 bp, Homo sapiens
agtctgtatttttcta

SEQ ID NO: 4842555 - DNA, 14 bp, Homo sapiens
agtcttctatttat

SEQ ID NO: 4842556 - DNA, 14 bp, Homo sapiens
agtctttcttcact

SEQ ID NO: 4842557 - DNA, 14 bp, Homo sapiens
agtctttgccttct

SEQ ID NO: 4842558 - DNA, 16 bp, Homo sapiens
agtctttgccttctct

SEQ ID NO: 4842559 - DNA, 19 bp, Homo sapiens
agtgaatttgggctgctgt

SEQ ID NO: 4842560 - DNA, 17 bp, Homo sapiens
agtgacaaagcaattta

SEQ ID NO: 4842561 - DNA, 13 bp, Homo sapiens
agtgactccaggg

SEQ ID NO: 4842562 - DNA, 14 bp, Homo sapiens
agtgatataaatca

SEQ ID NO: 4842563 - DNA, 21 bp, Homo sapiens
agtgcatagttgtagacaaag

SEQ ID NO: 4842564 - DNA, 12 bp, Homo sapiens
agtgccttctct

SEQ ID NO: 4842565 - DNA, 16 bp, Homo sapiens
agtgcctttagagggt

SEQ ID NO: 4842566 - DNA, 13 bp, Homo sapiens
agtgctcttccca

SEQ ID NO: 4842567 - DNA, 20 bp, Homo sapiens
agtgctcttcccactccagc

SEQ ID NO: 4842568 - DNA, 24 bp, Homo sapiens
agtggaacgaaaatgaaagctact

SEQ ID NO: 4842569 - DNA, 17 bp, Homo sapiens
agtggacgttaggccag

SEQ ID NO: 4842570 - DNA, 20 bp, Homo sapiens
agtggacgttaggccaggcc

SEQ ID NO: 4842571 - DNA, 15 bp, Homo sapiens
agtggctggggtgga

SEQ ID NO: 4842572 - DNA, 10 bp, Homo sapiens
agtgggaagg

SEQ ID NO: 4842573 - DNA, 13 bp, Homo sapiens
agtgggaagggag

SEQ ID NO: 4842574 - DNA, 18 bp, Homo sapiens
agtgggaatgttctttct

SEQ ID NO: 4842575 - DNA, 21 bp, Homo sapiens
agtgggctttggtggccaggg

SEQ ID NO: 4842576 - DNA, 22 bp, Homo sapiens
agtgggggatgggtcctctaga

SEQ ID NO: 4842577 - DNA, 15 bp, Homo sapiens
agtggtaattgggaa

SEQ ID NO: 4842578 - DNA, 13 bp, Homo sapiens
agtgtagctgtga

SEQ ID NO: 4842579 - DNA, 14 bp, Homo sapiens
agtgtagctgtgaa

SEQ ID NO: 4842580 - DNA, 15 bp, Homo sapiens
agtgtctaggcactg

SEQ ID NO: 4842581 - DNA, 16 bp, Homo sapiens
agtgtctgtgttttga

SEQ ID NO: 4842582 - DNA, 14 bp, Homo sapiens
agtgtgaaatatat

SEQ ID NO: 4842583 - DNA, 21 bp, Homo sapiens
agtgtgactccttatctcttt

SEQ ID NO: 4842584 - DNA, 19 bp, Homo sapiens
agtgtgaggacctccctgt

SEQ ID NO: 4842585 - DNA, 14 bp, Homo sapiens
agtgtgcagacagc

SEQ ID NO: 4842586 - DNA, 16 bp, Homo sapiens
agtgtgctaaaaatga

SEQ ID NO: 4842587 - DNA, 22 bp, Homo sapiens
agtgttactacagccttaatat

SEQ ID NO: 4842588 - DNA, 20 bp, Homo sapiens
agtgttgcctcttgcaatgc

SEQ ID NO: 4842589 - DNA, 22 bp, Homo sapiens
agtgttttggtggaaaaaacat

SEQ ID NO: 4842590 - DNA, 13 bp, Homo sapiens
agttaaagaaagg

SEQ ID NO: 4842591 - DNA, 16 bp, Homo sapiens
agttaaagaaaggaaa

SEQ ID NO: 4842592 - DNA, 14 bp, Homo sapiens
agttaacaggacag

SEQ ID NO: 4842593 - DNA, 18 bp, Homo sapiens
agttagctgaagaattga

SEQ ID NO: 4842594 - DNA, 20 bp, Homo sapiens
agttatacttatttgtatat

SEQ ID NO: 4842595 - DNA, 16 bp, Homo sapiens
agttatcatgaatttt

SEQ ID NO: 4842596 - DNA, 18 bp, Homo sapiens
agttatcatgaattttaa

SEQ ID NO: 4842597 - DNA, 22 bp, Homo sapiens
agttatcatgaattttaaagta

SEQ ID NO: 4842598 - DNA, 24 bp, Homo sapiens
agttcaatctggattcatatttaa

SEQ ID NO: 4842599 - DNA, 19 bp, Homo sapiens
agttccaaacagacaaaac

SEQ ID NO: 4842600 - DNA, 22 bp, Homo sapiens
agttcctcttttgtgctgcttc

SEQ ID NO: 4842601 - DNA, 16 bp, Homo sapiens
agttcctgtcccacat

SEQ ID NO: 4842602 - DNA, 23 bp, Homo sapiens
agttctaacagtgaagttttact

SEQ ID NO: 4842603 - DNA, 15 bp, Homo sapiens
agttctcaatgtaga

SEQ ID NO: 4842604 - DNA, 16 bp, Homo sapiens
agttctggatgtctgg

SEQ ID NO: 4842605 - DNA, 20 bp, Homo sapiens
agttctggatgtctggctca

SEQ ID NO: 4842606 - DNA, 14 bp, Homo sapiens
agttgatggagccc

SEQ ID NO: 4842607 - DNA, 17 bp, Homo sapiens
agttgatggagccccag

SEQ ID NO: 4842608 - DNA, 17 bp, Homo sapiens
agttgcatagcagtata

SEQ ID NO: 4842609 - DNA, 19 bp, Homo sapiens
agttgcccccattcccagc

SEQ ID NO: 4842610 - DNA, 15 bp, Homo sapiens
agttgctcaaaaaga

SEQ ID NO: 4842611 - DNA, 16 bp, Homo sapiens
agttgctcaaaaagaa

SEQ ID NO: 4842612 - DNA, 17 bp, Homo sapiens
agttggggacagaactc

SEQ ID NO: 4842613 - DNA, 15 bp, Homo sapiens
agttgggtgtctcct

SEQ ID NO: 4842614 - DNA, 14 bp, Homo sapiens
agttgtagacaaag

SEQ ID NO: 4842615 - DNA, 22 bp, Homo sapiens
agttgtgagtttaccttgtata

SEQ ID NO: 4842616 - DNA, 14 bp, Homo sapiens
agttgtgtttcaac

SEQ ID NO: 4842617 - DNA, 21 bp, Homo sapiens
agttgtgttttttaagatggc

SEQ ID NO: 4842618 - DNA, 18 bp, Homo sapiens
agtttacctggcttattt

SEQ ID NO: 4842619 - DNA, 14 bp, Homo sapiens
agtttaccttgtat

SEQ ID NO: 4842620 - DNA, 16 bp, Homo sapiens
agtttaggataaaata

SEQ ID NO: 4842621 - DNA, 20 bp, Homo sapiens
agtttcaagttttaaagttc

SEQ ID NO: 4842622 - DNA, 17 bp, Homo sapiens
agtttcactgtactgca

SEQ ID NO: 4842623 - DNA, 19 bp, Homo sapiens
agtttcactgtactgcatg

SEQ ID NO: 4842624 - DNA, 23 bp, Homo sapiens
agtttcactgtactgcatgtgac

SEQ ID NO: 4842625 - DNA, 17 bp, Homo sapiens
agtttcagagtatattg

SEQ ID NO: 4842626 - DNA, 12 bp, Homo sapiens
agtttgctgtgc

SEQ ID NO: 4842627 - DNA, 18 bp, Homo sapiens
agtttgctgtgctttgga

SEQ ID NO: 4842628 - DNA, 15 bp, Homo sapiens
agtttggttttgaca

SEQ ID NO: 4842629 - DNA, 12 bp, Homo sapiens
agtttgtgtaaa

SEQ ID NO: 4842630 - DNA, 13 bp, Homo sapiens
agtttgttggaaa

SEQ ID NO: 4842631 - DNA, 12 bp, Homo sapiens
agtttttgtttg

SEQ ID NO: 4842632 - DNA, 16 bp, Homo sapiens
agtttttgtttggaga

SEQ ID NO: 4842633 - DNA, 16 bp, Homo sapiens
ataaaaaatcatgcca

SEQ ID NO: 4842634 - DNA, 15 bp, Homo sapiens
ataaaatgatgttat

SEQ ID NO: 4842635 - DNA, 18 bp, Homo sapiens
ataaaatgatgttataca

SEQ ID NO: 4842636 - DNA, 13 bp, Homo sapiens
ataaagatgagtt

SEQ ID NO: 4842637 - DNA, 19 bp, Homo sapiens
ataaagtgcctcggacagt

SEQ ID NO: 4842638 - DNA, 12 bp, Homo sapiens
ataaatcataaa

SEQ ID NO: 4842639 - DNA, 19 bp, Homo sapiens
ataaatcattcttactaaa

SEQ ID NO: 4842640 - DNA, 21 bp, Homo sapiens
ataaatcattcttactaaaaa

SEQ ID NO: 4842641 - DNA, 16 bp, Homo sapiens
agcggggtcccctctg

SEQ ID NO: 4842642 - DNA, 22 bp, Homo sapiens
agcgggtacttatttctcagct

SEQ ID NO: 4842643 - DNA, 20 bp, Homo sapiens
agcgtgtggagcagagctct

SEQ ID NO: 4842644 - DNA, 15 bp, Homo sapiens
agctaaaaaggccct

SEQ ID NO: 4842645 - DNA, 23 bp, Homo sapiens
agctaaaatcaggaaagaaaagg

SEQ ID NO: 4842646 - DNA, 21 bp, Homo sapiens
agctaaagtttggttttgaca

SEQ ID NO: 4842647 - DNA, 12 bp, Homo sapiens
agctaattattt

SEQ ID NO: 4842648 - DNA, 12 bp, Homo sapiens
agctcaaatgaa

SEQ ID NO: 4842649 - DNA, 16 bp, Homo sapiens
agctcaaatgaaatgt

SEQ ID NO: 4842650 - DNA, 16 bp, Homo sapiens
agctctagcctctgga

SEQ ID NO: 4842651 - DNA, 15 bp, Homo sapiens
agctctcccctcctg

SEQ ID NO: 4842652 - DNA, 19 bp, Homo sapiens
agctctcccctcctgctgg

SEQ ID NO: 4842653 - DNA, 21 bp, Homo sapiens
agctctcccctcctgctgggc

SEQ ID NO: 4842654 - DNA, 14 bp, Homo sapiens
agctctcctccagc

SEQ ID NO: 4842655 - DNA, 20 bp, Homo sapiens
agctctcctccagccctggg

SEQ ID NO: 4842656 - DNA, 13 bp, Homo sapiens
agctctgaaatct

SEQ ID NO: 4842657 - DNA, 16 bp, Homo sapiens
agctctgaaatcttcc

SEQ ID NO: 4842658 - DNA, 22 bp, Homo sapiens
agctcttcctatccctctccta

SEQ ID NO: 4842659 - DNA, 21 bp, Homo sapiens
agctcttgtgttcagaagaat

SEQ ID NO: 4842660 - DNA, 13 bp, Homo sapiens
agctgaaatttta

SEQ ID NO: 4842661 - DNA, 20 bp, Homo sapiens
agctgaaattttagaaatat

SEQ ID NO: 4842662 - DNA, 18 bp, Homo sapiens
agctgcaaaaataatcat

SEQ ID NO: 4842663 - DNA, 16 bp, Homo sapiens
agctgcagagatttct

SEQ ID NO: 4842664 - DNA, 14 bp, Homo sapiens
agctgccatggcta

SEQ ID NO: 4842665 - DNA, 21 bp, Homo sapiens
agctgccgtagcttcagccag

SEQ ID NO: 4842666 - DNA, 21 bp, Homo sapiens
agctgctcctttaccctcttg

SEQ ID NO: 4842667 - DNA, 13 bp, Homo sapiens
agctgctgttgaa

SEQ ID NO: 4842668 - DNA, 17 bp, Homo sapiens
agctgctgttgaacttt

SEQ ID NO: 4842669 - DNA, 17 bp, Homo sapiens
agctgcttgacctagct

SEQ ID NO: 4842670 - DNA, 15 bp, Homo sapiens
agctggagcagcgga

SEQ ID NO: 4842671 - DNA, 15 bp, Homo sapiens
agctggcggaggctg

SEQ ID NO: 4842672 - DNA, 19 bp, Homo sapiens
ccttcatccatcctgagcc

SEQ ID NO: 4842673 - DNA, 13 bp, Homo sapiens
ccttcccccagca

SEQ ID NO: 4842674 - DNA, 12 bp, Homo sapiens
ccttcctcctga

SEQ ID NO: 4842675 - DNA, 18 bp, Homo sapiens
ccttctaaattcccaaat

SEQ ID NO: 4842676 - DNA, 21 bp, Homo sapiens
ccttctaaattcccaaatcct

SEQ ID NO: 4842677 - DNA, 16 bp, Homo sapiens
ccttctctttggggct

SEQ ID NO: 4842678 - DNA, 18 bp, Homo sapiens
ccttctgggtccagggag

SEQ ID NO: 4842679 - DNA, 20 bp, Homo sapiens
ccttctttggttccatgttg

SEQ ID NO: 4842680 - DNA, 17 bp, Homo sapiens
ccttgaaaaaaaacagt

SEQ ID NO: 4842681 - DNA, 15 bp, Homo sapiens
ccttgagtctctgaa

SEQ ID NO: 4842682 - DNA, 17 bp, Homo sapiens
ccttgagttaacaggac

SEQ ID NO: 4842683 - DNA, 14 bp, Homo sapiens
ccttgatggggtga

SEQ ID NO: 4842684 - DNA, 20 bp, Homo sapiens
ccttgcaacccaaggtgagg

SEQ ID NO: 4842685 - DNA, 19 bp, Homo sapiens
ccttgcagcggctcctgca

SEQ ID NO: 4842686 - DNA, 15 bp, Homo sapiens
ccttgcctccaggac

SEQ ID NO: 4842687 - DNA, 19 bp, Homo sapiens
ccttgcctccaggaccttg

SEQ ID NO: 4842688 - DNA, 18 bp, Homo sapiens
ccttgtataatattgaaa

SEQ ID NO: 4842689 - DNA, 15 bp, Homo sapiens
cctttaccctcttgg

SEQ ID NO: 4842690 - DNA, 21 bp, Homo sapiens
cctttatttttggcgtggctg

SEQ ID NO: 4842691 - DNA, 19 bp, Homo sapiens
cctttcctggcagtctcag

SEQ ID NO: 4842692 - DNA, 15 bp, Homo sapiens
cctttctctctctaa

SEQ ID NO: 4842693 - DNA, 12 bp, Homo sapiens
cctttgaagaag

SEQ ID NO: 4842694 - DNA, 21 bp, Homo sapiens
cctttgaagaaggcaaggctg

SEQ ID NO: 4842695 - DNA, 18 bp, Homo sapiens
cctttgcagttggactct

SEQ ID NO: 4842696 - DNA, 20 bp, Homo sapiens
ccttttaatctagagaaggc

SEQ ID NO: 4842697 - DNA, 12 bp, Homo sapiens
ccttttcttaaa

SEQ ID NO: 4842698 - DNA, 22 bp, Homo sapiens
cctttttacctggcctagaaag

SEQ ID NO: 4842699 - DNA, 19 bp, Homo sapiens
cctttttcataaattattt

SEQ ID NO: 4842700 - DNA, 14 bp, Homo sapiens
cgaaaacctgacta

SEQ ID NO: 4842701 - DNA, 22 bp, Homo sapiens
cgaagagagttctggatgtctg

SEQ ID NO: 4842702 - DNA, 17 bp, Homo sapiens
cgaatgcccctgttcat

SEQ ID NO: 4842703 - DNA, 13 bp, Homo sapiens
cgactctgacctc

SEQ ID NO: 4842704 - DNA, 16 bp, Homo sapiens
cgactctgcacccgcc

SEQ ID NO: 4842705 - DNA, 23 bp, Homo sapiens
cgactgtcagtggggcagcctct

SEQ ID NO: 4842706 - DNA, 17 bp, Homo sapiens
cgagagatcaaagatga

SEQ ID NO: 4842707 - DNA, 18 bp, Homo sapiens
cgagatcgggaagcagaa

SEQ ID NO: 4842708 - DNA, 22 bp, Homo sapiens
cgaggacatttgtgggcaagca

SEQ ID NO: 4842709 - DNA, 20 bp, Homo sapiens
cgagtctccgggactgccct

SEQ ID NO: 4842710 - DNA, 14 bp, Homo sapiens
cgagtgtagctgtg

SEQ ID NO: 4842711 - DNA, 17 bp, Homo sapiens
cgcaaccaagtgtgcta

SEQ ID NO: 4842712 - DNA, 11 bp, Homo sapiens
cgcagacctgg

SEQ ID NO: 4842713 - DNA, 21 bp, Homo sapiens
cgcagagaaatgccccagtgt

SEQ ID NO: 4842714 - DNA, 16 bp, Homo sapiens
cgcagaggtggggtgc

SEQ ID NO: 4842715 - DNA, 17 bp, Homo sapiens
cgcagaggtggggtgct

SEQ ID NO: 4842716 - DNA, 22 bp, Homo sapiens
cgcagaggtggggtgctggggc

SEQ ID NO: 4842717 - DNA, 16 bp, Homo sapiens
cgcagttgtagcagaa

SEQ ID NO: 4842718 - DNA, 19 bp, Homo sapiens
cgcagttgtagcagaaacc

SEQ ID NO: 4842719 - DNA, 20 bp, Homo sapiens
cgcagttgtagcagaaacca

SEQ ID NO: 4842720 - DNA, 20 bp, Homo sapiens
cgccagcgtgtggagcagag

SEQ ID NO: 4842721 - DNA, 14 bp, Homo sapiens
cgccagtcactgct

SEQ ID NO: 4842722 - DNA, 12 bp, Homo sapiens
cgcccccacctc

SEQ ID NO: 4842723 - DNA, 14 bp, Homo sapiens
cgccgccgccgctg

SEQ ID NO: 4842724 - DNA, 16 bp, Homo sapiens
cgccgccgccgctgcc

SEQ ID NO: 4842725 - DNA, 16 bp, Homo sapiens
cgcctcaccagccccc

SEQ ID NO: 4842726 - DNA, 22 bp, Homo sapiens
cgcggacccttctgggtccagg

SEQ ID NO: 4842727 - DNA, 22 bp, Homo sapiens
cggacagtccgcagttgtagca

SEQ ID NO: 4842728 - DNA, 19 bp, Homo sapiens
cggacccttctgggtccag

SEQ ID NO: 4842729 - DNA, 22 bp, Homo sapiens
cggacccttctgggtccaggga

SEQ ID NO: 4842730 - DNA, 17 bp, Homo sapiens
cggacctaggaccattt

SEQ ID NO: 4842731 - DNA, 16 bp, Homo sapiens
cggagcaaactctgct

SEQ ID NO: 4842732 - DNA, 15 bp, Homo sapiens
cggaggccttccctt

SEQ ID NO: 4842733 - DNA, 22 bp, Homo sapiens
cggagggcccctgcgtgggggc

SEQ ID NO: 4842734 - DNA, 15 bp, Homo sapiens
cggagtcagtgccag

SEQ ID NO: 4842735 - DNA, 17 bp, Homo sapiens
cggatcctgtgagtagg

SEQ ID NO: 4842736 - DNA, 18 bp, Homo sapiens
cggattgctctggagcag

SEQ ID NO: 4842737 - DNA, 20 bp, Homo sapiens
cggcagatgatgctttggaa

SEQ ID NO: 4842738 - DNA, 17 bp, Homo sapiens
cggccccgtctgtggct

SEQ ID NO: 4842739 - DNA, 18 bp, Homo sapiens
cggcccttacctttcctg

SEQ ID NO: 4842740 - DNA, 23 bp, Homo sapiens
cggctcccctcccaggggagcca

SEQ ID NO: 4842741 - DNA, 11 bp, Homo sapiens
cggctcctgca

SEQ ID NO: 4842742 - DNA, 23 bp, Homo sapiens
cggctctagggcctcagtctgga

SEQ ID NO: 4842743 - DNA, 23 bp, Homo sapiens
cggctctctatagcaccagggct

SEQ ID NO: 4842744 - DNA, 13 bp, Homo sapiens
cggctgccagggg

SEQ ID NO: 4842745 - DNA, 14 bp, Homo sapiens
cggctgccaggggc

SEQ ID NO: 4842746 - DNA, 15 bp, Homo sapiens
cggctgccaggggct

SEQ ID NO: 4842747 - DNA, 21 bp, Homo sapiens
cggctgccaggggctctgtgg

SEQ ID NO: 4842748 - DNA, 22 bp, Homo sapiens
cggctgccaggggctctgtggc

SEQ ID NO: 4842749 - DNA, 17 bp, Homo sapiens
cggctttaagtgtgctg

SEQ ID NO: 4842750 - DNA, 14 bp, Homo sapiens
cgggcaccaggggc

SEQ ID NO: 4842751 - DNA, 20 bp, Homo sapiens
cgggcatggtggctcatgcc

SEQ ID NO: 4842752 - DNA, 21 bp, Homo sapiens
cgggcatggtggctcatgcct

SEQ ID NO: 4842753 - DNA, 18 bp, Homo sapiens
cggggagaaacccagaga

SEQ ID NO: 4842754 - DNA, 18 bp, Homo sapiens
cggggggccgggggaggg

SEQ ID NO: 4842755 - DNA, 13 bp, Homo sapiens
cgggttctcccat

SEQ ID NO: 4842756 - DNA, 17 bp, Homo sapiens
cggttcagacccctgcc

SEQ ID NO: 4842757 - DNA, 15 bp, Homo sapiens
cgtagcttcagccag

SEQ ID NO: 4842758 - DNA, 22 bp, Homo sapiens
cgtcctctcggctgccaggggc

SEQ ID NO: 4842759 - DNA, 12 bp, Homo sapiens
cgtctcctccct

SEQ ID NO: 4842760 - DNA, 21 bp, Homo sapiens
cgtctgtggctttcagcctct

SEQ ID NO: 4842761 - DNA, 14 bp, Homo sapiens
cgtgccccttccct

SEQ ID NO: 4842762 - DNA, 16 bp, Homo sapiens
cgtgccccttccctgg

SEQ ID NO: 4842763 - DNA, 14 bp, Homo sapiens
cgtggcagcttgct

SEQ ID NO: 4842764 - DNA, 18 bp, Homo sapiens
cgtggcagcttgctgggc

SEQ ID NO: 4842765 - DNA, 20 bp, Homo sapiens
cgtggcagcttgctgggctt

SEQ ID NO: 4842766 - DNA, 17 bp, Homo sapiens
cgtggccacgggggcag

SEQ ID NO: 4842767 - DNA, 23 bp, Homo sapiens
cgtggccacgggggcagtgtgag

SEQ ID NO: 4842768 - DNA, 13 bp, Homo sapiens
cgtggctctgctg

SEQ ID NO: 4842769 - DNA, 22 bp, Homo sapiens
cgtttatatttttttaactgtg

SEQ ID NO: 4842770 - DNA, 22 bp, Homo sapiens
cgtttcatttagtcatgtgacc

SEQ ID NO: 4842771 - DNA, 13 bp, Homo sapiens
ctaaaaagtataa

SEQ ID NO: 4842772 - DNA, 22 bp, Homo sapiens
ctaaaatgaggatccagggcag

SEQ ID NO: 4842773 - DNA, 13 bp, Homo sapiens
ctaaaatgttcta

SEQ ID NO: 4842774 - DNA, 14 bp, Homo sapiens
ctaaaccccaagct

SEQ ID NO: 4842775 - DNA, 20 bp, Homo sapiens
ctaaaccccaagcttcccaa

SEQ ID NO: 4842776 - DNA, 17 bp, Homo sapiens
ctaaagagcatcctgat

SEQ ID NO: 4842777 - DNA, 15 bp, Homo sapiens
ctaaatatgaatgaa

SEQ ID NO: 4842778 - DNA, 23 bp, Homo sapiens
ctaaatatgaatgaatgggatat

SEQ ID NO: 4842779 - DNA, 13 bp, Homo sapiens
ctaaatgtgtaat

SEQ ID NO: 4842780 - DNA, 15 bp, Homo sapiens
ctaaatgtgtaataa

SEQ ID NO: 4842781 - DNA, 16 bp, Homo sapiens
ctaaattttaaagcca

SEQ ID NO: 4842782 - DNA, 17 bp, Homo sapiens
ctaaattttaaagccat

SEQ ID NO: 4842783 - DNA, 22 bp, Homo sapiens
ctaacaagtcataggttaatat

SEQ ID NO: 4842784 - DNA, 20 bp, Homo sapiens
ctaacagtgaagttttactg

SEQ ID NO: 4842785 - DNA, 21 bp, Homo sapiens
ctaaccaaggctgtgtttaga

SEQ ID NO: 4842786 - DNA, 14 bp, Homo sapiens
ctaacccagtcttt

SEQ ID NO: 4842787 - DNA, 12 bp, Homo sapiens
ctaacctgggac

SEQ ID NO: 4842788 - DNA, 13 bp, Homo sapiens
ctaacctgggacc

SEQ ID NO: 4842789 - DNA, 12 bp, Homo sapiens
ctaacctgtgac

SEQ ID NO: 4842790 - DNA, 20 bp, Homo sapiens
ctaacgaaatatcaaagtca

SEQ ID NO: 4842791 - DNA, 16 bp, Homo sapiens
ctaactcaaatacaca

SEQ ID NO: 4842792 - DNA, 20 bp, Homo sapiens
ctaactcaaatacacatttg

SEQ ID NO: 4842793 - DNA, 14 bp, Homo sapiens
ctaagaagaaggcc

SEQ ID NO: 4842794 - DNA, 12 bp, Homo sapiens
ccagtgactcca

SEQ ID NO: 4842795 - DNA, 13 bp, Homo sapiens
ccagtgactccag

SEQ ID NO: 4842796 - DNA, 18 bp, Homo sapiens
ccagttgcactcaggtga

SEQ ID NO: 4842797 - DNA, 21 bp, Homo sapiens
ccagtttaagccgcagacctg

SEQ ID NO: 4842798 - DNA, 13 bp, Homo sapiens
ccataagagaaac

SEQ ID NO: 4842799 - DNA, 19 bp, Homo sapiens
ccatactccttgcttcctg

SEQ ID NO: 4842800 - DNA, 21 bp, Homo sapiens
ccatactccttgcttcctgat

SEQ ID NO: 4842801 - DNA, 14 bp, Homo sapiens
ccatagatgctggc

SEQ ID NO: 4842802 - DNA, 14 bp, Homo sapiens
ccatatgcagaaat

SEQ ID NO: 4842803 - DNA, 16 bp, Homo sapiens
ccatatgcagaaatag

SEQ ID NO: 4842804 - DNA, 12 bp, Homo sapiens
ccatatttattc

SEQ ID NO: 4842805 - DNA, 17 bp, Homo sapiens
ccatcccactgctcccc

SEQ ID NO: 4842806 - DNA, 17 bp, Homo sapiens
ccatccctgcctggagg

SEQ ID NO: 4842807 - DNA, 16 bp, Homo sapiens
ccatcctaggaaccag

SEQ ID NO: 4842808 - DNA, 12 bp, Homo sapiens
ccatcgccggga

SEQ ID NO: 4842809 - DNA, 17 bp, Homo sapiens
ccatcgtattaaaaaac

SEQ ID NO: 4842810 - DNA, 12 bp, Homo sapiens
ccatctgaagag

SEQ ID NO: 4842811 - DNA, 12 bp, Homo sapiens
ccatcttctttc

SEQ ID NO: 4842812 - DNA, 22 bp, Homo sapiens
ccatcttctttcttccacccac

SEQ ID NO: 4842813 - DNA, 18 bp, Homo sapiens
ccatggctgaagctggag

SEQ ID NO: 4842814 - DNA, 20 bp, Homo sapiens
ccatgggggcacttgagttt

SEQ ID NO: 4842815 - DNA, 15 bp, Homo sapiens
ccattaaggggaaga

SEQ ID NO: 4842816 - DNA, 16 bp, Homo sapiens
ccattacaccacagca

SEQ ID NO: 4842817 - DNA, 13 bp, Homo sapiens
ccattacctccat

SEQ ID NO: 4842818 - DNA, 16 bp, Homo sapiens
ccattacctccatcca

SEQ ID NO: 4842819 - DNA, 13 bp, Homo sapiens
ccattccaaaata

SEQ ID NO: 4842820 - DNA, 15 bp, Homo sapiens
ccattctattctcca

SEQ ID NO: 4842821 - DNA, 18 bp, Homo sapiens
ccattgcttattatgtag

SEQ ID NO: 4842822 - DNA, 15 bp, Homo sapiens
ccatttccattgctt

SEQ ID NO: 4842823 - DNA, 19 bp, Homo sapiens
cccaaaccagcccagagca

SEQ ID NO: 4842824 - DNA, 19 bp, Homo sapiens
cccaaacctgggaaggcca

SEQ ID NO: 4842825 - DNA, 15 bp, Homo sapiens
cccaaatcctagact

SEQ ID NO: 4842826 - DNA, 24 bp, Homo sapiens
cccaaatcctagactgctcctggg

SEQ ID NO: 4842827 - DNA, 21 bp, Homo sapiens
cccaacctacattccaccctg

SEQ ID NO: 4842828 - DNA, 17 bp, Homo sapiens
cccaaggaatcagcagg

SEQ ID NO: 4842829 - DNA, 18 bp, Homo sapiens
cccaaggaatcagcagga

SEQ ID NO: 4842830 - DNA, 18 bp, Homo sapiens
cccaaggcattctcccag

SEQ ID NO: 4842831 - DNA, 21 bp, Homo sapiens
cccaagggacagcaagtgagc

SEQ ID NO: 4842832 - DNA, 17 bp, Homo sapiens
cccaaggtcctctcagt

SEQ ID NO: 4842833 - DNA, 19 bp, Homo sapiens
cccaagtcagcagtcctag

SEQ ID NO: 4842834 - DNA, 23 bp, Homo sapiens
cccaagtggacgttaggccaggc

SEQ ID NO: 4842835 - DNA, 18 bp, Homo sapiens
cccaagtggtgagcaagc

SEQ ID NO: 4842836 - DNA, 16 bp, Homo sapiens
cccaagttggaaggga

SEQ ID NO: 4842837 - DNA, 19 bp, Homo sapiens
cccaagttggaagggaccc

SEQ ID NO: 4842838 - DNA, 14 bp, Homo sapiens
cccaatatatgtat

SEQ ID NO: 4842839 - DNA, 23 bp, Homo sapiens
cccacaaactccaggctggaagt

SEQ ID NO: 4842840 - DNA, 21 bp, Homo sapiens
cccacaggcacattaactgtt

SEQ ID NO: 4842841 - DNA, 15 bp, Homo sapiens
cccacaggggatggt

SEQ ID NO: 4842842 - DNA, 16 bp, Homo sapiens
cccaccattctacctg

SEQ ID NO: 4842843 - DNA, 12 bp, Homo sapiens
cccaccccctcc

SEQ ID NO: 4842844 - DNA, 16 bp, Homo sapiens
cccaccctccatgctc

SEQ ID NO: 4842845 - DNA, 14 bp, Homo sapiens
cccaccctccggcg

SEQ ID NO: 4842846 - DNA, 14 bp, Homo sapiens
cccactccagctga

SEQ ID NO: 4842847 - DNA, 13 bp, Homo sapiens
cccactgctcccc

SEQ ID NO: 4842848 - DNA, 23 bp, Homo sapiens
cccagaacctctaagtgctgctg

SEQ ID NO: 4842849 - DNA, 14 bp, Homo sapiens
cccagagcagggtc

SEQ ID NO: 4842850 - DNA, 19 bp, Homo sapiens
cccagagcagggtctctct

SEQ ID NO: 4842851 - DNA, 13 bp, Homo sapiens
cccagagctgctg

SEQ ID NO: 4842852 - DNA, 12 bp, Homo sapiens
cccagaggtgga

SEQ ID NO: 4842853 - DNA, 23 bp, Homo sapiens
cccagaggtgggatcctccctca

SEQ ID NO: 4842854 - DNA, 14 bp, Homo sapiens
cccagagtgggctt

SEQ ID NO: 4842855 - DNA, 21 bp, Homo sapiens
cccagcacaaagcactggcct

SEQ ID NO: 4842856 - DNA, 23 bp, Homo sapiens
cccagcctgactagaactcctgt

SEQ ID NO: 4842857 - DNA, 20 bp, Homo sapiens
cccaggcagacaaccttgtc

SEQ ID NO: 4842858 - DNA, 14 bp, Homo sapiens
cccaggcatctgtt

SEQ ID NO: 4842859 - DNA, 14 bp, Homo sapiens
cccagggacagggc

SEQ ID NO: 4842860 - DNA, 14 bp, Homo sapiens
cccaggggagccag

SEQ ID NO: 4842861 - DNA, 17 bp, Homo sapiens
cccaggggagccagctg

SEQ ID NO: 4842862 - DNA, 22 bp, Homo sapiens
cccaggggagccagctgcttga

SEQ ID NO: 4842863 - DNA, 13 bp, Homo sapiens
cccagtctttctt

SEQ ID NO: 4842864 - DNA, 13 bp, Homo sapiens
cccagtgactcca

SEQ ID NO: 4842865 - DNA, 15 bp, Homo sapiens
cccagtgactccagg

SEQ ID NO: 4842866 - DNA, 16 bp, Homo sapiens
cccagtgactccaggg

SEQ ID NO: 4842867 - DNA, 20 bp, Homo sapiens
cccatagcagccagttcaaa

SEQ ID NO: 4842868 - DNA, 16 bp, Homo sapiens
cccatccctgcctgga

SEQ ID NO: 4842869 - DNA, 20 bp, Homo sapiens
cccatccctgcctggaggct

SEQ ID NO: 4842870 - DNA, 16 bp, Homo sapiens
cccatcctaggaacca

SEQ ID NO: 4842871 - DNA, 23 bp, Homo sapiens
cccatggctgaagctggagcagc

SEQ ID NO: 4842872 - DNA, 12 bp, Homo sapiens
cccattcccagc

SEQ ID NO: 4842873 - DNA, 19 bp, Homo sapiens
ccccaagggggctgctgct

SEQ ID NO: 4842874 - DNA, 20 bp, Homo sapiens
ccccaagggggctgctgctc

SEQ ID NO: 4842875 - DNA, 20 bp, Homo sapiens
ccccactttcaagaatcaga

SEQ ID NO: 4842876 - DNA, 19 bp, Homo sapiens
ccccagcacaaagcactgg

SEQ ID NO: 4842877 - DNA, 22 bp, Homo sapiens
ccccaggcatctgttagcagag

SEQ ID NO: 4842878 - DNA, 13 bp, Homo sapiens
ccccatccctggg

SEQ ID NO: 4842879 - DNA, 17 bp, Homo sapiens
ccccattcccagcctga

SEQ ID NO: 4842880 - DNA, 21 bp, Homo sapiens
ccccattcctgatcccatggc

SEQ ID NO: 4842881 - DNA, 22 bp, Homo sapiens
cccccttcaggagcctggccag

SEQ ID NO: 4842882 - DNA, 20 bp, Homo sapiens
cccctcccacgcctcaccag

SEQ ID NO: 4842883 - DNA, 23 bp, Homo sapiens
cccctcccaggggagccagctgc

SEQ ID NO: 4842884 - DNA, 14 bp, Homo sapiens
cccctcctgctggg

SEQ ID NO: 4842885 - DNA, 14 bp, Homo sapiens
cccctgcgtggggg

SEQ ID NO: 4842886 - DNA, 21 bp, Homo sapiens
cccctgctcccattcctccct

SEQ ID NO: 4842887 - DNA, 21 bp, Homo sapiens
ccccttaccccagtcacttct

SEQ ID NO: 4842888 - DNA, 17 bp, Homo sapiens
ccccttcatccatcctg

SEQ ID NO: 4842889 - DNA, 12 bp, Homo sapiens
ccccttccctgg

SEQ ID NO: 4842890 - DNA, 19 bp, Homo sapiens
ccccttcctcttgtctgat

SEQ ID NO: 4842891 - DNA, 17 bp, Homo sapiens
cccgcagaggtggggtg

SEQ ID NO: 4842892 - DNA, 20 bp, Homo sapiens
cccgcagaggtggggtgctg

SEQ ID NO: 4842893 - DNA, 13 bp, Homo sapiens
cccgccccgcccc

SEQ ID NO: 4842894 - DNA, 18 bp, Homo sapiens
cccgcccctcccacgcct

SEQ ID NO: 4842895 - DNA, 22 bp, Homo sapiens
cctcatcactggactgcatggg

SEQ ID NO: 4842896 - DNA, 14 bp, Homo sapiens
cctccaaaggaact

SEQ ID NO: 4842897 - DNA, 19 bp, Homo sapiens
cctccaaaggaactctaga

SEQ ID NO: 4842898 - DNA, 10 bp, Homo sapiens
cctccaccca

SEQ ID NO: 4842899 - DNA, 15 bp, Homo sapiens
cctccagaagctgct

SEQ ID NO: 4842900 - DNA, 19 bp, Homo sapiens
cctccagaagtcccttcaa

SEQ ID NO: 4842901 - DNA, 10 bp, Homo sapiens
cctccagact

SEQ ID NO: 4842902 - DNA, 14 bp, Homo sapiens
cctccagactcagc

SEQ ID NO: 4842903 - DNA, 16 bp, Homo sapiens
cctccagactcagcag

SEQ ID NO: 4842904 - DNA, 22 bp, Homo sapiens
cctccagactcagcagagtgag

SEQ ID NO: 4842905 - DNA, 14 bp, Homo sapiens
cctccagccctggg

SEQ ID NO: 4842906 - DNA, 15 bp, Homo sapiens
cctccagccctgggc

SEQ ID NO: 4842907 - DNA, 13 bp, Homo sapiens
cctccagctggga

SEQ ID NO: 4842908 - DNA, 15 bp, Homo sapiens
cctccaggaccttgc

SEQ ID NO: 4842909 - DNA, 22 bp, Homo sapiens
cctccaggaccttgcttccttc

SEQ ID NO: 4842910 - DNA, 14 bp, Homo sapiens
cctccatccatcct

SEQ ID NO: 4842911 - DNA, 22 bp, Homo sapiens
cctccatgctcctcacctgtct

SEQ ID NO: 4842912 - DNA, 22 bp, Homo sapiens
cctcccaagctgatggacatga

SEQ ID NO: 4842913 - DNA, 20 bp, Homo sapiens
cctcccaaggtcctctcagt

SEQ ID NO: 4842914 - DNA, 13 bp, Homo sapiens
cctcccacgcctc

SEQ ID NO: 4842915 - DNA, 13 bp, Homo sapiens
cctcccctgggca

SEQ ID NO: 4842916 - DNA, 12 bp, Homo sapiens
cctccgttgtct

SEQ ID NO: 4842917 - DNA, 18 bp, Homo sapiens
cctccttagccctgtctg

SEQ ID NO: 4842918 - DNA, 12 bp, Homo sapiens
cctccttctcct

SEQ ID NO: 4842919 - DNA, 12 bp, Homo sapiens
cctccttctgca

SEQ ID NO: 4842920 - DNA, 15 bp, Homo sapiens
cctccttctgcagtc

SEQ ID NO: 4842921 - DNA, 15 bp, Homo sapiens
catgaattttaaagt

SEQ ID NO: 4842922 - DNA, 15 bp, Homo sapiens
catgactctcatttt

SEQ ID NO: 4842923 - DNA, 23 bp, Homo sapiens
catgagtagtgggctatgcagga

SEQ ID NO: 4842924 - DNA, 16 bp, Homo sapiens
catgagttatcatgaa

SEQ ID NO: 4842925 - DNA, 16 bp, Homo sapiens
catgatttttgccctg

SEQ ID NO: 4842926 - DNA, 14 bp, Homo sapiens
catgcaataaaatt

SEQ ID NO: 4842927 - DNA, 15 bp, Homo sapiens
catgcaataaaattt

SEQ ID NO: 4842928 - DNA, 14 bp, Homo sapiens
catgcatataatga

SEQ ID NO: 4842929 - DNA, 21 bp, Homo sapiens
catgcatataatgaataaatc

SEQ ID NO: 4842930 - DNA, 18 bp, Homo sapiens
catgccaataaagtgatc

SEQ ID NO: 4842931 - DNA, 23 bp, Homo sapiens
catgctgctcccctaaagccagg

SEQ ID NO: 4842932 - DNA, 14 bp, Homo sapiens
catgcttaaatttt

SEQ ID NO: 4842933 - DNA, 20 bp, Homo sapiens
catggacatttagaagaaag

SEQ ID NO: 4842934 - DNA, 11 bp, Homo sapiens
catggagccta

SEQ ID NO: 4842935 - DNA, 19 bp, Homo sapiens
catggagcctacctctgtc

SEQ ID NO: 4842936 - DNA, 22 bp, Homo sapiens
catggagcctacctctgtctga

SEQ ID NO: 4842937 - DNA, 17 bp, Homo sapiens
catggcaggagtctctg

SEQ ID NO: 4842938 - DNA, 18 bp, Homo sapiens
catggctgaagctggagc

SEQ ID NO: 4842939 - DNA, 22 bp, Homo sapiens
catggctgaagctggagcagcg

SEQ ID NO: 4842940 - DNA, 17 bp, Homo sapiens
catggggaggcagcaga

SEQ ID NO: 4842941 - DNA, 14 bp, Homo sapiens
catggggccaggaa

SEQ ID NO: 4842942 - DNA, 17 bp, Homo sapiens
catgggggcacttgagt

SEQ ID NO: 4842943 - DNA, 19 bp, Homo sapiens
catgtaattttattttaaa

SEQ ID NO: 4842944 - DNA, 21 bp, Homo sapiens
catgtacaaaaattatgcaat

SEQ ID NO: 4842945 - DNA, 19 bp, Homo sapiens
catgtatgagtgtatgtgt

SEQ ID NO: 4842946 - DNA, 18 bp, Homo sapiens
catgtattgcacattgta

SEQ ID NO: 4842947 - DNA, 12 bp, Homo sapiens
catgtgacattt

SEQ ID NO: 4842948 - DNA, 18 bp, Homo sapiens
catgtgagctcttcctat

SEQ ID NO: 4842949 - DNA, 18 bp, Homo sapiens
catgtgagtctgggatat

SEQ ID NO: 4842950 - DNA, 16 bp, Homo sapiens
catgtgatacattttt

SEQ ID NO: 4842951 - DNA, 23 bp, Homo sapiens
catgtgtagagcccctactgtgg

SEQ ID NO: 4842952 - DNA, 15 bp, Homo sapiens
catgtgtctggccct

SEQ ID NO: 4842953 - DNA, 12 bp, Homo sapiens
catgtttaatgg

SEQ ID NO: 4842954 - DNA, 14 bp, Homo sapiens
catgtttggaaaat

SEQ ID NO: 4842955 - DNA, 19 bp, Homo sapiens
cattaaggggaagaatgaa

SEQ ID NO: 4842956 - DNA, 23 bp, Homo sapiens
cattaaggggaagaatgaaagct

SEQ ID NO: 4842957 - DNA, 23 bp, Homo sapiens
cattaatgcctgctttttggaaa

SEQ ID NO: 4842958 - DNA, 21 bp, Homo sapiens
cattacagaggtattaaaact

SEQ ID NO: 4842959 - DNA, 20 bp, Homo sapiens
cattaccaaaataataaaaa

SEQ ID NO: 4842960 - DNA, 23 bp, Homo sapiens
cattaccaaaataataaaaatca

SEQ ID NO: 4842961 - DNA, 16 bp, Homo sapiens
cattaccctacagaca

SEQ ID NO: 4842962 - DNA, 24 bp, Homo sapiens
cattacctccatccatccttccaa

SEQ ID NO: 4842963 - DNA, 18 bp, Homo sapiens
cattactagataaaatgt

SEQ ID NO: 4842964 - DNA, 15 bp, Homo sapiens
cattagcaaggcaga

SEQ ID NO: 4842965 - DNA, 19 bp, Homo sapiens
cattagtcctttgtctaag

SEQ ID NO: 4842966 - DNA, 15 bp, Homo sapiens
cattagttttgaaga

SEQ ID NO: 4842967 - DNA, 16 bp, Homo sapiens
cattagttttgaagat

SEQ ID NO: 4842968 - DNA, 14 bp, Homo sapiens
cattatgttaatat

SEQ ID NO: 4842969 - DNA, 15 bp, Homo sapiens
cattcacatttagaa

SEQ ID NO: 4842970 - DNA, 13 bp, Homo sapiens
cattcagaaaaaa

SEQ ID NO: 4842971 - DNA, 15 bp, Homo sapiens
cattcagaaatgttg

SEQ ID NO: 4842972 - DNA, 13 bp, Homo sapiens
cattcaggaattc

SEQ ID NO: 4842973 - DNA, 14 bp, Homo sapiens
cattcatccttcca

SEQ ID NO: 4842974 - DNA, 17 bp, Homo sapiens
cattccaccctgttact

SEQ ID NO: 4842975 - DNA, 22 bp, Homo sapiens
cattcccagcctgactagaact

SEQ ID NO: 4842976 - DNA, 23 bp, Homo sapiens
cattcctaatcaaattctgtctg

SEQ ID NO: 4842977 - DNA, 14 bp, Homo sapiens
cattctacctgagg

SEQ ID NO: 4842978 - DNA, 20 bp, Homo sapiens
cattctattctccagacatg

SEQ ID NO: 4842979 - DNA, 18 bp, Homo sapiens
cattctgaaccctccaaa

SEQ ID NO: 4842980 - DNA, 12 bp, Homo sapiens
cattctgaatta

SEQ ID NO: 4842981 - DNA, 23 bp, Homo sapiens
cattctgaattaattaatttgga

SEQ ID NO: 4842982 - DNA, 20 bp, Homo sapiens
cattctggggaaacaacatt

SEQ ID NO: 4842983 - DNA, 23 bp, Homo sapiens
cattctggtcaagggctgtcatt

SEQ ID NO: 4842984 - DNA, 12 bp, Homo sapiens
cattcttactaa

SEQ ID NO: 4842985 - DNA, 17 bp, Homo sapiens
cattcttgtgggagaca

SEQ ID NO: 4842986 - DNA, 18 bp, Homo sapiens
cattctttgcaatactgc

SEQ ID NO: 4842987 - DNA, 22 bp, Homo sapiens
cattgaagaatgttagagtaat

SEQ ID NO: 4842988 - DNA, 9 bp, Homo sapiens
cattgagta

SEQ ID NO: 4842989 - DNA, 16 bp, Homo sapiens
cattgagtattgttta

SEQ ID NO: 4842990 - DNA, 19 bp, Homo sapiens
cattgcacataagcttcca

SEQ ID NO: 4842991 - DNA, 17 bp, Homo sapiens
cattgcagcctaagaag

SEQ ID NO: 4842992 - DNA, 18 bp, Homo sapiens
cattgcagcctaagaaga

SEQ ID NO: 4842993 - DNA, 19 bp, Homo sapiens
cattgcagcctaagaagaa

SEQ ID NO: 4842994 - DNA, 16 bp, Homo sapiens
cattgtaattatgtaa

SEQ ID NO: 4842995 - DNA, 19 bp, Homo sapiens
cattgtaattatgtaaata

SEQ ID NO: 4842996 - DNA, 18 bp, Homo sapiens
cattgtttagatgaggct

SEQ ID NO: 4842997 - DNA, 20 bp, Homo sapiens
cattgtttagatgaggctca

SEQ ID NO: 4842998 - DNA, 17 bp, Homo sapiens
cattgtttcgtaacaca

SEQ ID NO: 4842999 - DNA, 12 bp, Homo sapiens
catttaaaaaaa

SEQ ID NO: 4843000 - DNA, 17 bp, Homo sapiens
catttaaattttttggc

SEQ ID NO: 4843001 - DNA, 18 bp, Homo sapiens
catttaaattttttggca

SEQ ID NO: 4843002 - DNA, 16 bp, Homo sapiens
catttagaagaaagat

SEQ ID NO: 4843003 - DNA, 17 bp, Homo sapiens
catttagaagaaagatg

SEQ ID NO: 4843004 - DNA, 17 bp, Homo sapiens
catttagtcatgtgacc

SEQ ID NO: 4843005 - DNA, 15 bp, Homo sapiens
catttatatattgaa

SEQ ID NO: 4843006 - DNA, 15 bp, Homo sapiens
catttattaagcagt

SEQ ID NO: 4843007 - DNA, 13 bp, Homo sapiens
catttcaggactc

SEQ ID NO: 4843008 - DNA, 15 bp, Homo sapiens
catttcaggactctc

SEQ ID NO: 4843009 - DNA, 20 bp, Homo sapiens
catttcaggactctctccag

SEQ ID NO: 4843010 - DNA, 22 bp, Homo sapiens
catttcaggactctctccagga

SEQ ID NO: 4843011 - DNA, 18 bp, Homo sapiens
catttctatattcctcca

SEQ ID NO: 4843012 - DNA, 16 bp, Homo sapiens
catttctcatgttgaa

SEQ ID NO: 4843013 - DNA, 22 bp, Homo sapiens
catttgctactgttgtaagaat

SEQ ID NO: 4843014 - DNA, 18 bp, Homo sapiens
catttgggagacatgtga

SEQ ID NO: 4843015 - DNA, 20 bp, Homo sapiens
catttgtatgtcaaagcttt

SEQ ID NO: 4843016 - DNA, 17 bp, Homo sapiens
cattttaagttttactg

SEQ ID NO: 4843017 - DNA, 15 bp, Homo sapiens
cattttaattttaaa

SEQ ID NO: 4843018 - DNA, 23 bp, Homo sapiens
cattttattaagctttttggaat

SEQ ID NO: 4843019 - DNA, 22 bp, Homo sapiens
cattttatttacagctgtgctc

SEQ ID NO: 4843020 - DNA, 16 bp, Homo sapiens
cattttcatattgtaa

SEQ ID NO: 4843021 - DNA, 17 bp, Homo sapiens
cattttcttttttaacc

SEQ ID NO: 4843022 - DNA, 12 bp, Homo sapiens
cattttgcctct

SEQ ID NO: 4843023 - DNA, 13 bp, Homo sapiens
cattttgcctctg

SEQ ID NO: 4843024 - DNA, 15 bp, Homo sapiens
cattttgcctctgtc

SEQ ID NO: 4843025 - DNA, 17 bp, Homo sapiens
cattttgcttcccatct

SEQ ID NO: 4843026 - DNA, 23 bp, Homo sapiens
catttttattaaagcatttccta

SEQ ID NO: 4843027 - DNA, 11 bp, Homo sapiens
catttttgaac

SEQ ID NO: 4843028 - DNA, 13 bp, Homo sapiens
ccaacctccagac

SEQ ID NO: 4843029 - DNA, 20 bp, Homo sapiens
ccaacctccagactcagcag

SEQ ID NO: 4843030 - DNA, 14 bp, Homo sapiens
ccaaccttgtttaa

SEQ ID NO: 4843031 - DNA, 21 bp, Homo sapiens
ccaagagctactcccacagca

SEQ ID NO: 4843032 - DNA, 11 bp, Homo sapiens
ccaagagggac

SEQ ID NO: 4843033 - DNA, 17 bp, Homo sapiens
ccaagagggactccaag

SEQ ID NO: 4843034 - DNA, 15 bp, Homo sapiens
ccaagccctggggca

SEQ ID NO: 4843035 - DNA, 16 bp, Homo sapiens
ccaagccctggggcag

SEQ ID NO: 4843036 - DNA, 17 bp, Homo sapiens
ccaagccctggggcagg

SEQ ID NO: 4843037 - DNA, 20 bp, Homo sapiens
ccaagctgaggaggtgctgc

SEQ ID NO: 4843038 - DNA, 22 bp, Homo sapiens
ccaagctgatggacatgagagt

SEQ ID NO: 4843039 - DNA, 23 bp, Homo sapiens
ccaagctgatggacatgagagta

SEQ ID NO: 4843040 - DNA, 13 bp, Homo sapiens
ccaagctggcaca

SEQ ID NO: 4843041 - DNA, 22 bp, Homo sapiens
ccaagctggcacaaaagacagc

SEQ ID NO: 4843042 - DNA, 13 bp, Homo sapiens
ccaagcttcccaa

SEQ ID NO: 4843043 - DNA, 17 bp, Homo sapiens
ccaaggaatcagcagga

SEQ ID NO: 4843044 - DNA, 21 bp, Homo sapiens
ccaaggagcatccttggcagt

SEQ ID NO: 4843045 - DNA, 17 bp, Homo sapiens
ccaaggcattctcccag

SEQ ID NO: 4843046 - DNA, 22 bp, Homo sapiens
ccaagggacagcaagtgagcag

SEQ ID NO: 4843047 - DNA, 13 bp, Homo sapiens
ccaagggaccagg

SEQ ID NO: 4843048 - DNA, 17 bp, Homo sapiens
ccaagggatctgcttga

SEQ ID NO: 4843049 - DNA, 14 bp, Homo sapiens
ccaagggggctgct

SEQ ID NO: 4843050 - DNA, 20 bp, Homo sapiens
ccaagggggctgctgctcct

SEQ ID NO: 4843051 - DNA, 14 bp, Homo sapiens
ccaaggtcctctca

SEQ ID NO: 4843052 - DNA, 20 bp, Homo sapiens
ccaaggtgaggtgaactcca

SEQ ID NO: 4843053 - DNA, 21 bp, Homo sapiens
ccaaggtgaggtgaactccag

SEQ ID NO: 4843054 - DNA, 24 bp, Homo sapiens
ccaaggtgaggtgaactccaggca

SEQ ID NO: 4843055 - DNA, 15 bp, Homo sapiens
ccaagtctctgtgta

SEQ ID NO: 4843056 - DNA, 21 bp, Homo sapiens
ccaagtggacgttaggccagg

SEQ ID NO: 4843057 - DNA, 23 bp, Homo sapiens
ccaatgaataatggaaaatgcca

SEQ ID NO: 4843058 - DNA, 18 bp, Homo sapiens
ccaatgaattattatata

SEQ ID NO: 4843059 - DNA, 14 bp, Homo sapiens
ccaatgactgagca

SEQ ID NO: 4843060 - DNA, 13 bp, Homo sapiens
ccaatgctgcttt

SEQ ID NO: 4843061 - DNA, 17 bp, Homo sapiens
ccacaaactccaggctg

SEQ ID NO: 4843062 - DNA, 23 bp, Homo sapiens
ccacaaactccaggctggaagta

SEQ ID NO: 4843063 - DNA, 13 bp, Homo sapiens
ccacactcagaaa

SEQ ID NO: 4843064 - DNA, 22 bp, Homo sapiens
ccacactcagaaaattccctgg

SEQ ID NO: 4843065 - DNA, 15 bp, Homo sapiens
ccacagaacttgtgg

SEQ ID NO: 4843066 - DNA, 16 bp, Homo sapiens
ccacagaacttgtggc

SEQ ID NO: 4843067 - DNA, 19 bp, Homo sapiens
ccacagaaggtgaactttg

SEQ ID NO: 4843068 - DNA, 18 bp, Homo sapiens
ccacaggcacattaactg

SEQ ID NO: 4843069 - DNA, 19 bp, Homo sapiens
ccacaggcacattaactgt

SEQ ID NO: 4843070 - DNA, 20 bp, Homo sapiens
ccacaggcacattaactgtt

SEQ ID NO: 4843071 - DNA, 14 bp, Homo sapiens
ccacatcaaacctt

SEQ ID NO: 4843072 - DNA, 13 bp, Homo sapiens
ccacccacaaact

SEQ ID NO: 4843073 - DNA, 22 bp, Homo sapiens
ccacccacaaactccaggctgg

SEQ ID NO: 4843074 - DNA, 23 bp, Homo sapiens
ccacccacaaactccaggctgga

SEQ ID NO: 4843075 - DNA, 12 bp, Homo sapiens
ccacccccaggc

SEQ ID NO: 4843076 - DNA, 20 bp, Homo sapiens
ccaccccgtagattcccatc

SEQ ID NO: 4843077 - DNA, 19 bp, Homo sapiens
ccacctcatcactggactg

SEQ ID NO: 4843078 - DNA, 12 bp, Homo sapiens
ccacgcctcacc

SEQ ID NO: 4843079 - DNA, 19 bp, Homo sapiens
ccacgcctcaccagccccc

SEQ ID NO: 4843080 - DNA, 19 bp, Homo sapiens
ccactaggaatcccagagg

SEQ ID NO: 4843081 - DNA, 20 bp, Homo sapiens
ccactccagctccttcgctt

SEQ ID NO: 4843082 - DNA, 13 bp, Homo sapiens
ccactccagctga

SEQ ID NO: 4843083 - DNA, 19 bp, Homo sapiens
ccactccttcatgtttgga

SEQ ID NO: 4843084 - DNA, 12 bp, Homo sapiens
ccacttctcccc

SEQ ID NO: 4843085 - DNA, 13 bp, Homo sapiens
ccacttctcccca

SEQ ID NO: 4843086 - DNA, 18 bp, Homo sapiens
ccactttattgcaatgca

SEQ ID NO: 4843087 - DNA, 13 bp, Homo sapiens
ccagaaaggtgtg

SEQ ID NO: 4843088 - DNA, 21 bp, Homo sapiens
ccagaaccttgatggggtgag

SEQ ID NO: 4843089 - DNA, 15 bp, Homo sapiens
ccagaatgaccttga

SEQ ID NO: 4843090 - DNA, 17 bp, Homo sapiens
ccagacaattccattca

SEQ ID NO: 4843091 - DNA, 14 bp, Homo sapiens
ccagacatggaggg

SEQ ID NO: 4843092 - DNA, 16 bp, Homo sapiens
ccagacatggagggga

SEQ ID NO: 4843093 - DNA, 18 bp, Homo sapiens
ccagacgtggtgcttctc

SEQ ID NO: 4843094 - DNA, 13 bp, Homo sapiens
ccagactcagcag

SEQ ID NO: 4843095 - DNA, 12 bp, Homo sapiens
ccagactctggg

SEQ ID NO: 4843096 - DNA, 16 bp, Homo sapiens
ccagagaaagcaaagg

SEQ ID NO: 4843097 - DNA, 21 bp, Homo sapiens
ccagagagggaaaaggcaggt

SEQ ID NO: 4843098 - DNA, 23 bp, Homo sapiens
ccagagctgtctgaactcacgtg

SEQ ID NO: 4843099 - DNA, 20 bp, Homo sapiens
ccagaggaccaatgcttgca

SEQ ID NO: 4843100 - DNA, 19 bp, Homo sapiens
ccagaggtgggatcctccc

SEQ ID NO: 4843101 - DNA, 20 bp, Homo sapiens
ccagaggtgggatcctccct

SEQ ID NO: 4843102 - DNA, 12 bp, Homo sapiens
ccagagtctctt

SEQ ID NO: 4843103 - DNA, 16 bp, Homo sapiens
ccagatacctgtgagg

SEQ ID NO: 4843104 - DNA, 21 bp, Homo sapiens
ccagatctttcagaaatataa

SEQ ID NO: 4843105 - DNA, 19 bp, Homo sapiens
ccagatgaggctggccaag

SEQ ID NO: 4843106 - DNA, 14 bp, Homo sapiens
ccagattggccaat

SEQ ID NO: 4843107 - DNA, 11 bp, Homo sapiens
ccagccacccc

SEQ ID NO: 4843108 - DNA, 17 bp, Homo sapiens
ccagccacccccaggca

SEQ ID NO: 4843109 - DNA, 17 bp, Homo sapiens
ccagcccaaacctggga

SEQ ID NO: 4843110 - DNA, 18 bp, Homo sapiens
ccagcccaaacctgggaa

SEQ ID NO: 4843111 - DNA, 20 bp, Homo sapiens
ccagcccaaacctgggaagg

SEQ ID NO: 4843112 - DNA, 16 bp, Homo sapiens
ccagcccgcagaggtg

SEQ ID NO: 4843113 - DNA, 22 bp, Homo sapiens
ccagcccgcagaggtggggtgc

SEQ ID NO: 4843114 - DNA, 14 bp, Homo sapiens
ccagctcacccctg

SEQ ID NO: 4843115 - DNA, 19 bp, Homo sapiens
ccagctctagcctctggac

SEQ ID NO: 4843116 - DNA, 15 bp, Homo sapiens
ccagctgcttgacct

SEQ ID NO: 4843117 - DNA, 15 bp, Homo sapiens
ccagctgtgcacttt

SEQ ID NO: 4843118 - DNA, 16 bp, Homo sapiens
ccaggaccttgcttcc

SEQ ID NO: 4843119 - DNA, 22 bp, Homo sapiens
ccaggaccttgcttccttctca

SEQ ID NO: 4843120 - DNA, 13 bp, Homo sapiens
ccaggactcccag

SEQ ID NO: 4843121 - DNA, 18 bp, Homo sapiens
ccaggactcccagaacct

SEQ ID NO: 4843122 - DNA, 18 bp, Homo sapiens
ccaggcagggagagagta

SEQ ID NO: 4843123 - DNA, 20 bp, Homo sapiens
ccaggcatctgttagcagag

SEQ ID NO: 4843124 - DNA, 22 bp, Homo sapiens
ccaggcatctgttagcagagtc

SEQ ID NO: 4843125 - DNA, 21 bp, Homo sapiens
ccaggcatgaaattcttccta

SEQ ID NO: 4843126 - DNA, 19 bp, Homo sapiens
ccaggctcaggagaagcca

SEQ ID NO: 4843127 - DNA, 13 bp, Homo sapiens
ccaggctggaagt

SEQ ID NO: 4843128 - DNA, 16 bp, Homo sapiens
ccagggacagggccct

SEQ ID NO: 4843129 - DNA, 17 bp, Homo sapiens
ccagggaggcagcctag

SEQ ID NO: 4843130 - DNA, 23 bp, Homo sapiens
ccagggaggcagcctagcctatg

SEQ ID NO: 4843131 - DNA, 17 bp, Homo sapiens
atttttttaaaattttg

SEQ ID NO: 4843132 - DNA, 22 bp, Homo sapiens
caaaaagagtcagacatttctt

SEQ ID NO: 4843133 - DNA, 16 bp, Homo sapiens
caaaaagccacagcag

SEQ ID NO: 4843134 - DNA, 16 bp, Homo sapiens
caaaaataatcatgaa

SEQ ID NO: 4843135 - DNA, 14 bp, Homo sapiens
caaaaattatatat

SEQ ID NO: 4843136 - DNA, 15 bp, Homo sapiens
caaaaattatatatt

SEQ ID NO: 4843137 - DNA, 15 bp, Homo sapiens
caaaaattatgcaat

SEQ ID NO: 4843138 - DNA, 19 bp, Homo sapiens
ctatttatttatttattca

SEQ ID NO: 4843139 - DNA, 14 bp, Homo sapiens
ctatttgtgacttt

SEQ ID NO: 4843140 - DNA, 15 bp, Homo sapiens
ctatttgtgactttt

SEQ ID NO: 4843141 - DNA, 17 bp, Homo sapiens
ctatttgtgacttttta

SEQ ID NO: 4843142 - DNA, 19 bp, Homo sapiens
ctatttttaatttcctgtg

SEQ ID NO: 4843143 - DNA, 15 bp, Homo sapiens
ctatttttatgatga

SEQ ID NO: 4843144 - DNA, 19 bp, Homo sapiens
ctatttttatgatgacaat

SEQ ID NO: 4843145 - DNA, 23 bp, Homo sapiens
ctatttttatgatgacaatcaaa

SEQ ID NO: 4843146 - DNA, 14 bp, Homo sapiens
ctatttttgtgaag

SEQ ID NO: 4843147 - DNA, 17 bp, Homo sapiens
ctatttttttagattga

SEQ ID NO: 4843148 - DNA, 16 bp, Homo sapiens
ctcaaacctggcagat

SEQ ID NO: 4843149 - DNA, 15 bp, Homo sapiens
ctcaaagaagtactg

SEQ ID NO: 4843150 - DNA, 18 bp, Homo sapiens
ctcaaatacacatttgct

SEQ ID NO: 4843151 - DNA, 17 bp, Homo sapiens
ctcaactctacccctgc

SEQ ID NO: 4843152 - DNA, 20 bp, Homo sapiens
ctcaactctacccctgctcc

SEQ ID NO: 4843153 - DNA, 17 bp, Homo sapiens
ctcaagcattctgttta

SEQ ID NO: 4843154 - DNA, 20 bp, Homo sapiens
ctcaaggataccttcttatt

SEQ ID NO: 4843155 - DNA, 23 bp, Homo sapiens
ctcaattttatccctcacctgta

SEQ ID NO: 4843156 - DNA, 15 bp, Homo sapiens
ctcacaagccagcca

SEQ ID NO: 4843157 - DNA, 18 bp, Homo sapiens
ctcacacccctgccccca

SEQ ID NO: 4843158 - DNA, 14 bp, Homo sapiens
ctcaccacagcctt

SEQ ID NO: 4843159 - DNA, 17 bp, Homo sapiens
ctcaccagccccccgcg

SEQ ID NO: 4843160 - DNA, 17 bp, Homo sapiens
ctcaccctctgtccttc

SEQ ID NO: 4843161 - DNA, 16 bp, Homo sapiens
ctcactactgaacaca

SEQ ID NO: 4843162 - DNA, 18 bp, Homo sapiens
ctcagaaaattccctggg

SEQ ID NO: 4843163 - DNA, 20 bp, Homo sapiens
ctcagaaaattccctggggt

SEQ ID NO: 4843164 - DNA, 22 bp, Homo sapiens
ctcagactgggcactggggcct

SEQ ID NO: 4843165 - DNA, 22 bp, Homo sapiens
ctcagagaggtagcactctcag

SEQ ID NO: 4843166 - DNA, 13 bp, Homo sapiens
ctcagctctctgg

SEQ ID NO: 4843167 - DNA, 14 bp, Homo sapiens
ctcagctgtgcctt

SEQ ID NO: 4843168 - DNA, 19 bp, Homo sapiens
ctcagctgtgccttccctt

SEQ ID NO: 4843169 - DNA, 12 bp, Homo sapiens
ctcaggacccat

SEQ ID NO: 4843170 - DNA, 14 bp, Homo sapiens
ctcaggccaaggga

SEQ ID NO: 4843171 - DNA, 13 bp, Homo sapiens
ctcagggtggggg

SEQ ID NO: 4843172 - DNA, 18 bp, Homo sapiens
ctcagggtggggggtgac

SEQ ID NO: 4843173 - DNA, 18 bp, Homo sapiens
ctcagtagcatctcagtg

SEQ ID NO: 4843174 - DNA, 18 bp, Homo sapiens
ctcagtggtgtgtgaagt

SEQ ID NO: 4843175 - DNA, 20 bp, Homo sapiens
ctcagtggtgtgtgaagttt

SEQ ID NO: 4843176 - DNA, 15 bp, Homo sapiens
ctcagttctcaaatg

SEQ ID NO: 4843177 - DNA, 18 bp, Homo sapiens
ctcagttctcaaatgtgt

SEQ ID NO: 4843178 - DNA, 22 bp, Homo sapiens
ctcagttctctcccttcctctc

SEQ ID NO: 4843179 - DNA, 23 bp, Homo sapiens
ctcagttctctcccttcctctct

SEQ ID NO: 4843180 - DNA, 15 bp, Homo sapiens
ctcagtttcttgctt

SEQ ID NO: 4843181 - DNA, 22 bp, Homo sapiens
ctcataggttaaaaaaaaaagt

SEQ ID NO: 4843182 - DNA, 15 bp, Homo sapiens
ctcatcactggactg

SEQ ID NO: 4843183 - DNA, 19 bp, Homo sapiens
ctcatcactggactgcatg

SEQ ID NO: 4843184 - DNA, 17 bp, Homo sapiens
ctcatgctgctccccta

SEQ ID NO: 4843185 - DNA, 20 bp, Homo sapiens
ctcatgtgcaataggtgaga

SEQ ID NO: 4843186 - DNA, 17 bp, Homo sapiens
ctcatgttgaaacttta

SEQ ID NO: 4843187 - DNA, 20 bp, Homo sapiens
ctcattttatttacagctgt

SEQ ID NO: 4843188 - DNA, 21 bp, Homo sapiens
ctcattttgcttcccatctga

SEQ ID NO: 4843189 - DNA, 21 bp, Homo sapiens
ctccaagcactagccttccca

SEQ ID NO: 4843190 - DNA, 13 bp, Homo sapiens
ctccaagccctgg

SEQ ID NO: 4843191 - DNA, 18 bp, Homo sapiens
ctccaagccctggggcag

SEQ ID NO: 4843192 - DNA, 14 bp, Homo sapiens
ctccaagcctgcct

SEQ ID NO: 4843193 - DNA, 15 bp, Homo sapiens
ctccaagcctgcctc

SEQ ID NO: 4843194 - DNA, 18 bp, Homo sapiens
ctccaagcctgcctccca

SEQ ID NO: 4843195 - DNA, 16 bp, Homo sapiens
ctccaatgactgagca

SEQ ID NO: 4843196 - DNA, 14 bp, Homo sapiens
ctccacactcagaa

SEQ ID NO: 4843197 - DNA, 17 bp, Homo sapiens
ctccacaggagagactg

SEQ ID NO: 4843198 - DNA, 15 bp, Homo sapiens
ctccagaagctgctc

SEQ ID NO: 4843199 - DNA, 14 bp, Homo sapiens
ctccagaagtccct

SEQ ID NO: 4843200 - DNA, 13 bp, Homo sapiens
ctccagactcagc

SEQ ID NO: 4843201 - DNA, 15 bp, Homo sapiens
ctccagactctgggg

SEQ ID NO: 4843202 - DNA, 14 bp, Homo sapiens
ctccagagaaagca

SEQ ID NO: 4843203 - DNA, 22 bp, Homo sapiens
ctccagagaaagcacaatttaa

SEQ ID NO: 4843204 - DNA, 12 bp, Homo sapiens
ctccagccctgg

SEQ ID NO: 4843205 - DNA, 15 bp, Homo sapiens
ctccagccctgggca

SEQ ID NO: 4843206 - DNA, 14 bp, Homo sapiens
ctccaggagggctc

SEQ ID NO: 4843207 - DNA, 10 bp, Homo sapiens
ctccaggctg

SEQ ID NO: 4843208 - DNA, 19 bp, Homo sapiens
ctccaggctggaagtactt

SEQ ID NO: 4843209 - DNA, 21 bp, Homo sapiens
ctccagggtgacaaggcctgc

SEQ ID NO: 4843210 - DNA, 15 bp, Homo sapiens
ctccatccatccttc

SEQ ID NO: 4843211 - DNA, 14 bp, Homo sapiens
ctccattcatcctt

SEQ ID NO: 4843212 - DNA, 15 bp, Homo sapiens
ctccattcatccttc

SEQ ID NO: 4843213 - DNA, 22 bp, Homo sapiens
ctcccaaggcattctcccagct

SEQ ID NO: 4843214 - DNA, 17 bp, Homo sapiens
ctcccaaggtcctctca

SEQ ID NO: 4843215 - DNA, 18 bp, Homo sapiens
ctcccaaggtcctctcag

SEQ ID NO: 4843216 - DNA, 23 bp, Homo sapiens
ctcccacaggggccatgtcctct

SEQ ID NO: 4843217 - DNA, 13 bp, Homo sapiens
ctcccacccaccg

SEQ ID NO: 4843218 - DNA, 21 bp, Homo sapiens
ctcccacgcctcaccagcccc

SEQ ID NO: 4843219 - DNA, 13 bp, Homo sapiens
ctcccagaacctc

SEQ ID NO: 4843220 - DNA, 21 bp, Homo sapiens
ctcccagaacctctaagtgct

SEQ ID NO: 4843221 - DNA, 17 bp, Homo sapiens
ctcccaggggagccagc

SEQ ID NO: 4843222 - DNA, 18 bp, Homo sapiens
ctcccaggggagccagct

SEQ ID NO: 4843223 - DNA, 19 bp, Homo sapiens
ctcccaggggagccagctg

SEQ ID NO: 4843224 - DNA, 22 bp, Homo sapiens
ctcccaggggagccagctgctt

SEQ ID NO: 4843225 - DNA, 22 bp, Homo sapiens
ctcccaggtgtttgtggggctg

SEQ ID NO: 4843226 - DNA, 19 bp, Homo sapiens
ctcccatgatttggggtga

SEQ ID NO: 4843227 - DNA, 19 bp, Homo sapiens
ctcccctaaagccaggctc

SEQ ID NO: 4843228 - DNA, 15 bp, Homo sapiens
ctcccctcctgctgg

SEQ ID NO: 4843229 - DNA, 14 bp, Homo sapiens
ctccctagctcctc

SEQ ID NO: 4843230 - DNA, 19 bp, Homo sapiens
ctccctcagctctctggga

SEQ ID NO: 4843231 - DNA, 17 bp, Homo sapiens
ctccggccatactgcct

SEQ ID NO: 4843232 - DNA, 17 bp, Homo sapiens
ctcctataaagtgcctc

SEQ ID NO: 4843233 - DNA, 19 bp, Homo sapiens
ctcctataaagtgcctcgg

SEQ ID NO: 4843234 - DNA, 16 bp, Homo sapiens
ctcctatatcctcctt

SEQ ID NO: 4843235 - DNA, 12 bp, Homo sapiens
ctcctcacctgt

SEQ ID NO: 4843236 - DNA, 11 bp, Homo sapiens
ctcctcagggt

SEQ ID NO: 4843237 - DNA, 14 bp, Homo sapiens
ctcctccagccctg

SEQ ID NO: 4843238 - DNA, 16 bp, Homo sapiens
ctcctccagccctggg

SEQ ID NO: 4843239 - DNA, 13 bp, Homo sapiens
ctcctcccgcccc

SEQ ID NO: 4843240 - DNA, 21 bp, Homo sapiens
ctcctcccgccccgcccctcc

SEQ ID NO: 4843241 - DNA, 23 bp, Homo sapiens
ctcctctctctttcctccaccca

SEQ ID NO: 4843242 - DNA, 17 bp, Homo sapiens
ctcctgccctctgctct

SEQ ID NO: 4843243 - DNA, 24 bp, Homo sapiens
ctcctgccctctgctctgcctgga

SEQ ID NO: 4843244 - DNA, 14 bp, Homo sapiens
ctcctgctgggcgt

SEQ ID NO: 4843245 - DNA, 20 bp, Homo sapiens
ctcctgggcattagcaaggc

SEQ ID NO: 4843246 - DNA, 23 bp, Homo sapiens
ctcctgtcttctttctccatgga

SEQ ID NO: 4843247 - DNA, 22 bp, Homo sapiens
ctcctgttccatttcagttcag

SEQ ID NO: 4843248 - DNA, 17 bp, Homo sapiens
ctccttatctctttcca

SEQ ID NO: 4843249 - DNA, 15 bp, Homo sapiens
ctccttgcttcctga

SEQ ID NO: 4843250 - DNA, 14 bp, Homo sapiens
ctcctttaccctct

SEQ ID NO: 4843251 - DNA, 15 bp, Homo sapiens
ctcctttaccctctt

SEQ ID NO: 4843252 - DNA, 22 bp, Homo sapiens
ctcctttcattaccctacagac

SEQ ID NO: 4843253 - DNA, 14 bp, Homo sapiens
ctcctttgaagaag

SEQ ID NO: 4843254 - DNA, 23 bp, Homo sapiens
ctcggctactggttacctggaga

SEQ ID NO: 4843255 - DNA, 15 bp, Homo sapiens
ctcggctgccagggg

SEQ ID NO: 4843256 - DNA, 22 bp, Homo sapiens
ctcggctgccaggggctctgtg

SEQ ID NO: 4843257 - DNA, 20 bp, Homo sapiens
ctcggggtgtgtcatttcta

SEQ ID NO: 4843258 - DNA, 24 bp, Homo sapiens
ctggcttcaaaaagccacagcaga

SEQ ID NO: 4843259 - DNA, 17 bp, Homo sapiens
ctggctttaagccttca

SEQ ID NO: 4843260 - DNA, 17 bp, Homo sapiens
ctgggaaagcataaagc

SEQ ID NO: 4843261 - DNA, 14 bp, Homo sapiens
ctgggaaggccagc

SEQ ID NO: 4843262 - DNA, 15 bp, Homo sapiens
ctgggacccacagaa

SEQ ID NO: 4843263 - DNA, 14 bp, Homo sapiens
ctgggacctcctta

SEQ ID NO: 4843264 - DNA, 15 bp, Homo sapiens
ctgggacctgtggtc

SEQ ID NO: 4843265 - DNA, 17 bp, Homo sapiens
ctgggagccacttctcc

SEQ ID NO: 4843266 - DNA, 19 bp, Homo sapiens
ctgggagccacttctcccc

SEQ ID NO: 4843267 - DNA, 22 bp, Homo sapiens
ctgggagccacttctccccaga

SEQ ID NO: 4843268 - DNA, 19 bp, Homo sapiens
ctgggattggggggtgggc

SEQ ID NO: 4843269 - DNA, 21 bp, Homo sapiens
ctgggattggggggtgggctt

SEQ ID NO: 4843270 - DNA, 18 bp, Homo sapiens
ctgggcactggggcctca

SEQ ID NO: 4843271 - DNA, 13 bp, Homo sapiens
ctgggcagaggga

SEQ ID NO: 4843272 - DNA, 21 bp, Homo sapiens
ctgggcattagcaaggcagag

SEQ ID NO: 4843273 - DNA, 22 bp, Homo sapiens
ctgggcattagcaaggcagagc

SEQ ID NO: 4843274 - DNA, 15 bp, Homo sapiens
ctgggcccaggggct

SEQ ID NO: 4843275 - DNA, 17 bp, Homo sapiens
ctgggcctcccctgggc

SEQ ID NO: 4843276 - DNA, 16 bp, Homo sapiens
ctgggcgtgtgtgaca

SEQ ID NO: 4843277 - DNA, 17 bp, Homo sapiens
ctgggcgtgtgtgacac

SEQ ID NO: 4843278 - DNA, 12 bp, Homo sapiens
ctgggctcagcc

SEQ ID NO: 4843279 - DNA, 13 bp, Homo sapiens
ctgggctgtgagg

SEQ ID NO: 4843280 - DNA, 13 bp, Homo sapiens
ctgggctttggga

SEQ ID NO: 4843281 - DNA, 12 bp, Homo sapiens
ctggggagccct

SEQ ID NO: 4843282 - DNA, 22 bp, Homo sapiens
ctggggagccctattgctgcta

SEQ ID NO: 4843283 - DNA, 14 bp, Homo sapiens
ctggggcctcagcc

SEQ ID NO: 4843284 - DNA, 23 bp, Homo sapiens
ctggggcctccagaagctgctcc

SEQ ID NO: 4843285 - DNA, 24 bp, Homo sapiens
ctggggcctccagaagctgctcct

SEQ ID NO: 4843286 - DNA, 11 bp, Homo sapiens
ctggggctgca

SEQ ID NO: 4843287 - DNA, 20 bp, Homo sapiens
ctggggggcaggcctcccaa

SEQ ID NO: 4843288 - DNA, 22 bp, Homo sapiens
ctggggggcaggcctcccaagc

SEQ ID NO: 4843289 - DNA, 18 bp, Homo sapiens
ctgggggtggacatctga

SEQ ID NO: 4843290 - DNA, 13 bp, Homo sapiens
ctgggtccaggga

SEQ ID NO: 4843291 - DNA, 14 bp, Homo sapiens
ctgggtccagggag

SEQ ID NO: 4843292 - DNA, 15 bp, Homo sapiens
ctgggtccagggagg

SEQ ID NO: 4843293 - DNA, 14 bp, Homo sapiens
ctgggtgacatttg

SEQ ID NO: 4843294 - DNA, 13 bp, Homo sapiens
ctgggtgtttttt

SEQ ID NO: 4843295 - DNA, 16 bp, Homo sapiens
ctgggtttgggagcca

SEQ ID NO: 4843296 - DNA, 18 bp, Homo sapiens
ctgggtttgggagccagg

SEQ ID NO: 4843297 - DNA, 19 bp, Homo sapiens
ctgggtttgggagccagga

SEQ ID NO: 4843298 - DNA, 21 bp, Homo sapiens
ctgggtttgggagccaggact

SEQ ID NO: 4843299 - DNA, 21 bp, Homo sapiens
ctggtaataaatgtgactcag

SEQ ID NO: 4843300 - DNA, 19 bp, Homo sapiens
ctggtcctggccgtcccta

SEQ ID NO: 4843301 - DNA, 17 bp, Homo sapiens
ctggtgaacactgtgac

SEQ ID NO: 4843302 - DNA, 19 bp, Homo sapiens
ctggtgaacactgtgacca

SEQ ID NO: 4843303 - DNA, 16 bp, Homo sapiens
ctggtggcagagtcct

SEQ ID NO: 4843304 - DNA, 15 bp, Homo sapiens
ctggttacctggaga

SEQ ID NO: 4843305 - DNA, 13 bp, Homo sapiens
ctggttcctgtgt

SEQ ID NO: 4843306 - DNA, 19 bp, Homo sapiens
ctggttgctaatgacagcc

SEQ ID NO: 4843307 - DNA, 15 bp, Homo sapiens
ctggttgtctctctt

SEQ ID NO: 4843308 - DNA, 15 bp, Homo sapiens
ctgtaaaacaggtta

SEQ ID NO: 4843309 - DNA, 22 bp, Homo sapiens
ctgtaaagatgtttatttcagg

SEQ ID NO: 4843310 - DNA, 21 bp, Homo sapiens
ctgtaaggatccggaaagaag

SEQ ID NO: 4843311 - DNA, 16 bp, Homo sapiens
ctgtaatgctgcctca

SEQ ID NO: 4843312 - DNA, 15 bp, Homo sapiens
ctgtacaaaagcaat

SEQ ID NO: 4843313 - DNA, 15 bp, Homo sapiens
ctgtagagccaatta

SEQ ID NO: 4843314 - DNA, 21 bp, Homo sapiens
ctgtagcctatttttttagat

SEQ ID NO: 4843315 - DNA, 16 bp, Homo sapiens
ctgtatcattttcttt

SEQ ID NO: 4843316 - DNA, 12 bp, Homo sapiens
ctgtatttcctt

SEQ ID NO: 4843317 - DNA, 10 bp, Homo sapiens
ctgtcactgt

SEQ ID NO: 4843318 - DNA, 15 bp, Homo sapiens
ctgtcagtggggcag

SEQ ID NO: 4843319 - DNA, 19 bp, Homo sapiens
ctgtcagtggggcagcctc

SEQ ID NO: 4843320 - DNA, 22 bp, Homo sapiens
ctgtcagtggggcagcctctcc

SEQ ID NO: 4843321 - DNA, 15 bp, Homo sapiens
ctgtccctagggctc

SEQ ID NO: 4843322 - DNA, 24 bp, Homo sapiens
ctgtccctagggctctccaagcac

SEQ ID NO: 4843323 - DNA, 15 bp, Homo sapiens
ctgtccgtgcccctt

SEQ ID NO: 4843324 - DNA, 19 bp, Homo sapiens
ctgtccgtgccccttccct

SEQ ID NO: 4843325 - DNA, 21 bp, Homo sapiens
ctgtccgtgccccttccctgg

SEQ ID NO: 4843326 - DNA, 15 bp, Homo sapiens
ctgtcctattatatt

SEQ ID NO: 4843327 - DNA, 15 bp, Homo sapiens
ctgtccttcccccag

SEQ ID NO: 4843328 - DNA, 16 bp, Homo sapiens
ctgtccttcccccagc

SEQ ID NO: 4843329 - DNA, 17 bp, Homo sapiens
ctgtccttcccccagca

SEQ ID NO: 4843330 - DNA, 15 bp, Homo sapiens
ctgtctaacctgtga

SEQ ID NO: 4843331 - DNA, 16 bp, Homo sapiens
ctgtctaacctgtgac

SEQ ID NO: 4843332 - DNA, 17 bp, Homo sapiens
ctgtctaggtctcctca

SEQ ID NO: 4843333 - DNA, 21 bp, Homo sapiens
ctgtctaggtctcctcagggt

SEQ ID NO: 4843334 - DNA, 18 bp, Homo sapiens
ctgtctgagacaggtgcc

SEQ ID NO: 4843335 - DNA, 19 bp, Homo sapiens
ctgtctgagacaggtgcct

SEQ ID NO: 4843336 - DNA, 19 bp, Homo sapiens
ctgtcttctttctccatgg

SEQ ID NO: 4843337 - DNA, 20 bp, Homo sapiens
ctgtcttctttctccatgga

SEQ ID NO: 4843338 - DNA, 21 bp, Homo sapiens
ctgtcttctttctccatggag

SEQ ID NO: 4843339 - DNA, 23 bp, Homo sapiens
ctgtgagaacccagtttcccgtc

SEQ ID NO: 4843340 - DNA, 20 bp, Homo sapiens
ctgtgagcacaaagaagaaa

SEQ ID NO: 4843341 - DNA, 22 bp, Homo sapiens
ctgtgagcacaaagaagaaagc

SEQ ID NO: 4843342 - DNA, 21 bp, Homo sapiens
ctgtgagcatggggccaggaa

SEQ ID NO: 4843343 - DNA, 13 bp, Homo sapiens
ctgtgagccttgc

SEQ ID NO: 4843344 - DNA, 17 bp, Homo sapiens
ctgtgattactgcaatc

SEQ ID NO: 4843345 - DNA, 14 bp, Homo sapiens
ctgtgccttccctt

SEQ ID NO: 4843346 - DNA, 18 bp, Homo sapiens
ctgtgccttccctttcta

SEQ ID NO: 4843347 - DNA, 21 bp, Homo sapiens
ctgtgctatcggcagatgatg

SEQ ID NO: 4843348 - DNA, 15 bp, Homo sapiens
ctgtgctccacactc

SEQ ID NO: 4843349 - DNA, 19 bp, Homo sapiens
ctgtgctccacactcagaa

SEQ ID NO: 4843350 - DNA, 22 bp, Homo sapiens
ctgtgctgaacataacttctca

SEQ ID NO: 4843351 - DNA, 21 bp, Homo sapiens
ctgtgcttcgactactgctcc

SEQ ID NO: 4843352 - DNA, 15 bp, Homo sapiens
ctgtggagtgaggtg

SEQ ID NO: 4843353 - DNA, 16 bp, Homo sapiens
ctgtggcaggaggctt

SEQ ID NO: 4843354 - DNA, 18 bp, Homo sapiens
ctgtggcataaattgcat

SEQ ID NO: 4843355 - DNA, 13 bp, Homo sapiens
ctgtggcctgcag

SEQ ID NO: 4843356 - DNA, 16 bp, Homo sapiens
ctgtggcctgcaggag

SEQ ID NO: 4843357 - DNA, 18 bp, Homo sapiens
ctgtggctttcagcctct

SEQ ID NO: 4843358 - DNA, 16 bp, Homo sapiens
ctgtgggaaagagcct

SEQ ID NO: 4843359 - DNA, 17 bp, Homo sapiens
ctgtgggaaagagccta

SEQ ID NO: 4843360 - DNA, 14 bp, Homo sapiens
ctgtgggcaaagtc

SEQ ID NO: 4843361 - DNA, 15 bp, Homo sapiens
ctgtgggctgactgc

SEQ ID NO: 4843362 - DNA, 18 bp, Homo sapiens
ctgtgtcattagtccttt

SEQ ID NO: 4843363 - DNA, 19 bp, Homo sapiens
ctgtgtcattagtcctttg

SEQ ID NO: 4843364 - DNA, 19 bp, Homo sapiens
ctgtgtgaatacctgctca

SEQ ID NO: 4843365 - DNA, 22 bp, Homo sapiens
ctgtgttactaaaaaaaagatg

SEQ ID NO: 4843366 - DNA, 22 bp, Homo sapiens
ctgtgtttatatggaagaaagt

SEQ ID NO: 4843367 - DNA, 18 bp, Homo sapiens
ctgtgttttgaaagaata

SEQ ID NO: 4843368 - DNA, 15 bp, Homo sapiens
ctgttcccccaccct

SEQ ID NO: 4843369 - DNA, 14 bp, Homo sapiens
ctgttgataaaaac

SEQ ID NO: 4843370 - DNA, 12 bp, Homo sapiens
ctgttgcacttt

SEQ ID NO: 4843371 - DNA, 18 bp, Homo sapiens
ctgttgcacttttgaatg

SEQ ID NO: 4843372 - DNA, 18 bp, Homo sapiens
ctgttggttctgattagg

SEQ ID NO: 4843373 - DNA, 17 bp, Homo sapiens
ctgtttcctagctgtgt

SEQ ID NO: 4843374 - DNA, 11 bp, Homo sapiens
ctgtttggaaa

SEQ ID NO: 4843375 - DNA, 17 bp, Homo sapiens
ctgtttggaaaagacag

SEQ ID NO: 4843376 - DNA, 18 bp, Homo sapiens
ctgttttgtggtttggaa

SEQ ID NO: 4843377 - DNA, 22 bp, Homo sapiens
cttaaagggcccaatgaattat

SEQ ID NO: 4843378 - DNA, 22 bp, Homo sapiens
cttggctttgtcacttttcctt

SEQ ID NO: 4843379 - DNA, 21 bp, Homo sapiens
cttgggcttcaacagccaagc

SEQ ID NO: 4843380 - DNA, 16 bp, Homo sapiens
cttggggaaggggcct

SEQ ID NO: 4843381 - DNA, 20 bp, Homo sapiens
cttggggaaggggcctgggc

SEQ ID NO: 4843382 - DNA, 23 bp, Homo sapiens
cttggggaaggggcctgggctgt

SEQ ID NO: 4843383 - DNA, 13 bp, Homo sapiens
cttggggaggcaa

SEQ ID NO: 4843384 - DNA, 18 bp, Homo sapiens
cttggggtgtggggtggg

SEQ ID NO: 4843385 - DNA, 19 bp, Homo sapiens
cttggggtgtggggtgggg

SEQ ID NO: 4843386 - DNA, 16 bp, Homo sapiens
cttgggtcacatgact

SEQ ID NO: 4843387 - DNA, 18 bp, Homo sapiens
cttgggtcacatgactct

SEQ ID NO: 4843388 - DNA, 20 bp, Homo sapiens
cttgggtcacatgactctca

SEQ ID NO: 4843389 - DNA, 23 bp, Homo sapiens
cttggttgatgtttaaagagaag

SEQ ID NO: 4843390 - DNA, 21 bp, Homo sapiens
cttggtttgttatatcaggga

SEQ ID NO: 4843391 - DNA, 15 bp, Homo sapiens
cttgtacagtctgct

SEQ ID NO: 4843392 - DNA, 21 bp, Homo sapiens
cttgtacagtctgctcctctt

SEQ ID NO: 4843393 - DNA, 12 bp, Homo sapiens
cttgtataatat

SEQ ID NO: 4843394 - DNA, 15 bp, Homo sapiens
cttgtatccaggcct

SEQ ID NO: 4843395 - DNA, 17 bp, Homo sapiens
cttgtattatctccttt

SEQ ID NO: 4843396 - DNA, 22 bp, Homo sapiens
cttgtattatctcctttgaaga

SEQ ID NO: 4843397 - DNA, 15 bp, Homo sapiens
cttgtgagagcccat

SEQ ID NO: 4843398 - DNA, 18 bp, Homo sapiens
cttgtgggagacagcagc

SEQ ID NO: 4843399 - DNA, 20 bp, Homo sapiens
cttgtgggagacagcagcct

SEQ ID NO: 4843400 - DNA, 22 bp, Homo sapiens
cttgtgggagacagcagcctgt

SEQ ID NO: 4843401 - DNA, 14 bp, Homo sapiens
cttgtggtggggca

SEQ ID NO: 4843402 - DNA, 15 bp, Homo sapiens
cttgtggtggggcag

SEQ ID NO: 4843403 - DNA, 17 bp, Homo sapiens
cttgtgttcagaagaat

SEQ ID NO: 4843404 - DNA, 14 bp, Homo sapiens
cttgttcaggaaaa

SEQ ID NO: 4843405 - DNA, 13 bp, Homo sapiens
cttgttcctgaaa

SEQ ID NO: 4843406 - DNA, 23 bp, Homo sapiens
cttgttcctgaaatgtgtttcct

SEQ ID NO: 4843407 - DNA, 15 bp, Homo sapiens
cttgtttacctttct

SEQ ID NO: 4843408 - DNA, 22 bp, Homo sapiens
cttgtttacctttctctctcta

SEQ ID NO: 4843409 - DNA, 19 bp, Homo sapiens
cttgtttacgatttcacta

SEQ ID NO: 4843410 - DNA, 17 bp, Homo sapiens
cttgttttggatggctt

SEQ ID NO: 4843411 - DNA, 21 bp, Homo sapiens
cttgttttggatggcttgtct

SEQ ID NO: 4843412 - DNA, 17 bp, Homo sapiens
ctttaagccttcaaaac

SEQ ID NO: 4843413 - DNA, 20 bp, Homo sapiens
ctttaagccttcaaaactat

SEQ ID NO: 4843414 - DNA, 20 bp, Homo sapiens
ctttaagtgtgctgggcaga

SEQ ID NO: 4843415 - DNA, 17 bp, Homo sapiens
ctttacctgtgaagtgt

SEQ ID NO: 4843416 - DNA, 14 bp, Homo sapiens
ctttagaagcctgc

SEQ ID NO: 4843417 - DNA, 18 bp, Homo sapiens
ctttagcttacctgggca

SEQ ID NO: 4843418 - DNA, 14 bp, Homo sapiens
ctttattgaaattc

SEQ ID NO: 4843419 - DNA, 14 bp, Homo sapiens
ctttcacccatcct

SEQ ID NO: 4843420 - DNA, 22 bp, Homo sapiens
ctttcatggctgctgttgctta

SEQ ID NO: 4843421 - DNA, 22 bp, Homo sapiens
ctttcattaccctacagacagc

SEQ ID NO: 4843422 - DNA, 15 bp, Homo sapiens
ctttccaccatacct

SEQ ID NO: 4843423 - DNA, 13 bp, Homo sapiens
ctttcccctctca

SEQ ID NO: 4843424 - DNA, 14 bp, Homo sapiens
ctttcccctctcat

SEQ ID NO: 4843425 - DNA, 14 bp, Homo sapiens
ctttcctccaccca

SEQ ID NO: 4843426 - DNA, 14 bp, Homo sapiens
ctttcctggcagtc

SEQ ID NO: 4843427 - DNA, 15 bp, Homo sapiens
ctttctaagcaacca

SEQ ID NO: 4843428 - DNA, 22 bp, Homo sapiens
ctttctaagcaaccacactgct

SEQ ID NO: 4843429 - DNA, 19 bp, Homo sapiens
ctttctacaactgattgca

SEQ ID NO: 4843430 - DNA, 23 bp, Homo sapiens
ctttctatttttatgatgacaat

SEQ ID NO: 4843431 - DNA, 21 bp, Homo sapiens
ctttctccatggagcctacct

SEQ ID NO: 4843432 - DNA, 20 bp, Homo sapiens
ctttctgctctatactgtgg

SEQ ID NO: 4843433 - DNA, 17 bp, Homo sapiens
ctttcttcactctggct

SEQ ID NO: 4843434 - DNA, 23 bp, Homo sapiens
ctttgagtagatccatttccatt

SEQ ID NO: 4843435 - DNA, 22 bp, Homo sapiens
ctttgcaatactgcttaattgc

SEQ ID NO: 4843436 - DNA, 22 bp, Homo sapiens
ctttgcagttggactctcaggg

SEQ ID NO: 4843437 - DNA, 15 bp, Homo sapiens
ctttgcatattataa

SEQ ID NO: 4843438 - DNA, 16 bp, Homo sapiens
ctttgcccaggcatga

SEQ ID NO: 4843439 - DNA, 22 bp, Homo sapiens
ctttggaacagggttggcattc

SEQ ID NO: 4843440 - DNA, 21 bp, Homo sapiens
ctttggaagatgcagaagcaa

SEQ ID NO: 4843441 - DNA, 18 bp, Homo sapiens
ctttgggcctctcctgcc

SEQ ID NO: 4843442 - DNA, 18 bp, Homo sapiens
ctttggggctaatttaac

SEQ ID NO: 4843443 - DNA, 13 bp, Homo sapiens
ctttgtaaaaatc

SEQ ID NO: 4843444 - DNA, 16 bp, Homo sapiens
ctttgtaaaaatcttt

SEQ ID NO: 4843445 - DNA, 13 bp, Homo sapiens
ctttgtattttga

SEQ ID NO: 4843446 - DNA, 17 bp, Homo sapiens
ctttgtattttgattat

SEQ ID NO: 4843447 - DNA, 18 bp, Homo sapiens
ctttgtattttgattatt

SEQ ID NO: 4843448 - DNA, 23 bp, Homo sapiens
ctttgtcagtgttgcctcttgca

SEQ ID NO: 4843449 - DNA, 23 bp, Homo sapiens
ctttgtctaagtagggccagggc

SEQ ID NO: 4843450 - DNA, 24 bp, Homo sapiens
ctttgtctaagtagggccagggca

SEQ ID NO: 4843451 - DNA, 13 bp, Homo sapiens
ctttgtgaccaga

SEQ ID NO: 4843452 - DNA, 14 bp, Homo sapiens
ctttgttgtgagaa

SEQ ID NO: 4843453 - DNA, 22 bp, Homo sapiens
ctttgttgtgagaatggcctgg

SEQ ID NO: 4843454 - DNA, 18 bp, Homo sapiens
cttttaaagaccctccta

SEQ ID NO: 4843455 - DNA, 17 bp, Homo sapiens
cttttaatccatttcag

SEQ ID NO: 4843456 - DNA, 20 bp, Homo sapiens
cttttaccttttttttttct

SEQ ID NO: 4843457 - DNA, 11 bp, Homo sapiens
cttttcttatt

SEQ ID NO: 4843458 - DNA, 17 bp, Homo sapiens
cttttcttatttttgta

SEQ ID NO: 4843459 - DNA, 16 bp, Homo sapiens
cttttgaatgtccaaa

SEQ ID NO: 4843460 - DNA, 21 bp, Homo sapiens
cttttgctgaacaggaaagag

SEQ ID NO: 4843461 - DNA, 20 bp, Homo sapiens
cttttgcttgccaaagtaca

SEQ ID NO: 4843462 - DNA, 23 bp, Homo sapiens
cttttggcaatgactcaaagtct

SEQ ID NO: 4843463 - DNA, 17 bp, Homo sapiens
cttttggcagagaccat

SEQ ID NO: 4843464 - DNA, 17 bp, Homo sapiens
cttttgggggtcagcat

SEQ ID NO: 4843465 - DNA, 22 bp, Homo sapiens
cttttgtagatggcgatgtgtt

SEQ ID NO: 4843466 - DNA, 23 bp, Homo sapiens
cttttgtagatggcgatgtgtta

SEQ ID NO: 4843467 - DNA, 21 bp, Homo sapiens
cttttgtgtccctgaagtatt

SEQ ID NO: 4843468 - DNA, 12 bp, Homo sapiens
cttttgtttggt

SEQ ID NO: 4843469 - DNA, 21 bp, Homo sapiens
ctttttacctggcctagaaag

SEQ ID NO: 4843470 - DNA, 16 bp, Homo sapiens
ctttttattaaaatat

SEQ ID NO: 4843471 - DNA, 14 bp, Homo sapiens
ctttttgaaatgtc

SEQ ID NO: 4843472 - DNA, 18 bp, Homo sapiens
ctttttggaatctttgta

SEQ ID NO: 4843473 - DNA, 18 bp, Homo sapiens
ctttttgttgatgaggac

SEQ ID NO: 4843474 - DNA, 15 bp, Homo sapiens
gaaaaaaaaaaaagc

SEQ ID NO: 4843475 - DNA, 22 bp, Homo sapiens
gaaaacagcgaacagccttaga

SEQ ID NO: 4843476 - DNA, 14 bp, Homo sapiens
gaaaacatgttaat

SEQ ID NO: 4843477 - DNA, 15 bp, Homo sapiens
gaaaaggcaggtgct

SEQ ID NO: 4843478 - DNA, 16 bp, Homo sapiens
gaaaaggttgaataat

SEQ ID NO: 4843479 - DNA, 14 bp, Homo sapiens
gaaaagtcttccta

SEQ ID NO: 4843480 - DNA, 18 bp, Homo sapiens
gaaaataactgaatttgg

SEQ ID NO: 4843481 - DNA, 15 bp, Homo sapiens
gaaaataatttctct

SEQ ID NO: 4843482 - DNA, 13 bp, Homo sapiens
gaaaatgaaagct

SEQ ID NO: 4843483 - DNA, 17 bp, Homo sapiens
gaaaatgtctgtaataa

SEQ ID NO: 4843484 - DNA, 17 bp, Homo sapiens
gaaaattaaggaaatgt

SEQ ID NO: 4843485 - DNA, 13 bp, Homo sapiens
gaaaattccctgg

SEQ ID NO: 4843486 - DNA, 16 bp, Homo sapiens
gaaaattcttaaaagg

SEQ ID NO: 4843487 - DNA, 15 bp, Homo sapiens
gaaaatttgccaatc

SEQ ID NO: 4843488 - DNA, 20 bp, Homo sapiens
gaaacaaataatttgaactt

SEQ ID NO: 4843489 - DNA, 16 bp, Homo sapiens
gaaacactgaaaagaa

SEQ ID NO: 4843490 - DNA, 13 bp, Homo sapiens
gaaacactgactt

SEQ ID NO: 4843491 - DNA, 23 bp, Homo sapiens
gaaacccagagatgcctgatttc

SEQ ID NO: 4843492 - DNA, 22 bp, Homo sapiens
gaaacctgccaaggagcatcct

SEQ ID NO: 4843493 - DNA, 17 bp, Homo sapiens
gaaactgaggcccagag

SEQ ID NO: 4843494 - DNA, 20 bp, Homo sapiens
gaaactgaggcccagagagg

SEQ ID NO: 4843495 - DNA, 23 bp, Homo sapiens
gaaactgaggcccagagagggaa

SEQ ID NO: 4843496 - DNA, 13 bp, Homo sapiens
gaaacttctcagt

SEQ ID NO: 4843497 - DNA, 15 bp, Homo sapiens
gacgaagggttggac

SEQ ID NO: 4843498 - DNA, 20 bp, Homo sapiens
gacgaggccaagctgaggag

SEQ ID NO: 4843499 - DNA, 21 bp, Homo sapiens
gacgggatgacctccagaagt

SEQ ID NO: 4843500 - DNA, 22 bp, Homo sapiens
gacgggatgacctccagaagtc

SEQ ID NO: 4843501 - DNA, 17 bp, Homo sapiens
gacggtgctcactccca

SEQ ID NO: 4843502 - DNA, 17 bp, Homo sapiens
gacgtctggggtgtggg

SEQ ID NO: 4843503 - DNA, 21 bp, Homo sapiens
gacgtgatgggctaggcctcc

SEQ ID NO: 4843504 - DNA, 14 bp, Homo sapiens
gacgttaggccagg

SEQ ID NO: 4843505 - DNA, 15 bp, Homo sapiens
gacgttaggccaggc

SEQ ID NO: 4843506 - DNA, 19 bp, Homo sapiens
gacgttaggccaggcctta

SEQ ID NO: 4843507 - DNA, 23 bp, Homo sapiens
gacgtttataaacagaaatggaa

SEQ ID NO: 4843508 - DNA, 18 bp, Homo sapiens
gactaaatgatctctgaa

SEQ ID NO: 4843509 - DNA, 16 bp, Homo sapiens
gactaactcaaataca

SEQ ID NO: 4843510 - DNA, 17 bp, Homo sapiens
gactactgctcctgtgg

SEQ ID NO: 4843511 - DNA, 20 bp, Homo sapiens
gactactgctcctgtggcag

SEQ ID NO: 4843512 - DNA, 20 bp, Homo sapiens
gactatgcgtggctggaacc

SEQ ID NO: 4843513 - DNA, 15 bp, Homo sapiens
gactcagtgaccagt

SEQ ID NO: 4843514 - DNA, 17 bp, Homo sapiens
gactccaaagctgttcc

SEQ ID NO: 4843515 - DNA, 16 bp, Homo sapiens
gactccaagccctggg

SEQ ID NO: 4843516 - DNA, 17 bp, Homo sapiens
gactccaagccctgggg

SEQ ID NO: 4843517 - DNA, 23 bp, Homo sapiens
gactccaagccctggggcagggt

SEQ ID NO: 4843518 - DNA, 12 bp, Homo sapiens
gactccagggtg

SEQ ID NO: 4843519 - DNA, 14 bp, Homo sapiens
gactcccagaacct

SEQ ID NO: 4843520 - DNA, 19 bp, Homo sapiens
gactccttatctctttcca

SEQ ID NO: 4843521 - DNA, 22 bp, Homo sapiens
gactccttatctctttccacca

SEQ ID NO: 4843522 - DNA, 14 bp, Homo sapiens
gactctagtattta

SEQ ID NO: 4843523 - DNA, 16 bp, Homo sapiens
gactctctccaggagg

SEQ ID NO: 4843524 - DNA, 23 bp, Homo sapiens
gactctgacctcttggccacaga

SEQ ID NO: 4843525 - DNA, 22 bp, Homo sapiens
gactctgggggtggacatctga

SEQ ID NO: 4843526 - DNA, 21 bp, Homo sapiens
gactcttagccctcaccacag

SEQ ID NO: 4843527 - DNA, 14 bp, Homo sapiens
gactgatttcagag

SEQ ID NO: 4843528 - DNA, 18 bp, Homo sapiens
gactgcatggggaggcag

SEQ ID NO: 4843529 - DNA, 19 bp, Homo sapiens
gactgcatggggaggcagc

SEQ ID NO: 4843530 - DNA, 21 bp, Homo sapiens
gactgcatggggaggcagcag

SEQ ID NO: 4843531 - DNA, 22 bp, Homo sapiens
gactgcatggggaggcagcaga

SEQ ID NO: 4843532 - DNA, 12 bp, Homo sapiens
gactgcatttgt

SEQ ID NO: 4843533 - DNA, 13 bp, Homo sapiens
gactgctcctggg

SEQ ID NO: 4843534 - DNA, 14 bp, Homo sapiens
gactgctcctgggc

SEQ ID NO: 4843535 - DNA, 20 bp, Homo sapiens
gactggatttgcagaagttt

SEQ ID NO: 4843536 - DNA, 17 bp, Homo sapiens
gactgggagccacttct

SEQ ID NO: 4843537 - DNA, 22 bp, Homo sapiens
gactgggagccacttctcccca

SEQ ID NO: 4843538 - DNA, 20 bp, Homo sapiens
gacttggagaatactgccaa

SEQ ID NO: 4843539 - DNA, 23 bp, Homo sapiens
gacttgtatagcatgaaataaaa

SEQ ID NO: 4843540 - DNA, 19 bp, Homo sapiens
gacttgtatattttaagaa

SEQ ID NO: 4843541 - DNA, 12 bp, Homo sapiens
gactttgatcca

SEQ ID NO: 4843542 - DNA, 21 bp, Homo sapiens
gacttttataacattttgaga

SEQ ID NO: 4843543 - DNA, 19 bp, Homo sapiens
gagaaacactatttgtgac

SEQ ID NO: 4843544 - DNA, 19 bp, Homo sapiens
gagaaacactgaaaagaag

SEQ ID NO: 4843545 - DNA, 12 bp, Homo sapiens
gagaaacccaga

SEQ ID NO: 4843546 - DNA, 13 bp, Homo sapiens
gagaaacctgcca

SEQ ID NO: 4843547 - DNA, 18 bp, Homo sapiens
gagaaagcacaatttaaa

SEQ ID NO: 4843548 - DNA, 14 bp, Homo sapiens
gagaacctgtgggc

SEQ ID NO: 4843549 - DNA, 19 bp, Homo sapiens
gagaacctgtgggctgact

SEQ ID NO: 4843550 - DNA, 23 bp, Homo sapiens
gagaagccagtgtctaggcactg

SEQ ID NO: 4843551 - DNA, 24 bp, Homo sapiens
gagaagccagtgtctaggcactga

SEQ ID NO: 4843552 - DNA, 22 bp, Homo sapiens
gagaatactgccaaaacattta

SEQ ID NO: 4843553 - DNA, 19 bp, Homo sapiens
gagaatgggacgaggacat

SEQ ID NO: 4843554 - DNA, 19 bp, Homo sapiens
gagaattgaggggaggtgg

SEQ ID NO: 4843555 - DNA, 21 bp, Homo sapiens
gagacattttccgcccactcc

SEQ ID NO: 4843556 - DNA, 15 bp, Homo sapiens
gagaccataagagaa

SEQ ID NO: 4843557 - DNA, 14 bp, Homo sapiens
gatagtaagcatag

SEQ ID NO: 4843558 - DNA, 23 bp, Homo sapiens
gatagtcttggaagctgtttgga

SEQ ID NO: 4843559 - DNA, 18 bp, Homo sapiens
gatatacaaagtgtacca

SEQ ID NO: 4843560 - DNA, 15 bp, Homo sapiens
gatattcagatgtat

SEQ ID NO: 4843561 - DNA, 16 bp, Homo sapiens
gatattgaatgttaaa

SEQ ID NO: 4843562 - DNA, 16 bp, Homo sapiens
gatcaaatagttgcat

SEQ ID NO: 4843563 - DNA, 16 bp, Homo sapiens
gatcagagttcctcct

SEQ ID NO: 4843564 - DNA, 19 bp, Homo sapiens
gatcatatggtaggaccct

SEQ ID NO: 4843565 - DNA, 21 bp, Homo sapiens
gatccagcccaaacctgggaa

SEQ ID NO: 4843566 - DNA, 18 bp, Homo sapiens
gatccagggcagcaggcc

SEQ ID NO: 4843567 - DNA, 23 bp, Homo sapiens
gatccatttccattgcttattat

SEQ ID NO: 4843568 - DNA, 15 bp, Homo sapiens
gatcctgggtttcca

SEQ ID NO: 4843569 - DNA, 22 bp, Homo sapiens
gatcgagtgtagctgtgaaatc

SEQ ID NO: 4843570 - DNA, 21 bp, Homo sapiens
gatctttatatttcaataaat

SEQ ID NO: 4843571 - DNA, 12 bp, Homo sapiens
gatctttcagaa

SEQ ID NO: 4843572 - DNA, 22 bp, Homo sapiens
gatgaatgtcagttgttattta

SEQ ID NO: 4843573 - DNA, 19 bp, Homo sapiens
gatgaattgtcacatctat

SEQ ID NO: 4843574 - DNA, 17 bp, Homo sapiens
gatgacctccagaagtc

SEQ ID NO: 4843575 - DNA, 18 bp, Homo sapiens
gatgagagaatgtggaaa

SEQ ID NO: 4843576 - DNA, 20 bp, Homo sapiens
gatgagccttgcagatatct

SEQ ID NO: 4843577 - DNA, 21 bp, Homo sapiens
gatgaggacccagagctgctg

SEQ ID NO: 4843578 - DNA, 22 bp, Homo sapiens
gatgaggagtaaaattcagttt

SEQ ID NO: 4843579 - DNA, 18 bp, Homo sapiens
gatgaggcaaacagcaag

SEQ ID NO: 4843580 - DNA, 20 bp, Homo sapiens
gatgataaaggaaataggat

SEQ ID NO: 4843581 - DNA, 13 bp, Homo sapiens
gatgatgagggaa

SEQ ID NO: 4843582 - DNA, 14 bp, Homo sapiens
gatgatgagggaag

SEQ ID NO: 4843583 - DNA, 14 bp, Homo sapiens
gatgcatttaataa

SEQ ID NO: 4843584 - DNA, 16 bp, Homo sapiens
gatgcatttaataaag

SEQ ID NO: 4843585 - DNA, 18 bp, Homo sapiens
gatgcatttaataaagat

SEQ ID NO: 4843586 - DNA, 13 bp, Homo sapiens
gatgcccctgaca

SEQ ID NO: 4843587 - DNA, 20 bp, Homo sapiens
gatggacatgagagtagggc

SEQ ID NO: 4843588 - DNA, 20 bp, Homo sapiens
gatggagtgtgcagacagcc

SEQ ID NO: 4843589 - DNA, 15 bp, Homo sapiens
gatggcttgtctata

SEQ ID NO: 4843590 - DNA, 15 bp, Homo sapiens
gatgggctaggcctc

SEQ ID NO: 4843591 - DNA, 16 bp, Homo sapiens
gatgggggaactgtga

SEQ ID NO: 4843592 - DNA, 17 bp, Homo sapiens
gatggggtgagaagtac

SEQ ID NO: 4843593 - DNA, 15 bp, Homo sapiens
gatggtaagagaaaa

SEQ ID NO: 4843594 - DNA, 18 bp, Homo sapiens
gatggtaagagaaaagag

SEQ ID NO: 4843595 - DNA, 22 bp, Homo sapiens
gatggtaagagaaaagagagaa

SEQ ID NO: 4843596 - DNA, 22 bp, Homo sapiens
gatgtcagctgctgttgaactt

SEQ ID NO: 4843597 - DNA, 23 bp, Homo sapiens
gatgtctttttattaaaatattt

SEQ ID NO: 4843598 - DNA, 20 bp, Homo sapiens
gatgtgttattacttcctca

SEQ ID NO: 4843599 - DNA, 14 bp, Homo sapiens
gatgtgttcttatt

SEQ ID NO: 4843600 - DNA, 23 bp, Homo sapiens
gattactctccatatcccttcct

SEQ ID NO: 4843601 - DNA, 15 bp, Homo sapiens
gattagaaattacct

SEQ ID NO: 4843602 - DNA, 20 bp, Homo sapiens
gattagaaattacctgtgga

SEQ ID NO: 4843603 - DNA, 13 bp, Homo sapiens
gattaggtaacgt

SEQ ID NO: 4843604 - DNA, 20 bp, Homo sapiens
gattaggtttcagcagagct

SEQ ID NO: 4843605 - DNA, 12 bp, Homo sapiens
gattcagagaaa

SEQ ID NO: 4843606 - DNA, 12 bp, Homo sapiens
gattcatattta

SEQ ID NO: 4843607 - DNA, 13 bp, Homo sapiens
gattctaaataca

SEQ ID NO: 4843608 - DNA, 14 bp, Homo sapiens
gattctaaatacat

SEQ ID NO: 4843609 - DNA, 17 bp, Homo sapiens
gattctatgttaatatt

SEQ ID NO: 4843610 - DNA, 16 bp, Homo sapiens
gattctggctttaagc

SEQ ID NO: 4843611 - DNA, 14 bp, Homo sapiens
gattgcctctgaaa

SEQ ID NO: 4843612 - DNA, 17 bp, Homo sapiens
gattgctctggagcagc

SEQ ID NO: 4843613 - DNA, 18 bp, Homo sapiens
gattgtgcctaatgtgtt

SEQ ID NO: 4843614 - DNA, 21 bp, Homo sapiens
gatttcactaggactcagaaa

SEQ ID NO: 4843615 - DNA, 20 bp, Homo sapiens
gatttccctccagagaaagc

SEQ ID NO: 4843616 - DNA, 22 bp, Homo sapiens
gatttctcaccctctgtccttc

SEQ ID NO: 4843617 - DNA, 15 bp, Homo sapiens
gcaaaaattatatat

SEQ ID NO: 4843618 - DNA, 18 bp, Homo sapiens
gcaaaactccaggcagga

SEQ ID NO: 4843619 - DNA, 23 bp, Homo sapiens
gcaaagaaaaaaaaaaaagccag

SEQ ID NO: 4843620 - DNA, 17 bp, Homo sapiens
gcaaaggtgcactccag

SEQ ID NO: 4843621 - DNA, 21 bp, Homo sapiens
gcaaagtcgccagtcactgct

SEQ ID NO: 4843622 - DNA, 17 bp, Homo sapiens
gcaaagtgacaaagcaa

SEQ ID NO: 4843623 - DNA, 21 bp, Homo sapiens
gcaaatagattcagagaaatt

SEQ ID NO: 4843624 - DNA, 22 bp, Homo sapiens
gcaaatagattcagagaaattt

SEQ ID NO: 4843625 - DNA, 23 bp, Homo sapiens
gcaaatgttaaaagttttatatg

SEQ ID NO: 4843626 - DNA, 16 bp, Homo sapiens
gcaacatctctgaatc

SEQ ID NO: 4843627 - DNA, 17 bp, Homo sapiens
gcaacatctctgaatcc

SEQ ID NO: 4843628 - DNA, 12 bp, Homo sapiens
gcaagagcccag

SEQ ID NO: 4843629 - DNA, 19 bp, Homo sapiens
gcaagaggcaagctgaaat

SEQ ID NO: 4843630 - DNA, 19 bp, Homo sapiens
gcaagcaccaacctccaga

SEQ ID NO: 4843631 - DNA, 21 bp, Homo sapiens
gcaagcaccaacctccagact

SEQ ID NO: 4843632 - DNA, 14 bp, Homo sapiens
gcaagcagatgaca

SEQ ID NO: 4843633 - DNA, 17 bp, Homo sapiens
gcaagctgaaattttag

SEQ ID NO: 4843634 - DNA, 14 bp, Homo sapiens
gcaaggcagagcct

SEQ ID NO: 4843635 - DNA, 17 bp, Homo sapiens
gcaaggggtgaggatag

SEQ ID NO: 4843636 - DNA, 11 bp, Homo sapiens
gcaaggtggcc

SEQ ID NO: 4843637 - DNA, 17 bp, Homo sapiens
gcaagtgagcagagatg

SEQ ID NO: 4843638 - DNA, 13 bp, Homo sapiens
gcaataaaattta

SEQ ID NO: 4843639 - DNA, 19 bp, Homo sapiens
gcaataaaatttaaaaaat

SEQ ID NO: 4843640 - DNA, 15 bp, Homo sapiens
gcaataataaagtac

SEQ ID NO: 4843641 - DNA, 13 bp, Homo sapiens
gcaattcagtgtt

SEQ ID NO: 4843642 - DNA, 21 bp, Homo sapiens
gcaatttactgatgagagaat

SEQ ID NO: 4843643 - DNA, 23 bp, Homo sapiens
gcaatttactgatgagagaatgt

SEQ ID NO: 4843644 - DNA, 15 bp, Homo sapiens
gcacaaacagaattt

SEQ ID NO: 4843645 - DNA, 20 bp, Homo sapiens
gcacaaacagaattttccat

SEQ ID NO: 4843646 - DNA, 14 bp, Homo sapiens
gcacaaagaagaaa

SEQ ID NO: 4843647 - DNA, 16 bp, Homo sapiens
gcacaaagaagaaagc

SEQ ID NO: 4843648 - DNA, 17 bp, Homo sapiens
gcacaagactggcccag

SEQ ID NO: 4843649 - DNA, 19 bp, Homo sapiens
gcacaagactggcccagtg

SEQ ID NO: 4843650 - DNA, 20 bp, Homo sapiens
gcacaagactggcccagtgc

SEQ ID NO: 4843651 - DNA, 21 bp, Homo sapiens
gcacaatgttggagcagcagg

SEQ ID NO: 4843652 - DNA, 14 bp, Homo sapiens
gcacagcatgaggc

SEQ ID NO: 4843653 - DNA, 14 bp, Homo sapiens
gcacagccttctcc

SEQ ID NO: 4843654 - DNA, 14 bp, Homo sapiens
gcacattaactgtt

SEQ ID NO: 4843655 - DNA, 14 bp, Homo sapiens
gcaccaacctccag

SEQ ID NO: 4843656 - DNA, 19 bp, Homo sapiens
gcaccaacctccagactca

SEQ ID NO: 4843657 - DNA, 14 bp, Homo sapiens
gcaccaggggccaa

SEQ ID NO: 4843658 - DNA, 20 bp, Homo sapiens
gcacccaccagttgctgctg

SEQ ID NO: 4843659 - DNA, 21 bp, Homo sapiens
gcactaaaatgaggatccagg

SEQ ID NO: 4843660 - DNA, 22 bp, Homo sapiens
gcactaaaatgaggatccaggg

SEQ ID NO: 4843661 - DNA, 13 bp, Homo sapiens
gcactctcagagt

SEQ ID NO: 4843662 - DNA, 12 bp, Homo sapiens
gcactgagcagg

SEQ ID NO: 4843663 - DNA, 16 bp, Homo sapiens
gcactgagcagggatc

SEQ ID NO: 4843664 - DNA, 11 bp, Homo sapiens
gcactggcctt

SEQ ID NO: 4843665 - DNA, 18 bp, Homo sapiens
gcacttattgaatatatg

SEQ ID NO: 4843666 - DNA, 23 bp, Homo sapiens
gcacttattgaccattttttaat

SEQ ID NO: 4843667 - DNA, 18 bp, Homo sapiens
gcagaaaccctgagcaga

SEQ ID NO: 4843668 - DNA, 19 bp, Homo sapiens
gcagaaatatagtgcaata

SEQ ID NO: 4843669 - DNA, 19 bp, Homo sapiens
gcagacagccatgcgtggc

SEQ ID NO: 4843670 - DNA, 15 bp, Homo sapiens
gcagacctggagctt

SEQ ID NO: 4843671 - DNA, 20 bp, Homo sapiens
gcagagaaatgccccagtgt

SEQ ID NO: 4843672 - DNA, 16 bp, Homo sapiens
gcagagatgtactgca

SEQ ID NO: 4843673 - DNA, 19 bp, Homo sapiens
gcagagcctttttacctgg

SEQ ID NO: 4843674 - DNA, 23 bp, Homo sapiens
gcagagcttgtggtggggcagga

SEQ ID NO: 4843675 - DNA, 13 bp, Homo sapiens
gcagaggtggggt

SEQ ID NO: 4843676 - DNA, 14 bp, Homo sapiens
gcagagttttcatt

SEQ ID NO: 4843677 - DNA, 18 bp, Homo sapiens
gccagtcactgctgcaag

SEQ ID NO: 4843678 - DNA, 19 bp, Homo sapiens
gccagtggtggaggtgggt

SEQ ID NO: 4843679 - DNA, 11 bp, Homo sapiens
gccagtgtcta

SEQ ID NO: 4843680 - DNA, 16 bp, Homo sapiens
gccatagatgctggct

SEQ ID NO: 4843681 - DNA, 18 bp, Homo sapiens
gccatagatgctggctgg

SEQ ID NO: 4843682 - DNA, 14 bp, Homo sapiens
gccatcttctttct

SEQ ID NO: 4843683 - DNA, 11 bp, Homo sapiens
gccatgaatta

SEQ ID NO: 4843684 - DNA, 14 bp, Homo sapiens
gccatgccaataaa

SEQ ID NO: 4843685 - DNA, 14 bp, Homo sapiens
gccatgttcccaga

SEQ ID NO: 4843686 - DNA, 21 bp, Homo sapiens
gccattttggggggttattta

SEQ ID NO: 4843687 - DNA, 13 bp, Homo sapiens
gcccaaacctggg

SEQ ID NO: 4843688 - DNA, 22 bp, Homo sapiens
gcccaacctacattccaccctg

SEQ ID NO: 4843689 - DNA, 20 bp, Homo sapiens
gcccaagcagacagccctgg

SEQ ID NO: 4843690 - DNA, 19 bp, Homo sapiens
gcccacaactcccttgcac

SEQ ID NO: 4843691 - DNA, 14 bp, Homo sapiens
gcccactcctggga

SEQ ID NO: 4843692 - DNA, 14 bp, Homo sapiens
gcccagactacagg

SEQ ID NO: 4843693 - DNA, 21 bp, Homo sapiens
gcccaggcagacaaccttgtc

SEQ ID NO: 4843694 - DNA, 23 bp, Homo sapiens
gcccaggggctgtggccgtctcc

SEQ ID NO: 4843695 - DNA, 21 bp, Homo sapiens
gcccagtgccagcaagtcctt

SEQ ID NO: 4843696 - DNA, 13 bp, Homo sapiens
gcccattcccacc

SEQ ID NO: 4843697 - DNA, 14 bp, Homo sapiens
gcccccattcccag

SEQ ID NO: 4843698 - DNA, 20 bp, Homo sapiens
gcccccattcccagcctgac

SEQ ID NO: 4843699 - DNA, 13 bp, Homo sapiens
gccccccctatct

SEQ ID NO: 4843700 - DNA, 17 bp, Homo sapiens
gccccccctatctcttc

SEQ ID NO: 4843701 - DNA, 21 bp, Homo sapiens
gccccccctatctcttcctgt

SEQ ID NO: 4843702 - DNA, 18 bp, Homo sapiens
gccccccgcgcgcccacc

SEQ ID NO: 4843703 - DNA, 12 bp, Homo sapiens
gccccctgccct

SEQ ID NO: 4843704 - DNA, 17 bp, Homo sapiens
gcccccttcaggagcct

SEQ ID NO: 4843705 - DNA, 14 bp, Homo sapiens
gccccgcccctccc

SEQ ID NO: 4843706 - DNA, 20 bp, Homo sapiens
gcccctactgtgggcaaagt

SEQ ID NO: 4843707 - DNA, 21 bp, Homo sapiens
gcccctgcgtgggggccagtc

SEQ ID NO: 4843708 - DNA, 22 bp, Homo sapiens
gcccgcagaggtggggtgctgg

SEQ ID NO: 4843709 - DNA, 18 bp, Homo sapiens
gcccgcctaagaccctga

SEQ ID NO: 4843710 - DNA, 19 bp, Homo sapiens
gcccgggagctgctgccct

SEQ ID NO: 4843711 - DNA, 13 bp, Homo sapiens
gccctcaccacag

SEQ ID NO: 4843712 - DNA, 17 bp, Homo sapiens
gccctcctgagggccgg

SEQ ID NO: 4843713 - DNA, 16 bp, Homo sapiens
gccctctgaaataatg

SEQ ID NO: 4843714 - DNA, 14 bp, Homo sapiens
gccctctgctctgc

SEQ ID NO: 4843715 - DNA, 17 bp, Homo sapiens
gccctctgctctgcctg

SEQ ID NO: 4843716 - DNA, 16 bp, Homo sapiens
gccctgaaatggcctg

SEQ ID NO: 4843717 - DNA, 17 bp, Homo sapiens
gccctgaaatggcctgt

SEQ ID NO: 4843718 - DNA, 16 bp, Homo sapiens
gccctgccagctgcag

SEQ ID NO: 4843719 - DNA, 14 bp, Homo sapiens
gccctggagctcag

SEQ ID NO: 4843720 - DNA, 17 bp, Homo sapiens
gccctgtcactgtccag

SEQ ID NO: 4843721 - DNA, 21 bp, Homo sapiens
gcccttcctcctgatggagtg

SEQ ID NO: 4843722 - DNA, 16 bp, Homo sapiens
gccctttcctggcagt

SEQ ID NO: 4843723 - DNA, 12 bp, Homo sapiens
gccgcagacctg

SEQ ID NO: 4843724 - DNA, 16 bp, Homo sapiens
gccgcagacctggagc

SEQ ID NO: 4843725 - DNA, 17 bp, Homo sapiens
gccgggggaggggcgcg

SEQ ID NO: 4843726 - DNA, 14 bp, Homo sapiens
gccgtctcctccct

SEQ ID NO: 4843727 - DNA, 17 bp, Homo sapiens
gccgtctcctccctcag

SEQ ID NO: 4843728 - DNA, 13 bp, Homo sapiens
gcctaacctggga

SEQ ID NO: 4843729 - DNA, 21 bp, Homo sapiens
gcctaagaagaaggccagaga

SEQ ID NO: 4843730 - DNA, 12 bp, Homo sapiens
gcctaagaccct

SEQ ID NO: 4843731 - DNA, 17 bp, Homo sapiens
gcctaagaccctgaatc

SEQ ID NO: 4843732 - DNA, 14 bp, Homo sapiens
gcctacctctgtct

SEQ ID NO: 4843733 - DNA, 22 bp, Homo sapiens
gcctacctctgtctgagacagg

SEQ ID NO: 4843734 - DNA, 23 bp, Homo sapiens
gcctacctctgtctgagacaggt

SEQ ID NO: 4843735 - DNA, 16 bp, Homo sapiens
gcctagaaagggcaag

SEQ ID NO: 4843736 - DNA, 18 bp, Homo sapiens
gcctagcctatgtctggc

SEQ ID NO: 4843737 - DNA, 20 bp, Homo sapiens
gcctagcctatgtctggcag

SEQ ID NO: 4843738 - DNA, 12 bp, Homo sapiens
gcctatttcccc

SEQ ID NO: 4843739 - DNA, 16 bp, Homo sapiens
gcctcaagtcactccc

SEQ ID NO: 4843740 - DNA, 18 bp, Homo sapiens
gcctcaagtcactcccaa

SEQ ID NO: 4843741 - DNA, 12 bp, Homo sapiens
gcctcaggaccc

SEQ ID NO: 4843742 - DNA, 13 bp, Homo sapiens
gcctcaggaccca

SEQ ID NO: 4843743 - DNA, 20 bp, Homo sapiens
gcctcaggacccatccctgc

SEQ ID NO: 4843744 - DNA, 23 bp, Homo sapiens
gcctcaggacccatccctgcctg

SEQ ID NO: 4843745 - DNA, 12 bp, Homo sapiens
gcctcaggctcc

SEQ ID NO: 4843746 - DNA, 16 bp, Homo sapiens
gcctcattttgcttcc

SEQ ID NO: 4843747 - DNA, 19 bp, Homo sapiens
gcctcattttgcttcccat

SEQ ID NO: 4843748 - DNA, 13 bp, Homo sapiens
gcctccaagcctg

SEQ ID NO: 4843749 - DNA, 17 bp, Homo sapiens
gcctccaagcctgcctc

SEQ ID NO: 4843750 - DNA, 20 bp, Homo sapiens
gcctccagaagctgctcctt

SEQ ID NO: 4843751 - DNA, 21 bp, Homo sapiens
gcctccagaagctgctccttt

SEQ ID NO: 4843752 - DNA, 20 bp, Homo sapiens
gcctccaggaccttgcttcc

SEQ ID NO: 4843753 - DNA, 21 bp, Homo sapiens
gcctccaggaccttgcttcct

SEQ ID NO: 4843754 - DNA, 13 bp, Homo sapiens
gcctcccctgggc

SEQ ID NO: 4843755 - DNA, 17 bp, Homo sapiens
gcctcgacctccccacc

SEQ ID NO: 4843756 - DNA, 18 bp, Homo sapiens
gcctctcctgccctctgc

SEQ ID NO: 4843757 - DNA, 14 bp, Homo sapiens
gcctctctggaaga

SEQ ID NO: 4843758 - DNA, 16 bp, Homo sapiens
gcctctgaaaagtgtg

SEQ ID NO: 4843759 - DNA, 13 bp, Homo sapiens
gcctctgcctggg

SEQ ID NO: 4843760 - DNA, 17 bp, Homo sapiens
gcctctgcctggggcct

SEQ ID NO: 4843761 - DNA, 20 bp, Homo sapiens
gcctctgcctggggcctcca

SEQ ID NO: 4843762 - DNA, 17 bp, Homo sapiens
gcctctggactggaaag

SEQ ID NO: 4843763 - DNA, 12 bp, Homo sapiens
gcctctgggacc

SEQ ID NO: 4843764 - DNA, 14 bp, Homo sapiens
gcctctgggaccca

SEQ ID NO: 4843765 - DNA, 15 bp, Homo sapiens
gcctctgggacccac

SEQ ID NO: 4843766 - DNA, 23 bp, Homo sapiens
gcctctgtccgtgccccttccct

SEQ ID NO: 4843767 - DNA, 19 bp, Homo sapiens
gcctgactagaactcctgt

SEQ ID NO: 4843768 - DNA, 22 bp, Homo sapiens
gcctgagaattgaggggaggtg

SEQ ID NO: 4843769 - DNA, 23 bp, Homo sapiens
gcctgagaattgaggggaggtgg

SEQ ID NO: 4843770 - DNA, 14 bp, Homo sapiens
gcctgcaggagggt

SEQ ID NO: 4843771 - DNA, 17 bp, Homo sapiens
gcctgctaaggctcctc

SEQ ID NO: 4843772 - DNA, 14 bp, Homo sapiens
gcctgcttcccaca

SEQ ID NO: 4843773 - DNA, 15 bp, Homo sapiens
gcctgctttcctgca

SEQ ID NO: 4843774 - DNA, 16 bp, Homo sapiens
gcctggagcaggccca

SEQ ID NO: 4843775 - DNA, 15 bp, Homo sapiens
gcctggagtgtcgga

SEQ ID NO: 4843776 - DNA, 14 bp, Homo sapiens
gcctggccaggcag

SEQ ID NO: 4843777 - DNA, 17 bp, Homo sapiens
gcctgggctcagcctgg

SEQ ID NO: 4843778 - DNA, 16 bp, Homo sapiens
gcctgggctgtgagga

SEQ ID NO: 4843779 - DNA, 13 bp, Homo sapiens
gcctgtccctagg

SEQ ID NO: 4843780 - DNA, 21 bp, Homo sapiens
gcctgtgagcatggggccagg

SEQ ID NO: 4843781 - DNA, 11 bp, Homo sapiens
gcctgttcctt

SEQ ID NO: 4843782 - DNA, 14 bp, Homo sapiens
gccttagagctctt

SEQ ID NO: 4843783 - DNA, 19 bp, Homo sapiens
gccttatctgaaaggccag

SEQ ID NO: 4843784 - DNA, 22 bp, Homo sapiens
gccttatctgaaaggccagcag

SEQ ID NO: 4843785 - DNA, 19 bp, Homo sapiens
gccttcaaaactatagctt

SEQ ID NO: 4843786 - DNA, 22 bp, Homo sapiens
gccttcaaaactatagcttgca

SEQ ID NO: 4843787 - DNA, 15 bp, Homo sapiens
gccttcatcagaact

SEQ ID NO: 4843788 - DNA, 15 bp, Homo sapiens
gccttcccagcttcc

SEQ ID NO: 4843789 - DNA, 17 bp, Homo sapiens
gccttcccagcttcccg

SEQ ID NO: 4843790 - DNA, 14 bp, Homo sapiens
gccttccctttaca

SEQ ID NO: 4843791 - DNA, 15 bp, Homo sapiens
gccttcctcctctca

SEQ ID NO: 4843792 - DNA, 14 bp, Homo sapiens
gccttcgtttatat

SEQ ID NO: 4843793 - DNA, 21 bp, Homo sapiens
gccttctctattgggcacagc

SEQ ID NO: 4843794 - DNA, 18 bp, Homo sapiens
gccttgcagatatctgca

SEQ ID NO: 4843795 - DNA, 19 bp, Homo sapiens
gccttgcagcggctcctgc

SEQ ID NO: 4843796 - DNA, 21 bp, Homo sapiens
gccttgcttctgtatttcctt

SEQ ID NO: 4843797 - DNA, 14 bp, Homo sapiens
gccttggaaattcc

SEQ ID NO: 4843798 - DNA, 12 bp, Homo sapiens
cctgtccctagg

SEQ ID NO: 4843799 - DNA, 17 bp, Homo sapiens
cctgtccctagggctct

SEQ ID NO: 4843800 - DNA, 18 bp, Homo sapiens
cctgtctgctaggcgctg

SEQ ID NO: 4843801 - DNA, 22 bp, Homo sapiens
cctgtctgctaggcgctgggga

SEQ ID NO: 4843802 - DNA, 16 bp, Homo sapiens
cctgtgagcacaaaga

SEQ ID NO: 4843803 - DNA, 20 bp, Homo sapiens
cctgtgagcacaaagaagaa

SEQ ID NO: 4843804 - DNA, 18 bp, Homo sapiens
cctgtgaggatagagact

SEQ ID NO: 4843805 - DNA, 20 bp, Homo sapiens
cctgtgaggatagagacttg

SEQ ID NO: 4843806 - DNA, 21 bp, Homo sapiens
cctgtgaggatagagacttgc

SEQ ID NO: 4843807 - DNA, 20 bp, Homo sapiens
cctgtggaaggcagagaaat

SEQ ID NO: 4843808 - DNA, 12 bp, Homo sapiens
cctgtggatatt

SEQ ID NO: 4843809 - DNA, 18 bp, Homo sapiens
cctgtggcataaattgca

SEQ ID NO: 4843810 - DNA, 22 bp, Homo sapiens
cctgttacttatgtagaaactg

SEQ ID NO: 4843811 - DNA, 14 bp, Homo sapiens
cctgttcatgtttt

SEQ ID NO: 4843812 - DNA, 14 bp, Homo sapiens
ccttacagcctctg

SEQ ID NO: 4843813 - DNA, 13 bp, Homo sapiens
ccttactggctta

SEQ ID NO: 4843814 - DNA, 18 bp, Homo sapiens
ccttactggcttacctcc

SEQ ID NO: 4843815 - DNA, 18 bp, Homo sapiens
ccttacttcaaagtgcct

SEQ ID NO: 4843816 - DNA, 15 bp, Homo sapiens
ccttagccctgtctg

SEQ ID NO: 4843817 - DNA, 20 bp, Homo sapiens
ccttagccctgtctgctagg

SEQ ID NO: 4843818 - DNA, 20 bp, Homo sapiens
ccttcaaggctcttcttcct

SEQ ID NO: 4843819 - DNA, 22 bp, Homo sapiens
ccttcaaggctcttcttcctca

SEQ ID NO: 4843820 - DNA, 14 bp, Homo sapiens
ccttcaggagcctg

SEQ ID NO: 4843821 - DNA, 15 bp, Homo sapiens
ccttcaggagcctgg

SEQ ID NO: 4843822 - DNA, 23 bp, Homo sapiens
ccttcaggagcctggccaggcag

SEQ ID NO: 4843823 - DNA, 19 bp, Homo sapiens
ccttcaggcagctgaaatt

SEQ ID NO: 4843824 - DNA, 21 bp, Homo sapiens
ccttcatcagaactcttcctc

SEQ ID NO: 4843825 - DNA, 17 bp, Homo sapiens
ccttcatccatcctgag

SEQ ID NO: 4843826 - DNA, 18 bp, Homo sapiens
ggacataagataaaatga

SEQ ID NO: 4843827 - DNA, 21 bp, Homo sapiens
ggacataagataaaatgatgt

SEQ ID NO: 4843828 - DNA, 22 bp, Homo sapiens
ggacatctgaccccaagggggc

SEQ ID NO: 4843829 - DNA, 20 bp, Homo sapiens
ggacatgagagtagggccct

SEQ ID NO: 4843830 - DNA, 22 bp, Homo sapiens
ggacatgagagtagggccctga

SEQ ID NO: 4843831 - DNA, 19 bp, Homo sapiens
ggacatttgaacatgttta

SEQ ID NO: 4843832 - DNA, 21 bp, Homo sapiens
ggacatttgtgggcaagcaga

SEQ ID NO: 4843833 - DNA, 21 bp, Homo sapiens
ggaccatttctctgcaggcca

SEQ ID NO: 4843834 - DNA, 22 bp, Homo sapiens
ggacccatccctgcctggaggc

SEQ ID NO: 4843835 - DNA, 20 bp, Homo sapiens
ggacccttgattcattctga

SEQ ID NO: 4843836 - DNA, 13 bp, Homo sapiens
ggaccttgcttcc

SEQ ID NO: 4843837 - DNA, 18 bp, Homo sapiens
ggaccttgcttccttctc

SEQ ID NO: 4843838 - DNA, 17 bp, Homo sapiens
ggacgctccctgctcca

SEQ ID NO: 4843839 - DNA, 19 bp, Homo sapiens
ggacgttaggccaggcctt

SEQ ID NO: 4843840 - DNA, 17 bp, Homo sapiens
ggactccaagccctggg

SEQ ID NO: 4843841 - DNA, 20 bp, Homo sapiens
ggactctcagggattctggg

SEQ ID NO: 4843842 - DNA, 15 bp, Homo sapiens
ggactctctccagga

SEQ ID NO: 4843843 - DNA, 17 bp, Homo sapiens
ggactctctccaggagg

SEQ ID NO: 4843844 - DNA, 22 bp, Homo sapiens
ggactctctccaggagggctcg

SEQ ID NO: 4843845 - DNA, 11 bp, Homo sapiens
ggactgcatgg

SEQ ID NO: 4843846 - DNA, 19 bp, Homo sapiens
ggactgcatggggaggcag

SEQ ID NO: 4843847 - DNA, 23 bp, Homo sapiens
ggactggttctgaggccagaaag

SEQ ID NO: 4843848 - DNA, 20 bp, Homo sapiens
ggagaagtcttctatttatt

SEQ ID NO: 4843849 - DNA, 21 bp, Homo sapiens
ggagaagttcttgattcagcc

SEQ ID NO: 4843850 - DNA, 21 bp, Homo sapiens
ggagaatggcatggcaggagt

SEQ ID NO: 4843851 - DNA, 15 bp, Homo sapiens
ggagacaaaagagca

SEQ ID NO: 4843852 - DNA, 23 bp, Homo sapiens
ggagactgataacttggggaggc

SEQ ID NO: 4843853 - DNA, 22 bp, Homo sapiens
ggagatttttttgagtcaaaga

SEQ ID NO: 4843854 - DNA, 16 bp, Homo sapiens
ggagcaaactctgctg

SEQ ID NO: 4843855 - DNA, 12 bp, Homo sapiens
ggagcagagctc

SEQ ID NO: 4843856 - DNA, 13 bp, Homo sapiens
ggagcagcaggcc

SEQ ID NO: 4843857 - DNA, 21 bp, Homo sapiens
ggagcagcaggcctctgggac

SEQ ID NO: 4843858 - DNA, 23 bp, Homo sapiens
ggagcattgcagcctaagaagaa

SEQ ID NO: 4843859 - DNA, 23 bp, Homo sapiens
ggagcatttaatggcagctagtg

SEQ ID NO: 4843860 - DNA, 15 bp, Homo sapiens
ggagccagctgcttg

SEQ ID NO: 4843861 - DNA, 11 bp, Homo sapiens
ggagccaggac

SEQ ID NO: 4843862 - DNA, 18 bp, Homo sapiens
ggagcctacctctgtctg

SEQ ID NO: 4843863 - DNA, 13 bp, Homo sapiens
ggagcctggccag

SEQ ID NO: 4843864 - DNA, 19 bp, Homo sapiens
ggagcctggccaggcaggg

SEQ ID NO: 4843865 - DNA, 23 bp, Homo sapiens
ggaggcaagagactgggagccac

SEQ ID NO: 4843866 - DNA, 19 bp, Homo sapiens
ggaggctcctctaggccct

SEQ ID NO: 4843867 - DNA, 14 bp, Homo sapiens
gtagagccaattag

SEQ ID NO: 4843868 - DNA, 17 bp, Homo sapiens
gtagagcccctactgtg

SEQ ID NO: 4843869 - DNA, 18 bp, Homo sapiens
gtagagcccctactgtgg

SEQ ID NO: 4843870 - DNA, 14 bp, Homo sapiens
gtagaggcttgttt

SEQ ID NO: 4843871 - DNA, 15 bp, Homo sapiens
gtagaggcttgttta

SEQ ID NO: 4843872 - DNA, 17 bp, Homo sapiens
gtagatatgtattcttt

SEQ ID NO: 4843873 - DNA, 15 bp, Homo sapiens
gtagcagagttaaat

SEQ ID NO: 4843874 - DNA, 20 bp, Homo sapiens
gtagcctatttttttagatt

SEQ ID NO: 4843875 - DNA, 16 bp, Homo sapiens
gtagctgcaaaaataa

SEQ ID NO: 4843876 - DNA, 13 bp, Homo sapiens
gtagctgcagcct

SEQ ID NO: 4843877 - DNA, 19 bp, Homo sapiens
gtagctgcagccttcatca

SEQ ID NO: 4843878 - DNA, 12 bp, Homo sapiens
gtagctgtgaaa

SEQ ID NO: 4843879 - DNA, 15 bp, Homo sapiens
gtagcttcagccagg

SEQ ID NO: 4843880 - DNA, 22 bp, Homo sapiens
gtagtcccggaggccttccctt

SEQ ID NO: 4843881 - DNA, 19 bp, Homo sapiens
gtagtgttgtccaggaagt

SEQ ID NO: 4843882 - DNA, 15 bp, Homo sapiens
gtataatattgaaaa

SEQ ID NO: 4843883 - DNA, 18 bp, Homo sapiens
gtataatgtttattaaat

SEQ ID NO: 4843884 - DNA, 20 bp, Homo sapiens
gtataatgtttattaaatgc

SEQ ID NO: 4843885 - DNA, 18 bp, Homo sapiens
gtatattacccaatggaa

SEQ ID NO: 4843886 - DNA, 12 bp, Homo sapiens
gtatattcagga

SEQ ID NO: 4843887 - DNA, 16 bp, Homo sapiens
gtatgcattattaaat

SEQ ID NO: 4843888 - DNA, 18 bp, Homo sapiens
gtatgcattattaaattg

SEQ ID NO: 4843889 - DNA, 18 bp, Homo sapiens
gtatgttaaagagaatga

SEQ ID NO: 4843890 - DNA, 18 bp, Homo sapiens
gtattaaaactaaatttc

SEQ ID NO: 4843891 - DNA, 20 bp, Homo sapiens
gtattaaaactaaatttcac

SEQ ID NO: 4843892 - DNA, 13 bp, Homo sapiens
gtattatgagcca

SEQ ID NO: 4843893 - DNA, 14 bp, Homo sapiens
gtattgcacattgt

SEQ ID NO: 4843894 - DNA, 18 bp, Homo sapiens
gtattgtttaaaatgtaa

SEQ ID NO: 4843895 - DNA, 15 bp, Homo sapiens
gtattttcatgaaaa

SEQ ID NO: 4843896 - DNA, 19 bp, Homo sapiens
gtattttcatgaaaatacc

SEQ ID NO: 4843897 - DNA, 22 bp, Homo sapiens
gtcaaagctttgactctataag

SEQ ID NO: 4843898 - DNA, 13 bp, Homo sapiens
gtcacatgactct

SEQ ID NO: 4843899 - DNA, 20 bp, Homo sapiens
gtcacatgactctcatttta

SEQ ID NO: 4843900 - DNA, 16 bp, Homo sapiens
gtggaaaaaacatttt

SEQ ID NO: 4843901 - DNA, 16 bp, Homo sapiens
gtggaacgaaaatgaa

SEQ ID NO: 4843902 - DNA, 16 bp, Homo sapiens
gtggacgttaggccag

SEQ ID NO: 4843903 - DNA, 16 bp, Homo sapiens
gtggatatttgtataa

SEQ ID NO: 4843904 - DNA, 23 bp, Homo sapiens
gtggatcacaaagtggaacgaaa

SEQ ID NO: 4843905 - DNA, 19 bp, Homo sapiens
gtggatccaaactgatcca

SEQ ID NO: 4843906 - DNA, 22 bp, Homo sapiens
gtggatcgagtgtagctgtgaa

SEQ ID NO: 4843907 - DNA, 15 bp, Homo sapiens
gtggcagcttgctgg

SEQ ID NO: 4843908 - DNA, 23 bp, Homo sapiens
gtggccacgggggcagtgtgagg

SEQ ID NO: 4843909 - DNA, 20 bp, Homo sapiens
gtggccgtctcctccctcag

SEQ ID NO: 4843910 - DNA, 22 bp, Homo sapiens
gtggcctcagctcaatgcagtt

SEQ ID NO: 4843911 - DNA, 13 bp, Homo sapiens
gtggcctgcagga

SEQ ID NO: 4843912 - DNA, 22 bp, Homo sapiens
gtggcctgctaaggctcctcct

SEQ ID NO: 4843913 - DNA, 18 bp, Homo sapiens
gtggccttgagtctctga

SEQ ID NO: 4843914 - DNA, 19 bp, Homo sapiens
gtggccttgagtctctgaa

SEQ ID NO: 4843915 - DNA, 20 bp, Homo sapiens
gtggcctttatgttctttca

SEQ ID NO: 4843916 - DNA, 15 bp, Homo sapiens
gtggctctgctggcc

SEQ ID NO: 4843917 - DNA, 15 bp, Homo sapiens
gtgggaatgttcttt

SEQ ID NO: 4843918 - DNA, 21 bp, Homo sapiens
gtgggaatgttctttctgctc

SEQ ID NO: 4843919 - DNA, 14 bp, Homo sapiens
gtgggacagtggtg

SEQ ID NO: 4843920 - DNA, 12 bp, Homo sapiens
gtgggagacagc

SEQ ID NO: 4843921 - DNA, 19 bp, Homo sapiens
gtgggagacagcagcctgt

SEQ ID NO: 4843922 - DNA, 13 bp, Homo sapiens
gtgggatcctccc

SEQ ID NO: 4843923 - DNA, 20 bp, Homo sapiens
gtgggatcctccctcatggc

SEQ ID NO: 4843924 - DNA, 20 bp, Homo sapiens
gtgggcaagcagatgacaga

SEQ ID NO: 4843925 - DNA, 18 bp, Homo sapiens
gtggggcctcaggctccg

SEQ ID NO: 4843926 - DNA, 15 bp, Homo sapiens
gtggggcgtggatcg

SEQ ID NO: 4843927 - DNA, 13 bp, Homo sapiens
gtggtctgccaat

SEQ ID NO: 4843928 - DNA, 14 bp, Homo sapiens
gtggtgtgtgaagt

SEQ ID NO: 4843929 - DNA, 19 bp, Homo sapiens
gtgtaataatgtaacatga

SEQ ID NO: 4843930 - DNA, 23 bp, Homo sapiens
gtgtagagcccctactgtgggca

SEQ ID NO: 4843931 - DNA, 17 bp, Homo sapiens
gtgtagctgcaaaaata

SEQ ID NO: 4843932 - DNA, 19 bp, Homo sapiens
gtgtagtcccggaggcctt

SEQ ID NO: 4843933 - DNA, 17 bp, Homo sapiens
gtgtcatgaagaatgtt

SEQ ID NO: 4843934 - DNA, 11 bp, Homo sapiens
gtgtgactcct

SEQ ID NO: 4843935 - DNA, 20 bp, Homo sapiens
gtgtgactccttatctcttt

SEQ ID NO: 4843936 - DNA, 14 bp, Homo sapiens
gtgtgcagacagcc

SEQ ID NO: 4843937 - DNA, 12 bp, Homo sapiens
gtgtgcataata

SEQ ID NO: 4843938 - DNA, 23 bp, Homo sapiens
gtgtggattgcctctgaaaagtg

SEQ ID NO: 4843939 - DNA, 15 bp, Homo sapiens
gtgtgtgccaagagc

SEQ ID NO: 4843940 - DNA, 20 bp, Homo sapiens
gtgttactaaaaaaaagatg

SEQ ID NO: 4843941 - DNA, 21 bp, Homo sapiens
gtgttactaaaaaaaagatga

SEQ ID NO: 4843942 - DNA, 17 bp, Homo sapiens
gtgttattacttcctca

SEQ ID NO: 4843943 - DNA, 20 bp, Homo sapiens
gtgttgcagccgcagagaaa

SEQ ID NO: 4843944 - DNA, 16 bp, Homo sapiens
gtgttgtccaggaagt

SEQ ID NO: 4843945 - DNA, 13 bp, Homo sapiens
gttaaaaaaaaaa

SEQ ID NO: 4843946 - DNA, 21 bp, Homo sapiens
gttaaggacccttttaagcat

SEQ ID NO: 4843947 - DNA, 18 bp, Homo sapiens
gttaatttgtgtgttttt

SEQ ID NO: 4843948 - DNA, 21 bp, Homo sapiens
gttaatttttcctgcatgttc

SEQ ID NO: 4843949 - DNA, 22 bp, Homo sapiens
gttaatttttcctgcatgttct

SEQ ID NO: 4843950 - DNA, 21 bp, Homo sapiens
gttacctggagaagtagtatt

SEQ ID NO: 4843951 - DNA, 17 bp, Homo sapiens
gttagctgaagaattga

SEQ ID NO: 4843952 - DNA, 24 bp, Homo sapiens
gttagttcaatctggattcatatt

SEQ ID NO: 4843953 - DNA, 19 bp, Homo sapiens
gttatacatcaatatgtat

SEQ ID NO: 4843954 - DNA, 14 bp, Homo sapiens
gttatcatgaattt

SEQ ID NO: 4843955 - DNA, 16 bp, Homo sapiens
gttatcatgaatttta

SEQ ID NO: 4843956 - DNA, 17 bp, Homo sapiens
gttatcatgaattttaa

SEQ ID NO: 4843957 - DNA, 23 bp, Homo sapiens
gttatttattccccagtgactcc

SEQ ID NO: 4843958 - DNA, 22 bp, Homo sapiens
gttcaacaaagaaacaaagatg

SEQ ID NO: 4843959 - DNA, 17 bp, Homo sapiens
gttcaagtttgctgcaa

SEQ ID NO: 4843960 - DNA, 12 bp, Homo sapiens
gttcagaagaat

SEQ ID NO: 4843961 - DNA, 19 bp, Homo sapiens
gttcagaagaatcttcctg

SEQ ID NO: 4843962 - DNA, 17 bp, Homo sapiens
gttccatgttgactgac

SEQ ID NO: 4843963 - DNA, 21 bp, Homo sapiens
gttccggggagaaacccagag

SEQ ID NO: 4843964 - DNA, 17 bp, Homo sapiens
gttcctactcacacttc

SEQ ID NO: 4843965 - DNA, 20 bp, Homo sapiens
gttcctgaaatgtgtttcct

SEQ ID NO: 4843966 - DNA, 13 bp, Homo sapiens
gttctaaggctca

SEQ ID NO: 4843967 - DNA, 12 bp, Homo sapiens
gttctcccatga

SEQ ID NO: 4843968 - DNA, 13 bp, Homo sapiens
gttctgaggccag

SEQ ID NO: 4843969 - DNA, 15 bp, Homo sapiens
gttctggatgtctgg

SEQ ID NO: 4843970 - DNA, 11 bp, Homo sapiens
gttcttcatga

SEQ ID NO: 4843971 - DNA, 17 bp, Homo sapiens
gttctttcacccatcct

SEQ ID NO: 4843972 - DNA, 22 bp, Homo sapiens
gttctttcacccatcctaggaa

SEQ ID NO: 4843973 - DNA, 23 bp, Homo sapiens
gttctttctgctctatactgtgg

SEQ ID NO: 4843974 - DNA, 22 bp, Homo sapiens
gttgagcatagagaacaaagta

SEQ ID NO: 4843975 - DNA, 21 bp, Homo sapiens
gttgatgaggacccagagctg

SEQ ID NO: 4843976 - DNA, 17 bp, Homo sapiens
gttgcacttttgaatgt

SEQ ID NO: 4843977 - DNA, 19 bp, Homo sapiens
gttgcacttttgaatgtcc

SEQ ID NO: 4843978 - DNA, 22 bp, Homo sapiens
gttgcacttttgaatgtccaaa

SEQ ID NO: 4843979 - DNA, 18 bp, Homo sapiens
gttgcatagcagtatatg

SEQ ID NO: 4843980 - DNA, 23 bp, Homo sapiens
gttgccatcctaccgtcttttcc

SEQ ID NO: 4843981 - DNA, 19 bp, Homo sapiens
gttgcccccattcccagcc

SEQ ID NO: 4843982 - DNA, 21 bp, Homo sapiens
gttgcccccattcccagcctg

SEQ ID NO: 4843983 - DNA, 23 bp, Homo sapiens
gttggacgggatgacctccagaa

SEQ ID NO: 4843984 - DNA, 13 bp, Homo sapiens
gttggagtgctct

SEQ ID NO: 4843985 - DNA, 15 bp, Homo sapiens
gttgtacttaaatgg

SEQ ID NO: 4843986 - DNA, 14 bp, Homo sapiens
gttgtcttagcatg

SEQ ID NO: 4843987 - DNA, 12 bp, Homo sapiens
gttgtgagaatg

SEQ ID NO: 4843988 - DNA, 19 bp, Homo sapiens
gttgtgagaatggcctgga

SEQ ID NO: 4843989 - DNA, 19 bp, Homo sapiens
gtttaaaatgtaatttaaa

SEQ ID NO: 4843990 - DNA, 21 bp, Homo sapiens
gtttaaaatgtaatttaaatg

SEQ ID NO: 4843991 - DNA, 21 bp, Homo sapiens
gtttaatgggtatgctcaggt

SEQ ID NO: 4843992 - DNA, 20 bp, Homo sapiens
gtttaatggtagttttacag

SEQ ID NO: 4843993 - DNA, 17 bp, Homo sapiens
gtttacatgaagcagaa

SEQ ID NO: 4843994 - DNA, 20 bp, Homo sapiens
gtttacatgaagcagaacct

SEQ ID NO: 4843995 - DNA, 20 bp, Homo sapiens
gtttagatgaggctcagaga

SEQ ID NO: 4843996 - DNA, 20 bp, Homo sapiens
gtttagatttatggttgtta

SEQ ID NO: 4843997 - DNA, 13 bp, Homo sapiens
gtttataataaaa

SEQ ID NO: 4843998 - DNA, 22 bp, Homo sapiens
gtttataatactactactgtta

SEQ ID NO: 4843999 - DNA, 23 bp, Homo sapiens
gtttatatttttttaactgtgat

SEQ ID NO: 4844000 - DNA, 18 bp, Homo sapiens
gtttattctttgcaaata

SEQ ID NO: 4844001 - DNA, 14 bp, Homo sapiens
gtttcaaagtgata

SEQ ID NO: 4844002 - DNA, 19 bp, Homo sapiens
gtttcactgtactgcatgt

SEQ ID NO: 4844003 - DNA, 12 bp, Homo sapiens
gtttcaggaagt

SEQ ID NO: 4844004 - DNA, 18 bp, Homo sapiens
gtttcagtttgttggaaa

SEQ ID NO: 4844005 - DNA, 19 bp, Homo sapiens
gtttcatttagtcatgtga

SEQ ID NO: 4844006 - DNA, 20 bp, Homo sapiens
gtttcatttagtcatgtgac

SEQ ID NO: 4844007 - DNA, 21 bp, Homo sapiens
gtttcatttagtcatgtgacc

SEQ ID NO: 4844008 - DNA, 17 bp, Homo sapiens
gtttccttttcaggaga

SEQ ID NO: 4844009 - DNA, 16 bp, Homo sapiens
gtttctctataaagta

SEQ ID NO: 4844010 - DNA, 19 bp, Homo sapiens
gtttgacagtttttgacat

SEQ ID NO: 4844011 - DNA, 11 bp, Homo sapiens
gtttgcaggag

SEQ ID NO: 4844012 - DNA, 19 bp, Homo sapiens
gtttgctgtgctttggaac

SEQ ID NO: 4844013 - DNA, 15 bp, Homo sapiens
gtttgggagccagga

SEQ ID NO: 4844014 - DNA, 16 bp, Homo sapiens
gtttgggagccaggac

SEQ ID NO: 4844015 - DNA, 17 bp, Homo sapiens
gtttgggagccaggact

SEQ ID NO: 4844016 - DNA, 18 bp, Homo sapiens
gtttgggagccaggactc

SEQ ID NO: 4844017 - DNA, 16 bp, Homo sapiens
gtttggtaaatgtttc

SEQ ID NO: 4844018 - DNA, 22 bp, Homo sapiens
gtttgtagtgccactgttgttt

SEQ ID NO: 4844019 - DNA, 22 bp, Homo sapiens
tccaggatgctaacatctaaaa

SEQ ID NO: 4844020 - DNA, 20 bp, Homo sapiens
tccagggaggggtccctgca

SEQ ID NO: 4844021 - DNA, 16 bp, Homo sapiens
tccagggcagcaggcc

SEQ ID NO: 4844022 - DNA, 19 bp, Homo sapiens
tccagggcagcaggccaga

SEQ ID NO: 4844023 - DNA, 20 bp, Homo sapiens
tccagggtgacaaggcctgc

SEQ ID NO: 4844024 - DNA, 13 bp, Homo sapiens
tccagttataaga

SEQ ID NO: 4844025 - DNA, 18 bp, Homo sapiens
tccatatatatgaaatgt

SEQ ID NO: 4844026 - DNA, 16 bp, Homo sapiens
tccatccatctttcca

SEQ ID NO: 4844027 - DNA, 21 bp, Homo sapiens
tccatccattacctccatcca

SEQ ID NO: 4844028 - DNA, 18 bp, Homo sapiens
tccatccctccattcatc

SEQ ID NO: 4844029 - DNA, 18 bp, Homo sapiens
tcgccagtcactgctgca

SEQ ID NO: 4844030 - DNA, 13 bp, Homo sapiens
tcgcccccacctc

SEQ ID NO: 4844031 - DNA, 15 bp, Homo sapiens
tcggaaatcttaaac

SEQ ID NO: 4844032 - DNA, 13 bp, Homo sapiens
tcggatcctgtga

SEQ ID NO: 4844033 - DNA, 13 bp, Homo sapiens
tcggctgccaggg

SEQ ID NO: 4844034 - DNA, 14 bp, Homo sapiens
tcggctgccagggg

SEQ ID NO: 4844035 - DNA, 16 bp, Homo sapiens
tcggctgccaggggct

SEQ ID NO: 4844036 - DNA, 19 bp, Homo sapiens
tcggctgccaggggctctg

SEQ ID NO: 4844037 - DNA, 21 bp, Homo sapiens
tcggctgccaggggctctgtg

SEQ ID NO: 4844038 - DNA, 14 bp, Homo sapiens
tcgggttctcccat

SEQ ID NO: 4844039 - DNA, 17 bp, Homo sapiens
tcgtattaaaaaacaat

SEQ ID NO: 4844040 - DNA, 18 bp, Homo sapiens
tctaaaaggtaatgtgtg

SEQ ID NO: 4844041 - DNA, 12 bp, Homo sapiens
tctaaagagcat

SEQ ID NO: 4844042 - DNA, 23 bp, Homo sapiens
tctaaatatgaatgaatgggata

SEQ ID NO: 4844043 - DNA, 14 bp, Homo sapiens
tctaacctgtgacc

SEQ ID NO: 4844044 - DNA, 15 bp, Homo sapiens
tctaagtgctgctgt

SEQ ID NO: 4844045 - DNA, 16 bp, Homo sapiens
tctaagtgctgctgtg

SEQ ID NO: 4844046 - DNA, 18 bp, Homo sapiens
tctaagtgctgctgtgga

SEQ ID NO: 4844047 - DNA, 12 bp, Homo sapiens
tctaattctgat

SEQ ID NO: 4844048 - DNA, 19 bp, Homo sapiens
tctacaatctctttttgtt

SEQ ID NO: 4844049 - DNA, 12 bp, Homo sapiens
tctacccctgct

SEQ ID NO: 4844050 - DNA, 19 bp, Homo sapiens
tctagaatcacagctcaag

SEQ ID NO: 4844051 - DNA, 21 bp, Homo sapiens
tctagagcttaatgctacatg

SEQ ID NO: 4844052 - DNA, 21 bp, Homo sapiens
tctagatgattttttgaaagt

SEQ ID NO: 4844053 - DNA, 14 bp, Homo sapiens
tctagcctctggac

SEQ ID NO: 4844054 - DNA, 20 bp, Homo sapiens
tctagcctctggactggaaa

SEQ ID NO: 4844055 - DNA, 18 bp, Homo sapiens
tctaggcactgagcaggg

SEQ ID NO: 4844056 - DNA, 13 bp, Homo sapiens
tctaggccctgtg

SEQ ID NO: 4844057 - DNA, 22 bp, Homo sapiens
tctaggccctgtgagcacaaag

SEQ ID NO: 4844058 - DNA, 14 bp, Homo sapiens
tctaggtctcctca

SEQ ID NO: 4844059 - DNA, 18 bp, Homo sapiens
tctagtgaggaagacaag

SEQ ID NO: 4844060 - DNA, 21 bp, Homo sapiens
tctagttgcccccattcccag

SEQ ID NO: 4844061 - DNA, 12 bp, Homo sapiens
tctataaaactc

SEQ ID NO: 4844062 - DNA, 16 bp, Homo sapiens
tctataaaactctgca

SEQ ID NO: 4844063 - DNA, 21 bp, Homo sapiens
tctataagcaaattgcttttt

SEQ ID NO: 4844064 - DNA, 17 bp, Homo sapiens
tctatagcaccagggct

SEQ ID NO: 4844065 - DNA, 18 bp, Homo sapiens
tctatattagatcaaata

SEQ ID NO: 4844066 - DNA, 14 bp, Homo sapiens
tctatattcctcca

SEQ ID NO: 4844067 - DNA, 15 bp, Homo sapiens
tctatattcctccag

SEQ ID NO: 4844068 - DNA, 15 bp, Homo sapiens
tctattctccagaca

SEQ ID NO: 4844069 - DNA, 13 bp, Homo sapiens
tctattgtttgtt

SEQ ID NO: 4844070 - DNA, 14 bp, Homo sapiens
tctatttttatgat

SEQ ID NO: 4844071 - DNA, 19 bp, Homo sapiens
tctatttttatgatgacaa

SEQ ID NO: 4844072 - DNA, 21 bp, Homo sapiens
tctcaaacctggcagatgggg

SEQ ID NO: 4844073 - DNA, 12 bp, Homo sapiens
tctcaaatgtgt

SEQ ID NO: 4844074 - DNA, 15 bp, Homo sapiens
tctcacactggagga

SEQ ID NO: 4844075 - DNA, 15 bp, Homo sapiens
tctcacttagtcctt

SEQ ID NO: 4844076 - DNA, 15 bp, Homo sapiens
tctcagctgtgcctt

SEQ ID NO: 4844077 - DNA, 17 bp, Homo sapiens
tctcagtggtgtgtgaa

SEQ ID NO: 4844078 - DNA, 19 bp, Homo sapiens
tctcagtggtgtgtgaagt

SEQ ID NO: 4844079 - DNA, 13 bp, Homo sapiens
tctcatcttgcct

SEQ ID NO: 4844080 - DNA, 15 bp, Homo sapiens
tctcattgcttacaa

SEQ ID NO: 4844081 - DNA, 21 bp, Homo sapiens
tctcattttatttacagctgt

SEQ ID NO: 4844082 - DNA, 17 bp, Homo sapiens
tctccaagcactagcct

SEQ ID NO: 4844083 - DNA, 17 bp, Homo sapiens
tctccacaggagagact

SEQ ID NO: 4844084 - DNA, 15 bp, Homo sapiens
tctccagaagaaaat

SEQ ID NO: 4844085 - DNA, 19 bp, Homo sapiens
tctccatggggaggcctca

SEQ ID NO: 4844086 - DNA, 16 bp, Homo sapiens
tctccattttcaagct

SEQ ID NO: 4844087 - DNA, 22 bp, Homo sapiens
tctcccagctctagcctctgga

SEQ ID NO: 4844088 - DNA, 17 bp, Homo sapiens
tctcccctcctgctggg

SEQ ID NO: 4844089 - DNA, 14 bp, Homo sapiens
tctcccctgccctt

SEQ ID NO: 4844090 - DNA, 16 bp, Homo sapiens
tctccgactctgcacc

SEQ ID NO: 4844091 - DNA, 20 bp, Homo sapiens
tctcctctctctttcctcca

SEQ ID NO: 4844092 - DNA, 19 bp, Homo sapiens
tctcctgccctctgctctg

SEQ ID NO: 4844093 - DNA, 21 bp, Homo sapiens
tctcctgccctctgctctgcc

SEQ ID NO: 4844094 - DNA, 12 bp, Homo sapiens
tctccttaagct

SEQ ID NO: 4844095 - DNA, 20 bp, Homo sapiens
tctccttaagctgcagagat

SEQ ID NO: 4844096 - DNA, 15 bp, Homo sapiens
tctcggctgccaggg

SEQ ID NO: 4844097 - DNA, 15 bp, Homo sapiens
tctctccaggagggc

SEQ ID NO: 4844098 - DNA, 18 bp, Homo sapiens
tctctcctcccctacacc

SEQ ID NO: 4844099 - DNA, 17 bp, Homo sapiens
tctctctgggcccaggg

SEQ ID NO: 4844100 - DNA, 18 bp, Homo sapiens
tctctctttcctccaccc

SEQ ID NO: 4844101 - DNA, 13 bp, Homo sapiens
tctctgaatttgt

SEQ ID NO: 4844102 - DNA, 17 bp, Homo sapiens
tctctggtaatattgac

SEQ ID NO: 4844103 - DNA, 22 bp, Homo sapiens
tctctgtactaaggagaaatga

SEQ ID NO: 4844104 - DNA, 12 bp, Homo sapiens
tctctttttgtt

SEQ ID NO: 4844105 - DNA, 14 bp, Homo sapiens
tctctttttgtttg

SEQ ID NO: 4844106 - DNA, 14 bp, Homo sapiens
tctgaaaggccagc

SEQ ID NO: 4844107 - DNA, 16 bp, Homo sapiens
tctgaaaggccagcag

SEQ ID NO: 4844108 - DNA, 22 bp, Homo sapiens
tctgaaatcttcccatgcattc

SEQ ID NO: 4844109 - DNA, 13 bp, Homo sapiens
tctgaagagacca

SEQ ID NO: 4844110 - DNA, 23 bp, Homo sapiens
tctgaagagaccactcaatccat

SEQ ID NO: 4844111 - DNA, 21 bp, Homo sapiens
tctgaccccaagggggctgct

SEQ ID NO: 4844112 - DNA, 18 bp, Homo sapiens
tctgacctcttggccaca

SEQ ID NO: 4844113 - DNA, 12 bp, Homo sapiens
tctgaggccaga

SEQ ID NO: 4844114 - DNA, 15 bp, Homo sapiens
tctgattctggcttt

SEQ ID NO: 4844115 - DNA, 14 bp, Homo sapiens
tctgcaacaagcat

SEQ ID NO: 4844116 - DNA, 14 bp, Homo sapiens
tctgcagtcagact

SEQ ID NO: 4844117 - DNA, 16 bp, Homo sapiens
tctgccccctagttca

SEQ ID NO: 4844118 - DNA, 22 bp, Homo sapiens
tctggaagagggaggggccctg

SEQ ID NO: 4844119 - DNA, 23 bp, Homo sapiens
tctggaagagggaggggccctgt

SEQ ID NO: 4844120 - DNA, 22 bp, Homo sapiens
tctggactggaaagcacaagac

SEQ ID NO: 4844121 - DNA, 21 bp, Homo sapiens
tctggatcccgttcagaaaac

SEQ ID NO: 4844122 - DNA, 16 bp, Homo sapiens
tctggccctaactcct

SEQ ID NO: 4844123 - DNA, 18 bp, Homo sapiens
tctggctcaaagcagcag

SEQ ID NO: 4844124 - DNA, 20 bp, Homo sapiens
tctggcttcaaaaagccaca

SEQ ID NO: 4844125 - DNA, 21 bp, Homo sapiens
tctggcttcaaaaagccacag

SEQ ID NO: 4844126 - DNA, 23 bp, Homo sapiens
tctggcttcaaaaagccacagca

SEQ ID NO: 4844127 - DNA, 14 bp, Homo sapiens
tctggctttaagcc

SEQ ID NO: 4844128 - DNA, 14 bp, Homo sapiens
tctgggtccaggga

SEQ ID NO: 4844129 - DNA, 15 bp, Homo sapiens
tctgggtccagggag

SEQ ID NO: 4844130 - DNA, 15 bp, Homo sapiens
tctgggttgccttta

SEQ ID NO: 4844131 - DNA, 19 bp, Homo sapiens
tctggttgctaatgacagc

SEQ ID NO: 4844132 - DNA, 19 bp, Homo sapiens
tctgtaataatagactgta

SEQ ID NO: 4844133 - DNA, 13 bp, Homo sapiens
tctgtaattgtgt

SEQ ID NO: 4844134 - DNA, 15 bp, Homo sapiens
tctgtagagccaatt

SEQ ID NO: 4844135 - DNA, 15 bp, Homo sapiens
tctgtccgtgcccct

SEQ ID NO: 4844136 - DNA, 21 bp, Homo sapiens
tctgtccgtgccccttccctg

SEQ ID NO: 4844137 - DNA, 13 bp, Homo sapiens
tctgtccttcccc

SEQ ID NO: 4844138 - DNA, 20 bp, Homo sapiens
tctgtctgagacaggtgcct

SEQ ID NO: 4844139 - DNA, 19 bp, Homo sapiens
tctgtgaacaagcttcagt

SEQ ID NO: 4844140 - DNA, 12 bp, Homo sapiens
tctgtggcaaaa

SEQ ID NO: 4844141 - DNA, 20 bp, Homo sapiens
tctgtgtaaccagctcagtg

SEQ ID NO: 4844142 - DNA, 15 bp, Homo sapiens
tctgttatgggcttt

SEQ ID NO: 4844143 - DNA, 19 bp, Homo sapiens
tctgttttgtggtttggaa

SEQ ID NO: 4844144 - DNA, 21 bp, Homo sapiens
tcttagccctcaccacagcct

SEQ ID NO: 4844145 - DNA, 21 bp, Homo sapiens
taagcagtatattagtattat

SEQ ID NO: 4844146 - DNA, 15 bp, Homo sapiens
taagcatgtgatgtt

SEQ ID NO: 4844147 - DNA, 17 bp, Homo sapiens
taagcatgtgtcccagg

SEQ ID NO: 4844148 - DNA, 16 bp, Homo sapiens
taagccgcagacctgg

SEQ ID NO: 4844149 - DNA, 17 bp, Homo sapiens
taagggaaaagataaag

SEQ ID NO: 4844150 - DNA, 14 bp, Homo sapiens
taagggagaaaaaa

SEQ ID NO: 4844151 - DNA, 13 bp, Homo sapiens
taagtttgtgtaa

SEQ ID NO: 4844152 - DNA, 20 bp, Homo sapiens
taagttttactgataatttg

SEQ ID NO: 4844153 - DNA, 15 bp, Homo sapiens
taataaaaagaaaga

SEQ ID NO: 4844154 - DNA, 16 bp, Homo sapiens
taataaaaagaaagat

SEQ ID NO: 4844155 - DNA, 19 bp, Homo sapiens
taataaaaagaaagatact

SEQ ID NO: 4844156 - DNA, 17 bp, Homo sapiens
taataagagaatgttcc

SEQ ID NO: 4844157 - DNA, 18 bp, Homo sapiens
taatatccctacatgtat

SEQ ID NO: 4844158 - DNA, 24 bp, Homo sapiens
taatatgacaaacatcattgttta

SEQ ID NO: 4844159 - DNA, 22 bp, Homo sapiens
taatattgaaaattgaaaagta

SEQ ID NO: 4844160 - DNA, 15 bp, Homo sapiens
taatcatgaaccaat

SEQ ID NO: 4844161 - DNA, 23 bp, Homo sapiens
taatccagttataagaagaagtt

SEQ ID NO: 4844162 - DNA, 13 bp, Homo sapiens
taatctcaatgca

SEQ ID NO: 4844163 - DNA, 14 bp, Homo sapiens
taatctcaatgcaa

SEQ ID NO: 4844164 - DNA, 13 bp, Homo sapiens
taatgaaatggag

SEQ ID NO: 4844165 - DNA, 21 bp, Homo sapiens
taatgatcagcaaaaagactg

SEQ ID NO: 4844166 - DNA, 17 bp, Homo sapiens
taatgctaaatgtgtaa

SEQ ID NO: 4844167 - DNA, 22 bp, Homo sapiens
tatcttataaagtggaagtatg

SEQ ID NO: 4844168 - DNA, 17 bp, Homo sapiens
tatcttgttcaggaaaa

SEQ ID NO: 4844169 - DNA, 15 bp, Homo sapiens
tatgaatgaaacatg

SEQ ID NO: 4844170 - DNA, 22 bp, Homo sapiens
tatgacaagctgtatcactgcc

SEQ ID NO: 4844171 - DNA, 23 bp, Homo sapiens
tatgacaagctgtatcactgcct

SEQ ID NO: 4844172 - DNA, 12 bp, Homo sapiens
tatgcaattcag

SEQ ID NO: 4844173 - DNA, 17 bp, Homo sapiens
tatgcaattcagtgttc

SEQ ID NO: 4844174 - DNA, 18 bp, Homo sapiens
tatgcagaaatagacaaa

SEQ ID NO: 4844175 - DNA, 21 bp, Homo sapiens
tatgcagaaatagacaaaaag

SEQ ID NO: 4844176 - DNA, 12 bp, Homo sapiens
tatgcattcaca

SEQ ID NO: 4844177 - DNA, 19 bp, Homo sapiens
tatgcattcacatttagaa

SEQ ID NO: 4844178 - DNA, 22 bp, Homo sapiens
tatgcattcacatttagaaaag

SEQ ID NO: 4844179 - DNA, 23 bp, Homo sapiens
tatgggcttttggggagccagaa

SEQ ID NO: 4844180 - DNA, 19 bp, Homo sapiens
tatgggggagattgaactt

SEQ ID NO: 4844181 - DNA, 22 bp, Homo sapiens
tatggtaatagctttagtgaat

SEQ ID NO: 4844182 - DNA, 20 bp, Homo sapiens
tatggtaggaccctcgagag

SEQ ID NO: 4844183 - DNA, 22 bp, Homo sapiens
tatggtatgtagccagctgtgc

SEQ ID NO: 4844184 - DNA, 17 bp, Homo sapiens
tatgtaggtaagactgt

SEQ ID NO: 4844185 - DNA, 14 bp, Homo sapiens
tatgtattcttttc

SEQ ID NO: 4844186 - DNA, 18 bp, Homo sapiens
tatgtattttttgaatct

SEQ ID NO: 4844187 - DNA, 15 bp, Homo sapiens
tatgtcagtactatt

SEQ ID NO: 4844188 - DNA, 13 bp, Homo sapiens
tatgttaaagaga

SEQ ID NO: 4844189 - DNA, 14 bp, Homo sapiens
tatgttaaagagaa

SEQ ID NO: 4844190 - DNA, 12 bp, Homo sapiens
tatgttctttca

SEQ ID NO: 4844191 - DNA, 14 bp, Homo sapiens
tattaaaaaacaat

SEQ ID NO: 4844192 - DNA, 23 bp, Homo sapiens
tattaaaaaagagacatccaaat

SEQ ID NO: 4844193 - DNA, 16 bp, Homo sapiens
tattaaaatatttcag

SEQ ID NO: 4844194 - DNA, 15 bp, Homo sapiens
tattaaaattccaaa

SEQ ID NO: 4844195 - DNA, 19 bp, Homo sapiens
tattaaaattccaaattca

SEQ ID NO: 4844196 - DNA, 12 bp, Homo sapiens
tattaaacaaag

SEQ ID NO: 4844197 - DNA, 13 bp, Homo sapiens
tattaaacaaagt

SEQ ID NO: 4844198 - DNA, 17 bp, Homo sapiens
tattaaacaaagtttca

SEQ ID NO: 4844199 - DNA, 17 bp, Homo sapiens
tattaaagcatttccta

SEQ ID NO: 4844200 - DNA, 15 bp, Homo sapiens
tattaaataacatgt

SEQ ID NO: 4844201 - DNA, 18 bp, Homo sapiens
tattaactatcttctttg

SEQ ID NO: 4844202 - DNA, 19 bp, Homo sapiens
tattaagcagtacaaatgt

SEQ ID NO: 4844203 - DNA, 13 bp, Homo sapiens
tattaagcttttt

SEQ ID NO: 4844204 - DNA, 16 bp, Homo sapiens
tattaagctttttgga

SEQ ID NO: 4844205 - DNA, 22 bp, Homo sapiens
tattacccaatggaaaatataa

SEQ ID NO: 4844206 - DNA, 20 bp, Homo sapiens
tattacttcctcaataaaaa

SEQ ID NO: 4844207 - DNA, 22 bp, Homo sapiens
tattagatcaaatagttgcata

SEQ ID NO: 4844208 - DNA, 14 bp, Homo sapiens
tattatacatgtga

SEQ ID NO: 4844209 - DNA, 17 bp, Homo sapiens
tattatattcattcttt

SEQ ID NO: 4844210 - DNA, 18 bp, Homo sapiens
tattatcttgttcaggaa

SEQ ID NO: 4844211 - DNA, 20 bp, Homo sapiens
tattatcttgttcaggaaaa

SEQ ID NO: 4844212 - DNA, 20 bp, Homo sapiens
tattcaggacttgaaagaaa

SEQ ID NO: 4844213 - DNA, 15 bp, Homo sapiens
tattcagggtaaata

SEQ ID NO: 4844214 - DNA, 18 bp, Homo sapiens
tattcattctttttgaaa

SEQ ID NO: 4844215 - DNA, 22 bp, Homo sapiens
tattccagatctttcagaaata

SEQ ID NO: 4844216 - DNA, 17 bp, Homo sapiens
tattccatatttattca

SEQ ID NO: 4844217 - DNA, 13 bp, Homo sapiens
tattctccagaca

SEQ ID NO: 4844218 - DNA, 20 bp, Homo sapiens
tattgaaaattgaaaagtac

SEQ ID NO: 4844219 - DNA, 16 bp, Homo sapiens
tattgaaatgatttca

SEQ ID NO: 4844220 - DNA, 13 bp, Homo sapiens
tattgaaattcta

SEQ ID NO: 4844221 - DNA, 14 bp, Homo sapiens
tattgaccattttt

SEQ ID NO: 4844222 - DNA, 17 bp, Homo sapiens
tattgacttgtatattt

SEQ ID NO: 4844223 - DNA, 13 bp, Homo sapiens
tattgatgttttc

SEQ ID NO: 4844224 - DNA, 20 bp, Homo sapiens
tattgattgggaaaacattt

SEQ ID NO: 4844225 - DNA, 14 bp, Homo sapiens
tattgcaataaagt

SEQ ID NO: 4844226 - DNA, 23 bp, Homo sapiens
tattgctgtgagccttgcatgac

SEQ ID NO: 4844227 - DNA, 16 bp, Homo sapiens
tattgtttaaaatgta

SEQ ID NO: 4844228 - DNA, 16 bp, Homo sapiens
tattgtttggtaaatg

SEQ ID NO: 4844229 - DNA, 20 bp, Homo sapiens
tattgtttgttgcactaaaa

SEQ ID NO: 4844230 - DNA, 21 bp, Homo sapiens
tatttaaatcctgaagagcat

SEQ ID NO: 4844231 - DNA, 18 bp, Homo sapiens
tatttacagctgtgctcc

SEQ ID NO: 4844232 - DNA, 18 bp, Homo sapiens
tatttataatacagaatc

SEQ ID NO: 4844233 - DNA, 19 bp, Homo sapiens
tatttattccccagtgact

SEQ ID NO: 4844234 - DNA, 22 bp, Homo sapiens
tatttattccccagtgactcca

SEQ ID NO: 4844235 - DNA, 21 bp, Homo sapiens
tatttcaggcattggatattt

SEQ ID NO: 4844236 - DNA, 19 bp, Homo sapiens
tatttctatatagacttgg

SEQ ID NO: 4844237 - DNA, 14 bp, Homo sapiens
tatttctcagctgt

SEQ ID NO: 4844238 - DNA, 13 bp, Homo sapiens
tatttgattattt

SEQ ID NO: 4844239 - DNA, 20 bp, Homo sapiens
tattttcatgaaaataccat

SEQ ID NO: 4844240 - DNA, 13 bp, Homo sapiens
tattttgaaatga

SEQ ID NO: 4844241 - DNA, 14 bp, Homo sapiens
tattttgaaatgaa

SEQ ID NO: 4844242 - DNA, 20 bp, Homo sapiens
tatttttataattgtacaaa

SEQ ID NO: 4844243 - DNA, 14 bp, Homo sapiens
tatttttatgatga

SEQ ID NO: 4844244 - DNA, 15 bp, Homo sapiens
tatttttttaaaatt

SEQ ID NO: 4844245 - DNA, 16 bp, Homo sapiens
tattttttttttcttc

SEQ ID NO: 4844246 - DNA, 17 bp, Homo sapiens
tattttttttttcttct

SEQ ID NO: 4844247 - DNA, 21 bp, Homo sapiens
tattttttttttcttcttggg

SEQ ID NO: 4844248 - DNA, 12 bp, Homo sapiens
tcaaaaagccac

SEQ ID NO: 4844249 - DNA, 15 bp, Homo sapiens
tcaaaaagccacagc

SEQ ID NO: 4844250 - DNA, 22 bp, Homo sapiens
tcaaaaagccacagcagagcat

SEQ ID NO: 4844251 - DNA, 20 bp, Homo sapiens
tcaaaaggtattatacatgt

SEQ ID NO: 4844252 - DNA, 14 bp, Homo sapiens
tcaaagaagtactg

SEQ ID NO: 4844253 - DNA, 20 bp, Homo sapiens
tcaaagcatggacatttaga

SEQ ID NO: 4844254 - DNA, 22 bp, Homo sapiens
tcaaagcatggacatttagaag

SEQ ID NO: 4844255 - DNA, 22 bp, Homo sapiens
tcaaagccggcctgagaaacac

SEQ ID NO: 4844256 - DNA, 11 bp, Homo sapiens
tcaaagccttc

SEQ ID NO: 4844257 - DNA, 23 bp, Homo sapiens
tcaaataggctattaaaaaagtc

SEQ ID NO: 4844258 - DNA, 14 bp, Homo sapiens
tcaaattctgtctg

SEQ ID NO: 4844259 - DNA, 15 bp, Homo sapiens
tcaaattctgtctgg

SEQ ID NO: 4844260 - DNA, 14 bp, Homo sapiens
tcaacaaagaaaca

SEQ ID NO: 4844261 - DNA, 21 bp, Homo sapiens
tcaacaaagaaacaaagatgt

SEQ ID NO: 4844262 - DNA, 18 bp, Homo sapiens
tcaacagccaagctggca

SEQ ID NO: 4844263 - DNA, 20 bp, Homo sapiens
tcaacagccaagctggcaca

SEQ ID NO: 4844264 - DNA, 21 bp, Homo sapiens
tcaacagccaagctggcacaa

SEQ ID NO: 4844265 - DNA, 18 bp, Homo sapiens
tcaactctacccctgctc

SEQ ID NO: 4844266 - DNA, 21 bp, Homo sapiens
tcaagctggaagaagtgagca

SEQ ID NO: 4844267 - DNA, 15 bp, Homo sapiens
tcaagtttgctgcaa

SEQ ID NO: 4844268 - DNA, 16 bp, Homo sapiens
tcaataaatgatatat

SEQ ID NO: 4844269 - DNA, 19 bp, Homo sapiens
tcaatgagagcataattta

SEQ ID NO: 4844270 - DNA, 21 bp, Homo sapiens
tcacaagtggtgtttattgca

SEQ ID NO: 4844271 - DNA, 23 bp, Homo sapiens
tcacagggaatggccacaaacct

SEQ ID NO: 4844272 - DNA, 13 bp, Homo sapiens
tcaccacagcctt

SEQ ID NO: 4844273 - DNA, 22 bp, Homo sapiens
ttttattaaaatatttcaggtt

SEQ ID NO: 4844274 - DNA, 17 bp, Homo sapiens
ttttcaaaaggtattat

SEQ ID NO: 4844275 - DNA, 18 bp, Homo sapiens
ttttcatgaatgtgctgg

SEQ ID NO: 4844276 - DNA, 21 bp, Homo sapiens
ttttcatgaatgtgctggtga

SEQ ID NO: 4844277 - DNA, 13 bp, Homo sapiens
ttttccaaaacaa

SEQ ID NO: 4844278 - DNA, 15 bp, Homo sapiens
ttttccttttcttaa

SEQ ID NO: 4844279 - DNA, 14 bp, Homo sapiens
ttttctaaaagctt

SEQ ID NO: 4844280 - DNA, 14 bp, Homo sapiens
ttttctctggtaat

SEQ ID NO: 4844281 - DNA, 21 bp, Homo sapiens
ttttgaagattctatgttaat

SEQ ID NO: 4844282 - DNA, 19 bp, Homo sapiens
ttttgacaggttttccaaa

SEQ ID NO: 4844283 - DNA, 21 bp, Homo sapiens
ttttgcactgaggatattcag

SEQ ID NO: 4844284 - DNA, 22 bp, Homo sapiens
ttttggcaatgactcaaagtct

SEQ ID NO: 4844285 - DNA, 21 bp, Homo sapiens
ttttgggggtcagcatccagt

SEQ ID NO: 4844286 - DNA, 17 bp, Homo sapiens
ttttgtatgttaaagag

SEQ ID NO: 4844287 - DNA, 18 bp, Homo sapiens
ttttgtattttcatgaaa

SEQ ID NO: 4844288 - DNA, 16 bp, Homo sapiens
ttttgtggtttggaat

SEQ ID NO: 4844289 - DNA, 14 bp, Homo sapiens
ttttgtgtgaaatt

SEQ ID NO: 4844290 - DNA, 15 bp, Homo sapiens
ttttgtgtgaaattg

SEQ ID NO: 4844291 - DNA, 16 bp, Homo sapiens
ttttgttggtgctttg

SEQ ID NO: 4844292 - DNA, 15 bp, Homo sapiens
ttttgtttggtaaat

SEQ ID NO: 4844293 - DNA, 17 bp, Homo sapiens
tttttaaaatatttatt

SEQ ID NO: 4844294 - DNA, 12 bp, Homo sapiens
tttttaaaattt

SEQ ID NO: 4844295 - DNA, 11 bp, Homo sapiens
tttttaactgt

SEQ ID NO: 4844296 - DNA, 12 bp, Homo sapiens
tttttaactgta

SEQ ID NO: 4844297 - DNA, 19 bp, Homo sapiens
tttttagattgagaaatgt

SEQ ID NO: 4844298 - DNA, 20 bp, Homo sapiens
tttttagattgagaaatgtg

SEQ ID NO: 4844299 - DNA, 14 bp, Homo sapiens
tttttattaaaata

SEQ ID NO: 4844300 - DNA, 19 bp, Homo sapiens
tttttgcatgcatgcaaat

SEQ ID NO: 4844301 - DNA, 12 bp, Homo sapiens
tttttgtgaaga

SEQ ID NO: 4844302 - DNA, 14 bp, Homo sapiens
tttttgtttggaga

SEQ ID NO: 4844303 - DNA, 18 bp, Homo sapiens
ttttttaaaaggccattt

SEQ ID NO: 4844304 - DNA, 12 bp, Homo sapiens
ttttttaagctt

SEQ ID NO: 4844305 - DNA, 17 bp, Homo sapiens
ttctttgagtaatgtga

SEQ ID NO: 4844306 - DNA, 21 bp, Homo sapiens
ttcttttgctgaacaggaaag

SEQ ID NO: 4844307 - DNA, 13 bp, Homo sapiens
ttcttttgtttgg

SEQ ID NO: 4844308 - DNA, 15 bp, Homo sapiens
ttctttttgaaatgt

SEQ ID NO: 4844309 - DNA, 19 bp, Homo sapiens
ttgaaaaatataaaattat

SEQ ID NO: 4844310 - DNA, 16 bp, Homo sapiens
ttgaaaattgaaaagt

SEQ ID NO: 4844311 - DNA, 18 bp, Homo sapiens
ttgaaatgaactttgtca

SEQ ID NO: 4844312 - DNA, 20 bp, Homo sapiens
ttgaaccttaaaaggtactg

SEQ ID NO: 4844313 - DNA, 14 bp, Homo sapiens
ttgaagaaggcaag

SEQ ID NO: 4844314 - DNA, 14 bp, Homo sapiens
ttgaagagacagag

SEQ ID NO: 4844315 - DNA, 20 bp, Homo sapiens
ttgaagagacagagacaagt

SEQ ID NO: 4844316 - DNA, 13 bp, Homo sapiens
ttgaagattctat

SEQ ID NO: 4844317 - DNA, 22 bp, Homo sapiens
ttgaagattctatgttaatatt

SEQ ID NO: 4844318 - DNA, 19 bp, Homo sapiens
ttgaaggtagaatgttttc

SEQ ID NO: 4844319 - DNA, 22 bp, Homo sapiens
ttgaagttagtggaaatctgaa

SEQ ID NO: 4844320 - DNA, 19 bp, Homo sapiens
ttgaagtttcaagttttaa

SEQ ID NO: 4844321 - DNA, 22 bp, Homo sapiens
ttgaagtttcaagttttaaagt

SEQ ID NO: 4844322 - DNA, 21 bp, Homo sapiens
ttgaatctatgaacctgaaaa

SEQ ID NO: 4844323 - DNA, 13 bp, Homo sapiens
ttgaatgtccaaa

SEQ ID NO: 4844324 - DNA, 14 bp, Homo sapiens
ttgaatgttaaagg

SEQ ID NO: 4844325 - DNA, 22 bp, Homo sapiens
ttgaatgttaaagggatatttt

SEQ ID NO: 4844326 - DNA, 18 bp, Homo sapiens
ttgacaggttttccaaaa

SEQ ID NO: 4844327 - DNA, 14 bp, Homo sapiens
ttgacagtgttttt

SEQ ID NO: 4844328 - DNA, 16 bp, Homo sapiens
ttgacagtttttgaca

SEQ ID NO: 4844329 - DNA, 16 bp, Homo sapiens
ttgacatggaaatgaa

SEQ ID NO: 4844330 - DNA, 15 bp, Homo sapiens
ttgacatttatatta

SEQ ID NO: 4844331 - DNA, 13 bp, Homo sapiens
ttgactttccaga

SEQ ID NO: 4844332 - DNA, 14 bp, Homo sapiens
ttgactttccagaa

SEQ ID NO: 4844333 - DNA, 16 bp, Homo sapiens
ttgactttccagaatg

SEQ ID NO: 4844334 - DNA, 20 bp, Homo sapiens
ttgacttttataaagcatgt

SEQ ID NO: 4844335 - DNA, 15 bp, Homo sapiens
ttgagtattgtttaa

SEQ ID NO: 4844336 - DNA, 20 bp, Homo sapiens
ttgagtattgtttaaaatgt

SEQ ID NO: 4844337 - DNA, 22 bp, Homo sapiens
ttgagtattgtttaaaatgtaa

SEQ ID NO: 4844338 - DNA, 15 bp, Homo sapiens
ttgagtgtatgagta

SEQ ID NO: 4844339 - DNA, 18 bp, Homo sapiens
ttgatactaccagggtct

SEQ ID NO: 4844340 - DNA, 17 bp, Homo sapiens
ttgatggagccccaggg

SEQ ID NO: 4844341 - DNA, 19 bp, Homo sapiens
ttgattgggaaaacatttg

SEQ ID NO: 4844342 - DNA, 14 bp, Homo sapiens
ttgatttcaaagtt

SEQ ID NO: 4844343 - DNA, 19 bp, Homo sapiens
ttgcaaggtgtgatggtct

SEQ ID NO: 4844344 - DNA, 11 bp, Homo sapiens
ttgcaatgcag

SEQ ID NO: 4844345 - DNA, 20 bp, Homo sapiens
ttgcaccatactccttgctt

SEQ ID NO: 4844346 - DNA, 22 bp, Homo sapiens
ttgcaccatactccttgcttcc

SEQ ID NO: 4844347 - DNA, 21 bp, Homo sapiens
ttgcactaaaatgaggatcca

SEQ ID NO: 4844348 - DNA, 16 bp, Homo sapiens
ttgcagaactgtagct

SEQ ID NO: 4844349 - DNA, 18 bp, Homo sapiens
ttgcagatatctgcatgt

SEQ ID NO: 4844350 - DNA, 18 bp, Homo sapiens
ttgcagccgcagagaaat

SEQ ID NO: 4844351 - DNA, 21 bp, Homo sapiens
ttgcatactttgtattttgat

SEQ ID NO: 4844352 - DNA, 13 bp, Homo sapiens
ttgcatgcatgca

SEQ ID NO: 4844353 - DNA, 16 bp, Homo sapiens
ttgcatgcatgcaaat

SEQ ID NO: 4844354 - DNA, 16 bp, Homo sapiens
ttgccaaagtacagaa

SEQ ID NO: 4844355 - DNA, 21 bp, Homo sapiens
ttgccaaagtacagaatttga

SEQ ID NO: 4844356 - DNA, 20 bp, Homo sapiens
ttgccagaggaccaatgctt

SEQ ID NO: 4844357 - DNA, 15 bp, Homo sapiens
ttgccaggacatgca

SEQ ID NO: 4844358 - DNA, 19 bp, Homo sapiens
ttgcccccattcccagcct

SEQ ID NO: 4844359 - DNA, 19 bp, Homo sapiens
ttgcctcattttgcttccc

SEQ ID NO: 4844360 - DNA, 21 bp, Homo sapiens
ttgccttctctgttcccttgc

SEQ ID NO: 4844361 - DNA, 15 bp, Homo sapiens
ttgctctggagcagc

SEQ ID NO: 4844362 - DNA, 19 bp, Homo sapiens
ttgctgataccatatgaat

SEQ ID NO: 4844363 - DNA, 19 bp, Homo sapiens
ttgctggtgcctgccacct

SEQ ID NO: 4844364 - DNA, 13 bp, Homo sapiens
ttgctgtacaaaa

SEQ ID NO: 4844365 - DNA, 17 bp, Homo sapiens
ttgctgtacaaaagcaa

SEQ ID NO: 4844366 - DNA, 17 bp, Homo sapiens
ttgctgtgagccttgca

SEQ ID NO: 4844367 - DNA, 16 bp, Homo sapiens
ttgcttgccaaagtac

SEQ ID NO: 4844368 - DNA, 11 bp, Homo sapiens
ttggaaattcc

SEQ ID NO: 4844369 - DNA, 18 bp, Homo sapiens
ttggaaattcctgtactg

SEQ ID NO: 4844370 - DNA, 17 bp, Homo sapiens
ttggaagatgcagaagc

SEQ ID NO: 4844371 - DNA, 18 bp, Homo sapiens
ttggaagctgtttggaaa

SEQ ID NO: 4844372 - DNA, 21 bp, Homo sapiens
ttggaagctgtttggaaaaga

SEQ ID NO: 4844373 - DNA, 18 bp, Homo sapiens
ttggaagggaccccagat

SEQ ID NO: 4844374 - DNA, 17 bp, Homo sapiens
ttggaatattaaaaaac

SEQ ID NO: 4844375 - DNA, 15 bp, Homo sapiens
ttggacattttatgt

SEQ ID NO: 4844376 - DNA, 16 bp, Homo sapiens
ttggacattttatgtc

SEQ ID NO: 4844377 - DNA, 13 bp, Homo sapiens
ttggactctcagg

SEQ ID NO: 4844378 - DNA, 16 bp, Homo sapiens
ttggagcagcaggcct

SEQ ID NO: 4844379 - DNA, 16 bp, Homo sapiens
ttggatggcttgtcta

SEQ ID NO: 4844380 - DNA, 19 bp, Homo sapiens
ttggcacttgccattccaa

SEQ ID NO: 4844381 - DNA, 23 bp, Homo sapiens
ttggcagtgggaatgttctttct

SEQ ID NO: 4844382 - DNA, 16 bp, Homo sapiens
ttggcattctttgcaa

SEQ ID NO: 4844383 - DNA, 11 bp, Homo sapiens
ttggccaatta

SEQ ID NO: 4844384 - DNA, 20 bp, Homo sapiens
ttggcccccttcaggagcct

SEQ ID NO: 4844385 - DNA, 19 bp, Homo sapiens
ttggcgtagcagagttaaa

SEQ ID NO: 4844386 - DNA, 12 bp, Homo sapiens
ttgggaaaacat

SEQ ID NO: 4844387 - DNA, 15 bp, Homo sapiens
ttgggaaaacatttg

SEQ ID NO: 4844388 - DNA, 15 bp, Homo sapiens
ttgggaaaggcaggg

SEQ ID NO: 4844389 - DNA, 13 bp, Homo sapiens
ttgggaaagtatt

SEQ ID NO: 4844390 - DNA, 23 bp, Homo sapiens
ttgggaatgaggaaaattcttaa

SEQ ID NO: 4844391 - DNA, 12 bp, Homo sapiens
ttgggagccagg

SEQ ID NO: 4844392 - DNA, 18 bp, Homo sapiens
ttgggagccaggactccc

SEQ ID NO: 4844393 - DNA, 23 bp, Homo sapiens
ttgggcctctcctgccctctgct

SEQ ID NO: 4844394 - DNA, 12 bp, Homo sapiens
ttggggaggcaa

SEQ ID NO: 4844395 - DNA, 12 bp, Homo sapiens
ttggggctcctt

SEQ ID NO: 4844396 - DNA, 23 bp, Homo sapiens
ttggggctcctttcccctctcat

SEQ ID NO: 4844397 - DNA, 17 bp, Homo sapiens
ttggtaaatgtttcttt

SEQ ID NO: 4844398 - DNA, 12 bp, Homo sapiens
ttggtatatttt

SEQ ID NO: 4844399 - DNA, 21 bp, Homo sapiens
ttggtctcccatatgcagaaa

SEQ ID NO: 4844400 - DNA, 17 bp, Homo sapiens
ttggttttcctgtggca

SEQ ID NO: 4844401 - DNA, 22 bp, Homo sapiens
ttgtaaaaatcttttgaagcat

SEQ ID NO: 4844402 - DNA, 16 bp, Homo sapiens
ttgtaattatgtaaat

SEQ ID NO: 4844403 - DNA, 21 bp, Homo sapiens
tgacagaggtttgaaggagaa

SEQ ID NO: 4844404 - DNA, 23 bp, Homo sapiens
tgacagaggtttgaaggagaatg

SEQ ID NO: 4844405 - DNA, 14 bp, Homo sapiens
tgacagctccggga

SEQ ID NO: 4844406 - DNA, 13 bp, Homo sapiens
tgacaggccttcc

SEQ ID NO: 4844407 - DNA, 15 bp, Homo sapiens
tgacaggccttcctc

SEQ ID NO: 4844408 - DNA, 14 bp, Homo sapiens
tgacagtgttttta

SEQ ID NO: 4844409 - DNA, 18 bp, Homo sapiens
tgacagttcccagagtgg

SEQ ID NO: 4844410 - DNA, 15 bp, Homo sapiens
tgacagtttttgaca

SEQ ID NO: 4844411 - DNA, 23 bp, Homo sapiens
tgacagtttttgacatttatatt

SEQ ID NO: 4844412 - DNA, 13 bp, Homo sapiens
tgacatacatatt

SEQ ID NO: 4844413 - DNA, 16 bp, Homo sapiens
tgacatttatatattg

SEQ ID NO: 4844414 - DNA, 13 bp, Homo sapiens
tgacatttatatt

SEQ ID NO: 4844415 - DNA, 13 bp, Homo sapiens
tgacatttcttct

SEQ ID NO: 4844416 - DNA, 21 bp, Homo sapiens
tgacatttgggagacatgtga

SEQ ID NO: 4844417 - DNA, 16 bp, Homo sapiens
tgaccactctgtcttg

SEQ ID NO: 4844418 - DNA, 14 bp, Homo sapiens
tgaccagaaagctt

SEQ ID NO: 4844419 - DNA, 23 bp, Homo sapiens
tgaccagaaagcttcatccacag

SEQ ID NO: 4844420 - DNA, 20 bp, Homo sapiens
tgaccaggcttttgtagatg

SEQ ID NO: 4844421 - DNA, 15 bp, Homo sapiens
tgaccagtctgaccc

SEQ ID NO: 4844422 - DNA, 20 bp, Homo sapiens
tgaccccaagggggctgctg

SEQ ID NO: 4844423 - DNA, 23 bp, Homo sapiens
tgaccccaagggggctgctgctc

SEQ ID NO: 4844424 - DNA, 21 bp, Homo sapiens
tgaccctgggcagttccttac

SEQ ID NO: 4844425 - DNA, 13 bp, Homo sapiens
tgacctccagaag

SEQ ID NO: 4844426 - DNA, 20 bp, Homo sapiens
tgacctgaccccattcctga

SEQ ID NO: 4844427 - DNA, 22 bp, Homo sapiens
tgacctggcatctaattctgat

SEQ ID NO: 4844428 - DNA, 21 bp, Homo sapiens
tgactaacaggccaaagagtc

SEQ ID NO: 4844429 - DNA, 20 bp, Homo sapiens
tgactaactcaaatacacat

SEQ ID NO: 4844430 - DNA, 23 bp, Homo sapiens
tgactagaactcctgtcttcttt

SEQ ID NO: 4844431 - DNA, 17 bp, Homo sapiens
tgactaggttctgtaga

SEQ ID NO: 4844432 - DNA, 18 bp, Homo sapiens
tgactcagcatcacccac

SEQ ID NO: 4844433 - DNA, 19 bp, Homo sapiens
tgactcttatttatagaat

SEQ ID NO: 4844434 - DNA, 18 bp, Homo sapiens
tgactgaagaagatgagc

SEQ ID NO: 4844435 - DNA, 11 bp, Homo sapiens
tgactgtgtca

SEQ ID NO: 4844436 - DNA, 17 bp, Homo sapiens
tgacttaggtttcagga

SEQ ID NO: 4844437 - DNA, 21 bp, Homo sapiens
tgacttaggtttcaggaagtt

SEQ ID NO: 4844438 - DNA, 19 bp, Homo sapiens
tgacttatggcatgactct

SEQ ID NO: 4844439 - DNA, 18 bp, Homo sapiens
tgacttctcccctgccct

SEQ ID NO: 4844440 - DNA, 12 bp, Homo sapiens
tgacttgtatat

SEQ ID NO: 4844441 - DNA, 19 bp, Homo sapiens
tgacttgtatattttaaga

SEQ ID NO: 4844442 - DNA, 13 bp, Homo sapiens
tgactttccagaa

SEQ ID NO: 4844443 - DNA, 16 bp, Homo sapiens
tgacttttataaagca

SEQ ID NO: 4844444 - DNA, 18 bp, Homo sapiens
tgacttttataaagcatg

SEQ ID NO: 4844445 - DNA, 18 bp, Homo sapiens
tgagaaaaactaacttga

SEQ ID NO: 4844446 - DNA, 19 bp, Homo sapiens
tgagaagtacagggcagaa

SEQ ID NO: 4844447 - DNA, 18 bp, Homo sapiens
tgagaatggcctggagca

SEQ ID NO: 4844448 - DNA, 23 bp, Homo sapiens
tgagaatggcctggagcaggccc

SEQ ID NO: 4844449 - DNA, 15 bp, Homo sapiens
tgagaattgagggga

SEQ ID NO: 4844450 - DNA, 15 bp, Homo sapiens
tgagagcataattta

SEQ ID NO: 4844451 - DNA, 23 bp, Homo sapiens
tgagagcccattcccaccattct

SEQ ID NO: 4844452 - DNA, 20 bp, Homo sapiens
tgagaggaggacttggttga

SEQ ID NO: 4844453 - DNA, 14 bp, Homo sapiens
tgagagtagggccc

SEQ ID NO: 4844454 - DNA, 17 bp, Homo sapiens
tgagagtagggccctga

SEQ ID NO: 4844455 - DNA, 19 bp, Homo sapiens
tgagagttccggggagaaa

SEQ ID NO: 4844456 - DNA, 16 bp, Homo sapiens
tgagatactgtgtata

SEQ ID NO: 4844457 - DNA, 16 bp, Homo sapiens
tgagattctgaagtat

SEQ ID NO: 4844458 - DNA, 22 bp, Homo sapiens
tgagattggttttcctgtggca

SEQ ID NO: 4844459 - DNA, 18 bp, Homo sapiens
tgagcaagcaccaacctc

SEQ ID NO: 4844460 - DNA, 23 bp, Homo sapiens
tgagcaagcaccaacctccagac

SEQ ID NO: 4844461 - DNA, 13 bp, Homo sapiens
tgagcacaaagaa

SEQ ID NO: 4844462 - DNA, 16 bp, Homo sapiens
tgagcacaaagaagaa

SEQ ID NO: 4844463 - DNA, 21 bp, Homo sapiens
tgagcaggaaagactggccct

SEQ ID NO: 4844464 - DNA, 14 bp, Homo sapiens
tgagcagggatctg

SEQ ID NO: 4844465 - DNA, 21 bp, Homo sapiens
tgagcagtgttggagtgagga

SEQ ID NO: 4844466 - DNA, 20 bp, Homo sapiens
tgagcatagagaacaaagta

SEQ ID NO: 4844467 - DNA, 14 bp, Homo sapiens
tgagcatggggcca

SEQ ID NO: 4844468 - DNA, 15 bp, Homo sapiens
tgagcatggggccag

SEQ ID NO: 4844469 - DNA, 20 bp, Homo sapiens
tgagccaaatttcttttgct

SEQ ID NO: 4844470 - DNA, 22 bp, Homo sapiens
tgagccttgcagatatctgcat

SEQ ID NO: 4844471 - DNA, 12 bp, Homo sapiens
tgagctctgaaa

SEQ ID NO: 4844472 - DNA, 16 bp, Homo sapiens
tgagctctgaaatctt

SEQ ID NO: 4844473 - DNA, 15 bp, Homo sapiens
tgaggacccagagct

SEQ ID NO: 4844474 - DNA, 17 bp, Homo sapiens
tgaggagagaggaggaa

SEQ ID NO: 4844475 - DNA, 15 bp, Homo sapiens
tgaggagtaaaattc

SEQ ID NO: 4844476 - DNA, 14 bp, Homo sapiens
tgaggataggacag

SEQ ID NO: 4844477 - DNA, 18 bp, Homo sapiens
tgaggatattcagatgta

SEQ ID NO: 4844478 - DNA, 15 bp, Homo sapiens
tgaggatccagggca

SEQ ID NO: 4844479 - DNA, 17 bp, Homo sapiens
tgaggatccagggcagc

SEQ ID NO: 4844480 - DNA, 18 bp, Homo sapiens
tgaggatccagggcagca

SEQ ID NO: 4844481 - DNA, 21 bp, Homo sapiens
tgaggatccagggcagcaggc

SEQ ID NO: 4844482 - DNA, 22 bp, Homo sapiens
tgaggatccagggcagcaggcc

SEQ ID NO: 4844483 - DNA, 13 bp, Homo sapiens
tgaggcaaacagc

SEQ ID NO: 4844484 - DNA, 13 bp, Homo sapiens
tgaggcccagaga

SEQ ID NO: 4844485 - DNA, 18 bp, Homo sapiens
tgaggcccagagagggaa

SEQ ID NO: 4844486 - DNA, 15 bp, Homo sapiens
tgaggctgagaaagc

SEQ ID NO: 4844487 - DNA, 14 bp, Homo sapiens
tgaggggaggtggc

SEQ ID NO: 4844488 - DNA, 16 bp, Homo sapiens
tgaggtgaactccagg

SEQ ID NO: 4844489 - DNA, 21 bp, Homo sapiens
tgaggtgaactccaggcatgt

SEQ ID NO: 4844490 - DNA, 18 bp, Homo sapiens
tgagtccttgatttcaaa

SEQ ID NO: 4844491 - DNA, 12 bp, Homo sapiens
tgagtggcctgc

SEQ ID NO: 4844492 - DNA, 16 bp, Homo sapiens
tgagttaacaggacag

SEQ ID NO: 4844493 - DNA, 21 bp, Homo sapiens
tgagttatcatgaattttaaa

SEQ ID NO: 4844494 - DNA, 16 bp, Homo sapiens
tgagttccagttgaag

SEQ ID NO: 4844495 - DNA, 17 bp, Homo sapiens
tgataaaggaaatagga

SEQ ID NO: 4844496 - DNA, 17 bp, Homo sapiens
tgataacttggggaggc

SEQ ID NO: 4844497 - DNA, 19 bp, Homo sapiens
tgataacttggggaggcaa

SEQ ID NO: 4844498 - DNA, 16 bp, Homo sapiens
tgataagggaaaagat

SEQ ID NO: 4844499 - DNA, 22 bp, Homo sapiens
tgataccattctattctccaga

SEQ ID NO: 4844500 - DNA, 23 bp, Homo sapiens
tgataccattctattctccagac

SEQ ID NO: 4844501 - DNA, 15 bp, Homo sapiens
tgatactaccagggt

SEQ ID NO: 4844502 - DNA, 17 bp, Homo sapiens
tgatactaccagggtct

SEQ ID NO: 4844503 - DNA, 19 bp, Homo sapiens
tgatataaatcagattctt

SEQ ID NO: 4844504 - DNA, 20 bp, Homo sapiens
tgatataccaaattaaaaaa

SEQ ID NO: 4844505 - DNA, 19 bp, Homo sapiens
tgatcccttgagatatgga

SEQ ID NO: 4844506 - DNA, 18 bp, Homo sapiens
tgatgaggacccagagct

SEQ ID NO: 4844507 - DNA, 13 bp, Homo sapiens
tgatgctttggaa

SEQ ID NO: 4844508 - DNA, 14 bp, Homo sapiens
tgatgctttggaag

SEQ ID NO: 4844509 - DNA, 22 bp, Homo sapiens
tgatgctttggaagatgcagaa

SEQ ID NO: 4844510 - DNA, 15 bp, Homo sapiens
tgatggagccccagg

SEQ ID NO: 4844511 - DNA, 23 bp, Homo sapiens
tgatggagtgtgcagacagccat

SEQ ID NO: 4844512 - DNA, 17 bp, Homo sapiens
tgatgtacagattcttt

SEQ ID NO: 4844513 - DNA, 15 bp, Homo sapiens
tgatgtttaaagaga

SEQ ID NO: 4844514 - DNA, 14 bp, Homo sapiens
tgattactgcaatc

SEQ ID NO: 4844515 - DNA, 19 bp, Homo sapiens
tgattactgcaatcactgt

SEQ ID NO: 4844516 - DNA, 13 bp, Homo sapiens
tgattcattctga

SEQ ID NO: 4844517 - DNA, 15 bp, Homo sapiens
tgattgggaaaacat

SEQ ID NO: 4844518 - DNA, 21 bp, Homo sapiens
tgattgggaaaacatttgctg

SEQ ID NO: 4844519 - DNA, 20 bp, Homo sapiens
tgatttcaaagttttgttgt

SEQ ID NO: 4844520 - DNA, 22 bp, Homo sapiens
tgatttcttaggggaaggagaa

SEQ ID NO: 4844521 - DNA, 13 bp, Homo sapiens
tgatttggggtga

SEQ ID NO: 4844522 - DNA, 17 bp, Homo sapiens
tgattttttttaattac

SEQ ID NO: 4844523 - DNA, 22 bp, Homo sapiens
aaagcataaagctcaaatgaaa

SEQ ID NO: 4844524 - DNA, 18 bp, Homo sapiens
aaagccatgccaataaag

SEQ ID NO: 4844525 - DNA, 22 bp, Homo sapiens
aaagccatgccaataaagtgat

SEQ ID NO: 4844526 - DNA, 18 bp, Homo sapiens
aaagcctgggtgacattt

SEQ ID NO: 4844527 - DNA, 20 bp, Homo sapiens
aaagctggtggcagagtcct

SEQ ID NO: 4844528 - DNA, 23 bp, Homo sapiens
aaagctttcatgtcccagaactt

SEQ ID NO: 4844529 - DNA, 22 bp, Homo sapiens
aaaggataaagaaggatgatgt

SEQ ID NO: 4844530 - DNA, 12 bp, Homo sapiens
aaaggatgtgat

SEQ ID NO: 4844531 - DNA, 17 bp, Homo sapiens
aaaggatgtgatatata

SEQ ID NO: 4844532 - DNA, 13 bp, Homo sapiens
aaaggcagggccc

SEQ ID NO: 4844533 - DNA, 14 bp, Homo sapiens
aaagggagtttttg

SEQ ID NO: 4844534 - DNA, 13 bp, Homo sapiens
aaagggatatttt

SEQ ID NO: 4844535 - DNA, 19 bp, Homo sapiens
aaagggcccaatgaattat

SEQ ID NO: 4844536 - DNA, 16 bp, Homo sapiens
aaaggtaatgtgtgga

SEQ ID NO: 4844537 - DNA, 20 bp, Homo sapiens
aaaggtattatacatgtgat

SEQ ID NO: 4844538 - DNA, 16 bp, Homo sapiens
aaaggtgcactccaga

SEQ ID NO: 4844539 - DNA, 17 bp, Homo sapiens
aaaggtgtgaggagaga

SEQ ID NO: 4844540 - DNA, 20 bp, Homo sapiens
aaaggtttaagaaatagaat

SEQ ID NO: 4844541 - DNA, 21 bp, Homo sapiens
aaagtaaggtgcttggagttt

SEQ ID NO: 4844542 - DNA, 13 bp, Homo sapiens
aaagtacagaatt

SEQ ID NO: 4844543 - DNA, 22 bp, Homo sapiens
aaagtataatgtttattaaatg

SEQ ID NO: 4844544 - DNA, 13 bp, Homo sapiens
aaagtcagaagtt

SEQ ID NO: 4844545 - DNA, 23 bp, Homo sapiens
aaagtcagttgctcaaaaagaaa

SEQ ID NO: 4844546 - DNA, 19 bp, Homo sapiens
aaagtctccagaagaaaat

SEQ ID NO: 4844547 - DNA, 23 bp, Homo sapiens
aaagtctgctctcatataagaca

SEQ ID NO: 4844548 - DNA, 15 bp, Homo sapiens
aaagtggaagtatgt

SEQ ID NO: 4844549 - DNA, 21 bp, Homo sapiens
aaagtgtgaaataaatttttt

SEQ ID NO: 4844550 - DNA, 21 bp, Homo sapiens
aaagtgtgtatatattttgtg

SEQ ID NO: 4844551 - DNA, 12 bp, Homo sapiens
aaagttaacatt

SEQ ID NO: 4844552 - DNA, 15 bp, Homo sapiens
aaagttctcaatgta

SEQ ID NO: 4844553 - DNA, 17 bp, Homo sapiens
aaagtttggttttgaca

SEQ ID NO: 4844554 - DNA, 14 bp, Homo sapiens
aaataaaatatatc

SEQ ID NO: 4844555 - DNA, 22 bp, Homo sapiens
aaataaaccaaaggaaaatgtc

SEQ ID NO: 4844556 - DNA, 22 bp, Homo sapiens
aaataaagaacaattgttagat

SEQ ID NO: 4844557 - DNA, 14 bp, Homo sapiens
aaataaataatttt

SEQ ID NO: 4844558 - DNA, 20 bp, Homo sapiens
aaataacctaattaatatat

SEQ ID NO: 4844559 - DNA, 14 bp, Homo sapiens
aaataactgaattt

SEQ ID NO: 4844560 - DNA, 20 bp, Homo sapiens
aaataatgctacaattttaa

SEQ ID NO: 4844561 - DNA, 15 bp, Homo sapiens
aaataatttgaactt

SEQ ID NO: 4844562 - DNA, 20 bp, Homo sapiens
aaataatttgaactttggaa

SEQ ID NO: 4844563 - DNA, 22 bp, Homo sapiens
aaatacacatttgctactgttg

SEQ ID NO: 4844564 - DNA, 19 bp, Homo sapiens
aaatacgtttgtgtttcta

SEQ ID NO: 4844565 - DNA, 19 bp, Homo sapiens
aaatagacaaaaagtatat

SEQ ID NO: 4844566 - DNA, 19 bp, Homo sapiens
aaataggaatcattcagaa

SEQ ID NO: 4844567 - DNA, 19 bp, Homo sapiens
aaataggatctccactgga

SEQ ID NO: 4844568 - DNA, 19 bp, Homo sapiens
aaatagtatgaaaatggaa

SEQ ID NO: 4844569 - DNA, 16 bp, Homo sapiens
aaatataacacatttt

SEQ ID NO: 4844570 - DNA, 17 bp, Homo sapiens
aaatataacacattttt

SEQ ID NO: 4844571 - DNA, 12 bp, Homo sapiens
aaatatcaaagt

SEQ ID NO: 4844572 - DNA, 21 bp, Homo sapiens
aaatatcaaagtcattaaaga

SEQ ID NO: 4844573 - DNA, 23 bp, Homo sapiens
aaatatcccttggacattttatg

SEQ ID NO: 4844574 - DNA, 16 bp, Homo sapiens
aaatattcctttgcat

SEQ ID NO: 4844575 - DNA, 15 bp, Homo sapiens
aaatcaatagttgaa

SEQ ID NO: 4844576 - DNA, 17 bp, Homo sapiens
aaatccctgcctcaggc

SEQ ID NO: 4844577 - DNA, 16 bp, Homo sapiens
aaatctgaacattctc

SEQ ID NO: 4844578 - DNA, 14 bp, Homo sapiens
aaatgaaagaaaat

SEQ ID NO: 4844579 - DNA, 13 bp, Homo sapiens
aaatgaaagctac

SEQ ID NO: 4844580 - DNA, 14 bp, Homo sapiens
aaatgaaagctact

SEQ ID NO: 4844581 - DNA, 12 bp, Homo sapiens
aaatgaactttg

SEQ ID NO: 4844582 - DNA, 17 bp, Homo sapiens
aaatgaagatctttata

SEQ ID NO: 4844583 - DNA, 19 bp, Homo sapiens
aaatgaagatctttatatt

SEQ ID NO: 4844584 - DNA, 14 bp, Homo sapiens
aaatgccccagtgt

SEQ ID NO: 4844585 - DNA, 23 bp, Homo sapiens
aaatgcttcatttgtatgtcaaa

SEQ ID NO: 4844586 - DNA, 12 bp, Homo sapiens
aaatggaaattt

SEQ ID NO: 4844587 - DNA, 23 bp, Homo sapiens
aaatggaggatctctaaagagca

SEQ ID NO: 4844588 - DNA, 19 bp, Homo sapiens
aaatggggaactcccccag

SEQ ID NO: 4844589 - DNA, 23 bp, Homo sapiens
aaatggtcctatttttgtgaaga

SEQ ID NO: 4844590 - DNA, 13 bp, Homo sapiens
aaatgtaatttaa

SEQ ID NO: 4844591 - DNA, 19 bp, Homo sapiens
aaatgtaatttaaatgaaa

SEQ ID NO: 4844592 - DNA, 19 bp, Homo sapiens
aaatgtataaatatacagt

SEQ ID NO: 4844593 - DNA, 21 bp, Homo sapiens
aaatgtataaatatacagtat

SEQ ID NO: 4844594 - DNA, 13 bp, Homo sapiens
aaatgtatgcatt

SEQ ID NO: 4844595 - DNA, 22 bp, Homo sapiens
aaatgtggtctgccaatctgta

SEQ ID NO: 4844596 - DNA, 16 bp, Homo sapiens
aaatgtgtaataatgt

SEQ ID NO: 4844597 - DNA, 18 bp, Homo sapiens
aaatgttaaaagttttat

SEQ ID NO: 4844598 - DNA, 10 bp, Homo sapiens
aaatgtttct

SEQ ID NO: 4844599 - DNA, 11 bp, Homo sapiens
aaatgtttctt

SEQ ID NO: 4844600 - DNA, 16 bp, Homo sapiens
aaattaagcaaatgtt

SEQ ID NO: 4844601 - DNA, 23 bp, Homo sapiens
aaattatatattgcaaggtgtga

SEQ ID NO: 4844602 - DNA, 21 bp, Homo sapiens
aaattatgcaattcagtgttc

SEQ ID NO: 4844603 - DNA, 17 bp, Homo sapiens
aaattatttgattattt

SEQ ID NO: 4844604 - DNA, 21 bp, Homo sapiens
aaattcaaagcatggacattt

SEQ ID NO: 4844605 - DNA, 16 bp, Homo sapiens
aaattcaactttgtaa

SEQ ID NO: 4844606 - DNA, 21 bp, Homo sapiens
aaattcatggcatgcttaaat

SEQ ID NO: 4844607 - DNA, 21 bp, Homo sapiens
aaattcccttttcaccttttc

SEQ ID NO: 4844608 - DNA, 19 bp, Homo sapiens
aaattgagttgcacttatt

SEQ ID NO: 4844609 - DNA, 14 bp, Homo sapiens
aaattgcatacttt

SEQ ID NO: 4844610 - DNA, 15 bp, Homo sapiens
aaattgcatactttg

SEQ ID NO: 4844611 - DNA, 19 bp, Homo sapiens
aaattgttatcaaaatagt

SEQ ID NO: 4844612 - DNA, 17 bp, Homo sapiens
aaatttgccaatctttc

SEQ ID NO: 4844613 - DNA, 12 bp, Homo sapiens
aaattttaaagc

SEQ ID NO: 4844614 - DNA, 19 bp, Homo sapiens
aaatttttttttaaagcag

SEQ ID NO: 4844615 - DNA, 16 bp, Homo sapiens
aacaaacaaaactctt

SEQ ID NO: 4844616 - DNA, 12 bp, Homo sapiens
aacaaacaagcc

SEQ ID NO: 4844617 - DNA, 22 bp, Homo sapiens
aacaatggtgtggtgaatgtgt

SEQ ID NO: 4844618 - DNA, 14 bp, Homo sapiens
aacactatttgtga

SEQ ID NO: 4844619 - DNA, 15 bp, Homo sapiens
aacactatttgtgac

SEQ ID NO: 4844620 - DNA, 14 bp, Homo sapiens
aacactgtgaccag

SEQ ID NO: 4844621 - DNA, 15 bp, Homo sapiens
aacactgtgaccagg

SEQ ID NO: 4844622 - DNA, 17 bp, Homo sapiens
aacagactgttgagtta

SEQ ID NO: 4844623 - DNA, 19 bp, Homo sapiens
aacagagactgaatagata

SEQ ID NO: 4844624 - DNA, 17 bp, Homo sapiens
aacagccttagagctct

SEQ ID NO: 4844625 - DNA, 20 bp, Homo sapiens
aacagccttagagctcttgt

SEQ ID NO: 4844626 - DNA, 15 bp, Homo sapiens
aacagggttggcatt

SEQ ID NO: 4844627 - DNA, 20 bp, Homo sapiens
aacagtgaagttttactgtc

SEQ ID NO: 4844628 - DNA, 21 bp, Homo sapiens
aacataactcacacccctgcc

SEQ ID NO: 4844629 - DNA, 19 bp, Homo sapiens
aacatatatttattgagta

SEQ ID NO: 4844630 - DNA, 23 bp, Homo sapiens
aacatctccatggggaggcctca

SEQ ID NO: 4844631 - DNA, 20 bp, Homo sapiens
aacatgggctgtgattactg

SEQ ID NO: 4844632 - DNA, 22 bp, Homo sapiens
aacatgggctgtgattactgca

SEQ ID NO: 4844633 - DNA, 20 bp, Homo sapiens
aacatgttaatgacaatatt

SEQ ID NO: 4844634 - DNA, 20 bp, Homo sapiens
aacatgttcccaaggcccca

SEQ ID NO: 4844635 - DNA, 23 bp, Homo sapiens
aacatgttcccaaggccccactt

SEQ ID NO: 4844636 - DNA, 16 bp, Homo sapiens
aacatgtttaatgggt

SEQ ID NO: 4844637 - DNA, 18 bp, Homo sapiens
aacattctcctgtggaag

SEQ ID NO: 4844638 - DNA, 15 bp, Homo sapiens
aacatttatatgtag

SEQ ID NO: 4844639 - DNA, 17 bp, Homo sapiens
aacattttaagttttac

SEQ ID NO: 4844640 - DNA, 19 bp, Homo sapiens
aaccacacttgaaaccttt

SEQ ID NO: 4844641 - DNA, 12 bp, Homo sapiens
aaccactagaaa

SEQ ID NO: 4844642 - DNA, 17 bp, Homo sapiens
aaactcaggcaaagaaa

SEQ ID NO: 4844643 - DNA, 19 bp, Homo sapiens
aaactcaggcaaagaaaat

SEQ ID NO: 4844644 - DNA, 10 bp, Homo sapiens
aaactccagg

SEQ ID NO: 4844645 - DNA, 11 bp, Homo sapiens
aaactccaggc

SEQ ID NO: 4844646 - DNA, 20 bp, Homo sapiens
aaacttcatgtaattttatt

SEQ ID NO: 4844647 - DNA, 17 bp, Homo sapiens
aaacttccaaagaaagt

SEQ ID NO: 4844648 - DNA, 20 bp, Homo sapiens
aaactttgggaaaacatgtt

SEQ ID NO: 4844649 - DNA, 21 bp, Homo sapiens
aaagaaaaaaaaaaaagccag

SEQ ID NO: 4844650 - DNA, 14 bp, Homo sapiens
aaagaaaacaaaaa

SEQ ID NO: 4844651 - DNA, 12 bp, Homo sapiens
aaagaaaattga

SEQ ID NO: 4844652 - DNA, 13 bp, Homo sapiens
aaagaaaattgag

SEQ ID NO: 4844653 - DNA, 12 bp, Homo sapiens
aaagaaaggaaa

SEQ ID NO: 4844654 - DNA, 13 bp, Homo sapiens
aaagaaataaacc

SEQ ID NO: 4844655 - DNA, 14 bp, Homo sapiens
aaagacactgcaga

SEQ ID NO: 4844656 - DNA, 14 bp, Homo sapiens
aaagaccagaaatt

SEQ ID NO: 4844657 - DNA, 19 bp, Homo sapiens
aaagactggatttgcagaa

SEQ ID NO: 4844658 - DNA, 12 bp, Homo sapiens
aaagactggccc

SEQ ID NO: 4844659 - DNA, 11 bp, Homo sapiens
aaagagaaaga

SEQ ID NO: 4844660 - DNA, 20 bp, Homo sapiens
aaagagaatgagtccttgat

SEQ ID NO: 4844661 - DNA, 18 bp, Homo sapiens
aaagagagaaacactgaa

SEQ ID NO: 4844662 - DNA, 15 bp, Homo sapiens
aaagagcatcctgat

SEQ ID NO: 4844663 - DNA, 20 bp, Homo sapiens
aaagagctaggaaccctgga

SEQ ID NO: 4844664 - DNA, 13 bp, Homo sapiens
aaagagtcagaca

SEQ ID NO: 4844665 - DNA, 21 bp, Homo sapiens
aaagagttgggtgtctcctta

SEQ ID NO: 4844666 - DNA, 14 bp, Homo sapiens
aaagagtttgaaac

SEQ ID NO: 4844667 - DNA, 11 bp, Homo sapiens
aaagatgagtt

SEQ ID NO: 4844668 - DNA, 17 bp, Homo sapiens
aaagatggttaaacatt

SEQ ID NO: 4844669 - DNA, 23 bp, Homo sapiens
aaagcactggccttgcctccagg

SEQ ID NO: 4844670 - DNA, 12 bp, Homo sapiens
aaagcagttcct

SEQ ID NO: 4844671 - DNA, 21 bp, Homo sapiens
aaagcagttcctgtcccacat

SEQ ID NO: 4844672 - DNA, 15 bp, Homo sapiens
aaagcatggacattt

SEQ ID NO: 4844673 - DNA, 18 bp, Homo sapiens
aaagccacagcagagcat

SEQ ID NO: 4844674 - DNA, 16 bp, Homo sapiens
aaagccaggctcagga

SEQ ID NO: 4844675 - DNA, 12 bp, Homo sapiens
aaagcctgctca

SEQ ID NO: 4844676 - DNA, 14 bp, Homo sapiens
aaagctcaaatgaa

SEQ ID NO: 4844677 - DNA, 19 bp, Homo sapiens
aaagctcaaatgaaatgta

SEQ ID NO: 4844678 - DNA, 18 bp, Homo sapiens
aaagctgcaaaaattata

SEQ ID NO: 4844679 - DNA, 13 bp, Homo sapiens
aaaggaaaagaaa

SEQ ID NO: 4844680 - DNA, 15 bp, Homo sapiens
aaaggaaagctgtgt

SEQ ID NO: 4844681 - DNA, 14 bp, Homo sapiens
aaaggatgtgatat

SEQ ID NO: 4844682 - DNA, 19 bp, Homo sapiens
aaaggatgtgatatataag

SEQ ID NO: 4844683 - DNA, 23 bp, Homo sapiens
aaaggatgtgatatataagtgta

SEQ ID NO: 4844684 - DNA, 11 bp, Homo sapiens
aaaggcagggc

SEQ ID NO: 4844685 - DNA, 15 bp, Homo sapiens
aaaggcatgtacaaa

SEQ ID NO: 4844686 - DNA, 15 bp, Homo sapiens
aaagggagtttttga

SEQ ID NO: 4844687 - DNA, 18 bp, Homo sapiens
aaaggtgcactccagact

SEQ ID NO: 4844688 - DNA, 12 bp, Homo sapiens
aaaggtggtggt

SEQ ID NO: 4844689 - DNA, 15 bp, Homo sapiens
aaaggtgtgaggaga

SEQ ID NO: 4844690 - DNA, 18 bp, Homo sapiens
aaagtaaatacatgcata

SEQ ID NO: 4844691 - DNA, 16 bp, Homo sapiens
aaagtaactgtgagaa

SEQ ID NO: 4844692 - DNA, 15 bp, Homo sapiens
aaagtacagaatttg

SEQ ID NO: 4844693 - DNA, 22 bp, Homo sapiens
aaagtacattctggggaaacaa

SEQ ID NO: 4844694 - DNA, 20 bp, Homo sapiens
aaagtataatgtttattaaa

SEQ ID NO: 4844695 - DNA, 14 bp, Homo sapiens
aaagtatgcattat

SEQ ID NO: 4844696 - DNA, 15 bp, Homo sapiens
aaagtatttactttt

SEQ ID NO: 4844697 - DNA, 17 bp, Homo sapiens
aaagtcaccaaatagtg

SEQ ID NO: 4844698 - DNA, 16 bp, Homo sapiens
aaagtcattaaagaca

SEQ ID NO: 4844699 - DNA, 22 bp, Homo sapiens
aaagtcctcctttcattaccct

SEQ ID NO: 4844700 - DNA, 15 bp, Homo sapiens
aaagtgcctgggctc

SEQ ID NO: 4844701 - DNA, 15 bp, Homo sapiens
aaagttaacattaat

SEQ ID NO: 4844702 - DNA, 14 bp, Homo sapiens
aaagttttgttgta

SEQ ID NO: 4844703 - DNA, 14 bp, Homo sapiens
aaagtttttgtttg

SEQ ID NO: 4844704 - DNA, 15 bp, Homo sapiens
aaatacacatttgct

SEQ ID NO: 4844705 - DNA, 19 bp, Homo sapiens
aaatacatgccacatcaaa

SEQ ID NO: 4844706 - DNA, 23 bp, Homo sapiens
aaatacatgccacatcaaacctt

SEQ ID NO: 4844707 - DNA, 18 bp, Homo sapiens
aaatagacaaaaagtata

SEQ ID NO: 4844708 - DNA, 19 bp, Homo sapiens
aaatagattcagagaaatt

SEQ ID NO: 4844709 - DNA, 18 bp, Homo sapiens
aaatagtgtgaaatatat

SEQ ID NO: 4844710 - DNA, 22 bp, Homo sapiens
aaatagttgcatagcagtatat

SEQ ID NO: 4844711 - DNA, 15 bp, Homo sapiens
aaatatagtgcaata

SEQ ID NO: 4844712 - DNA, 14 bp, Homo sapiens
aaatatttctcaac

SEQ ID NO: 4844713 - DNA, 14 bp, Homo sapiens
aaatcactttcata

SEQ ID NO: 4844714 - DNA, 14 bp, Homo sapiens
aaatcagctttgta

SEQ ID NO: 4844715 - DNA, 21 bp, Homo sapiens
aaatcattcttactaaaaagt

SEQ ID NO: 4844716 - DNA, 15 bp, Homo sapiens
aaatctaagctgtgt

SEQ ID NO: 4844717 - DNA, 13 bp, Homo sapiens
aaatctgaacatt

SEQ ID NO: 4844718 - DNA, 17 bp, Homo sapiens
aaatcttttgaagcata

SEQ ID NO: 4844719 - DNA, 11 bp, Homo sapiens
aaatgaacttt

SEQ ID NO: 4844720 - DNA, 18 bp, Homo sapiens
aaatgaagatctttatat

SEQ ID NO: 4844721 - DNA, 22 bp, Homo sapiens
aaatgaggatccagggcagcag

SEQ ID NO: 4844722 - DNA, 15 bp, Homo sapiens
aaatgatttcacagt

SEQ ID NO: 4844723 - DNA, 21 bp, Homo sapiens
aaatgcagggaggggaggcag

SEQ ID NO: 4844724 - DNA, 20 bp, Homo sapiens
aaatgctcccacctgaattt

SEQ ID NO: 4844725 - DNA, 16 bp, Homo sapiens
aaatgcttcatttgta

SEQ ID NO: 4844726 - DNA, 19 bp, Homo sapiens
aaatgcttcatttgtatgt

SEQ ID NO: 4844727 - DNA, 20 bp, Homo sapiens
aaatggaggatctctaaaga

SEQ ID NO: 4844728 - DNA, 20 bp, Homo sapiens
aaatggtcctatttttgtga

SEQ ID NO: 4844729 - DNA, 21 bp, Homo sapiens
aaatggtcctatttttgtgaa

SEQ ID NO: 4844730 - DNA, 17 bp, Homo sapiens
aaatgtaatttaaatga

SEQ ID NO: 4844731 - DNA, 15 bp, Homo sapiens
aaatgtttcttttaa

SEQ ID NO: 4844732 - DNA, 18 bp, Homo sapiens
aaatgtttcttttaaaga

SEQ ID NO: 4844733 - DNA, 19 bp, Homo sapiens
aaatgtttcttttgtttgg

SEQ ID NO: 4844734 - DNA, 17 bp, Homo sapiens
aaattaaaaaaaaattg

SEQ ID NO: 4844735 - DNA, 22 bp, Homo sapiens
aaattaaaaaaaaattgtatct

SEQ ID NO: 4844736 - DNA, 13 bp, Homo sapiens
aaattaagcaaat

SEQ ID NO: 4844737 - DNA, 18 bp, Homo sapiens
aaattacctgtggatatt

SEQ ID NO: 4844738 - DNA, 19 bp, Homo sapiens
aaattagatcctaagatgt

SEQ ID NO: 4844739 - DNA, 16 bp, Homo sapiens
aaattcaccttcccct

SEQ ID NO: 4844740 - DNA, 11 bp, Homo sapiens
aaattcctgta

SEQ ID NO: 4844741 - DNA, 12 bp, Homo sapiens
aaattgcatact

SEQ ID NO: 4844742 - DNA, 12 bp, Homo sapiens
aaattgcttttt

SEQ ID NO: 4844743 - DNA, 21 bp, Homo sapiens
aaatttaataccagatacctt

SEQ ID NO: 4844744 - DNA, 18 bp, Homo sapiens
aaatttctgtaaaacagg

SEQ ID NO: 4844745 - DNA, 20 bp, Homo sapiens
aaatttgccaatctttccta

SEQ ID NO: 4844746 - DNA, 10 bp, Homo sapiens
aaattttaaa

SEQ ID NO: 4844747 - DNA, 22 bp, Homo sapiens
aaattttaaagccattctgatt

SEQ ID NO: 4844748 - DNA, 15 bp, Homo sapiens
aacaaacaaaactct

SEQ ID NO: 4844749 - DNA, 12 bp, Homo sapiens
aacaaagtaaaa

SEQ ID NO: 4844750 - DNA, 16 bp, Homo sapiens
aacaatggtgtggtga

SEQ ID NO: 4844751 - DNA, 17 bp, Homo sapiens
aacactttgctaggaga

SEQ ID NO: 4844752 - DNA, 13 bp, Homo sapiens
aacagacacaatt

SEQ ID NO: 4844753 - DNA, 13 bp, Homo sapiens
aacagccaagctg

SEQ ID NO: 4844754 - DNA, 19 bp, Homo sapiens
aacaggaaagagctaggaa

SEQ ID NO: 4844755 - DNA, 19 bp, Homo sapiens
aacaggttataacagtgtt

SEQ ID NO: 4844756 - DNA, 21 bp, Homo sapiens
aacagtgaagttttactgtct

SEQ ID NO: 4844757 - DNA, 21 bp, Homo sapiens
aacatagcagatctgttttgt

SEQ ID NO: 4844758 - DNA, 13 bp, Homo sapiens
aacatatgttgca

SEQ ID NO: 4844759 - DNA, 19 bp, Homo sapiens
aacatgggctgtgattact

SEQ ID NO: 4844760 - DNA, 15 bp, Homo sapiens
aagcctactatttaa

SEQ ID NO: 4844761 - DNA, 19 bp, Homo sapiens
aagcctccaagcctgcctc

SEQ ID NO: 4844762 - DNA, 13 bp, Homo sapiens
aagcctgcctccc

SEQ ID NO: 4844763 - DNA, 22 bp, Homo sapiens
aagccttcaaaactatagcttg

SEQ ID NO: 4844764 - DNA, 17 bp, Homo sapiens
aagctcaaatgaaatgt

SEQ ID NO: 4844765 - DNA, 20 bp, Homo sapiens
aagctctctgtactaaggag

SEQ ID NO: 4844766 - DNA, 11 bp, Homo sapiens
aagctgaaatt

SEQ ID NO: 4844767 - DNA, 12 bp, Homo sapiens
aagctgaaattt

SEQ ID NO: 4844768 - DNA, 20 bp, Homo sapiens
aagctgaaattttagaaata

SEQ ID NO: 4844769 - DNA, 18 bp, Homo sapiens
aagctgatttttgtcttt

SEQ ID NO: 4844770 - DNA, 17 bp, Homo sapiens
aagctgcagagatttct

SEQ ID NO: 4844771 - DNA, 22 bp, Homo sapiens
aggagaagtcttctatttattt

SEQ ID NO: 4844772 - DNA, 11 bp, Homo sapiens
aggagaatggc

SEQ ID NO: 4844773 - DNA, 14 bp, Homo sapiens
aggagaatggcatg

SEQ ID NO: 4844774 - DNA, 21 bp, Homo sapiens
aggagaatggcatggcaggag

SEQ ID NO: 4844775 - DNA, 16 bp, Homo sapiens
aggagacaaaagagca

SEQ ID NO: 4844776 - DNA, 17 bp, Homo sapiens
aggagcacacatccaag

SEQ ID NO: 4844777 - DNA, 17 bp, Homo sapiens
aggagcatccttggcag

SEQ ID NO: 4844778 - DNA, 11 bp, Homo sapiens
aggagcctggc

SEQ ID NO: 4844779 - DNA, 16 bp, Homo sapiens
aggagcctggccaggc

SEQ ID NO: 4844780 - DNA, 18 bp, Homo sapiens
aggaggcacctacactca

SEQ ID NO: 4844781 - DNA, 15 bp, Homo sapiens
aggagggttggagtg

SEQ ID NO: 4844782 - DNA, 14 bp, Homo sapiens
aggagtctctgcca

SEQ ID NO: 4844783 - DNA, 20 bp, Homo sapiens
aggagtctctgccagttact

SEQ ID NO: 4844784 - DNA, 15 bp, Homo sapiens
aggatagagacttgc

SEQ ID NO: 4844785 - DNA, 14 bp, Homo sapiens
aggatccagggcag

SEQ ID NO: 4844786 - DNA, 21 bp, Homo sapiens
aggatccagggcagcaggcca

SEQ ID NO: 4844787 - DNA, 13 bp, Homo sapiens
aggatcctggcct

SEQ ID NO: 4844788 - DNA, 18 bp, Homo sapiens
aggatcctggcctgagaa

SEQ ID NO: 4844789 - DNA, 17 bp, Homo sapiens
aggatctctaaagagca

SEQ ID NO: 4844790 - DNA, 19 bp, Homo sapiens
aggatgaattgtcacatct

SEQ ID NO: 4844791 - DNA, 19 bp, Homo sapiens
aggatgcccagacatcagc

SEQ ID NO: 4844792 - DNA, 22 bp, Homo sapiens
aggatgctaacatctaaaaata

SEQ ID NO: 4844793 - DNA, 12 bp, Homo sapiens
aggcaaaaatgt

SEQ ID NO: 4844794 - DNA, 14 bp, Homo sapiens
aggcaagaaagctt

SEQ ID NO: 4844795 - DNA, 16 bp, Homo sapiens
aggcaagctgaaattt

SEQ ID NO: 4844796 - DNA, 15 bp, Homo sapiens
aggcacattaactgt

SEQ ID NO: 4844797 - DNA, 14 bp, Homo sapiens
aggcactgagcagg

SEQ ID NO: 4844798 - DNA, 16 bp, Homo sapiens
aggcagacaaccttgt

SEQ ID NO: 4844799 - DNA, 14 bp, Homo sapiens
aggcagagaaatct

SEQ ID NO: 4844800 - DNA, 18 bp, Homo sapiens
aggcagatgtttgcctca

SEQ ID NO: 4844801 - DNA, 16 bp, Homo sapiens
aggcagggccctgaaa

SEQ ID NO: 4844802 - DNA, 22 bp, Homo sapiens
aggcaggtgcttttggcagaga

SEQ ID NO: 4844803 - DNA, 21 bp, Homo sapiens
aggcatctgttagcagagtct

SEQ ID NO: 4844804 - DNA, 16 bp, Homo sapiens
aggcatgtacaaaaat

SEQ ID NO: 4844805 - DNA, 18 bp, Homo sapiens
aggcatgtacaaaaatta

SEQ ID NO: 4844806 - DNA, 14 bp, Homo sapiens
aggcattggatatt

SEQ ID NO: 4844807 - DNA, 11 bp, Homo sapiens
aggccagagaa

SEQ ID NO: 4844808 - DNA, 13 bp, Homo sapiens
aggccagagaaag

SEQ ID NO: 4844809 - DNA, 15 bp, Homo sapiens
aggccagagaaagca

SEQ ID NO: 4844810 - DNA, 14 bp, Homo sapiens
aggccagagaggga

SEQ ID NO: 4844811 - DNA, 16 bp, Homo sapiens
aggccagagagggaaa

SEQ ID NO: 4844812 - DNA, 16 bp, Homo sapiens
aggccagcagctgatg

SEQ ID NO: 4844813 - DNA, 13 bp, Homo sapiens
aggcccaatgctg

SEQ ID NO: 4844814 - DNA, 16 bp, Homo sapiens
aggcccagagagggaa

SEQ ID NO: 4844815 - DNA, 13 bp, Homo sapiens
aggcccatagcag

SEQ ID NO: 4844816 - DNA, 14 bp, Homo sapiens
aggccctgtgagca

SEQ ID NO: 4844817 - DNA, 18 bp, Homo sapiens
aggccctgtgagcacaaa

SEQ ID NO: 4844818 - DNA, 16 bp, Homo sapiens
aggccgccagcgtgtg

SEQ ID NO: 4844819 - DNA, 21 bp, Homo sapiens
aggccgccagcgtgtggagca

SEQ ID NO: 4844820 - DNA, 15 bp, Homo sapiens
aggcctccgttgtct

SEQ ID NO: 4844821 - DNA, 13 bp, Homo sapiens
aggcctctgggac

SEQ ID NO: 4844822 - DNA, 19 bp, Homo sapiens
aggcctctgggacccacag

SEQ ID NO: 4844823 - DNA, 23 bp, Homo sapiens
aggctaccaacttgtatccaggc

SEQ ID NO: 4844824 - DNA, 14 bp, Homo sapiens
aggctactgtaatg

SEQ ID NO: 4844825 - DNA, 15 bp, Homo sapiens
aggctactgtaatgc

SEQ ID NO: 4844826 - DNA, 23 bp, Homo sapiens
aggctactgtaatgctgcctcag

SEQ ID NO: 4844827 - DNA, 18 bp, Homo sapiens
aggctcaggagaagccag

SEQ ID NO: 4844828 - DNA, 17 bp, Homo sapiens
aggctccgggcaccagg

SEQ ID NO: 4844829 - DNA, 19 bp, Homo sapiens
aggctccgggcaccagggg

SEQ ID NO: 4844830 - DNA, 21 bp, Homo sapiens
aggctcctccttgcccagact

SEQ ID NO: 4844831 - DNA, 22 bp, Homo sapiens
aggctcctctaggccctgtgag

SEQ ID NO: 4844832 - DNA, 19 bp, Homo sapiens
aggctcttatgtgtgcctt

SEQ ID NO: 4844833 - DNA, 18 bp, Homo sapiens
aggctgagacagtgaatt

SEQ ID NO: 4844834 - DNA, 20 bp, Homo sapiens
aggctgggcctcccctgggc

SEQ ID NO: 4844835 - DNA, 18 bp, Homo sapiens
aggctggggacacaggat

SEQ ID NO: 4844836 - DNA, 22 bp, Homo sapiens
aggctggggacacaggatcctg

SEQ ID NO: 4844837 - DNA, 21 bp, Homo sapiens
aggcttgcccagtacatttaa

SEQ ID NO: 4844838 - DNA, 15 bp, Homo sapiens
agggaagaactattg

SEQ ID NO: 4844839 - DNA, 18 bp, Homo sapiens
agggaagatgacctgccc

SEQ ID NO: 4844840 - DNA, 15 bp, Homo sapiens
agggaatggccacaa

SEQ ID NO: 4844841 - DNA, 15 bp, Homo sapiens
agggacagcaagtga

SEQ ID NO: 4844842 - DNA, 23 bp, Homo sapiens
agggaccccagatacctgtgagg

SEQ ID NO: 4844843 - DNA, 22 bp, Homo sapiens
agggactacccatagacatgaa

SEQ ID NO: 4844844 - DNA, 13 bp, Homo sapiens
agggactccaagc

SEQ ID NO: 4844845 - DNA, 18 bp, Homo sapiens
agggactccaagccctgg

SEQ ID NO: 4844846 - DNA, 20 bp, Homo sapiens
agggactccaagccctgggg

SEQ ID NO: 4844847 - DNA, 22 bp, Homo sapiens
agggactccaagccctggggca

SEQ ID NO: 4844848 - DNA, 19 bp, Homo sapiens
agggagagagtagctgcag

SEQ ID NO: 4844849 - DNA, 18 bp, Homo sapiens
agggagcattgcagccta

SEQ ID NO: 4844850 - DNA, 16 bp, Homo sapiens
agggaggcagcctagc

SEQ ID NO: 4844851 - DNA, 17 bp, Homo sapiens
agggaggggccctgtca

SEQ ID NO: 4844852 - DNA, 22 bp, Homo sapiens
agggatctgcttgatatcccaa

SEQ ID NO: 4844853 - DNA, 17 bp, Homo sapiens
agggatgatgagggaag

SEQ ID NO: 4844854 - DNA, 13 bp, Homo sapiens
agggcagcaggcc

SEQ ID NO: 4844855 - DNA, 14 bp, Homo sapiens
agggcagcaggcca

SEQ ID NO: 4844856 - DNA, 15 bp, Homo sapiens
agggcagcaggccag

SEQ ID NO: 4844857 - DNA, 20 bp, Homo sapiens
agggcagcaggccagagaaa

SEQ ID NO: 4844858 - DNA, 19 bp, Homo sapiens
agggccctgaaatggcctg

SEQ ID NO: 4844859 - DNA, 18 bp, Homo sapiens
agggccctgacaggcctt

SEQ ID NO: 4844860 - DNA, 18 bp, Homo sapiens
agggccctggagctcagg

SEQ ID NO: 4844861 - DNA, 17 bp, Homo sapiens
agggctcgggagccatg

SEQ ID NO: 4844862 - DNA, 18 bp, Homo sapiens
agggctcggggtgtgtca

SEQ ID NO: 4844863 - DNA, 18 bp, Homo sapiens
agggctctccaagcacta

SEQ ID NO: 4844864 - DNA, 19 bp, Homo sapiens
agggctctccaagcactag

SEQ ID NO: 4844865 - DNA, 17 bp, Homo sapiens
aggggagccagctgctt

SEQ ID NO: 4844866 - DNA, 16 bp, Homo sapiens
aggggaggtggccagc

SEQ ID NO: 4844867 - DNA, 22 bp, Homo sapiens
aggggaggtggccagcccgcag

SEQ ID NO: 4844868 - DNA, 16 bp, Homo sapiens
aggggccaacctcagg

SEQ ID NO: 4844869 - DNA, 19 bp, Homo sapiens
aggggccatgtcctctctt

SEQ ID NO: 4844870 - DNA, 23 bp, Homo sapiens
aggggccctgtcactgtccagag

SEQ ID NO: 4844871 - DNA, 15 bp, Homo sapiens
aggggcctgggctgt

SEQ ID NO: 4844872 - DNA, 16 bp, Homo sapiens
aggggcctgggctgtg

SEQ ID NO: 4844873 - DNA, 14 bp, Homo sapiens
aggggcgcgggagg

SEQ ID NO: 4844874 - DNA, 21 bp, Homo sapiens
aggggctaccctgggaagctg

SEQ ID NO: 4844875 - DNA, 16 bp, Homo sapiens
aggggctctgtggcaa

SEQ ID NO: 4844876 - DNA, 21 bp, Homo sapiens
aggggcttaattattgatgtt

SEQ ID NO: 4844877 - DNA, 18 bp, Homo sapiens
agggggtatgcagagctt

SEQ ID NO: 4844878 - DNA, 23 bp, Homo sapiens
aggggtccctgcaaaactccagg

SEQ ID NO: 4844879 - DNA, 15 bp, Homo sapiens
aggggtgaggatagg

SEQ ID NO: 4844880 - DNA, 21 bp, Homo sapiens
aggggttccttccacttctgg

SEQ ID NO: 4844881 - DNA, 22 bp, Homo sapiens
agggtctaccaatacaaaatgt

SEQ ID NO: 4844882 - DNA, 15 bp, Homo sapiens
agggtctctcaggga

SEQ ID NO: 4844883 - DNA, 11 bp, Homo sapiens
agggtgggggg

SEQ ID NO: 4844884 - DNA, 14 bp, Homo sapiens
agggtggggggcca

SEQ ID NO: 4844885 - DNA, 16 bp, Homo sapiens
aggtagcactctcaga

SEQ ID NO: 4844886 - DNA, 18 bp, Homo sapiens
aggtagctggggagccct

SEQ ID NO: 4844887 - DNA, 15 bp, Homo sapiens
aggtatctagagctt

SEQ ID NO: 4844888 - DNA, 19 bp, Homo sapiens
aggtattaaaactaaattt

SEQ ID NO: 4844889 - DNA, 13 bp, Homo sapiens
aggtattatacat

SEQ ID NO: 4844890 - DNA, 19 bp, Homo sapiens
aggtcagttgtgtttttta

SEQ ID NO: 4844891 - DNA, 16 bp, Homo sapiens
atatatataaatgtat

SEQ ID NO: 4844892 - DNA, 19 bp, Homo sapiens
atatatcttataaagtgga

SEQ ID NO: 4844893 - DNA, 21 bp, Homo sapiens
atatatttattgagtacctac

SEQ ID NO: 4844894 - DNA, 22 bp, Homo sapiens
atatattttgtgtgaaattgca

SEQ ID NO: 4844895 - DNA, 21 bp, Homo sapiens
atatcaaagtcattaaagaca

SEQ ID NO: 4844896 - DNA, 21 bp, Homo sapiens
atatcatgagtgaataaatgt

SEQ ID NO: 4844897 - DNA, 20 bp, Homo sapiens
atatcccttggacattttat

SEQ ID NO: 4844898 - DNA, 18 bp, Homo sapiens
atatcctccttctcctgt

SEQ ID NO: 4844899 - DNA, 13 bp, Homo sapiens
atatctgcatgtg

SEQ ID NO: 4844900 - DNA, 14 bp, Homo sapiens
atatctgcatgtgt

SEQ ID NO: 4844901 - DNA, 13 bp, Homo sapiens
atatgaatgaaac

SEQ ID NO: 4844902 - DNA, 14 bp, Homo sapiens
atatgtatatatgt

SEQ ID NO: 4844903 - DNA, 14 bp, Homo sapiens
atatgtattctttt

SEQ ID NO: 4844904 - DNA, 18 bp, Homo sapiens
atatgtattcttttctca

SEQ ID NO: 4844905 - DNA, 20 bp, Homo sapiens
atatgtattcttttctcagt

SEQ ID NO: 4844906 - DNA, 16 bp, Homo sapiens
atatgtattttttgaa

SEQ ID NO: 4844907 - DNA, 19 bp, Homo sapiens
atatgtgctggaattctaa

SEQ ID NO: 4844908 - DNA, 17 bp, Homo sapiens
atattaaaaaagagaca

SEQ ID NO: 4844909 - DNA, 17 bp, Homo sapiens
atattaaataacatgtt

SEQ ID NO: 4844910 - DNA, 21 bp, Homo sapiens
atattaaataacatgtttctc

SEQ ID NO: 4844911 - DNA, 17 bp, Homo sapiens
atattactgacatttct

SEQ ID NO: 4844912 - DNA, 19 bp, Homo sapiens
atattataaaggataaaga

SEQ ID NO: 4844913 - DNA, 19 bp, Homo sapiens
atattcagggtaaatagga

SEQ ID NO: 4844914 - DNA, 16 bp, Homo sapiens
atattcctccagctgg

SEQ ID NO: 4844915 - DNA, 12 bp, Homo sapiens
atattcctttgc

SEQ ID NO: 4844916 - DNA, 22 bp, Homo sapiens
atattctttagcttacctgggc

SEQ ID NO: 4844917 - DNA, 14 bp, Homo sapiens
atattgacttgtat

SEQ ID NO: 4844918 - DNA, 21 bp, Homo sapiens
atattgattgggaaaacattt

SEQ ID NO: 4844919 - DNA, 12 bp, Homo sapiens
atattgtaatct

SEQ ID NO: 4844920 - DNA, 19 bp, Homo sapiens
atattgtaatctatgttta

SEQ ID NO: 4844921 - DNA, 21 bp, Homo sapiens
atatttcaataaatgatatat

SEQ ID NO: 4844922 - DNA, 20 bp, Homo sapiens
atatttgcaaagtgtattag

SEQ ID NO: 4844923 - DNA, 15 bp, Homo sapiens
atattttgaaatgaa

SEQ ID NO: 4844924 - DNA, 20 bp, Homo sapiens
atatttttaaaatatttatt

SEQ ID NO: 4844925 - DNA, 15 bp, Homo sapiens
atcaaacctttgagt

SEQ ID NO: 4844926 - DNA, 24 bp, Homo sapiens
atcaaagccggcctgagaaacact

SEQ ID NO: 4844927 - DNA, 19 bp, Homo sapiens
atcaaattctgtctgggga

SEQ ID NO: 4844928 - DNA, 18 bp, Homo sapiens
atcaagggaagaactatt

SEQ ID NO: 4844929 - DNA, 14 bp, Homo sapiens
atcaatagttgaat

SEQ ID NO: 4844930 - DNA, 15 bp, Homo sapiens
atcaatatgtatata

SEQ ID NO: 4844931 - DNA, 13 bp, Homo sapiens
atcacagggaatg

SEQ ID NO: 4844932 - DNA, 20 bp, Homo sapiens
atcactgccttcgtttatat

SEQ ID NO: 4844933 - DNA, 18 bp, Homo sapiens
atcactggactgcatggg

SEQ ID NO: 4844934 - DNA, 12 bp, Homo sapiens
atcactttcata

SEQ ID NO: 4844935 - DNA, 16 bp, Homo sapiens
atcagaactcttcctc

SEQ ID NO: 4844936 - DNA, 20 bp, Homo sapiens
atcagaactcttcctcctcc

SEQ ID NO: 4844937 - DNA, 14 bp, Homo sapiens
atcagcaaagaaaa

SEQ ID NO: 4844938 - DNA, 23 bp, Homo sapiens
atcagcaaagaaaaaaaaaaaag

SEQ ID NO: 4844939 - DNA, 22 bp, Homo sapiens
atcagtaacccccttaaattta

SEQ ID NO: 4844940 - DNA, 19 bp, Homo sapiens
atcagtaatgctaaatgtg

SEQ ID NO: 4844941 - DNA, 20 bp, Homo sapiens
atcagtaatgctaaatgtgt

SEQ ID NO: 4844942 - DNA, 21 bp, Homo sapiens
atcagtaatgctaaatgtgta

SEQ ID NO: 4844943 - DNA, 13 bp, Homo sapiens
atcataaagtcag

SEQ ID NO: 4844944 - DNA, 21 bp, Homo sapiens
atcatctcttcctcacaccca

SEQ ID NO: 4844945 - DNA, 16 bp, Homo sapiens
atcatgaatgctttta

SEQ ID NO: 4844946 - DNA, 14 bp, Homo sapiens
atcatgaattttaa

SEQ ID NO: 4844947 - DNA, 15 bp, Homo sapiens
atcatgaattttaaa

SEQ ID NO: 4844948 - DNA, 17 bp, Homo sapiens
atcatgaattttaaagt

SEQ ID NO: 4844949 - DNA, 18 bp, Homo sapiens
atcatgtgtagagcccct

SEQ ID NO: 4844950 - DNA, 16 bp, Homo sapiens
atcattcagaaatgtt

SEQ ID NO: 4844951 - DNA, 14 bp, Homo sapiens
atcattcttactaa

SEQ ID NO: 4844952 - DNA, 23 bp, Homo sapiens
atcattcttactaaaaagtataa

SEQ ID NO: 4844953 - DNA, 17 bp, Homo sapiens
atccacagccttgcagc

SEQ ID NO: 4844954 - DNA, 22 bp, Homo sapiens
atccacagccttgcagcggctc

SEQ ID NO: 4844955 - DNA, 19 bp, Homo sapiens
atccacctcatcactggac

SEQ ID NO: 4844956 - DNA, 21 bp, Homo sapiens
atccacctcatcactggactg

SEQ ID NO: 4844957 - DNA, 18 bp, Homo sapiens
atccagggcagcaggcca

SEQ ID NO: 4844958 - DNA, 19 bp, Homo sapiens
atccagggcagcaggccag

SEQ ID NO: 4844959 - DNA, 18 bp, Homo sapiens
atccattacctccatcca

SEQ ID NO: 4844960 - DNA, 13 bp, Homo sapiens
atccatttcagga

SEQ ID NO: 4844961 - DNA, 16 bp, Homo sapiens
atccatttcaggactc

SEQ ID NO: 4844962 - DNA, 17 bp, Homo sapiens
atccatttcaggactct

SEQ ID NO: 4844963 - DNA, 18 bp, Homo sapiens
atccatttcaggactctc

SEQ ID NO: 4844964 - DNA, 17 bp, Homo sapiens
atccatttccattgctt

SEQ ID NO: 4844965 - DNA, 21 bp, Homo sapiens
atcccaagttggaagggaccc

SEQ ID NO: 4844966 - DNA, 14 bp, Homo sapiens
atcccgtcttccag

SEQ ID NO: 4844967 - DNA, 13 bp, Homo sapiens
atccctacatgta

SEQ ID NO: 4844968 - DNA, 14 bp, Homo sapiens
atccctcacctgta

SEQ ID NO: 4844969 - DNA, 22 bp, Homo sapiens
atccctgaggactgatttcaga

SEQ ID NO: 4844970 - DNA, 15 bp, Homo sapiens
atccctgcctcaggc

SEQ ID NO: 4844971 - DNA, 20 bp, Homo sapiens
atccctgcctcaggccaagg

SEQ ID NO: 4844972 - DNA, 13 bp, Homo sapiens
atccctgcctgga

SEQ ID NO: 4844973 - DNA, 16 bp, Homo sapiens
atccctgcctggaggc

SEQ ID NO: 4844974 - DNA, 21 bp, Homo sapiens
atcccttggacattttatgtc

SEQ ID NO: 4844975 - DNA, 23 bp, Homo sapiens
atcctcagttctcaaatgtgtgt

SEQ ID NO: 4844976 - DNA, 13 bp, Homo sapiens
atcctgaagagca

SEQ ID NO: 4844977 - DNA, 11 bp, Homo sapiens
atcctggcctg

SEQ ID NO: 4844978 - DNA, 17 bp, Homo sapiens
atccttgagattctgaa

SEQ ID NO: 4844979 - DNA, 17 bp, Homo sapiens
atcgagtgtagctgtga

SEQ ID NO: 4844980 - DNA, 17 bp, Homo sapiens
atcggcagatgatgctt

SEQ ID NO: 4844981 - DNA, 15 bp, Homo sapiens
atcgtttttgtattt

SEQ ID NO: 4844982 - DNA, 23 bp, Homo sapiens
atctaaaaatagacttaaatctc

SEQ ID NO: 4844983 - DNA, 15 bp, Homo sapiens
atctaagtgatataa

SEQ ID NO: 4844984 - DNA, 15 bp, Homo sapiens
atctaataattattc

SEQ ID NO: 4844985 - DNA, 23 bp, Homo sapiens
atctacaatctctttttgtttgc

SEQ ID NO: 4844986 - DNA, 19 bp, Homo sapiens
atctatccacactgtcaaa

SEQ ID NO: 4844987 - DNA, 19 bp, Homo sapiens
atctatgaacctgaaaagg

SEQ ID NO: 4844988 - DNA, 15 bp, Homo sapiens
atctatgtttataat

SEQ ID NO: 4844989 - DNA, 19 bp, Homo sapiens
atctattgtttgttgcact

SEQ ID NO: 4844990 - DNA, 14 bp, Homo sapiens
atctcaatgcaagc

SEQ ID NO: 4844991 - DNA, 20 bp, Homo sapiens
atctcagtggtgtgtgaagt

SEQ ID NO: 4844992 - DNA, 20 bp, Homo sapiens
atctccatggggaggcctca

SEQ ID NO: 4844993 - DNA, 20 bp, Homo sapiens
atctgaaaggccagcagctg

SEQ ID NO: 4844994 - DNA, 13 bp, Homo sapiens
atctgaagagtgg

SEQ ID NO: 4844995 - DNA, 16 bp, Homo sapiens
atctgccccctagttc

SEQ ID NO: 4844996 - DNA, 14 bp, Homo sapiens
atctgttagcagag

SEQ ID NO: 4844997 - DNA, 15 bp, Homo sapiens
atctgttagcagagt

SEQ ID NO: 4844998 - DNA, 18 bp, Homo sapiens
atctgttagcagagtctg

SEQ ID NO: 4844999 - DNA, 21 bp, Homo sapiens
atctgttagcagagtctgtct

SEQ ID NO: 4845000 - DNA, 21 bp, Homo sapiens
atctgttttgtggtttggaat

SEQ ID NO: 4845001 - DNA, 18 bp, Homo sapiens
atctgtttttacgtatgt

SEQ ID NO: 4845002 - DNA, 19 bp, Homo sapiens
atcttaaaccttaagatac

SEQ ID NO: 4845003 - DNA, 15 bp, Homo sapiens
atcttacaatattga

SEQ ID NO: 4845004 - DNA, 21 bp, Homo sapiens
atcttattttctcaatctcct

SEQ ID NO: 4845005 - DNA, 15 bp, Homo sapiens
atcttcctggcacaa

SEQ ID NO: 4845006 - DNA, 16 bp, Homo sapiens
atcttctttcttccac

SEQ ID NO: 4845007 - DNA, 21 bp, Homo sapiens
atcttctttcttccacccaca

SEQ ID NO: 4845008 - DNA, 21 bp, Homo sapiens
atcttctttggacttctgaag

SEQ ID NO: 4845009 - DNA, 12 bp, Homo sapiens
atcttgcctcat

SEQ ID NO: 4845010 - DNA, 15 bp, Homo sapiens
atcttgttcaggaaa

SEQ ID NO: 4845011 - DNA, 15 bp, Homo sapiens
acagtaagatatctc

SEQ ID NO: 4845012 - DNA, 15 bp, Homo sapiens
acagtacccaaactg

SEQ ID NO: 4845013 - DNA, 16 bp, Homo sapiens
acagtatagatttttg

SEQ ID NO: 4845014 - DNA, 23 bp, Homo sapiens
acagtatgtgggatattgaatgt

SEQ ID NO: 4845015 - DNA, 15 bp, Homo sapiens
acagtccgcagttgt

SEQ ID NO: 4845016 - DNA, 20 bp, Homo sapiens
acagtccgcagttgtagcag

SEQ ID NO: 4845017 - DNA, 13 bp, Homo sapiens
acagtctgctcct

SEQ ID NO: 4845018 - DNA, 16 bp, Homo sapiens
acagtctgctcctctt

SEQ ID NO: 4845019 - DNA, 18 bp, Homo sapiens
acagtctgctcctcttgt

SEQ ID NO: 4845020 - DNA, 16 bp, Homo sapiens
acagtgaagttttact

SEQ ID NO: 4845021 - DNA, 12 bp, Homo sapiens
acagtgccttct

SEQ ID NO: 4845022 - DNA, 19 bp, Homo sapiens
acagtgtaatccaggggtg

SEQ ID NO: 4845023 - DNA, 20 bp, Homo sapiens
acagttcccagagtgggctt

SEQ ID NO: 4845024 - DNA, 18 bp, Homo sapiens
acagttgatggagcccca

SEQ ID NO: 4845025 - DNA, 19 bp, Homo sapiens
acagttgatggagccccag

SEQ ID NO: 4845026 - DNA, 20 bp, Homo sapiens
acagttgatggagccccagg

SEQ ID NO: 4845027 - DNA, 21 bp, Homo sapiens
acagttttaactgtggatatt

SEQ ID NO: 4845028 - DNA, 15 bp, Homo sapiens
acataaaagaaataa

SEQ ID NO: 4845029 - DNA, 15 bp, Homo sapiens
acataaaccctccaa

SEQ ID NO: 4845030 - DNA, 20 bp, Homo sapiens
acataactcacacccctgcc

SEQ ID NO: 4845031 - DNA, 15 bp, Homo sapiens
acataagcttccatt

SEQ ID NO: 4845032 - DNA, 17 bp, Homo sapiens
acatagcataggctggg

SEQ ID NO: 4845033 - DNA, 14 bp, Homo sapiens
acatcaatatgtat

SEQ ID NO: 4845034 - DNA, 14 bp, Homo sapiens
acatcacaagacta

SEQ ID NO: 4845035 - DNA, 15 bp, Homo sapiens
acatccatccctcca

SEQ ID NO: 4845036 - DNA, 12 bp, Homo sapiens
acatctctgaat

SEQ ID NO: 4845037 - DNA, 13 bp, Homo sapiens
acatctgttttgt

SEQ ID NO: 4845038 - DNA, 18 bp, Homo sapiens
acatctttattgaaattc

SEQ ID NO: 4845039 - DNA, 16 bp, Homo sapiens
acatgaagcagaacct

SEQ ID NO: 4845040 - DNA, 19 bp, Homo sapiens
acatgagagtagggccctg

SEQ ID NO: 4845041 - DNA, 16 bp, Homo sapiens
acatgcaataaaattt

SEQ ID NO: 4845042 - DNA, 19 bp, Homo sapiens
acatggccatcttctttct

SEQ ID NO: 4845043 - DNA, 20 bp, Homo sapiens
acatgggctgtgattactgc

SEQ ID NO: 4845044 - DNA, 21 bp, Homo sapiens
acatgggctgtgattactgca

SEQ ID NO: 4845045 - DNA, 21 bp, Homo sapiens
acatggggaggttgtggggcc

SEQ ID NO: 4845046 - DNA, 18 bp, Homo sapiens
acatgtattgcacattgt

SEQ ID NO: 4845047 - DNA, 15 bp, Homo sapiens
acatgtgacatttat

SEQ ID NO: 4845048 - DNA, 20 bp, Homo sapiens
acatgttaatgacaatattc

SEQ ID NO: 4845049 - DNA, 21 bp, Homo sapiens
acatgttcccaaaacaatggt

SEQ ID NO: 4845050 - DNA, 19 bp, Homo sapiens
acattaactgttgcacttt

SEQ ID NO: 4845051 - DNA, 22 bp, Homo sapiens
acattacaaagttaaaattgtt

SEQ ID NO: 4845052 - DNA, 21 bp, Homo sapiens
acattatctcacttagtcctt

SEQ ID NO: 4845053 - DNA, 12 bp, Homo sapiens
acattgaagaat

SEQ ID NO: 4845054 - DNA, 17 bp, Homo sapiens
acatttagaaaagtgaa

SEQ ID NO: 4845055 - DNA, 16 bp, Homo sapiens
acatttagaagaaaga

SEQ ID NO: 4845056 - DNA, 19 bp, Homo sapiens
acatttatattaaataaca

SEQ ID NO: 4845057 - DNA, 14 bp, Homo sapiens
acatttctttggaa

SEQ ID NO: 4845058 - DNA, 15 bp, Homo sapiens
acatttgctgccatt

SEQ ID NO: 4845059 - DNA, 17 bp, Homo sapiens
acatttgggagacatgt

SEQ ID NO: 4845060 - DNA, 19 bp, Homo sapiens
acatttgggagacatgtga

SEQ ID NO: 4845061 - DNA, 13 bp, Homo sapiens
acattttattaag

SEQ ID NO: 4845062 - DNA, 21 bp, Homo sapiens
acattttccgcccactcctgg

SEQ ID NO: 4845063 - DNA, 14 bp, Homo sapiens
acattttttaagct

SEQ ID NO: 4845064 - DNA, 19 bp, Homo sapiens
accaaaggaaaatgtctgt

SEQ ID NO: 4845065 - DNA, 18 bp, Homo sapiens
accaaatagtgtgaaata

SEQ ID NO: 4845066 - DNA, 15 bp, Homo sapiens
accaaattaaaaaaa

SEQ ID NO: 4845067 - DNA, 13 bp, Homo sapiens
accaacctccaga

SEQ ID NO: 4845068 - DNA, 15 bp, Homo sapiens
accaacctccagact

SEQ ID NO: 4845069 - DNA, 18 bp, Homo sapiens
accaagtgtgctaaaaat

SEQ ID NO: 4845070 - DNA, 11 bp, Homo sapiens
accaatacaaa

SEQ ID NO: 4845071 - DNA, 17 bp, Homo sapiens
accacacttgaaacctt

SEQ ID NO: 4845072 - DNA, 20 bp, Homo sapiens
accactaggaatcccagagg

SEQ ID NO: 4845073 - DNA, 21 bp, Homo sapiens
accactccttcatgtttggaa

SEQ ID NO: 4845074 - DNA, 15 bp, Homo sapiens
accactttattgcaa

SEQ ID NO: 4845075 - DNA, 21 bp, Homo sapiens
accactttattgcaatgcaga

SEQ ID NO: 4845076 - DNA, 17 bp, Homo sapiens
accagagtctgtatttt

SEQ ID NO: 4845077 - DNA, 20 bp, Homo sapiens
accagcttagccaacatagt

SEQ ID NO: 4845078 - DNA, 13 bp, Homo sapiens
accaggggccaac

SEQ ID NO: 4845079 - DNA, 20 bp, Homo sapiens
accaggggccaacctcaggc

SEQ ID NO: 4845080 - DNA, 15 bp, Homo sapiens
accagggtctctcag

SEQ ID NO: 4845081 - DNA, 16 bp, Homo sapiens
accagggtctctcagg

SEQ ID NO: 4845082 - DNA, 17 bp, Homo sapiens
accagggtctctcaggg

SEQ ID NO: 4845083 - DNA, 17 bp, Homo sapiens
accaggtccagatgtgc

SEQ ID NO: 4845084 - DNA, 14 bp, Homo sapiens
accagtgcctgtga

SEQ ID NO: 4845085 - DNA, 21 bp, Homo sapiens
accagtttaagccgcagacct

SEQ ID NO: 4845086 - DNA, 22 bp, Homo sapiens
accagtttaagccgcagacctg

SEQ ID NO: 4845087 - DNA, 13 bp, Homo sapiens
accataagagaaa

SEQ ID NO: 4845088 - DNA, 14 bp, Homo sapiens
accatatgaatgaa

SEQ ID NO: 4845089 - DNA, 16 bp, Homo sapiens
accatgtgagctcttc

SEQ ID NO: 4845090 - DNA, 18 bp, Homo sapiens
accatgtgagctcttcct

SEQ ID NO: 4845091 - DNA, 14 bp, Homo sapiens
accattaccaaaat

SEQ ID NO: 4845092 - DNA, 20 bp, Homo sapiens
accattctattctccagaca

SEQ ID NO: 4845093 - DNA, 23 bp, Homo sapiens
accattttttaatttacttgttt

SEQ ID NO: 4845094 - DNA, 18 bp, Homo sapiens
acccacaaactccaggct

SEQ ID NO: 4845095 - DNA, 14 bp, Homo sapiens
acccacagaacttg

SEQ ID NO: 4845096 - DNA, 18 bp, Homo sapiens
acccaccagttgctgctg

SEQ ID NO: 4845097 - DNA, 20 bp, Homo sapiens
acccaccgccacaataaaga

SEQ ID NO: 4845098 - DNA, 21 bp, Homo sapiens
acccagacgtggtgcttctca

SEQ ID NO: 4845099 - DNA, 14 bp, Homo sapiens
acccagagatgcct

SEQ ID NO: 4845100 - DNA, 11 bp, Homo sapiens
acccagagctg

SEQ ID NO: 4845101 - DNA, 15 bp, Homo sapiens
acccatccctgcctg

SEQ ID NO: 4845102 - DNA, 19 bp, Homo sapiens
acccatcctaggaaccagc

SEQ ID NO: 4845103 - DNA, 22 bp, Homo sapiens
acccattaaggggaagaatgaa

SEQ ID NO: 4845104 - DNA, 15 bp, Homo sapiens
accccaaagagaaag

SEQ ID NO: 4845105 - DNA, 18 bp, Homo sapiens
accccaatatatgtattt

SEQ ID NO: 4845106 - DNA, 20 bp, Homo sapiens
accccagatacctgtgagga

SEQ ID NO: 4845107 - DNA, 15 bp, Homo sapiens
accccagtcacttct

SEQ ID NO: 4845108 - DNA, 13 bp, Homo sapiens
accccattcctga

SEQ ID NO: 4845109 - DNA, 14 bp, Homo sapiens
accccattcctgat

SEQ ID NO: 4845110 - DNA, 17 bp, Homo sapiens
acccccttaaatttaat

SEQ ID NO: 4845111 - DNA, 11 bp, Homo sapiens
acccctgctcc

SEQ ID NO: 4845112 - DNA, 22 bp, Homo sapiens
accccttaccccaaagagaaag

SEQ ID NO: 4845113 - DNA, 21 bp, Homo sapiens
acccgcctcgacctccccacc

SEQ ID NO: 4845114 - DNA, 14 bp, Homo sapiens
acccgtcctctcgg

SEQ ID NO: 4845115 - DNA, 15 bp, Homo sapiens
acccgtcctctcggc

SEQ ID NO: 4845116 - DNA, 13 bp, Homo sapiens
accctacagacag

SEQ ID NO: 4845117 - DNA, 22 bp, Homo sapiens
accctacagacagcttacagga

SEQ ID NO: 4845118 - DNA, 18 bp, Homo sapiens
accctccaagggatctgc

SEQ ID NO: 4845119 - DNA, 14 bp, Homo sapiens
accctccggcgggt

SEQ ID NO: 4845120 - DNA, 14 bp, Homo sapiens
accctcgagagcct

SEQ ID NO: 4845121 - DNA, 22 bp, Homo sapiens
accctgaatccgtacttgggtc

SEQ ID NO: 4845122 - DNA, 14 bp, Homo sapiens
accctgttacttat

SEQ ID NO: 4845123 - DNA, 20 bp, Homo sapiens
acccttctgggtccagggag

SEQ ID NO: 4845124 - DNA, 23 bp, Homo sapiens
accgcagaagcctccccagctca

SEQ ID NO: 4845125 - DNA, 18 bp, Homo sapiens
acctacagttttaactgt

SEQ ID NO: 4845126 - DNA, 19 bp, Homo sapiens
acctacagttttaactgtg

SEQ ID NO: 4845127 - DNA, 22 bp, Homo sapiens
acctagttaaagaaaggaaaag

SEQ ID NO: 4845128 - DNA, 22 bp, Homo sapiens
acctcaggctcctaaagagaca

SEQ ID NO: 4845129 - DNA, 14 bp, Homo sapiens
acctcatcactgga

SEQ ID NO: 4845130 - DNA, 17 bp, Homo sapiens
acctccagaagtccctt

SEQ ID NO: 4845131 - DNA, 14 bp, Homo sapiens
acctccagactcag

SEQ ID NO: 4845132 - DNA, 13 bp, Homo sapiens
acctccctgtctc

SEQ ID NO: 4845133 - DNA, 18 bp, Homo sapiens
acctccttagccctgtct

SEQ ID NO: 4845134 - DNA, 22 bp, Homo sapiens
acctccttctgcagtcagactg

SEQ ID NO: 4845135 - DNA, 15 bp, Homo sapiens
acctcgggcctgctg

SEQ ID NO: 4845136 - DNA, 17 bp, Homo sapiens
acctctaagtgctgctg

SEQ ID NO: 4845137 - DNA, 17 bp, Homo sapiens
acctctgtctgagacag

SEQ ID NO: 4845138 - DNA, 19 bp, Homo sapiens
acctctgtctgagacaggt

SEQ ID NO: 4845139 - DNA, 13 bp, Homo sapiens
acctctttgctca

SEQ ID NO: 4845140 - DNA, 14 bp, Homo sapiens
acctgaaagagagg

SEQ ID NO: 4845141 - DNA, 13 bp, Homo sapiens
acctgaatttgta

SEQ ID NO: 4845142 - DNA, 15 bp, Homo sapiens
acctgaatttgtata

SEQ ID NO: 4845143 - DNA, 20 bp, Homo sapiens
acctgaatttgtatatgact

SEQ ID NO: 4845144 - DNA, 22 bp, Homo sapiens
acctgaatttgtatatgactgc

SEQ ID NO: 4845145 - DNA, 21 bp, Homo sapiens
acctgaggccaggacgtctgg

SEQ ID NO: 4845146 - DNA, 20 bp, Homo sapiens
acctgcacactgtcctatta

SEQ ID NO: 4845147 - DNA, 14 bp, Homo sapiens
acctgccccaagtg

SEQ ID NO: 4845148 - DNA, 23 bp, Homo sapiens
acctgccctgggcatgcccagcc

SEQ ID NO: 4845149 - DNA, 16 bp, Homo sapiens
acctgctcacgtcaaa

SEQ ID NO: 4845150 - DNA, 14 bp, Homo sapiens
acctggagaagtag

SEQ ID NO: 4845151 - DNA, 19 bp, Homo sapiens
acctggagcttcagccagg

SEQ ID NO: 4845152 - DNA, 16 bp, Homo sapiens
acctggcctagaaagg

SEQ ID NO: 4845153 - DNA, 13 bp, Homo sapiens
acctgggcacaaa

SEQ ID NO: 4845154 - DNA, 22 bp, Homo sapiens
acctgtgctgaacataacttct

SEQ ID NO: 4845155 - DNA, 14 bp, Homo sapiens
acctgtggatattt

SEQ ID NO: 4845156 - DNA, 15 bp, Homo sapiens
acctgtggtcatgtg

SEQ ID NO: 4845157 - DNA, 15 bp, Homo sapiens
accttaatttaactt

SEQ ID NO: 4845158 - DNA, 17 bp, Homo sapiens
accttaatttaactttc

SEQ ID NO: 4845159 - DNA, 21 bp, Homo sapiens
accttcaaggctcttcttcct

SEQ ID NO: 4845160 - DNA, 16 bp, Homo sapiens
accttccatagcctcc

SEQ ID NO: 4845161 - DNA, 17 bp, Homo sapiens
accttctagttgccccc

SEQ ID NO: 4845162 - DNA, 21 bp, Homo sapiens
acctttcctgatgcccctgac

SEQ ID NO: 4845163 - DNA, 22 bp, Homo sapiens
acctttcctgatgcccctgaca

SEQ ID NO: 4845164 - DNA, 13 bp, Homo sapiens
acctttctctctc

SEQ ID NO: 4845165 - DNA, 20 bp, Homo sapiens
acctttgagtagatccattt

SEQ ID NO: 4845166 - DNA, 11 bp, Homo sapiens
accttttcagg

SEQ ID NO: 4845167 - DNA, 22 bp, Homo sapiens
acgaggacatttgtgggcaagc

SEQ ID NO: 4845168 - DNA, 14 bp, Homo sapiens
acgatgacagtgtt

SEQ ID NO: 4845169 - DNA, 15 bp, Homo sapiens
acgatgatgtacaga

SEQ ID NO: 4845170 - DNA, 19 bp, Homo sapiens
acgatgcatttaataaaga

SEQ ID NO: 4845171 - DNA, 19 bp, Homo sapiens
acgggatgacctccagaag

SEQ ID NO: 4845172 - DNA, 12 bp, Homo sapiens
acgggggcagtg

SEQ ID NO: 4845173 - DNA, 15 bp, Homo sapiens
acgggggcagtgtga

SEQ ID NO: 4845174 - DNA, 15 bp, Homo sapiens
acgtggtgcttctca

SEQ ID NO: 4845175 - DNA, 15 bp, Homo sapiens
acgttaggccaggcc

SEQ ID NO: 4845176 - DNA, 15 bp, Homo sapiens
actaaaaaaaagatg

SEQ ID NO: 4845177 - DNA, 19 bp, Homo sapiens
actaaatgatctctgaaag

SEQ ID NO: 4845178 - DNA, 18 bp, Homo sapiens
actaacaggccaaagagt

SEQ ID NO: 4845179 - DNA, 15 bp, Homo sapiens
actaactcaaataca

SEQ ID NO: 4845180 - DNA, 18 bp, Homo sapiens
actaactcaaatacacat

SEQ ID NO: 4845181 - DNA, 21 bp, Homo sapiens
actaccagggtctctcaggga

SEQ ID NO: 4845182 - DNA, 15 bp, Homo sapiens
actacccatagacat

SEQ ID NO: 4845183 - DNA, 13 bp, Homo sapiens
actactagtgtga

SEQ ID NO: 4845184 - DNA, 19 bp, Homo sapiens
actactgctcctgtggcag

SEQ ID NO: 4845185 - DNA, 23 bp, Homo sapiens
actactgctcctgtggcaggagg

SEQ ID NO: 4845186 - DNA, 22 bp, Homo sapiens
actactgttatcagtaatgcta

SEQ ID NO: 4845187 - DNA, 23 bp, Homo sapiens
actactgttatcagtaatgctaa

SEQ ID NO: 4845188 - DNA, 16 bp, Homo sapiens
actagtgtgactcctt

SEQ ID NO: 4845189 - DNA, 13 bp, Homo sapiens
actatatataatg

SEQ ID NO: 4845190 - DNA, 20 bp, Homo sapiens
actatatatataaatgtata

SEQ ID NO: 4845191 - DNA, 22 bp, Homo sapiens
actatcttctttggacttctga

SEQ ID NO: 4845192 - DNA, 17 bp, Homo sapiens
actatggtgctgccttg

SEQ ID NO: 4845193 - DNA, 22 bp, Homo sapiens
actatggtgctgccttgcttct

SEQ ID NO: 4845194 - DNA, 23 bp, Homo sapiens
actattgtgctcagagacactgt

SEQ ID NO: 4845195 - DNA, 11 bp, Homo sapiens
actatttgtga

SEQ ID NO: 4845196 - DNA, 18 bp, Homo sapiens
actcagaaaattccctgg

SEQ ID NO: 4845197 - DNA, 19 bp, Homo sapiens
actcagaaaattccctggg

SEQ ID NO: 4845198 - DNA, 15 bp, Homo sapiens
actccaagccctggg

SEQ ID NO: 4845199 - DNA, 18 bp, Homo sapiens
actccaagccctggggca

SEQ ID NO: 4845200 - DNA, 21 bp, Homo sapiens
actccaagccctggggcaggg

SEQ ID NO: 4845201 - DNA, 22 bp, Homo sapiens
actccagactctgggggtggac

SEQ ID NO: 4845202 - DNA, 20 bp, Homo sapiens
actccagctgacagccacac

SEQ ID NO: 4845203 - DNA, 20 bp, Homo sapiens
actccaggcatgtgtctggc

SEQ ID NO: 4845204 - DNA, 16 bp, Homo sapiens
actccaggctggaagt

SEQ ID NO: 4845205 - DNA, 22 bp, Homo sapiens
actcccaagggacagcaagtga

SEQ ID NO: 4845206 - DNA, 15 bp, Homo sapiens
actcccccagaggtg

SEQ ID NO: 4845207 - DNA, 18 bp, Homo sapiens
actccctggctgttctga

SEQ ID NO: 4845208 - DNA, 17 bp, Homo sapiens
actcctataaagtgcct

SEQ ID NO: 4845209 - DNA, 17 bp, Homo sapiens
actcctgtcttctttct

SEQ ID NO: 4845210 - DNA, 20 bp, Homo sapiens
actcctgtcttctttctcca

SEQ ID NO: 4845211 - DNA, 23 bp, Homo sapiens
actcctgtcttctttctccatgg

SEQ ID NO: 4845212 - DNA, 13 bp, Homo sapiens
actccttgcttcc

SEQ ID NO: 4845213 - DNA, 16 bp, Homo sapiens
actccttgcttcctga

SEQ ID NO: 4845214 - DNA, 14 bp, Homo sapiens
actctacccctgct

SEQ ID NO: 4845215 - DNA, 15 bp, Homo sapiens
actctacccctgctc

SEQ ID NO: 4845216 - DNA, 12 bp, Homo sapiens
actctagagggc

SEQ ID NO: 4845217 - DNA, 22 bp, Homo sapiens
actctataagcaaattgctttt

SEQ ID NO: 4845218 - DNA, 12 bp, Homo sapiens
actctcagagtg

SEQ ID NO: 4845219 - DNA, 24 bp, Homo sapiens
actctcattttatttacagctgtg

SEQ ID NO: 4845220 - DNA, 13 bp, Homo sapiens
actctctccagga

SEQ ID NO: 4845221 - DNA, 14 bp, Homo sapiens
actctgcatgtaga

SEQ ID NO: 4845222 - DNA, 20 bp, Homo sapiens
actctgcatgtagaggcttg

SEQ ID NO: 4845223 - DNA, 15 bp, Homo sapiens
actctgttcccccac

SEQ ID NO: 4845224 - DNA, 13 bp, Homo sapiens
actcttcctcctc

SEQ ID NO: 4845225 - DNA, 16 bp, Homo sapiens
actgaaatccttgaga

SEQ ID NO: 4845226 - DNA, 15 bp, Homo sapiens
actgaacacatgtgt

SEQ ID NO: 4845227 - DNA, 13 bp, Homo sapiens
actgaatttggag

SEQ ID NO: 4845228 - DNA, 13 bp, Homo sapiens
actgagccagatt

SEQ ID NO: 4845229 - DNA, 23 bp, Homo sapiens
actgaggatattcagatgtatgt

SEQ ID NO: 4845230 - DNA, 16 bp, Homo sapiens
actgaggcccagagag

SEQ ID NO: 4845231 - DNA, 22 bp, Homo sapiens
actgatatatcatgagtgaata

SEQ ID NO: 4845232 - DNA, 19 bp, Homo sapiens
actgatgagtttcactgta

SEQ ID NO: 4845233 - DNA, 16 bp, Homo sapiens
actgcatggggaggca

SEQ ID NO: 4845234 - DNA, 17 bp, Homo sapiens
actgcatggggaggcag

SEQ ID NO: 4845235 - DNA, 15 bp, Homo sapiens
actgcatgtgacttc

SEQ ID NO: 4845236 - DNA, 13 bp, Homo sapiens
actgccctccgaa

SEQ ID NO: 4845237 - DNA, 15 bp, Homo sapiens
actgctcctgtggca

SEQ ID NO: 4845238 - DNA, 17 bp, Homo sapiens
actgctcctgtggcagg

SEQ ID NO: 4845239 - DNA, 14 bp, Homo sapiens
actgctgctgctgc

SEQ ID NO: 4845240 - DNA, 21 bp, Homo sapiens
actgcttcccttactttgctg

SEQ ID NO: 4845241 - DNA, 15 bp, Homo sapiens
actggactgcatggg

SEQ ID NO: 4845242 - DNA, 15 bp, Homo sapiens
actggatggaaagac

SEQ ID NO: 4845243 - DNA, 15 bp, Homo sapiens
actggcccagtgcca

SEQ ID NO: 4845244 - DNA, 14 bp, Homo sapiens
actggccttgcctc

SEQ ID NO: 4845245 - DNA, 17 bp, Homo sapiens
actggccttgcctccag

SEQ ID NO: 4845246 - DNA, 15 bp, Homo sapiens
actgggcactggggc

SEQ ID NO: 4845247 - DNA, 16 bp, Homo sapiens
actggggcctcagcct

SEQ ID NO: 4845248 - DNA, 15 bp, Homo sapiens
actggttacctggag

SEQ ID NO: 4845249 - DNA, 16 bp, Homo sapiens
actggttacctggaga

SEQ ID NO: 4845250 - DNA, 17 bp, Homo sapiens
actggttacctggagaa

SEQ ID NO: 4845251 - DNA, 17 bp, Homo sapiens
actgtaaacttctgcaa

SEQ ID NO: 4845252 - DNA, 17 bp, Homo sapiens
agaagatagtcttggaa

SEQ ID NO: 4845253 - DNA, 13 bp, Homo sapiens
agaagatgagcct

SEQ ID NO: 4845254 - DNA, 21 bp, Homo sapiens
agaagcaataataaagtactt

SEQ ID NO: 4845255 - DNA, 22 bp, Homo sapiens
agaagccaatctacaatctctt

SEQ ID NO: 4845256 - DNA, 22 bp, Homo sapiens
agaagccagtgtctaggcactg

SEQ ID NO: 4845257 - DNA, 19 bp, Homo sapiens
agaagcctgacaactcatt

SEQ ID NO: 4845258 - DNA, 10 bp, Homo sapiens
agaagcctgc

SEQ ID NO: 4845259 - DNA, 16 bp, Homo sapiens
agaaggccagagaggg

SEQ ID NO: 4845260 - DNA, 19 bp, Homo sapiens
agaaggccagagagggaaa

SEQ ID NO: 4845261 - DNA, 18 bp, Homo sapiens
agaagtcttctatttatt

SEQ ID NO: 4845262 - DNA, 21 bp, Homo sapiens
agaagtcttctatttatttat

SEQ ID NO: 4845263 - DNA, 19 bp, Homo sapiens
agaagtgcatgaaaaacca

SEQ ID NO: 4845264 - DNA, 16 bp, Homo sapiens
agaataataattaacc

SEQ ID NO: 4845265 - DNA, 17 bp, Homo sapiens
agaataccacatcaaat

SEQ ID NO: 4845266 - DNA, 17 bp, Homo sapiens
agaatagaacacagttt

SEQ ID NO: 4845267 - DNA, 15 bp, Homo sapiens
agaatcacagctcaa

SEQ ID NO: 4845268 - DNA, 14 bp, Homo sapiens
agaatctttagaga

SEQ ID NO: 4845269 - DNA, 23 bp, Homo sapiens
agaatctttagagaagtatacat

SEQ ID NO: 4845270 - DNA, 21 bp, Homo sapiens
agaatgaaagctgttccttgg

SEQ ID NO: 4845271 - DNA, 15 bp, Homo sapiens
agaatgaccttgagt

SEQ ID NO: 4845272 - DNA, 16 bp, Homo sapiens
agaatggcatggcagg

SEQ ID NO: 4845273 - DNA, 13 bp, Homo sapiens
agaatggcctgga

SEQ ID NO: 4845274 - DNA, 15 bp, Homo sapiens
agaatggcctggagc

SEQ ID NO: 4845275 - DNA, 16 bp, Homo sapiens
agaatggcctggagca

SEQ ID NO: 4845276 - DNA, 18 bp, Homo sapiens
agaatggcctggagcagg

SEQ ID NO: 4845277 - DNA, 20 bp, Homo sapiens
agaatggcctggagcaggcc

SEQ ID NO: 4845278 - DNA, 21 bp, Homo sapiens
agaatggcctggagcaggccc

SEQ ID NO: 4845279 - DNA, 16 bp, Homo sapiens
agaatgtatttgctga

SEQ ID NO: 4845280 - DNA, 16 bp, Homo sapiens
agaatgttagagtaat

SEQ ID NO: 4845281 - DNA, 21 bp, Homo sapiens
agaattgaggggaggtggcca

SEQ ID NO: 4845282 - DNA, 19 bp, Homo sapiens
agacaaaaagtatattaaa

SEQ ID NO: 4845283 - DNA, 23 bp, Homo sapiens
agacaaaaagtatattaaacaaa

SEQ ID NO: 4845284 - DNA, 15 bp, Homo sapiens
agacaaaagagcagt

SEQ ID NO: 4845285 - DNA, 18 bp, Homo sapiens
agacaagtaatttcagtg

SEQ ID NO: 4845286 - DNA, 19 bp, Homo sapiens
agacactgttgataaaaac

SEQ ID NO: 4845287 - DNA, 14 bp, Homo sapiens
agacagctggcgga

SEQ ID NO: 4845288 - DNA, 22 bp, Homo sapiens
agacaggtgcctaacctgggac

SEQ ID NO: 4845289 - DNA, 23 bp, Homo sapiens
agacaggtgcctaacctgggacc

SEQ ID NO: 4845290 - DNA, 23 bp, Homo sapiens
agacattttccgcccactcctgg

SEQ ID NO: 4845291 - DNA, 12 bp, Homo sapiens
agaccagaaatt

SEQ ID NO: 4845292 - DNA, 14 bp, Homo sapiens
agaccagaaattcc

SEQ ID NO: 4845293 - DNA, 18 bp, Homo sapiens
agaccagagctgtctgaa

SEQ ID NO: 4845294 - DNA, 18 bp, Homo sapiens
agaccataagagaaacct

SEQ ID NO: 4845295 - DNA, 11 bp, Homo sapiens
agacccctgcc

SEQ ID NO: 4845296 - DNA, 13 bp, Homo sapiens
agacccctgcctg

SEQ ID NO: 4845297 - DNA, 12 bp, Homo sapiens
agacctggagct

SEQ ID NO: 4845298 - DNA, 19 bp, Homo sapiens
agacgtgatgggctaggcc

SEQ ID NO: 4845299 - DNA, 21 bp, Homo sapiens
agacgtgatgggctaggcctc

SEQ ID NO: 4845300 - DNA, 13 bp, Homo sapiens
agacgtggtgctt

SEQ ID NO: 4845301 - DNA, 16 bp, Homo sapiens
agactaaaagttgcat

SEQ ID NO: 4845302 - DNA, 19 bp, Homo sapiens
agactatatatataaatgt

SEQ ID NO: 4845303 - DNA, 21 bp, Homo sapiens
agactatatatataaatgtat

SEQ ID NO: 4845304 - DNA, 21 bp, Homo sapiens
agactgaatagatatgaaagc

SEQ ID NO: 4845305 - DNA, 14 bp, Homo sapiens
agactgctcctggg

SEQ ID NO: 4845306 - DNA, 16 bp, Homo sapiens
agactgctcctgggca

SEQ ID NO: 4845307 - DNA, 18 bp, Homo sapiens
agactggcccagtgccag

SEQ ID NO: 4845308 - DNA, 21 bp, Homo sapiens
agactggcccagtgccagcaa

SEQ ID NO: 4845309 - DNA, 17 bp, Homo sapiens
agactgggagccacttc

SEQ ID NO: 4845310 - DNA, 20 bp, Homo sapiens
agactgggagccacttctcc

SEQ ID NO: 4845311 - DNA, 23 bp, Homo sapiens
agactgtagatatgtattctttt

SEQ ID NO: 4845312 - DNA, 18 bp, Homo sapiens
agagaaacctgccaagga

SEQ ID NO: 4845313 - DNA, 20 bp, Homo sapiens
agagaaagcaaaggtgcact

SEQ ID NO: 4845314 - DNA, 15 bp, Homo sapiens
agagaaatgccccag

SEQ ID NO: 4845315 - DNA, 18 bp, Homo sapiens
agagaaatgccccagtgt

SEQ ID NO: 4845316 - DNA, 17 bp, Homo sapiens
agagaacctgtgggctg

SEQ ID NO: 4845317 - DNA, 14 bp, Homo sapiens
agagaatgtatttg

SEQ ID NO: 4845318 - DNA, 17 bp, Homo sapiens
agagaatgtattttcat

SEQ ID NO: 4845319 - DNA, 13 bp, Homo sapiens
agagaatgtggaa

SEQ ID NO: 4845320 - DNA, 14 bp, Homo sapiens
agagaatgtggaaa

SEQ ID NO: 4845321 - DNA, 15 bp, Homo sapiens
agagaatgtggaaat

SEQ ID NO: 4845322 - DNA, 14 bp, Homo sapiens
agagacaagtaatt

SEQ ID NO: 4845323 - DNA, 19 bp, Homo sapiens
agagacaagtaatttcagt

SEQ ID NO: 4845324 - DNA, 20 bp, Homo sapiens
agagacaagtaatttcagtg

SEQ ID NO: 4845325 - DNA, 18 bp, Homo sapiens
agagaccataagagaaac

SEQ ID NO: 4845326 - DNA, 22 bp, Homo sapiens
agagactgaatagatatgaaag

SEQ ID NO: 4845327 - DNA, 21 bp, Homo sapiens
agagactttgatactaccagg

SEQ ID NO: 4845328 - DNA, 15 bp, Homo sapiens
agagatcaaagatga

SEQ ID NO: 4845329 - DNA, 13 bp, Homo sapiens
agagatttctcat

SEQ ID NO: 4845330 - DNA, 17 bp, Homo sapiens
agagcagtggtaagaat

SEQ ID NO: 4845331 - DNA, 19 bp, Homo sapiens
agagcagtggtaagaatag

SEQ ID NO: 4845332 - DNA, 12 bp, Homo sapiens
agagcatcctga

SEQ ID NO: 4845333 - DNA, 15 bp, Homo sapiens
agagccatacataaa

SEQ ID NO: 4845334 - DNA, 16 bp, Homo sapiens
agagccatacataaaa

SEQ ID NO: 4845335 - DNA, 19 bp, Homo sapiens
agagccatacataaaagaa

SEQ ID NO: 4845336 - DNA, 20 bp, Homo sapiens
agagccatacataaaagaaa

SEQ ID NO: 4845337 - DNA, 16 bp, Homo sapiens
agagcccctactgtgg

SEQ ID NO: 4845338 - DNA, 19 bp, Homo sapiens
agagcccctactgtgggca

SEQ ID NO: 4845339 - DNA, 17 bp, Homo sapiens
agagcccgggagctgct

SEQ ID NO: 4845340 - DNA, 21 bp, Homo sapiens
agagcctttttacctggccta

SEQ ID NO: 4845341 - DNA, 17 bp, Homo sapiens
agagctaaaaaggccct

SEQ ID NO: 4845342 - DNA, 18 bp, Homo sapiens
agagctaaaaaggccctt

SEQ ID NO: 4845343 - DNA, 14 bp, Homo sapiens
agagctaggaaccc

SEQ ID NO: 4845344 - DNA, 17 bp, Homo sapiens
agagctatcaggagaaa

SEQ ID NO: 4845345 - DNA, 22 bp, Homo sapiens
agagctcttgtgttcagaagaa

SEQ ID NO: 4845346 - DNA, 20 bp, Homo sapiens
agagctgctgcacacactca

SEQ ID NO: 4845347 - DNA, 22 bp, Homo sapiens
agagctgctgcacacactcacc

SEQ ID NO: 4845348 - DNA, 17 bp, Homo sapiens
agagctgtctgaactca

SEQ ID NO: 4845349 - DNA, 18 bp, Homo sapiens
agaggaccaatgcttgca

SEQ ID NO: 4845350 - DNA, 23 bp, Homo sapiens
agaggactggttctgaggccaga

SEQ ID NO: 4845351 - DNA, 18 bp, Homo sapiens
agaggcaagctgaaattt

SEQ ID NO: 4845352 - DNA, 19 bp, Homo sapiens
agaggcttgtttacctttc

SEQ ID NO: 4845353 - DNA, 16 bp, Homo sapiens
agagggaggggccctg

SEQ ID NO: 4845354 - DNA, 13 bp, Homo sapiens
agaggtagcactc

SEQ ID NO: 4845355 - DNA, 20 bp, Homo sapiens
agaggtgggatcctccctca

SEQ ID NO: 4845356 - DNA, 18 bp, Homo sapiens
agaggtggggtgctgggg

SEQ ID NO: 4845357 - DNA, 17 bp, Homo sapiens
agaggtttgaaggagaa

SEQ ID NO: 4845358 - DNA, 21 bp, Homo sapiens
agaggtttgaaggagaatggc

SEQ ID NO: 4845359 - DNA, 21 bp, Homo sapiens
agagtcaactacacaaagcag

SEQ ID NO: 4845360 - DNA, 22 bp, Homo sapiens
agagtcaactacacaaagcagg

SEQ ID NO: 4845361 - DNA, 17 bp, Homo sapiens
agagttccggggagaaa

SEQ ID NO: 4845362 - DNA, 21 bp, Homo sapiens
agagtttcagtttgttggaaa

SEQ ID NO: 4845363 - DNA, 14 bp, Homo sapiens
agagtttgaaactc

SEQ ID NO: 4845364 - DNA, 18 bp, Homo sapiens
agataaagaccagaaatt

SEQ ID NO: 4845365 - DNA, 20 bp, Homo sapiens
agataatattgtttggtaaa

SEQ ID NO: 4845366 - DNA, 17 bp, Homo sapiens
agatacctgtgaggact

SEQ ID NO: 4845367 - DNA, 18 bp, Homo sapiens
agatactaaggacgttgt

SEQ ID NO: 4845368 - DNA, 16 bp, Homo sapiens
agatacttacatgttc

SEQ ID NO: 4845369 - DNA, 18 bp, Homo sapiens
agatagggggaagacaga

SEQ ID NO: 4845370 - DNA, 15 bp, Homo sapiens
agatatctcaatgaa

SEQ ID NO: 4845371 - DNA, 23 bp, Homo sapiens
agccccagggtttacatgaagca

SEQ ID NO: 4845372 - DNA, 14 bp, Homo sapiens
agcccctactgtgg

SEQ ID NO: 4845373 - DNA, 17 bp, Homo sapiens
agcccctactgtgggca

SEQ ID NO: 4845374 - DNA, 14 bp, Homo sapiens
agccctcaccacag

SEQ ID NO: 4845375 - DNA, 12 bp, Homo sapiens
agccctcctgag

SEQ ID NO: 4845376 - DNA, 19 bp, Homo sapiens
agccctggcaaatgcctga

SEQ ID NO: 4845377 - DNA, 23 bp, Homo sapiens
agccctgggcacatagcataggc

SEQ ID NO: 4845378 - DNA, 15 bp, Homo sapiens
agccctggggcaggg

SEQ ID NO: 4845379 - DNA, 22 bp, Homo sapiens
agccctgtctgctaggcgctgg

SEQ ID NO: 4845380 - DNA, 13 bp, Homo sapiens
agccgcagacctg

SEQ ID NO: 4845381 - DNA, 13 bp, Homo sapiens
agccgcagagaaa

SEQ ID NO: 4845382 - DNA, 14 bp, Homo sapiens
agcctaagaagaag

SEQ ID NO: 4845383 - DNA, 17 bp, Homo sapiens
agcctaagaagaaggcc

SEQ ID NO: 4845384 - DNA, 15 bp, Homo sapiens
agcctacctctgtct

SEQ ID NO: 4845385 - DNA, 16 bp, Homo sapiens
agcctagcctatgtct

SEQ ID NO: 4845386 - DNA, 17 bp, Homo sapiens
agcctagcctatgtctg

SEQ ID NO: 4845387 - DNA, 22 bp, Homo sapiens
agcctagcctatgtctggcaga

SEQ ID NO: 4845388 - DNA, 19 bp, Homo sapiens
agcctatgtctggcagatg

SEQ ID NO: 4845389 - DNA, 14 bp, Homo sapiens
agcctccttctttc

SEQ ID NO: 4845390 - DNA, 21 bp, Homo sapiens
agcctctgacttaagctgcct

SEQ ID NO: 4845391 - DNA, 16 bp, Homo sapiens
agcctctggactggaa

SEQ ID NO: 4845392 - DNA, 23 bp, Homo sapiens
agcctctggactggaaagcacaa

SEQ ID NO: 4845393 - DNA, 13 bp, Homo sapiens
agcctgactagaa

SEQ ID NO: 4845394 - DNA, 23 bp, Homo sapiens
agcctgactagaactcctgtctt

SEQ ID NO: 4845395 - DNA, 10 bp, Homo sapiens
agcctgctca

SEQ ID NO: 4845396 - DNA, 13 bp, Homo sapiens
agcctgcttccca

SEQ ID NO: 4845397 - DNA, 15 bp, Homo sapiens
agcctgcttcccaca

SEQ ID NO: 4845398 - DNA, 16 bp, Homo sapiens
agcctgcttcccacaa

SEQ ID NO: 4845399 - DNA, 18 bp, Homo sapiens
agcctgcttcccacaact

SEQ ID NO: 4845400 - DNA, 17 bp, Homo sapiens
agcctgctttcctgcag

SEQ ID NO: 4845401 - DNA, 23 bp, Homo sapiens
agcctggatcctcagttctcaaa

SEQ ID NO: 4845402 - DNA, 12 bp, Homo sapiens
agcctggccagg

SEQ ID NO: 4845403 - DNA, 13 bp, Homo sapiens
agcctggccaggc

SEQ ID NO: 4845404 - DNA, 15 bp, Homo sapiens
agcctggtttctggg

SEQ ID NO: 4845405 - DNA, 21 bp, Homo sapiens
agcctgtatgtggtgtggggc

SEQ ID NO: 4845406 - DNA, 16 bp, Homo sapiens
agccttcatcagaact

SEQ ID NO: 4845407 - DNA, 17 bp, Homo sapiens
ctgaatctgctaccaaa

SEQ ID NO: 4845408 - DNA, 14 bp, Homo sapiens
ctgaatgaagcagt

SEQ ID NO: 4845409 - DNA, 20 bp, Homo sapiens
ctgaatttgtatatgactgc

SEQ ID NO: 4845410 - DNA, 22 bp, Homo sapiens
ctgaatttgtatatgactgcat

SEQ ID NO: 4845411 - DNA, 20 bp, Homo sapiens
ctgacaaccattaaagtcag

SEQ ID NO: 4845412 - DNA, 16 bp, Homo sapiens
ctgacagagctctggg

SEQ ID NO: 4845413 - DNA, 14 bp, Homo sapiens
ctgacaggccttcc

SEQ ID NO: 4845414 - DNA, 14 bp, Homo sapiens
ctgacatttcttct

SEQ ID NO: 4845415 - DNA, 18 bp, Homo sapiens
ctgacatttcttctagtg

SEQ ID NO: 4845416 - DNA, 22 bp, Homo sapiens
ctgaccccaagggggctgctgc

SEQ ID NO: 4845417 - DNA, 16 bp, Homo sapiens
ctgaccccattcctga

SEQ ID NO: 4845418 - DNA, 20 bp, Homo sapiens
ctgacccttacagcctctga

SEQ ID NO: 4845419 - DNA, 23 bp, Homo sapiens
ctgacccttacagcctctgactt

SEQ ID NO: 4845420 - DNA, 13 bp, Homo sapiens
ctgactagaactc

SEQ ID NO: 4845421 - DNA, 21 bp, Homo sapiens
cttggggaaggggcctgggct

SEQ ID NO: 4845422 - DNA, 17 bp, Homo sapiens
cttgggtcacatgactc

SEQ ID NO: 4845423 - DNA, 14 bp, Homo sapiens
cttgggtgaatttc

SEQ ID NO: 4845424 - DNA, 19 bp, Homo sapiens
cttggtcccatggctgaag

SEQ ID NO: 4845425 - DNA, 14 bp, Homo sapiens
cttgtacagtctgc

SEQ ID NO: 4845426 - DNA, 17 bp, Homo sapiens
cttgtatattttaagaa

SEQ ID NO: 4845427 - DNA, 17 bp, Homo sapiens
cttgtatccaggcctgg

SEQ ID NO: 4845428 - DNA, 23 bp, Homo sapiens
cttgtcttctggtactttctgtt

SEQ ID NO: 4845429 - DNA, 22 bp, Homo sapiens
cttgtgagagcccattcccacc

SEQ ID NO: 4845430 - DNA, 17 bp, Homo sapiens
cttgtgggagacagcag

SEQ ID NO: 4845431 - DNA, 15 bp, Homo sapiens
cttgtgttcagaaga

SEQ ID NO: 4845432 - DNA, 19 bp, Homo sapiens
cttgtgttcagaagaatct

SEQ ID NO: 4845433 - DNA, 19 bp, Homo sapiens
cttgttcaggaaaaggttg

SEQ ID NO: 4845434 - DNA, 15 bp, Homo sapiens
cttgttcctgaaatg

SEQ ID NO: 4845435 - DNA, 21 bp, Homo sapiens
ctttaactgccgtaatttaac

SEQ ID NO: 4845436 - DNA, 17 bp, Homo sapiens
ctttacagctctcctcc

SEQ ID NO: 4845437 - DNA, 20 bp, Homo sapiens
ctttacagctctcctccagc

SEQ ID NO: 4845438 - DNA, 24 bp, Homo sapiens
ctttacagctctcctccagccctg

SEQ ID NO: 4845439 - DNA, 15 bp, Homo sapiens
ctttagaagcctgca

SEQ ID NO: 4845440 - DNA, 19 bp, Homo sapiens
ctttagagaagtatacata

SEQ ID NO: 4845441 - DNA, 22 bp, Homo sapiens
ctttagagaagtatacataagt

SEQ ID NO: 4845442 - DNA, 21 bp, Homo sapiens
ctttagcttacctgggcacaa

SEQ ID NO: 4845443 - DNA, 21 bp, Homo sapiens
ctttagtttttggttgggaat

SEQ ID NO: 4845444 - DNA, 15 bp, Homo sapiens
ctttatacacagtgg

SEQ ID NO: 4845445 - DNA, 20 bp, Homo sapiens
ctttatatttcaataaatga

SEQ ID NO: 4845446 - DNA, 15 bp, Homo sapiens
ctttatgttctttca

SEQ ID NO: 4845447 - DNA, 14 bp, Homo sapiens
ctttattaatgttt

SEQ ID NO: 4845448 - DNA, 15 bp, Homo sapiens
ctttattaatgtttt

SEQ ID NO: 4845449 - DNA, 13 bp, Homo sapiens
ctttattgcaatg

SEQ ID NO: 4845450 - DNA, 15 bp, Homo sapiens
ctttcacccatccta

SEQ ID NO: 4845451 - DNA, 17 bp, Homo sapiens
ctttcacccatcctagg

SEQ ID NO: 4845452 - DNA, 20 bp, Homo sapiens
ctttcactaaaacacacagg

SEQ ID NO: 4845453 - DNA, 23 bp, Homo sapiens
ctttcagaaatataacacatttt

SEQ ID NO: 4845454 - DNA, 16 bp, Homo sapiens
ctttccaccatacctt

SEQ ID NO: 4845455 - DNA, 22 bp, Homo sapiens
ctttccatccattacctccatc

SEQ ID NO: 4845456 - DNA, 23 bp, Homo sapiens
ctttccatccattacctccatcc

SEQ ID NO: 4845457 - DNA, 18 bp, Homo sapiens
ctttctaagcaaccacac

SEQ ID NO: 4845458 - DNA, 16 bp, Homo sapiens
ctttctccatggagcc

SEQ ID NO: 4845459 - DNA, 13 bp, Homo sapiens
ctttcttcactct

SEQ ID NO: 4845460 - DNA, 19 bp, Homo sapiens
ctttcttcactctggcttc

SEQ ID NO: 4845461 - DNA, 14 bp, Homo sapiens
ctttgaagaaggca

SEQ ID NO: 4845462 - DNA, 19 bp, Homo sapiens
ctttgactctataagcaaa

SEQ ID NO: 4845463 - DNA, 21 bp, Homo sapiens
ctttgagtagatccatttcca

SEQ ID NO: 4845464 - DNA, 17 bp, Homo sapiens
ctttgatactaccaggg

SEQ ID NO: 4845465 - DNA, 13 bp, Homo sapiens
ctttgcatattat

SEQ ID NO: 4845466 - DNA, 23 bp, Homo sapiens
ctttgcatattataaaggataaa

SEQ ID NO: 4845467 - DNA, 13 bp, Homo sapiens
ctttgccttctct

SEQ ID NO: 4845468 - DNA, 21 bp, Homo sapiens
ctttgctgccagctctcagga

SEQ ID NO: 4845469 - DNA, 18 bp, Homo sapiens
ctttggaagatgcagaag

SEQ ID NO: 4845470 - DNA, 17 bp, Homo sapiens
ctttggagttaaaatgc

SEQ ID NO: 4845471 - DNA, 20 bp, Homo sapiens
ctttggattctaaatacatg

SEQ ID NO: 4845472 - DNA, 14 bp, Homo sapiens
ctttgggaaaacat

SEQ ID NO: 4845473 - DNA, 21 bp, Homo sapiens
ctttgggaaaacatgttaatg

SEQ ID NO: 4845474 - DNA, 21 bp, Homo sapiens
ctttgggaagtttgctgtgct

SEQ ID NO: 4845475 - DNA, 16 bp, Homo sapiens
ctttggggctcctttc

SEQ ID NO: 4845476 - DNA, 20 bp, Homo sapiens
ctttgggtggctcactactg

SEQ ID NO: 4845477 - DNA, 21 bp, Homo sapiens
ctttgggtggctcactactga

SEQ ID NO: 4845478 - DNA, 23 bp, Homo sapiens
ctttgggtggctcactactgaac

SEQ ID NO: 4845479 - DNA, 16 bp, Homo sapiens
ctttggtggccaggga

SEQ ID NO: 4845480 - DNA, 13 bp, Homo sapiens
ctttgtaccaaaa

SEQ ID NO: 4845481 - DNA, 15 bp, Homo sapiens
ctttgtaccaaaatt

SEQ ID NO: 4845482 - DNA, 17 bp, Homo sapiens
ctttgtcacttttcctt

SEQ ID NO: 4845483 - DNA, 14 bp, Homo sapiens
ctttgtgaccagaa

SEQ ID NO: 4845484 - DNA, 15 bp, Homo sapiens
ctttgttgtgagaat

SEQ ID NO: 4845485 - DNA, 23 bp, Homo sapiens
ctttgttgtgagaatggcctgga

SEQ ID NO: 4845486 - DNA, 18 bp, Homo sapiens
cttttaaggataaatcat

SEQ ID NO: 4845487 - DNA, 21 bp, Homo sapiens
cttttaatccatttcaggact

SEQ ID NO: 4845488 - DNA, 14 bp, Homo sapiens
cttttataaagcat

SEQ ID NO: 4845489 - DNA, 14 bp, Homo sapiens
cttttcaggaaaat

SEQ ID NO: 4845490 - DNA, 13 bp, Homo sapiens
cttttcaggagat

SEQ ID NO: 4845491 - DNA, 18 bp, Homo sapiens
cttttcaggagatgggga

SEQ ID NO: 4845492 - DNA, 16 bp, Homo sapiens
cttttccttttcttaa

SEQ ID NO: 4845493 - DNA, 17 bp, Homo sapiens
cttttctcagtgttggt

SEQ ID NO: 4845494 - DNA, 19 bp, Homo sapiens
cttttgctgaacaggaaag

SEQ ID NO: 4845495 - DNA, 14 bp, Homo sapiens
cttttggcctcctg

SEQ ID NO: 4845496 - DNA, 16 bp, Homo sapiens
cttttggcctcctgca

SEQ ID NO: 4845497 - DNA, 22 bp, Homo sapiens
cttttgggggtcagcatccagt

SEQ ID NO: 4845498 - DNA, 14 bp, Homo sapiens
cttttgtttggtaa

SEQ ID NO: 4845499 - DNA, 16 bp, Homo sapiens
cttttgtttggtaaat

SEQ ID NO: 4845500 - DNA, 20 bp, Homo sapiens
ctttttcatagtaagtgcga

SEQ ID NO: 4845501 - DNA, 11 bp, Homo sapiens
ctttttggaat

SEQ ID NO: 4845502 - DNA, 12 bp, Homo sapiens
ctttttggaatc

SEQ ID NO: 4845503 - DNA, 22 bp, Homo sapiens
ctttttttctctgcatttaaaa

SEQ ID NO: 4845504 - DNA, 16 bp, Homo sapiens
gaaaaatataaaatta

SEQ ID NO: 4845505 - DNA, 16 bp, Homo sapiens
gaaaaatctaagtgat

SEQ ID NO: 4845506 - DNA, 20 bp, Homo sapiens
gaaaacatgttaatgacaat

SEQ ID NO: 4845507 - DNA, 11 bp, Homo sapiens
gaaaacccacc

SEQ ID NO: 4845508 - DNA, 13 bp, Homo sapiens
gaaaagagagaaa

SEQ ID NO: 4845509 - DNA, 11 bp, Homo sapiens
gaaaagtcttc

SEQ ID NO: 4845510 - DNA, 13 bp, Homo sapiens
gaaaagtcttcct

SEQ ID NO: 4845511 - DNA, 16 bp, Homo sapiens
gaaaagtgaattgaag

SEQ ID NO: 4845512 - DNA, 15 bp, Homo sapiens
gaaaataactgaatt

SEQ ID NO: 4845513 - DNA, 19 bp, Homo sapiens
gaaaataatttctcttgta

SEQ ID NO: 4845514 - DNA, 19 bp, Homo sapiens
gaaaatctttataaatgta

SEQ ID NO: 4845515 - DNA, 17 bp, Homo sapiens
gaaaatgaaatgcatat

SEQ ID NO: 4845516 - DNA, 17 bp, Homo sapiens
gaaaattccctggggtc

SEQ ID NO: 4845517 - DNA, 14 bp, Homo sapiens
gaaacaaacaaaac

SEQ ID NO: 4845518 - DNA, 17 bp, Homo sapiens
gaaacactatttgtgac

SEQ ID NO: 4845519 - DNA, 18 bp, Homo sapiens
gaaaccagagtctgtatt

SEQ ID NO: 4845520 - DNA, 14 bp, Homo sapiens
gaaaccctgagcag

SEQ ID NO: 4845521 - DNA, 15 bp, Homo sapiens
gaaaccctgagcaga

SEQ ID NO: 4845522 - DNA, 15 bp, Homo sapiens
gaaacctgatgtcag

SEQ ID NO: 4845523 - DNA, 18 bp, Homo sapiens
gaaacctgccaaggagca

SEQ ID NO: 4845524 - DNA, 15 bp, Homo sapiens
gaaactgaggcccag

SEQ ID NO: 4845525 - DNA, 16 bp, Homo sapiens
gaaactgaggcccaga

SEQ ID NO: 4845526 - DNA, 18 bp, Homo sapiens
gaaagaggttaggagtag

SEQ ID NO: 4845527 - DNA, 23 bp, Homo sapiens
gaaagcaaaggtgcactccagac

SEQ ID NO: 4845528 - DNA, 22 bp, Homo sapiens
gaaagcagagttttcattaaat

SEQ ID NO: 4845529 - DNA, 19 bp, Homo sapiens
gaaagctaaagtttggttt

SEQ ID NO: 4845530 - DNA, 19 bp, Homo sapiens
gaaagctggtggcagagtc

SEQ ID NO: 4845531 - DNA, 14 bp, Homo sapiens
gaaaggaaaagaaa

SEQ ID NO: 4845532 - DNA, 16 bp, Homo sapiens
gaaaggcagggccctg

SEQ ID NO: 4845533 - DNA, 17 bp, Homo sapiens
gaaaggcagggccctga

SEQ ID NO: 4845534 - DNA, 10 bp, Homo sapiens
gaaagtcaga

SEQ ID NO: 4845535 - DNA, 17 bp, Homo sapiens
gaaagttaacattaatg

SEQ ID NO: 4845536 - DNA, 18 bp, Homo sapiens
gaaagtttttttttatta

SEQ ID NO: 4845537 - DNA, 16 bp, Homo sapiens
gaaataaaatatatct

SEQ ID NO: 4845538 - DNA, 19 bp, Homo sapiens
gaaataaaccaaaggaaaa

SEQ ID NO: 4845539 - DNA, 14 bp, Homo sapiens
gaaataatgctaca

SEQ ID NO: 4845540 - DNA, 13 bp, Homo sapiens
gaaataatgggat

SEQ ID NO: 4845541 - DNA, 13 bp, Homo sapiens
gaaatactcatgt

SEQ ID NO: 4845542 - DNA, 17 bp, Homo sapiens
gaaatataacacatttt

SEQ ID NO: 4845543 - DNA, 15 bp, Homo sapiens
gaaatatagtgcaat

SEQ ID NO: 4845544 - DNA, 16 bp, Homo sapiens
gaaatatagtgcaata

SEQ ID NO: 4845545 - DNA, 23 bp, Homo sapiens
gaaatatcaaagtcattaaagac

SEQ ID NO: 4845546 - DNA, 12 bp, Homo sapiens
gaaatgccccag

SEQ ID NO: 4845547 - DNA, 13 bp, Homo sapiens
gaaatgccccagt

SEQ ID NO: 4845548 - DNA, 16 bp, Homo sapiens
gaaatggaaagcagag

SEQ ID NO: 4845549 - DNA, 24 bp, Homo sapiens
gaaatggaggatctctaaagagca

SEQ ID NO: 4845550 - DNA, 16 bp, Homo sapiens
gaaatggcctgtccct

SEQ ID NO: 4845551 - DNA, 21 bp, Homo sapiens
gaaatggggaactcccccaga

SEQ ID NO: 4845552 - DNA, 15 bp, Homo sapiens
gaaattacctgtgga

SEQ ID NO: 4845553 - DNA, 18 bp, Homo sapiens
gaaattacctgtggatat

SEQ ID NO: 4845554 - DNA, 19 bp, Homo sapiens
gaaattacctgtggatatt

SEQ ID NO: 4845555 - DNA, 20 bp, Homo sapiens
gaaattctatttataataca

SEQ ID NO: 4845556 - DNA, 14 bp, Homo sapiens
gaaattttagaaat

SEQ ID NO: 4845557 - DNA, 23 bp, Homo sapiens
gaacaaagtaaaagtagtgttgt

SEQ ID NO: 4845558 - DNA, 17 bp, Homo sapiens
gaacacatgtgtatgat

SEQ ID NO: 4845559 - DNA, 12 bp, Homo sapiens
gaacactgtgac

SEQ ID NO: 4845560 - DNA, 13 bp, Homo sapiens
gaacagccttaga

SEQ ID NO: 4845561 - DNA, 18 bp, Homo sapiens
gaacataaaccctccaag

SEQ ID NO: 4845562 - DNA, 21 bp, Homo sapiens
gaaccagccaaccatcatgtg

SEQ ID NO: 4845563 - DNA, 17 bp, Homo sapiens
gaacccccctcccaccc

SEQ ID NO: 4845564 - DNA, 20 bp, Homo sapiens
gaaccgcagaagcctcccca

SEQ ID NO: 4845565 - DNA, 23 bp, Homo sapiens
gaacctacagttttaactgtgga

SEQ ID NO: 4845566 - DNA, 19 bp, Homo sapiens
gaacctctaagtgctgctg

SEQ ID NO: 4845567 - DNA, 21 bp, Homo sapiens
gaacctctaagtgctgctgtg

SEQ ID NO: 4845568 - DNA, 22 bp, Homo sapiens
gaacctctaagtgctgctgtgg

SEQ ID NO: 4845569 - DNA, 12 bp, Homo sapiens
gaacctgtgggc

SEQ ID NO: 4845570 - DNA, 12 bp, Homo sapiens
gaaccttctttg

SEQ ID NO: 4845571 - DNA, 15 bp, Homo sapiens
gaacggaggaggaca

SEQ ID NO: 4845572 - DNA, 11 bp, Homo sapiens
gaactccaggc

SEQ ID NO: 4845573 - DNA, 16 bp, Homo sapiens
gaactccaggcatgtg

SEQ ID NO: 4845574 - DNA, 19 bp, Homo sapiens
gaactccaggcatgtgtct

SEQ ID NO: 4845575 - DNA, 13 bp, Homo sapiens
gaactctgttccc

SEQ ID NO: 4845576 - DNA, 16 bp, Homo sapiens
gaactctgttccccca

SEQ ID NO: 4845577 - DNA, 19 bp, Homo sapiens
gaactctgttcccccaccc

SEQ ID NO: 4845578 - DNA, 16 bp, Homo sapiens
gaactcttcctcctcc

SEQ ID NO: 4845579 - DNA, 18 bp, Homo sapiens
gaactgaaatccttgaga

SEQ ID NO: 4845580 - DNA, 17 bp, Homo sapiens
gaacttcagcattgtaa

SEQ ID NO: 4845581 - DNA, 20 bp, Homo sapiens
gaacttgtgtccctaatgtg

SEQ ID NO: 4845582 - DNA, 15 bp, Homo sapiens
gaactttgtcagtgt

SEQ ID NO: 4845583 - DNA, 22 bp, Homo sapiens
gaactttgtgcttcaaggacat

SEQ ID NO: 4845584 - DNA, 20 bp, Homo sapiens
gaactttttaaagaagtgca

SEQ ID NO: 4845585 - DNA, 12 bp, Homo sapiens
gaagaaaatttg

SEQ ID NO: 4845586 - DNA, 15 bp, Homo sapiens
gaagaaggcaaggct

SEQ ID NO: 4845587 - DNA, 13 bp, Homo sapiens
gaagaaggccaga

SEQ ID NO: 4845588 - DNA, 14 bp, Homo sapiens
gaagagagttctgg

SEQ ID NO: 4845589 - DNA, 22 bp, Homo sapiens
gaagagcgagagatcaaagatg

SEQ ID NO: 4845590 - DNA, 15 bp, Homo sapiens
gaagagtggaaatgg

SEQ ID NO: 4845591 - DNA, 17 bp, Homo sapiens
gaagattctatgttaat

SEQ ID NO: 4845592 - DNA, 23 bp, Homo sapiens
gaagattctatgttaatatttta

SEQ ID NO: 4845593 - DNA, 22 bp, Homo sapiens
gaagcaagaggcaagctgaaat

SEQ ID NO: 4845594 - DNA, 17 bp, Homo sapiens
gaagcaataataaagta

SEQ ID NO: 4845595 - DNA, 12 bp, Homo sapiens
gaagcagaacct

SEQ ID NO: 4845596 - DNA, 21 bp, Homo sapiens
gaagcctccaagcctgcctcc

SEQ ID NO: 4845597 - DNA, 17 bp, Homo sapiens
gaaggagaagtaagagg

SEQ ID NO: 4845598 - DNA, 21 bp, Homo sapiens
gaaggatgatgtctttttatt

SEQ ID NO: 4845599 - DNA, 24 bp, Homo sapiens
gaaggcaaactgaggcagcatgca

SEQ ID NO: 4845600 - DNA, 13 bp, Homo sapiens
gaaggcagagaaa

SEQ ID NO: 4845601 - DNA, 14 bp, Homo sapiens
gaaggccagagagg

SEQ ID NO: 4845602 - DNA, 12 bp, Homo sapiens
gaaggggctggt

SEQ ID NO: 4845603 - DNA, 16 bp, Homo sapiens
gaaggtagaatgtttt

SEQ ID NO: 4845604 - DNA, 17 bp, Homo sapiens
gaaggtagaatgttttc

SEQ ID NO: 4845605 - DNA, 19 bp, Homo sapiens
gaaggtgaactttgtgctt

SEQ ID NO: 4845606 - DNA, 19 bp, Homo sapiens
gaaggtgataagggaaaag

SEQ ID NO: 4845607 - DNA, 23 bp, Homo sapiens
gaaggtgataagggaaaagataa

SEQ ID NO: 4845608 - DNA, 23 bp, Homo sapiens
gaagtacttggcccccttcagga

SEQ ID NO: 4845609 - DNA, 17 bp, Homo sapiens
gaagtcttctatttatt

SEQ ID NO: 4845610 - DNA, 14 bp, Homo sapiens
gaagtttgctgtgc

SEQ ID NO: 4845611 - DNA, 17 bp, Homo sapiens
gaagtttgctgtgcttt

SEQ ID NO: 4845612 - DNA, 17 bp, Homo sapiens
gaagtttggagatagat

SEQ ID NO: 4845613 - DNA, 16 bp, Homo sapiens
gaataccacatcaaat

SEQ ID NO: 4845614 - DNA, 17 bp, Homo sapiens
gaatactgccaaaacat

SEQ ID NO: 4845615 - DNA, 19 bp, Homo sapiens
gaatatgtagtatctatat

SEQ ID NO: 4845616 - DNA, 22 bp, Homo sapiens
gaatcagaagatagtcttggaa

SEQ ID NO: 4845617 - DNA, 12 bp, Homo sapiens
gaatccaagatt

SEQ ID NO: 4845618 - DNA, 16 bp, Homo sapiens
gaatctatgaacctga

SEQ ID NO: 4845619 - DNA, 18 bp, Homo sapiens
gaatcttcctggcacaat

SEQ ID NO: 4845620 - DNA, 19 bp, Homo sapiens
gaatctttgtaccaaaatt

SEQ ID NO: 4845621 - DNA, 15 bp, Homo sapiens
gaatgaaagctgttc

SEQ ID NO: 4845622 - DNA, 14 bp, Homo sapiens
gaatgaggaaaatt

SEQ ID NO: 4845623 - DNA, 21 bp, Homo sapiens
gaatggatttttctttaactg

SEQ ID NO: 4845624 - DNA, 12 bp, Homo sapiens
gaatggcctgga

SEQ ID NO: 4845625 - DNA, 15 bp, Homo sapiens
gaatggcctggagca

SEQ ID NO: 4845626 - DNA, 18 bp, Homo sapiens
gaatggcctggagcaggc

SEQ ID NO: 4845627 - DNA, 16 bp, Homo sapiens
gaatgggacgaggaca

SEQ ID NO: 4845628 - DNA, 22 bp, Homo sapiens
gaatgtattttcatagatgtgt

SEQ ID NO: 4845629 - DNA, 18 bp, Homo sapiens
gaatgtccaaaatttata

SEQ ID NO: 4845630 - DNA, 12 bp, Homo sapiens
gaatgtgctggt

SEQ ID NO: 4845631 - DNA, 18 bp, Homo sapiens
gaatgtgctggtgaacac

SEQ ID NO: 4845632 - DNA, 22 bp, Homo sapiens
gaattaatatccctacatgtat

SEQ ID NO: 4845633 - DNA, 16 bp, Homo sapiens
gaattgtcacatctat

SEQ ID NO: 4845634 - DNA, 22 bp, Homo sapiens
gaatttgtatatgactgcattt

SEQ ID NO: 4845635 - DNA, 17 bp, Homo sapiens
gaatttgtcgggttctc

SEQ ID NO: 4845636 - DNA, 14 bp, Homo sapiens
gaatttttaactgt

SEQ ID NO: 4845637 - DNA, 15 bp, Homo sapiens
gaatttttaactgta

SEQ ID NO: 4845638 - DNA, 16 bp, Homo sapiens
gacaaaaagtatatta

SEQ ID NO: 4845639 - DNA, 18 bp, Homo sapiens
gacaaaaagtatattaaa

SEQ ID NO: 4845640 - DNA, 22 bp, Homo sapiens
gacaaaaagtatattaaacaaa

SEQ ID NO: 4845641 - DNA, 19 bp, Homo sapiens
gacaaccttgtcccaagga

SEQ ID NO: 4845642 - DNA, 21 bp, Homo sapiens
gacaactcattttcatattgt

SEQ ID NO: 4845643 - DNA, 15 bp, Homo sapiens
gacaagtaatttcag

SEQ ID NO: 4845644 - DNA, 22 bp, Homo sapiens
gacacaactgtgtgattaaaag

SEQ ID NO: 4845645 - DNA, 20 bp, Homo sapiens
gacacaggatcctggcctga

SEQ ID NO: 4845646 - DNA, 23 bp, Homo sapiens
gacactgcagaaaccctgagcag

SEQ ID NO: 4845647 - DNA, 14 bp, Homo sapiens
gacagcaagtgagc

SEQ ID NO: 4845648 - DNA, 16 bp, Homo sapiens
gacagcagcctgtatg

SEQ ID NO: 4845649 - DNA, 13 bp, Homo sapiens
gacagccttgcaa

SEQ ID NO: 4845650 - DNA, 18 bp, Homo sapiens
gacagctggcggaggctg

SEQ ID NO: 4845651 - DNA, 20 bp, Homo sapiens
gacagctggcggaggctgct

SEQ ID NO: 4845652 - DNA, 17 bp, Homo sapiens
gacagcttacaggagcc

SEQ ID NO: 4845653 - DNA, 23 bp, Homo sapiens
gacagggcccccacaggggatgg

SEQ ID NO: 4845654 - DNA, 16 bp, Homo sapiens
gacagggccctggagc

SEQ ID NO: 4845655 - DNA, 17 bp, Homo sapiens
gacagtccgcagttgta

SEQ ID NO: 4845656 - DNA, 20 bp, Homo sapiens
gacagtgttccccgatacca

SEQ ID NO: 4845657 - DNA, 19 bp, Homo sapiens
gacagttgatggagcccca

SEQ ID NO: 4845658 - DNA, 12 bp, Homo sapiens
gacagtttttga

SEQ ID NO: 4845659 - DNA, 19 bp, Homo sapiens
gacagtttttgacatttat

SEQ ID NO: 4845660 - DNA, 14 bp, Homo sapiens
gacataagataaaa

SEQ ID NO: 4845661 - DNA, 20 bp, Homo sapiens
gacatcatcattcttgtggg

SEQ ID NO: 4845662 - DNA, 16 bp, Homo sapiens
ctataaggcagccttg

SEQ ID NO: 4845663 - DNA, 13 bp, Homo sapiens
ctatacacacaca

SEQ ID NO: 4845664 - DNA, 15 bp, Homo sapiens
ctatacacacacaca

SEQ ID NO: 4845665 - DNA, 22 bp, Homo sapiens
ctatactgtggcctgcaggagg

SEQ ID NO: 4845666 - DNA, 15 bp, Homo sapiens
ctatagcttgcagaa

SEQ ID NO: 4845667 - DNA, 21 bp, Homo sapiens
ctatagcttgcagaactgtag

SEQ ID NO: 4845668 - DNA, 16 bp, Homo sapiens
ctatatatataaatgt

SEQ ID NO: 4845669 - DNA, 17 bp, Homo sapiens
ctatatatataaatgta

SEQ ID NO: 4845670 - DNA, 16 bp, Homo sapiens
ctatattcctccagct

SEQ ID NO: 4845671 - DNA, 18 bp, Homo sapiens
ctatcttctttggacttc

SEQ ID NO: 4845672 - DNA, 19 bp, Homo sapiens
ctatcttttttagtgttaa

SEQ ID NO: 4845673 - DNA, 14 bp, Homo sapiens
ctatgtctggcaga

SEQ ID NO: 4845674 - DNA, 15 bp, Homo sapiens
ctatgtctggcagat

SEQ ID NO: 4845675 - DNA, 17 bp, Homo sapiens
ctatgtctggcagatga

SEQ ID NO: 4845676 - DNA, 14 bp, Homo sapiens
ctatgttccccagg

SEQ ID NO: 4845677 - DNA, 23 bp, Homo sapiens
ctattaaaaaagtctacaacata

SEQ ID NO: 4845678 - DNA, 12 bp, Homo sapiens
ctattgctgcta

SEQ ID NO: 4845679 - DNA, 20 bp, Homo sapiens
ctatttaaatccttggcttc

SEQ ID NO: 4845680 - DNA, 20 bp, Homo sapiens
ctatttcccccttcatccat

SEQ ID NO: 4845681 - DNA, 15 bp, Homo sapiens
ctattttctaaagac

SEQ ID NO: 4845682 - DNA, 21 bp, Homo sapiens
ctatttttaatttcctgtgag

SEQ ID NO: 4845683 - DNA, 22 bp, Homo sapiens
ctatttttaatttcctgtgagg

SEQ ID NO: 4845684 - DNA, 23 bp, Homo sapiens
ctatttttaatttcctgtgagga

SEQ ID NO: 4845685 - DNA, 22 bp, Homo sapiens
ctatttttgacatggaaatgaa

SEQ ID NO: 4845686 - DNA, 14 bp, Homo sapiens
ctcaaacctggcag

SEQ ID NO: 4845687 - DNA, 13 bp, Homo sapiens
ctcaaagaagtac

SEQ ID NO: 4845688 - DNA, 16 bp, Homo sapiens
ctcaaagaagtactgt

SEQ ID NO: 4845689 - DNA, 16 bp, Homo sapiens
ctcaaatacacatttg

SEQ ID NO: 4845690 - DNA, 17 bp, Homo sapiens
ctcaaatacacatttgc

SEQ ID NO: 4845691 - DNA, 20 bp, Homo sapiens
ctcaaataggctattaaaaa

SEQ ID NO: 4845692 - DNA, 16 bp, Homo sapiens
ctcaacattgcatggt

SEQ ID NO: 4845693 - DNA, 20 bp, Homo sapiens
ctcaagtcactcccaagccc

SEQ ID NO: 4845694 - DNA, 19 bp, Homo sapiens
ctcaatgaaccataaattc

SEQ ID NO: 4845695 - DNA, 20 bp, Homo sapiens
ctcaatgaaccataaattca

SEQ ID NO: 4845696 - DNA, 22 bp, Homo sapiens
ctcaatgcaagccccaactttc

SEQ ID NO: 4845697 - DNA, 14 bp, Homo sapiens
ctcacactggagga

SEQ ID NO: 4845698 - DNA, 14 bp, Homo sapiens
ctcacccccatccc

SEQ ID NO: 4845699 - DNA, 15 bp, Homo sapiens
ctcacttgcccacac

SEQ ID NO: 4845700 - DNA, 21 bp, Homo sapiens
ctcagaaacgagatcgggaag

SEQ ID NO: 4845701 - DNA, 13 bp, Homo sapiens
ctcagactgggca

SEQ ID NO: 4845702 - DNA, 13 bp, Homo sapiens
ctcagagaggtag

SEQ ID NO: 4845703 - DNA, 23 bp, Homo sapiens
ctcagagaggtagcactctcaga

SEQ ID NO: 4845704 - DNA, 14 bp, Homo sapiens
ctcagcagagtgag

SEQ ID NO: 4845705 - DNA, 19 bp, Homo sapiens
ctcagcctgctttcctgca

SEQ ID NO: 4845706 - DNA, 18 bp, Homo sapiens
ctcagcctggtttctggg

SEQ ID NO: 4845707 - DNA, 19 bp, Homo sapiens
ctcagcctggtttctgggt

SEQ ID NO: 4845708 - DNA, 22 bp, Homo sapiens
ctcagcctggtttctgggtgct

SEQ ID NO: 4845709 - DNA, 15 bp, Homo sapiens
ctcagctctctggga

SEQ ID NO: 4845710 - DNA, 20 bp, Homo sapiens
ctcagcttcttcacaggcac

SEQ ID NO: 4845711 - DNA, 23 bp, Homo sapiens
ctcaggacccatccctgcctgga

SEQ ID NO: 4845712 - DNA, 22 bp, Homo sapiens
ctcaggctccgggcaccagggg

SEQ ID NO: 4845713 - DNA, 21 bp, Homo sapiens
ctcagtgttttggtggaaaaa

SEQ ID NO: 4845714 - DNA, 13 bp, Homo sapiens
ctcagttctcaaa

SEQ ID NO: 4845715 - DNA, 16 bp, Homo sapiens
ctcagttctctccctt

SEQ ID NO: 4845716 - DNA, 20 bp, Homo sapiens
ctcagttctctcccttcctc

SEQ ID NO: 4845717 - DNA, 14 bp, Homo sapiens
ctcatcactggact

SEQ ID NO: 4845718 - DNA, 12 bp, Homo sapiens
ctcatgctgctc

SEQ ID NO: 4845719 - DNA, 12 bp, Homo sapiens
ctcattgacttt

SEQ ID NO: 4845720 - DNA, 14 bp, Homo sapiens
ctcattgactttta

SEQ ID NO: 4845721 - DNA, 21 bp, Homo sapiens
ctcattttatttacagctgtg

SEQ ID NO: 4845722 - DNA, 17 bp, Homo sapiens
ctcattttgcttcccat

SEQ ID NO: 4845723 - DNA, 12 bp, Homo sapiens
ctccaagcacta

SEQ ID NO: 4845724 - DNA, 22 bp, Homo sapiens
ctccaagcactagccttcccag

SEQ ID NO: 4845725 - DNA, 17 bp, Homo sapiens
ctccaagccctggggca

SEQ ID NO: 4845726 - DNA, 21 bp, Homo sapiens
ctccaagccctggggcagggt

SEQ ID NO: 4845727 - DNA, 17 bp, Homo sapiens
ctccaagcctgcctccc

SEQ ID NO: 4845728 - DNA, 19 bp, Homo sapiens
ctccaagcctgcctcccaa

SEQ ID NO: 4845729 - DNA, 13 bp, Homo sapiens
ctccaagggatct

SEQ ID NO: 4845730 - DNA, 14 bp, Homo sapiens
ctccaagggatctg

SEQ ID NO: 4845731 - DNA, 18 bp, Homo sapiens
ctccaaggtgatgttgta

SEQ ID NO: 4845732 - DNA, 14 bp, Homo sapiens
ctccactggaccct

SEQ ID NO: 4845733 - DNA, 19 bp, Homo sapiens
ctccagaaccgcagaagcc

SEQ ID NO: 4845734 - DNA, 13 bp, Homo sapiens
ctccagaagaaaa

SEQ ID NO: 4845735 - DNA, 19 bp, Homo sapiens
ctccagaagctgctccttt

SEQ ID NO: 4845736 - DNA, 18 bp, Homo sapiens
ctccagaagtcccttcaa

SEQ ID NO: 4845737 - DNA, 14 bp, Homo sapiens
ctccagactcagca

SEQ ID NO: 4845738 - DNA, 16 bp, Homo sapiens
ctccagactcagcaga

SEQ ID NO: 4845739 - DNA, 17 bp, Homo sapiens
ctccagactcagcagag

SEQ ID NO: 4845740 - DNA, 18 bp, Homo sapiens
ctccagactcagcagagt

SEQ ID NO: 4845741 - DNA, 14 bp, Homo sapiens
ctccagactctggg

SEQ ID NO: 4845742 - DNA, 22 bp, Homo sapiens
ctccagactctgggggtggaca

SEQ ID NO: 4845743 - DNA, 14 bp, Homo sapiens
ctccagccctgggc

SEQ ID NO: 4845744 - DNA, 16 bp, Homo sapiens
ctccagctgacagcca

SEQ ID NO: 4845745 - DNA, 17 bp, Homo sapiens
ctccagctgacagccac

SEQ ID NO: 4845746 - DNA, 17 bp, Homo sapiens
ctccaggagggctcggg

SEQ ID NO: 4845747 - DNA, 16 bp, Homo sapiens
ctccaggcatgtgtct

SEQ ID NO: 4845748 - DNA, 20 bp, Homo sapiens
ctccaggcatgtgtctggcc

SEQ ID NO: 4845749 - DNA, 15 bp, Homo sapiens
ctccaggctggaagt

SEQ ID NO: 4845750 - DNA, 13 bp, Homo sapiens
ctccagggtgaca

SEQ ID NO: 4845751 - DNA, 16 bp, Homo sapiens
ctccagggtgacaagg

SEQ ID NO: 4845752 - DNA, 21 bp, Homo sapiens
ctccatccacctcatcactgg

SEQ ID NO: 4845753 - DNA, 17 bp, Homo sapiens
ctccatgctcctcacct

SEQ ID NO: 4845754 - DNA, 21 bp, Homo sapiens
ctccatgctcctcacctgtct

SEQ ID NO: 4845755 - DNA, 23 bp, Homo sapiens
ctccatggagcctacctctgtct

SEQ ID NO: 4845756 - DNA, 19 bp, Homo sapiens
ctccatggggaggcctcac

SEQ ID NO: 4845757 - DNA, 16 bp, Homo sapiens
ctccattttcaagctg

SEQ ID NO: 4845758 - DNA, 22 bp, Homo sapiens
ctcccaacccattcactacagg

SEQ ID NO: 4845759 - DNA, 21 bp, Homo sapiens
ctcccaagctgatggacatga

SEQ ID NO: 4845760 - DNA, 20 bp, Homo sapiens
ctcccaaggcattctcccag

SEQ ID NO: 4845761 - DNA, 18 bp, Homo sapiens
ctcccacagcagccccag

SEQ ID NO: 4845762 - DNA, 19 bp, Homo sapiens
attaaagtcagaagtttta

SEQ ID NO: 4845763 - DNA, 16 bp, Homo sapiens
attaaatgcttcattt

SEQ ID NO: 4845764 - DNA, 14 bp, Homo sapiens
attaactatcttct

SEQ ID NO: 4845765 - DNA, 22 bp, Homo sapiens
attaactatcttctttggactt

SEQ ID NO: 4845766 - DNA, 13 bp, Homo sapiens
attaactgttgca

SEQ ID NO: 4845767 - DNA, 21 bp, Homo sapiens
attaactgttgcacttttgaa

SEQ ID NO: 4845768 - DNA, 18 bp, Homo sapiens
attaagctttttggaatc

SEQ ID NO: 4845769 - DNA, 19 bp, Homo sapiens
attaaggggaagaatgaaa

SEQ ID NO: 4845770 - DNA, 19 bp, Homo sapiens
attaatatccctacatgta

SEQ ID NO: 4845771 - DNA, 23 bp, Homo sapiens
attaatattcagggtaaatagga

SEQ ID NO: 4845772 - DNA, 18 bp, Homo sapiens
attaatggtttattcttt

SEQ ID NO: 4845773 - DNA, 13 bp, Homo sapiens
attacaaagttaa

SEQ ID NO: 4845774 - DNA, 15 bp, Homo sapiens
attacaaagttaaaa

SEQ ID NO: 4845775 - DNA, 21 bp, Homo sapiens
attacagaggtattaaaacta

SEQ ID NO: 4845776 - DNA, 22 bp, Homo sapiens
attacgaatgcccctgttcatg

SEQ ID NO: 4845777 - DNA, 21 bp, Homo sapiens
attactgacatttcttctagt

SEQ ID NO: 4845778 - DNA, 15 bp, Homo sapiens
attactgcaatcact

SEQ ID NO: 4845779 - DNA, 21 bp, Homo sapiens
attactgctttaatcagaaac

SEQ ID NO: 4845780 - DNA, 23 bp, Homo sapiens
attactttggggctaatttaaca

SEQ ID NO: 4845781 - DNA, 16 bp, Homo sapiens
attagaaacaaacaaa

SEQ ID NO: 4845782 - DNA, 18 bp, Homo sapiens
attagaaacaaacaaaac

SEQ ID NO: 4845783 - DNA, 13 bp, Homo sapiens
attagcaaggcag

SEQ ID NO: 4845784 - DNA, 14 bp, Homo sapiens
attagcaaggcaga

SEQ ID NO: 4845785 - DNA, 18 bp, Homo sapiens
attagcaaggcagagcct

SEQ ID NO: 4845786 - DNA, 23 bp, Homo sapiens
attagtgatgtccttaaaatgtg

SEQ ID NO: 4845787 - DNA, 16 bp, Homo sapiens
attatattcattcttt

SEQ ID NO: 4845788 - DNA, 13 bp, Homo sapiens
attatcagcaaag

SEQ ID NO: 4845789 - DNA, 16 bp, Homo sapiens
attatcagcaaagaaa

SEQ ID NO: 4845790 - DNA, 18 bp, Homo sapiens
attatctcctttgaagaa

SEQ ID NO: 4845791 - DNA, 17 bp, Homo sapiens
attatgtaaataactct

SEQ ID NO: 4845792 - DNA, 15 bp, Homo sapiens
attatttgattattt

SEQ ID NO: 4845793 - DNA, 16 bp, Homo sapiens
attatttgattattta

SEQ ID NO: 4845794 - DNA, 19 bp, Homo sapiens
attatttgattatttaaga

SEQ ID NO: 4845795 - DNA, 21 bp, Homo sapiens
attatttgattatttaagact

SEQ ID NO: 4845796 - DNA, 14 bp, Homo sapiens
attatttttataat

SEQ ID NO: 4845797 - DNA, 19 bp, Homo sapiens
attatttttataattgtac

SEQ ID NO: 4845798 - DNA, 21 bp, Homo sapiens
attatttttttaaaattttgt

SEQ ID NO: 4845799 - DNA, 12 bp, Homo sapiens
attcaaagcatg

SEQ ID NO: 4845800 - DNA, 14 bp, Homo sapiens
attcaactttgtaa

SEQ ID NO: 4845801 - DNA, 14 bp, Homo sapiens
attcacatttagaa

SEQ ID NO: 4845802 - DNA, 15 bp, Homo sapiens
attcacatttagaaa

SEQ ID NO: 4845803 - DNA, 13 bp, Homo sapiens
attcagaaatgtt

SEQ ID NO: 4845804 - DNA, 13 bp, Homo sapiens
attcagagaaatt

SEQ ID NO: 4845805 - DNA, 14 bp, Homo sapiens
attcagatgtatgt

SEQ ID NO: 4845806 - DNA, 13 bp, Homo sapiens
attcatccttcca

SEQ ID NO: 4845807 - DNA, 15 bp, Homo sapiens
attcatctaatgtat

SEQ ID NO: 4845808 - DNA, 16 bp, Homo sapiens
attcattctttttgaa

SEQ ID NO: 4845809 - DNA, 12 bp, Homo sapiens
attccaaaatat

SEQ ID NO: 4845810 - DNA, 19 bp, Homo sapiens
attccagatctttcagaaa

SEQ ID NO: 4845811 - DNA, 17 bp, Homo sapiens
attcccaaatcctagac

SEQ ID NO: 4845812 - DNA, 18 bp, Homo sapiens
attcccaaatcctagact

SEQ ID NO: 4845813 - DNA, 13 bp, Homo sapiens
attcccagcctga

SEQ ID NO: 4845814 - DNA, 16 bp, Homo sapiens
attccccagtgactcc

SEQ ID NO: 4845815 - DNA, 17 bp, Homo sapiens
attccccagtgactcca

SEQ ID NO: 4845816 - DNA, 23 bp, Homo sapiens
attccccccattttgcctctgtc

SEQ ID NO: 4845817 - DNA, 12 bp, Homo sapiens
attcctccagct

SEQ ID NO: 4845818 - DNA, 16 bp, Homo sapiens
attcctccctccggcc

SEQ ID NO: 4845819 - DNA, 19 bp, Homo sapiens
attcctgatcccatggcca

SEQ ID NO: 4845820 - DNA, 14 bp, Homo sapiens
attcctttgcatat

SEQ ID NO: 4845821 - DNA, 15 bp, Homo sapiens
attctataaaactct

SEQ ID NO: 4845822 - DNA, 15 bp, Homo sapiens
attctatgttaatat

SEQ ID NO: 4845823 - DNA, 23 bp, Homo sapiens
attctcccagctctagcctctgg

SEQ ID NO: 4845824 - DNA, 23 bp, Homo sapiens
attctgattattgagttccagtt

SEQ ID NO: 4845825 - DNA, 15 bp, Homo sapiens
ccagtgactccaggg

SEQ ID NO: 4845826 - DNA, 18 bp, Homo sapiens
ccagtggtggaggtgggt

SEQ ID NO: 4845827 - DNA, 23 bp, Homo sapiens
ccagtgtctaggcactgagcagg

SEQ ID NO: 4845828 - DNA, 17 bp, Homo sapiens
ccagttacttgggcttc

SEQ ID NO: 4845829 - DNA, 12 bp, Homo sapiens
ccagttcaaaaa

SEQ ID NO: 4845830 - DNA, 21 bp, Homo sapiens
ccataagagaaacctgccaag

SEQ ID NO: 4845831 - DNA, 20 bp, Homo sapiens
ccatactccttgcttcctga

SEQ ID NO: 4845832 - DNA, 16 bp, Homo sapiens
ccatagatgctggctg

SEQ ID NO: 4845833 - DNA, 17 bp, Homo sapiens
ccatagatgctggctgg

SEQ ID NO: 4845834 - DNA, 18 bp, Homo sapiens
ccatcatgtgtagagccc

SEQ ID NO: 4845835 - DNA, 20 bp, Homo sapiens
ccatcccactgctcccccaa

SEQ ID NO: 4845836 - DNA, 16 bp, Homo sapiens
ccatccctgcctggag

SEQ ID NO: 4845837 - DNA, 15 bp, Homo sapiens
ccatcctaggaacca

SEQ ID NO: 4845838 - DNA, 13 bp, Homo sapiens
ccatcctgagcca

SEQ ID NO: 4845839 - DNA, 22 bp, Homo sapiens
ccatcgccgggactccagaacc

SEQ ID NO: 4845840 - DNA, 18 bp, Homo sapiens
ccatctccacaggagaga

SEQ ID NO: 4845841 - DNA, 23 bp, Homo sapiens
ccatcttctttcttccacccaca

SEQ ID NO: 4845842 - DNA, 18 bp, Homo sapiens
ccatgccaataaagtgat

SEQ ID NO: 4845843 - DNA, 11 bp, Homo sapiens
ccatgccccca

SEQ ID NO: 4845844 - DNA, 15 bp, Homo sapiens
ccatgctcctcacct

SEQ ID NO: 4845845 - DNA, 16 bp, Homo sapiens
ccatgctcctcacctg

SEQ ID NO: 4845846 - DNA, 14 bp, Homo sapiens
ccatggagcctacc

SEQ ID NO: 4845847 - DNA, 14 bp, Homo sapiens
ccatggctgaagct

SEQ ID NO: 4845848 - DNA, 15 bp, Homo sapiens
ccatggctgaagctg

SEQ ID NO: 4845849 - DNA, 23 bp, Homo sapiens
ccatggctgaagctggagcagcg

SEQ ID NO: 4845850 - DNA, 16 bp, Homo sapiens
ccatgggggcacttga

SEQ ID NO: 4845851 - DNA, 22 bp, Homo sapiens
ccattacagaggtattaaaact

SEQ ID NO: 4845852 - DNA, 22 bp, Homo sapiens
ccattacctccatccatccttc

SEQ ID NO: 4845853 - DNA, 13 bp, Homo sapiens
ccattcatccttc

SEQ ID NO: 4845854 - DNA, 19 bp, Homo sapiens
ccattcatccttccatcca

SEQ ID NO: 4845855 - DNA, 20 bp, Homo sapiens
ccattcatccttccatccat

SEQ ID NO: 4845856 - DNA, 11 bp, Homo sapiens
ccattccaaaa

SEQ ID NO: 4845857 - DNA, 21 bp, Homo sapiens
ccattccaaaatattatgccc

SEQ ID NO: 4845858 - DNA, 19 bp, Homo sapiens
ccattccgggttcactccc

SEQ ID NO: 4845859 - DNA, 17 bp, Homo sapiens
ccattctattctccaga

SEQ ID NO: 4845860 - DNA, 19 bp, Homo sapiens
cctgctcaatccctgagga

SEQ ID NO: 4845861 - DNA, 21 bp, Homo sapiens
cctgctgggcgtgtgtgacac

SEQ ID NO: 4845862 - DNA, 14 bp, Homo sapiens
cctgcttcccacaa

SEQ ID NO: 4845863 - DNA, 23 bp, Homo sapiens
cctggacctgccctgggccacac

SEQ ID NO: 4845864 - DNA, 13 bp, Homo sapiens
cctggagaagtag

SEQ ID NO: 4845865 - DNA, 13 bp, Homo sapiens
cctggagcaggcc

SEQ ID NO: 4845866 - DNA, 16 bp, Homo sapiens
cctggagcaggcccaa

SEQ ID NO: 4845867 - DNA, 21 bp, Homo sapiens
cctggagcaggcccaatgctg

SEQ ID NO: 4845868 - DNA, 22 bp, Homo sapiens
cctggagcttcagccaggtctg

SEQ ID NO: 4845869 - DNA, 18 bp, Homo sapiens
cctggaggacggccggct

SEQ ID NO: 4845870 - DNA, 21 bp, Homo sapiens
cctggcaaatgcctgactcag

SEQ ID NO: 4845871 - DNA, 21 bp, Homo sapiens
cctggcacaatgttggagcag

SEQ ID NO: 4845872 - DNA, 16 bp, Homo sapiens
cctggcagatgggggc

SEQ ID NO: 4845873 - DNA, 20 bp, Homo sapiens
cctggcagatgggggcctct

SEQ ID NO: 4845874 - DNA, 15 bp, Homo sapiens
cctggccaggcaggg

SEQ ID NO: 4845875 - DNA, 14 bp, Homo sapiens
cctggcctagaaag

SEQ ID NO: 4845876 - DNA, 14 bp, Homo sapiens
cctggctgttctga

SEQ ID NO: 4845877 - DNA, 13 bp, Homo sapiens
cctgggcacaaac

SEQ ID NO: 4845878 - DNA, 22 bp, Homo sapiens
cctgggcattagcaaggcagag

SEQ ID NO: 4845879 - DNA, 16 bp, Homo sapiens
cctgggctcagcctgg

SEQ ID NO: 4845880 - DNA, 15 bp, Homo sapiens
cctgggctgtgagga

SEQ ID NO: 4845881 - DNA, 12 bp, Homo sapiens
cctggggcaggg

SEQ ID NO: 4845882 - DNA, 16 bp, Homo sapiens
cctgtccctagggctc

SEQ ID NO: 4845883 - DNA, 18 bp, Homo sapiens
cctgtccctagggctctc

SEQ ID NO: 4845884 - DNA, 21 bp, Homo sapiens
cctgtctaacttggggaaggg

SEQ ID NO: 4845885 - DNA, 14 bp, Homo sapiens
cctgtctaggtctc

SEQ ID NO: 4845886 - DNA, 17 bp, Homo sapiens
cctgtctaggtctcctc

SEQ ID NO: 4845887 - DNA, 20 bp, Homo sapiens
cctgtctaggtctcctcagg

SEQ ID NO: 4845888 - DNA, 18 bp, Homo sapiens
cctgtcttctttctccat

SEQ ID NO: 4845889 - DNA, 22 bp, Homo sapiens
cctgtcttctttctccatggag

SEQ ID NO: 4845890 - DNA, 19 bp, Homo sapiens
cctgtgaccagtctgaccc

SEQ ID NO: 4845891 - DNA, 20 bp, Homo sapiens
cctgtgagcatggggccagg

SEQ ID NO: 4845892 - DNA, 21 bp, Homo sapiens
cctgtgagcatggggccagga

SEQ ID NO: 4845893 - DNA, 23 bp, Homo sapiens
cctgtgaggatagagacttgcag

SEQ ID NO: 4845894 - DNA, 17 bp, Homo sapiens
cctgtgctgaacataac

SEQ ID NO: 4845895 - DNA, 23 bp, Homo sapiens
cctgtgctgaacataacttctca

SEQ ID NO: 4845896 - DNA, 19 bp, Homo sapiens
cctgtggaaggcagagaaa

SEQ ID NO: 4845897 - DNA, 15 bp, Homo sapiens
cctgtggcaggaggc

SEQ ID NO: 4845898 - DNA, 15 bp, Homo sapiens
cctgtggcataaatt

SEQ ID NO: 4845899 - DNA, 14 bp, Homo sapiens
cctgtggtcatgtg

SEQ ID NO: 4845900 - DNA, 21 bp, Homo sapiens
cctgttcatgtttttgtttta

SEQ ID NO: 4845901 - DNA, 19 bp, Homo sapiens
cctgttgtcagatctattg

SEQ ID NO: 4845902 - DNA, 13 bp, Homo sapiens
ccttaaatttaat

SEQ ID NO: 4845903 - DNA, 13 bp, Homo sapiens
ccttaccccagtc

SEQ ID NO: 4845904 - DNA, 21 bp, Homo sapiens
ccttacttcaaagtgcctggg

SEQ ID NO: 4845905 - DNA, 22 bp, Homo sapiens
ccttatctgaaaggccagcagc

SEQ ID NO: 4845906 - DNA, 21 bp, Homo sapiens
ccttcaacctgcatagccggt

SEQ ID NO: 4845907 - DNA, 13 bp, Homo sapiens
ccttcaggagcct

SEQ ID NO: 4845908 - DNA, 17 bp, Homo sapiens
ccttcaggagcctggcc

SEQ ID NO: 4845909 - DNA, 18 bp, Homo sapiens
ccttcaggagcctggcca

SEQ ID NO: 4845910 - DNA, 15 bp, Homo sapiens
ccttcatcagaactc

SEQ ID NO: 4845911 - DNA, 20 bp, Homo sapiens
ccttcatcagaactcttcct

SEQ ID NO: 4845912 - DNA, 20 bp, Homo sapiens
ccttcatccatcctgagcca

SEQ ID NO: 4845913 - DNA, 24 bp, Homo sapiens
ccttccatccatctttccatccat

SEQ ID NO: 4845914 - DNA, 20 bp, Homo sapiens
ccttccctgggtttgggagc

SEQ ID NO: 4845915 - DNA, 15 bp, Homo sapiens
ccttcctcctctcaa

SEQ ID NO: 4845916 - DNA, 16 bp, Homo sapiens
ccttcctgctgctgct

SEQ ID NO: 4845917 - DNA, 18 bp, Homo sapiens
ccttcctgctgctgctac

SEQ ID NO: 4845918 - DNA, 22 bp, Homo sapiens
ccttctaggatagcgctcccct

SEQ ID NO: 4845919 - DNA, 16 bp, Homo sapiens
ccttctcatcttgcct

SEQ ID NO: 4845920 - DNA, 17 bp, Homo sapiens
ccttctccctagctcct

SEQ ID NO: 4845921 - DNA, 22 bp, Homo sapiens
ccttgagagttccggggagaaa

SEQ ID NO: 4845922 - DNA, 20 bp, Homo sapiens
ccttgagattctgaagtatg

SEQ ID NO: 4845923 - DNA, 13 bp, Homo sapiens
ccttgagtctctg

SEQ ID NO: 4845924 - DNA, 18 bp, Homo sapiens
ccttgagttaacaggaca

SEQ ID NO: 4845925 - DNA, 19 bp, Homo sapiens
ccttgagttaacaggacag

SEQ ID NO: 4845926 - DNA, 20 bp, Homo sapiens
ccttgcagatatctgcatgt

SEQ ID NO: 4845927 - DNA, 15 bp, Homo sapiens
ccttgcagcggctcc

SEQ ID NO: 4845928 - DNA, 19 bp, Homo sapiens
ccttgcaggggtcccccct

SEQ ID NO: 4845929 - DNA, 20 bp, Homo sapiens
ccttgcccagactacagggc

SEQ ID NO: 4845930 - DNA, 15 bp, Homo sapiens
ccttgcttccttctc

SEQ ID NO: 4845931 - DNA, 18 bp, Homo sapiens
ccttggacattttatgtc

SEQ ID NO: 4845932 - DNA, 17 bp, Homo sapiens
ccttggattttcctgaa

SEQ ID NO: 4845933 - DNA, 13 bp, Homo sapiens
ccttgggtccccc

SEQ ID NO: 4845934 - DNA, 13 bp, Homo sapiens
ccttgtttaatgg

SEQ ID NO: 4845935 - DNA, 20 bp, Homo sapiens
cctttacagctctcctccag

SEQ ID NO: 4845936 - DNA, 16 bp, Homo sapiens
cctttatgttctttca

SEQ ID NO: 4845937 - DNA, 18 bp, Homo sapiens
cctttcattaccctacag

SEQ ID NO: 4845938 - DNA, 20 bp, Homo sapiens
cctttcattaccctacagac

SEQ ID NO: 4845939 - DNA, 14 bp, Homo sapiens
cctttcccctctca

SEQ ID NO: 4845940 - DNA, 15 bp, Homo sapiens
cctttcccctctcat

SEQ ID NO: 4845941 - DNA, 13 bp, Homo sapiens
cctttcctgatgc

SEQ ID NO: 4845942 - DNA, 11 bp, Homo sapiens
cctttcctggc

SEQ ID NO: 4845943 - DNA, 13 bp, Homo sapiens
cctttgaagaagg

SEQ ID NO: 4845944 - DNA, 23 bp, Homo sapiens
cctttgcagttggactctcaggg

SEQ ID NO: 4845945 - DNA, 14 bp, Homo sapiens
ccttttaagcatgt

SEQ ID NO: 4845946 - DNA, 14 bp, Homo sapiens
ccttttcaggaaaa

SEQ ID NO: 4845947 - DNA, 14 bp, Homo sapiens
ccttttcaggagat

SEQ ID NO: 4845948 - DNA, 16 bp, Homo sapiens
ccttttttttttcttg

SEQ ID NO: 4845949 - DNA, 15 bp, Homo sapiens
cgaaatatcaaagtc

SEQ ID NO: 4845950 - DNA, 17 bp, Homo sapiens
cgaaatatcaaagtcat

SEQ ID NO: 4845951 - DNA, 19 bp, Homo sapiens
cgaacagccttagagctct

SEQ ID NO: 4845952 - DNA, 15 bp, Homo sapiens
cgaagagttcccttg

SEQ ID NO: 4845953 - DNA, 16 bp, Homo sapiens
cgactactgctcctgt

SEQ ID NO: 4845954 - DNA, 22 bp, Homo sapiens
catctgttagcagagtctgtct

SEQ ID NO: 4845955 - DNA, 12 bp, Homo sapiens
catctttagaaa

SEQ ID NO: 4845956 - DNA, 17 bp, Homo sapiens
catctttattgaaattc

SEQ ID NO: 4845957 - DNA, 21 bp, Homo sapiens
catctttattgaaattctatt

SEQ ID NO: 4845958 - DNA, 14 bp, Homo sapiens
catctttccatcca

SEQ ID NO: 4845959 - DNA, 18 bp, Homo sapiens
catgaagcagaaccttct

SEQ ID NO: 4845960 - DNA, 15 bp, Homo sapiens
catgaatgtgctggt

SEQ ID NO: 4845961 - DNA, 21 bp, Homo sapiens
catgaattttaaagtatgcat

SEQ ID NO: 4845962 - DNA, 13 bp, Homo sapiens
catgacagcctcc

SEQ ID NO: 4845963 - DNA, 19 bp, Homo sapiens
catgagagtagggccctga

SEQ ID NO: 4845964 - DNA, 22 bp, Homo sapiens
catgagagtagggccctgacag

SEQ ID NO: 4845965 - DNA, 19 bp, Homo sapiens
catgagttatcatgaattt

SEQ ID NO: 4845966 - DNA, 23 bp, Homo sapiens
catgatttccctccagagaaagc

SEQ ID NO: 4845967 - DNA, 16 bp, Homo sapiens
catgcaaatgagctct

SEQ ID NO: 4845968 - DNA, 22 bp, Homo sapiens
catgcaaatgagctctgaaatc

SEQ ID NO: 4845969 - DNA, 18 bp, Homo sapiens
catgcaataaaatttaaa

SEQ ID NO: 4845970 - DNA, 20 bp, Homo sapiens
catgcatataatgaataaat

SEQ ID NO: 4845971 - DNA, 22 bp, Homo sapiens
catgcatataatgaataaatca

SEQ ID NO: 4845972 - DNA, 12 bp, Homo sapiens
catgccaataaa

SEQ ID NO: 4845973 - DNA, 21 bp, Homo sapiens
catgccaataaagtgatctgt

SEQ ID NO: 4845974 - DNA, 13 bp, Homo sapiens
catgcctgatgaa

SEQ ID NO: 4845975 - DNA, 14 bp, Homo sapiens
catgcctgatgaaa

SEQ ID NO: 4845976 - DNA, 23 bp, Homo sapiens
catgcgtggccacgggggcagtg

SEQ ID NO: 4845977 - DNA, 15 bp, Homo sapiens
catgctcaccgccct

SEQ ID NO: 4845978 - DNA, 14 bp, Homo sapiens
catgctcctcacct

SEQ ID NO: 4845979 - DNA, 18 bp, Homo sapiens
catgctcctcacctgtct

SEQ ID NO: 4845980 - DNA, 16 bp, Homo sapiens
catgcttcacaatgtt

SEQ ID NO: 4845981 - DNA, 18 bp, Homo sapiens
catggaaatgaagcaggg

SEQ ID NO: 4845982 - DNA, 15 bp, Homo sapiens
catggacatttagaa

SEQ ID NO: 4845983 - DNA, 20 bp, Homo sapiens
catggcagcctactctcctt

SEQ ID NO: 4845984 - DNA, 13 bp, Homo sapiens
catggcaggagtc

SEQ ID NO: 4845985 - DNA, 18 bp, Homo sapiens
catggcatgcttaaattt

SEQ ID NO: 4845986 - DNA, 19 bp, Homo sapiens
catggctgaagctggagca

SEQ ID NO: 4845987 - DNA, 15 bp, Homo sapiens
catggctgctgttgc

SEQ ID NO: 4845988 - DNA, 13 bp, Homo sapiens
catggggaggcag

SEQ ID NO: 4845989 - DNA, 15 bp, Homo sapiens
catggggaggcagca

SEQ ID NO: 4845990 - DNA, 20 bp, Homo sapiens
catggggaggcagcagagcg

SEQ ID NO: 4845991 - DNA, 21 bp, Homo sapiens
catggggaggcagcagagcgg

SEQ ID NO: 4845992 - DNA, 15 bp, Homo sapiens
catggggccaggaaa

SEQ ID NO: 4845993 - DNA, 19 bp, Homo sapiens
catgggggcacttgagttt

SEQ ID NO: 4845994 - DNA, 21 bp, Homo sapiens
catggtgctagtgggccctct

SEQ ID NO: 4845995 - DNA, 20 bp, Homo sapiens
catgtacttccctcttgaaa

SEQ ID NO: 4845996 - DNA, 16 bp, Homo sapiens
catgtgacatttatat

SEQ ID NO: 4845997 - DNA, 18 bp, Homo sapiens
catgtgaccactctgtct

SEQ ID NO: 4845998 - DNA, 22 bp, Homo sapiens
catgtgacttctcccctgccct

SEQ ID NO: 4845999 - DNA, 16 bp, Homo sapiens
catgtgagtctgggat

SEQ ID NO: 4846000 - DNA, 21 bp, Homo sapiens
catgtgagtgacgatgatgta

SEQ ID NO: 4846001 - DNA, 15 bp, Homo sapiens
catgtgatacatttt

SEQ ID NO: 4846002 - DNA, 17 bp, Homo sapiens
catgtgtagagccccta

SEQ ID NO: 4846003 - DNA, 14 bp, Homo sapiens
catgtgtcccagga

SEQ ID NO: 4846004 - DNA, 18 bp, Homo sapiens
catgtgtcccaggagcag

SEQ ID NO: 4846005 - DNA, 14 bp, Homo sapiens
catgtgtctggccc

SEQ ID NO: 4846006 - DNA, 16 bp, Homo sapiens
catgttcccaaaacaa

SEQ ID NO: 4846007 - DNA, 18 bp, Homo sapiens
catgttcccaaaacaatg

SEQ ID NO: 4846008 - DNA, 12 bp, Homo sapiens
catgttcccaga

SEQ ID NO: 4846009 - DNA, 22 bp, Homo sapiens
catgttctccattttcaagctg

SEQ ID NO: 4846010 - DNA, 12 bp, Homo sapiens
catgtttggaaa

SEQ ID NO: 4846011 - DNA, 20 bp, Homo sapiens
catgtttttgttttaaaacg

SEQ ID NO: 4846012 - DNA, 15 bp, Homo sapiens
cattaaagtcagaag

SEQ ID NO: 4846013 - DNA, 18 bp, Homo sapiens
cattaaagtcagaagttt

SEQ ID NO: 4846014 - DNA, 13 bp, Homo sapiens
cattaactgttgc

SEQ ID NO: 4846015 - DNA, 14 bp, Homo sapiens
cattaactgttgca

SEQ ID NO: 4846016 - DNA, 22 bp, Homo sapiens
cattaactgttgcacttttgaa

SEQ ID NO: 4846017 - DNA, 21 bp, Homo sapiens
cattaaggggaagaatgaaag

SEQ ID NO: 4846018 - DNA, 22 bp, Homo sapiens
cattaatgcctgctttttggaa

SEQ ID NO: 4846019 - DNA, 22 bp, Homo sapiens
cattacaactgaccaagtttct

SEQ ID NO: 4846020 - DNA, 16 bp, Homo sapiens
cattacctccatccat

SEQ ID NO: 4846021 - DNA, 21 bp, Homo sapiens
cattacctccatccatccttc

SEQ ID NO: 4846022 - DNA, 19 bp, Homo sapiens
cattagcaaggcagagcct

SEQ ID NO: 4846023 - DNA, 20 bp, Homo sapiens
cattagcaaggcagagcctt

SEQ ID NO: 4846024 - DNA, 13 bp, Homo sapiens
cattagttttgaa

SEQ ID NO: 4846025 - DNA, 15 bp, Homo sapiens
cattatgttaatatt

SEQ ID NO: 4846026 - DNA, 16 bp, Homo sapiens
cattatgttaatattt

SEQ ID NO: 4846027 - DNA, 13 bp, Homo sapiens
cattattaaattg

SEQ ID NO: 4846028 - DNA, 18 bp, Homo sapiens
cattcagagctatggtgc

SEQ ID NO: 4846029 - DNA, 23 bp, Homo sapiens
cattcccagcctgactagaactc

SEQ ID NO: 4846030 - DNA, 18 bp, Homo sapiens
cattctattctccagaca

SEQ ID NO: 4846031 - DNA, 13 bp, Homo sapiens
cattctcccagct

SEQ ID NO: 4846032 - DNA, 14 bp, Homo sapiens
cattctcccagctc

SEQ ID NO: 4846033 - DNA, 15 bp, Homo sapiens
cattctcccagctct

SEQ ID NO: 4846034 - DNA, 21 bp, Homo sapiens
cattctgaattaattaatttg

SEQ ID NO: 4846035 - DNA, 18 bp, Homo sapiens
cattcttactaaaaagta

SEQ ID NO: 4846036 - DNA, 22 bp, Homo sapiens
cattcttactaaaaagtataaa

SEQ ID NO: 4846037 - DNA, 21 bp, Homo sapiens
cattcttgtgggagacagcag

SEQ ID NO: 4846038 - DNA, 21 bp, Homo sapiens
cattgaagaatgttagagtaa

SEQ ID NO: 4846039 - DNA, 10 bp, Homo sapiens
cattgagtat

SEQ ID NO: 4846040 - DNA, 11 bp, Homo sapiens
cattgcagcct

SEQ ID NO: 4846041 - DNA, 20 bp, Homo sapiens
cattgcagcctaagaagaag

SEQ ID NO: 4846042 - DNA, 23 bp, Homo sapiens
cattgcagcctaagaagaaggcc

SEQ ID NO: 4846043 - DNA, 21 bp, Homo sapiens
cattggcaaagtgacaaagca

SEQ ID NO: 4846044 - DNA, 23 bp, Homo sapiens
cattggggtagttgtgtttcaac

SEQ ID NO: 4846045 - DNA, 19 bp, Homo sapiens
cattgtcaccgcaggtgct

SEQ ID NO: 4846046 - DNA, 22 bp, Homo sapiens
cattgtttagatgaggctcaga

SEQ ID NO: 4846047 - DNA, 14 bp, Homo sapiens
catttaataaagat

SEQ ID NO: 4846048 - DNA, 18 bp, Homo sapiens
catttaataaagatgagt

SEQ ID NO: 4846049 - DNA, 19 bp, Homo sapiens
catttaataaagatgagtt

SEQ ID NO: 4846050 - DNA, 13 bp, Homo sapiens
catttaatgccat

SEQ ID NO: 4846051 - DNA, 21 bp, Homo sapiens
catttaatggcagctagtgcc

SEQ ID NO: 4846052 - DNA, 12 bp, Homo sapiens
catttagaaaag

SEQ ID NO: 4846053 - DNA, 15 bp, Homo sapiens
catttagtaagaata

SEQ ID NO: 4846054 - DNA, 15 bp, Homo sapiens
catttagtcatgtga

SEQ ID NO: 4846055 - DNA, 13 bp, Homo sapiens
catttatatattg

SEQ ID NO: 4846056 - DNA, 22 bp, Homo sapiens
catttatatattgaattaatat

SEQ ID NO: 4846057 - DNA, 17 bp, Homo sapiens
catttatattaaataac

SEQ ID NO: 4846058 - DNA, 21 bp, Homo sapiens
catttatattaaataacatgt

SEQ ID NO: 4846059 - DNA, 18 bp, Homo sapiens
catttatgacaagctgta

SEQ ID NO: 4846060 - DNA, 19 bp, Homo sapiens
catttatgacaagctgtat

SEQ ID NO: 4846061 - DNA, 16 bp, Homo sapiens
catttattaagcagta

SEQ ID NO: 4846062 - DNA, 14 bp, Homo sapiens
catttccattgctt

SEQ ID NO: 4846063 - DNA, 21 bp, Homo sapiens
catttctatattcctccagct

SEQ ID NO: 4846064 - DNA, 13 bp, Homo sapiens
catttctttgcat

SEQ ID NO: 4846065 - DNA, 18 bp, Homo sapiens
cattttaattttaaagtg

SEQ ID NO: 4846066 - DNA, 21 bp, Homo sapiens
cattttattaagctttttgga

SEQ ID NO: 4846067 - DNA, 22 bp, Homo sapiens
cattttattaagctttttggaa

SEQ ID NO: 4846068 - DNA, 18 bp, Homo sapiens
cattttatttacagctgt

SEQ ID NO: 4846069 - DNA, 21 bp, Homo sapiens
cattttatttacagctgtgct

SEQ ID NO: 4846070 - DNA, 19 bp, Homo sapiens
cattttcatattgtaatct

SEQ ID NO: 4846071 - DNA, 15 bp, Homo sapiens
cattttgcttcccat

SEQ ID NO: 4846072 - DNA, 13 bp, Homo sapiens
cattttttaagct

SEQ ID NO: 4846073 - DNA, 15 bp, Homo sapiens
ccaaaattttaaaaa

SEQ ID NO: 4846074 - DNA, 18 bp, Homo sapiens
ccaaacctgggaaggcca

SEQ ID NO: 4846075 - DNA, 14 bp, Homo sapiens
ccaaagctgttcca

SEQ ID NO: 4846076 - DNA, 22 bp, Homo sapiens
ccaaagtacagaatttgaatta

SEQ ID NO: 4846077 - DNA, 12 bp, Homo sapiens
ccaaataaataa

SEQ ID NO: 4846078 - DNA, 19 bp, Homo sapiens
ccaaatagtgtgaaatata

SEQ ID NO: 4846079 - DNA, 21 bp, Homo sapiens
ccaaatgcagggaggggaggc

SEQ ID NO: 4846080 - DNA, 18 bp, Homo sapiens
ccaaatttaaaactgttg

SEQ ID NO: 4846081 - DNA, 17 bp, Homo sapiens
ccaacatatatttattg

SEQ ID NO: 4846082 - DNA, 21 bp, Homo sapiens
ccaacctacattccaccctgt

SEQ ID NO: 4846083 - DNA, 17 bp, Homo sapiens
ccaacctcaggctccta

SEQ ID NO: 4846084 - DNA, 14 bp, Homo sapiens
ccaacctccagact

SEQ ID NO: 4846085 - DNA, 15 bp, Homo sapiens
ccaacctccagactc

SEQ ID NO: 4846086 - DNA, 17 bp, Homo sapiens
ccaactttttcatagta

SEQ ID NO: 4846087 - DNA, 12 bp, Homo sapiens
ccaagccctggg

SEQ ID NO: 4846088 - DNA, 13 bp, Homo sapiens
ccaagcctgcctc

SEQ ID NO: 4846089 - DNA, 18 bp, Homo sapiens
ccaagctgatggacatga

SEQ ID NO: 4846090 - DNA, 23 bp, Homo sapiens
ccaagctggcacaaaagacagct

SEQ ID NO: 4846091 - DNA, 16 bp, Homo sapiens
ccaagcttcccaacag

SEQ ID NO: 4846092 - DNA, 15 bp, Homo sapiens
ccaagctttaaatta

SEQ ID NO: 4846093 - DNA, 18 bp, Homo sapiens
ccaaggaaaggcatgtac

SEQ ID NO: 4846094 - DNA, 22 bp, Homo sapiens
ccaaggccgccagcgtgtggag

SEQ ID NO: 4846095 - DNA, 23 bp, Homo sapiens
ccaaggccgccagcgtgtggagc

SEQ ID NO: 4846096 - DNA, 23 bp, Homo sapiens
ccaagggacagcaagtgagcaga

SEQ ID NO: 4846097 - DNA, 14 bp, Homo sapiens
ccaaggtcctgctc

SEQ ID NO: 4846098 - DNA, 15 bp, Homo sapiens
ccaaggtcctgctca

SEQ ID NO: 4846099 - DNA, 14 bp, Homo sapiens
ccaagtggtgagca

SEQ ID NO: 4846100 - DNA, 18 bp, Homo sapiens
ccaagtggtgagcaagca

SEQ ID NO: 4846101 - DNA, 23 bp, Homo sapiens
ccaagttggaagggaccccagat

SEQ ID NO: 4846102 - DNA, 17 bp, Homo sapiens
ccaatacaaaatgtatt

SEQ ID NO: 4846103 - DNA, 15 bp, Homo sapiens
ccaataccttcaagg

SEQ ID NO: 4846104 - DNA, 13 bp, Homo sapiens
ccaatatatgtat

SEQ ID NO: 4846105 - DNA, 14 bp, Homo sapiens
ccaatatatgtatt

SEQ ID NO: 4846106 - DNA, 19 bp, Homo sapiens
ccaatccatcgtattaaaa

SEQ ID NO: 4846107 - DNA, 11 bp, Homo sapiens
ccaatctgtac

SEQ ID NO: 4846108 - DNA, 12 bp, Homo sapiens
ccaatgctgctt

SEQ ID NO: 4846109 - DNA, 16 bp, Homo sapiens
ccaatgctgcttttgg

SEQ ID NO: 4846110 - DNA, 15 bp, Homo sapiens
ccacaaacctgcccg

SEQ ID NO: 4846111 - DNA, 17 bp, Homo sapiens
ccacaactcccttgcac

SEQ ID NO: 4846112 - DNA, 19 bp, Homo sapiens
ccacaactcccttgcacgt

SEQ ID NO: 4846113 - DNA, 14 bp, Homo sapiens
ccacactgcttggc

SEQ ID NO: 4846114 - DNA, 21 bp, Homo sapiens
ccacactgcttggcccttcaa

SEQ ID NO: 4846115 - DNA, 16 bp, Homo sapiens
ccacacttgaaacctt

SEQ ID NO: 4846116 - DNA, 17 bp, Homo sapiens
ccacacttgaaaccttt

SEQ ID NO: 4846117 - DNA, 13 bp, Homo sapiens
cacctccttctgc

SEQ ID NO: 4846118 - DNA, 16 bp, Homo sapiens
cacctccttctgcagt

SEQ ID NO: 4846119 - DNA, 15 bp, Homo sapiens
cacctgtagcagcca

SEQ ID NO: 4846120 - DNA, 22 bp, Homo sapiens
caccttgaccaaaatcagcttt

SEQ ID NO: 4846121 - DNA, 19 bp, Homo sapiens
cacgatgcatttaataaag

SEQ ID NO: 4846122 - DNA, 14 bp, Homo sapiens
cacgcctcaccagc

SEQ ID NO: 4846123 - DNA, 17 bp, Homo sapiens
cacgttggggtgattta

SEQ ID NO: 4846124 - DNA, 20 bp, Homo sapiens
cacgttggggtgatttaatc

SEQ ID NO: 4846125 - DNA, 14 bp, Homo sapiens
cactaacagagtgg

SEQ ID NO: 4846126 - DNA, 21 bp, Homo sapiens
cactacaggtgaaggctctca

SEQ ID NO: 4846127 - DNA, 20 bp, Homo sapiens
cactaggaatcccagaggtg

SEQ ID NO: 4846128 - DNA, 16 bp, Homo sapiens
cactaggactcagaaa

SEQ ID NO: 4846129 - DNA, 15 bp, Homo sapiens
cactatttgtgactt

SEQ ID NO: 4846130 - DNA, 21 bp, Homo sapiens
cactcagaaaattccctgggg

SEQ ID NO: 4846131 - DNA, 18 bp, Homo sapiens
cactccagactctggggg

SEQ ID NO: 4846132 - DNA, 13 bp, Homo sapiens
cactccagctgac

SEQ ID NO: 4846133 - DNA, 23 bp, Homo sapiens
cactcccaagggacagcaagtga

SEQ ID NO: 4846134 - DNA, 13 bp, Homo sapiens
cactcccagtgct

SEQ ID NO: 4846135 - DNA, 15 bp, Homo sapiens
cactccttcatgttt

SEQ ID NO: 4846136 - DNA, 20 bp, Homo sapiens
cactccttcatgtttggaaa

SEQ ID NO: 4846137 - DNA, 23 bp, Homo sapiens
cactctggcttcaaaaagccaca

SEQ ID NO: 4846138 - DNA, 20 bp, Homo sapiens
cactgccttcgtttatattt

SEQ ID NO: 4846139 - DNA, 22 bp, Homo sapiens
cactgcggctgtctccttgaag

SEQ ID NO: 4846140 - DNA, 15 bp, Homo sapiens
cactggactgcatgg

SEQ ID NO: 4846141 - DNA, 16 bp, Homo sapiens
cactggactgcatggg

SEQ ID NO: 4846142 - DNA, 22 bp, Homo sapiens
cactggactgcatggggaggca

SEQ ID NO: 4846143 - DNA, 20 bp, Homo sapiens
cactggccggagtcagtgcc

SEQ ID NO: 4846144 - DNA, 18 bp, Homo sapiens
cactggccttgcctccag

SEQ ID NO: 4846145 - DNA, 14 bp, Homo sapiens
cactgtactgcatg

SEQ ID NO: 4846146 - DNA, 15 bp, Homo sapiens
cacttattgaatata

SEQ ID NO: 4846147 - DNA, 17 bp, Homo sapiens
cacttgctcccaaccca

SEQ ID NO: 4846148 - DNA, 21 bp, Homo sapiens
cactttcaagaatcagacagc

SEQ ID NO: 4846149 - DNA, 14 bp, Homo sapiens
cacttttccttttc

SEQ ID NO: 4846150 - DNA, 15 bp, Homo sapiens
cagaaaattccctgg

SEQ ID NO: 4846151 - DNA, 18 bp, Homo sapiens
cagaaaccaacaagaacc

SEQ ID NO: 4846152 - DNA, 19 bp, Homo sapiens
cagaaagcctgggtgacat

SEQ ID NO: 4846153 - DNA, 23 bp, Homo sapiens
cagaaaggtgtgaggagagagga

SEQ ID NO: 4846154 - DNA, 16 bp, Homo sapiens
cagaaatagacaaaaa

SEQ ID NO: 4846155 - DNA, 15 bp, Homo sapiens
cagaaatatagtgca

SEQ ID NO: 4846156 - DNA, 15 bp, Homo sapiens
cagaaatggaaagca

SEQ ID NO: 4846157 - DNA, 17 bp, Homo sapiens
cagaaatggaaagcaga

SEQ ID NO: 4846158 - DNA, 20 bp, Homo sapiens
cagaaattcaatttggattt

SEQ ID NO: 4846159 - DNA, 16 bp, Homo sapiens
cagaacatatgttgca

SEQ ID NO: 4846160 - DNA, 17 bp, Homo sapiens
cagaacctctaagtgct

SEQ ID NO: 4846161 - DNA, 20 bp, Homo sapiens
cagaacctctaagtgctgct

SEQ ID NO: 4846162 - DNA, 21 bp, Homo sapiens
cagaacctctaagtgctgctg

SEQ ID NO: 4846163 - DNA, 13 bp, Homo sapiens
cagaacgtggctc

SEQ ID NO: 4846164 - DNA, 14 bp, Homo sapiens
cagaactcttcctc

SEQ ID NO: 4846165 - DNA, 22 bp, Homo sapiens
cagaactcttcctcctcccaag

SEQ ID NO: 4846166 - DNA, 21 bp, Homo sapiens
cagaagaatcttcctggcaca

SEQ ID NO: 4846167 - DNA, 22 bp, Homo sapiens
cagaagcctccaagcctgcctc

SEQ ID NO: 4846168 - DNA, 18 bp, Homo sapiens
cagaagcctccccagctc

SEQ ID NO: 4846169 - DNA, 16 bp, Homo sapiens
cagaagctgctccttt

SEQ ID NO: 4846170 - DNA, 20 bp, Homo sapiens
cagaaggtgaactttgtgct

SEQ ID NO: 4846171 - DNA, 22 bp, Homo sapiens
cagaagtcacacattacaaagt

SEQ ID NO: 4846172 - DNA, 13 bp, Homo sapiens
cagaatcttgttt

SEQ ID NO: 4846173 - DNA, 19 bp, Homo sapiens
cagaatcttgttttgaaaa

SEQ ID NO: 4846174 - DNA, 20 bp, Homo sapiens
cagaatcttgttttgaaaat

SEQ ID NO: 4846175 - DNA, 15 bp, Homo sapiens
cagaatgaccttgag

SEQ ID NO: 4846176 - DNA, 16 bp, Homo sapiens
cagaatgaccttgagt

SEQ ID NO: 4846177 - DNA, 17 bp, Homo sapiens
cagaatttttaactgta

SEQ ID NO: 4846178 - DNA, 17 bp, Homo sapiens
cagacaaccttgtccca

SEQ ID NO: 4846179 - DNA, 16 bp, Homo sapiens
cagacagccatgcgtg

SEQ ID NO: 4846180 - DNA, 12 bp, Homo sapiens
cagacatttctt

SEQ ID NO: 4846181 - DNA, 18 bp, Homo sapiens
cagacatttctttggaaa

SEQ ID NO: 4846182 - DNA, 12 bp, Homo sapiens
cagacctggagc

SEQ ID NO: 4846183 - DNA, 15 bp, Homo sapiens
cagactcagcagagt

SEQ ID NO: 4846184 - DNA, 16 bp, Homo sapiens
cagactgggcactggg

SEQ ID NO: 4846185 - DNA, 15 bp, Homo sapiens
cagactgttgagtta

SEQ ID NO: 4846186 - DNA, 11 bp, Homo sapiens
cagagaaagca

SEQ ID NO: 4846187 - DNA, 22 bp, Homo sapiens
cagagaaagcaaaggtgcactc

SEQ ID NO: 4846188 - DNA, 17 bp, Homo sapiens
cagagaaatgccccagt

SEQ ID NO: 4846189 - DNA, 15 bp, Homo sapiens
cagagacaagtaatt

SEQ ID NO: 4846190 - DNA, 23 bp, Homo sapiens
cagagacactgttgataaaaact

SEQ ID NO: 4846191 - DNA, 12 bp, Homo sapiens
cagagagggaaa

SEQ ID NO: 4846192 - DNA, 20 bp, Homo sapiens
cagagagggaaaaggcaggt

SEQ ID NO: 4846193 - DNA, 23 bp, Homo sapiens
cagagagggaaaaggcaggtgct

SEQ ID NO: 4846194 - DNA, 20 bp, Homo sapiens
cagagagggaagatgacctg

SEQ ID NO: 4846195 - DNA, 23 bp, Homo sapiens
cagagatgcctgatttcattcct

SEQ ID NO: 4846196 - DNA, 13 bp, Homo sapiens
cagagatgtactg

SEQ ID NO: 4846197 - DNA, 19 bp, Homo sapiens
cagagcagggtctctctaa

SEQ ID NO: 4846198 - DNA, 22 bp, Homo sapiens
cagagcctttttacctggccta

SEQ ID NO: 4846199 - DNA, 23 bp, Homo sapiens
cagagcctttttacctggcctag

SEQ ID NO: 4846200 - DNA, 22 bp, Homo sapiens
cagagcggggtcccctctgtgc

SEQ ID NO: 4846201 - DNA, 22 bp, Homo sapiens
cagagctctcccctcctgctgg

SEQ ID NO: 4846202 - DNA, 13 bp, Homo sapiens
cagagctctgggt

SEQ ID NO: 4846203 - DNA, 18 bp, Homo sapiens
cagaggaccaatgcttgc

SEQ ID NO: 4846204 - DNA, 18 bp, Homo sapiens
cagaggtggggtgctggg

SEQ ID NO: 4846205 - DNA, 21 bp, Homo sapiens
cagaggtggggtgctggggct

SEQ ID NO: 4846206 - DNA, 19 bp, Homo sapiens
cagaggtttgaaggagaat

SEQ ID NO: 4846207 - DNA, 21 bp, Homo sapiens
cagagtgagggggtaaagcag

SEQ ID NO: 4846208 - DNA, 19 bp, Homo sapiens
cagagtgggctttggtggc

SEQ ID NO: 4846209 - DNA, 22 bp, Homo sapiens
cagagtgttttgaccagtttaa

SEQ ID NO: 4846210 - DNA, 22 bp, Homo sapiens
cagagttttcattaaatccttt

SEQ ID NO: 4846211 - DNA, 16 bp, Homo sapiens
cagataaacaaacaag

SEQ ID NO: 4846212 - DNA, 17 bp, Homo sapiens
cagatacctgtgaggac

SEQ ID NO: 4846213 - DNA, 18 bp, Homo sapiens
cagataccttatcttaca

SEQ ID NO: 4846214 - DNA, 16 bp, Homo sapiens
cagatatctgcatgtg

SEQ ID NO: 4846215 - DNA, 15 bp, Homo sapiens
cagatcacccattcc

SEQ ID NO: 4846216 - DNA, 20 bp, Homo sapiens
cagatctattgtttgttgca

SEQ ID NO: 4846217 - DNA, 12 bp, Homo sapiens
cagatctgtttt

SEQ ID NO: 4846218 - DNA, 16 bp, Homo sapiens
cagatgagggctggct

SEQ ID NO: 4846219 - DNA, 14 bp, Homo sapiens
cagatggagcccat

SEQ ID NO: 4846220 - DNA, 16 bp, Homo sapiens
cagatgggggcctctc

SEQ ID NO: 4846221 - DNA, 18 bp, Homo sapiens
cagatgtgctataatctg

SEQ ID NO: 4846222 - DNA, 20 bp, Homo sapiens
cagatgtgctataatctgtt

SEQ ID NO: 4846223 - DNA, 22 bp, Homo sapiens
cagatgtgctataatctgtttt

SEQ ID NO: 4846224 - DNA, 16 bp, Homo sapiens
cagcaaattccagatt

SEQ ID NO: 4846225 - DNA, 18 bp, Homo sapiens
cagcaacccttcctgctg

SEQ ID NO: 4846226 - DNA, 15 bp, Homo sapiens
cagcacaaagcactg

SEQ ID NO: 4846227 - DNA, 17 bp, Homo sapiens
cagcactttgggaggct

SEQ ID NO: 4846228 - DNA, 22 bp, Homo sapiens
cagcactttgggaggctgaggc

SEQ ID NO: 4846229 - DNA, 22 bp, Homo sapiens
cagcagagcggggtcccctctg

SEQ ID NO: 4846230 - DNA, 15 bp, Homo sapiens
cagcagccccaggag

SEQ ID NO: 4846231 - DNA, 18 bp, Homo sapiens
cagcagccccaggagaag

SEQ ID NO: 4846232 - DNA, 13 bp, Homo sapiens
cagcagcctgtat

SEQ ID NO: 4846233 - DNA, 16 bp, Homo sapiens
cagcagcctgtatgtg

SEQ ID NO: 4846234 - DNA, 19 bp, Homo sapiens
cagcagctgatgctgtact

SEQ ID NO: 4846235 - DNA, 23 bp, Homo sapiens
cagcaggaagccatagatgctgg

SEQ ID NO: 4846236 - DNA, 12 bp, Homo sapiens
cagcaggccaga

SEQ ID NO: 4846237 - DNA, 16 bp, Homo sapiens
cagcaggcctctggga

SEQ ID NO: 4846238 - DNA, 23 bp, Homo sapiens
cagcaggcctctgggacccacag

SEQ ID NO: 4846239 - DNA, 21 bp, Homo sapiens
cagcagtcgcccaagcagaca

SEQ ID NO: 4846240 - DNA, 22 bp, Homo sapiens
cagcagtcgcccaagcagacag

SEQ ID NO: 4846241 - DNA, 17 bp, Homo sapiens
cagcatccaccccaccc

SEQ ID NO: 4846242 - DNA, 17 bp, Homo sapiens
cagcatccagtgtgaga

SEQ ID NO: 4846243 - DNA, 13 bp, Homo sapiens
cagcattgtaatt

SEQ ID NO: 4846244 - DNA, 17 bp, Homo sapiens
cagcattgtaattatgt

SEQ ID NO: 4846245 - DNA, 16 bp, Homo sapiens
cagcattgtgtggaat

SEQ ID NO: 4846246 - DNA, 16 bp, Homo sapiens
cagccaagctggcaca

SEQ ID NO: 4846247 - DNA, 23 bp, Homo sapiens
cagccagaacgtggctctgctgg

SEQ ID NO: 4846248 - DNA, 19 bp, Homo sapiens
cagccaggtctgactccaa

SEQ ID NO: 4846249 - DNA, 22 bp, Homo sapiens
cagccagtcccgtttcatttag

SEQ ID NO: 4846250 - DNA, 14 bp, Homo sapiens
cagccatgcgtggc

SEQ ID NO: 4846251 - DNA, 19 bp, Homo sapiens
cagcccaaacctgggaagg

SEQ ID NO: 4846252 - DNA, 15 bp, Homo sapiens
cagcccgcagaggtg

SEQ ID NO: 4846253 - DNA, 17 bp, Homo sapiens
cagcccgcagaggtggg

SEQ ID NO: 4846254 - DNA, 12 bp, Homo sapiens
cagccctggcaa

SEQ ID NO: 4846255 - DNA, 12 bp, Homo sapiens
cagccctgggca

SEQ ID NO: 4846256 - DNA, 12 bp, Homo sapiens
cagccgcagaga

SEQ ID NO: 4846257 - DNA, 17 bp, Homo sapiens
cagccgcagagaaatgc

SEQ ID NO: 4846258 - DNA, 13 bp, Homo sapiens
cagcctaagaaga

SEQ ID NO: 4846259 - DNA, 17 bp, Homo sapiens
cagcctaagaagaaggc

SEQ ID NO: 4846260 - DNA, 22 bp, Homo sapiens
cagcctcagggacgactctgac

SEQ ID NO: 4846261 - DNA, 23 bp, Homo sapiens
cagcctctgacttaagctgcctc

SEQ ID NO: 4846262 - DNA, 12 bp, Homo sapiens
cagcctgcttcc

SEQ ID NO: 4846263 - DNA, 14 bp, Homo sapiens
cagcctgcttccca

SEQ ID NO: 4846264 - DNA, 16 bp, Homo sapiens
cagcctgcttcccaca

SEQ ID NO: 4846265 - DNA, 16 bp, Homo sapiens
cagcctggtttctggg

SEQ ID NO: 4846266 - DNA, 14 bp, Homo sapiens
cagccttaatattt

SEQ ID NO: 4846267 - DNA, 17 bp, Homo sapiens
cagccttagagctcttg

SEQ ID NO: 4846268 - DNA, 18 bp, Homo sapiens
cagccttagagctcttgt

SEQ ID NO: 4846269 - DNA, 21 bp, Homo sapiens
cagccttgcagcggctcctgc

SEQ ID NO: 4846270 - DNA, 22 bp, Homo sapiens
cagccttgcagcggctcctgca

SEQ ID NO: 4846271 - DNA, 21 bp, Homo sapiens
cagccttgtacagtctgctcc

SEQ ID NO: 4846272 - DNA, 15 bp, Homo sapiens
cagcggattgctctg

SEQ ID NO: 4846273 - DNA, 17 bp, Homo sapiens
cagcggattgctctgga

SEQ ID NO: 4846274 - DNA, 20 bp, Homo sapiens
cagcggattgctctggagca

SEQ ID NO: 4846275 - DNA, 14 bp, Homo sapiens
cagcggctcctgca

SEQ ID NO: 4846276 - DNA, 15 bp, Homo sapiens
cagcggctcctgcaa

SEQ ID NO: 4846277 - DNA, 18 bp, Homo sapiens
cagcggtgccaacctctt

SEQ ID NO: 4846278 - DNA, 15 bp, Homo sapiens
cagcgtgtggagcag

SEQ ID NO: 4846279 - DNA, 17 bp, Homo sapiens
cagcgtgtggagcagag

SEQ ID NO: 4846280 - DNA, 18 bp, Homo sapiens
cagcgtgtggagcagagc

SEQ ID NO: 4846281 - DNA, 22 bp, Homo sapiens
cagcgtgtggagcagagctctc

SEQ ID NO: 4846282 - DNA, 14 bp, Homo sapiens
cagctcacccctgg

SEQ ID NO: 4846283 - DNA, 13 bp, Homo sapiens
cagctcagtgttt

SEQ ID NO: 4846284 - DNA, 19 bp, Homo sapiens
cagctccgggatcagcaac

SEQ ID NO: 4846285 - DNA, 16 bp, Homo sapiens
cagctctagcctctgg

SEQ ID NO: 4846286 - DNA, 20 bp, Homo sapiens
cagctctagcctctggactg

SEQ ID NO: 4846287 - DNA, 14 bp, Homo sapiens
cagctctcctccag

SEQ ID NO: 4846288 - DNA, 15 bp, Homo sapiens
cagctctcctccagc

SEQ ID NO: 4846289 - DNA, 19 bp, Homo sapiens
cagctctcctccagccctg

SEQ ID NO: 4846290 - DNA, 21 bp, Homo sapiens
cagctctcctccagccctggg

SEQ ID NO: 4846291 - DNA, 20 bp, Homo sapiens
cagctctctgggacctcctt

SEQ ID NO: 4846292 - DNA, 11 bp, Homo sapiens
cagctgaaatt

SEQ ID NO: 4846293 - DNA, 18 bp, Homo sapiens
cagctgaaattcaccaag

SEQ ID NO: 4846294 - DNA, 19 bp, Homo sapiens
cagctgaaattcaccaaga

SEQ ID NO: 4846295 - DNA, 13 bp, Homo sapiens
cagctgctgttga

SEQ ID NO: 4846296 - DNA, 17 bp, Homo sapiens
cagctggcggaggctgc

SEQ ID NO: 4846297 - DNA, 21 bp, Homo sapiens
cagctgtgctccacactcaga

SEQ ID NO: 4846298 - DNA, 15 bp, Homo sapiens
cagcttacaggagcc

SEQ ID NO: 4846299 - DNA, 19 bp, Homo sapiens
cagcttacaggagccagcc

SEQ ID NO: 4846300 - DNA, 20 bp, Homo sapiens
cagcttcggagggcccctgc

SEQ ID NO: 4846301 - DNA, 23 bp, Homo sapiens
cagcttcggagggcccctgcgtg

SEQ ID NO: 4846302 - DNA, 14 bp, Homo sapiens
cagcttgctgggct

SEQ ID NO: 4846303 - DNA, 16 bp, Homo sapiens
cagcttgctgggcttt

SEQ ID NO: 4846304 - DNA, 23 bp, Homo sapiens
cagcttgctgggctttgggaagt

SEQ ID NO: 4846305 - DNA, 19 bp, Homo sapiens
caggacagttgatggagcc

SEQ ID NO: 4846306 - DNA, 21 bp, Homo sapiens
caggacagttgatggagcccc

SEQ ID NO: 4846307 - DNA, 19 bp, Homo sapiens
caggacatgcaataaaatt

SEQ ID NO: 4846308 - DNA, 22 bp, Homo sapiens
caggacccatccctgcctggag

SEQ ID NO: 4846309 - DNA, 23 bp, Homo sapiens
caggacccatccctgcctggagg

SEQ ID NO: 4846310 - DNA, 20 bp, Homo sapiens
caggactcccagaacctcta

SEQ ID NO: 4846311 - DNA, 21 bp, Homo sapiens
caggactcccagaacctctaa

SEQ ID NO: 4846312 - DNA, 22 bp, Homo sapiens
caggactcccagaacctctaag

SEQ ID NO: 4846313 - DNA, 16 bp, Homo sapiens
caggactctctccagg

SEQ ID NO: 4846314 - DNA, 16 bp, Homo sapiens
caggacttgaaagaaa

SEQ ID NO: 4846315 - DNA, 23 bp, Homo sapiens
caggagaaggggctttgtgacca

SEQ ID NO: 4846316 - DNA, 15 bp, Homo sapiens
caggagatggggaat

SEQ ID NO: 4846317 - DNA, 14 bp, Homo sapiens
caggagccagcctg

SEQ ID NO: 4846318 - DNA, 15 bp, Homo sapiens
caggagccagcctgc

SEQ ID NO: 4846319 - DNA, 13 bp, Homo sapiens
caggagcccccct

SEQ ID NO: 4846320 - DNA, 15 bp, Homo sapiens
caggagcctggccag

SEQ ID NO: 4846321 - DNA, 21 bp, Homo sapiens
caggagcctggccaggcaggg

SEQ ID NO: 4846322 - DNA, 22 bp, Homo sapiens
caggagggttggagtgctcttc

SEQ ID NO: 4846323 - DNA, 15 bp, Homo sapiens
caggatccccctctt

SEQ ID NO: 4846324 - DNA, 20 bp, Homo sapiens
caggatgtgtgggccaggat

SEQ ID NO: 4846325 - DNA, 16 bp, Homo sapiens
caggcacattaactgt

SEQ ID NO: 4846326 - DNA, 14 bp, Homo sapiens
caggcagggagaga

SEQ ID NO: 4846327 - DNA, 20 bp, Homo sapiens
caggcatgtgtctggcccta

SEQ ID NO: 4846328 - DNA, 22 bp, Homo sapiens
caggccaaagagtctccagttt

SEQ ID NO: 4846329 - DNA, 18 bp, Homo sapiens
caggccaagggaccaggt

SEQ ID NO: 4846330 - DNA, 14 bp, Homo sapiens
caggccagagaaag

SEQ ID NO: 4846331 - DNA, 14 bp, Homo sapiens
caggcctctgggac

SEQ ID NO: 4846332 - DNA, 17 bp, Homo sapiens
caggcctctgggaccca

SEQ ID NO: 4846333 - DNA, 21 bp, Homo sapiens
caggcctctgggacccacaga

SEQ ID NO: 4846334 - DNA, 21 bp, Homo sapiens
caggccttatctgaaaggcca

SEQ ID NO: 4846335 - DNA, 19 bp, Homo sapiens
caggccttcctcctctcaa

SEQ ID NO: 4846336 - DNA, 13 bp, Homo sapiens
caggctcaggaga

SEQ ID NO: 4846337 - DNA, 18 bp, Homo sapiens
caggctcaggagaagcca

SEQ ID NO: 4846338 - DNA, 21 bp, Homo sapiens
caggctccgggcaccaggggc

SEQ ID NO: 4846339 - DNA, 15 bp, Homo sapiens
caggctgcagaggca

SEQ ID NO: 4846340 - DNA, 16 bp, Homo sapiens
cagggaatggccacaa

SEQ ID NO: 4846341 - DNA, 18 bp, Homo sapiens
cagggaatggccacaaac

SEQ ID NO: 4846342 - DNA, 14 bp, Homo sapiens
cagggacagggccc

SEQ ID NO: 4846343 - DNA, 14 bp, Homo sapiens
cagggatggaggga

SEQ ID NO: 4846344 - DNA, 13 bp, Homo sapiens
cagggcagcaggc

SEQ ID NO: 4846345 - DNA, 16 bp, Homo sapiens
cagggcagcaggccag

SEQ ID NO: 4846346 - DNA, 16 bp, Homo sapiens
cagggcccccacaggg

SEQ ID NO: 4846347 - DNA, 21 bp, Homo sapiens
cagggccctgaaatggcctgt

SEQ ID NO: 4846348 - DNA, 20 bp, Homo sapiens
cagggccctggagctcaggg

SEQ ID NO: 4846349 - DNA, 19 bp, Homo sapiens
cagggctcacgtgggaacc

SEQ ID NO: 4846350 - DNA, 17 bp, Homo sapiens
caggggagacgaggcca

SEQ ID NO: 4846351 - DNA, 13 bp, Homo sapiens
caggggagccagc

SEQ ID NO: 4846352 - DNA, 14 bp, Homo sapiens
caggggagccagct

SEQ ID NO: 4846353 - DNA, 19 bp, Homo sapiens
caggggagccagctgcttg

SEQ ID NO: 4846354 - DNA, 18 bp, Homo sapiens
caggggctggtgggacag

SEQ ID NO: 4846355 - DNA, 14 bp, Homo sapiens
caggggtcccccct

SEQ ID NO: 4846356 - DNA, 18 bp, Homo sapiens
cagggtctctcagggatg

SEQ ID NO: 4846357 - DNA, 13 bp, Homo sapiens
cagggtggggggt

SEQ ID NO: 4846358 - DNA, 20 bp, Homo sapiens
cagggtggggggtgacagtg

SEQ ID NO: 4846359 - DNA, 20 bp, Homo sapiens
cagggtttacatgaagcaga

SEQ ID NO: 4846360 - DNA, 17 bp, Homo sapiens
caggtcacacgaggggc

SEQ ID NO: 4846361 - DNA, 15 bp, Homo sapiens
caggtccagatgtgc

SEQ ID NO: 4846362 - DNA, 20 bp, Homo sapiens
caggtcccagccccttttcc

SEQ ID NO: 4846363 - DNA, 14 bp, Homo sapiens
caggtctgactcca

SEQ ID NO: 4846364 - DNA, 15 bp, Homo sapiens
caggtctgactccaa

SEQ ID NO: 4846365 - DNA, 16 bp, Homo sapiens
caggtctgactccaaa

SEQ ID NO: 4846366 - DNA, 18 bp, Homo sapiens
caggtctgactccaaagc

SEQ ID NO: 4846367 - DNA, 18 bp, Homo sapiens
caggtgcctaacctggga

SEQ ID NO: 4846368 - DNA, 16 bp, Homo sapiens
caggtgctcatgctgc

SEQ ID NO: 4846369 - DNA, 17 bp, Homo sapiens
caggtgctcatgctgct

SEQ ID NO: 4846370 - DNA, 13 bp, Homo sapiens
caggtgcttttgg

SEQ ID NO: 4846371 - DNA, 22 bp, Homo sapiens
caggtgcttttggcagagacca

SEQ ID NO: 4846372 - DNA, 18 bp, Homo sapiens
caggtgtttgtggggctg

SEQ ID NO: 4846373 - DNA, 20 bp, Homo sapiens
caggttagtgacatttaatg

SEQ ID NO: 4846374 - DNA, 16 bp, Homo sapiens
caggttataacagtgt

SEQ ID NO: 4846375 - DNA, 20 bp, Homo sapiens
cagtaagttatctttgaata

SEQ ID NO: 4846376 - DNA, 18 bp, Homo sapiens
cagtaatgctaaatgtgt

SEQ ID NO: 4846377 - DNA, 15 bp, Homo sapiens
cagtacatttaaatt

SEQ ID NO: 4846378 - DNA, 16 bp, Homo sapiens
cagtacatttaaattt

SEQ ID NO: 4846379 - DNA, 20 bp, Homo sapiens
cagtacatttaaattttttg

SEQ ID NO: 4846380 - DNA, 22 bp, Homo sapiens
cagtactattcaggtaacacta

SEQ ID NO: 4846381 - DNA, 16 bp, Homo sapiens
cagtagcatctcagtg

SEQ ID NO: 4846382 - DNA, 19 bp, Homo sapiens
cagtatgtgggatattgaa

SEQ ID NO: 4846383 - DNA, 14 bp, Homo sapiens
cagtatttttaaag

SEQ ID NO: 4846384 - DNA, 15 bp, Homo sapiens
cagtatttttaaagg

SEQ ID NO: 4846385 - DNA, 17 bp, Homo sapiens
cagtcactgctgcaagg

SEQ ID NO: 4846386 - DNA, 16 bp, Homo sapiens
cagtccaaaagtgttg

SEQ ID NO: 4846387 - DNA, 14 bp, Homo sapiens
cagtcctaacaaat

SEQ ID NO: 4846388 - DNA, 21 bp, Homo sapiens
cagtctcagtccaaaagtgtt

SEQ ID NO: 4846389 - DNA, 15 bp, Homo sapiens
cagtctgctcctctt

SEQ ID NO: 4846390 - DNA, 13 bp, Homo sapiens
cagtctttcttca

SEQ ID NO: 4846391 - DNA, 15 bp, Homo sapiens
cagtgcctattgata

SEQ ID NO: 4846392 - DNA, 13 bp, Homo sapiens
cagtgcctgtgag

SEQ ID NO: 4846393 - DNA, 13 bp, Homo sapiens
cagtgccttctct

SEQ ID NO: 4846394 - DNA, 19 bp, Homo sapiens
cagtgggaatgttctttct

SEQ ID NO: 4846395 - DNA, 14 bp, Homo sapiens
cagtggggcagcct

SEQ ID NO: 4846396 - DNA, 17 bp, Homo sapiens
cagtggtaagaatagta

SEQ ID NO: 4846397 - DNA, 16 bp, Homo sapiens
cagtggtgtgtgaagt

SEQ ID NO: 4846398 - DNA, 18 bp, Homo sapiens
cagtgtcccaccttgacc

SEQ ID NO: 4846399 - DNA, 13 bp, Homo sapiens
cagtgtctgtgtt

SEQ ID NO: 4846400 - DNA, 20 bp, Homo sapiens
cagtgtgaggacctccctgt

SEQ ID NO: 4846401 - DNA, 22 bp, Homo sapiens
cagtgttccaagtctctgtgta

SEQ ID NO: 4846402 - DNA, 21 bp, Homo sapiens
cagtgttttggtggaaaaaac

SEQ ID NO: 4846403 - DNA, 23 bp, Homo sapiens
cagtgttttggtggaaaaaacat

SEQ ID NO: 4846404 - DNA, 21 bp, Homo sapiens
cagtgtttttagacctgtgtt

SEQ ID NO: 4846405 - DNA, 14 bp, Homo sapiens
cagttcccagagtg

SEQ ID NO: 4846406 - DNA, 17 bp, Homo sapiens
cagttctctcccttcct

SEQ ID NO: 4846407 - DNA, 14 bp, Homo sapiens
cagttgatggagcc

SEQ ID NO: 4846408 - DNA, 16 bp, Homo sapiens
cagttgatggagcccc

SEQ ID NO: 4846409 - DNA, 17 bp, Homo sapiens
cagttgatggagcccca

SEQ ID NO: 4846410 - DNA, 18 bp, Homo sapiens
cagttgatggagccccag

SEQ ID NO: 4846411 - DNA, 19 bp, Homo sapiens
cagttggactctcagggat

SEQ ID NO: 4846412 - DNA, 14 bp, Homo sapiens
cagttgttatttat

SEQ ID NO: 4846413 - DNA, 19 bp, Homo sapiens
cagttgttatttattgaaa

SEQ ID NO: 4846414 - DNA, 23 bp, Homo sapiens
cagtttaagccgcagacctggag

SEQ ID NO: 4846415 - DNA, 13 bp, Homo sapiens
cagtttggaatta

SEQ ID NO: 4846416 - DNA, 13 bp, Homo sapiens
cagttttaactgt

SEQ ID NO: 4846417 - DNA, 16 bp, Homo sapiens
cagttttaactgtgga

SEQ ID NO: 4846418 - DNA, 23 bp, Homo sapiens
cagttttaactgtggatattgtt

SEQ ID NO: 4846419 - DNA, 13 bp, Homo sapiens
cagttttcggaaa

SEQ ID NO: 4846420 - DNA, 22 bp, Homo sapiens
cagtttttgacatttatattaa

SEQ ID NO: 4846421 - DNA, 16 bp, Homo sapiens
cataaaagaaataaac

SEQ ID NO: 4846422 - DNA, 17 bp, Homo sapiens
cataaaatcgctttcaa

SEQ ID NO: 4846423 - DNA, 16 bp, Homo sapiens
cataaaccctccaagg

SEQ ID NO: 4846424 - DNA, 17 bp, Homo sapiens
cataaagctcaaatgaa

SEQ ID NO: 4846425 - DNA, 20 bp, Homo sapiens
cataaagctcaaatgaaatg

SEQ ID NO: 4846426 - DNA, 22 bp, Homo sapiens
cataaagtaaatacatgcatat

SEQ ID NO: 4846427 - DNA, 12 bp, Homo sapiens
cataaattattt

SEQ ID NO: 4846428 - DNA, 20 bp, Homo sapiens
cataactcacacccctgccc

SEQ ID NO: 4846429 - DNA, 21 bp, Homo sapiens
cataactcacacccctgcccc

SEQ ID NO: 4846430 - DNA, 19 bp, Homo sapiens
cataacttctcatgtatat

SEQ ID NO: 4846431 - DNA, 14 bp, Homo sapiens
cataagagaaacct

SEQ ID NO: 4846432 - DNA, 12 bp, Homo sapiens
cataagataaaa

SEQ ID NO: 4846433 - DNA, 13 bp, Homo sapiens
cataagcttccat

SEQ ID NO: 4846434 - DNA, 19 bp, Homo sapiens
cataagcttccattttaat

SEQ ID NO: 4846435 - DNA, 18 bp, Homo sapiens
cataatgtttctggattt

SEQ ID NO: 4846436 - DNA, 22 bp, Homo sapiens
cataatgtttctggatttcata

SEQ ID NO: 4846437 - DNA, 13 bp, Homo sapiens
cataatttaaaaa

SEQ ID NO: 4846438 - DNA, 14 bp, Homo sapiens
cataatttaaaaat

SEQ ID NO: 4846439 - DNA, 17 bp, Homo sapiens
catactttgtattttga

SEQ ID NO: 4846440 - DNA, 18 bp, Homo sapiens
catagaaaccactagaaa

SEQ ID NO: 4846441 - DNA, 14 bp, Homo sapiens
catagacatgaaag

SEQ ID NO: 4846442 - DNA, 16 bp, Homo sapiens
catagcagatctgttt

SEQ ID NO: 4846443 - DNA, 17 bp, Homo sapiens
catagcagatctgtttt

SEQ ID NO: 4846444 - DNA, 23 bp, Homo sapiens
catagcctccaaacatgttccca

SEQ ID NO: 4846445 - DNA, 16 bp, Homo sapiens
catagctgtacttctt

SEQ ID NO: 4846446 - DNA, 15 bp, Homo sapiens
cataggttaaaaaaa

SEQ ID NO: 4846447 - DNA, 21 bp, Homo sapiens
catagtaagtgcgaagactga

SEQ ID NO: 4846448 - DNA, 18 bp, Homo sapiens
catataagacaaatattc

SEQ ID NO: 4846449 - DNA, 14 bp, Homo sapiens
catataatgaataa

SEQ ID NO: 4846450 - DNA, 14 bp, Homo sapiens
catatatttattga

SEQ ID NO: 4846451 - DNA, 13 bp, Homo sapiens
catatgaatgaaa

SEQ ID NO: 4846452 - DNA, 17 bp, Homo sapiens
catatgaatgaaacatg

SEQ ID NO: 4846453 - DNA, 13 bp, Homo sapiens
catatgcagaaat

SEQ ID NO: 4846454 - DNA, 12 bp, Homo sapiens
catatgttgcaa

SEQ ID NO: 4846455 - DNA, 16 bp, Homo sapiens
catattccatatttat

SEQ ID NO: 4846456 - DNA, 17 bp, Homo sapiens
catatttaatttgaagg

SEQ ID NO: 4846457 - DNA, 17 bp, Homo sapiens
catcaaacctttgagta

SEQ ID NO: 4846458 - DNA, 13 bp, Homo sapiens
catcaaataagaa

SEQ ID NO: 4846459 - DNA, 16 bp, Homo sapiens
catcaatatgtatata

SEQ ID NO: 4846460 - DNA, 14 bp, Homo sapiens
catcatctcttcct

SEQ ID NO: 4846461 - DNA, 23 bp, Homo sapiens
catcatgaggccggatgaaactt

SEQ ID NO: 4846462 - DNA, 22 bp, Homo sapiens
catcattcttgtgggagacagc

SEQ ID NO: 4846463 - DNA, 12 bp, Homo sapiens
catccatcctga

SEQ ID NO: 4846464 - DNA, 13 bp, Homo sapiens
catccatcctgag

SEQ ID NO: 4846465 - DNA, 14 bp, Homo sapiens
catccatcctgagc

SEQ ID NO: 4846466 - DNA, 17 bp, Homo sapiens
catccatgtacttccct

SEQ ID NO: 4846467 - DNA, 20 bp, Homo sapiens
catccctgggggccttgggt

SEQ ID NO: 4846468 - DNA, 15 bp, Homo sapiens
catcctaggaaccag

SEQ ID NO: 4846469 - DNA, 18 bp, Homo sapiens
catcctaggaaccagcca

SEQ ID NO: 4846470 - DNA, 22 bp, Homo sapiens
catcctaggaaccagccaacca

SEQ ID NO: 4846471 - DNA, 17 bp, Homo sapiens
catcctccagatagtgt

SEQ ID NO: 4846472 - DNA, 12 bp, Homo sapiens
catcctgagcca

SEQ ID NO: 4846473 - DNA, 17 bp, Homo sapiens
catcctgataccattct

SEQ ID NO: 4846474 - DNA, 14 bp, Homo sapiens
catccttccatcca

SEQ ID NO: 4846475 - DNA, 19 bp, Homo sapiens
catccttgagattctgaag

SEQ ID NO: 4846476 - DNA, 16 bp, Homo sapiens
catcgccgggactcca

SEQ ID NO: 4846477 - DNA, 22 bp, Homo sapiens
catcgtattaaaaaacaattaa

SEQ ID NO: 4846478 - DNA, 23 bp, Homo sapiens
catctaaaaatagacttaaatct

SEQ ID NO: 4846479 - DNA, 15 bp, Homo sapiens
catctaattctgatt

SEQ ID NO: 4846480 - DNA, 18 bp, Homo sapiens
catctgtataccctctgt

SEQ ID NO: 4846481 - DNA, 19 bp, Homo sapiens
catctgtataccctctgtt

SEQ ID NO: 4846482 - DNA, 21 bp, Homo sapiens
catctgtataccctctgtttc

SEQ ID NO: 4846483 - DNA, 16 bp, Homo sapiens
catctgttagcagagt

SEQ ID NO: 4846484 - DNA, 17 bp, Homo sapiens
tgtaattttattttaaa

SEQ ID NO: 4846485 - DNA, 20 bp, Homo sapiens
tgtaattttattttaaaatt

SEQ ID NO: 4846486 - DNA, 21 bp, Homo sapiens
tgtacaaaaattatgcaattc

SEQ ID NO: 4846487 - DNA, 19 bp, Homo sapiens
tgtacagattctttcagtt

SEQ ID NO: 4846488 - DNA, 15 bp, Homo sapiens
tgtacagtctgctcc

SEQ ID NO: 4846489 - DNA, 15 bp, Homo sapiens
tgtaccaaaatttta

SEQ ID NO: 4846490 - DNA, 20 bp, Homo sapiens
tgtactaacccagtctttct

SEQ ID NO: 4846491 - DNA, 22 bp, Homo sapiens
tgtactgaataggttccccaat

SEQ ID NO: 4846492 - DNA, 16 bp, Homo sapiens
tgtacttcttgaatat

SEQ ID NO: 4846493 - DNA, 21 bp, Homo sapiens
tgtactttatcatgaatgctt

SEQ ID NO: 4846494 - DNA, 19 bp, Homo sapiens
tgtagagcccctactgtgg

SEQ ID NO: 4846495 - DNA, 19 bp, Homo sapiens
tgtagaggcataaacctgt

SEQ ID NO: 4846496 - DNA, 12 bp, Homo sapiens
tgtagcagaaac

SEQ ID NO: 4846497 - DNA, 18 bp, Homo sapiens
tgtagccagctgtgcact

SEQ ID NO: 4846498 - DNA, 15 bp, Homo sapiens
tgtagctgaggaggc

SEQ ID NO: 4846499 - DNA, 12 bp, Homo sapiens
tgtagctgtgaa

SEQ ID NO: 4846500 - DNA, 14 bp, Homo sapiens
tgtaggtaagactg

SEQ ID NO: 4846501 - DNA, 20 bp, Homo sapiens
tgtagtcccggaggccttcc

SEQ ID NO: 4846502 - DNA, 13 bp, Homo sapiens
tgtatatgactgc

SEQ ID NO: 4846503 - DNA, 15 bp, Homo sapiens
tgtatgagtgtatgt

SEQ ID NO: 4846504 - DNA, 17 bp, Homo sapiens
tgtatgagtgtatgtgt

SEQ ID NO: 4846505 - DNA, 15 bp, Homo sapiens
tgtatgtcaaagctt

SEQ ID NO: 4846506 - DNA, 15 bp, Homo sapiens
tgtatgttaaagaga

SEQ ID NO: 4846507 - DNA, 18 bp, Homo sapiens
tgtattcttttctcagtg

SEQ ID NO: 4846508 - DNA, 15 bp, Homo sapiens
tgtattgcacattgt

SEQ ID NO: 4846509 - DNA, 19 bp, Homo sapiens
tgtattgcacattgtaaaa

SEQ ID NO: 4846510 - DNA, 15 bp, Homo sapiens
tgtatttgagcatat

SEQ ID NO: 4846511 - DNA, 14 bp, Homo sapiens
tgtattttgattat

SEQ ID NO: 4846512 - DNA, 22 bp, Homo sapiens
tgtcacaagtggtgtttattgc

SEQ ID NO: 4846513 - DNA, 23 bp, Homo sapiens
tgtcacaagtggtgtttattgca

SEQ ID NO: 4846514 - DNA, 21 bp, Homo sapiens
tgtcacatctatccacactgt

SEQ ID NO: 4846515 - DNA, 18 bp, Homo sapiens
tgtcacttttccttttct

SEQ ID NO: 4846516 - DNA, 16 bp, Homo sapiens
tgtcagctgctgttga

SEQ ID NO: 4846517 - DNA, 17 bp, Homo sapiens
tgtcagctgctgttgaa

SEQ ID NO: 4846518 - DNA, 22 bp, Homo sapiens
tgtcagctgctgttgaactttt

SEQ ID NO: 4846519 - DNA, 23 bp, Homo sapiens
tgtcagtgttgcctcttgcaatg

SEQ ID NO: 4846520 - DNA, 17 bp, Homo sapiens
tgtcagttgttatttat

SEQ ID NO: 4846521 - DNA, 23 bp, Homo sapiens
tgtcatttctatattcctccagc

SEQ ID NO: 4846522 - DNA, 17 bp, Homo sapiens
tgtccaaaatttatatt

SEQ ID NO: 4846523 - DNA, 14 bp, Homo sapiens
tgtccagccacccc

SEQ ID NO: 4846524 - DNA, 22 bp, Homo sapiens
tgtccagccacccccaggcatc

SEQ ID NO: 4846525 - DNA, 20 bp, Homo sapiens
ttcagttctttggattctaa

SEQ ID NO: 4846526 - DNA, 22 bp, Homo sapiens
ttcatactgtaacattcaggaa

SEQ ID NO: 4846527 - DNA, 23 bp, Homo sapiens
ttcatattgtaatctatgtttat

SEQ ID NO: 4846528 - DNA, 13 bp, Homo sapiens
ttcatatttaatt

SEQ ID NO: 4846529 - DNA, 19 bp, Homo sapiens
ttcatcagaactcttcctc

SEQ ID NO: 4846530 - DNA, 16 bp, Homo sapiens
ttcatccttccatcca

SEQ ID NO: 4846531 - DNA, 21 bp, Homo sapiens
ttcatctaatgtattatgagc

SEQ ID NO: 4846532 - DNA, 19 bp, Homo sapiens
ttcatgaatgtgctggtga

SEQ ID NO: 4846533 - DNA, 23 bp, Homo sapiens
ttcatgattagaaattacctgtg

SEQ ID NO: 4846534 - DNA, 21 bp, Homo sapiens
ttcatggctgctgttgcttaa

SEQ ID NO: 4846535 - DNA, 22 bp, Homo sapiens
ttcatggctgctgttgcttaaa

SEQ ID NO: 4846536 - DNA, 13 bp, Homo sapiens
ttcatgtaatttt

SEQ ID NO: 4846537 - DNA, 23 bp, Homo sapiens
ttcatgtttggaaaataatttct

SEQ ID NO: 4846538 - DNA, 20 bp, Homo sapiens
ttcattaccctacagacagc

SEQ ID NO: 4846539 - DNA, 20 bp, Homo sapiens
ttcattactagataaaatgt

SEQ ID NO: 4846540 - DNA, 21 bp, Homo sapiens
ttccaaacagacaaaacagat

SEQ ID NO: 4846541 - DNA, 23 bp, Homo sapiens
ttccaaacagacaaaacagataa

SEQ ID NO: 4846542 - DNA, 13 bp, Homo sapiens
ttccaaattcatg

SEQ ID NO: 4846543 - DNA, 23 bp, Homo sapiens
ttccacccacaaactccaggctg

SEQ ID NO: 4846544 - DNA, 14 bp, Homo sapiens
ttccagaatgacct

SEQ ID NO: 4846545 - DNA, 20 bp, Homo sapiens
ttccagctgtcactctgtgc

SEQ ID NO: 4846546 - DNA, 14 bp, Homo sapiens
ttccagtcctaaca

SEQ ID NO: 4846547 - DNA, 17 bp, Homo sapiens
ttccagtcctaacaaat

SEQ ID NO: 4846548 - DNA, 18 bp, Homo sapiens
ttccattttaattttaaa

SEQ ID NO: 4846549 - DNA, 13 bp, Homo sapiens
ttcccaccttcca

SEQ ID NO: 4846550 - DNA, 11 bp, Homo sapiens
ttcccagcctg

SEQ ID NO: 4846551 - DNA, 12 bp, Homo sapiens
ttcccagcctga

SEQ ID NO: 4846552 - DNA, 20 bp, Homo sapiens
ttccccccattttgcctctg

SEQ ID NO: 4846553 - DNA, 21 bp, Homo sapiens
ttccccccattttgcctctgt

SEQ ID NO: 4846554 - DNA, 20 bp, Homo sapiens
ttcccctctcatacataaaa

SEQ ID NO: 4846555 - DNA, 22 bp, Homo sapiens
ttcccttaaggggtatcatgta

SEQ ID NO: 4846556 - DNA, 22 bp, Homo sapiens
ttcccttgcaggggtcccccct

SEQ ID NO: 4846557 - DNA, 16 bp, Homo sapiens
ttcctactcacacttc

SEQ ID NO: 4846558 - DNA, 17 bp, Homo sapiens
ttcctactcacacttca

SEQ ID NO: 4846559 - DNA, 22 bp, Homo sapiens
ttcctcctacttacaacccagg

SEQ ID NO: 4846560 - DNA, 14 bp, Homo sapiens
ttcctcctcccaag

SEQ ID NO: 4846561 - DNA, 14 bp, Homo sapiens
ttcctcctgatgga

SEQ ID NO: 4846562 - DNA, 18 bp, Homo sapiens
ttcctgctgctgctactg

SEQ ID NO: 4846563 - DNA, 16 bp, Homo sapiens
ttcctgtactgtgtct

SEQ ID NO: 4846564 - DNA, 11 bp, Homo sapiens
ttcctgtgagg

SEQ ID NO: 4846565 - DNA, 15 bp, Homo sapiens
ttccttcaggcagct

SEQ ID NO: 4846566 - DNA, 16 bp, Homo sapiens
ttccttttcaggagat

SEQ ID NO: 4846567 - DNA, 14 bp, Homo sapiens
ttcggaaacactga

SEQ ID NO: 4846568 - DNA, 13 bp, Homo sapiens
ttcgtttatattt

SEQ ID NO: 4846569 - DNA, 23 bp, Homo sapiens
ttctaaatacatgccacatcaaa

SEQ ID NO: 4846570 - DNA, 22 bp, Homo sapiens
ttctaaatatcccttggacatt

SEQ ID NO: 4846571 - DNA, 20 bp, Homo sapiens
ttctaagcaaccacactgct

SEQ ID NO: 4846572 - DNA, 18 bp, Homo sapiens
ttctagtacctgtgactc

SEQ ID NO: 4846573 - DNA, 22 bp, Homo sapiens
ttctagttgcccccattcccag

SEQ ID NO: 4846574 - DNA, 15 bp, Homo sapiens
ttctattctccagac

SEQ ID NO: 4846575 - DNA, 15 bp, Homo sapiens
ttctattttttgttt

SEQ ID NO: 4846576 - DNA, 19 bp, Homo sapiens
ttctcaccctctgtccttc

SEQ ID NO: 4846577 - DNA, 22 bp, Homo sapiens
ttctcatgttgaaactttaaga

SEQ ID NO: 4846578 - DNA, 13 bp, Homo sapiens
ttctccatggagc

SEQ ID NO: 4846579 - DNA, 15 bp, Homo sapiens
ttctcccatgatttg

SEQ ID NO: 4846580 - DNA, 14 bp, Homo sapiens
ttctcccctgccct

SEQ ID NO: 4846581 - DNA, 19 bp, Homo sapiens
ttctgaaggtagcattctt

SEQ ID NO: 4846582 - DNA, 16 bp, Homo sapiens
ttctgaagtatgaagt

SEQ ID NO: 4846583 - DNA, 18 bp, Homo sapiens
ttctgaagtatgaagtct

SEQ ID NO: 4846584 - DNA, 16 bp, Homo sapiens
ttctgaggccagaaag

SEQ ID NO: 4846585 - DNA, 23 bp, Homo sapiens
ttctgattctggctttaagcctt

SEQ ID NO: 4846586 - DNA, 17 bp, Homo sapiens
ttctgctctatactgtg

SEQ ID NO: 4846587 - DNA, 14 bp, Homo sapiens
ttctggatgtctgg

SEQ ID NO: 4846588 - DNA, 15 bp, Homo sapiens
ttctggatgtctggc

SEQ ID NO: 4846589 - DNA, 14 bp, Homo sapiens
ttctgggctgatgg

SEQ ID NO: 4846590 - DNA, 13 bp, Homo sapiens
ttctgtaattgtg

SEQ ID NO: 4846591 - DNA, 21 bp, Homo sapiens
ttcttaaaaggcccatagcag

SEQ ID NO: 4846592 - DNA, 15 bp, Homo sapiens
ttcttactaaaaagt

SEQ ID NO: 4846593 - DNA, 18 bp, Homo sapiens
ttcttatttaatcttttc

SEQ ID NO: 4846594 - DNA, 18 bp, Homo sapiens
ttcttcacacagacacta

SEQ ID NO: 4846595 - DNA, 15 bp, Homo sapiens
ttcttcacaggcact

SEQ ID NO: 4846596 - DNA, 16 bp, Homo sapiens
ttcttcactctggctt

SEQ ID NO: 4846597 - DNA, 23 bp, Homo sapiens
ttcttccacccacaaactccagg

SEQ ID NO: 4846598 - DNA, 15 bp, Homo sapiens
ttcttcctaatgtca

SEQ ID NO: 4846599 - DNA, 19 bp, Homo sapiens
ttctttaactgccgtaatt

SEQ ID NO: 4846600 - DNA, 18 bp, Homo sapiens
ttctttcacccatcctag

SEQ ID NO: 4846601 - DNA, 21 bp, Homo sapiens
ttctttctgctctatactgtg

SEQ ID NO: 4846602 - DNA, 21 bp, Homo sapiens
ttctttggattctaaatacat

SEQ ID NO: 4846603 - DNA, 22 bp, Homo sapiens
ttcttttaatgatgccatggca

SEQ ID NO: 4846604 - DNA, 17 bp, Homo sapiens
ttgaaaaatataaaatt

SEQ ID NO: 4846605 - DNA, 20 bp, Homo sapiens
ttgaaaaatataaaattatg

SEQ ID NO: 4846606 - DNA, 22 bp, Homo sapiens
ttgaaactttgggaaaacatgt

SEQ ID NO: 4846607 - DNA, 14 bp, Homo sapiens
ttgaaagaatagaa

SEQ ID NO: 4846608 - DNA, 23 bp, Homo sapiens
ttgaaatgaactttgtcagtgtt

SEQ ID NO: 4846609 - DNA, 14 bp, Homo sapiens
ttgaaatgatttca

SEQ ID NO: 4846610 - DNA, 14 bp, Homo sapiens
ttgaaattctattt

SEQ ID NO: 4846611 - DNA, 21 bp, Homo sapiens
ttgaaattctatttataatac

SEQ ID NO: 4846612 - DNA, 14 bp, Homo sapiens
ttgaactttggaac

SEQ ID NO: 4846613 - DNA, 16 bp, Homo sapiens
ttgaagaaggcaaggc

SEQ ID NO: 4846614 - DNA, 11 bp, Homo sapiens
ttgaagcatag

SEQ ID NO: 4846615 - DNA, 19 bp, Homo sapiens
ttgaagcatagataatatt

SEQ ID NO: 4846616 - DNA, 13 bp, Homo sapiens
ttgaatatatgat

SEQ ID NO: 4846617 - DNA, 23 bp, Homo sapiens
ttgaatgtccaaaatttatattt

SEQ ID NO: 4846618 - DNA, 12 bp, Homo sapiens
ttgacacctgct

SEQ ID NO: 4846619 - DNA, 23 bp, Homo sapiens
ttgactaactcaaatacacattt

SEQ ID NO: 4846620 - DNA, 19 bp, Homo sapiens
ttgactcttatttatagaa

SEQ ID NO: 4846621 - DNA, 21 bp, Homo sapiens
ttgacttttataaagcatgtt

SEQ ID NO: 4846622 - DNA, 18 bp, Homo sapiens
ttgagaggaggacttggt

SEQ ID NO: 4846623 - DNA, 22 bp, Homo sapiens
ttgagagttccggggagaaacc

SEQ ID NO: 4846624 - DNA, 12 bp, Homo sapiens
ttgagattctga

SEQ ID NO: 4846625 - DNA, 16 bp, Homo sapiens
ttgaggggaggtggcc

SEQ ID NO: 4846626 - DNA, 17 bp, Homo sapiens
ttgagtacctactgtgt

SEQ ID NO: 4846627 - DNA, 13 bp, Homo sapiens
ttgagtattgttt

SEQ ID NO: 4846628 - DNA, 17 bp, Homo sapiens
ttgagttaacaggacag

SEQ ID NO: 4846629 - DNA, 15 bp, Homo sapiens
ttgatactaccaggg

SEQ ID NO: 4846630 - DNA, 19 bp, Homo sapiens
ttgatagggtctaccaata

SEQ ID NO: 4846631 - DNA, 22 bp, Homo sapiens
ttgatagggtctaccaatacaa

SEQ ID NO: 4846632 - DNA, 19 bp, Homo sapiens
ttgatataccaaattaaaa

SEQ ID NO: 4846633 - DNA, 15 bp, Homo sapiens
ttgatggagccccag

SEQ ID NO: 4846634 - DNA, 23 bp, Homo sapiens
ttgattattttttttttcttctt

SEQ ID NO: 4846635 - DNA, 17 bp, Homo sapiens
ttgattgggaaaacatt

SEQ ID NO: 4846636 - DNA, 18 bp, Homo sapiens
ttgatttgattgggatga

SEQ ID NO: 4846637 - DNA, 13 bp, Homo sapiens
ttgcaaagtgtat

SEQ ID NO: 4846638 - DNA, 18 bp, Homo sapiens
ttgcaacctctttgctca

SEQ ID NO: 4846639 - DNA, 13 bp, Homo sapiens
ttgcaatgcagag

SEQ ID NO: 4846640 - DNA, 19 bp, Homo sapiens
ttgcacagccaaatttaaa

SEQ ID NO: 4846641 - DNA, 19 bp, Homo sapiens
ttgcagcctaagaagaagg

SEQ ID NO: 4846642 - DNA, 15 bp, Homo sapiens
ttgcagcggctcctg

SEQ ID NO: 4846643 - DNA, 19 bp, Homo sapiens
ttgcatattataaaggata

SEQ ID NO: 4846644 - DNA, 23 bp, Homo sapiens
tttcacccatcctaggaaccagc

SEQ ID NO: 4846645 - DNA, 18 bp, Homo sapiens
tttcaccttttcaggaaa

SEQ ID NO: 4846646 - DNA, 21 bp, Homo sapiens
tttcagaaatataacacattt

SEQ ID NO: 4846647 - DNA, 22 bp, Homo sapiens
tttcagttctttggattctaaa

SEQ ID NO: 4846648 - DNA, 14 bp, Homo sapiens
tttcagtttgttgg

SEQ ID NO: 4846649 - DNA, 16 bp, Homo sapiens
tttcatgaatgtgctg

SEQ ID NO: 4846650 - DNA, 18 bp, Homo sapiens
tttcatgtcccagaactt

SEQ ID NO: 4846651 - DNA, 12 bp, Homo sapiens
tttccagaatga

SEQ ID NO: 4846652 - DNA, 23 bp, Homo sapiens
tttcccactcattctgaattaat

SEQ ID NO: 4846653 - DNA, 19 bp, Homo sapiens
tttcccccttcatccatcc

SEQ ID NO: 4846654 - DNA, 21 bp, Homo sapiens
tttcccccttcatccatcctg

SEQ ID NO: 4846655 - DNA, 22 bp, Homo sapiens
tttcccccttcatccatcctga

SEQ ID NO: 4846656 - DNA, 14 bp, Homo sapiens
tttcctactttcta

SEQ ID NO: 4846657 - DNA, 16 bp, Homo sapiens
tttcctgatgcccctg

SEQ ID NO: 4846658 - DNA, 13 bp, Homo sapiens
tttcctgcatgtt

SEQ ID NO: 4846659 - DNA, 12 bp, Homo sapiens
tttcctggcagt

SEQ ID NO: 4846660 - DNA, 14 bp, Homo sapiens
tttctaaactccct

SEQ ID NO: 4846661 - DNA, 18 bp, Homo sapiens
tttctacaactgattgca

SEQ ID NO: 4846662 - DNA, 20 bp, Homo sapiens
tttctagtacctgtgactct

SEQ ID NO: 4846663 - DNA, 15 bp, Homo sapiens
tttctatattcctcc

SEQ ID NO: 4846664 - DNA, 17 bp, Homo sapiens
tttctatattcctccag

SEQ ID NO: 4846665 - DNA, 22 bp, Homo sapiens
tttctatttttatgatgacaat

SEQ ID NO: 4846666 - DNA, 17 bp, Homo sapiens
tttctcagtgttggtat

SEQ ID NO: 4846667 - DNA, 20 bp, Homo sapiens
tttctcagtgttggtatatt

SEQ ID NO: 4846668 - DNA, 15 bp, Homo sapiens
tttctctataaagta

SEQ ID NO: 4846669 - DNA, 14 bp, Homo sapiens
tttctgggtgctag

SEQ ID NO: 4846670 - DNA, 17 bp, Homo sapiens
tttcttatccaactttt

SEQ ID NO: 4846671 - DNA, 21 bp, Homo sapiens
tttgaaaaatataaaattatg

SEQ ID NO: 4846672 - DNA, 21 bp, Homo sapiens
tttgaaagaatagaacacagt

SEQ ID NO: 4846673 - DNA, 14 bp, Homo sapiens
tttgaaatgaactt

SEQ ID NO: 4846674 - DNA, 14 bp, Homo sapiens
tttgaactttggaa

SEQ ID NO: 4846675 - DNA, 14 bp, Homo sapiens
tttgaatatgtagt

SEQ ID NO: 4846676 - DNA, 19 bp, Homo sapiens
tttgaatatgtagtatcta

SEQ ID NO: 4846677 - DNA, 23 bp, Homo sapiens
tttgaatgtccaaaatttatatt

SEQ ID NO: 4846678 - DNA, 13 bp, Homo sapiens
tttgacagtgttt

SEQ ID NO: 4846679 - DNA, 14 bp, Homo sapiens
tttgatacattttt

SEQ ID NO: 4846680 - DNA, 22 bp, Homo sapiens
tttgatataccaaattaaaaaa

SEQ ID NO: 4846681 - DNA, 18 bp, Homo sapiens
tttgcaaagtgtattagg

SEQ ID NO: 4846682 - DNA, 19 bp, Homo sapiens
tttgcaacctctttgctca

SEQ ID NO: 4846683 - DNA, 13 bp, Homo sapiens
tttgcatgcatgc

SEQ ID NO: 4846684 - DNA, 15 bp, Homo sapiens
tttgccagaggacca

SEQ ID NO: 4846685 - DNA, 11 bp, Homo sapiens
tttgcctctgt

SEQ ID NO: 4846686 - DNA, 18 bp, Homo sapiens
tttggacttctgaagaga

SEQ ID NO: 4846687 - DNA, 22 bp, Homo sapiens
tttggaggctggagtaatcaga

SEQ ID NO: 4846688 - DNA, 15 bp, Homo sapiens
tttggattctaaata

SEQ ID NO: 4846689 - DNA, 20 bp, Homo sapiens
tttggatttaaaagcctgct

SEQ ID NO: 4846690 - DNA, 18 bp, Homo sapiens
tttgggaagtttgctgtg

SEQ ID NO: 4846691 - DNA, 15 bp, Homo sapiens
tttgggagccaggac

SEQ ID NO: 4846692 - DNA, 16 bp, Homo sapiens
tttgggcctgttcctt

SEQ ID NO: 4846693 - DNA, 20 bp, Homo sapiens
tttgggtggctcactactga

SEQ ID NO: 4846694 - DNA, 19 bp, Homo sapiens
tttggtagctgggaaagca

SEQ ID NO: 4846695 - DNA, 21 bp, Homo sapiens
tttggtagctgggaaagcata

SEQ ID NO: 4846696 - DNA, 22 bp, Homo sapiens
tttgtaactgtttagatgaatg

SEQ ID NO: 4846697 - DNA, 20 bp, Homo sapiens
tttgtactttatcatgaatg

SEQ ID NO: 4846698 - DNA, 21 bp, Homo sapiens
tttgtagatggcgatgtgtta

SEQ ID NO: 4846699 - DNA, 16 bp, Homo sapiens
tttgtatgttaaagag

SEQ ID NO: 4846700 - DNA, 13 bp, Homo sapiens
tttgtattttcat

SEQ ID NO: 4846701 - DNA, 14 bp, Homo sapiens
tttgtattttcatg

SEQ ID NO: 4846702 - DNA, 21 bp, Homo sapiens
tttgtattttcatgaaaatac

SEQ ID NO: 4846703 - DNA, 18 bp, Homo sapiens
tttgtgaccagaaagctt

SEQ ID NO: 4846704 - DNA, 16 bp, Homo sapiens
tttgttgcactaaaat

SEQ ID NO: 4846705 - DNA, 23 bp, Homo sapiens
tttgttttaaaacgtgtaaatga

SEQ ID NO: 4846706 - DNA, 19 bp, Homo sapiens
ttttaaaacgtgtaaatga

SEQ ID NO: 4846707 - DNA, 18 bp, Homo sapiens
ttttaaagttcattgcaa

SEQ ID NO: 4846708 - DNA, 17 bp, Homo sapiens
ttttaatttcctgtgag

SEQ ID NO: 4846709 - DNA, 18 bp, Homo sapiens
ttttagtgtgtgcataat

SEQ ID NO: 4846710 - DNA, 20 bp, Homo sapiens
ttttattaaagcatttccta

SEQ ID NO: 4846711 - DNA, 18 bp, Homo sapiens
ttttcagcaaattccaga

SEQ ID NO: 4846712 - DNA, 23 bp, Homo sapiens
ttttcataaattatttgattatt

SEQ ID NO: 4846713 - DNA, 15 bp, Homo sapiens
ttttcatagatgtgt

SEQ ID NO: 4846714 - DNA, 23 bp, Homo sapiens
ttttcatagtaagtgcgaagact

SEQ ID NO: 4846715 - DNA, 13 bp, Homo sapiens
ttttcatgaaaat

SEQ ID NO: 4846716 - DNA, 14 bp, Homo sapiens
ttttcatgaatgtg

SEQ ID NO: 4846717 - DNA, 20 bp, Homo sapiens
ttttccatttattaagcagt

SEQ ID NO: 4846718 - DNA, 18 bp, Homo sapiens
ttttcctgcatgttctgt

SEQ ID NO: 4846719 - DNA, 14 bp, Homo sapiens
ttttccttttctta

SEQ ID NO: 4846720 - DNA, 16 bp, Homo sapiens
ttttccttttcttaaa

SEQ ID NO: 4846721 - DNA, 22 bp, Homo sapiens
ttttcggaaacactgacttagg

SEQ ID NO: 4846722 - DNA, 19 bp, Homo sapiens
ttttctattatttttataa

SEQ ID NO: 4846723 - DNA, 16 bp, Homo sapiens
ttttcttcttgggata

SEQ ID NO: 4846724 - DNA, 18 bp, Homo sapiens
ttttctttaactgccgta

SEQ ID NO: 4846725 - DNA, 12 bp, Homo sapiens
ttttgaagtgat

SEQ ID NO: 4846726 - DNA, 15 bp, Homo sapiens
ttttgacatggaaat

SEQ ID NO: 4846727 - DNA, 16 bp, Homo sapiens
ttttgatgagttgtga

SEQ ID NO: 4846728 - DNA, 22 bp, Homo sapiens
ttttgattattttttttttctt

SEQ ID NO: 4846729 - DNA, 17 bp, Homo sapiens
ttttgcacagccaaatt

SEQ ID NO: 4846730 - DNA, 17 bp, Homo sapiens
ttttggcgaatctcaaa

SEQ ID NO: 4846731 - DNA, 22 bp, Homo sapiens
ttttgtcttttaatccatttca

SEQ ID NO: 4846732 - DNA, 17 bp, Homo sapiens
ttttgtggtttggaata

SEQ ID NO: 4846733 - DNA, 16 bp, Homo sapiens
tttttaatttcctgtg

SEQ ID NO: 4846734 - DNA, 19 bp, Homo sapiens
tttttaatttcctgtgagg

SEQ ID NO: 4846735 - DNA, 17 bp, Homo sapiens
tttttagtgttaaagag

SEQ ID NO: 4846736 - DNA, 18 bp, Homo sapiens
tttttataattgtacaaa

SEQ ID NO: 4846737 - DNA, 23 bp, Homo sapiens
tttttattaaaatatttcaggtt

SEQ ID NO: 4846738 - DNA, 20 bp, Homo sapiens
tggccatcttctttcttcca

SEQ ID NO: 4846739 - DNA, 18 bp, Homo sapiens
tggcccagtgccagcaag

SEQ ID NO: 4846740 - DNA, 18 bp, Homo sapiens
tggcccccttcaggagcc

SEQ ID NO: 4846741 - DNA, 19 bp, Homo sapiens
tggcccttcaagggtcagg

SEQ ID NO: 4846742 - DNA, 15 bp, Homo sapiens
tggccgtctcctccc

SEQ ID NO: 4846743 - DNA, 14 bp, Homo sapiens
tggcctagaaaggg

SEQ ID NO: 4846744 - DNA, 18 bp, Homo sapiens
tggcctggagcaggccca

SEQ ID NO: 4846745 - DNA, 12 bp, Homo sapiens
tggcctgtccct

SEQ ID NO: 4846746 - DNA, 16 bp, Homo sapiens
tggccttgcctccagg

SEQ ID NO: 4846747 - DNA, 14 bp, Homo sapiens
tggcggaggctgct

SEQ ID NO: 4846748 - DNA, 13 bp, Homo sapiens
tggctgaagctgg

SEQ ID NO: 4846749 - DNA, 20 bp, Homo sapiens
tggctgaagctggagcagcg

SEQ ID NO: 4846750 - DNA, 19 bp, Homo sapiens
tggcttatttaatatgctt

SEQ ID NO: 4846751 - DNA, 19 bp, Homo sapiens
tggcttcaaaaagccacag

SEQ ID NO: 4846752 - DNA, 23 bp, Homo sapiens
tggcttcaaaaagccacagcaga

SEQ ID NO: 4846753 - DNA, 14 bp, Homo sapiens
tggcttgggcattg

SEQ ID NO: 4846754 - DNA, 20 bp, Homo sapiens
tggctttgtcacttttcctt

SEQ ID NO: 4846755 - DNA, 14 bp, Homo sapiens
tgggaaagagccta

SEQ ID NO: 4846756 - DNA, 20 bp, Homo sapiens
tgggaaaggcagggccctga

SEQ ID NO: 4846757 - DNA, 21 bp, Homo sapiens
tgggaacccccctcccaccca

SEQ ID NO: 4846758 - DNA, 15 bp, Homo sapiens
tgggaaggccagcct

SEQ ID NO: 4846759 - DNA, 13 bp, Homo sapiens
tgggaagtttgct

SEQ ID NO: 4846760 - DNA, 16 bp, Homo sapiens
tgggaagtttgctgtg

SEQ ID NO: 4846761 - DNA, 17 bp, Homo sapiens
tgggaagtttgctgtgc

SEQ ID NO: 4846762 - DNA, 21 bp, Homo sapiens
tgggaagtttgctgtgctttg

SEQ ID NO: 4846763 - DNA, 22 bp, Homo sapiens
tgggaatgttctttctgctcta

SEQ ID NO: 4846764 - DNA, 16 bp, Homo sapiens
tgggacaggaaagaga

SEQ ID NO: 4846765 - DNA, 12 bp, Homo sapiens
tgggacccacag

SEQ ID NO: 4846766 - DNA, 14 bp, Homo sapiens
tgggacccacagaa

SEQ ID NO: 4846767 - DNA, 17 bp, Homo sapiens
tgggacccacagaactt

SEQ ID NO: 4846768 - DNA, 21 bp, Homo sapiens
tgggacccacagaacttgtgg

SEQ ID NO: 4846769 - DNA, 14 bp, Homo sapiens
tgggagacagcagc

SEQ ID NO: 4846770 - DNA, 19 bp, Homo sapiens
tgggagacagcagcctgta

SEQ ID NO: 4846771 - DNA, 16 bp, Homo sapiens
tgggagacatgtgaca

SEQ ID NO: 4846772 - DNA, 18 bp, Homo sapiens
tgggagatttttttgagt

SEQ ID NO: 4846773 - DNA, 15 bp, Homo sapiens
tgggagccaggactc

SEQ ID NO: 4846774 - DNA, 24 bp, Homo sapiens
tgggatattctttagcttacctgg

SEQ ID NO: 4846775 - DNA, 17 bp, Homo sapiens
tgggatattttgaaatg

SEQ ID NO: 4846776 - DNA, 14 bp, Homo sapiens
tgggatcctccctc

SEQ ID NO: 4846777 - DNA, 14 bp, Homo sapiens
tgggatgaatgcca

SEQ ID NO: 4846778 - DNA, 13 bp, Homo sapiens
tgggattagaaac

SEQ ID NO: 4846779 - DNA, 15 bp, Homo sapiens
tgggcacaaacagaa

SEQ ID NO: 4846780 - DNA, 19 bp, Homo sapiens
tgggcacatagcataggct

SEQ ID NO: 4846781 - DNA, 16 bp, Homo sapiens
tgggcattagcaaggc

SEQ ID NO: 4846782 - DNA, 17 bp, Homo sapiens
tgggcattagcaaggca

SEQ ID NO: 4846783 - DNA, 18 bp, Homo sapiens
tgggcattagcaaggcag

SEQ ID NO: 4846784 - DNA, 18 bp, Homo sapiens
tgatgaaagctttggcga

SEQ ID NO: 4846785 - DNA, 13 bp, Homo sapiens
tgatgacaatcaa

SEQ ID NO: 4846786 - DNA, 14 bp, Homo sapiens
tgatgagagaatgt

SEQ ID NO: 4846787 - DNA, 19 bp, Homo sapiens
tgatgaggacccagagctg

SEQ ID NO: 4846788 - DNA, 18 bp, Homo sapiens
tgatgagtttcactgtac

SEQ ID NO: 4846789 - DNA, 19 bp, Homo sapiens
tgatggacatgagagtagg

SEQ ID NO: 4846790 - DNA, 16 bp, Homo sapiens
tgattgggaaaacatt

SEQ ID NO: 4846791 - DNA, 17 bp, Homo sapiens
tgattgggaaaacattt

SEQ ID NO: 4846792 - DNA, 19 bp, Homo sapiens
tgatttcagtaagtctcat

SEQ ID NO: 4846793 - DNA, 15 bp, Homo sapiens
tgatttcattcctcg

SEQ ID NO: 4846794 - DNA, 18 bp, Homo sapiens
tgatttccctccagagaa

SEQ ID NO: 4846795 - DNA, 23 bp, Homo sapiens
tgatttctcaccctctgtccttc

SEQ ID NO: 4846796 - DNA, 14 bp, Homo sapiens
tgattttttgaaag

SEQ ID NO: 4846797 - DNA, 20 bp, Homo sapiens
tgcaaatagattcagagaaa

SEQ ID NO: 4846798 - DNA, 22 bp, Homo sapiens
tgcaaatagattcagagaaatt

SEQ ID NO: 4846799 - DNA, 18 bp, Homo sapiens
tgcaaatgagctctgaaa

SEQ ID NO: 4846800 - DNA, 19 bp, Homo sapiens
tgcaacagactgttgagtt

SEQ ID NO: 4846801 - DNA, 15 bp, Homo sapiens
tgcaacatctctgaa

SEQ ID NO: 4846802 - DNA, 17 bp, Homo sapiens
tgcaacccaaggtgagg

SEQ ID NO: 4846803 - DNA, 15 bp, Homo sapiens
tgcaagcttcttgct

SEQ ID NO: 4846804 - DNA, 16 bp, Homo sapiens
tgcaaggtggcctctg

SEQ ID NO: 4846805 - DNA, 15 bp, Homo sapiens
tgcaataaagtataa

SEQ ID NO: 4846806 - DNA, 22 bp, Homo sapiens
tgcaatagtgcaacatctctga

SEQ ID NO: 4846807 - DNA, 13 bp, Homo sapiens
tgcaatcactgtg

SEQ ID NO: 4846808 - DNA, 14 bp, Homo sapiens
tgcaatcactgtgc

SEQ ID NO: 4846809 - DNA, 16 bp, Homo sapiens
tgcaatcactgtgcta

SEQ ID NO: 4846810 - DNA, 15 bp, Homo sapiens
tgcaatgcagaggtt

SEQ ID NO: 4846811 - DNA, 24 bp, Homo sapiens
tgcaattaaacttccaaagaaagt

SEQ ID NO: 4846812 - DNA, 18 bp, Homo sapiens
tgcacacactcacctcta

SEQ ID NO: 4846813 - DNA, 14 bp, Homo sapiens
tgcacactgtccta

SEQ ID NO: 4846814 - DNA, 18 bp, Homo sapiens
tgcacatttctttgcatt

SEQ ID NO: 4846815 - DNA, 22 bp, Homo sapiens
tgcaccatactccttgcttcct

SEQ ID NO: 4846816 - DNA, 20 bp, Homo sapiens
tgcactaaaatgaggatcca

SEQ ID NO: 4846817 - DNA, 19 bp, Homo sapiens
tgcactccagactctgggg

SEQ ID NO: 4846818 - DNA, 16 bp, Homo sapiens
tgcacttttgaatgtc

SEQ ID NO: 4846819 - DNA, 20 bp, Homo sapiens
tgcacttttgaatgtccaaa

SEQ ID NO: 4846820 - DNA, 20 bp, Homo sapiens
tgcagaaatagacaaaaagt

SEQ ID NO: 4846821 - DNA, 20 bp, Homo sapiens
tgcagacagccatgcgtggc

SEQ ID NO: 4846822 - DNA, 17 bp, Homo sapiens
tgcagatatctgcatgt

SEQ ID NO: 4846823 - DNA, 13 bp, Homo sapiens
tgcagcagtcgcc

SEQ ID NO: 4846824 - DNA, 16 bp, Homo sapiens
tgcagccgcagagaaa

SEQ ID NO: 4846825 - DNA, 13 bp, Homo sapiens
tgcagcctaagaa

SEQ ID NO: 4846826 - DNA, 15 bp, Homo sapiens
tgcagcctaagaaga

SEQ ID NO: 4846827 - DNA, 16 bp, Homo sapiens
tgcagcctaagaagaa

SEQ ID NO: 4846828 - DNA, 19 bp, Homo sapiens
tgcagcctaagaagaaggc

SEQ ID NO: 4846829 - DNA, 21 bp, Homo sapiens
tgcagcctaagaagaaggcca

SEQ ID NO: 4846830 - DNA, 16 bp, Homo sapiens
tgcagcctggttggca

SEQ ID NO: 4846831 - DNA, 14 bp, Homo sapiens
tgcagcggctcctg

SEQ ID NO: 4846832 - DNA, 16 bp, Homo sapiens
tgcagcggctcctgca

SEQ ID NO: 4846833 - DNA, 16 bp, Homo sapiens
tgcagggaggggaggc

SEQ ID NO: 4846834 - DNA, 20 bp, Homo sapiens
tgcagttggactctcaggga

SEQ ID NO: 4846835 - DNA, 16 bp, Homo sapiens
tgcatagcagtatatg

SEQ ID NO: 4846836 - DNA, 21 bp, Homo sapiens
tgcatagttgtagacaaagta

SEQ ID NO: 4846837 - DNA, 16 bp, Homo sapiens
tgcatataatgaataa

SEQ ID NO: 4846838 - DNA, 19 bp, Homo sapiens
tggaaccacattgaagaat

SEQ ID NO: 4846839 - DNA, 13 bp, Homo sapiens
tggaagaaagtaa

SEQ ID NO: 4846840 - DNA, 14 bp, Homo sapiens
tggaagaaagtaag

SEQ ID NO: 4846841 - DNA, 22 bp, Homo sapiens
tggaagatgcagaagcaataat

SEQ ID NO: 4846842 - DNA, 23 bp, Homo sapiens
tggaagctgtttggaaaagacag

SEQ ID NO: 4846843 - DNA, 16 bp, Homo sapiens
tggaaggcagagaaat

SEQ ID NO: 4846844 - DNA, 16 bp, Homo sapiens
tggaagggaccccaga

SEQ ID NO: 4846845 - DNA, 13 bp, Homo sapiens
tggaattctaaca

SEQ ID NO: 4846846 - DNA, 22 bp, Homo sapiens
tggacatgagagtagggccctg

SEQ ID NO: 4846847 - DNA, 13 bp, Homo sapiens
tggacctgcccac

SEQ ID NO: 4846848 - DNA, 19 bp, Homo sapiens
tggacgggatgacctccag

SEQ ID NO: 4846849 - DNA, 21 bp, Homo sapiens
tggacgggatgacctccagaa

SEQ ID NO: 4846850 - DNA, 12 bp, Homo sapiens
tggactctcagg

SEQ ID NO: 4846851 - DNA, 13 bp, Homo sapiens
tggactctcaggg

SEQ ID NO: 4846852 - DNA, 14 bp, Homo sapiens
tggactctcaggga

SEQ ID NO: 4846853 - DNA, 12 bp, Homo sapiens
tggactgcatgg

SEQ ID NO: 4846854 - DNA, 19 bp, Homo sapiens
tggactgcatggggaggca

SEQ ID NO: 4846855 - DNA, 22 bp, Homo sapiens
tggactgcatggggaggcagca

SEQ ID NO: 4846856 - DNA, 14 bp, Homo sapiens
tggactggaaagca

SEQ ID NO: 4846857 - DNA, 16 bp, Homo sapiens
tggacttctgaagaga

SEQ ID NO: 4846858 - DNA, 17 bp, Homo sapiens
tggagaatactgccaaa

SEQ ID NO: 4846859 - DNA, 15 bp, Homo sapiens
tggagcacaaaattc

SEQ ID NO: 4846860 - DNA, 16 bp, Homo sapiens
tggagcacaaaattca

SEQ ID NO: 4846861 - DNA, 17 bp, Homo sapiens
tggagcacaaaattcaa

SEQ ID NO: 4846862 - DNA, 13 bp, Homo sapiens
tggagcagagctc

SEQ ID NO: 4846863 - DNA, 20 bp, Homo sapiens
tggagcagcaggcctctggg

SEQ ID NO: 4846864 - DNA, 19 bp, Homo sapiens
tggagcctacctctgtctg

SEQ ID NO: 4846865 - DNA, 17 bp, Homo sapiens
tggagcttcagccaggt

SEQ ID NO: 4846866 - DNA, 19 bp, Homo sapiens
tggagcttcagccaggtct

SEQ ID NO: 4846867 - DNA, 17 bp, Homo sapiens
tggaggctcctctaggc

SEQ ID NO: 4846868 - DNA, 21 bp, Homo sapiens
tggaggctcctctaggccctg

SEQ ID NO: 4846869 - DNA, 19 bp, Homo sapiens
tggagggaagacctgaaag

SEQ ID NO: 4846870 - DNA, 13 bp, Homo sapiens
tggaggtgggtgt

SEQ ID NO: 4846871 - DNA, 18 bp, Homo sapiens
tggagtgtcggatcctgt

SEQ ID NO: 4846872 - DNA, 17 bp, Homo sapiens
tggagtgtgcagacagc

SEQ ID NO: 4846873 - DNA, 11 bp, Homo sapiens
tggatatttgt

SEQ ID NO: 4846874 - DNA, 16 bp, Homo sapiens
tggatcccgttcagaa

SEQ ID NO: 4846875 - DNA, 22 bp, Homo sapiens
tggatcccgttcagaaaaccac

SEQ ID NO: 4846876 - DNA, 19 bp, Homo sapiens
tggatcctcagttctcaaa

SEQ ID NO: 4846877 - DNA, 19 bp, Homo sapiens
tggatcgagtgtagctgtg

SEQ ID NO: 4846878 - DNA, 23 bp, Homo sapiens
tggatggcttgtctatactcctt

SEQ ID NO: 4846879 - DNA, 13 bp, Homo sapiens
tggatgtctggct

SEQ ID NO: 4846880 - DNA, 16 bp, Homo sapiens
tggattgcctctgaaa

SEQ ID NO: 4846881 - DNA, 19 bp, Homo sapiens
tggattgtgcctaatgtgt

SEQ ID NO: 4846882 - DNA, 20 bp, Homo sapiens
tggattgtgcctaatgtgtt

SEQ ID NO: 4846883 - DNA, 23 bp, Homo sapiens
tggattgtgcctaatgtgtttga

SEQ ID NO: 4846884 - DNA, 20 bp, Homo sapiens
tggatttaaaagcctgctca

SEQ ID NO: 4846885 - DNA, 13 bp, Homo sapiens
tggatttgcagaa

SEQ ID NO: 4846886 - DNA, 14 bp, Homo sapiens
tggatttgcagaag

SEQ ID NO: 4846887 - DNA, 21 bp, Homo sapiens
tggatttggcactagccaaag

SEQ ID NO: 4846888 - DNA, 18 bp, Homo sapiens
tggcaaagtgacaaagca

SEQ ID NO: 4846889 - DNA, 22 bp, Homo sapiens
tggcacaaaagacagctggcgg

SEQ ID NO: 4846890 - DNA, 22 bp, Homo sapiens
tggcacttgccattccaaaata

SEQ ID NO: 4846891 - DNA, 22 bp, Homo sapiens
tggcagatgggggcctctctgg

SEQ ID NO: 4846892 - DNA, 16 bp, Homo sapiens
tggcagctagtgcctt

SEQ ID NO: 4846893 - DNA, 18 bp, Homo sapiens
tggcagcttgctgggctt

SEQ ID NO: 4846894 - DNA, 22 bp, Homo sapiens
tggcagcttgctgggctttggg

SEQ ID NO: 4846895 - DNA, 12 bp, Homo sapiens
tggcaggaggct

SEQ ID NO: 4846896 - DNA, 15 bp, Homo sapiens
tggcagtctcagtcc

SEQ ID NO: 4846897 - DNA, 19 bp, Homo sapiens
tggcagtgggaatgttctt

SEQ ID NO: 4846898 - DNA, 17 bp, Homo sapiens
tggcatgcttaaatttt

SEQ ID NO: 4846899 - DNA, 23 bp, Homo sapiens
tggcattcaaccacgcaggaagc

SEQ ID NO: 4846900 - DNA, 14 bp, Homo sapiens
tggccacgggggca

SEQ ID NO: 4846901 - DNA, 19 bp, Homo sapiens
tggccacgggggcagtgtg

SEQ ID NO: 4846902 - DNA, 19 bp, Homo sapiens
tggccagcccgcagaggtg

SEQ ID NO: 4846903 - DNA, 16 bp, Homo sapiens
tggccagggaggcagc

SEQ ID NO: 4846904 - DNA, 21 bp, Homo sapiens
tggccagggaggcagcctagc

SEQ ID NO: 4846905 - DNA, 22 bp, Homo sapiens
tggccagtaaaatactattgcc

SEQ ID NO: 4846906 - DNA, 13 bp, Homo sapiens
tggccatcttctt

SEQ ID NO: 4846907 - DNA, 17 bp, Homo sapiens
tggccatcttctttctt

SEQ ID NO: 4846908 - DNA, 18 bp, Homo sapiens
tggccatcttctttcttc

SEQ ID NO: 4846909 - DNA, 22 bp, Homo sapiens
taacctagttaaagaaaggaaa

SEQ ID NO: 4846910 - DNA, 15 bp, Homo sapiens
taactcaaatacaca

SEQ ID NO: 4846911 - DNA, 18 bp, Homo sapiens
taactcaaatacacattt

SEQ ID NO: 4846912 - DNA, 23 bp, Homo sapiens
taactcaaggataccttcttatt

SEQ ID NO: 4846913 - DNA, 18 bp, Homo sapiens
taactcacacccctgccc

SEQ ID NO: 4846914 - DNA, 16 bp, Homo sapiens
taactcctataaagtg

SEQ ID NO: 4846915 - DNA, 13 bp, Homo sapiens
taactgaatttgg

SEQ ID NO: 4846916 - DNA, 15 bp, Homo sapiens
taactgtaaagatgt

SEQ ID NO: 4846917 - DNA, 12 bp, Homo sapiens
taactgtgataa

SEQ ID NO: 4846918 - DNA, 21 bp, Homo sapiens
taacttagactctagtattta

SEQ ID NO: 4846919 - DNA, 14 bp, Homo sapiens
taacttcctgtgga

SEQ ID NO: 4846920 - DNA, 23 bp, Homo sapiens
taacttgatagggtctaccaata

SEQ ID NO: 4846921 - DNA, 19 bp, Homo sapiens
taagaaatactcatgtgca

SEQ ID NO: 4846922 - DNA, 13 bp, Homo sapiens
taagaaatagaat

SEQ ID NO: 4846923 - DNA, 16 bp, Homo sapiens
taagaagaaggccaga

SEQ ID NO: 4846924 - DNA, 18 bp, Homo sapiens
taagaagaaggccagaga

SEQ ID NO: 4846925 - DNA, 22 bp, Homo sapiens
taagaagaagttcatgtccaaa

SEQ ID NO: 4846926 - DNA, 13 bp, Homo sapiens
taagaattctgat

SEQ ID NO: 4846927 - DNA, 19 bp, Homo sapiens
taagacaaatattcctttg

SEQ ID NO: 4846928 - DNA, 20 bp, Homo sapiens
taagacactgaaaaatctaa

SEQ ID NO: 4846929 - DNA, 17 bp, Homo sapiens
taagactgtagatatgt

SEQ ID NO: 4846930 - DNA, 12 bp, Homo sapiens
taagagaaacct

SEQ ID NO: 4846931 - DNA, 23 bp, Homo sapiens
taagagaaacctgccaaggagca

SEQ ID NO: 4846932 - DNA, 17 bp, Homo sapiens
taagatatctcaatgaa

SEQ ID NO: 4846933 - DNA, 15 bp, Homo sapiens
taagatgtgttctta

SEQ ID NO: 4846934 - DNA, 18 bp, Homo sapiens
taagcaaatgttaaaagt

SEQ ID NO: 4846935 - DNA, 19 bp, Homo sapiens
taagcaaatgttaaaagtt

SEQ ID NO: 4846936 - DNA, 20 bp, Homo sapiens
taagcaaccacactgcttgg

SEQ ID NO: 4846937 - DNA, 12 bp, Homo sapiens
taagcagtatat

SEQ ID NO: 4846938 - DNA, 19 bp, Homo sapiens
taagccgcagacctggagc

SEQ ID NO: 4846939 - DNA, 20 bp, Homo sapiens
taagccgcagacctggagct

SEQ ID NO: 4846940 - DNA, 14 bp, Homo sapiens
taagccttcaaaac

SEQ ID NO: 4846941 - DNA, 15 bp, Homo sapiens
taagctttttggaat

SEQ ID NO: 4846942 - DNA, 22 bp, Homo sapiens
taaggataaatcataaagtcag

SEQ ID NO: 4846943 - DNA, 17 bp, Homo sapiens
taaggatccggaaagaa

SEQ ID NO: 4846944 - DNA, 13 bp, Homo sapiens
taaggctcctcct

SEQ ID NO: 4846945 - DNA, 16 bp, Homo sapiens
taaggggaagaatgaa

SEQ ID NO: 4846946 - DNA, 20 bp, Homo sapiens
taaggggaagaatgaaagct

SEQ ID NO: 4846947 - DNA, 14 bp, Homo sapiens
taagtctttcatgg

SEQ ID NO: 4846948 - DNA, 13 bp, Homo sapiens
taagttatctttg

SEQ ID NO: 4846949 - DNA, 14 bp, Homo sapiens
taataaagatgagt

SEQ ID NO: 4846950 - DNA, 23 bp, Homo sapiens
taataaatgtgactcagcatcac

SEQ ID NO: 4846951 - DNA, 15 bp, Homo sapiens
taataagcactgtaa

SEQ ID NO: 4846952 - DNA, 16 bp, Homo sapiens
taataagcactgtaaa

SEQ ID NO: 4846953 - DNA, 16 bp, Homo sapiens
taataatgtaacatga

SEQ ID NO: 4846954 - DNA, 17 bp, Homo sapiens
taataatgtaacatgat

SEQ ID NO: 4846955 - DNA, 17 bp, Homo sapiens
taataattattattaaa

SEQ ID NO: 4846956 - DNA, 20 bp, Homo sapiens
taatagctttagtgaattaa

SEQ ID NO: 4846957 - DNA, 16 bp, Homo sapiens
taatatattaaaattc

SEQ ID NO: 4846958 - DNA, 20 bp, Homo sapiens
taatatgcttataacctagt

SEQ ID NO: 4846959 - DNA, 21 bp, Homo sapiens
taatattgaaaattgaaaagt

SEQ ID NO: 4846960 - DNA, 20 bp, Homo sapiens
taatattgtttggtaaatgt

SEQ ID NO: 4846961 - DNA, 16 bp, Homo sapiens
taatatttatatattt

SEQ ID NO: 4846962 - DNA, 18 bp, Homo sapiens
taatcaaattctgtctgg

SEQ ID NO: 4846963 - DNA, 19 bp, Homo sapiens
taatccagttataagaaga

SEQ ID NO: 4846964 - DNA, 18 bp, Homo sapiens
taatccatttcaggactc

SEQ ID NO: 4846965 - DNA, 14 bp, Homo sapiens
taatctatgtttat

SEQ ID NO: 4846966 - DNA, 20 bp, Homo sapiens
taatgcctgctttttggaaa

SEQ ID NO: 4846967 - DNA, 15 bp, Homo sapiens
taatgctaaatgtgt

SEQ ID NO: 4846968 - DNA, 22 bp, Homo sapiens
taatgctaaatgtgtaataatg

SEQ ID NO: 4846969 - DNA, 14 bp, Homo sapiens
taatgctacaattt

SEQ ID NO: 4846970 - DNA, 17 bp, Homo sapiens
taatgctgcctcaggac

SEQ ID NO: 4846971 - DNA, 17 bp, Homo sapiens
taatggcagctagtgcc

SEQ ID NO: 4846972 - DNA, 13 bp, Homo sapiens
taatgggattaga

SEQ ID NO: 4846973 - DNA, 23 bp, Homo sapiens
taatgtatataaactgggatgta

SEQ ID NO: 4846974 - DNA, 15 bp, Homo sapiens
taatgtttattaaat

SEQ ID NO: 4846975 - DNA, 16 bp, Homo sapiens
taatgtttattaaatg

SEQ ID NO: 4846976 - DNA, 22 bp, Homo sapiens
taatgtttattaaatgcttcat

SEQ ID NO: 4846977 - DNA, 22 bp, Homo sapiens
taatgtttctggatttcatact

SEQ ID NO: 4846978 - DNA, 13 bp, Homo sapiens
taatgttttcaaa

SEQ ID NO: 4846979 - DNA, 17 bp, Homo sapiens
taattaatatattaaaa

SEQ ID NO: 4846980 - DNA, 22 bp, Homo sapiens
taattaatatattaaaattcca

SEQ ID NO: 4846981 - DNA, 20 bp, Homo sapiens
taattaatttggagcacaaa

SEQ ID NO: 4846982 - DNA, 15 bp, Homo sapiens
taattatgtaaataa

SEQ ID NO: 4846983 - DNA, 15 bp, Homo sapiens
taattgtacaaaatt

SEQ ID NO: 4846984 - DNA, 22 bp, Homo sapiens
taattgtacaaaattaagcaaa

SEQ ID NO: 4846985 - DNA, 23 bp, Homo sapiens
taattgtacaaaattaagcaaat

SEQ ID NO: 4846986 - DNA, 14 bp, Homo sapiens
taattgtgccccta

SEQ ID NO: 4846987 - DNA, 20 bp, Homo sapiens
taattgtgtggattctttaa

SEQ ID NO: 4846988 - DNA, 13 bp, Homo sapiens
taatttaaatgaa

SEQ ID NO: 4846989 - DNA, 16 bp, Homo sapiens
taatttacttgttttg

SEQ ID NO: 4846990 - DNA, 12 bp, Homo sapiens
taatttcctgtg

SEQ ID NO: 4846991 - DNA, 15 bp, Homo sapiens
taatttcctgtgagg

SEQ ID NO: 4846992 - DNA, 14 bp, Homo sapiens
taatttccttcagg

SEQ ID NO: 4846993 - DNA, 18 bp, Homo sapiens
tacaaagttaaaattgtt

SEQ ID NO: 4846994 - DNA, 14 bp, Homo sapiens
tacaatattgattg

SEQ ID NO: 4846995 - DNA, 19 bp, Homo sapiens
tacaatattgattgggaaa

SEQ ID NO: 4846996 - DNA, 17 bp, Homo sapiens
tacaatctctttttgtt

SEQ ID NO: 4846997 - DNA, 17 bp, Homo sapiens
tacacatttgctactgt

SEQ ID NO: 4846998 - DNA, 18 bp, Homo sapiens
tacacttcacctccttct

SEQ ID NO: 4846999 - DNA, 21 bp, Homo sapiens
tacagacagcttacaggagcc

SEQ ID NO: 4847000 - DNA, 22 bp, Homo sapiens
tacagacagcttacaggagcca

SEQ ID NO: 4847001 - DNA, 23 bp, Homo sapiens
tacagacagcttacaggagccag

SEQ ID NO: 4847002 - DNA, 16 bp, Homo sapiens
tacagatctcagggct

SEQ ID NO: 4847003 - DNA, 13 bp, Homo sapiens
tacagccttattt

SEQ ID NO: 4847004 - DNA, 16 bp, Homo sapiens
tacagctctcctccag

SEQ ID NO: 4847005 - DNA, 23 bp, Homo sapiens
tacagctctcctccagccctggg

SEQ ID NO: 4847006 - DNA, 13 bp, Homo sapiens
tacaggtcatctg

SEQ ID NO: 4847007 - DNA, 22 bp, Homo sapiens
tacagtgcatagttgtagacaa

SEQ ID NO: 4847008 - DNA, 20 bp, Homo sapiens
tacagttttaactgtggata

SEQ ID NO: 4847009 - DNA, 17 bp, Homo sapiens
tacatcaatatgtatat

SEQ ID NO: 4847010 - DNA, 17 bp, Homo sapiens
tacatgccacatcaaac

SEQ ID NO: 4847011 - DNA, 15 bp, Homo sapiens
tacatgtgatacatt

SEQ ID NO: 4847012 - DNA, 15 bp, Homo sapiens
tacatgttcccaaaa

SEQ ID NO: 4847013 - DNA, 14 bp, Homo sapiens
tacattccaccctg

SEQ ID NO: 4847014 - DNA, 20 bp, Homo sapiens
tacattccaccctgttactt

SEQ ID NO: 4847015 - DNA, 18 bp, Homo sapiens
taccaatacaaaatgtat

SEQ ID NO: 4847016 - DNA, 15 bp, Homo sapiens
taccagggtctctca

SEQ ID NO: 4847017 - DNA, 19 bp, Homo sapiens
taccagggtctctcaggga

SEQ ID NO: 4847018 - DNA, 19 bp, Homo sapiens
taccatttagtaagaatac

SEQ ID NO: 4847019 - DNA, 16 bp, Homo sapiens
tacccatagacatgaa

SEQ ID NO: 4847020 - DNA, 18 bp, Homo sapiens
tacccatagacatgaaag

SEQ ID NO: 4847021 - DNA, 22 bp, Homo sapiens
tacccctgctcccattcctccc

SEQ ID NO: 4847022 - DNA, 14 bp, Homo sapiens
taccctacagacag

SEQ ID NO: 4847023 - DNA, 21 bp, Homo sapiens
tacccttgtgagagcccattc

SEQ ID NO: 4847024 - DNA, 18 bp, Homo sapiens
taccggagagagaatgta

SEQ ID NO: 4847025 - DNA, 13 bp, Homo sapiens
tacctaacatctg

SEQ ID NO: 4847026 - DNA, 15 bp, Homo sapiens
tacctctgtctgaga

SEQ ID NO: 4847027 - DNA, 21 bp, Homo sapiens
tacctgctcacgtcaaatgca

SEQ ID NO: 4847028 - DNA, 19 bp, Homo sapiens
tacctggatgttcttttta

SEQ ID NO: 4847029 - DNA, 13 bp, Homo sapiens
tacctggcctaga

SEQ ID NO: 4847030 - DNA, 15 bp, Homo sapiens
tacctgtgaagtgtt

SEQ ID NO: 4847031 - DNA, 11 bp, Homo sapiens
tacctgtgagg

SEQ ID NO: 4847032 - DNA, 12 bp, Homo sapiens
tacctgtgagga

SEQ ID NO: 4847033 - DNA, 13 bp, Homo sapiens
tacctgtgaggac

SEQ ID NO: 4847034 - DNA, 12 bp, Homo sapiens
tacctgtggata

SEQ ID NO: 4847035 - DNA, 23 bp, Homo sapiens
taccttatcttacaatattgatt

SEQ ID NO: 4847036 - DNA, 20 bp, Homo sapiens
taccttgtatactgtaggca

SEQ ID NO: 4847037 - DNA, 18 bp, Homo sapiens
tacctttctctctctaag

SEQ ID NO: 4847038 - DNA, 20 bp, Homo sapiens
taccttttttttttcttggt

SEQ ID NO: 4847039 - DNA, 15 bp, Homo sapiens
tactaaaaagtataa

SEQ ID NO: 4847040 - DNA, 19 bp, Homo sapiens
tactaacccagtctttctt

SEQ ID NO: 4847041 - DNA, 17 bp, Homo sapiens
tactcacacttcagctg

SEQ ID NO: 4847042 - DNA, 14 bp, Homo sapiens
tactccttgcttcc

SEQ ID NO: 4847043 - DNA, 19 bp, Homo sapiens
tactccttgcttcctgatg

SEQ ID NO: 4847044 - DNA, 20 bp, Homo sapiens
tactcttctgcctcctagac

SEQ ID NO: 4847045 - DNA, 21 bp, Homo sapiens
tactgaacacatgtgtatgat

SEQ ID NO: 4847046 - DNA, 19 bp, Homo sapiens
tactgaatgaagcagtatt

SEQ ID NO: 4847047 - DNA, 14 bp, Homo sapiens
tactgatttcagta

SEQ ID NO: 4847048 - DNA, 18 bp, Homo sapiens
tactgatttcagtaagtc

SEQ ID NO: 4847049 - DNA, 20 bp, Homo sapiens
tactgcaaagtcgccagtca

SEQ ID NO: 4847050 - DNA, 22 bp, Homo sapiens
tactggggggcaggcctcccaa

SEQ ID NO: 4847051 - DNA, 20 bp, Homo sapiens
tactggttacctggagaagt

SEQ ID NO: 4847052 - DNA, 16 bp, Homo sapiens
tactgtaatgctgcct

SEQ ID NO: 4847053 - DNA, 18 bp, Homo sapiens
tactgtaatgctgcctca

SEQ ID NO: 4847054 - DNA, 19 bp, Homo sapiens
tactgtaatgctgcctcag

SEQ ID NO: 4847055 - DNA, 17 bp, Homo sapiens
tactgtggcctgcagga

SEQ ID NO: 4847056 - DNA, 15 bp, Homo sapiens
tactgtgggcaaagt

SEQ ID NO: 4847057 - DNA, 16 bp, Homo sapiens
tactgttgtaagaatt

SEQ ID NO: 4847058 - DNA, 17 bp, Homo sapiens
tactgttgtaagaattc

SEQ ID NO: 4847059 - DNA, 24 bp, Homo sapiens
tacttaaatggtaataagcactgt

SEQ ID NO: 4847060 - DNA, 15 bp, Homo sapiens
tacttatttctcagc

SEQ ID NO: 4847061 - DNA, 18 bp, Homo sapiens
tacttatttgtatatggt

SEQ ID NO: 4847062 - DNA, 16 bp, Homo sapiens
tacttcaaagtgcctg

SEQ ID NO: 4847063 - DNA, 18 bp, Homo sapiens
tacttcaaagtgcctggg

SEQ ID NO: 4847064 - DNA, 15 bp, Homo sapiens
tacttcccactgtat

SEQ ID NO: 4847065 - DNA, 20 bp, Homo sapiens
tacttctgtaattgtgtgga

SEQ ID NO: 4847066 - DNA, 13 bp, Homo sapiens
tacttcttgaata

SEQ ID NO: 4847067 - DNA, 16 bp, Homo sapiens
tacttggaactaggct

SEQ ID NO: 4847068 - DNA, 17 bp, Homo sapiens
tacttggcccccttcag

SEQ ID NO: 4847069 - DNA, 22 bp, Homo sapiens
tacttggcccccttcaggagcc

SEQ ID NO: 4847070 - DNA, 23 bp, Homo sapiens
tacttggcccccttcaggagcct

SEQ ID NO: 4847071 - DNA, 20 bp, Homo sapiens
tacttgggtcacatgactct

SEQ ID NO: 4847072 - DNA, 17 bp, Homo sapiens
tactttagaagcctgca

SEQ ID NO: 4847073 - DNA, 21 bp, Homo sapiens
tactttagaagcctgcataat

SEQ ID NO: 4847074 - DNA, 21 bp, Homo sapiens
tactttctatttttatgatga

SEQ ID NO: 4847075 - DNA, 22 bp, Homo sapiens
tactttctatttttatgatgac

SEQ ID NO: 4847076 - DNA, 23 bp, Homo sapiens
tactttggtagctgggaaagcat

SEQ ID NO: 4847077 - DNA, 16 bp, Homo sapiens
tactttgtattttgat

SEQ ID NO: 4847078 - DNA, 21 bp, Homo sapiens
tactttgtattttgattattt

SEQ ID NO: 4847079 - DNA, 14 bp, Homo sapiens
tagaaaagtgaatt

SEQ ID NO: 4847080 - DNA, 15 bp, Homo sapiens
tagaaatattcacat

SEQ ID NO: 4847081 - DNA, 18 bp, Homo sapiens
tagaaattacctgtggat

SEQ ID NO: 4847082 - DNA, 18 bp, Homo sapiens
tagaagcctgacaactca

SEQ ID NO: 4847083 - DNA, 20 bp, Homo sapiens
tagacaaaaagtatattaaa

SEQ ID NO: 4847084 - DNA, 14 bp, Homo sapiens
tagacaaagtacat

SEQ ID NO: 4847085 - DNA, 19 bp, Homo sapiens
tagacctgttctttccatc

SEQ ID NO: 4847086 - DNA, 13 bp, Homo sapiens
tagacggtgctca

SEQ ID NO: 4847087 - DNA, 20 bp, Homo sapiens
tagactcaaagaagtactgt

SEQ ID NO: 4847088 - DNA, 17 bp, Homo sapiens
tagactgctcctgggca

SEQ ID NO: 4847089 - DNA, 14 bp, Homo sapiens
tagagaacaaagta

SEQ ID NO: 4847090 - DNA, 23 bp, Homo sapiens
tagagactttgatactaccaggg

SEQ ID NO: 4847091 - DNA, 16 bp, Homo sapiens
tagagctaaaaaggcc

SEQ ID NO: 4847092 - DNA, 22 bp, Homo sapiens
tagagctcttgtgttcagaaga

SEQ ID NO: 4847093 - DNA, 23 bp, Homo sapiens
tagagctcttgtgttcagaagaa

SEQ ID NO: 4847094 - DNA, 12 bp, Homo sapiens
tagagtaatgaa

SEQ ID NO: 4847095 - DNA, 17 bp, Homo sapiens
tagagtaatgaaatgga

SEQ ID NO: 4847096 - DNA, 13 bp, Homo sapiens
tagataatattgt

SEQ ID NO: 4847097 - DNA, 15 bp, Homo sapiens
tagataatattgttt

SEQ ID NO: 4847098 - DNA, 15 bp, Homo sapiens
tagatatgaaagctg

SEQ ID NO: 4847099 - DNA, 18 bp, Homo sapiens
tagatcaaatagttgcat

SEQ ID NO: 4847100 - DNA, 20 bp, Homo sapiens
tagatcaaatagttgcatag

SEQ ID NO: 4847101 - DNA, 14 bp, Homo sapiens
tagatccagcccaa

SEQ ID NO: 4847102 - DNA, 22 bp, Homo sapiens
tagatccagcccaaacctggga

SEQ ID NO: 4847103 - DNA, 15 bp, Homo sapiens
tagatccatttccat

SEQ ID NO: 4847104 - DNA, 21 bp, Homo sapiens
tagatcctaagatgtgttctt

SEQ ID NO: 4847105 - DNA, 20 bp, Homo sapiens
tagatgaatgtcagttgtta

SEQ ID NO: 4847106 - DNA, 19 bp, Homo sapiens
tagatgaggctcagagagg

SEQ ID NO: 4847107 - DNA, 22 bp, Homo sapiens
tagatgattttttgaaagttaa

SEQ ID NO: 4847108 - DNA, 16 bp, Homo sapiens
tagatggcgatgtgtt

SEQ ID NO: 4847109 - DNA, 16 bp, Homo sapiens
tagatgggaggatgaa

SEQ ID NO: 4847110 - DNA, 12 bp, Homo sapiens
tagattcagaga

SEQ ID NO: 4847111 - DNA, 15 bp, Homo sapiens
tagattgagaaatgt

SEQ ID NO: 4847112 - DNA, 16 bp, Homo sapiens
tagcaaggcagagcct

SEQ ID NO: 4847113 - DNA, 17 bp, Homo sapiens
tagcaaggcagagcctt

SEQ ID NO: 4847114 - DNA, 13 bp, Homo sapiens
tagcaccagggct

SEQ ID NO: 4847115 - DNA, 14 bp, Homo sapiens
tagcactctcagag

SEQ ID NO: 4847116 - DNA, 17 bp, Homo sapiens
tagcagatctgttttgt

SEQ ID NO: 4847117 - DNA, 16 bp, Homo sapiens
tagcatgaaataaaat

SEQ ID NO: 4847118 - DNA, 24 bp, Homo sapiens
tagcattgtaaaattatttcatga

SEQ ID NO: 4847119 - DNA, 20 bp, Homo sapiens
tagcctaaggctcctgtttt

SEQ ID NO: 4847120 - DNA, 14 bp, Homo sapiens
tagcctatgtctgg

SEQ ID NO: 4847121 - DNA, 17 bp, Homo sapiens
tagcctatgtctggcag

SEQ ID NO: 4847122 - DNA, 20 bp, Homo sapiens
tagcctatgtctggcagatg

SEQ ID NO: 4847123 - DNA, 19 bp, Homo sapiens
tagcctctggactggaaag

SEQ ID NO: 4847124 - DNA, 22 bp, Homo sapiens
tagcgtttaaggtgagcataaa

SEQ ID NO: 4847125 - DNA, 13 bp, Homo sapiens
tagctaattattt

SEQ ID NO: 4847126 - DNA, 21 bp, Homo sapiens
tagctctttgggcctctcctg

SEQ ID NO: 4847127 - DNA, 15 bp, Homo sapiens
tagctgaagaattga

SEQ ID NO: 4847128 - DNA, 21 bp, Homo sapiens
tagctgaagaattgaaaagtt

SEQ ID NO: 4847129 - DNA, 22 bp, Homo sapiens
tagctgaagaattgaaaagttt

SEQ ID NO: 4847130 - DNA, 16 bp, Homo sapiens
tagctgaggctgagaa

SEQ ID NO: 4847131 - DNA, 20 bp, Homo sapiens
tagctgaggctgagaaagct

SEQ ID NO: 4847132 - DNA, 23 bp, Homo sapiens
tagctgaggctgagaaagctaaa

SEQ ID NO: 4847133 - DNA, 18 bp, Homo sapiens
tagctgggaaagcataaa

SEQ ID NO: 4847134 - DNA, 15 bp, Homo sapiens
tagcttacctgggca

SEQ ID NO: 4847135 - DNA, 14 bp, Homo sapiens
tagcttcagccagg

SEQ ID NO: 4847136 - DNA, 14 bp, Homo sapiens
taggaaccctggag

SEQ ID NO: 4847137 - DNA, 19 bp, Homo sapiens
taggagtggtgatttgaaa

SEQ ID NO: 4847138 - DNA, 20 bp, Homo sapiens
taggcactgagcagggatct

SEQ ID NO: 4847139 - DNA, 23 bp, Homo sapiens
taggccaggccttatctgaaagg

SEQ ID NO: 4847140 - DNA, 16 bp, Homo sapiens
taggctggggacacag

SEQ ID NO: 4847141 - DNA, 18 bp, Homo sapiens
taggggaaggagaagtaa

SEQ ID NO: 4847142 - DNA, 16 bp, Homo sapiens
tagggtcttgggggtc

SEQ ID NO: 4847143 - DNA, 20 bp, Homo sapiens
taggtagaagtgagcaaaaa

SEQ ID NO: 4847144 - DNA, 15 bp, Homo sapiens
taggtctcctcaggg

SEQ ID NO: 4847145 - DNA, 15 bp, Homo sapiens
tagtaagcatagaaa

SEQ ID NO: 4847146 - DNA, 16 bp, Homo sapiens
tagtacctgtgactct

SEQ ID NO: 4847147 - DNA, 16 bp, Homo sapiens
tagtatctatatgact

SEQ ID NO: 4847148 - DNA, 13 bp, Homo sapiens
tagtatgaaaatg

SEQ ID NO: 4847149 - DNA, 22 bp, Homo sapiens
tagtattatcttgttcaggaaa

SEQ ID NO: 4847150 - DNA, 20 bp, Homo sapiens
tagtatttatgggtggattt

SEQ ID NO: 4847151 - DNA, 20 bp, Homo sapiens
tagtcccggaggccttccct

SEQ ID NO: 4847152 - DNA, 17 bp, Homo sapiens
tagtctaagactatata

SEQ ID NO: 4847153 - DNA, 11 bp, Homo sapiens
tagtcttggaa

SEQ ID NO: 4847154 - DNA, 23 bp, Homo sapiens
tagtcttggaagctgtttggaaa

SEQ ID NO: 4847155 - DNA, 22 bp, Homo sapiens
tagtgatgtccttaaaatgtgg

SEQ ID NO: 4847156 - DNA, 13 bp, Homo sapiens
tagtggctggggt

SEQ ID NO: 4847157 - DNA, 11 bp, Homo sapiens
tagtgtgaaat

SEQ ID NO: 4847158 - DNA, 21 bp, Homo sapiens
tagttaaagaaaggaaaagaa

SEQ ID NO: 4847159 - DNA, 19 bp, Homo sapiens
tagttgcatagcagtatat

SEQ ID NO: 4847160 - DNA, 15 bp, Homo sapiens
tagttgtgtttcaac

SEQ ID NO: 4847161 - DNA, 17 bp, Homo sapiens
tataaacagaaatggaa

SEQ ID NO: 4847162 - DNA, 22 bp, Homo sapiens
tataaactatatataatgtata

SEQ ID NO: 4847163 - DNA, 17 bp, Homo sapiens
tataaactgggatgtaa

SEQ ID NO: 4847164 - DNA, 12 bp, Homo sapiens
tataaatgtata

SEQ ID NO: 4847165 - DNA, 16 bp, Homo sapiens
tataaatgtataaata

SEQ ID NO: 4847166 - DNA, 20 bp, Homo sapiens
tataaatgtataaatataca

SEQ ID NO: 4847167 - DNA, 14 bp, Homo sapiens
tataacacattttt

SEQ ID NO: 4847168 - DNA, 22 bp, Homo sapiens
tataactcaaggataccttctt

SEQ ID NO: 4847169 - DNA, 13 bp, Homo sapiens
tataagtgtacat

SEQ ID NO: 4847170 - DNA, 14 bp, Homo sapiens
tataagtgtacata

SEQ ID NO: 4847171 - DNA, 15 bp, Homo sapiens
tataagtgtacatat

SEQ ID NO: 4847172 - DNA, 18 bp, Homo sapiens
tataagtgtacatatgtg

SEQ ID NO: 4847173 - DNA, 20 bp, Homo sapiens
tataatacagaatcttgttt

SEQ ID NO: 4847174 - DNA, 16 bp, Homo sapiens
tataatattgaaaatt

SEQ ID NO: 4847175 - DNA, 19 bp, Homo sapiens
tataatattgaaaattgaa

SEQ ID NO: 4847176 - DNA, 16 bp, Homo sapiens
tataatgaataaatca

SEQ ID NO: 4847177 - DNA, 23 bp, Homo sapiens
tataatgatcagcaaaaagactg

SEQ ID NO: 4847178 - DNA, 20 bp, Homo sapiens
tataatgtttattaaatgct

SEQ ID NO: 4847179 - DNA, 14 bp, Homo sapiens
tataattgtacaaa

SEQ ID NO: 4847180 - DNA, 23 bp, Homo sapiens
tataattgtacaaaattaagcaa

SEQ ID NO: 4847181 - DNA, 20 bp, Homo sapiens
tatacatcaatatgtatata

SEQ ID NO: 4847182 - DNA, 21 bp, Homo sapiens
tatacatcaatatgtatatat

SEQ ID NO: 4847183 - DNA, 15 bp, Homo sapiens
tatacatgtgataca

SEQ ID NO: 4847184 - DNA, 21 bp, Homo sapiens
tatagacttggagaatactgc

SEQ ID NO: 4847185 - DNA, 20 bp, Homo sapiens
tatagcatgaaataaaatat

SEQ ID NO: 4847186 - DNA, 17 bp, Homo sapiens
tataggctattttctaa

SEQ ID NO: 4847187 - DNA, 21 bp, Homo sapiens
tataggctattttctaaagac

SEQ ID NO: 4847188 - DNA, 13 bp, Homo sapiens
tataggttctttt

SEQ ID NO: 4847189 - DNA, 13 bp, Homo sapiens
tatataaatgtat

SEQ ID NO: 4847190 - DNA, 19 bp, Homo sapiens
tatataagtgtacatatgt

SEQ ID NO: 4847191 - DNA, 23 bp, Homo sapiens
tatataagtgtacatatgtgctg

SEQ ID NO: 4847192 - DNA, 14 bp, Homo sapiens
tatataggctattt

SEQ ID NO: 4847193 - DNA, 15 bp, Homo sapiens
tatatataaatgtat

SEQ ID NO: 4847194 - DNA, 11 bp, Homo sapiens
tatatatatat

SEQ ID NO: 4847195 - DNA, 18 bp, Homo sapiens
tatatattttgtgtgaaa

SEQ ID NO: 4847196 - DNA, 21 bp, Homo sapiens
tatattaaaattccaaattca

SEQ ID NO: 4847197 - DNA, 22 bp, Homo sapiens
tatattaaaattccaaattcat

SEQ ID NO: 4847198 - DNA, 15 bp, Homo sapiens
tatattaaataacat

SEQ ID NO: 4847199 - DNA, 18 bp, Homo sapiens
tatattaaataacatgtt

SEQ ID NO: 4847200 - DNA, 18 bp, Homo sapiens
tatattacccaatggaaa

SEQ ID NO: 4847201 - DNA, 23 bp, Homo sapiens
tatattactgacatttcttctag

SEQ ID NO: 4847202 - DNA, 15 bp, Homo sapiens
tatattcctccagct

SEQ ID NO: 4847203 - DNA, 17 bp, Homo sapiens
tatattcctccagctgg

SEQ ID NO: 4847204 - DNA, 15 bp, Homo sapiens
tatatttataaggaa

SEQ ID NO: 4847205 - DNA, 17 bp, Homo sapiens
tatattttgtttacaaa

SEQ ID NO: 4847206 - DNA, 16 bp, Homo sapiens
tatatttttttaactg

SEQ ID NO: 4847207 - DNA, 18 bp, Homo sapiens
tatcaaagtcattaaaga

SEQ ID NO: 4847208 - DNA, 21 bp, Homo sapiens
tatcactgccttcgtttatat

SEQ ID NO: 4847209 - DNA, 15 bp, Homo sapiens
tatcagtaatgctaa

SEQ ID NO: 4847210 - DNA, 21 bp, Homo sapiens
tatcagtaatgctaaatgtgt

SEQ ID NO: 4847211 - DNA, 15 bp, Homo sapiens
tatcatgaattttaa

SEQ ID NO: 4847212 - DNA, 18 bp, Homo sapiens
tatcatgaattttaaagt

SEQ ID NO: 4847213 - DNA, 14 bp, Homo sapiens
tatccaactttttc

SEQ ID NO: 4847214 - DNA, 17 bp, Homo sapiens
tatccaactttttcata

SEQ ID NO: 4847215 - DNA, 15 bp, Homo sapiens
tatccctacatgtat

SEQ ID NO: 4847216 - DNA, 15 bp, Homo sapiens
tatccctcacctgta

SEQ ID NO: 4847217 - DNA, 19 bp, Homo sapiens
tatcccttggacattttat

SEQ ID NO: 4847218 - DNA, 16 bp, Homo sapiens
tatctcaatgaaccat

SEQ ID NO: 4847219 - DNA, 14 bp, Homo sapiens
tatctcctttgaag

SEQ ID NO: 4847220 - DNA, 20 bp, Homo sapiens
tatctcctttgaagaaggca

SEQ ID NO: 4847221 - DNA, 12 bp, Homo sapiens
tatctctttcca

SEQ ID NO: 4847222 - DNA, 15 bp, Homo sapiens
tatctgcatgtgtca

SEQ ID NO: 4847223 - DNA, 23 bp, Homo sapiens
tatcttataaagtggaagtatgt

SEQ ID NO: 4847224 - DNA, 15 bp, Homo sapiens
tatcttattttctca

SEQ ID NO: 4847225 - DNA, 16 bp, Homo sapiens
tatgaatgaatgggat

SEQ ID NO: 4847226 - DNA, 17 bp, Homo sapiens
tatgacaagctgtatca

SEQ ID NO: 4847227 - DNA, 21 bp, Homo sapiens
tatgagattggttttcctgtg

SEQ ID NO: 4847228 - DNA, 18 bp, Homo sapiens
tatgagtgtatgtgttta

SEQ ID NO: 4847229 - DNA, 16 bp, Homo sapiens
tatgatgacaatcaaa

SEQ ID NO: 4847230 - DNA, 22 bp, Homo sapiens
tatgcagaaatagacaaaaagt

SEQ ID NO: 4847231 - DNA, 12 bp, Homo sapiens
tatgcagagctt

SEQ ID NO: 4847232 - DNA, 15 bp, Homo sapiens
tatgcagagcttgtg

SEQ ID NO: 4847233 - DNA, 23 bp, Homo sapiens
tatgcattcacatttagaaaagt

SEQ ID NO: 4847234 - DNA, 13 bp, Homo sapiens
tatgctttattaa

SEQ ID NO: 4847235 - DNA, 19 bp, Homo sapiens
tatggaagccaccgggaga

SEQ ID NO: 4847236 - DNA, 20 bp, Homo sapiens
tatgggggagattgaacttt

SEQ ID NO: 4847237 - DNA, 14 bp, Homo sapiens
tatggtatgtagcc

SEQ ID NO: 4847238 - DNA, 17 bp, Homo sapiens
tatggtggatccaaact

SEQ ID NO: 4847239 - DNA, 16 bp, Homo sapiens
tatgtaaataactcta

SEQ ID NO: 4847240 - DNA, 15 bp, Homo sapiens
tatgtaacttcctgt

SEQ ID NO: 4847241 - DNA, 21 bp, Homo sapiens
tatgtaggtaagactgtagat

SEQ ID NO: 4847242 - DNA, 18 bp, Homo sapiens
tatgtagtatctatatga

SEQ ID NO: 4847243 - DNA, 16 bp, Homo sapiens
tatgtattttttgaat

SEQ ID NO: 4847244 - DNA, 13 bp, Homo sapiens
tatgtctggcaga

SEQ ID NO: 4847245 - DNA, 18 bp, Homo sapiens
tatgtgggatattgaatg

SEQ ID NO: 4847246 - DNA, 16 bp, Homo sapiens
tatgttaatatttctg

SEQ ID NO: 4847247 - DNA, 14 bp, Homo sapiens
tatgttaatatttt

SEQ ID NO: 4847248 - DNA, 21 bp, Homo sapiens
tattaaaaaacaattaactgc

SEQ ID NO: 4847249 - DNA, 17 bp, Homo sapiens
tattaaaaaagagacat

SEQ ID NO: 4847250 - DNA, 12 bp, Homo sapiens
tattaaaactaa

SEQ ID NO: 4847251 - DNA, 17 bp, Homo sapiens
tattaaaactaaatttc

SEQ ID NO: 4847252 - DNA, 19 bp, Homo sapiens
tattaaaactaaatttcac

SEQ ID NO: 4847253 - DNA, 18 bp, Homo sapiens
tattactgacatttcttc

SEQ ID NO: 4847254 - DNA, 16 bp, Homo sapiens
tattataaaggataaa

SEQ ID NO: 4847255 - DNA, 20 bp, Homo sapiens
tattataaaggataaagaag

SEQ ID NO: 4847256 - DNA, 23 bp, Homo sapiens
tattatattcattctttttgaaa

SEQ ID NO: 4847257 - DNA, 16 bp, Homo sapiens
tattcagggtaaatag

SEQ ID NO: 4847258 - DNA, 13 bp, Homo sapiens
tattccccagtga

SEQ ID NO: 4847259 - DNA, 16 bp, Homo sapiens
tattccccagtgactc

SEQ ID NO: 4847260 - DNA, 19 bp, Homo sapiens
tattccccagtgactccag

SEQ ID NO: 4847261 - DNA, 21 bp, Homo sapiens
tattccccagtgactccaggg

SEQ ID NO: 4847262 - DNA, 13 bp, Homo sapiens
tattcctccagct

SEQ ID NO: 4847263 - DNA, 14 bp, Homo sapiens
tattcctccagctg

SEQ ID NO: 4847264 - DNA, 15 bp, Homo sapiens
tattcctccagctgg

SEQ ID NO: 4847265 - DNA, 22 bp, Homo sapiens
tattcctttatacacagtggat

SEQ ID NO: 4847266 - DNA, 19 bp, Homo sapiens
tattgaaaattgaaaagta

SEQ ID NO: 4847267 - DNA, 21 bp, Homo sapiens
tattgagttccagttgaagtt

SEQ ID NO: 4847268 - DNA, 19 bp, Homo sapiens
tattgattgggaaaacatt

SEQ ID NO: 4847269 - DNA, 16 bp, Homo sapiens
tattgcaataaagtat

SEQ ID NO: 4847270 - DNA, 17 bp, Homo sapiens
tattggacctgcccaca

SEQ ID NO: 4847271 - DNA, 17 bp, Homo sapiens
tattgtttaaaatgtaa

SEQ ID NO: 4847272 - DNA, 17 bp, Homo sapiens
tattgtttggtaaatgt

SEQ ID NO: 4847273 - DNA, 15 bp, Homo sapiens
tatttaatatgctta

SEQ ID NO: 4847274 - DNA, 23 bp, Homo sapiens
tatttaatttgaaggtagaatgt

SEQ ID NO: 4847275 - DNA, 14 bp, Homo sapiens
tatttacagctgtg

SEQ ID NO: 4847276 - DNA, 23 bp, Homo sapiens
tatttactttttcggtttcaaag

SEQ ID NO: 4847277 - DNA, 12 bp, Homo sapiens
tatttattgaaa

SEQ ID NO: 4847278 - DNA, 14 bp, Homo sapiens
tatttatttattta

SEQ ID NO: 4847279 - DNA, 15 bp, Homo sapiens
tatttcaataaatga

SEQ ID NO: 4847280 - DNA, 22 bp, Homo sapiens
tatttcccccttcatccatcct

SEQ ID NO: 4847281 - DNA, 12 bp, Homo sapiens
tatttctatata

SEQ ID NO: 4847282 - DNA, 17 bp, Homo sapiens
tatttctcagctgtgcc

SEQ ID NO: 4847283 - DNA, 19 bp, Homo sapiens
tatttctcagctgtgcctt

SEQ ID NO: 4847284 - DNA, 21 bp, Homo sapiens
tatttctgaaggtagcattct

SEQ ID NO: 4847285 - DNA, 18 bp, Homo sapiens
tatttgctgacaaccatt

SEQ ID NO: 4847286 - DNA, 13 bp, Homo sapiens
tattttaaaattt

SEQ ID NO: 4847287 - DNA, 14 bp, Homo sapiens
tattttcatgaaaa

SEQ ID NO: 4847288 - DNA, 18 bp, Homo sapiens
tattttgaaatgaacttt

SEQ ID NO: 4847289 - DNA, 18 bp, Homo sapiens
tattttgggcctgttcct

SEQ ID NO: 4847290 - DNA, 14 bp, Homo sapiens
tattttgtgtgaaa

SEQ ID NO: 4847291 - DNA, 15 bp, Homo sapiens
tattttgtgtgaaat

SEQ ID NO: 4847292 - DNA, 20 bp, Homo sapiens
tatttttaatttcctgtgag

SEQ ID NO: 4847293 - DNA, 15 bp, Homo sapiens
tatttttttaactgt

SEQ ID NO: 4847294 - DNA, 19 bp, Homo sapiens
tattttttttttcttcttg

SEQ ID NO: 4847295 - DNA, 17 bp, Homo sapiens
tcaaaaagccacagcag

SEQ ID NO: 4847296 - DNA, 18 bp, Homo sapiens
tcaaaaagccacagcaga

SEQ ID NO: 4847297 - DNA, 14 bp, Homo sapiens
tcaaacctggcaga

SEQ ID NO: 4847298 - DNA, 17 bp, Homo sapiens
tcaaagccggcctgaga

SEQ ID NO: 4847299 - DNA, 19 bp, Homo sapiens
tcaaagccggcctgagaaa

SEQ ID NO: 4847300 - DNA, 13 bp, Homo sapiens
tcaaagtcattaa

SEQ ID NO: 4847301 - DNA, 23 bp, Homo sapiens
tcaaagtgcctgggctcagcctg

SEQ ID NO: 4847302 - DNA, 14 bp, Homo sapiens
tcaaatacacattt

SEQ ID NO: 4847303 - DNA, 17 bp, Homo sapiens
tcaaatacacatttgct

SEQ ID NO: 4847304 - DNA, 23 bp, Homo sapiens
tcaaatgaaatgtatgcattcac

SEQ ID NO: 4847305 - DNA, 18 bp, Homo sapiens
tcaaattctgtctgggga

SEQ ID NO: 4847306 - DNA, 14 bp, Homo sapiens
tcaacagaacatat

SEQ ID NO: 4847307 - DNA, 17 bp, Homo sapiens
tcaacatttctcatgtt

SEQ ID NO: 4847308 - DNA, 19 bp, Homo sapiens
tcaactgaggttcttggga

SEQ ID NO: 4847309 - DNA, 16 bp, Homo sapiens
tcaacttattctttga

SEQ ID NO: 4847310 - DNA, 19 bp, Homo sapiens
tcaactttgtaaaaatctt

SEQ ID NO: 4847311 - DNA, 16 bp, Homo sapiens
tcaaggacattggtga

SEQ ID NO: 4847312 - DNA, 22 bp, Homo sapiens
tcaagttctggacctgggcatg

SEQ ID NO: 4847313 - DNA, 13 bp, Homo sapiens
tcaataaatgata

SEQ ID NO: 4847314 - DNA, 12 bp, Homo sapiens
tcaatagttgaa

SEQ ID NO: 4847315 - DNA, 13 bp, Homo sapiens
tcaatagttgaat

SEQ ID NO: 4847316 - DNA, 15 bp, Homo sapiens
tcaatagttgaatta

SEQ ID NO: 4847317 - DNA, 16 bp, Homo sapiens
tcaatagttgaattag

SEQ ID NO: 4847318 - DNA, 20 bp, Homo sapiens
tcaatccatccatgtacttc

SEQ ID NO: 4847319 - DNA, 14 bp, Homo sapiens
tcaatctcctctct

SEQ ID NO: 4847320 - DNA, 21 bp, Homo sapiens
tcaatctcctctctctttcct

SEQ ID NO: 4847321 - DNA, 17 bp, Homo sapiens
tcaatgaaccataaatt

SEQ ID NO: 4847322 - DNA, 21 bp, Homo sapiens
tcaatgcaagccccaactttc

SEQ ID NO: 4847323 - DNA, 20 bp, Homo sapiens
tcaattagcgtttaaggtga

SEQ ID NO: 4847324 - DNA, 16 bp, Homo sapiens
tcaattttatccctca

SEQ ID NO: 4847325 - DNA, 21 bp, Homo sapiens
tcaattttatccctcacctgt

SEQ ID NO: 4847326 - DNA, 22 bp, Homo sapiens
tcaattttatccctcacctgta

SEQ ID NO: 4847327 - DNA, 20 bp, Homo sapiens
tcacaaaatatattttgttt

SEQ ID NO: 4847328 - DNA, 20 bp, Homo sapiens
tcacaagtggtgtttattgc

SEQ ID NO: 4847329 - DNA, 14 bp, Homo sapiens
tcacacagacacta

SEQ ID NO: 4847330 - DNA, 15 bp, Homo sapiens
tcacacccctgcccc

SEQ ID NO: 4847331 - DNA, 19 bp, Homo sapiens
tcacagggaatggccacaa

SEQ ID NO: 4847332 - DNA, 14 bp, Homo sapiens
tcacatccatccct

SEQ ID NO: 4847333 - DNA, 15 bp, Homo sapiens
tcaccaaaagacact

SEQ ID NO: 4847334 - DNA, 16 bp, Homo sapiens
tcaccaaaagacactg

SEQ ID NO: 4847335 - DNA, 20 bp, Homo sapiens
tcacccatcctaggaaccag

SEQ ID NO: 4847336 - DNA, 23 bp, Homo sapiens
tcacccatcctaggaaccagcca

SEQ ID NO: 4847337 - DNA, 12 bp, Homo sapiens
tcacccccatcc

SEQ ID NO: 4847338 - DNA, 14 bp, Homo sapiens
tcacccccatccct

SEQ ID NO: 4847339 - DNA, 14 bp, Homo sapiens
tcaccctctgtcct

SEQ ID NO: 4847340 - DNA, 18 bp, Homo sapiens
tcaccctctgtccttccc

SEQ ID NO: 4847341 - DNA, 20 bp, Homo sapiens
tcaccgcaggtgctcatgct

SEQ ID NO: 4847342 - DNA, 21 bp, Homo sapiens
tcacctccttctgcagtcaga

SEQ ID NO: 4847343 - DNA, 13 bp, Homo sapiens
tcacctgcactaa

SEQ ID NO: 4847344 - DNA, 15 bp, Homo sapiens
tcactactgaacaca

SEQ ID NO: 4847345 - DNA, 14 bp, Homo sapiens
tcactgccttcgtt

SEQ ID NO: 4847346 - DNA, 15 bp, Homo sapiens
tcactggactgcatg

SEQ ID NO: 4847347 - DNA, 16 bp, Homo sapiens
tcactgtactgcatgt

SEQ ID NO: 4847348 - DNA, 17 bp, Homo sapiens
tcactgtactgcatgtg

SEQ ID NO: 4847349 - DNA, 18 bp, Homo sapiens
tcactgtactgcatgtga

SEQ ID NO: 4847350 - DNA, 18 bp, Homo sapiens
tcactgtatcattttctt

SEQ ID NO: 4847351 - DNA, 17 bp, Homo sapiens
tcacttagtcctttatc

SEQ ID NO: 4847352 - DNA, 20 bp, Homo sapiens
tcacttttccttttcttaaa

SEQ ID NO: 4847353 - DNA, 20 bp, Homo sapiens
tcacttttggcaatgactca

SEQ ID NO: 4847354 - DNA, 17 bp, Homo sapiens
tcagaaaaaaataaatg

SEQ ID NO: 4847355 - DNA, 14 bp, Homo sapiens
tcagaaaaccactt

SEQ ID NO: 4847356 - DNA, 17 bp, Homo sapiens
tcagaaaattccctggg

SEQ ID NO: 4847357 - DNA, 15 bp, Homo sapiens
tcagaactcttcctc

SEQ ID NO: 4847358 - DNA, 22 bp, Homo sapiens
tcagaagaatcttcctggcaca

SEQ ID NO: 4847359 - DNA, 13 bp, Homo sapiens
tcagaagatagtc

SEQ ID NO: 4847360 - DNA, 20 bp, Homo sapiens
tcagaagatagtcttggaag

SEQ ID NO: 4847361 - DNA, 22 bp, Homo sapiens
tcagaattagagcatgggaggt

SEQ ID NO: 4847362 - DNA, 16 bp, Homo sapiens
tcagaatttttaactg

SEQ ID NO: 4847363 - DNA, 17 bp, Homo sapiens
tcagaatttttaactgt

SEQ ID NO: 4847364 - DNA, 16 bp, Homo sapiens
tcagacatttctttgg

SEQ ID NO: 4847365 - DNA, 22 bp, Homo sapiens
tcagagaggtagcactctcaga

SEQ ID NO: 4847366 - DNA, 20 bp, Homo sapiens
tcagagctatggtgcttgct

SEQ ID NO: 4847367 - DNA, 19 bp, Homo sapiens
tcagagtgttttgaccagt

SEQ ID NO: 4847368 - DNA, 12 bp, Homo sapiens
tcagcatccagt

SEQ ID NO: 4847369 - DNA, 16 bp, Homo sapiens
tcagcatccagtgtga

SEQ ID NO: 4847370 - DNA, 19 bp, Homo sapiens
tcagcatccagtgtgagat

SEQ ID NO: 4847371 - DNA, 14 bp, Homo sapiens
tcagcattgtaatt

SEQ ID NO: 4847372 - DNA, 17 bp, Homo sapiens
tcagcattgtaattatg

SEQ ID NO: 4847373 - DNA, 19 bp, Homo sapiens
tcagccaggcaagaaagct

SEQ ID NO: 4847374 - DNA, 19 bp, Homo sapiens
tcagccaggtctgactcca

SEQ ID NO: 4847375 - DNA, 21 bp, Homo sapiens
tcagccaggtctgactccaaa

SEQ ID NO: 4847376 - DNA, 17 bp, Homo sapiens
tcagcctgctttcctgc

SEQ ID NO: 4847377 - DNA, 12 bp, Homo sapiens
tcagcctggttt

SEQ ID NO: 4847378 - DNA, 21 bp, Homo sapiens
tcagctctctgggacctcctt

SEQ ID NO: 4847379 - DNA, 16 bp, Homo sapiens
tcagctgctgttgaac

SEQ ID NO: 4847380 - DNA, 23 bp, Homo sapiens
tcagctgctgttgaactttttaa

SEQ ID NO: 4847381 - DNA, 22 bp, Homo sapiens
tcagctgggtcacatccatccc

SEQ ID NO: 4847382 - DNA, 23 bp, Homo sapiens
tcagctgggtcacatccatccct

SEQ ID NO: 4847383 - DNA, 15 bp, Homo sapiens
tcagctgtgccttcc

SEQ ID NO: 4847384 - DNA, 22 bp, Homo sapiens
tcagctgtgccttccctttcta

SEQ ID NO: 4847385 - DNA, 15 bp, Homo sapiens
tcaggaaaaggttga

SEQ ID NO: 4847386 - DNA, 19 bp, Homo sapiens
tcaggaaaaggttgaataa

SEQ ID NO: 4847387 - DNA, 18 bp, Homo sapiens
tcaggaattcttggagaa

SEQ ID NO: 4847388 - DNA, 21 bp, Homo sapiens
tcaggactctctccaggaggg

SEQ ID NO: 4847389 - DNA, 17 bp, Homo sapiens
tcaggacttgaaagaaa

SEQ ID NO: 4847390 - DNA, 14 bp, Homo sapiens
tcaggagaagccag

SEQ ID NO: 4847391 - DNA, 15 bp, Homo sapiens
tcaggagaagccagt

SEQ ID NO: 4847392 - DNA, 15 bp, Homo sapiens
tcaggagatggggaa

SEQ ID NO: 4847393 - DNA, 22 bp, Homo sapiens
tcaggagcctggccaggcaggg

SEQ ID NO: 4847394 - DNA, 17 bp, Homo sapiens
tcaggattctgttcctt

SEQ ID NO: 4847395 - DNA, 17 bp, Homo sapiens
tcaggctgcagaggcac

SEQ ID NO: 4847396 - DNA, 17 bp, Homo sapiens
tcagggatggagggaag

SEQ ID NO: 4847397 - DNA, 14 bp, Homo sapiens
tcagtaagttatct

SEQ ID NO: 4847398 - DNA, 12 bp, Homo sapiens
tcagtccaggat

SEQ ID NO: 4847399 - DNA, 12 bp, Homo sapiens
tcagttctcaaa

SEQ ID NO: 4847400 - DNA, 18 bp, Homo sapiens
tcagttctctcccttcct

SEQ ID NO: 4847401 - DNA, 13 bp, Homo sapiens
tcagttgcttgtc

SEQ ID NO: 4847402 - DNA, 16 bp, Homo sapiens
tcagttgtgtttttta

SEQ ID NO: 4847403 - DNA, 14 bp, Homo sapiens
tcagtttgttggaa

SEQ ID NO: 4847404 - DNA, 15 bp, Homo sapiens
tcagtttgttggaaa

SEQ ID NO: 4847405 - DNA, 16 bp, Homo sapiens
tcagtttgttggaaag

SEQ ID NO: 4847406 - DNA, 14 bp, Homo sapiens
tcataggttaaaaa

SEQ ID NO: 4847407 - DNA, 15 bp, Homo sapiens
tcataggttaaaaaa

SEQ ID NO: 4847408 - DNA, 23 bp, Homo sapiens
tcataggttaaaaaaaaaagtca

SEQ ID NO: 4847409 - DNA, 18 bp, Homo sapiens
tcatagtaagtgcgaaga

SEQ ID NO: 4847410 - DNA, 22 bp, Homo sapiens
tcatagtaagtgcgaagactga

SEQ ID NO: 4847411 - DNA, 22 bp, Homo sapiens
tcatatggtaggaccctcgaga

SEQ ID NO: 4847412 - DNA, 14 bp, Homo sapiens
tcatattgtaatct

SEQ ID NO: 4847413 - DNA, 12 bp, Homo sapiens
tcatcactggac

SEQ ID NO: 4847414 - DNA, 13 bp, Homo sapiens
tcatcactggact

SEQ ID NO: 4847415 - DNA, 17 bp, Homo sapiens
tcatcactggactgcat

SEQ ID NO: 4847416 - DNA, 15 bp, Homo sapiens
tcatcattcttgtgg

SEQ ID NO: 4847417 - DNA, 13 bp, Homo sapiens
tcatccatcctga

SEQ ID NO: 4847418 - DNA, 18 bp, Homo sapiens
tcatccatcctgagccaa

SEQ ID NO: 4847419 - DNA, 13 bp, Homo sapiens
tcatctcttcctc

SEQ ID NO: 4847420 - DNA, 20 bp, Homo sapiens
tcatcttgcctcattttgct

SEQ ID NO: 4847421 - DNA, 15 bp, Homo sapiens
tcatgaatgctttta

SEQ ID NO: 4847422 - DNA, 14 bp, Homo sapiens
tcatgacagcctcc

SEQ ID NO: 4847423 - DNA, 15 bp, Homo sapiens
tcatgcctgatgaaa

SEQ ID NO: 4847424 - DNA, 13 bp, Homo sapiens
tcatgtaatttta

SEQ ID NO: 4847425 - DNA, 16 bp, Homo sapiens
tcatgtcttctcacaa

SEQ ID NO: 4847426 - DNA, 17 bp, Homo sapiens
tcatgtgagtctgggat

SEQ ID NO: 4847427 - DNA, 13 bp, Homo sapiens
tcatgtttggaaa

SEQ ID NO: 4847428 - DNA, 16 bp, Homo sapiens
tcattagtcctttgtc

SEQ ID NO: 4847429 - DNA, 14 bp, Homo sapiens
tcattagttttgaa

SEQ ID NO: 4847430 - DNA, 18 bp, Homo sapiens
tcattatgtcaaccaggt

SEQ ID NO: 4847431 - DNA, 19 bp, Homo sapiens
tcattctgaaccctccaaa

SEQ ID NO: 4847432 - DNA, 23 bp, Homo sapiens
tcattctgaaccctccaaaggaa

SEQ ID NO: 4847433 - DNA, 14 bp, Homo sapiens
tcattctgaattaa

SEQ ID NO: 4847434 - DNA, 15 bp, Homo sapiens
tcattcttactaaaa

SEQ ID NO: 4847435 - DNA, 21 bp, Homo sapiens
tcattcttgtgggagacagca

SEQ ID NO: 4847436 - DNA, 22 bp, Homo sapiens
tcattcttgtgggagacagcag

SEQ ID NO: 4847437 - DNA, 21 bp, Homo sapiens
tcattctttttgaaatgtcaa

SEQ ID NO: 4847438 - DNA, 19 bp, Homo sapiens
tcattggcattctttgcaa

SEQ ID NO: 4847439 - DNA, 21 bp, Homo sapiens
tcattgtttagatgaggctca

SEQ ID NO: 4847440 - DNA, 21 bp, Homo sapiens
tcatttctatattcctccagc

SEQ ID NO: 4847441 - DNA, 18 bp, Homo sapiens
tcattttgcttcccatct

SEQ ID NO: 4847442 - DNA, 21 bp, Homo sapiens
tccaaacagacaaaacagata

SEQ ID NO: 4847443 - DNA, 21 bp, Homo sapiens
tccaaatttttttttaaagca

SEQ ID NO: 4847444 - DNA, 15 bp, Homo sapiens
tccaagagggactcc

SEQ ID NO: 4847445 - DNA, 21 bp, Homo sapiens
tccaagcactagccttcccag

SEQ ID NO: 4847446 - DNA, 18 bp, Homo sapiens
tccaagccctggggcagg

SEQ ID NO: 4847447 - DNA, 13 bp, Homo sapiens
tccaagcctgcct

SEQ ID NO: 4847448 - DNA, 17 bp, Homo sapiens
tccaagcctgcctccca

SEQ ID NO: 4847449 - DNA, 20 bp, Homo sapiens
tccaagtctctgtgtaacca

SEQ ID NO: 4847450 - DNA, 14 bp, Homo sapiens
tccacagccttgca

SEQ ID NO: 4847451 - DNA, 17 bp, Homo sapiens
tccaccataccttagag

SEQ ID NO: 4847452 - DNA, 23 bp, Homo sapiens
tccacccacaaactccaggctgg

SEQ ID NO: 4847453 - DNA, 15 bp, Homo sapiens
tccacctcatcactg

SEQ ID NO: 4847454 - DNA, 24 bp, Homo sapiens
tccacctcatcactggactgcatg

SEQ ID NO: 4847455 - DNA, 13 bp, Homo sapiens
tccactcccagtg

SEQ ID NO: 4847456 - DNA, 22 bp, Homo sapiens
tccactggccggagtcagtgcc

SEQ ID NO: 4847457 - DNA, 19 bp, Homo sapiens
tccagaaccacacttgaaa

SEQ ID NO: 4847458 - DNA, 15 bp, Homo sapiens
tccagactcagcaga

SEQ ID NO: 4847459 - DNA, 17 bp, Homo sapiens
tccagactcagcagagt

SEQ ID NO: 4847460 - DNA, 19 bp, Homo sapiens
tccagagaaagcacaattt

SEQ ID NO: 4847461 - DNA, 21 bp, Homo sapiens
tccagcccaaacctgggaagg

SEQ ID NO: 4847462 - DNA, 14 bp, Homo sapiens
tccagccctgggca

SEQ ID NO: 4847463 - DNA, 15 bp, Homo sapiens
tccagccctgggcac

SEQ ID NO: 4847464 - DNA, 16 bp, Homo sapiens
tccagccctgggcaca

SEQ ID NO: 4847465 - DNA, 18 bp, Homo sapiens
tccagctgacagccacac

SEQ ID NO: 4847466 - DNA, 16 bp, Homo sapiens
tccagcttcggagggc

SEQ ID NO: 4847467 - DNA, 14 bp, Homo sapiens
tccaggagggctcg

SEQ ID NO: 4847468 - DNA, 11 bp, Homo sapiens
tccaggctgga

SEQ ID NO: 4847469 - DNA, 15 bp, Homo sapiens
tccagggaggggtcc

SEQ ID NO: 4847470 - DNA, 14 bp, Homo sapiens
tccagggcagcagg

SEQ ID NO: 4847471 - DNA, 17 bp, Homo sapiens
tccagggcagcaggcca

SEQ ID NO: 4847472 - DNA, 21 bp, Homo sapiens
tccagggcagcaggccagaga

SEQ ID NO: 4847473 - DNA, 22 bp, Homo sapiens
tccagggcagcaggccagagaa

SEQ ID NO: 4847474 - DNA, 21 bp, Homo sapiens
tccagtataagactactgaat

SEQ ID NO: 4847475 - DNA, 15 bp, Homo sapiens
tccagtcattatgtt

SEQ ID NO: 4847476 - DNA, 16 bp, Homo sapiens
tccagttataagaaga

SEQ ID NO: 4847477 - DNA, 21 bp, Homo sapiens
tccatcaggtgaggtgtgctc

SEQ ID NO: 4847478 - DNA, 13 bp, Homo sapiens
tccatcctgagcc

SEQ ID NO: 4847479 - DNA, 15 bp, Homo sapiens
tccatccttgagatt

SEQ ID NO: 4847480 - DNA, 22 bp, Homo sapiens
tccatcgtattaaaaaacaatt

SEQ ID NO: 4847481 - DNA, 12 bp, Homo sapiens
tccatggggagg

SEQ ID NO: 4847482 - DNA, 21 bp, Homo sapiens
tccatgtacttccctcttgaa

SEQ ID NO: 4847483 - DNA, 14 bp, Homo sapiens
tccattacaccaca

SEQ ID NO: 4847484 - DNA, 17 bp, Homo sapiens
tccattacctccatcca

SEQ ID NO: 4847485 - DNA, 21 bp, Homo sapiens
tccattacctccatccatcct

SEQ ID NO: 4847486 - DNA, 15 bp, Homo sapiens
tccatttcaggactc

SEQ ID NO: 4847487 - DNA, 21 bp, Homo sapiens
tccatttcaggactctctcca

SEQ ID NO: 4847488 - DNA, 17 bp, Homo sapiens
tccattttaattttaaa

SEQ ID NO: 4847489 - DNA, 22 bp, Homo sapiens
tcccaaggcattctcccagctc

SEQ ID NO: 4847490 - DNA, 20 bp, Homo sapiens
tcccaagggtgccctttggg

SEQ ID NO: 4847491 - DNA, 22 bp, Homo sapiens
tcccacaactactagtgtgact

SEQ ID NO: 4847492 - DNA, 20 bp, Homo sapiens
tcccacagcagccccaggag

SEQ ID NO: 4847493 - DNA, 23 bp, Homo sapiens
tcccacagcagccccaggagaag

SEQ ID NO: 4847494 - DNA, 18 bp, Homo sapiens
tcccacctgaatttgtat

SEQ ID NO: 4847495 - DNA, 21 bp, Homo sapiens
tcccacgcctcaccagccccc

SEQ ID NO: 4847496 - DNA, 18 bp, Homo sapiens
tcccactccagctgacag

SEQ ID NO: 4847497 - DNA, 11 bp, Homo sapiens
tcccagaacct

SEQ ID NO: 4847498 - DNA, 12 bp, Homo sapiens
tcccagaacctc

SEQ ID NO: 4847499 - DNA, 14 bp, Homo sapiens
tcccagaacctcta

SEQ ID NO: 4847500 - DNA, 16 bp, Homo sapiens
tcccagaaccttgatg

SEQ ID NO: 4847501 - DNA, 22 bp, Homo sapiens
tcccagaggtgggatcctccct

SEQ ID NO: 4847502 - DNA, 16 bp, Homo sapiens
tcccagctctagcctc

SEQ ID NO: 4847503 - DNA, 13 bp, Homo sapiens
tcccagcttcccg

SEQ ID NO: 4847504 - DNA, 19 bp, Homo sapiens
tcccaggggagccagctgc

SEQ ID NO: 4847505 - DNA, 20 bp, Homo sapiens
tcccatggctgaagctggag

SEQ ID NO: 4847506 - DNA, 23 bp, Homo sapiens
tcccatggctgaagctggagcag

SEQ ID NO: 4847507 - DNA, 19 bp, Homo sapiens
tctaagtagggccagggca

SEQ ID NO: 4847508 - DNA, 14 bp, Homo sapiens
tctaagtgctgctg

SEQ ID NO: 4847509 - DNA, 13 bp, Homo sapiens
tctacagtgtcct

SEQ ID NO: 4847510 - DNA, 17 bp, Homo sapiens
tctactagattgtgatc

SEQ ID NO: 4847511 - DNA, 12 bp, Homo sapiens
tctaggccctgt

SEQ ID NO: 4847512 - DNA, 15 bp, Homo sapiens
tctaggccctgtgag

SEQ ID NO: 4847513 - DNA, 21 bp, Homo sapiens
tctagggcctcagtctggagt

SEQ ID NO: 4847514 - DNA, 16 bp, Homo sapiens
tctaggtctcctcagg

SEQ ID NO: 4847515 - DNA, 17 bp, Homo sapiens
tctaggtctcctcaggg

SEQ ID NO: 4847516 - DNA, 18 bp, Homo sapiens
tctaggtctcctcagggt

SEQ ID NO: 4847517 - DNA, 17 bp, Homo sapiens
tctagtacctgtgactc

SEQ ID NO: 4847518 - DNA, 22 bp, Homo sapiens
tctagtatttatgggtggattt

SEQ ID NO: 4847519 - DNA, 22 bp, Homo sapiens
tctagttgcccccattcccagc

SEQ ID NO: 4847520 - DNA, 12 bp, Homo sapiens
tctatactgtgg

SEQ ID NO: 4847521 - DNA, 17 bp, Homo sapiens
tctatactgtggcctgc

SEQ ID NO: 4847522 - DNA, 17 bp, Homo sapiens
tctatattcctccagct

SEQ ID NO: 4847523 - DNA, 19 bp, Homo sapiens
tctatattcctccagctgg

SEQ ID NO: 4847524 - DNA, 13 bp, Homo sapiens
tctatgaacctga

SEQ ID NO: 4847525 - DNA, 14 bp, Homo sapiens
tctatgttaatatt

SEQ ID NO: 4847526 - DNA, 16 bp, Homo sapiens
tctatgttaatatttt

SEQ ID NO: 4847527 - DNA, 21 bp, Homo sapiens
tctattctccagacatggagg

SEQ ID NO: 4847528 - DNA, 17 bp, Homo sapiens
tctattgtttgttgcac

SEQ ID NO: 4847529 - DNA, 14 bp, Homo sapiens
tctcaaacctggca

SEQ ID NO: 4847530 - DNA, 20 bp, Homo sapiens
tctcaaataggctattaaaa

SEQ ID NO: 4847531 - DNA, 19 bp, Homo sapiens
tctcacccccatccctggg

SEQ ID NO: 4847532 - DNA, 16 bp, Homo sapiens
tctcaccctctgtcct

SEQ ID NO: 4847533 - DNA, 14 bp, Homo sapiens
tctcagctgtgcct

SEQ ID NO: 4847534 - DNA, 20 bp, Homo sapiens
tctcaggtttgttttgtgaa

SEQ ID NO: 4847535 - DNA, 18 bp, Homo sapiens
tctcagtccagcagtttc

SEQ ID NO: 4847536 - DNA, 18 bp, Homo sapiens
tctcagtggtgtgtgaag

SEQ ID NO: 4847537 - DNA, 16 bp, Homo sapiens
tctcagttctctccct

SEQ ID NO: 4847538 - DNA, 16 bp, Homo sapiens
tctcataggttaaaaa

SEQ ID NO: 4847539 - DNA, 13 bp, Homo sapiens
tctccactggacc

SEQ ID NO: 4847540 - DNA, 11 bp, Homo sapiens
tctccagacat

SEQ ID NO: 4847541 - DNA, 16 bp, Homo sapiens
tctccatggagcctac

SEQ ID NO: 4847542 - DNA, 17 bp, Homo sapiens
tctccattttcaagctg

SEQ ID NO: 4847543 - DNA, 14 bp, Homo sapiens
tctcccagctctag

SEQ ID NO: 4847544 - DNA, 13 bp, Homo sapiens
tctcccctcctgc

SEQ ID NO: 4847545 - DNA, 15 bp, Homo sapiens
tctccctagctcctc

SEQ ID NO: 4847546 - DNA, 20 bp, Homo sapiens
tctccctagctcctcccctt

SEQ ID NO: 4847547 - DNA, 17 bp, Homo sapiens
tctcccttcctctctcc

SEQ ID NO: 4847548 - DNA, 12 bp, Homo sapiens
tctcctcagggt

SEQ ID NO: 4847549 - DNA, 18 bp, Homo sapiens
tctcctcccgccccgccc

SEQ ID NO: 4847550 - DNA, 13 bp, Homo sapiens
tctcctccctcag

SEQ ID NO: 4847551 - DNA, 20 bp, Homo sapiens
tctccttatagacacttgct

SEQ ID NO: 4847552 - DNA, 21 bp, Homo sapiens
tctccttcatgacagcctcca

SEQ ID NO: 4847553 - DNA, 16 bp, Homo sapiens
tctccttgagtgtatg

SEQ ID NO: 4847554 - DNA, 17 bp, Homo sapiens
tctctaaggtttacaat

SEQ ID NO: 4847555 - DNA, 20 bp, Homo sapiens
tctctcccttcctctctcct

SEQ ID NO: 4847556 - DNA, 14 bp, Homo sapiens
tctctctctaaggt

SEQ ID NO: 4847557 - DNA, 19 bp, Homo sapiens
tctctctttcctccaccca

SEQ ID NO: 4847558 - DNA, 20 bp, Homo sapiens
tctctggaagagggaggggc

SEQ ID NO: 4847559 - DNA, 17 bp, Homo sapiens
tctctgggacctcctta

SEQ ID NO: 4847560 - DNA, 15 bp, Homo sapiens
tctcttcggtggcct

SEQ ID NO: 4847561 - DNA, 16 bp, Homo sapiens
tctcttggctttgtca

SEQ ID NO: 4847562 - DNA, 18 bp, Homo sapiens
tctctttccaccatacct

SEQ ID NO: 4847563 - DNA, 15 bp, Homo sapiens
tctgaaaagtgtgta

SEQ ID NO: 4847564 - DNA, 18 bp, Homo sapiens
tctgaaaggccagcagct

SEQ ID NO: 4847565 - DNA, 24 bp, Homo sapiens
tctgaccccaagggggctgctgct

SEQ ID NO: 4847566 - DNA, 23 bp, Homo sapiens
tctgacccttacagcctctgact

SEQ ID NO: 4847567 - DNA, 16 bp, Homo sapiens
tctgacctcttggcca

SEQ ID NO: 4847568 - DNA, 20 bp, Homo sapiens
tctgacttaagctgcctcaa

SEQ ID NO: 4847569 - DNA, 17 bp, Homo sapiens
tctgaggccagaaaggt

SEQ ID NO: 4847570 - DNA, 20 bp, Homo sapiens
tctgaggccagaaaggtgtg

SEQ ID NO: 4847571 - DNA, 19 bp, Homo sapiens
tctgagggaaaccagagtc

SEQ ID NO: 4847572 - DNA, 22 bp, Homo sapiens
tctgattgatttgattgggatg

SEQ ID NO: 4847573 - DNA, 17 bp, Homo sapiens
tctgcaacaagcatgca

SEQ ID NO: 4847574 - DNA, 14 bp, Homo sapiens
tctgcacccgcctc

SEQ ID NO: 4847575 - DNA, 15 bp, Homo sapiens
tctgccaatctgtac

SEQ ID NO: 4847576 - DNA, 18 bp, Homo sapiens
tctgccaatctgtacaaa

SEQ ID NO: 4847577 - DNA, 22 bp, Homo sapiens
tctgccagttacttgggcttca

SEQ ID NO: 4847578 - DNA, 9 bp, Homo sapiens
tctgcctgg

SEQ ID NO: 4847579 - DNA, 19 bp, Homo sapiens
tctgctccatcggggcagg

SEQ ID NO: 4847580 - DNA, 13 bp, Homo sapiens
tctgctcctcttg

SEQ ID NO: 4847581 - DNA, 15 bp, Homo sapiens
tctgctctatactgt

SEQ ID NO: 4847582 - DNA, 16 bp, Homo sapiens
tctgctctatactgtg

SEQ ID NO: 4847583 - DNA, 20 bp, Homo sapiens
tctgctctatactgtggcct

SEQ ID NO: 4847584 - DNA, 15 bp, Homo sapiens
tctgctctgcctgga

SEQ ID NO: 4847585 - DNA, 16 bp, Homo sapiens
tctgctctgcctggag

SEQ ID NO: 4847586 - DNA, 18 bp, Homo sapiens
tctgctctgcctggagtg

SEQ ID NO: 4847587 - DNA, 18 bp, Homo sapiens
tctgcttgatatcccaag

SEQ ID NO: 4847588 - DNA, 19 bp, Homo sapiens
tctggactggaaagcacaa

SEQ ID NO: 4847589 - DNA, 23 bp, Homo sapiens
tctggactggaaagcacaagact

SEQ ID NO: 4847590 - DNA, 15 bp, Homo sapiens
tctggattcatattt

SEQ ID NO: 4847591 - DNA, 19 bp, Homo sapiens
tctggattcatatttaatt

SEQ ID NO: 4847592 - DNA, 22 bp, Homo sapiens
tctggcttcaaaaagccacagc

SEQ ID NO: 4847593 - DNA, 14 bp, Homo sapiens
tctgggacccacag

SEQ ID NO: 4847594 - DNA, 16 bp, Homo sapiens
tctgggacccacagaa

SEQ ID NO: 4847595 - DNA, 18 bp, Homo sapiens
tctgggtgctagatccag

SEQ ID NO: 4847596 - DNA, 14 bp, Homo sapiens
tctggttgctaatg

SEQ ID NO: 4847597 - DNA, 13 bp, Homo sapiens
tctgtaataatag

SEQ ID NO: 4847598 - DNA, 22 bp, Homo sapiens
tctgtactaaacagtaagatat

SEQ ID NO: 4847599 - DNA, 14 bp, Homo sapiens
tctgtagagccaat

SEQ ID NO: 4847600 - DNA, 15 bp, Homo sapiens
tctgtatttttctaa

SEQ ID NO: 4847601 - DNA, 20 bp, Homo sapiens
tctgtccgtgccccttccct

SEQ ID NO: 4847602 - DNA, 23 bp, Homo sapiens
tctgtccgtgccccttccctggg

SEQ ID NO: 4847603 - DNA, 15 bp, Homo sapiens
tctgtccttccccca

SEQ ID NO: 4847604 - DNA, 18 bp, Homo sapiens
tctgtccttcccccagca

SEQ ID NO: 4847605 - DNA, 22 bp, Homo sapiens
tctgtctcttggctttgtcact

SEQ ID NO: 4847606 - DNA, 19 bp, Homo sapiens
tctgtctgagacaggtgcc

SEQ ID NO: 4847607 - DNA, 21 bp, Homo sapiens
tctgtgcttcgactactgctc

SEQ ID NO: 4847608 - DNA, 22 bp, Homo sapiens
tctgtgtaaccagctcagtgtt

SEQ ID NO: 4847609 - DNA, 18 bp, Homo sapiens
tctgtgttttgaaagaat

SEQ ID NO: 4847610 - DNA, 14 bp, Homo sapiens
tctgttagcagagt

SEQ ID NO: 4847611 - DNA, 19 bp, Homo sapiens
tcttaaagaaaacccaccc

SEQ ID NO: 4847612 - DNA, 21 bp, Homo sapiens
tcttacaatattgattgggaa

SEQ ID NO: 4847613 - DNA, 11 bp, Homo sapiens
tcttagcatgg

SEQ ID NO: 4847614 - DNA, 20 bp, Homo sapiens
tcttagctgaggctgagaaa

SEQ ID NO: 4847615 - DNA, 14 bp, Homo sapiens
tcttatgtgtgcct

SEQ ID NO: 4847616 - DNA, 17 bp, Homo sapiens
tcttcaaagccttctcc

SEQ ID NO: 4847617 - DNA, 14 bp, Homo sapiens
tcttcactctggct

SEQ ID NO: 4847618 - DNA, 15 bp, Homo sapiens
tcttcactctggctt

SEQ ID NO: 4847619 - DNA, 18 bp, Homo sapiens
tcttcatgcctgatgaaa

SEQ ID NO: 4847620 - DNA, 14 bp, Homo sapiens
tcttccacccacaa

SEQ ID NO: 4847621 - DNA, 21 bp, Homo sapiens
tcttccacccacaaactccag

SEQ ID NO: 4847622 - DNA, 23 bp, Homo sapiens
tcttccacccacaaactccaggc

SEQ ID NO: 4847623 - DNA, 15 bp, Homo sapiens
tcttcccactccagc

SEQ ID NO: 4847624 - DNA, 16 bp, Homo sapiens
tcttcggtggccttga

SEQ ID NO: 4847625 - DNA, 16 bp, Homo sapiens
tcttctttctccatgg

SEQ ID NO: 4847626 - DNA, 22 bp, Homo sapiens
tcttgcctcattttgcttccca

SEQ ID NO: 4847627 - DNA, 17 bp, Homo sapiens
tcttgggatacagatct

SEQ ID NO: 4847628 - DNA, 22 bp, Homo sapiens
tcttgtgtttccacagcctgca

SEQ ID NO: 4847629 - DNA, 12 bp, Homo sapiens
tcttgttcctga

SEQ ID NO: 4847630 - DNA, 18 bp, Homo sapiens
tcttgttgctgtacaaaa

SEQ ID NO: 4847631 - DNA, 13 bp, Homo sapiens
tcttgttttgaaa

SEQ ID NO: 4847632 - DNA, 20 bp, Homo sapiens
tctttagcttacctgggcac

SEQ ID NO: 4847633 - DNA, 23 bp, Homo sapiens
tctttagtttttggttgggaatg

SEQ ID NO: 4847634 - DNA, 14 bp, Homo sapiens
tctttatatttcaa

SEQ ID NO: 4847635 - DNA, 15 bp, Homo sapiens
tctttatatttcaat

SEQ ID NO: 4847636 - DNA, 18 bp, Homo sapiens
tctttcagaaatataaca

SEQ ID NO: 4847637 - DNA, 10 bp, Homo sapiens
tctttcatgg

SEQ ID NO: 4847638 - DNA, 21 bp, Homo sapiens
tctttccaccataccttagag

SEQ ID NO: 4847639 - DNA, 22 bp, Homo sapiens
tctttccaccataccttagaga

SEQ ID NO: 4847640 - DNA, 14 bp, Homo sapiens
tctttcctccaccc

SEQ ID NO: 4847641 - DNA, 15 bp, Homo sapiens
tctttcctccaccca

SEQ ID NO: 4847642 - DNA, 19 bp, Homo sapiens
tctttctagttcagctgcc

SEQ ID NO: 4847643 - DNA, 22 bp, Homo sapiens
tctttctagttcagctgcccca

SEQ ID NO: 4847644 - DNA, 14 bp, Homo sapiens
tctttcttcactct

SEQ ID NO: 4847645 - DNA, 15 bp, Homo sapiens
tctttcttcactctg

SEQ ID NO: 4847646 - DNA, 16 bp, Homo sapiens
tctttgagtaatgtga

SEQ ID NO: 4847647 - DNA, 15 bp, Homo sapiens
tctttgcaatactgc

SEQ ID NO: 4847648 - DNA, 14 bp, Homo sapiens
tctttgccttctct

SEQ ID NO: 4847649 - DNA, 20 bp, Homo sapiens
tctttgctcaacagaacata

SEQ ID NO: 4847650 - DNA, 22 bp, Homo sapiens
tctttgggcctctcctgccctc

SEQ ID NO: 4847651 - DNA, 14 bp, Homo sapiens
tctttgtaccaaaa

SEQ ID NO: 4847652 - DNA, 23 bp, Homo sapiens
tctttgtaccaaaattttaaaaa

SEQ ID NO: 4847653 - DNA, 18 bp, Homo sapiens
tcttttaaagaccctcct

SEQ ID NO: 4847654 - DNA, 16 bp, Homo sapiens
tcttttgtttggtaaa

SEQ ID NO: 4847655 - DNA, 20 bp, Homo sapiens
tctttttaaaaattgttatt

SEQ ID NO: 4847656 - DNA, 18 bp, Homo sapiens
tcttttttagtgttaaag

SEQ ID NO: 4847657 - DNA, 16 bp, Homo sapiens
tgaaaaaaaacagtgg

SEQ ID NO: 4847658 - DNA, 19 bp, Homo sapiens
tgaaaagggtcagaaggat

SEQ ID NO: 4847659 - DNA, 15 bp, Homo sapiens
tgaaaagtttttgtt

SEQ ID NO: 4847660 - DNA, 16 bp, Homo sapiens
tgaaaataactgaatt

SEQ ID NO: 4847661 - DNA, 11 bp, Homo sapiens
tgaaaatggaa

SEQ ID NO: 4847662 - DNA, 13 bp, Homo sapiens
tgaaaattgaaaa

SEQ ID NO: 4847663 - DNA, 17 bp, Homo sapiens
tgaaaattgaaaagtac

SEQ ID NO: 4847664 - DNA, 15 bp, Homo sapiens
tgaaacttctcagtc

SEQ ID NO: 4847665 - DNA, 20 bp, Homo sapiens
tgaaagaatagaacacagtt

SEQ ID NO: 4847666 - DNA, 21 bp, Homo sapiens
tgaaagaggtaaaattctcta

SEQ ID NO: 4847667 - DNA, 23 bp, Homo sapiens
tgaaataatgggattagaaacaa

SEQ ID NO: 4847668 - DNA, 14 bp, Homo sapiens
tgaaatccttgaga

SEQ ID NO: 4847669 - DNA, 18 bp, Homo sapiens
tgaaatcttcccatgcat

SEQ ID NO: 4847670 - DNA, 13 bp, Homo sapiens
tgaaatgaacttt

SEQ ID NO: 4847671 - DNA, 15 bp, Homo sapiens
tgaaatgaactttgt

SEQ ID NO: 4847672 - DNA, 17 bp, Homo sapiens
tgaaatgaactttgtca

SEQ ID NO: 4847673 - DNA, 20 bp, Homo sapiens
tgaaatggcctgtccctagg

SEQ ID NO: 4847674 - DNA, 16 bp, Homo sapiens
tgaaattcaccaagaa

SEQ ID NO: 4847675 - DNA, 17 bp, Homo sapiens
tgaacaagcttcagtaa

SEQ ID NO: 4847676 - DNA, 15 bp, Homo sapiens
tgaacacatgtgtat

SEQ ID NO: 4847677 - DNA, 13 bp, Homo sapiens
tgaacactgtgac

SEQ ID NO: 4847678 - DNA, 15 bp, Homo sapiens
tgaacataacttctc

SEQ ID NO: 4847679 - DNA, 21 bp, Homo sapiens
tgaacataacttctcatgtat

SEQ ID NO: 4847680 - DNA, 20 bp, Homo sapiens
tgaacatgtttaatgggtat

SEQ ID NO: 4847681 - DNA, 16 bp, Homo sapiens
tgaaccataaattcaa

SEQ ID NO: 4847682 - DNA, 22 bp, Homo sapiens
tgaaccataaattcaactttgt

SEQ ID NO: 4847683 - DNA, 21 bp, Homo sapiens
tgaacctgaaaagggtcagaa

SEQ ID NO: 4847684 - DNA, 23 bp, Homo sapiens
tgaacctgaaaagggtcagaagg

SEQ ID NO: 4847685 - DNA, 16 bp, Homo sapiens
tgaactctgttccccc

SEQ ID NO: 4847686 - DNA, 21 bp, Homo sapiens
tgaactctgttcccccaccct

SEQ ID NO: 4847687 - DNA, 15 bp, Homo sapiens
tgaagaagatgagcc

SEQ ID NO: 4847688 - DNA, 21 bp, Homo sapiens
tgaagagggacataagataaa

SEQ ID NO: 4847689 - DNA, 21 bp, Homo sapiens
tgaagattctatgttaatatt

SEQ ID NO: 4847690 - DNA, 13 bp, Homo sapiens
tgaagcagaacct

SEQ ID NO: 4847691 - DNA, 15 bp, Homo sapiens
tgaagcagaaccttc

SEQ ID NO: 4847692 - DNA, 19 bp, Homo sapiens
tgaagcagaaccttctttg

SEQ ID NO: 4847693 - DNA, 17 bp, Homo sapiens
tgaagcatagataatat

SEQ ID NO: 4847694 - DNA, 17 bp, Homo sapiens
tgaaggagaatggcatg

SEQ ID NO: 4847695 - DNA, 13 bp, Homo sapiens
tgaaggggctggt

SEQ ID NO: 4847696 - DNA, 18 bp, Homo sapiens
tgaaggtagaatgttttc

SEQ ID NO: 4847697 - DNA, 19 bp, Homo sapiens
tgaaggtagaatgttttca

SEQ ID NO: 4847698 - DNA, 19 bp, Homo sapiens
tgaaggtgataagggaaaa

SEQ ID NO: 4847699 - DNA, 17 bp, Homo sapiens
tgaagtctgagggaaac

SEQ ID NO: 4847700 - DNA, 15 bp, Homo sapiens
tgaagttagtggaaa

SEQ ID NO: 4847701 - DNA, 21 bp, Homo sapiens
tgaagttagtggaaatctgaa

SEQ ID NO: 4847702 - DNA, 13 bp, Homo sapiens
tgaagtttcaagt

SEQ ID NO: 4847703 - DNA, 13 bp, Homo sapiens
tgaataaatgtct

SEQ ID NO: 4847704 - DNA, 12 bp, Homo sapiens
tgaatatatgat

SEQ ID NO: 4847705 - DNA, 16 bp, Homo sapiens
tgaatgaagcagtatt

SEQ ID NO: 4847706 - DNA, 14 bp, Homo sapiens
tgaatgcttttagt

SEQ ID NO: 4847707 - DNA, 23 bp, Homo sapiens
tgaatgcttttagtgtgtgcata

SEQ ID NO: 4847708 - DNA, 21 bp, Homo sapiens
tgaatgggatattttgaaatg

SEQ ID NO: 4847709 - DNA, 12 bp, Homo sapiens
tgaatgtgctgg

SEQ ID NO: 4847710 - DNA, 17 bp, Homo sapiens
tgaatgtgctggtgaac

SEQ ID NO: 4847711 - DNA, 16 bp, Homo sapiens
tgaatgtgtgagaaaa

SEQ ID NO: 4847712 - DNA, 17 bp, Homo sapiens
tgaatgtgtgagaaaaa

SEQ ID NO: 4847713 - DNA, 18 bp, Homo sapiens
tgaatgtgtgagaaaaac

SEQ ID NO: 4847714 - DNA, 16 bp, Homo sapiens
tgaattaatatcccta

SEQ ID NO: 4847715 - DNA, 23 bp, Homo sapiens
tgaattaatatccctacatgtat

SEQ ID NO: 4847716 - DNA, 19 bp, Homo sapiens
tgaattaattaatttggag

SEQ ID NO: 4847717 - DNA, 17 bp, Homo sapiens
tgaattatcagcaaaga

SEQ ID NO: 4847718 - DNA, 18 bp, Homo sapiens
tgaattatcagcaaagaa

SEQ ID NO: 4847719 - DNA, 17 bp, Homo sapiens
tgaatttgccagaggac

SEQ ID NO: 4847720 - DNA, 15 bp, Homo sapiens
tgaatttgtatatga

SEQ ID NO: 4847721 - DNA, 22 bp, Homo sapiens
tgaattttctaaaagctttcat

SEQ ID NO: 4847722 - DNA, 16 bp, Homo sapiens
tgacaaagcctctgaa

SEQ ID NO: 4847723 - DNA, 17 bp, Homo sapiens
tgacaaccattaaagtc

SEQ ID NO: 4847724 - DNA, 21 bp, Homo sapiens
tgacaagagttggggacagaa

SEQ ID NO: 4847725 - DNA, 19 bp, Homo sapiens
tgacaagctgtatcactgc

SEQ ID NO: 4847726 - DNA, 24 bp, Homo sapiens
tgacaatattccagatctttcaga

SEQ ID NO: 4847727 - DNA, 12 bp, Homo sapiens
tgacaatcaaag

SEQ ID NO: 4847728 - DNA, 22 bp, Homo sapiens
tgacagccacaccgtggcagct

SEQ ID NO: 4847729 - DNA, 16 bp, Homo sapiens
tgacagtgccttctct

SEQ ID NO: 4847730 - DNA, 17 bp, Homo sapiens
tgacagttcccagagtg

SEQ ID NO: 4847731 - DNA, 17 bp, Homo sapiens
tgacatcctttctttta

SEQ ID NO: 4847732 - DNA, 21 bp, Homo sapiens
tgacatcctttcttttaatga

SEQ ID NO: 4847733 - DNA, 16 bp, Homo sapiens
tgacatggaaatgaag

SEQ ID NO: 4847734 - DNA, 22 bp, Homo sapiens
tgacatttcttctagtgatgat

SEQ ID NO: 4847735 - DNA, 22 bp, Homo sapiens
tgacatttgggagacatgtgac

SEQ ID NO: 4847736 - DNA, 15 bp, Homo sapiens
tgaccactctgtctt

SEQ ID NO: 4847737 - DNA, 16 bp, Homo sapiens
tgaccagtctgaccct

SEQ ID NO: 4847738 - DNA, 12 bp, Homo sapiens
tgaccatttttt

SEQ ID NO: 4847739 - DNA, 20 bp, Homo sapiens
tgacccttacagcctctgac

SEQ ID NO: 4847740 - DNA, 12 bp, Homo sapiens
tgacctccagaa

SEQ ID NO: 4847741 - DNA, 19 bp, Homo sapiens
tgacctcttctctcctccc

SEQ ID NO: 4847742 - DNA, 21 bp, Homo sapiens
tgacctgaccccattcctgat

SEQ ID NO: 4847743 - DNA, 14 bp, Homo sapiens
tgacgatgatgtac

SEQ ID NO: 4847744 - DNA, 17 bp, Homo sapiens
tgactagaactcctgtc

SEQ ID NO: 4847745 - DNA, 22 bp, Homo sapiens
tgactagaactcctgtcttctt

SEQ ID NO: 4847746 - DNA, 14 bp, Homo sapiens
tgactcaaagtctg

SEQ ID NO: 4847747 - DNA, 23 bp, Homo sapiens
aaatgtggtctgccaatctgtac

SEQ ID NO: 4847748 - DNA, 14 bp, Homo sapiens
aaatgttaaaagtt

SEQ ID NO: 4847749 - DNA, 17 bp, Homo sapiens
aaattaagcaaatgtta

SEQ ID NO: 4847750 - DNA, 21 bp, Homo sapiens
aaattatgtgaccataatgta

SEQ ID NO: 4847751 - DNA, 14 bp, Homo sapiens
aaattcaaagcatg

SEQ ID NO: 4847752 - DNA, 20 bp, Homo sapiens
aaattcaactttgtaaaaat

SEQ ID NO: 4847753 - DNA, 23 bp, Homo sapiens
aaattgcatactttgtattttga

SEQ ID NO: 4847754 - DNA, 16 bp, Homo sapiens
aaattgttatcaaaat

SEQ ID NO: 4847755 - DNA, 16 bp, Homo sapiens
aaatttaaaaaataaa

SEQ ID NO: 4847756 - DNA, 18 bp, Homo sapiens
aaatttcactactagatt

SEQ ID NO: 4847757 - DNA, 12 bp, Homo sapiens
aaatttcttttg

SEQ ID NO: 4847758 - DNA, 15 bp, Homo sapiens
aaattttaactaaat

SEQ ID NO: 4847759 - DNA, 21 bp, Homo sapiens
aaattttacaagggcataaag

SEQ ID NO: 4847760 - DNA, 20 bp, Homo sapiens
aaattttcatgaatgtgctg

SEQ ID NO: 4847761 - DNA, 13 bp, Homo sapiens
aaattttttggca

SEQ ID NO: 4847762 - DNA, 20 bp, Homo sapiens
aacaaataatttgaactttg

SEQ ID NO: 4847763 - DNA, 17 bp, Homo sapiens
aacaacatttatatgta

SEQ ID NO: 4847764 - DNA, 12 bp, Homo sapiens
aacaagcttcag

SEQ ID NO: 4847765 - DNA, 18 bp, Homo sapiens
aacaatggtgtggtgaat

SEQ ID NO: 4847766 - DNA, 21 bp, Homo sapiens
aacaatggtgtggtgaatgtg

SEQ ID NO: 4847767 - DNA, 13 bp, Homo sapiens
aacaattaactgc

SEQ ID NO: 4847768 - DNA, 21 bp, Homo sapiens
aacaattaactgccctctgaa

SEQ ID NO: 4847769 - DNA, 17 bp, Homo sapiens
aacacaaacccccactc

SEQ ID NO: 4847770 - DNA, 16 bp, Homo sapiens
aacactatttgtgact

SEQ ID NO: 4847771 - DNA, 18 bp, Homo sapiens
aacactatttgtgacttt

SEQ ID NO: 4847772 - DNA, 22 bp, Homo sapiens
aacactatttgtgactttttaa

SEQ ID NO: 4847773 - DNA, 18 bp, Homo sapiens
aacagaattttccattta

SEQ ID NO: 4847774 - DNA, 17 bp, Homo sapiens
aacagacacaatttata

SEQ ID NO: 4847775 - DNA, 16 bp, Homo sapiens
aacagccaagctggca

SEQ ID NO: 4847776 - DNA, 21 bp, Homo sapiens
aacagtatgtgggatattgaa

SEQ ID NO: 4847777 - DNA, 13 bp, Homo sapiens
aacagtgtttaaa

SEQ ID NO: 4847778 - DNA, 21 bp, Homo sapiens
aacataacttctcatgtatat

SEQ ID NO: 4847779 - DNA, 18 bp, Homo sapiens
aacatatatttattgagt

SEQ ID NO: 4847780 - DNA, 18 bp, Homo sapiens
aacatctccatggggagg

SEQ ID NO: 4847781 - DNA, 18 bp, Homo sapiens
aacatctttattgaaatt

SEQ ID NO: 4847782 - DNA, 19 bp, Homo sapiens
aacatctttattgaaattc

SEQ ID NO: 4847783 - DNA, 15 bp, Homo sapiens
aacatgggctgtgat

SEQ ID NO: 4847784 - DNA, 17 bp, Homo sapiens
aacatgggctgtgatta

SEQ ID NO: 4847785 - DNA, 21 bp, Homo sapiens
aacatgggctgtgattactgc

SEQ ID NO: 4847786 - DNA, 13 bp, Homo sapiens
aacatgtttaatg

SEQ ID NO: 4847787 - DNA, 17 bp, Homo sapiens
aacatgtttctctataa

SEQ ID NO: 4847788 - DNA, 14 bp, Homo sapiens
aaccacattgaaga

SEQ ID NO: 4847789 - DNA, 16 bp, Homo sapiens
aaccacattgaagaat

SEQ ID NO: 4847790 - DNA, 16 bp, Homo sapiens
aaccacctatttttga

SEQ ID NO: 4847791 - DNA, 15 bp, Homo sapiens
aaccagctcagtgtt

SEQ ID NO: 4847792 - DNA, 19 bp, Homo sapiens
aaccagctcagtgttttgg

SEQ ID NO: 4847793 - DNA, 13 bp, Homo sapiens
aaccattaaagtc

SEQ ID NO: 4847794 - DNA, 15 bp, Homo sapiens
aaccattaaagtcag

SEQ ID NO: 4847795 - DNA, 18 bp, Homo sapiens
aaccatttttgaacctta

SEQ ID NO: 4847796 - DNA, 15 bp, Homo sapiens
aacccagagatgcct

SEQ ID NO: 4847797 - DNA, 15 bp, Homo sapiens
aacctcaggctccta

SEQ ID NO: 4847798 - DNA, 11 bp, Homo sapiens
aacctccagac

SEQ ID NO: 4847799 - DNA, 20 bp, Homo sapiens
aacctctaagtgctgctgtg

SEQ ID NO: 4847800 - DNA, 22 bp, Homo sapiens
aacctctttgcgtttccttttt

SEQ ID NO: 4847801 - DNA, 15 bp, Homo sapiens
aacctggcagatggg

SEQ ID NO: 4847802 - DNA, 17 bp, Homo sapiens
aacctgggaaggccagc

SEQ ID NO: 4847803 - DNA, 23 bp, Homo sapiens
aacctgggaaggccagccttgta

SEQ ID NO: 4847804 - DNA, 16 bp, Homo sapiens
aacctgggacctgtgg

SEQ ID NO: 4847805 - DNA, 13 bp, Homo sapiens
aaccttaagatac

SEQ ID NO: 4847806 - DNA, 22 bp, Homo sapiens
aaccttgtttaatagatttggg

SEQ ID NO: 4847807 - DNA, 14 bp, Homo sapiens
aacgaaaacctgac

SEQ ID NO: 4847808 - DNA, 16 bp, Homo sapiens
aacgaaaatgaaagct

SEQ ID NO: 4847809 - DNA, 15 bp, Homo sapiens
aacgtggctctgctg

SEQ ID NO: 4847810 - DNA, 17 bp, Homo sapiens
aacgtggctctgctggc

SEQ ID NO: 4847811 - DNA, 22 bp, Homo sapiens
aactaaatttcactactagatt

SEQ ID NO: 4847812 - DNA, 18 bp, Homo sapiens
aactaaattttaaagcca

SEQ ID NO: 4847813 - DNA, 18 bp, Homo sapiens
aactactagtgtgactcc

SEQ ID NO: 4847814 - DNA, 21 bp, Homo sapiens
aactactgaatgaagcagtat

SEQ ID NO: 4847815 - DNA, 15 bp, Homo sapiens
aactagcattgtaaa

SEQ ID NO: 4847816 - DNA, 23 bp, Homo sapiens
aactatagcttgcagaactgtag

SEQ ID NO: 4847817 - DNA, 23 bp, Homo sapiens
aactatcttctttggacttctga

SEQ ID NO: 4847818 - DNA, 22 bp, Homo sapiens
aactcaaggataccttcttatt

SEQ ID NO: 4847819 - DNA, 23 bp, Homo sapiens
aactcaaggataccttcttattt

SEQ ID NO: 4847820 - DNA, 17 bp, Homo sapiens
aactcacacccctgccc

SEQ ID NO: 4847821 - DNA, 10 bp, Homo sapiens
aactccaggc

SEQ ID NO: 4847822 - DNA, 12 bp, Homo sapiens
aactccaggcag

SEQ ID NO: 4847823 - DNA, 13 bp, Homo sapiens
aactccaggcatg

SEQ ID NO: 4847824 - DNA, 18 bp, Homo sapiens
aactcccccagaggtgga

SEQ ID NO: 4847825 - DNA, 18 bp, Homo sapiens
aactcctgtcttctttct

SEQ ID NO: 4847826 - DNA, 14 bp, Homo sapiens
aactctacccctgc

SEQ ID NO: 4847827 - DNA, 15 bp, Homo sapiens
aactctacccctgct

SEQ ID NO: 4847828 - DNA, 16 bp, Homo sapiens
aactctacccctgctc

SEQ ID NO: 4847829 - DNA, 11 bp, Homo sapiens
aactctgctgt

SEQ ID NO: 4847830 - DNA, 22 bp, Homo sapiens
aactctgctgtctaacctgtga

SEQ ID NO: 4847831 - DNA, 10 bp, Homo sapiens
aactgaaatc

SEQ ID NO: 4847832 - DNA, 23 bp, Homo sapiens
aactgacctgaccccattcctga

SEQ ID NO: 4847833 - DNA, 13 bp, Homo sapiens
aactgaggcccag

SEQ ID NO: 4847834 - DNA, 14 bp, Homo sapiens
aactgaggcccaga

SEQ ID NO: 4847835 - DNA, 16 bp, Homo sapiens
aactgccgtaatttaa

SEQ ID NO: 4847836 - DNA, 18 bp, Homo sapiens
aactgccgtaatttaact

SEQ ID NO: 4847837 - DNA, 23 bp, Homo sapiens
aactgcttcccttactttgctga

SEQ ID NO: 4847838 - DNA, 14 bp, Homo sapiens
aactgtaaagatgt

SEQ ID NO: 4847839 - DNA, 19 bp, Homo sapiens
aactgtccgtaagcagtat

SEQ ID NO: 4847840 - DNA, 21 bp, Homo sapiens
aactgtccgtaagcagtatat

SEQ ID NO: 4847841 - DNA, 23 bp, Homo sapiens
aactgtgataatccccacaggca

SEQ ID NO: 4847842 - DNA, 11 bp, Homo sapiens
aactgtggata

SEQ ID NO: 4847843 - DNA, 13 bp, Homo sapiens
aactgtggatatt

SEQ ID NO: 4847844 - DNA, 17 bp, Homo sapiens
aactgttgcacttttga

SEQ ID NO: 4847845 - DNA, 20 bp, Homo sapiens
aacttagactctagtattta

SEQ ID NO: 4847846 - DNA, 19 bp, Homo sapiens
aacttcagcattgtaatta

SEQ ID NO: 4847847 - DNA, 14 bp, Homo sapiens
aacttcctgtggat

SEQ ID NO: 4847848 - DNA, 20 bp, Homo sapiens
aacttctgcaacaagcatgc

SEQ ID NO: 4847849 - DNA, 22 bp, Homo sapiens
aacttctgcaacaagcatgcag

SEQ ID NO: 4847850 - DNA, 15 bp, Homo sapiens
aacttggggaagggg

SEQ ID NO: 4847851 - DNA, 17 bp, Homo sapiens
aacttggggaaggggcc

SEQ ID NO: 4847852 - DNA, 15 bp, Homo sapiens
aacttggggaggcaa

SEQ ID NO: 4847853 - DNA, 21 bp, Homo sapiens
aactttgtaaaaatcttttga

SEQ ID NO: 4847854 - DNA, 14 bp, Homo sapiens
aagaaagatactta

SEQ ID NO: 4847855 - DNA, 14 bp, Homo sapiens
aagaaagatgtttg

SEQ ID NO: 4847856 - DNA, 13 bp, Homo sapiens
aagaaagcttcct

SEQ ID NO: 4847857 - DNA, 15 bp, Homo sapiens
aagaaagcttccttc

SEQ ID NO: 4847858 - DNA, 17 bp, Homo sapiens
aagaaataaaccaaagg

SEQ ID NO: 4847859 - DNA, 12 bp, Homo sapiens
aagaaatacagt

SEQ ID NO: 4847860 - DNA, 21 bp, Homo sapiens
aagaaccactccttcatgttt

SEQ ID NO: 4847861 - DNA, 17 bp, Homo sapiens
aagaagaaggccagaga

SEQ ID NO: 4847862 - DNA, 19 bp, Homo sapiens
aagaagagcgagagatcaa

SEQ ID NO: 4847863 - DNA, 20 bp, Homo sapiens
aagaagagctatcaggagaa

SEQ ID NO: 4847864 - DNA, 17 bp, Homo sapiens
aagaaggatgatgtctt

SEQ ID NO: 4847865 - DNA, 13 bp, Homo sapiens
aagaatcttcctg

SEQ ID NO: 4847866 - DNA, 16 bp, Homo sapiens
aagaatcttcctggca

SEQ ID NO: 4847867 - DNA, 14 bp, Homo sapiens
aatgcatatttgca

SEQ ID NO: 4847868 - DNA, 17 bp, Homo sapiens
aatgccatctatctagt

SEQ ID NO: 4847869 - DNA, 16 bp, Homo sapiens
aatgccccagtgttat

SEQ ID NO: 4847870 - DNA, 20 bp, Homo sapiens
aatgctacaattttaagagg

SEQ ID NO: 4847871 - DNA, 23 bp, Homo sapiens
aatgctcccacctgaatttgtat

SEQ ID NO: 4847872 - DNA, 19 bp, Homo sapiens
aatgctgcctcaggaccca

SEQ ID NO: 4847873 - DNA, 20 bp, Homo sapiens
aatgctgcctcaggacccat

SEQ ID NO: 4847874 - DNA, 12 bp, Homo sapiens
aatgctgctttt

SEQ ID NO: 4847875 - DNA, 16 bp, Homo sapiens
aatgcttgcatggaga

SEQ ID NO: 4847876 - DNA, 19 bp, Homo sapiens
aatggaggatctctaaaga

SEQ ID NO: 4847877 - DNA, 17 bp, Homo sapiens
aatggatttttctttaa

SEQ ID NO: 4847878 - DNA, 18 bp, Homo sapiens
aatggatttttctttaac

SEQ ID NO: 4847879 - DNA, 20 bp, Homo sapiens
aatggatttttctttaactg

SEQ ID NO: 4847880 - DNA, 18 bp, Homo sapiens
aatggcagctagtgcctt

SEQ ID NO: 4847881 - DNA, 13 bp, Homo sapiens
aatggcatggcag

SEQ ID NO: 4847882 - DNA, 14 bp, Homo sapiens
aatggcctggagca

SEQ ID NO: 4847883 - DNA, 16 bp, Homo sapiens
aatgggattagaaaca

SEQ ID NO: 4847884 - DNA, 17 bp, Homo sapiens
aatggggaactccccca

SEQ ID NO: 4847885 - DNA, 14 bp, Homo sapiens
aatggtaataagca

SEQ ID NO: 4847886 - DNA, 17 bp, Homo sapiens
aatggtcctatttttgt

SEQ ID NO: 4847887 - DNA, 20 bp, Homo sapiens
aatggttaatttttcctgca

SEQ ID NO: 4847888 - DNA, 17 bp, Homo sapiens
aatgtaatttaaatgaa

SEQ ID NO: 4847889 - DNA, 19 bp, Homo sapiens
aatgtactgatttcagtaa

SEQ ID NO: 4847890 - DNA, 22 bp, Homo sapiens
aatgtattttcatagatgtgtt

SEQ ID NO: 4847891 - DNA, 19 bp, Homo sapiens
aatgtccaaaatttatatt

SEQ ID NO: 4847892 - DNA, 18 bp, Homo sapiens
aatgtctgtaataataga

SEQ ID NO: 4847893 - DNA, 22 bp, Homo sapiens
aatgtggtctgccaatctgtac

SEQ ID NO: 4847894 - DNA, 20 bp, Homo sapiens
aatgttagagtaatgaaatg

SEQ ID NO: 4847895 - DNA, 13 bp, Homo sapiens
aatgttctttctg

SEQ ID NO: 4847896 - DNA, 18 bp, Homo sapiens
aatgttctttctgctcta

SEQ ID NO: 4847897 - DNA, 20 bp, Homo sapiens
aatgttggagcagcaggcct

SEQ ID NO: 4847898 - DNA, 21 bp, Homo sapiens
aatgttggagcagcaggcctc

SEQ ID NO: 4847899 - DNA, 16 bp, Homo sapiens
aatgtttattaaatgc

SEQ ID NO: 4847900 - DNA, 16 bp, Homo sapiens
aatgtttctggatttc

SEQ ID NO: 4847901 - DNA, 18 bp, Homo sapiens
aattaaaaacgaaaacct

SEQ ID NO: 4847902 - DNA, 20 bp, Homo sapiens
aattaaaaacgaaaacctga

SEQ ID NO: 4847903 - DNA, 22 bp, Homo sapiens
aattaagcaaatgttaaaagtt

SEQ ID NO: 4847904 - DNA, 16 bp, Homo sapiens
aattaaggaaatgtta

SEQ ID NO: 4847905 - DNA, 17 bp, Homo sapiens
aattaatatattaaaat

SEQ ID NO: 4847906 - DNA, 13 bp, Homo sapiens
aattataaatgac

SEQ ID NO: 4847907 - DNA, 19 bp, Homo sapiens
aattatatattgcaaggtg

SEQ ID NO: 4847908 - DNA, 20 bp, Homo sapiens
aattatcagcaaagaaaaaa

SEQ ID NO: 4847909 - DNA, 21 bp, Homo sapiens
aattatcagcaaagaaaaaaa

SEQ ID NO: 4847910 - DNA, 16 bp, Homo sapiens
aattatttaattgtcc

SEQ ID NO: 4847911 - DNA, 13 bp, Homo sapiens
aattcaaagcatg

SEQ ID NO: 4847912 - DNA, 16 bp, Homo sapiens
aattcaactttgtaaa

SEQ ID NO: 4847913 - DNA, 17 bp, Homo sapiens
aattcaatttggattta

SEQ ID NO: 4847914 - DNA, 15 bp, Homo sapiens
aattcaccttcccct

SEQ ID NO: 4847915 - DNA, 23 bp, Homo sapiens
aattctgattctggctttaagcc

SEQ ID NO: 4847916 - DNA, 15 bp, Homo sapiens
aattctgattgattt

SEQ ID NO: 4847917 - DNA, 16 bp, Homo sapiens
aattgaagtttcaagt

SEQ ID NO: 4847918 - DNA, 20 bp, Homo sapiens
aattgactcttatttataga

SEQ ID NO: 4847919 - DNA, 23 bp, Homo sapiens
aattgctgataccatatgaatga

SEQ ID NO: 4847920 - DNA, 13 bp, Homo sapiens
aattgtacaaaat

SEQ ID NO: 4847921 - DNA, 12 bp, Homo sapiens
aattgtgcccct

SEQ ID NO: 4847922 - DNA, 15 bp, Homo sapiens
aattgtgtggattct

SEQ ID NO: 4847923 - DNA, 14 bp, Homo sapiens
aatttaaaaatata

SEQ ID NO: 4847924 - DNA, 15 bp, Homo sapiens
aatttaaaaatatat

SEQ ID NO: 4847925 - DNA, 16 bp, Homo sapiens
aatttaaatgaaagaa

SEQ ID NO: 4847926 - DNA, 19 bp, Homo sapiens
aatttaaatgaaagaaaat

SEQ ID NO: 4847927 - DNA, 13 bp, Homo sapiens
aatttcctgtgag

SEQ ID NO: 4847928 - DNA, 17 bp, Homo sapiens
aatttccttcaggcagc

SEQ ID NO: 4847929 - DNA, 21 bp, Homo sapiens
aatttctagtacctgtgactc

SEQ ID NO: 4847930 - DNA, 22 bp, Homo sapiens
aatttggaggctggagtaatca

SEQ ID NO: 4847931 - DNA, 21 bp, Homo sapiens
aatttgtgtgtttttagctgt

SEQ ID NO: 4847932 - DNA, 23 bp, Homo sapiens
aattttaaaaaagggagtttttg

SEQ ID NO: 4847933 - DNA, 14 bp, Homo sapiens
aattttatccctca

SEQ ID NO: 4847934 - DNA, 20 bp, Homo sapiens
aattttatccctcacctgta

SEQ ID NO: 4847935 - DNA, 17 bp, Homo sapiens
aatttttcctgcatgtt

SEQ ID NO: 4847936 - DNA, 20 bp, Homo sapiens
aatttttcctgcatgttctg

SEQ ID NO: 4847937 - DNA, 16 bp, Homo sapiens
acaaaatggtcctatt

SEQ ID NO: 4847938 - DNA, 18 bp, Homo sapiens
acaaaattcaaagcatgg

SEQ ID NO: 4847939 - DNA, 13 bp, Homo sapiens
acaaactccaggc

SEQ ID NO: 4847940 - DNA, 16 bp, Homo sapiens
acaaactccaggctgg

SEQ ID NO: 4847941 - DNA, 17 bp, Homo sapiens
acaaagaaacaaagatg

SEQ ID NO: 4847942 - DNA, 20 bp, Homo sapiens
acaaagaaacaaagatgtta

SEQ ID NO: 4847943 - DNA, 17 bp, Homo sapiens
acaaagcactggccttg

SEQ ID NO: 4847944 - DNA, 20 bp, Homo sapiens
acaaagtaaaagtagtgttg

SEQ ID NO: 4847945 - DNA, 18 bp, Homo sapiens
acaaagtttcagagtata

SEQ ID NO: 4847946 - DNA, 19 bp, Homo sapiens
acaaagtttcagagtatat

SEQ ID NO: 4847947 - DNA, 22 bp, Homo sapiens
acaaagtttcagagtatattgt

SEQ ID NO: 4847948 - DNA, 20 bp, Homo sapiens
acaaatgctcccacctgaat

SEQ ID NO: 4847949 - DNA, 20 bp, Homo sapiens
acaaattgactcttatttat

SEQ ID NO: 4847950 - DNA, 22 bp, Homo sapiens
acaacatagcagatctgttttg

SEQ ID NO: 4847951 - DNA, 14 bp, Homo sapiens
acaactcccttgca

SEQ ID NO: 4847952 - DNA, 13 bp, Homo sapiens
acaagactggccc

SEQ ID NO: 4847953 - DNA, 18 bp, Homo sapiens
acaagactggcccagtgc

SEQ ID NO: 4847954 - DNA, 21 bp, Homo sapiens
acaagactggcccagtgccag

SEQ ID NO: 4847955 - DNA, 15 bp, Homo sapiens
acaagccccctgccc

SEQ ID NO: 4847956 - DNA, 14 bp, Homo sapiens
acaaggcctgcttg

SEQ ID NO: 4847957 - DNA, 19 bp, Homo sapiens
acaagtggtgtttattgca

SEQ ID NO: 4847958 - DNA, 17 bp, Homo sapiens
acaatattccagatctt

SEQ ID NO: 4847959 - DNA, 13 bp, Homo sapiens
acaattaactgcc

SEQ ID NO: 4847960 - DNA, 12 bp, Homo sapiens
acaattttaaga

SEQ ID NO: 4847961 - DNA, 10 bp, Homo sapiens
acacacacac

SEQ ID NO: 4847962 - DNA, 11 bp, Homo sapiens
acacacacaca

SEQ ID NO: 4847963 - DNA, 12 bp, Homo sapiens
acacacacacac

SEQ ID NO: 4847964 - DNA, 13 bp, Homo sapiens
acacacacacacg

SEQ ID NO: 4847965 - DNA, 14 bp, Homo sapiens
acacacacacacga

SEQ ID NO: 4847966 - DNA, 16 bp, Homo sapiens
acacacacacacgatg

SEQ ID NO: 4847967 - DNA, 15 bp, Homo sapiens
acacacacacgatgc

SEQ ID NO: 4847968 - DNA, 13 bp, Homo sapiens
acacacgatgcat

SEQ ID NO: 4847969 - DNA, 15 bp, Homo sapiens
acacacgatgcattt

SEQ ID NO: 4847970 - DNA, 20 bp, Homo sapiens
acacacgatgcatttaataa

SEQ ID NO: 4847971 - DNA, 19 bp, Homo sapiens
acacaggatcctggcctga

SEQ ID NO: 4847972 - DNA, 14 bp, Homo sapiens
acacatgtgtatga

SEQ ID NO: 4847973 - DNA, 20 bp, Homo sapiens
acaccattaccaaaataata

SEQ ID NO: 4847974 - DNA, 21 bp, Homo sapiens
acaccattaccaaaataataa

SEQ ID NO: 4847975 - DNA, 13 bp, Homo sapiens
acacccctgcccc

SEQ ID NO: 4847976 - DNA, 22 bp, Homo sapiens
acaccgtggcagcttgctgggc

SEQ ID NO: 4847977 - DNA, 14 bp, Homo sapiens
acacgatgcattta

SEQ ID NO: 4847978 - DNA, 19 bp, Homo sapiens
acacgatgcatttaataaa

SEQ ID NO: 4847979 - DNA, 20 bp, Homo sapiens
acacgatgcatttaataaag

SEQ ID NO: 4847980 - DNA, 21 bp, Homo sapiens
acacgatgcatttaataaaga

SEQ ID NO: 4847981 - DNA, 13 bp, Homo sapiens
acactatttgtga

SEQ ID NO: 4847982 - DNA, 15 bp, Homo sapiens
acactatttgtgact

SEQ ID NO: 4847983 - DNA, 20 bp, Homo sapiens
acactcagaaaattccctgg

SEQ ID NO: 4847984 - DNA, 22 bp, Homo sapiens
acactcagaaaattccctgggg

SEQ ID NO: 4847985 - DNA, 23 bp, Homo sapiens
acactgaaaaatctaagtgatat

SEQ ID NO: 4847986 - DNA, 16 bp, Homo sapiens
acactgtgaccaggct

SEQ ID NO: 4847987 - DNA, 21 bp, Homo sapiens
actccttatctctttccacca

SEQ ID NO: 4847988 - DNA, 17 bp, Homo sapiens
actccttcatgtttgga

SEQ ID NO: 4847989 - DNA, 18 bp, Homo sapiens
actccttcatgtttggaa

SEQ ID NO: 4847990 - DNA, 18 bp, Homo sapiens
actcgagaccataaagat

SEQ ID NO: 4847991 - DNA, 15 bp, Homo sapiens
actctaaaattataa

SEQ ID NO: 4847992 - DNA, 20 bp, Homo sapiens
actctaaccaaggctgtgtt

SEQ ID NO: 4847993 - DNA, 16 bp, Homo sapiens
actctacccctgctcc

SEQ ID NO: 4847994 - DNA, 11 bp, Homo sapiens
actctcaggga

SEQ ID NO: 4847995 - DNA, 9 bp, Homo sapiens
actctgctg

SEQ ID NO: 4847996 - DNA, 15 bp, Homo sapiens
actctgtcttgtgtt

SEQ ID NO: 4847997 - DNA, 22 bp, Homo sapiens
actctgttcccccaccctccat

SEQ ID NO: 4847998 - DNA, 19 bp, Homo sapiens
actcttaagtcctaaaagt

SEQ ID NO: 4847999 - DNA, 15 bp, Homo sapiens
actcttatttataga

SEQ ID NO: 4848000 - DNA, 20 bp, Homo sapiens
actcttatttatagaattta

SEQ ID NO: 4848001 - DNA, 16 bp, Homo sapiens
actgaaaagaaggaaa

SEQ ID NO: 4848002 - DNA, 19 bp, Homo sapiens
actgaaaagaaggaaagat

SEQ ID NO: 4848003 - DNA, 14 bp, Homo sapiens
actgaaatccttga

SEQ ID NO: 4848004 - DNA, 15 bp, Homo sapiens
actgaaatccttgag

SEQ ID NO: 4848005 - DNA, 20 bp, Homo sapiens
actgaatgaagcagtatttt

SEQ ID NO: 4848006 - DNA, 21 bp, Homo sapiens
actgaatgaagcagtattttg

SEQ ID NO: 4848007 - DNA, 13 bp, Homo sapiens
actgacatttctt

SEQ ID NO: 4848008 - DNA, 21 bp, Homo sapiens
actgacctgaccccattcctg

SEQ ID NO: 4848009 - DNA, 13 bp, Homo sapiens
actgacttaggtt

SEQ ID NO: 4848010 - DNA, 12 bp, Homo sapiens
actgagcaggga

SEQ ID NO: 4848011 - DNA, 13 bp, Homo sapiens
actgaggcccaga

SEQ ID NO: 4848012 - DNA, 17 bp, Homo sapiens
actgaggcccagagagg

SEQ ID NO: 4848013 - DNA, 19 bp, Homo sapiens
actgaggcccagagaggga

SEQ ID NO: 4848014 - DNA, 20 bp, Homo sapiens
actgaggcccagagagggaa

SEQ ID NO: 4848015 - DNA, 20 bp, Homo sapiens
actgatgagagaatgtggaa

SEQ ID NO: 4848016 - DNA, 21 bp, Homo sapiens
actgatgagagaatgtggaaa

SEQ ID NO: 4848017 - DNA, 14 bp, Homo sapiens
actgatttcagtaa

SEQ ID NO: 4848018 - DNA, 15 bp, Homo sapiens
actgatttcagtaag

SEQ ID NO: 4848019 - DNA, 18 bp, Homo sapiens
actgcaaagtcgccagtc

SEQ ID NO: 4848020 - DNA, 19 bp, Homo sapiens
actgcagaaaccctgagca

SEQ ID NO: 4848021 - DNA, 18 bp, Homo sapiens
actgcatggggaggcagc

SEQ ID NO: 4848022 - DNA, 13 bp, Homo sapiens
actgcatttgtgt

SEQ ID NO: 4848023 - DNA, 16 bp, Homo sapiens
actgccgtaatttaac

SEQ ID NO: 4848024 - DNA, 17 bp, Homo sapiens
actgccgtaatttaact

SEQ ID NO: 4848025 - DNA, 14 bp, Homo sapiens
actgctcctgggca

SEQ ID NO: 4848026 - DNA, 16 bp, Homo sapiens
actgctcctgtggcag

SEQ ID NO: 4848027 - DNA, 15 bp, Homo sapiens
actgctgcaaggtgg

SEQ ID NO: 4848028 - DNA, 22 bp, Homo sapiens
actgctgcaaggtggcctctgc

SEQ ID NO: 4848029 - DNA, 23 bp, Homo sapiens
actgctgctgctgctgccgccgc

SEQ ID NO: 4848030 - DNA, 12 bp, Homo sapiens
actggactgcat

SEQ ID NO: 4848031 - DNA, 13 bp, Homo sapiens
actggactgcatg

SEQ ID NO: 4848032 - DNA, 23 bp, Homo sapiens
actggaggagcacacatccaaga

SEQ ID NO: 4848033 - DNA, 18 bp, Homo sapiens
actggatttgcagaagtt

SEQ ID NO: 4848034 - DNA, 19 bp, Homo sapiens
actggccggagtcagtgcc

SEQ ID NO: 4848035 - DNA, 18 bp, Homo sapiens
actggcttacctcctcat

SEQ ID NO: 4848036 - DNA, 14 bp, Homo sapiens
actgggatgcctct

SEQ ID NO: 4848037 - DNA, 14 bp, Homo sapiens
actggggggcaggc

SEQ ID NO: 4848038 - DNA, 13 bp, Homo sapiens
actggtgtaatct

SEQ ID NO: 4848039 - DNA, 17 bp, Homo sapiens
actggtgtaatctcaat

SEQ ID NO: 4848040 - DNA, 21 bp, Homo sapiens
actggttctgaggccagaaag

SEQ ID NO: 4848041 - DNA, 12 bp, Homo sapiens
actgtactgaat

SEQ ID NO: 4848042 - DNA, 12 bp, Homo sapiens
actgtactgcat

SEQ ID NO: 4848043 - DNA, 19 bp, Homo sapiens
actgtactgcatgtgactt

SEQ ID NO: 4848044 - DNA, 20 bp, Homo sapiens
actgtagatatgtattcttt

SEQ ID NO: 4848045 - DNA, 14 bp, Homo sapiens
actgtcagtggggc

SEQ ID NO: 4848046 - DNA, 17 bp, Homo sapiens
actgtccagagtctctt

SEQ ID NO: 4848047 - DNA, 15 bp, Homo sapiens
actgtcctattatat

SEQ ID NO: 4848048 - DNA, 17 bp, Homo sapiens
actgtctattaatattc

SEQ ID NO: 4848049 - DNA, 14 bp, Homo sapiens
actgtggcctgcag

SEQ ID NO: 4848050 - DNA, 12 bp, Homo sapiens
actgttgagtta

SEQ ID NO: 4848051 - DNA, 15 bp, Homo sapiens
actgttgataaaaac

SEQ ID NO: 4848052 - DNA, 20 bp, Homo sapiens
actgttgcacttttgaatgt

SEQ ID NO: 4848053 - DNA, 21 bp, Homo sapiens
actgttggaatggatttttct

SEQ ID NO: 4848054 - DNA, 22 bp, Homo sapiens
acttacatgttcccaaaacaat

SEQ ID NO: 4848055 - DNA, 19 bp, Homo sapiens
acttagactctagtattta

SEQ ID NO: 4848056 - DNA, 16 bp, Homo sapiens
acttatgtagaaactg

SEQ ID NO: 4848057 - DNA, 15 bp, Homo sapiens
acttattgaatatat

SEQ ID NO: 4848058 - DNA, 18 bp, Homo sapiens
acttattgaatatatgat

SEQ ID NO: 4848059 - DNA, 16 bp, Homo sapiens
acttatttctcagctg

SEQ ID NO: 4848060 - DNA, 21 bp, Homo sapiens
acttcaaagtgcctgggctca

SEQ ID NO: 4848061 - DNA, 16 bp, Homo sapiens
acttcagcattgtaat

SEQ ID NO: 4848062 - DNA, 18 bp, Homo sapiens
acttccaaagaaagttct

SEQ ID NO: 4848063 - DNA, 15 bp, Homo sapiens
acttcccactgtatg

SEQ ID NO: 4848064 - DNA, 15 bp, Homo sapiens
acttccctcttgaaa

SEQ ID NO: 4848065 - DNA, 14 bp, Homo sapiens
acttcctcaataaa

SEQ ID NO: 4848066 - DNA, 16 bp, Homo sapiens
acttctgcaacaagca

SEQ ID NO: 4848067 - DNA, 19 bp, Homo sapiens
acttctgcaacaagcatgc

SEQ ID NO: 4848068 - DNA, 21 bp, Homo sapiens
acttctggggccacctctgga

SEQ ID NO: 4848069 - DNA, 17 bp, Homo sapiens
acttggcccccttcagg

SEQ ID NO: 4848070 - DNA, 18 bp, Homo sapiens
acttggcccccttcagga

SEQ ID NO: 4848071 - DNA, 22 bp, Homo sapiens
acttggcccccttcaggagcct

SEQ ID NO: 4848072 - DNA, 21 bp, Homo sapiens
acttggggaaggggcctgggc

SEQ ID NO: 4848073 - DNA, 22 bp, Homo sapiens
acttggggaaggggcctgggct

SEQ ID NO: 4848074 - DNA, 23 bp, Homo sapiens
acttggggaaggggcctgggctg

SEQ ID NO: 4848075 - DNA, 19 bp, Homo sapiens
acttgggtcacatgactct

SEQ ID NO: 4848076 - DNA, 22 bp, Homo sapiens
acttggtttgttatatcaggga

SEQ ID NO: 4848077 - DNA, 20 bp, Homo sapiens
acttgtatattttaagaaat

SEQ ID NO: 4848078 - DNA, 19 bp, Homo sapiens
acttgttttggatggcttg

SEQ ID NO: 4848079 - DNA, 16 bp, Homo sapiens
actttagaagcctgca

SEQ ID NO: 4848080 - DNA, 16 bp, Homo sapiens
actttattgcaatgca

SEQ ID NO: 4848081 - DNA, 18 bp, Homo sapiens
actttccagaatgacctt

SEQ ID NO: 4848082 - DNA, 18 bp, Homo sapiens
actttctatttttatgat

SEQ ID NO: 4848083 - DNA, 20 bp, Homo sapiens
actttcttatccaacttttt

SEQ ID NO: 4848084 - DNA, 17 bp, Homo sapiens
actttgcactgatatat

SEQ ID NO: 4848085 - DNA, 19 bp, Homo sapiens
actttgcactgatatatca

SEQ ID NO: 4848086 - DNA, 21 bp, Homo sapiens
actttgcactgatatatcatg

SEQ ID NO: 4848087 - DNA, 19 bp, Homo sapiens
actttgggaaaacatgtta

SEQ ID NO: 4848088 - DNA, 17 bp, Homo sapiens
actttggggctaattta

SEQ ID NO: 4848089 - DNA, 14 bp, Homo sapiens
actttgtattttga

SEQ ID NO: 4848090 - DNA, 16 bp, Homo sapiens
acttttataaagcatg

SEQ ID NO: 4848091 - DNA, 17 bp, Homo sapiens
acttttataaagcatgt

SEQ ID NO: 4848092 - DNA, 13 bp, Homo sapiens
acttttgaatgtc

SEQ ID NO: 4848093 - DNA, 21 bp, Homo sapiens
actttttcatagtaagtgcga

SEQ ID NO: 4848094 - DNA, 12 bp, Homo sapiens
agaaaaccactt

SEQ ID NO: 4848095 - DNA, 14 bp, Homo sapiens
agaaaacccacccc

SEQ ID NO: 4848096 - DNA, 13 bp, Homo sapiens
agaaaagagagaa

SEQ ID NO: 4848097 - DNA, 19 bp, Homo sapiens
agaaaagtgaattgaagtt

SEQ ID NO: 4848098 - DNA, 17 bp, Homo sapiens
agaaaatgaaatgcata

SEQ ID NO: 4848099 - DNA, 21 bp, Homo sapiens
agaaaatgaaatgcatatttg

SEQ ID NO: 4848100 - DNA, 17 bp, Homo sapiens
agaaaattccctggggt

SEQ ID NO: 4848101 - DNA, 22 bp, Homo sapiens
agaaaattgagttgcacttatt

SEQ ID NO: 4848102 - DNA, 21 bp, Homo sapiens
agaaaatttgccaatctttcc

SEQ ID NO: 4848103 - DNA, 18 bp, Homo sapiens
agaaacactatttgtgac

SEQ ID NO: 4848104 - DNA, 19 bp, Homo sapiens
agaaacccagagatgcctg

SEQ ID NO: 4848105 - DNA, 12 bp, Homo sapiens
agaaacctgcca

SEQ ID NO: 4848106 - DNA, 22 bp, Homo sapiens
agaaagagtttgaaactcgaga

SEQ ID NO: 4848107 - DNA, 21 bp, Homo sapiens
agcatccagtgtgagatactg

SEQ ID NO: 4848108 - DNA, 20 bp, Homo sapiens
agcatcctgataccattcta

SEQ ID NO: 4848109 - DNA, 13 bp, Homo sapiens
agcatccttggca

SEQ ID NO: 4848110 - DNA, 15 bp, Homo sapiens
agcatccttggcagt

SEQ ID NO: 4848111 - DNA, 18 bp, Homo sapiens
agcatctcagtggtgtgt

SEQ ID NO: 4848112 - DNA, 20 bp, Homo sapiens
agcatggacatttagaagaa

SEQ ID NO: 4848113 - DNA, 14 bp, Homo sapiens
agcatggggccagg

SEQ ID NO: 4848114 - DNA, 13 bp, Homo sapiens
agcattgcagcct

SEQ ID NO: 4848115 - DNA, 19 bp, Homo sapiens
agcattgcagcctaagaag

SEQ ID NO: 4848116 - DNA, 20 bp, Homo sapiens
agcatttaatggcagctagt

SEQ ID NO: 4848117 - DNA, 12 bp, Homo sapiens
agccaaatttaa

SEQ ID NO: 4848118 - DNA, 13 bp, Homo sapiens
agccaaatttctt

SEQ ID NO: 4848119 - DNA, 16 bp, Homo sapiens
agccaagctggcacaa

SEQ ID NO: 4848120 - DNA, 20 bp, Homo sapiens
agccaagctggcacaaaaga

SEQ ID NO: 4848121 - DNA, 21 bp, Homo sapiens
agccaagctggcacaaaagac

SEQ ID NO: 4848122 - DNA, 15 bp, Homo sapiens
agccaagctttaaat

SEQ ID NO: 4848123 - DNA, 19 bp, Homo sapiens
agccaagctttaaattatg

SEQ ID NO: 4848124 - DNA, 20 bp, Homo sapiens
agccaagctttaaattatgt

SEQ ID NO: 4848125 - DNA, 18 bp, Homo sapiens
agccaaggccgccagcgt

SEQ ID NO: 4848126 - DNA, 16 bp, Homo sapiens
agccaagggcctcggg

SEQ ID NO: 4848127 - DNA, 13 bp, Homo sapiens
agccaatgctgtc

SEQ ID NO: 4848128 - DNA, 19 bp, Homo sapiens
agccacaccgtggcagctt

SEQ ID NO: 4848129 - DNA, 12 bp, Homo sapiens
agccacagcaga

SEQ ID NO: 4848130 - DNA, 22 bp, Homo sapiens
agccagaacgtggctctgctgg

SEQ ID NO: 4848131 - DNA, 17 bp, Homo sapiens
agccagcctgcttccca

SEQ ID NO: 4848132 - DNA, 20 bp, Homo sapiens
agccagcctgcttcccacaa

SEQ ID NO: 4848133 - DNA, 22 bp, Homo sapiens
agccagcctgcttcccacaact

SEQ ID NO: 4848134 - DNA, 12 bp, Homo sapiens
agccaggactcc

SEQ ID NO: 4848135 - DNA, 16 bp, Homo sapiens
agccaggactcccaga

SEQ ID NO: 4848136 - DNA, 17 bp, Homo sapiens
agccaggactcccagaa

SEQ ID NO: 4848137 - DNA, 21 bp, Homo sapiens
agccaggactcccagaacctc

SEQ ID NO: 4848138 - DNA, 21 bp, Homo sapiens
agccaggcaagaaagcttcct

SEQ ID NO: 4848139 - DNA, 20 bp, Homo sapiens
agccaggctcaggagaagcc

SEQ ID NO: 4848140 - DNA, 16 bp, Homo sapiens
agccaggtctgactcc

SEQ ID NO: 4848141 - DNA, 19 bp, Homo sapiens
agccaggtctgactccaaa

SEQ ID NO: 4848142 - DNA, 20 bp, Homo sapiens
agccaggtctgactccaaag

SEQ ID NO: 4848143 - DNA, 23 bp, Homo sapiens
agccaggtctgactccaaagctg

SEQ ID NO: 4848144 - DNA, 17 bp, Homo sapiens
agccatacataaaagaa

SEQ ID NO: 4848145 - DNA, 21 bp, Homo sapiens
agccatacataaaagaaataa

SEQ ID NO: 4848146 - DNA, 14 bp, Homo sapiens
agccatagatgctg

SEQ ID NO: 4848147 - DNA, 16 bp, Homo sapiens
agccatgccaataaag

SEQ ID NO: 4848148 - DNA, 17 bp, Homo sapiens
agcccaaacctgggaag

SEQ ID NO: 4848149 - DNA, 23 bp, Homo sapiens
agcccaacctacattccaccctg

SEQ ID NO: 4848150 - DNA, 13 bp, Homo sapiens
agccccctgccct

SEQ ID NO: 4848151 - DNA, 21 bp, Homo sapiens
agcccctactgtgggcaaagt

SEQ ID NO: 4848152 - DNA, 16 bp, Homo sapiens
agcccgcagaggtggg

SEQ ID NO: 4848153 - DNA, 15 bp, Homo sapiens
agccctattgctgct

SEQ ID NO: 4848154 - DNA, 17 bp, Homo sapiens
agccctattgctgctaa

SEQ ID NO: 4848155 - DNA, 22 bp, Homo sapiens
agccctcaccacagccttctaa

SEQ ID NO: 4848156 - DNA, 14 bp, Homo sapiens
agccctggggcagg

SEQ ID NO: 4848157 - DNA, 16 bp, Homo sapiens
agccgcagacctggag

SEQ ID NO: 4848158 - DNA, 18 bp, Homo sapiens
agcctaagaagaaggcca

SEQ ID NO: 4848159 - DNA, 20 bp, Homo sapiens
agcctaagaagaaggccaga

SEQ ID NO: 4848160 - DNA, 18 bp, Homo sapiens
agcctaaggctcctgttt

SEQ ID NO: 4848161 - DNA, 18 bp, Homo sapiens
agcctacctctgtctgag

SEQ ID NO: 4848162 - DNA, 14 bp, Homo sapiens
agcctactatttaa

SEQ ID NO: 4848163 - DNA, 13 bp, Homo sapiens
agcctactctcct

SEQ ID NO: 4848164 - DNA, 13 bp, Homo sapiens
agcctccaagcct

SEQ ID NO: 4848165 - DNA, 18 bp, Homo sapiens
agcctctccgactctgca

SEQ ID NO: 4848166 - DNA, 20 bp, Homo sapiens
agcctctccgactctgcacc

SEQ ID NO: 4848167 - DNA, 14 bp, Homo sapiens
agcctgactagaac

SEQ ID NO: 4848168 - DNA, 21 bp, Homo sapiens
agcctgactagaactcctgtc

SEQ ID NO: 4848169 - DNA, 15 bp, Homo sapiens
agcctgcctcccaag

SEQ ID NO: 4848170 - DNA, 14 bp, Homo sapiens
agcctgcttcccac

SEQ ID NO: 4848171 - DNA, 18 bp, Homo sapiens
agcctgctttcctgcagc

SEQ ID NO: 4848172 - DNA, 14 bp, Homo sapiens
agcctggccaggca

SEQ ID NO: 4848173 - DNA, 18 bp, Homo sapiens
agcctgtatgtggtgtgg

SEQ ID NO: 4848174 - DNA, 21 bp, Homo sapiens
agccttacttcaaagtgcctg

SEQ ID NO: 4848175 - DNA, 13 bp, Homo sapiens
agccttagagctc

SEQ ID NO: 4848176 - DNA, 14 bp, Homo sapiens
agccttagagctct

SEQ ID NO: 4848177 - DNA, 16 bp, Homo sapiens
agccttagagctcttg

SEQ ID NO: 4848178 - DNA, 19 bp, Homo sapiens
agccttcatcagaactctt

SEQ ID NO: 4848179 - DNA, 16 bp, Homo sapiens
agccttctccctagct

SEQ ID NO: 4848180 - DNA, 19 bp, Homo sapiens
agccttgcaacccaaggtg

SEQ ID NO: 4848181 - DNA, 23 bp, Homo sapiens
agccttgcaacccaaggtgaggt

SEQ ID NO: 4848182 - DNA, 23 bp, Homo sapiens
agccttgcagatatctgcatgtg

SEQ ID NO: 4848183 - DNA, 14 bp, Homo sapiens
agccttgcagcggc

SEQ ID NO: 4848184 - DNA, 17 bp, Homo sapiens
agccttgtacagtctgc

SEQ ID NO: 4848185 - DNA, 19 bp, Homo sapiens
agccttgtacagtctgctc

SEQ ID NO: 4848186 - DNA, 21 bp, Homo sapiens
agccttgtacagtctgctcct

SEQ ID NO: 4848187 - DNA, 16 bp, Homo sapiens
agcctttacctgtgaa

SEQ ID NO: 4848188 - DNA, 15 bp, Homo sapiens
agcgaacagccttag

SEQ ID NO: 4848189 - DNA, 23 bp, Homo sapiens
agcgaggcacccttactggctta

SEQ ID NO: 4848190 - DNA, 17 bp, Homo sapiens
agcggattgctctggag

SEQ ID NO: 4848191 - DNA, 13 bp, Homo sapiens
agcgtgtggagca

SEQ ID NO: 4848192 - DNA, 17 bp, Homo sapiens
agcgtgtggagcagagc

SEQ ID NO: 4848193 - DNA, 20 bp, Homo sapiens
agcgttctaaatatgaatga

SEQ ID NO: 4848194 - DNA, 16 bp, Homo sapiens
agctaggaaccctgga

SEQ ID NO: 4848195 - DNA, 19 bp, Homo sapiens
agctaggaaccctggaggt

SEQ ID NO: 4848196 - DNA, 20 bp, Homo sapiens
agctaggaaccctggaggta

SEQ ID NO: 4848197 - DNA, 12 bp, Homo sapiens
agctagtgcctt

SEQ ID NO: 4848198 - DNA, 13 bp, Homo sapiens
agctcacccctgg

SEQ ID NO: 4848199 - DNA, 15 bp, Homo sapiens
agctccgggatcagc

SEQ ID NO: 4848200 - DNA, 13 bp, Homo sapiens
agctcctcccctt

SEQ ID NO: 4848201 - DNA, 13 bp, Homo sapiens
agctctagcctct

SEQ ID NO: 4848202 - DNA, 17 bp, Homo sapiens
agctctagcctctggac

SEQ ID NO: 4848203 - DNA, 20 bp, Homo sapiens
agctctcaggaccgtgccct

SEQ ID NO: 4848204 - DNA, 16 bp, Homo sapiens
agctctcccctcctgc

SEQ ID NO: 4848205 - DNA, 22 bp, Homo sapiens
agctctcctccagccctgggca

SEQ ID NO: 4848206 - DNA, 19 bp, Homo sapiens
agctcttgtgttcagaaga

SEQ ID NO: 4848207 - DNA, 17 bp, Homo sapiens
agctgaaattttagaaa

SEQ ID NO: 4848208 - DNA, 18 bp, Homo sapiens
agctgaggctgagaaagc

SEQ ID NO: 4848209 - DNA, 19 bp, Homo sapiens
agctgaggctgagaaagct

SEQ ID NO: 4848210 - DNA, 18 bp, Homo sapiens
agctgcaaaaattatata

SEQ ID NO: 4848211 - DNA, 19 bp, Homo sapiens
agctgcagagatttctcat

SEQ ID NO: 4848212 - DNA, 22 bp, Homo sapiens
agctgcagccttcatcagaact

SEQ ID NO: 4848213 - DNA, 18 bp, Homo sapiens
agctgctcctttaccctc

SEQ ID NO: 4848214 - DNA, 19 bp, Homo sapiens
agctgctcctttaccctct

SEQ ID NO: 4848215 - DNA, 16 bp, Homo sapiens
agctgctgttgaactt

SEQ ID NO: 4848216 - DNA, 18 bp, Homo sapiens
agctgctgttgaactttt

SEQ ID NO: 4848217 - DNA, 19 bp, Homo sapiens
agctgcttgacctagctct

SEQ ID NO: 4848218 - DNA, 14 bp, Homo sapiens
agctggagcagcgg

SEQ ID NO: 4848219 - DNA, 14 bp, Homo sapiens
agctggcacaaaag

SEQ ID NO: 4848220 - DNA, 20 bp, Homo sapiens
agctggcacaaaagacagct

SEQ ID NO: 4848221 - DNA, 14 bp, Homo sapiens
agctgggaaagcat

SEQ ID NO: 4848222 - DNA, 20 bp, Homo sapiens
agctgggtcacatccatccc

SEQ ID NO: 4848223 - DNA, 16 bp, Homo sapiens
agctggtggcagagtc

SEQ ID NO: 4848224 - DNA, 15 bp, Homo sapiens
agctgtgccttccct

SEQ ID NO: 4848225 - DNA, 21 bp, Homo sapiens
agctgtgtgaatacctgctca

SEQ ID NO: 4848226 - DNA, 21 bp, Homo sapiens
agctgttccattacaccacag

SEQ ID NO: 4848227 - DNA, 18 bp, Homo sapiens
aggctgcagaggcacctc

SEQ ID NO: 4848228 - DNA, 18 bp, Homo sapiens
aggctgctcggctactgg

SEQ ID NO: 4848229 - DNA, 15 bp, Homo sapiens
aggctggaagtactt

SEQ ID NO: 4848230 - DNA, 22 bp, Homo sapiens
aggctgggcctcccctgggcag

SEQ ID NO: 4848231 - DNA, 15 bp, Homo sapiens
aggctggggacacag

SEQ ID NO: 4848232 - DNA, 18 bp, Homo sapiens
aggctttgggtggctcac

SEQ ID NO: 4848233 - DNA, 22 bp, Homo sapiens
aggctttgggtggctcactact

SEQ ID NO: 4848234 - DNA, 15 bp, Homo sapiens
agggaaagttttttt

SEQ ID NO: 4848235 - DNA, 14 bp, Homo sapiens
agggaagaactatt

SEQ ID NO: 4848236 - DNA, 17 bp, Homo sapiens
agggaagacctgaaaga

SEQ ID NO: 4848237 - DNA, 21 bp, Homo sapiens
agggaagacctgaaagagagg

SEQ ID NO: 4848238 - DNA, 21 bp, Homo sapiens
agggaagatgacctgccccaa

SEQ ID NO: 4848239 - DNA, 15 bp, Homo sapiens
agggaatctagccca

SEQ ID NO: 4848240 - DNA, 11 bp, Homo sapiens
agggacagcaa

SEQ ID NO: 4848241 - DNA, 17 bp, Homo sapiens
agggacagcaagtgagc

SEQ ID NO: 4848242 - DNA, 19 bp, Homo sapiens
agggacagcaagtgagcag

SEQ ID NO: 4848243 - DNA, 20 bp, Homo sapiens
agggacagcaagtgagcaga

SEQ ID NO: 4848244 - DNA, 16 bp, Homo sapiens
agggacataagataaa

SEQ ID NO: 4848245 - DNA, 13 bp, Homo sapiens
agggaccccagat

SEQ ID NO: 4848246 - DNA, 17 bp, Homo sapiens
agggactccaagccctg

SEQ ID NO: 4848247 - DNA, 17 bp, Homo sapiens
agggagcattgcagcct

SEQ ID NO: 4848248 - DNA, 14 bp, Homo sapiens
agggatgatgaggg

SEQ ID NO: 4848249 - DNA, 15 bp, Homo sapiens
agggatgatgaggga

SEQ ID NO: 4848250 - DNA, 20 bp, Homo sapiens
agggatgatgagggaagcaa

SEQ ID NO: 4848251 - DNA, 15 bp, Homo sapiens
agggatggagggaag

SEQ ID NO: 4848252 - DNA, 17 bp, Homo sapiens
agggcaaggggtgagga

SEQ ID NO: 4848253 - DNA, 17 bp, Homo sapiens
agggcaccgtattcctc

SEQ ID NO: 4848254 - DNA, 12 bp, Homo sapiens
agggcagcaggc

SEQ ID NO: 4848255 - DNA, 13 bp, Homo sapiens
agggcataaagta

SEQ ID NO: 4848256 - DNA, 19 bp, Homo sapiens
agggcctcagtctggagtg

SEQ ID NO: 4848257 - DNA, 21 bp, Homo sapiens
agggccttggaaattcctgta

SEQ ID NO: 4848258 - DNA, 23 bp, Homo sapiens
agggctcggggtgtgtcatttct

SEQ ID NO: 4848259 - DNA, 13 bp, Homo sapiens
agggctctccaag

SEQ ID NO: 4848260 - DNA, 14 bp, Homo sapiens
aggggagacgaggc

SEQ ID NO: 4848261 - DNA, 11 bp, Homo sapiens
aggggagccag

SEQ ID NO: 4848262 - DNA, 12 bp, Homo sapiens
aggggagccagc

SEQ ID NO: 4848263 - DNA, 20 bp, Homo sapiens
aggggaggtggccagcccgc

SEQ ID NO: 4848264 - DNA, 21 bp, Homo sapiens
aggggaggtggccagcccgca

SEQ ID NO: 4848265 - DNA, 19 bp, Homo sapiens
aggggccaacctcaggctc

SEQ ID NO: 4848266 - DNA, 22 bp, Homo sapiens
aggggccaacctcaggctccta

SEQ ID NO: 4848267 - DNA, 15 bp, Homo sapiens
aggggccatgtcctc

SEQ ID NO: 4848268 - DNA, 17 bp, Homo sapiens
aggggcctgggctgtga

SEQ ID NO: 4848269 - DNA, 20 bp, Homo sapiens
aggggcctgggctgtgagga

SEQ ID NO: 4848270 - DNA, 19 bp, Homo sapiens
aggggctaccctgggaagc

SEQ ID NO: 4848271 - DNA, 13 bp, Homo sapiens
aggggctctgtgg

SEQ ID NO: 4848272 - DNA, 21 bp, Homo sapiens
aggggctggtggagatgtagg

SEQ ID NO: 4848273 - DNA, 19 bp, Homo sapiens
aggggctgtggccgtctcc

SEQ ID NO: 4848274 - DNA, 14 bp, Homo sapiens
agggggctgctgct

SEQ ID NO: 4848275 - DNA, 17 bp, Homo sapiens
agggggtaaagcagttc

SEQ ID NO: 4848276 - DNA, 20 bp, Homo sapiens
agggggtttgctggggaact

SEQ ID NO: 4848277 - DNA, 21 bp, Homo sapiens
aggggtatcatgtatggtgat

SEQ ID NO: 4848278 - DNA, 19 bp, Homo sapiens
aggggttccttccacttct

SEQ ID NO: 4848279 - DNA, 18 bp, Homo sapiens
agggtagtggctggggtg

SEQ ID NO: 4848280 - DNA, 20 bp, Homo sapiens
agggtcttgggggtcagggg

SEQ ID NO: 4848281 - DNA, 18 bp, Homo sapiens
agggtgacaaggcctgct

SEQ ID NO: 4848282 - DNA, 17 bp, Homo sapiens
agggtgccctttggggt

SEQ ID NO: 4848283 - DNA, 21 bp, Homo sapiens
agggtgccctttggggtcccg

SEQ ID NO: 4848284 - DNA, 12 bp, Homo sapiens
agggtggggggt

SEQ ID NO: 4848285 - DNA, 23 bp, Homo sapiens
aggtaacactagggccttggaaa

SEQ ID NO: 4848286 - DNA, 22 bp, Homo sapiens
aggtagcactctcagagtgttt

SEQ ID NO: 4848287 - DNA, 21 bp, Homo sapiens
aggtatactttagtagacatt

SEQ ID NO: 4848288 - DNA, 20 bp, Homo sapiens
aggtattaaaactaaatttc

SEQ ID NO: 4848289 - DNA, 23 bp, Homo sapiens
aggtcacacgaggggccccgtgt

SEQ ID NO: 4848290 - DNA, 16 bp, Homo sapiens
aggtcatctgctggga

SEQ ID NO: 4848291 - DNA, 12 bp, Homo sapiens
aggtcctctcag

SEQ ID NO: 4848292 - DNA, 12 bp, Homo sapiens
aggtccttgccc

SEQ ID NO: 4848293 - DNA, 17 bp, Homo sapiens
aggtccttgccctttgt

SEQ ID NO: 4848294 - DNA, 19 bp, Homo sapiens
aggtctcctcagggtgggg

SEQ ID NO: 4848295 - DNA, 19 bp, Homo sapiens
aggtgaggtgaactccagg

SEQ ID NO: 4848296 - DNA, 22 bp, Homo sapiens
aggtgaggtgaactccaggcat

SEQ ID NO: 4848297 - DNA, 13 bp, Homo sapiens
aggtgcactccag

SEQ ID NO: 4848298 - DNA, 15 bp, Homo sapiens
aggtgcactccagac

SEQ ID NO: 4848299 - DNA, 16 bp, Homo sapiens
aggtgcactccagact

SEQ ID NO: 4848300 - DNA, 17 bp, Homo sapiens
aggtgcactccagactc

SEQ ID NO: 4848301 - DNA, 17 bp, Homo sapiens
aggtgcctaacctggga

SEQ ID NO: 4848302 - DNA, 17 bp, Homo sapiens
aggtgctaatttgtttt

SEQ ID NO: 4848303 - DNA, 14 bp, Homo sapiens
aggtgctcatgctg

SEQ ID NO: 4848304 - DNA, 16 bp, Homo sapiens
aggtgctcatgctgct

SEQ ID NO: 4848305 - DNA, 20 bp, Homo sapiens
aggtggatactggggggcag

SEQ ID NO: 4848306 - DNA, 22 bp, Homo sapiens
aggtggcactaccccaaaccca

SEQ ID NO: 4848307 - DNA, 15 bp, Homo sapiens
aggtggcctctgcct

SEQ ID NO: 4848308 - DNA, 14 bp, Homo sapiens
aggtggggtgctgg

SEQ ID NO: 4848309 - DNA, 21 bp, Homo sapiens
aggtgtattggtgttgcagcc

SEQ ID NO: 4848310 - DNA, 14 bp, Homo sapiens
aggtgtgaggagag

SEQ ID NO: 4848311 - DNA, 15 bp, Homo sapiens
aggtgtgaggagaga

SEQ ID NO: 4848312 - DNA, 21 bp, Homo sapiens
aggtgtgaggagagaggagga

SEQ ID NO: 4848313 - DNA, 17 bp, Homo sapiens
aggtgtttgtggggctg

SEQ ID NO: 4848314 - DNA, 16 bp, Homo sapiens
aggttaatatttaaga

SEQ ID NO: 4848315 - DNA, 16 bp, Homo sapiens
aggttattgcaataaa

SEQ ID NO: 4848316 - DNA, 19 bp, Homo sapiens
aggttctgtagagccaatt

SEQ ID NO: 4848317 - DNA, 15 bp, Homo sapiens
aggttgaataatata

SEQ ID NO: 4848318 - DNA, 16 bp, Homo sapiens
aggtttgaaggagaat

SEQ ID NO: 4848319 - DNA, 20 bp, Homo sapiens
aggtttgttttgtgaatttt

SEQ ID NO: 4848320 - DNA, 22 bp, Homo sapiens
aggttttccaaaagtaaagatg

SEQ ID NO: 4848321 - DNA, 18 bp, Homo sapiens
aggtttttttccttctga

SEQ ID NO: 4848322 - DNA, 20 bp, Homo sapiens
agtaaaatactattgcctca

SEQ ID NO: 4848323 - DNA, 12 bp, Homo sapiens
agtaaaattcag

SEQ ID NO: 4848324 - DNA, 14 bp, Homo sapiens
agtaagatatctca

SEQ ID NO: 4848325 - DNA, 12 bp, Homo sapiens
agtaagcagtgt

SEQ ID NO: 4848326 - DNA, 21 bp, Homo sapiens
agtaagcagtgttacttgcag

SEQ ID NO: 4848327 - DNA, 14 bp, Homo sapiens
agtaagtgcgaaga

SEQ ID NO: 4848328 - DNA, 20 bp, Homo sapiens
agtaagttatctttgaatat

SEQ ID NO: 4848329 - DNA, 15 bp, Homo sapiens
agtaatgaaatggag

SEQ ID NO: 4848330 - DNA, 16 bp, Homo sapiens
agtaatgctaaatgtg

SEQ ID NO: 4848331 - DNA, 17 bp, Homo sapiens
agtaatgctaaatgtgt

SEQ ID NO: 4848332 - DNA, 19 bp, Homo sapiens
agtaatgctaaatgtgtaa

SEQ ID NO: 4848333 - DNA, 19 bp, Homo sapiens
agtaatgtgactaaaggaa

SEQ ID NO: 4848334 - DNA, 12 bp, Homo sapiens
agtacagaattt

SEQ ID NO: 4848335 - DNA, 14 bp, Homo sapiens
agtacagaatttga

SEQ ID NO: 4848336 - DNA, 14 bp, Homo sapiens
agtacagggcagaa

SEQ ID NO: 4848337 - DNA, 19 bp, Homo sapiens
agtacatttaaattttttg

SEQ ID NO: 4848338 - DNA, 23 bp, Homo sapiens
agtacttggcccccttcaggagc

SEQ ID NO: 4848339 - DNA, 14 bp, Homo sapiens
agtagacatttata

SEQ ID NO: 4848340 - DNA, 16 bp, Homo sapiens
agtagatccatttcca

SEQ ID NO: 4848341 - DNA, 23 bp, Homo sapiens
agtagatccatttccattgctta

SEQ ID NO: 4848342 - DNA, 15 bp, Homo sapiens
agtagatctatatta

SEQ ID NO: 4848343 - DNA, 20 bp, Homo sapiens
agtagatgtggcctttgaat

SEQ ID NO: 4848344 - DNA, 21 bp, Homo sapiens
agtagatgtggcctttgaatt

SEQ ID NO: 4848345 - DNA, 14 bp, Homo sapiens
agtaggctgggcct

SEQ ID NO: 4848346 - DNA, 22 bp, Homo sapiens
agtataaaatagtatgaaaatg

SEQ ID NO: 4848347 - DNA, 17 bp, Homo sapiens
atatgaaagctgatttt

SEQ ID NO: 4848348 - DNA, 14 bp, Homo sapiens
atatgccttgtata

SEQ ID NO: 4848349 - DNA, 19 bp, Homo sapiens
atatgctttattaatgttt

SEQ ID NO: 4848350 - DNA, 16 bp, Homo sapiens
atatggaagaaagtaa

SEQ ID NO: 4848351 - DNA, 15 bp, Homo sapiens
atatggtaggaccct

SEQ ID NO: 4848352 - DNA, 13 bp, Homo sapiens
atatgtattcttt

SEQ ID NO: 4848353 - DNA, 23 bp, Homo sapiens
atatgtattttttgaatctatga

SEQ ID NO: 4848354 - DNA, 24 bp, Homo sapiens
atattaaaaaacttcatgtaattt

SEQ ID NO: 4848355 - DNA, 21 bp, Homo sapiens
atattaaaattccaaattcat

SEQ ID NO: 4848356 - DNA, 20 bp, Homo sapiens
atattaaacaaagtttcaga

SEQ ID NO: 4848357 - DNA, 22 bp, Homo sapiens
atattaaacaaagtttcagagt

SEQ ID NO: 4848358 - DNA, 13 bp, Homo sapiens
atattaaataaca

SEQ ID NO: 4848359 - DNA, 17 bp, Homo sapiens
atattacccaatggaaa

SEQ ID NO: 4848360 - DNA, 12 bp, Homo sapiens
atattcctccag

SEQ ID NO: 4848361 - DNA, 15 bp, Homo sapiens
atattcctccagctg

SEQ ID NO: 4848362 - DNA, 23 bp, Homo sapiens
atattctttagcttacctgggca

SEQ ID NO: 4848363 - DNA, 16 bp, Homo sapiens
atattgaaaattgaaa

SEQ ID NO: 4848364 - DNA, 21 bp, Homo sapiens
atattgaaaattgaaaagtac

SEQ ID NO: 4848365 - DNA, 23 bp, Homo sapiens
atattgaaaattgaaaagtacaa

SEQ ID NO: 4848366 - DNA, 15 bp, Homo sapiens
atattgacttgtata

SEQ ID NO: 4848367 - DNA, 19 bp, Homo sapiens
atattgattgggaaaacat

SEQ ID NO: 4848368 - DNA, 16 bp, Homo sapiens
atattgtttggtaaat

SEQ ID NO: 4848369 - DNA, 21 bp, Homo sapiens
atattgtttggtaaatgtttc

SEQ ID NO: 4848370 - DNA, 15 bp, Homo sapiens
atatttatatattta

SEQ ID NO: 4848371 - DNA, 18 bp, Homo sapiens
atatttcaataaatgata

SEQ ID NO: 4848372 - DNA, 21 bp, Homo sapiens
atattttcctagtagatctat

SEQ ID NO: 4848373 - DNA, 19 bp, Homo sapiens
atattttgaaatgaacttt

SEQ ID NO: 4848374 - DNA, 15 bp, Homo sapiens
atatttttttaactg

SEQ ID NO: 4848375 - DNA, 19 bp, Homo sapiens
atcaaagccggcctgagaa

SEQ ID NO: 4848376 - DNA, 23 bp, Homo sapiens
atcaaagccggcctgagaaacac

SEQ ID NO: 4848377 - DNA, 19 bp, Homo sapiens
atcaaagtcattaaagaca

SEQ ID NO: 4848378 - DNA, 22 bp, Homo sapiens
atcaaagtcattaaagacagga

SEQ ID NO: 4848379 - DNA, 17 bp, Homo sapiens
atcaaattctgtctggg

SEQ ID NO: 4848380 - DNA, 23 bp, Homo sapiens
atcaaccacctatttttgacatg

SEQ ID NO: 4848381 - DNA, 17 bp, Homo sapiens
atcaatagttgaattag

SEQ ID NO: 4848382 - DNA, 14 bp, Homo sapiens
atcacaaagtggaa

SEQ ID NO: 4848383 - DNA, 12 bp, Homo sapiens
atcacagggaat

SEQ ID NO: 4848384 - DNA, 19 bp, Homo sapiens
atcacagggaatggccaca

SEQ ID NO: 4848385 - DNA, 12 bp, Homo sapiens
atcactggactg

SEQ ID NO: 4848386 - DNA, 18 bp, Homo sapiens
atcactgtatcattttct

SEQ ID NO: 4848387 - DNA, 15 bp, Homo sapiens
atcagaactcttcct

SEQ ID NO: 4848388 - DNA, 20 bp, Homo sapiens
atcagcaggatgtgtgggcc

SEQ ID NO: 4848389 - DNA, 15 bp, Homo sapiens
atcagtaaccccctt

SEQ ID NO: 4848390 - DNA, 19 bp, Homo sapiens
atcagtaacccccttaaat

SEQ ID NO: 4848391 - DNA, 15 bp, Homo sapiens
atcagtaatatttat

SEQ ID NO: 4848392 - DNA, 19 bp, Homo sapiens
atcatatggtaggaccctc

SEQ ID NO: 4848393 - DNA, 23 bp, Homo sapiens
atcatatggtaggaccctcgaga

SEQ ID NO: 4848394 - DNA, 13 bp, Homo sapiens
atcatctcttcct

SEQ ID NO: 4848395 - DNA, 20 bp, Homo sapiens
atcatgaggccggatgaaac

SEQ ID NO: 4848396 - DNA, 19 bp, Homo sapiens
atcatgccagtatttttaa

SEQ ID NO: 4848397 - DNA, 12 bp, Homo sapiens
atcattcagaaa

SEQ ID NO: 4848398 - DNA, 14 bp, Homo sapiens
atcattcagaaatg

SEQ ID NO: 4848399 - DNA, 22 bp, Homo sapiens
atccaaatttttttttaaagca

SEQ ID NO: 4848400 - DNA, 14 bp, Homo sapiens
atccagggcagcag

SEQ ID NO: 4848401 - DNA, 20 bp, Homo sapiens
atccagggcagcaggccaga

SEQ ID NO: 4848402 - DNA, 14 bp, Homo sapiens
atccatccctccat

SEQ ID NO: 4848403 - DNA, 10 bp, Homo sapiens
atccatcctg

SEQ ID NO: 4848404 - DNA, 16 bp, Homo sapiens
atccatcctgagccaa

SEQ ID NO: 4848405 - DNA, 15 bp, Homo sapiens
atccattacctccat

SEQ ID NO: 4848406 - DNA, 23 bp, Homo sapiens
atcccagaggtgggatcctccct

SEQ ID NO: 4848407 - DNA, 20 bp, Homo sapiens
atccccctctttgcacagca

SEQ ID NO: 4848408 - DNA, 13 bp, Homo sapiens
atcccctaaaata

SEQ ID NO: 4848409 - DNA, 16 bp, Homo sapiens
atcccgttcagaaaac

SEQ ID NO: 4848410 - DNA, 14 bp, Homo sapiens
atccctacatgtat

SEQ ID NO: 4848411 - DNA, 18 bp, Homo sapiens
atccctacatgtattgca

SEQ ID NO: 4848412 - DNA, 17 bp, Homo sapiens
atccctcacctgtagca

SEQ ID NO: 4848413 - DNA, 15 bp, Homo sapiens
atccctgaggactga

SEQ ID NO: 4848414 - DNA, 20 bp, Homo sapiens
atcccttggacattttatgt

SEQ ID NO: 4848415 - DNA, 13 bp, Homo sapiens
atccggaaagaag

SEQ ID NO: 4848416 - DNA, 14 bp, Homo sapiens
atcctagactgctc

SEQ ID NO: 4848417 - DNA, 20 bp, Homo sapiens
atcctagactgctcctgggc

SEQ ID NO: 4848418 - DNA, 21 bp, Homo sapiens
atcctagactgctcctgggca

SEQ ID NO: 4848419 - DNA, 14 bp, Homo sapiens
atcctaggaaccag

SEQ ID NO: 4848420 - DNA, 20 bp, Homo sapiens
atcctccttctcctgttcca

SEQ ID NO: 4848421 - DNA, 12 bp, Homo sapiens
atcctgagccaa

SEQ ID NO: 4848422 - DNA, 18 bp, Homo sapiens
atcctgggcatccttctt

SEQ ID NO: 4848423 - DNA, 22 bp, Homo sapiens
atcctgtgagtaggctgggcct

SEQ ID NO: 4848424 - DNA, 21 bp, Homo sapiens
atccttgagattctgaagtat

SEQ ID NO: 4848425 - DNA, 12 bp, Homo sapiens
atccttggcagt

SEQ ID NO: 4848426 - DNA, 11 bp, Homo sapiens
atcgagtgtag

SEQ ID NO: 4848427 - DNA, 16 bp, Homo sapiens
atcgagtgtagctgtg

SEQ ID NO: 4848428 - DNA, 19 bp, Homo sapiens
atcgagtgtagctgtgaaa

SEQ ID NO: 4848429 - DNA, 16 bp, Homo sapiens
atcgtattaaaaaaca

SEQ ID NO: 4848430 - DNA, 14 bp, Homo sapiens
atcgtttttgtatt

SEQ ID NO: 4848431 - DNA, 13 bp, Homo sapiens
atctaagtgatat

SEQ ID NO: 4848432 - DNA, 17 bp, Homo sapiens
atctaagtgatataaat

SEQ ID NO: 4848433 - DNA, 13 bp, Homo sapiens
atctaattctgat

SEQ ID NO: 4848434 - DNA, 14 bp, Homo sapiens
atctacaatctctt

SEQ ID NO: 4848435 - DNA, 19 bp, Homo sapiens
atctacaatctctttttgt

SEQ ID NO: 4848436 - DNA, 16 bp, Homo sapiens
atctatctagttctaa

SEQ ID NO: 4848437 - DNA, 15 bp, Homo sapiens
atctatgaacctgaa

SEQ ID NO: 4848438 - DNA, 20 bp, Homo sapiens
atctcaaataggctattaaa

SEQ ID NO: 4848439 - DNA, 16 bp, Homo sapiens
atctcagtggtgtgtg

SEQ ID NO: 4848440 - DNA, 18 bp, Homo sapiens
atctcagtggtgtgtgaa

SEQ ID NO: 4848441 - DNA, 16 bp, Homo sapiens
atctcattgcttacaa

SEQ ID NO: 4848442 - DNA, 19 bp, Homo sapiens
atctccacaggagagactg

SEQ ID NO: 4848443 - DNA, 20 bp, Homo sapiens
atctccacaggagagactgg

SEQ ID NO: 4848444 - DNA, 15 bp, Homo sapiens
atctcctttgaagaa

SEQ ID NO: 4848445 - DNA, 18 bp, Homo sapiens
atctcctttgaagaaggc

SEQ ID NO: 4848446 - DNA, 19 bp, Homo sapiens
atctcctttgaagaaggca

SEQ ID NO: 4848447 - DNA, 20 bp, Homo sapiens
atctcctttgaagaaggcaa

SEQ ID NO: 4848448 - DNA, 16 bp, Homo sapiens
atctctttttgtttgc

SEQ ID NO: 4848449 - DNA, 14 bp, Homo sapiens
atctgaaaggccag

SEQ ID NO: 4848450 - DNA, 19 bp, Homo sapiens
atctgaaaggccagcagct

SEQ ID NO: 4848451 - DNA, 13 bp, Homo sapiens
atctgaacattct

SEQ ID NO: 4848452 - DNA, 15 bp, Homo sapiens
atctgaagagtggaa

SEQ ID NO: 4848453 - DNA, 20 bp, Homo sapiens
atctggaccccaaagaatag

SEQ ID NO: 4848454 - DNA, 20 bp, Homo sapiens
atctggatgcctcattatgt

SEQ ID NO: 4848455 - DNA, 14 bp, Homo sapiens
atctgtacaaaatg

SEQ ID NO: 4848456 - DNA, 18 bp, Homo sapiens
atctgtataccctctgtt

SEQ ID NO: 4848457 - DNA, 23 bp, Homo sapiens
atctgttagcagagtctgtctct

SEQ ID NO: 4848458 - DNA, 24 bp, Homo sapiens
atcttataaagtggaagtatgtat

SEQ ID NO: 4848459 - DNA, 18 bp, Homo sapiens
atcttcaaagccttctcc

SEQ ID NO: 4848460 - DNA, 14 bp, Homo sapiens
atcttcccatgcat

SEQ ID NO: 4848461 - DNA, 12 bp, Homo sapiens
atcttctttctt

SEQ ID NO: 4848462 - DNA, 18 bp, Homo sapiens
atcttctttcttccaccc

SEQ ID NO: 4848463 - DNA, 14 bp, Homo sapiens
atcttgttcaggaa

SEQ ID NO: 4848464 - DNA, 15 bp, Homo sapiens
atctttattgaaatt

SEQ ID NO: 4848465 - DNA, 12 bp, Homo sapiens
atctttcagaaa

SEQ ID NO: 4848466 - DNA, 17 bp, Homo sapiens
atctttgtaccaaaatt

SEQ ID NO: 4848467 - DNA, 18 bp, Homo sapiens
attctatgttaatatttt

SEQ ID NO: 4848468 - DNA, 14 bp, Homo sapiens
attctattctccag

SEQ ID NO: 4848469 - DNA, 17 bp, Homo sapiens
attctattctccagaca

SEQ ID NO: 4848470 - DNA, 16 bp, Homo sapiens
attctccagacatgga

SEQ ID NO: 4848471 - DNA, 16 bp, Homo sapiens
attctctagatttatt

SEQ ID NO: 4848472 - DNA, 18 bp, Homo sapiens
attctgaaccctccaaag

SEQ ID NO: 4848473 - DNA, 22 bp, Homo sapiens
attctgattctggctttaagcc

SEQ ID NO: 4848474 - DNA, 22 bp, Homo sapiens
attctggggaaacaacatttat

SEQ ID NO: 4848475 - DNA, 23 bp, Homo sapiens
attcttaaaaggcccatagcagc

SEQ ID NO: 4848476 - DNA, 13 bp, Homo sapiens
attcttactaaaa

SEQ ID NO: 4848477 - DNA, 17 bp, Homo sapiens
attcttactaaaaagta

SEQ ID NO: 4848478 - DNA, 22 bp, Homo sapiens
attcttactaaaaagtataaaa

SEQ ID NO: 4848479 - DNA, 19 bp, Homo sapiens
attcttgtgggagacagca

SEQ ID NO: 4848480 - DNA, 21 bp, Homo sapiens
attcttgttgctgtacaaaag

SEQ ID NO: 4848481 - DNA, 17 bp, Homo sapiens
attctttcagttctttg

SEQ ID NO: 4848482 - DNA, 19 bp, Homo sapiens
attctttgcaatactgctt

SEQ ID NO: 4848483 - DNA, 21 bp, Homo sapiens
attctttggagttaaaatgca

SEQ ID NO: 4848484 - DNA, 20 bp, Homo sapiens
attgaaaattaaggaaatgt

SEQ ID NO: 4848485 - DNA, 19 bp, Homo sapiens
attgactaactcaaataca

SEQ ID NO: 4848486 - DNA, 19 bp, Homo sapiens
attgactcttatttataga

SEQ ID NO: 4848487 - DNA, 20 bp, Homo sapiens
attgagtacctactgtgtgc

SEQ ID NO: 4848488 - DNA, 15 bp, Homo sapiens
attgagtattgttta

SEQ ID NO: 4848489 - DNA, 20 bp, Homo sapiens
attgagtattgtttaaaatg

SEQ ID NO: 4848490 - DNA, 21 bp, Homo sapiens
attgagtattgtttaaaatgt

SEQ ID NO: 4848491 - DNA, 19 bp, Homo sapiens
attgataaccttgaaaaaa

SEQ ID NO: 4848492 - DNA, 13 bp, Homo sapiens
attgatgttttca

SEQ ID NO: 4848493 - DNA, 18 bp, Homo sapiens
attgattgggaaaacatt

SEQ ID NO: 4848494 - DNA, 21 bp, Homo sapiens
attgattgggaaaacatttgc

SEQ ID NO: 4848495 - DNA, 16 bp, Homo sapiens
attgcaataaagtata

SEQ ID NO: 4848496 - DNA, 17 bp, Homo sapiens
attgcaataaagtataa

SEQ ID NO: 4848497 - DNA, 14 bp, Homo sapiens
attgcatcactgta

SEQ ID NO: 4848498 - DNA, 15 bp, Homo sapiens
attgcatcactgtat

SEQ ID NO: 4848499 - DNA, 13 bp, Homo sapiens
attgcatccacta

SEQ ID NO: 4848500 - DNA, 13 bp, Homo sapiens
attgcctctgaaa

SEQ ID NO: 4848501 - DNA, 17 bp, Homo sapiens
attgctctggagcagcc

SEQ ID NO: 4848502 - DNA, 20 bp, Homo sapiens
attgctgataccatatgaat

SEQ ID NO: 4848503 - DNA, 21 bp, Homo sapiens
attgcttacaagcctaagaat

SEQ ID NO: 4848504 - DNA, 23 bp, Homo sapiens
attgcttttttccaaaacaaaaa

SEQ ID NO: 4848505 - DNA, 16 bp, Homo sapiens
attggacctgcccaca

SEQ ID NO: 4848506 - DNA, 18 bp, Homo sapiens
attggcattctttgcaat

SEQ ID NO: 4848507 - DNA, 12 bp, Homo sapiens
attggccaatta

SEQ ID NO: 4848508 - DNA, 17 bp, Homo sapiens
attggggggtgggcttt

SEQ ID NO: 4848509 - DNA, 13 bp, Homo sapiens
attggggtagttg

SEQ ID NO: 4848510 - DNA, 15 bp, Homo sapiens
attggtgttgcagcc

SEQ ID NO: 4848511 - DNA, 15 bp, Homo sapiens
attgtaaaaatggca

SEQ ID NO: 4848512 - DNA, 15 bp, Homo sapiens
attgtaatctatgtt

SEQ ID NO: 4848513 - DNA, 22 bp, Homo sapiens
attgtgcccctaaagagcatcc

SEQ ID NO: 4848514 - DNA, 12 bp, Homo sapiens
attgtgtggaat

SEQ ID NO: 4848515 - DNA, 12 bp, Homo sapiens
attgtgtttcta

SEQ ID NO: 4848516 - DNA, 22 bp, Homo sapiens
attgtgtttctaccggagagag

SEQ ID NO: 4848517 - DNA, 15 bp, Homo sapiens
atttaagacactgaa

SEQ ID NO: 4848518 - DNA, 14 bp, Homo sapiens
atttaatatatata

SEQ ID NO: 4848519 - DNA, 22 bp, Homo sapiens
atttaatggcagctagtgcctt

SEQ ID NO: 4848520 - DNA, 14 bp, Homo sapiens
atttactgatgaga

SEQ ID NO: 4848521 - DNA, 17 bp, Homo sapiens
atttactgatgagagaa

SEQ ID NO: 4848522 - DNA, 15 bp, Homo sapiens
atttagaagaaagat

SEQ ID NO: 4848523 - DNA, 14 bp, Homo sapiens
atttagtcatgtga

SEQ ID NO: 4848524 - DNA, 18 bp, Homo sapiens
atttatagaatttaatat

SEQ ID NO: 4848525 - DNA, 19 bp, Homo sapiens
atttatatttttaaaatat

SEQ ID NO: 4848526 - DNA, 14 bp, Homo sapiens
atttattcattagt

SEQ ID NO: 4848527 - DNA, 13 bp, Homo sapiens
atttattccccag

SEQ ID NO: 4848528 - DNA, 17 bp, Homo sapiens
atttattccccagtgac

SEQ ID NO: 4848529 - DNA, 15 bp, Homo sapiens
atttattgaaatgat

SEQ ID NO: 4848530 - DNA, 22 bp, Homo sapiens
atttattgagtacctactgtgt

SEQ ID NO: 4848531 - DNA, 19 bp, Homo sapiens
atttcaggactctctccag

SEQ ID NO: 4848532 - DNA, 20 bp, Homo sapiens
atttcaggactctctccagg

SEQ ID NO: 4848533 - DNA, 17 bp, Homo sapiens
atttcagtgtaaagtgt

SEQ ID NO: 4848534 - DNA, 23 bp, Homo sapiens
atttcatactgtaacattcagga

SEQ ID NO: 4848535 - DNA, 15 bp, Homo sapiens
atttcatgattagaa

SEQ ID NO: 4848536 - DNA, 13 bp, Homo sapiens
atttcattcctcg

SEQ ID NO: 4848537 - DNA, 13 bp, Homo sapiens
atttcctgtgagg

SEQ ID NO: 4848538 - DNA, 15 bp, Homo sapiens
atttcctgtgaggat

SEQ ID NO: 4848539 - DNA, 16 bp, Homo sapiens
atttccttcaggcagc

SEQ ID NO: 4848540 - DNA, 19 bp, Homo sapiens
atttctatattcctccagc

SEQ ID NO: 4848541 - DNA, 15 bp, Homo sapiens
atttctcatgttgaa

SEQ ID NO: 4848542 - DNA, 20 bp, Homo sapiens
atttctgaaggtagcattct

SEQ ID NO: 4848543 - DNA, 16 bp, Homo sapiens
atttctttgcattcca

SEQ ID NO: 4848544 - DNA, 14 bp, Homo sapiens
atttgaaaaatata

SEQ ID NO: 4848545 - DNA, 15 bp, Homo sapiens
atttgaaaaatataa

SEQ ID NO: 4848546 - DNA, 23 bp, Homo sapiens
atttgaaggtagaatgttttcaa

SEQ ID NO: 4848547 - DNA, 18 bp, Homo sapiens
atttgattgggatgaatg

SEQ ID NO: 4848548 - DNA, 14 bp, Homo sapiens
atttgccaatcttt

SEQ ID NO: 4848549 - DNA, 16 bp, Homo sapiens
atttgccagaggacca

SEQ ID NO: 4848550 - DNA, 13 bp, Homo sapiens
atttgcctatttc

SEQ ID NO: 4848551 - DNA, 20 bp, Homo sapiens
atttggatttaaaagcctgc

SEQ ID NO: 4848552 - DNA, 15 bp, Homo sapiens
atttggggtgatttc

SEQ ID NO: 4848553 - DNA, 16 bp, Homo sapiens
atttgtatatgactgc

SEQ ID NO: 4848554 - DNA, 21 bp, Homo sapiens
atttgtatatgactgcatttg

SEQ ID NO: 4848555 - DNA, 16 bp, Homo sapiens
atttgtatatggtatt

SEQ ID NO: 4848556 - DNA, 20 bp, Homo sapiens
atttgtcgggttctcccatg

SEQ ID NO: 4848557 - DNA, 21 bp, Homo sapiens
atttgtcgggttctcccatga

SEQ ID NO: 4848558 - DNA, 13 bp, Homo sapiens
atttgtgactttt

SEQ ID NO: 4848559 - DNA, 15 bp, Homo sapiens
atttgtgacttttta

SEQ ID NO: 4848560 - DNA, 17 bp, Homo sapiens
attttaaagtgcaaaag

SEQ ID NO: 4848561 - DNA, 21 bp, Homo sapiens
attttaactaaattttaaagc

SEQ ID NO: 4848562 - DNA, 22 bp, Homo sapiens
attttacctagctaattattta

SEQ ID NO: 4848563 - DNA, 20 bp, Homo sapiens
attttagaaataataaaaag

SEQ ID NO: 4848564 - DNA, 13 bp, Homo sapiens
attttatgtcttt

SEQ ID NO: 4848565 - DNA, 15 bp, Homo sapiens
attttatttacagct

SEQ ID NO: 4848566 - DNA, 22 bp, Homo sapiens
attttcacttttggcaatgact

SEQ ID NO: 4848567 - DNA, 16 bp, Homo sapiens
attttcatagatgtgt

SEQ ID NO: 4848568 - DNA, 18 bp, Homo sapiens
attttcatattgtaatct

SEQ ID NO: 4848569 - DNA, 14 bp, Homo sapiens
attttcatgaaaat

SEQ ID NO: 4848570 - DNA, 17 bp, Homo sapiens
attttcatgaaaatacc

SEQ ID NO: 4848571 - DNA, 20 bp, Homo sapiens
attttcatgaaaataccatt

SEQ ID NO: 4848572 - DNA, 21 bp, Homo sapiens
attttcatgaaaataccattt

SEQ ID NO: 4848573 - DNA, 17 bp, Homo sapiens
attttcatgaatgtgct

SEQ ID NO: 4848574 - DNA, 17 bp, Homo sapiens
attttgaaatgaacttt

SEQ ID NO: 4848575 - DNA, 12 bp, Homo sapiens
attttgatattg

SEQ ID NO: 4848576 - DNA, 22 bp, Homo sapiens
attttgcttcccatctgaagag

SEQ ID NO: 4848577 - DNA, 21 bp, Homo sapiens
attttggcgaatctcaaaatt

SEQ ID NO: 4848578 - DNA, 21 bp, Homo sapiens
attttgttcaagtttgctgca

SEQ ID NO: 4848579 - DNA, 12 bp, Homo sapiens
atttttaactgt

SEQ ID NO: 4848580 - DNA, 21 bp, Homo sapiens
atttttataattgtacaaaat

SEQ ID NO: 4848581 - DNA, 18 bp, Homo sapiens
atttttgacatggaaatg

SEQ ID NO: 4848582 - DNA, 13 bp, Homo sapiens
atttttgccctgc

SEQ ID NO: 4848583 - DNA, 16 bp, Homo sapiens
attttttaagaaaaaa

SEQ ID NO: 4848584 - DNA, 13 bp, Homo sapiens
attttttgaaagt

SEQ ID NO: 4848585 - DNA, 11 bp, Homo sapiens
attttttgaat

SEQ ID NO: 4848586 - DNA, 15 bp, Homo sapiens
atttttttaaaattt

SEQ ID NO: 4848587 - DNA, 21 bp, Homo sapiens
cacttgaaacctttttttatc

SEQ ID NO: 4848588 - DNA, 15 bp, Homo sapiens
cactttcataatctt

SEQ ID NO: 4848589 - DNA, 22 bp, Homo sapiens
cactttgcactgatatatcatg

SEQ ID NO: 4848590 - DNA, 17 bp, Homo sapiens
cagaaaattccctgggg

SEQ ID NO: 4848591 - DNA, 19 bp, Homo sapiens
cagaaaccaacaagaacca

SEQ ID NO: 4848592 - DNA, 16 bp, Homo sapiens
cagaaaccctgagcag

SEQ ID NO: 4848593 - DNA, 21 bp, Homo sapiens
cagaaagcttcatccacagcc

SEQ ID NO: 4848594 - DNA, 21 bp, Homo sapiens
cagaaatagacaaaaagtata

SEQ ID NO: 4848595 - DNA, 21 bp, Homo sapiens
cagaaatataacacatttttt

SEQ ID NO: 4848596 - DNA, 22 bp, Homo sapiens
cagaaccacacttgaaaccttt

SEQ ID NO: 4848597 - DNA, 19 bp, Homo sapiens
cagaacctctaagtgctgc

SEQ ID NO: 4848598 - DNA, 22 bp, Homo sapiens
cagaacctctaagtgctgctgt

SEQ ID NO: 4848599 - DNA, 24 bp, Homo sapiens
cagaacctctaagtgctgctgtgg

SEQ ID NO: 4848600 - DNA, 17 bp, Homo sapiens
cagaactcttcctcctc

SEQ ID NO: 4848601 - DNA, 23 bp, Homo sapiens
cagaagaatcttcctggcacaat

SEQ ID NO: 4848602 - DNA, 16 bp, Homo sapiens
cagaaggatgcccaga

SEQ ID NO: 4848603 - DNA, 14 bp, Homo sapiens
cagaaggtgaactt

SEQ ID NO: 4848604 - DNA, 20 bp, Homo sapiens
cagaagtcacacattacaaa

SEQ ID NO: 4848605 - DNA, 22 bp, Homo sapiens
cagaattaagaaatactcatgt

SEQ ID NO: 4848606 - DNA, 18 bp, Homo sapiens
cagaatttttaactgtac

SEQ ID NO: 4848607 - DNA, 15 bp, Homo sapiens
cagacaattccattc

SEQ ID NO: 4848608 - DNA, 16 bp, Homo sapiens
cagacagccctggcaa

SEQ ID NO: 4848609 - DNA, 16 bp, Homo sapiens
cagacagcttacagga

SEQ ID NO: 4848610 - DNA, 17 bp, Homo sapiens
cagacagcttacaggag

SEQ ID NO: 4848611 - DNA, 19 bp, Homo sapiens
cagacagcttacaggagcc

SEQ ID NO: 4848612 - DNA, 20 bp, Homo sapiens
cagacagcttacaggagcca

SEQ ID NO: 4848613 - DNA, 16 bp, Homo sapiens
cagaccagagctgtct

SEQ ID NO: 4848614 - DNA, 18 bp, Homo sapiens
cagaccagagctgtctga

SEQ ID NO: 4848615 - DNA, 22 bp, Homo sapiens
cagaccagagctgtctgaactc

SEQ ID NO: 4848616 - DNA, 13 bp, Homo sapiens
cagacctggagct

SEQ ID NO: 4848617 - DNA, 21 bp, Homo sapiens
cagacctggagcttcagccag

SEQ ID NO: 4848618 - DNA, 17 bp, Homo sapiens
cagactcagcagagtga

SEQ ID NO: 4848619 - DNA, 19 bp, Homo sapiens
cagactgggcactggggcc

SEQ ID NO: 4848620 - DNA, 15 bp, Homo sapiens
cagagaaagcaaagg

SEQ ID NO: 4848621 - DNA, 20 bp, Homo sapiens
cagagaaatctaagctgtgt

SEQ ID NO: 4848622 - DNA, 20 bp, Homo sapiens
cagagaaatgccccagtgtt

SEQ ID NO: 4848623 - DNA, 22 bp, Homo sapiens
cagagacactgttgataaaaac

SEQ ID NO: 4848624 - DNA, 17 bp, Homo sapiens
cagagaccataagagaa

SEQ ID NO: 4848625 - DNA, 22 bp, Homo sapiens
cagagagggaaaaggcaggtgc

SEQ ID NO: 4848626 - DNA, 13 bp, Homo sapiens
cagagagggaaga

SEQ ID NO: 4848627 - DNA, 20 bp, Homo sapiens
cagagaggtagcactctcag

SEQ ID NO: 4848628 - DNA, 21 bp, Homo sapiens
cagagaggtagcactctcaga

SEQ ID NO: 4848629 - DNA, 17 bp, Homo sapiens
cagagatgcctgatttc

SEQ ID NO: 4848630 - DNA, 20 bp, Homo sapiens
cagagatgcctgatttcatt

SEQ ID NO: 4848631 - DNA, 16 bp, Homo sapiens
cagagatttctcattg

SEQ ID NO: 4848632 - DNA, 19 bp, Homo sapiens
cagagcaggacctgggaca

SEQ ID NO: 4848633 - DNA, 18 bp, Homo sapiens
cagagcctttttacctgg

SEQ ID NO: 4848634 - DNA, 15 bp, Homo sapiens
cagagcttgtggtgg

SEQ ID NO: 4848635 - DNA, 13 bp, Homo sapiens
cagaggcacctca

SEQ ID NO: 4848636 - DNA, 16 bp, Homo sapiens
cagaggtggatactgg

SEQ ID NO: 4848637 - DNA, 19 bp, Homo sapiens
cagaggtgggatcctccct

SEQ ID NO: 4848638 - DNA, 20 bp, Homo sapiens
cagaggtgggatcctccctc

SEQ ID NO: 4848639 - DNA, 17 bp, Homo sapiens
cagaggtggggtgctgg

SEQ ID NO: 4848640 - DNA, 17 bp, Homo sapiens
cagaggtttgaaggaga

SEQ ID NO: 4848641 - DNA, 13 bp, Homo sapiens
cagagtcctggag

SEQ ID NO: 4848642 - DNA, 20 bp, Homo sapiens
cagagtctgtatttttctaa

SEQ ID NO: 4848643 - DNA, 14 bp, Homo sapiens
cagagtctgtctct

SEQ ID NO: 4848644 - DNA, 20 bp, Homo sapiens
cagagtgagggggtaaagca

SEQ ID NO: 4848645 - DNA, 15 bp, Homo sapiens
cagagtgggctttgg

SEQ ID NO: 4848646 - DNA, 14 bp, Homo sapiens
cagagttttcatta

SEQ ID NO: 4848647 - DNA, 17 bp, Homo sapiens
cagagttttcattaaat

SEQ ID NO: 4848648 - DNA, 15 bp, Homo sapiens
cagatacctgtgagg

SEQ ID NO: 4848649 - DNA, 18 bp, Homo sapiens
cagatacctgtgaggact

SEQ ID NO: 4848650 - DNA, 19 bp, Homo sapiens
cagataccttatcttacaa

SEQ ID NO: 4848651 - DNA, 22 bp, Homo sapiens
cagataccttatcttacaatat

SEQ ID NO: 4848652 - DNA, 23 bp, Homo sapiens
cagataccttatcttacaatatt

SEQ ID NO: 4848653 - DNA, 20 bp, Homo sapiens
cagatcatatggtaggaccc

SEQ ID NO: 4848654 - DNA, 17 bp, Homo sapiens
cagatctttcagaaata

SEQ ID NO: 4848655 - DNA, 23 bp, Homo sapiens
cagatgacagaggtttgaaggag

SEQ ID NO: 4848656 - DNA, 18 bp, Homo sapiens
cagatgaggcaaacagca

SEQ ID NO: 4848657 - DNA, 15 bp, Homo sapiens
cagatgagggctggc

SEQ ID NO: 4848658 - DNA, 18 bp, Homo sapiens
cagatgatgctttggaag

SEQ ID NO: 4848659 - DNA, 19 bp, Homo sapiens
cagatgatgctttggaaga

SEQ ID NO: 4848660 - DNA, 22 bp, Homo sapiens
cagatgcttgcggcaaaaggaa

SEQ ID NO: 4848661 - DNA, 23 bp, Homo sapiens
cagatgcttgcggcaaaaggaaa

SEQ ID NO: 4848662 - DNA, 23 bp, Homo sapiens
cagatgggggcctctctggaaga

SEQ ID NO: 4848663 - DNA, 16 bp, Homo sapiens
cagatgtttgcctcat

SEQ ID NO: 4848664 - DNA, 24 bp, Homo sapiens
cagcaacccttcctgctgctgcta

SEQ ID NO: 4848665 - DNA, 16 bp, Homo sapiens
cagcaagagtaagcag

SEQ ID NO: 4848666 - DNA, 19 bp, Homo sapiens
cagcaagagtaagcagtgt

SEQ ID NO: 4848667 - DNA, 15 bp, Homo sapiens
cagcaagtgagcaga

SEQ ID NO: 4848668 - DNA, 12 bp, Homo sapiens
cagcagagcatt

SEQ ID NO: 4848669 - DNA, 16 bp, Homo sapiens
cagcagccccaggaga

SEQ ID NO: 4848670 - DNA, 16 bp, Homo sapiens
cagcagctgatgctgt

SEQ ID NO: 4848671 - DNA, 17 bp, Homo sapiens
cagcagctgatgctgta

SEQ ID NO: 4848672 - DNA, 22 bp, Homo sapiens
cagcaggactgtgggaaagagc

SEQ ID NO: 4848673 - DNA, 15 bp, Homo sapiens
cagcaggccagagaa

SEQ ID NO: 4848674 - DNA, 21 bp, Homo sapiens
cagcaggcctctgggacccac

SEQ ID NO: 4848675 - DNA, 18 bp, Homo sapiens
cagcagtcgcccaagcag

SEQ ID NO: 4848676 - DNA, 14 bp, Homo sapiens
cagcatccagtgtg

SEQ ID NO: 4848677 - DNA, 16 bp, Homo sapiens
cagcatctgctccatc

SEQ ID NO: 4848678 - DNA, 18 bp, Homo sapiens
cagcattgtaattatgta

SEQ ID NO: 4848679 - DNA, 16 bp, Homo sapiens
cagcattgtatatgtg

SEQ ID NO: 4848680 - DNA, 14 bp, Homo sapiens
cagcattgtgtgga

SEQ ID NO: 4848681 - DNA, 15 bp, Homo sapiens
cagcattgtgtggaa

SEQ ID NO: 4848682 - DNA, 16 bp, Homo sapiens
cagccaaggccgccag

SEQ ID NO: 4848683 - DNA, 23 bp, Homo sapiens
cagccacaccgtggcagcttgct

SEQ ID NO: 4848684 - DNA, 17 bp, Homo sapiens
cagccacccccaggcat

SEQ ID NO: 4848685 - DNA, 17 bp, Homo sapiens
cagccagaacgtggctc

SEQ ID NO: 4848686 - DNA, 14 bp, Homo sapiens
cagccaggcaagaa

SEQ ID NO: 4848687 - DNA, 21 bp, Homo sapiens
cagccaggtctgactccaaag

SEQ ID NO: 4848688 - DNA, 18 bp, Homo sapiens
cagcccaaacctgggaag

SEQ ID NO: 4848689 - DNA, 22 bp, Homo sapiens
cagcccaaacctgggaaggcca

SEQ ID NO: 4848690 - DNA, 19 bp, Homo sapiens
cagccccctaaaagcactc

SEQ ID NO: 4848691 - DNA, 16 bp, Homo sapiens
cagcccgcagaggtgg

SEQ ID NO: 4848692 - DNA, 14 bp, Homo sapiens
cagccgcagagaaa

SEQ ID NO: 4848693 - DNA, 15 bp, Homo sapiens
cagccgcagagaaat

SEQ ID NO: 4848694 - DNA, 21 bp, Homo sapiens
cagccgcagagaaatgcccca

SEQ ID NO: 4848695 - DNA, 20 bp, Homo sapiens
cagcctagcctatgtctggc

SEQ ID NO: 4848696 - DNA, 22 bp, Homo sapiens
cagcctagcctatgtctggcag

SEQ ID NO: 4848697 - DNA, 21 bp, Homo sapiens
cagcctcaagtcactcccaag

SEQ ID NO: 4848698 - DNA, 18 bp, Homo sapiens
cagcctctccgactctgc

SEQ ID NO: 4848699 - DNA, 19 bp, Homo sapiens
cagcctctccgactctgca

SEQ ID NO: 4848700 - DNA, 19 bp, Homo sapiens
cagcctgactagaactcct

SEQ ID NO: 4848701 - DNA, 21 bp, Homo sapiens
cagcctgactagaactcctgt

SEQ ID NO: 4848702 - DNA, 18 bp, Homo sapiens
cagcctgcttcccacaac

SEQ ID NO: 4848703 - DNA, 21 bp, Homo sapiens
cagcctgctttcctgcagcag

SEQ ID NO: 4848704 - DNA, 15 bp, Homo sapiens
cagcctgtatgtggt

SEQ ID NO: 4848705 - DNA, 15 bp, Homo sapiens
cattacaccacagca

SEQ ID NO: 4848706 - DNA, 11 bp, Homo sapiens
cattaccaaaa

SEQ ID NO: 4848707 - DNA, 15 bp, Homo sapiens
cattacctccatcca

SEQ ID NO: 4848708 - DNA, 23 bp, Homo sapiens
cattacctccatccatccttcca

SEQ ID NO: 4848709 - DNA, 17 bp, Homo sapiens
cattagagtcaactaca

SEQ ID NO: 4848710 - DNA, 21 bp, Homo sapiens
cattagcaaggcagagccttt

SEQ ID NO: 4848711 - DNA, 14 bp, Homo sapiens
cattagttttgaag

SEQ ID NO: 4848712 - DNA, 17 bp, Homo sapiens
cattatgttaatatttc

SEQ ID NO: 4848713 - DNA, 17 bp, Homo sapiens
cattattaaattgtaaa

SEQ ID NO: 4848714 - DNA, 18 bp, Homo sapiens
cattcaacagagactgaa

SEQ ID NO: 4848715 - DNA, 14 bp, Homo sapiens
cattcagaaatgtt

SEQ ID NO: 4848716 - DNA, 19 bp, Homo sapiens
cattcaggaattcttggag

SEQ ID NO: 4848717 - DNA, 13 bp, Homo sapiens
cattcccagcctg

SEQ ID NO: 4848718 - DNA, 14 bp, Homo sapiens
cattcccagcctga

SEQ ID NO: 4848719 - DNA, 16 bp, Homo sapiens
cattcccagcctgact

SEQ ID NO: 4848720 - DNA, 22 bp, Homo sapiens
cattcctaatcaaattctgtct

SEQ ID NO: 4848721 - DNA, 12 bp, Homo sapiens
cattcctccctc

SEQ ID NO: 4848722 - DNA, 16 bp, Homo sapiens
cattctattctccaga

SEQ ID NO: 4848723 - DNA, 12 bp, Homo sapiens
cattctcccagc

SEQ ID NO: 4848724 - DNA, 19 bp, Homo sapiens
cattctgaaccctccaaag

SEQ ID NO: 4848725 - DNA, 15 bp, Homo sapiens
cattctgaattaatt

SEQ ID NO: 4848726 - DNA, 20 bp, Homo sapiens
cattctgaattaattaattt

SEQ ID NO: 4848727 - DNA, 23 bp, Homo sapiens
cattcttgtgggagacagcagcc

SEQ ID NO: 4848728 - DNA, 13 bp, Homo sapiens
cattctttttgaa

SEQ ID NO: 4848729 - DNA, 16 bp, Homo sapiens
cattctttttgaaatg

SEQ ID NO: 4848730 - DNA, 16 bp, Homo sapiens
cattgacttttataaa

SEQ ID NO: 4848731 - DNA, 18 bp, Homo sapiens
cattgacttttataaagc

SEQ ID NO: 4848732 - DNA, 21 bp, Homo sapiens
cattgcacataagcttccatt

SEQ ID NO: 4848733 - DNA, 16 bp, Homo sapiens
cattgcagcctaagaa

SEQ ID NO: 4848734 - DNA, 18 bp, Homo sapiens
cattggatattttttact

SEQ ID NO: 4848735 - DNA, 12 bp, Homo sapiens
cattggcaaagt

SEQ ID NO: 4848736 - DNA, 22 bp, Homo sapiens
cattggcaaagtgacaaagcaa

SEQ ID NO: 4848737 - DNA, 15 bp, Homo sapiens
cattgtaattatgta

SEQ ID NO: 4848738 - DNA, 21 bp, Homo sapiens
cattgtaattatgtaaataac

SEQ ID NO: 4848739 - DNA, 22 bp, Homo sapiens
cattgtaattatgtaaataact

SEQ ID NO: 4848740 - DNA, 23 bp, Homo sapiens
cattgtaattatgtaaataactc

SEQ ID NO: 4848741 - DNA, 13 bp, Homo sapiens
cattgtgtggaat

SEQ ID NO: 4848742 - DNA, 12 bp, Homo sapiens
catttaaatttt

SEQ ID NO: 4848743 - DNA, 17 bp, Homo sapiens
catttaataaagatgag

SEQ ID NO: 4848744 - DNA, 22 bp, Homo sapiens
catttaatggcagctagtgcct

SEQ ID NO: 4848745 - DNA, 20 bp, Homo sapiens
catttagaagcctgacaact

SEQ ID NO: 4848746 - DNA, 14 bp, Homo sapiens
catttagtaagaat

SEQ ID NO: 4848747 - DNA, 12 bp, Homo sapiens
catttatatatt

SEQ ID NO: 4848748 - DNA, 21 bp, Homo sapiens
catttatgacaagctgtatca

SEQ ID NO: 4848749 - DNA, 18 bp, Homo sapiens
catttattaagcagtaca

SEQ ID NO: 4848750 - DNA, 21 bp, Homo sapiens
catttcaggactctctccagg

SEQ ID NO: 4848751 - DNA, 23 bp, Homo sapiens
catttcaggactctctccaggag

SEQ ID NO: 4848752 - DNA, 22 bp, Homo sapiens
catttctatattcctccagctg

SEQ ID NO: 4848753 - DNA, 17 bp, Homo sapiens
catttctcatgttgaaa

SEQ ID NO: 4848754 - DNA, 14 bp, Homo sapiens
catttctttggaaa

SEQ ID NO: 4848755 - DNA, 20 bp, Homo sapiens
catttgggagacatgtgaca

SEQ ID NO: 4848756 - DNA, 17 bp, Homo sapiens
catttggggtaatactt

SEQ ID NO: 4848757 - DNA, 17 bp, Homo sapiens
catttgtgggcaagcag

SEQ ID NO: 4848758 - DNA, 22 bp, Homo sapiens
catttgtgggcaagcagatgac

SEQ ID NO: 4848759 - DNA, 14 bp, Homo sapiens
cattttaattttaa

SEQ ID NO: 4848760 - DNA, 13 bp, Homo sapiens
cattttgcttccc

SEQ ID NO: 4848761 - DNA, 16 bp, Homo sapiens
cattttgcttcccatc

SEQ ID NO: 4848762 - DNA, 21 bp, Homo sapiens
ccaaaagtgttgactgtgtca

SEQ ID NO: 4848763 - DNA, 20 bp, Homo sapiens
ccaaacctgggaaggccagc

SEQ ID NO: 4848764 - DNA, 17 bp, Homo sapiens
ccaaactgatccagtat

SEQ ID NO: 4848765 - DNA, 12 bp, Homo sapiens
ccaaagaaagtt

SEQ ID NO: 4848766 - DNA, 12 bp, Homo sapiens
ccaaagagaaag

SEQ ID NO: 4848767 - DNA, 14 bp, Homo sapiens
ccaaaggaaaatgt

SEQ ID NO: 4848768 - DNA, 16 bp, Homo sapiens
ccaaaggaactctaga

SEQ ID NO: 4848769 - DNA, 23 bp, Homo sapiens
ccaaatgcagggaggggaggcag

SEQ ID NO: 4848770 - DNA, 12 bp, Homo sapiens
ccaaattaaaaa

SEQ ID NO: 4848771 - DNA, 19 bp, Homo sapiens
ccaacaagaaccactcctt

SEQ ID NO: 4848772 - DNA, 22 bp, Homo sapiens
ccaacatatatttattgagtac

SEQ ID NO: 4848773 - DNA, 16 bp, Homo sapiens
ccaacctcaggctcct

SEQ ID NO: 4848774 - DNA, 11 bp, Homo sapiens
ccaacctccag

SEQ ID NO: 4848775 - DNA, 22 bp, Homo sapiens
ccaagcactagccttcccagct

SEQ ID NO: 4848776 - DNA, 12 bp, Homo sapiens
ccaagctgagga

SEQ ID NO: 4848777 - DNA, 15 bp, Homo sapiens
ccaagctggcacaaa

SEQ ID NO: 4848778 - DNA, 16 bp, Homo sapiens
ccaaggaatcagcagg

SEQ ID NO: 4848779 - DNA, 17 bp, Homo sapiens
ccaagggggctgctgct

SEQ ID NO: 4848780 - DNA, 16 bp, Homo sapiens
ccaaggtcctctcagt

SEQ ID NO: 4848781 - DNA, 16 bp, Homo sapiens
ccaaggtcctgctcaa

SEQ ID NO: 4848782 - DNA, 22 bp, Homo sapiens
ccaaggtgaggtgaactccagg

SEQ ID NO: 4848783 - DNA, 23 bp, Homo sapiens
ccaaggtgaggtgaactccaggc

SEQ ID NO: 4848784 - DNA, 15 bp, Homo sapiens
ccaataaagtgatct

SEQ ID NO: 4848785 - DNA, 17 bp, Homo sapiens
ccaatatatgtattttt

SEQ ID NO: 4848786 - DNA, 20 bp, Homo sapiens
ccaatccatcgtattaaaaa

SEQ ID NO: 4848787 - DNA, 18 bp, Homo sapiens
ccaatgcttgcatggaga

SEQ ID NO: 4848788 - DNA, 19 bp, Homo sapiens
ccaatgcttgcatggagaa

SEQ ID NO: 4848789 - DNA, 22 bp, Homo sapiens
ccaatgcttgcatggagaatgg

SEQ ID NO: 4848790 - DNA, 18 bp, Homo sapiens
ccaattaaaaacgaaaac

SEQ ID NO: 4848791 - DNA, 21 bp, Homo sapiens
ccaattaaaaacgaaaacctg

SEQ ID NO: 4848792 - DNA, 14 bp, Homo sapiens
ccacaaacctgccc

SEQ ID NO: 4848793 - DNA, 14 bp, Homo sapiens
ccacaaactccagg

SEQ ID NO: 4848794 - DNA, 18 bp, Homo sapiens
ccacaaactccaggctgg

SEQ ID NO: 4848795 - DNA, 21 bp, Homo sapiens
ccacaataaagatcgccccca

SEQ ID NO: 4848796 - DNA, 22 bp, Homo sapiens
ccacaccgtggcagcttgctgg

SEQ ID NO: 4848797 - DNA, 11 bp, Homo sapiens
ccacagaactt

SEQ ID NO: 4848798 - DNA, 16 bp, Homo sapiens
ccacagcagccccagg

SEQ ID NO: 4848799 - DNA, 18 bp, Homo sapiens
ccacagccttgcagcggc

SEQ ID NO: 4848800 - DNA, 21 bp, Homo sapiens
ccacagccttgcagcggctcc

SEQ ID NO: 4848801 - DNA, 23 bp, Homo sapiens
ccacagccttgcagcggctcctg

SEQ ID NO: 4848802 - DNA, 17 bp, Homo sapiens
ccacccacaaactccag

SEQ ID NO: 4848803 - DNA, 16 bp, Homo sapiens
ccacctcatcactgga

SEQ ID NO: 4848804 - DNA, 21 bp, Homo sapiens
ccacgcctcaccagccccccg

SEQ ID NO: 4848805 - DNA, 17 bp, Homo sapiens
ccacgggggcagtgtga

SEQ ID NO: 4848806 - DNA, 22 bp, Homo sapiens
ccacgtctgcgccgccgccgga

SEQ ID NO: 4848807 - DNA, 20 bp, Homo sapiens
ccactagaggggcacccacc

SEQ ID NO: 4848808 - DNA, 13 bp, Homo sapiens
ccactggaccctt

SEQ ID NO: 4848809 - DNA, 11 bp, Homo sapiens
ccacttctccc

SEQ ID NO: 4848810 - DNA, 19 bp, Homo sapiens
ccagaaaggtgtgaggaga

SEQ ID NO: 4848811 - DNA, 24 bp, Homo sapiens
ccagaacctctaagtgctgctgtg

SEQ ID NO: 4848812 - DNA, 15 bp, Homo sapiens
ccagaagaaaatttg

SEQ ID NO: 4848813 - DNA, 15 bp, Homo sapiens
ccagactcagcagag

SEQ ID NO: 4848814 - DNA, 13 bp, Homo sapiens
ccagactctgggg

SEQ ID NO: 4848815 - DNA, 18 bp, Homo sapiens
ccagagaaagcaaaggtg

SEQ ID NO: 4848816 - DNA, 22 bp, Homo sapiens
ccagagaaagcaaaggtgcact

SEQ ID NO: 4848817 - DNA, 21 bp, Homo sapiens
ccagagaaagcacaatttaaa

SEQ ID NO: 4848818 - DNA, 19 bp, Homo sapiens
ccagagaacctgtgggctg

SEQ ID NO: 4848819 - DNA, 14 bp, Homo sapiens
ccagagagggaaaa

SEQ ID NO: 4848820 - DNA, 13 bp, Homo sapiens
ccagagagggaag

SEQ ID NO: 4848821 - DNA, 12 bp, Homo sapiens
ccagagatgcct

SEQ ID NO: 4848822 - DNA, 16 bp, Homo sapiens
ccagagcagggtctct

SEQ ID NO: 4848823 - DNA, 12 bp, Homo sapiens
ccagaggaccaa

SEQ ID NO: 4848824 - DNA, 23 bp, Homo sapiens
ccagaggaccaatgcttgcatgg

SEQ ID NO: 4848825 - DNA, 13 bp, Homo sapiens
cccagactacagg

SEQ ID NO: 4848826 - DNA, 15 bp, Homo sapiens
cccagactacagggc

SEQ ID NO: 4848827 - DNA, 15 bp, Homo sapiens
cccagagagggaaga

SEQ ID NO: 4848828 - DNA, 18 bp, Homo sapiens
cccagaggtggatactgg

SEQ ID NO: 4848829 - DNA, 20 bp, Homo sapiens
cccagaggtgggatcctccc

SEQ ID NO: 4848830 - DNA, 23 bp, Homo sapiens
cccagcacaaagcactggccttg

SEQ ID NO: 4848831 - DNA, 18 bp, Homo sapiens
cccagcccctggtggtgg

SEQ ID NO: 4848832 - DNA, 12 bp, Homo sapiens
cccagcctgact

SEQ ID NO: 4848833 - DNA, 21 bp, Homo sapiens
cccaggcatgaaattcttcct

SEQ ID NO: 4848834 - DNA, 20 bp, Homo sapiens
cccaggggagccagctgctt

SEQ ID NO: 4848835 - DNA, 20 bp, Homo sapiens
cccaggtgtttgtggggctg

SEQ ID NO: 4848836 - DNA, 20 bp, Homo sapiens
cccagtgccagcaagtcctt

SEQ ID NO: 4848837 - DNA, 19 bp, Homo sapiens
cccagttgcactcaggtga

SEQ ID NO: 4848838 - DNA, 20 bp, Homo sapiens
cccagttgcactcaggtgac

SEQ ID NO: 4848839 - DNA, 17 bp, Homo sapiens
cccatcatacacttcct

SEQ ID NO: 4848840 - DNA, 14 bp, Homo sapiens
cccatccctgcctg

SEQ ID NO: 4848841 - DNA, 17 bp, Homo sapiens
cccatccctgcctggag

SEQ ID NO: 4848842 - DNA, 18 bp, Homo sapiens
cccatggctgaagctgga

SEQ ID NO: 4848843 - DNA, 21 bp, Homo sapiens
cccattaaggggaagaatgaa

SEQ ID NO: 4848844 - DNA, 13 bp, Homo sapiens
cccattcccacca

SEQ ID NO: 4848845 - DNA, 16 bp, Homo sapiens
cccattcccagcctga

SEQ ID NO: 4848846 - DNA, 17 bp, Homo sapiens
cccattcccagcctgac

SEQ ID NO: 4848847 - DNA, 14 bp, Homo sapiens
cccattcctccctc

SEQ ID NO: 4848848 - DNA, 18 bp, Homo sapiens
ccccaagggggctgctgc

SEQ ID NO: 4848849 - DNA, 17 bp, Homo sapiens
ccccacccgctcccaca

SEQ ID NO: 4848850 - DNA, 12 bp, Homo sapiens
ccccacctccac

SEQ ID NO: 4848851 - DNA, 15 bp, Homo sapiens
ccccagatacctgtg

SEQ ID NO: 4848852 - DNA, 17 bp, Homo sapiens
ccccagatacctgtgag

SEQ ID NO: 4848853 - DNA, 18 bp, Homo sapiens
ccccagatacctgtgagg

SEQ ID NO: 4848854 - DNA, 20 bp, Homo sapiens
ccccagatacctgtgaggac

SEQ ID NO: 4848855 - DNA, 22 bp, Homo sapiens
ccccagcacaaagcactggcct

SEQ ID NO: 4848856 - DNA, 23 bp, Homo sapiens
ccccaggcatctgttagcagagt

SEQ ID NO: 4848857 - DNA, 22 bp, Homo sapiens
ccccagggacagggccctggag

SEQ ID NO: 4848858 - DNA, 15 bp, Homo sapiens
ccccagtgactccag

SEQ ID NO: 4848859 - DNA, 17 bp, Homo sapiens
ccccagtgactccaggg

SEQ ID NO: 4848860 - DNA, 20 bp, Homo sapiens
ccccagtgactccagggtga

SEQ ID NO: 4848861 - DNA, 21 bp, Homo sapiens
ccccctatctcttcctgtcta

SEQ ID NO: 4848862 - DNA, 15 bp, Homo sapiens
cccccttcaggagcc

SEQ ID NO: 4848863 - DNA, 14 bp, Homo sapiens
ccccgcgcgcccac

SEQ ID NO: 4848864 - DNA, 14 bp, Homo sapiens
ccccgtctgtggct

SEQ ID NO: 4848865 - DNA, 21 bp, Homo sapiens
cccctaaaagcactcctgctt

SEQ ID NO: 4848866 - DNA, 17 bp, Homo sapiens
cccctaaagagcatcct

SEQ ID NO: 4848867 - DNA, 19 bp, Homo sapiens
cccctaaagagcatcctga

SEQ ID NO: 4848868 - DNA, 18 bp, Homo sapiens
cccctatctcttcctgtc

SEQ ID NO: 4848869 - DNA, 16 bp, Homo sapiens
cccctcccacccaccg

SEQ ID NO: 4848870 - DNA, 18 bp, Homo sapiens
cccctcccacgcctcacc

SEQ ID NO: 4848871 - DNA, 22 bp, Homo sapiens
cccctcccaggggagccagctg

SEQ ID NO: 4848872 - DNA, 16 bp, Homo sapiens
cccctcctgctgggcg

SEQ ID NO: 4848873 - DNA, 22 bp, Homo sapiens
cccctccttctaggatagcgct

SEQ ID NO: 4848874 - DNA, 22 bp, Homo sapiens
cccctctgtgcttcgactactg

SEQ ID NO: 4848875 - DNA, 16 bp, Homo sapiens
cccctctttgcacagc

SEQ ID NO: 4848876 - DNA, 21 bp, Homo sapiens
cccctctttgcacagcatgag

SEQ ID NO: 4848877 - DNA, 15 bp, Homo sapiens
cccctgggcagggtt

SEQ ID NO: 4848878 - DNA, 11 bp, Homo sapiens
ccccttcagga

SEQ ID NO: 4848879 - DNA, 22 bp, Homo sapiens
cccgaggacgctccctgctcca

SEQ ID NO: 4848880 - DNA, 14 bp, Homo sapiens
cccgagtctccggg

SEQ ID NO: 4848881 - DNA, 15 bp, Homo sapiens
cccgagtctccggga

SEQ ID NO: 4848882 - DNA, 22 bp, Homo sapiens
cccgcagaggtggggtgctggg

SEQ ID NO: 4848883 - DNA, 23 bp, Homo sapiens
cccgcagaggtggggtgctgggg

SEQ ID NO: 4848884 - DNA, 14 bp, Homo sapiens
cccggaggccttcc

SEQ ID NO: 4848885 - DNA, 22 bp, Homo sapiens
cccgtcctctcggctgccaggg

SEQ ID NO: 4848886 - DNA, 15 bp, Homo sapiens
cccgtgtcctgcctg

SEQ ID NO: 4848887 - DNA, 20 bp, Homo sapiens
ccctaaaagcactcctgctt

SEQ ID NO: 4848888 - DNA, 19 bp, Homo sapiens
ccctaaagccaggctcagg

SEQ ID NO: 4848889 - DNA, 22 bp, Homo sapiens
ccctaaagccaggctcaggaga

SEQ ID NO: 4848890 - DNA, 20 bp, Homo sapiens
ccctacagacagcttacagg

SEQ ID NO: 4848891 - DNA, 22 bp, Homo sapiens
ccctaggatcccgtcttccaga

SEQ ID NO: 4848892 - DNA, 16 bp, Homo sapiens
ccctagttcaggtcca

SEQ ID NO: 4848893 - DNA, 14 bp, Homo sapiens
ccctattgctgcta

SEQ ID NO: 4848894 - DNA, 20 bp, Homo sapiens
ccctcaccacagccttctaa

SEQ ID NO: 4848895 - DNA, 14 bp, Homo sapiens
ccctcccacccacc

SEQ ID NO: 4848896 - DNA, 14 bp, Homo sapiens
ccctcccaggggag

SEQ ID NO: 4848897 - DNA, 18 bp, Homo sapiens
ccctcccaggggagccag

SEQ ID NO: 4848898 - DNA, 22 bp, Homo sapiens
ccctcccaggggagccagctgc

SEQ ID NO: 4848899 - DNA, 18 bp, Homo sapiens
ccctccggcgggtgacag

SEQ ID NO: 4848900 - DNA, 15 bp, Homo sapiens
ccctcgagagcctta

SEQ ID NO: 4848901 - DNA, 18 bp, Homo sapiens
ccctctgctctgcctgga

SEQ ID NO: 4848902 - DNA, 20 bp, Homo sapiens
ccctctttgcacagcatgag

SEQ ID NO: 4848903 - DNA, 15 bp, Homo sapiens
ccctgaaatggcctg

SEQ ID NO: 4848904 - DNA, 16 bp, Homo sapiens
ccctgaaatggcctgt

SEQ ID NO: 4848905 - DNA, 19 bp, Homo sapiens
ccctgaatccgtacttggg

SEQ ID NO: 4848906 - DNA, 13 bp, Homo sapiens
ccctgacaggcct

SEQ ID NO: 4848907 - DNA, 15 bp, Homo sapiens
ccctgcccccacccc

SEQ ID NO: 4848908 - DNA, 22 bp, Homo sapiens
ccctgcccttcctcctgatgga

SEQ ID NO: 4848909 - DNA, 23 bp, Homo sapiens
ccctgcctcaggccaagggacca

SEQ ID NO: 4848910 - DNA, 14 bp, Homo sapiens
ccctgcctggactt

SEQ ID NO: 4848911 - DNA, 22 bp, Homo sapiens
ccctgcggccccgtctgtggct

SEQ ID NO: 4848912 - DNA, 14 bp, Homo sapiens
ccctgctcccattc

SEQ ID NO: 4848913 - DNA, 21 bp, Homo sapiens
ccctgctcccattcctccctc

SEQ ID NO: 4848914 - DNA, 23 bp, Homo sapiens
ccctggagctcagggtccttgtt

SEQ ID NO: 4848915 - DNA, 12 bp, Homo sapiens
ccctggggcagg

SEQ ID NO: 4848916 - DNA, 20 bp, Homo sapiens
ccctggggcagggtgggggg

SEQ ID NO: 4848917 - DNA, 20 bp, Homo sapiens
ccctggggtcaccttctagt

SEQ ID NO: 4848918 - DNA, 16 bp, Homo sapiens
ccctgggtttgggagc

SEQ ID NO: 4848919 - DNA, 9 bp, Homo sapiens
ccctgtcac

SEQ ID NO: 4848920 - DNA, 19 bp, Homo sapiens
ccctgtctgctaggcgctg

SEQ ID NO: 4848921 - DNA, 17 bp, Homo sapiens
ccctgtgagcacaaaga

SEQ ID NO: 4848922 - DNA, 19 bp, Homo sapiens
ccctgttcagctactccca

SEQ ID NO: 4848923 - DNA, 16 bp, Homo sapiens
ccctgttcatgttttt

SEQ ID NO: 4848924 - DNA, 15 bp, Homo sapiens
cccttacagcctctg

SEQ ID NO: 4848925 - DNA, 17 bp, Homo sapiens
cccttacagcctctgac

SEQ ID NO: 4848926 - DNA, 14 bp, Homo sapiens
cccttaccccagtc

SEQ ID NO: 4848927 - DNA, 16 bp, Homo sapiens
cccttcaggagcctgg

SEQ ID NO: 4848928 - DNA, 20 bp, Homo sapiens
cccttcaggagcctggccag

SEQ ID NO: 4848929 - DNA, 16 bp, Homo sapiens
cccttcatccatcctg

SEQ ID NO: 4848930 - DNA, 21 bp, Homo sapiens
cccttcatccatcctgagcca

SEQ ID NO: 4848931 - DNA, 13 bp, Homo sapiens
cccttccctgggt

SEQ ID NO: 4848932 - DNA, 20 bp, Homo sapiens
cccttcctcctgatggagtg

SEQ ID NO: 4848933 - DNA, 16 bp, Homo sapiens
cccttgattcattctg

SEQ ID NO: 4848934 - DNA, 13 bp, Homo sapiens
cccttgcacgtaa

SEQ ID NO: 4848935 - DNA, 22 bp, Homo sapiens
cccttgcaggggtcccccctca

SEQ ID NO: 4848936 - DNA, 21 bp, Homo sapiens
ccgagcatgcttccctaggat

SEQ ID NO: 4848937 - DNA, 16 bp, Homo sapiens
ccgagggcgaccccgt

SEQ ID NO: 4848938 - DNA, 16 bp, Homo sapiens
ccgcagaagcctcccc

SEQ ID NO: 4848939 - DNA, 20 bp, Homo sapiens
ccgcagaagcctccccagct

SEQ ID NO: 4848940 - DNA, 15 bp, Homo sapiens
ccgcagacctggagc

SEQ ID NO: 4848941 - DNA, 16 bp, Homo sapiens
ccgcagacctggagct

SEQ ID NO: 4848942 - DNA, 19 bp, Homo sapiens
ccgcagacctggagcttca

SEQ ID NO: 4848943 - DNA, 11 bp, Homo sapiens
ccgcagagaaa

SEQ ID NO: 4848944 - DNA, 14 bp, Homo sapiens
ccgcagagaaatgc

SEQ ID NO: 4848945 - DNA, 24 bp, Homo sapiens
cctttcctggcagtctcagtccaa

SEQ ID NO: 4848946 - DNA, 21 bp, Homo sapiens
cctttctaagcaaccacactg

SEQ ID NO: 4848947 - DNA, 14 bp, Homo sapiens
cctttctacaactg

SEQ ID NO: 4848948 - DNA, 22 bp, Homo sapiens
cctttcttttaatgatgccatg

SEQ ID NO: 4848949 - DNA, 17 bp, Homo sapiens
cctttgaagaaggcaag

SEQ ID NO: 4848950 - DNA, 22 bp, Homo sapiens
cctttgcagttggactctcagg

SEQ ID NO: 4848951 - DNA, 19 bp, Homo sapiens
cctttttacctggcctaga

SEQ ID NO: 4848952 - DNA, 18 bp, Homo sapiens
cctttttgttgatgagga

SEQ ID NO: 4848953 - DNA, 15 bp, Homo sapiens
cgaagagagttctgg

SEQ ID NO: 4848954 - DNA, 23 bp, Homo sapiens
cgaagagagttctggatgtctgg

SEQ ID NO: 4848955 - DNA, 17 bp, Homo sapiens
cgaagtctttgccttct

SEQ ID NO: 4848956 - DNA, 20 bp, Homo sapiens
cgaagtctttgccttctctg

SEQ ID NO: 4848957 - DNA, 22 bp, Homo sapiens
cgaatgaaaataactgaatttg

SEQ ID NO: 4848958 - DNA, 16 bp, Homo sapiens
cgaatgcccctgttca

SEQ ID NO: 4848959 - DNA, 20 bp, Homo sapiens
cgaatgcccctgttcatgtt

SEQ ID NO: 4848960 - DNA, 19 bp, Homo sapiens
cgaccccgtcacagcctca

SEQ ID NO: 4848961 - DNA, 22 bp, Homo sapiens
cgactgtcagtggggcagcctc

SEQ ID NO: 4848962 - DNA, 21 bp, Homo sapiens
cgagatagggggaagacagat

SEQ ID NO: 4848963 - DNA, 16 bp, Homo sapiens
cgagatcgggaagcag

SEQ ID NO: 4848964 - DNA, 15 bp, Homo sapiens
cgagggatgatgagg

SEQ ID NO: 4848965 - DNA, 19 bp, Homo sapiens
cgagggatgatgagggaag

SEQ ID NO: 4848966 - DNA, 21 bp, Homo sapiens
cgagggatgatgagggaagca

SEQ ID NO: 4848967 - DNA, 15 bp, Homo sapiens
cgagtgtagctgtga

SEQ ID NO: 4848968 - DNA, 16 bp, Homo sapiens
cgagtgtagctgtgaa

SEQ ID NO: 4848969 - DNA, 17 bp, Homo sapiens
cgagtgtagtcccggag

SEQ ID NO: 4848970 - DNA, 10 bp, Homo sapiens
cgatgcattt

SEQ ID NO: 4848971 - DNA, 19 bp, Homo sapiens
cgatgcatttaataaagat

SEQ ID NO: 4848972 - DNA, 19 bp, Homo sapiens
cgcagagaaatgccccagt

SEQ ID NO: 4848973 - DNA, 17 bp, Homo sapiens
cgcagttgtagcagaaa

SEQ ID NO: 4848974 - DNA, 18 bp, Homo sapiens
cgccagcgtgtggagcag

SEQ ID NO: 4848975 - DNA, 21 bp, Homo sapiens
cgccagcgtgtggagcagagc

SEQ ID NO: 4848976 - DNA, 13 bp, Homo sapiens
cgcccactcctgg

SEQ ID NO: 4848977 - DNA, 23 bp, Homo sapiens
cgccggagtccactcccagtgct

SEQ ID NO: 4848978 - DNA, 14 bp, Homo sapiens
cgcgggagggggcg

SEQ ID NO: 4848979 - DNA, 18 bp, Homo sapiens
cgctgcccttgggtcccc

SEQ ID NO: 4848980 - DNA, 10 bp, Homo sapiens
cgctgctggg

SEQ ID NO: 4848981 - DNA, 12 bp, Homo sapiens
cggaaagaagag

SEQ ID NO: 4848982 - DNA, 12 bp, Homo sapiens
cggatcctgtga

SEQ ID NO: 4848983 - DNA, 15 bp, Homo sapiens
cggattgctctggag

SEQ ID NO: 4848984 - DNA, 20 bp, Homo sapiens
cggattgctctggagcagcc

SEQ ID NO: 4848985 - DNA, 14 bp, Homo sapiens
cggcagatgatgct

SEQ ID NO: 4848986 - DNA, 22 bp, Homo sapiens
cggcagatgatgctttggaaga

SEQ ID NO: 4848987 - DNA, 12 bp, Homo sapiens
cggcctgagaaa

SEQ ID NO: 4848988 - DNA, 14 bp, Homo sapiens
cggcgggtgacagc

SEQ ID NO: 4848989 - DNA, 19 bp, Homo sapiens
cggctactggttacctgga

SEQ ID NO: 4848990 - DNA, 23 bp, Homo sapiens
cggctactggttacctggagaag

SEQ ID NO: 4848991 - DNA, 23 bp, Homo sapiens
cggctgccaggggctctgtggca

SEQ ID NO: 4848992 - DNA, 14 bp, Homo sapiens
cgggatgacctcca

SEQ ID NO: 4848993 - DNA, 16 bp, Homo sapiens
cgggatgacctccaga

SEQ ID NO: 4848994 - DNA, 17 bp, Homo sapiens
cgggatgacctccagaa

SEQ ID NO: 4848995 - DNA, 17 bp, Homo sapiens
cgggcaccaggggccaa

SEQ ID NO: 4848996 - DNA, 17 bp, Homo sapiens
cggggagaaacccagag

SEQ ID NO: 4848997 - DNA, 16 bp, Homo sapiens
cgggggaggggcgcgg

SEQ ID NO: 4848998 - DNA, 18 bp, Homo sapiens
cgggggaggggcgcggga

SEQ ID NO: 4848999 - DNA, 19 bp, Homo sapiens
cgggtgggcggcacagcct

SEQ ID NO: 4849000 - DNA, 18 bp, Homo sapiens
cggtattaaaatggagcg

SEQ ID NO: 4849001 - DNA, 19 bp, Homo sapiens
cgtaaacttcagtgtccca

SEQ ID NO: 4849002 - DNA, 23 bp, Homo sapiens
cgtaagcagtatattagtattat

SEQ ID NO: 4849003 - DNA, 16 bp, Homo sapiens
cgtattaaaaaacaat

SEQ ID NO: 4849004 - DNA, 23 bp, Homo sapiens
cgtattaaaaaacaattaactgc

SEQ ID NO: 4849005 - DNA, 18 bp, Homo sapiens
cgtcttttcctgtttcct

SEQ ID NO: 4849006 - DNA, 16 bp, Homo sapiens
cgtggcagcttgctgg

SEQ ID NO: 4849007 - DNA, 19 bp, Homo sapiens
cgtggcagcttgctgggct

SEQ ID NO: 4849008 - DNA, 20 bp, Homo sapiens
cgtggccacgggggcagtgt

SEQ ID NO: 4849009 - DNA, 23 bp, Homo sapiens
cgtgggaacccccctcccaccca

SEQ ID NO: 4849010 - DNA, 13 bp, Homo sapiens
cgtgtggagcaga

SEQ ID NO: 4849011 - DNA, 18 bp, Homo sapiens
cgtgtggagcagagctct

SEQ ID NO: 4849012 - DNA, 13 bp, Homo sapiens
cgttaggccaggc

SEQ ID NO: 4849013 - DNA, 18 bp, Homo sapiens
cgtttataaacagaaatg

SEQ ID NO: 4849014 - DNA, 14 bp, Homo sapiens
ctaaaaaaaagatg

SEQ ID NO: 4849015 - DNA, 18 bp, Homo sapiens
ctaaaaaggcccttagag

SEQ ID NO: 4849016 - DNA, 21 bp, Homo sapiens
ctaaaaatagacttaaatctc

SEQ ID NO: 4849017 - DNA, 20 bp, Homo sapiens
ctaaaagttctcaatgtaga

SEQ ID NO: 4849018 - DNA, 18 bp, Homo sapiens
ctaaaatgaggatccagg

SEQ ID NO: 4849019 - DNA, 18 bp, Homo sapiens
ctaaagccaggctcagga

SEQ ID NO: 4849020 - DNA, 19 bp, Homo sapiens
ctaaagccaggctcaggag

SEQ ID NO: 4849021 - DNA, 20 bp, Homo sapiens
ctaaagccaggctcaggaga

SEQ ID NO: 4849022 - DNA, 18 bp, Homo sapiens
ctaaatgtgcaatagaag

SEQ ID NO: 4849023 - DNA, 23 bp, Homo sapiens
ctaaattatttactgcaaaaaga

SEQ ID NO: 4849024 - DNA, 22 bp, Homo sapiens
ctaaattcccaaatcctagact

SEQ ID NO: 4849025 - DNA, 14 bp, Homo sapiens
ctaaattttaaagc

SEQ ID NO: 4849026 - DNA, 17 bp, Homo sapiens
ctaacatgccctgttca

SEQ ID NO: 4849027 - DNA, 19 bp, Homo sapiens
ctaaccaaggctgtgttta

SEQ ID NO: 4849028 - DNA, 22 bp, Homo sapiens
ctaacttggggaaggggcctgg

SEQ ID NO: 4849029 - DNA, 21 bp, Homo sapiens
ctaagaaatgccagtggtgga

SEQ ID NO: 4849030 - DNA, 21 bp, Homo sapiens
ctaagaagaaggccagagagg

SEQ ID NO: 4849031 - DNA, 20 bp, Homo sapiens
ctaagatgtgttcttatttt

SEQ ID NO: 4849032 - DNA, 24 bp, Homo sapiens
ctaagcatgtgtcccaggagcagg

SEQ ID NO: 4849033 - DNA, 14 bp, Homo sapiens
ctaaggctcctcct

SEQ ID NO: 4849034 - DNA, 18 bp, Homo sapiens
ctaaggtttccagtcaga

SEQ ID NO: 4849035 - DNA, 18 bp, Homo sapiens
ctaagtagggccagggca

SEQ ID NO: 4849036 - DNA, 19 bp, Homo sapiens
ctaagtgctgctgtggagt

SEQ ID NO: 4849037 - DNA, 21 bp, Homo sapiens
ctaagtgcttattacatttta

SEQ ID NO: 4849038 - DNA, 21 bp, Homo sapiens
ctaatcaaattctgtctgggg

SEQ ID NO: 4849039 - DNA, 15 bp, Homo sapiens
ctaattaatatatta

SEQ ID NO: 4849040 - DNA, 18 bp, Homo sapiens
ctaattgtgcccctaaag

SEQ ID NO: 4849041 - DNA, 19 bp, Homo sapiens
ctaatttgttttggatata

SEQ ID NO: 4849042 - DNA, 16 bp, Homo sapiens
ctacaactgattgcaa

SEQ ID NO: 4849043 - DNA, 21 bp, Homo sapiens
ctacaatctctttttgtttgc

SEQ ID NO: 4849044 - DNA, 15 bp, Homo sapiens
ctacactcacctgca

SEQ ID NO: 4849045 - DNA, 11 bp, Homo sapiens
ctacagacagc

SEQ ID NO: 4849046 - DNA, 22 bp, Homo sapiens
ctacagacagcttacaggagcc

SEQ ID NO: 4849047 - DNA, 22 bp, Homo sapiens
ctacaggtgaaggctctcaccc

SEQ ID NO: 4849048 - DNA, 13 bp, Homo sapiens
ctacatgtattgc

SEQ ID NO: 4849049 - DNA, 21 bp, Homo sapiens
ctacatgtattgcacattgta

SEQ ID NO: 4849050 - DNA, 22 bp, Homo sapiens
ctacatgtattgcacattgtaa

SEQ ID NO: 4849051 - DNA, 16 bp, Homo sapiens
ctacctactggtgtaa

SEQ ID NO: 4849052 - DNA, 18 bp, Homo sapiens
ctacctggaggaatgatt

SEQ ID NO: 4849053 - DNA, 18 bp, Homo sapiens
ctactcacacttcagctg

SEQ ID NO: 4849054 - DNA, 16 bp, Homo sapiens
ctactgctcctgtggc

SEQ ID NO: 4849055 - DNA, 16 bp, Homo sapiens
ctactggttacctgga

SEQ ID NO: 4849056 - DNA, 23 bp, Homo sapiens
ctactggttacctggagaagtag

SEQ ID NO: 4849057 - DNA, 18 bp, Homo sapiens
ctactgtaatgctgcctc

SEQ ID NO: 4849058 - DNA, 20 bp, Homo sapiens
ctactgtaatgctgcctcag

SEQ ID NO: 4849059 - DNA, 23 bp, Homo sapiens
ctactgtgggcaaagtcctcctt

SEQ ID NO: 4849060 - DNA, 22 bp, Homo sapiens
ctactgttgtaagaattctgat

SEQ ID NO: 4849061 - DNA, 18 bp, Homo sapiens
ctacttctgtaattgtgt

SEQ ID NO: 4849062 - DNA, 16 bp, Homo sapiens
ctagaactcctgtctt

SEQ ID NO: 4849063 - DNA, 15 bp, Homo sapiens
ctgatgctgggcaat

SEQ ID NO: 4849064 - DNA, 22 bp, Homo sapiens
ctgatgctgggcaatgaggcag

SEQ ID NO: 4849065 - DNA, 17 bp, Homo sapiens
ctgatggacatgagagt

SEQ ID NO: 4849066 - DNA, 16 bp, Homo sapiens
ctgatggagtgtgcag

SEQ ID NO: 4849067 - DNA, 19 bp, Homo sapiens
ctgatggagtgtgcagaca

SEQ ID NO: 4849068 - DNA, 20 bp, Homo sapiens
ctgatgggtgccctttcctg

SEQ ID NO: 4849069 - DNA, 23 bp, Homo sapiens
ctgatgtcagctgctgttgaact

SEQ ID NO: 4849070 - DNA, 20 bp, Homo sapiens
ctgattattgagttccagtt

SEQ ID NO: 4849071 - DNA, 18 bp, Homo sapiens
ctgattctggctttaagc

SEQ ID NO: 4849072 - DNA, 19 bp, Homo sapiens
ctgattctggctttaagcc

SEQ ID NO: 4849073 - DNA, 22 bp, Homo sapiens
ctgattcttgttgctgtacaaa

SEQ ID NO: 4849074 - DNA, 16 bp, Homo sapiens
ctgcaaaaattatata

SEQ ID NO: 4849075 - DNA, 13 bp, Homo sapiens
ctgcaacccaagt

SEQ ID NO: 4849076 - DNA, 13 bp, Homo sapiens
ctgcaaggtggcc

SEQ ID NO: 4849077 - DNA, 23 bp, Homo sapiens
ctgcaaggtggcctctgcctggg

SEQ ID NO: 4849078 - DNA, 19 bp, Homo sapiens
ctgcaagtcagtccaggat

SEQ ID NO: 4849079 - DNA, 14 bp, Homo sapiens
ctgcaatcactgtg

SEQ ID NO: 4849080 - DNA, 17 bp, Homo sapiens
ctgcactaacagagtgg

SEQ ID NO: 4849081 - DNA, 23 bp, Homo sapiens
ctgcagagatttctcattgactt

SEQ ID NO: 4849082 - DNA, 16 bp, Homo sapiens
ctgcagagcaggacct

SEQ ID NO: 4849083 - DNA, 14 bp, Homo sapiens
ctgcagcagtcgcc

SEQ ID NO: 4849084 - DNA, 20 bp, Homo sapiens
ctgcagcagtcgcccaagca

SEQ ID NO: 4849085 - DNA, 19 bp, Homo sapiens
ctgcagccttcatcagaac

SEQ ID NO: 4849086 - DNA, 20 bp, Homo sapiens
ctgcagccttcatcagaact

SEQ ID NO: 4849087 - DNA, 17 bp, Homo sapiens
ctgcaggccacttacct

SEQ ID NO: 4849088 - DNA, 14 bp, Homo sapiens
ctgcatggggaggc

SEQ ID NO: 4849089 - DNA, 17 bp, Homo sapiens
ctgcatggggaggcagc

SEQ ID NO: 4849090 - DNA, 22 bp, Homo sapiens
ctgcatggggaggcagcagagc

SEQ ID NO: 4849091 - DNA, 15 bp, Homo sapiens
ctgcatgtgacttct

SEQ ID NO: 4849092 - DNA, 16 bp, Homo sapiens
ctgccaaaggatgtga

SEQ ID NO: 4849093 - DNA, 23 bp, Homo sapiens
ctgccaaggagcatccttggcag

SEQ ID NO: 4849094 - DNA, 19 bp, Homo sapiens
ctgccaatctgtacaaaat

SEQ ID NO: 4849095 - DNA, 18 bp, Homo sapiens
ctgccagctgcagcctgg

SEQ ID NO: 4849096 - DNA, 18 bp, Homo sapiens
ctgccagttacttgggct

SEQ ID NO: 4849097 - DNA, 19 bp, Homo sapiens
ctgccataaatatttctca

SEQ ID NO: 4849098 - DNA, 19 bp, Homo sapiens
ctgcccacaactcccttgc

SEQ ID NO: 4849099 - DNA, 20 bp, Homo sapiens
ctgcccacaactcccttgca

SEQ ID NO: 4849100 - DNA, 20 bp, Homo sapiens
ctgccccctccgtcccaccc

SEQ ID NO: 4849101 - DNA, 12 bp, Homo sapiens
ctgccctctgct

SEQ ID NO: 4849102 - DNA, 15 bp, Homo sapiens
ctgccctctgctctg

SEQ ID NO: 4849103 - DNA, 22 bp, Homo sapiens
ctgccctctgctctgcctggag

SEQ ID NO: 4849104 - DNA, 22 bp, Homo sapiens
ctgcccttcctcctgatggagt

SEQ ID NO: 4849105 - DNA, 20 bp, Homo sapiens
ctgcccttgggtccccccga

SEQ ID NO: 4849106 - DNA, 13 bp, Homo sapiens
ctgccgttttctg

SEQ ID NO: 4849107 - DNA, 15 bp, Homo sapiens
ctgccgttttctggg

SEQ ID NO: 4849108 - DNA, 15 bp, Homo sapiens
ctgcctcaggaccca

SEQ ID NO: 4849109 - DNA, 21 bp, Homo sapiens
ctgcctcaggacccatccctg

SEQ ID NO: 4849110 - DNA, 15 bp, Homo sapiens
ctgcctcaggccaag

SEQ ID NO: 4849111 - DNA, 21 bp, Homo sapiens
ctgcctcccaaggtcctctca

SEQ ID NO: 4849112 - DNA, 11 bp, Homo sapiens
ctgcctggagg

SEQ ID NO: 4849113 - DNA, 17 bp, Homo sapiens
ctgcctggggcctccag

SEQ ID NO: 4849114 - DNA, 20 bp, Homo sapiens
ctgcctggggcctccagaag

SEQ ID NO: 4849115 - DNA, 15 bp, Homo sapiens
ctgcctgtctgaagc

SEQ ID NO: 4849116 - DNA, 17 bp, Homo sapiens
ctgctaagtcattggca

SEQ ID NO: 4849117 - DNA, 20 bp, Homo sapiens
ctgctaagtcattggcaaag

SEQ ID NO: 4849118 - DNA, 21 bp, Homo sapiens
ctgctcaactctacccctgct

SEQ ID NO: 4849119 - DNA, 20 bp, Homo sapiens
ctgctcccctaaagccaggc

SEQ ID NO: 4849120 - DNA, 21 bp, Homo sapiens
ctgctcccctaaagccaggct

SEQ ID NO: 4849121 - DNA, 20 bp, Homo sapiens
ctgctccctgtggcactcag

SEQ ID NO: 4849122 - DNA, 13 bp, Homo sapiens
ctgctcctgggca

SEQ ID NO: 4849123 - DNA, 14 bp, Homo sapiens
ctgctcctgggcat

SEQ ID NO: 4849124 - DNA, 14 bp, Homo sapiens
ctgctcctgtggca

SEQ ID NO: 4849125 - DNA, 20 bp, Homo sapiens
ctgctcctttaccctcttgg

SEQ ID NO: 4849126 - DNA, 15 bp, Homo sapiens
ctgctctatactgtg

SEQ ID NO: 4849127 - DNA, 16 bp, Homo sapiens
ctgctctatactgtgg

SEQ ID NO: 4849128 - DNA, 16 bp, Homo sapiens
ctgctctgcctggagt

SEQ ID NO: 4849129 - DNA, 20 bp, Homo sapiens
ctgctgcaaggtggcctctg

SEQ ID NO: 4849130 - DNA, 16 bp, Homo sapiens
ctgctgcacacactca

SEQ ID NO: 4849131 - DNA, 16 bp, Homo sapiens
ctgctgctactgctgc

SEQ ID NO: 4849132 - DNA, 14 bp, Homo sapiens
ctgctgctcctctc

SEQ ID NO: 4849133 - DNA, 16 bp, Homo sapiens
ctgctgctgccgccgc

SEQ ID NO: 4849134 - DNA, 22 bp, Homo sapiens
ctgctgggcgtgtgtgacactg

SEQ ID NO: 4849135 - DNA, 13 bp, Homo sapiens
ctgctgtggagtg

SEQ ID NO: 4849136 - DNA, 11 bp, Homo sapiens
ctgcttcccac

SEQ ID NO: 4849137 - DNA, 15 bp, Homo sapiens
ctgcttcccacaact

SEQ ID NO: 4849138 - DNA, 21 bp, Homo sapiens
ctgcttcccttactttgctga

SEQ ID NO: 4849139 - DNA, 17 bp, Homo sapiens
ctgcttgacctagctct

SEQ ID NO: 4849140 - DNA, 18 bp, Homo sapiens
ctgcttgactttccagaa

SEQ ID NO: 4849141 - DNA, 16 bp, Homo sapiens
ctgctttttggaaagt

SEQ ID NO: 4849142 - DNA, 18 bp, Homo sapiens
ctgctttttggaaagtca

SEQ ID NO: 4849143 - DNA, 17 bp, Homo sapiens
ctggaaagcacaagact

SEQ ID NO: 4849144 - DNA, 19 bp, Homo sapiens
ctggaaagcacaagactgg

SEQ ID NO: 4849145 - DNA, 19 bp, Homo sapiens
ctggaagtacttggccccc

SEQ ID NO: 4849146 - DNA, 22 bp, Homo sapiens
ctggactgcatggggaggcagc

SEQ ID NO: 4849147 - DNA, 21 bp, Homo sapiens
ctggagcagcggattgctctg

SEQ ID NO: 4849148 - DNA, 13 bp, Homo sapiens
ctggagcaggccc

SEQ ID NO: 4849149 - DNA, 13 bp, Homo sapiens
ctggagcttcagc

SEQ ID NO: 4849150 - DNA, 21 bp, Homo sapiens
ctggagcttcagccaggtctg

SEQ ID NO: 4849151 - DNA, 22 bp, Homo sapiens
ctggatgcctcattatgtcaac

SEQ ID NO: 4849152 - DNA, 13 bp, Homo sapiens
ctggatgtctggc

SEQ ID NO: 4849153 - DNA, 18 bp, Homo sapiens
ctggatttgcagaagttt

SEQ ID NO: 4849154 - DNA, 18 bp, Homo sapiens
ctggcaaatgcctgactc

SEQ ID NO: 4849155 - DNA, 14 bp, Homo sapiens
ctggcacaaaagac

SEQ ID NO: 4849156 - DNA, 17 bp, Homo sapiens
ctggcacaaaagacagc

SEQ ID NO: 4849157 - DNA, 18 bp, Homo sapiens
ctggcacaatgttggagc

SEQ ID NO: 4849158 - DNA, 19 bp, Homo sapiens
ctggcacaatgttggagca

SEQ ID NO: 4849159 - DNA, 22 bp, Homo sapiens
ctggcagatgggggcctctctg

SEQ ID NO: 4849160 - DNA, 13 bp, Homo sapiens
ctggccaggcagg

SEQ ID NO: 4849161 - DNA, 12 bp, Homo sapiens
ctggcccagtgc

SEQ ID NO: 4849162 - DNA, 16 bp, Homo sapiens
ctggcccagtgccagc

SEQ ID NO: 4849163 - DNA, 23 bp, Homo sapiens
ctggccggagtcagtgccaggtc

SEQ ID NO: 4849164 - DNA, 18 bp, Homo sapiens
ctggccttgcctccagga

SEQ ID NO: 4849165 - DNA, 18 bp, Homo sapiens
ctggctcaaagcagcagg

SEQ ID NO: 4849166 - DNA, 21 bp, Homo sapiens
ctggctcaaagcagcaggact

SEQ ID NO: 4849167 - DNA, 23 bp, Homo sapiens
ctggctgttctgatcggccagtt

SEQ ID NO: 4849168 - DNA, 15 bp, Homo sapiens
ctgggaaggccagcc

SEQ ID NO: 4849169 - DNA, 19 bp, Homo sapiens
ctgggaaggccagccttgt

SEQ ID NO: 4849170 - DNA, 13 bp, Homo sapiens
ctgggacccacag

SEQ ID NO: 4849171 - DNA, 16 bp, Homo sapiens
ctgggacccacagaac

SEQ ID NO: 4849172 - DNA, 18 bp, Homo sapiens
ctgggagccacttctccc

SEQ ID NO: 4849173 - DNA, 20 bp, Homo sapiens
ctgggagccacttctcccca

SEQ ID NO: 4849174 - DNA, 22 bp, Homo sapiens
ctgggattggggggtgggcttt

SEQ ID NO: 4849175 - DNA, 13 bp, Homo sapiens
ctgggcacaaaca

SEQ ID NO: 4849176 - DNA, 14 bp, Homo sapiens
ctgggcactggggc

SEQ ID NO: 4849177 - DNA, 15 bp, Homo sapiens
ctgggcagagggagg

SEQ ID NO: 4849178 - DNA, 16 bp, Homo sapiens
ctgggcatgacatcct

SEQ ID NO: 4849179 - DNA, 19 bp, Homo sapiens
ctgggcattagcaaggcag

SEQ ID NO: 4849180 - DNA, 21 bp, Homo sapiens
ctgggcgtgtgtgacactgat

SEQ ID NO: 4849181 - DNA, 15 bp, Homo sapiens
ctgggctgtgaggac

SEQ ID NO: 4849182 - DNA, 20 bp, Homo sapiens
ctggggaaacaacatttata

SEQ ID NO: 4849183 - DNA, 20 bp, Homo sapiens
ctttctaagcaaccacactg

SEQ ID NO: 4849184 - DNA, 17 bp, Homo sapiens
ctttctagttcagctgc

SEQ ID NO: 4849185 - DNA, 17 bp, Homo sapiens
ctttctatttttatgat

SEQ ID NO: 4849186 - DNA, 14 bp, Homo sapiens
ctttctccatggag

SEQ ID NO: 4849187 - DNA, 17 bp, Homo sapiens
ctttctccatggagcct

SEQ ID NO: 4849188 - DNA, 18 bp, Homo sapiens
ctttctccatggagccta

SEQ ID NO: 4849189 - DNA, 18 bp, Homo sapiens
ctttcttccacccacaaa

SEQ ID NO: 4849190 - DNA, 23 bp, Homo sapiens
ctttgaatatgtagtatctatat

SEQ ID NO: 4849191 - DNA, 21 bp, Homo sapiens
ctttgacctaaattatttact

SEQ ID NO: 4849192 - DNA, 16 bp, Homo sapiens
ctttgatactaccagg

SEQ ID NO: 4849193 - DNA, 21 bp, Homo sapiens
ctttgatactaccagggtctc

SEQ ID NO: 4849194 - DNA, 12 bp, Homo sapiens
ctttgcaaataa

SEQ ID NO: 4849195 - DNA, 16 bp, Homo sapiens
ctttgcactgatatat

SEQ ID NO: 4849196 - DNA, 20 bp, Homo sapiens
ctttgcagttggactctcag

SEQ ID NO: 4849197 - DNA, 19 bp, Homo sapiens
ctttgcattttgatattgc

SEQ ID NO: 4849198 - DNA, 16 bp, Homo sapiens
ctttggacttctgaag

SEQ ID NO: 4849199 - DNA, 17 bp, Homo sapiens
ctttggacttctgaaga

SEQ ID NO: 4849200 - DNA, 14 bp, Homo sapiens
ctttggagttaaaa

SEQ ID NO: 4849201 - DNA, 21 bp, Homo sapiens
ctttggattctaaatacatgc

SEQ ID NO: 4849202 - DNA, 14 bp, Homo sapiens
ctttgggtggctca

SEQ ID NO: 4849203 - DNA, 22 bp, Homo sapiens
ctttgggtggctcactactgaa

SEQ ID NO: 4849204 - DNA, 15 bp, Homo sapiens
ctttggtggccaggg

SEQ ID NO: 4849205 - DNA, 22 bp, Homo sapiens
ctttgtcacttttccttttctt

SEQ ID NO: 4849206 - DNA, 14 bp, Homo sapiens
ctttgtcagtgttg

SEQ ID NO: 4849207 - DNA, 17 bp, Homo sapiens
ctttgttgtgagaatgg

SEQ ID NO: 4849208 - DNA, 12 bp, Homo sapiens
cttttaaagacc

SEQ ID NO: 4849209 - DNA, 17 bp, Homo sapiens
cttttaagcatgtgatg

SEQ ID NO: 4849210 - DNA, 23 bp, Homo sapiens
cttttaagcatgtgatgttgtct

SEQ ID NO: 4849211 - DNA, 14 bp, Homo sapiens
cttttaaggataaa

SEQ ID NO: 4849212 - DNA, 21 bp, Homo sapiens
cttttaccttttttttttctt

SEQ ID NO: 4849213 - DNA, 19 bp, Homo sapiens
cttttgaatgtccaaaatt

SEQ ID NO: 4849214 - DNA, 22 bp, Homo sapiens
cttttggcctcctgcaaagtct

SEQ ID NO: 4849215 - DNA, 21 bp, Homo sapiens
cttttgggggtcagcatccag

SEQ ID NO: 4849216 - DNA, 13 bp, Homo sapiens
ctttttacctggc

SEQ ID NO: 4849217 - DNA, 16 bp, Homo sapiens
ctttttacctggccta

SEQ ID NO: 4849218 - DNA, 18 bp, Homo sapiens
ctttttattaaaatattt

SEQ ID NO: 4849219 - DNA, 18 bp, Homo sapiens
ctttttcataaattattt

SEQ ID NO: 4849220 - DNA, 22 bp, Homo sapiens
ctttttccaactcagaaattca

SEQ ID NO: 4849221 - DNA, 16 bp, Homo sapiens
cttttttttttcttgg

SEQ ID NO: 4849222 - DNA, 17 bp, Homo sapiens
gaaaaataaacactaca

SEQ ID NO: 4849223 - DNA, 20 bp, Homo sapiens
gaaaaatctaagtgatataa

SEQ ID NO: 4849224 - DNA, 16 bp, Homo sapiens
gaaaacatgttaatga

SEQ ID NO: 4849225 - DNA, 13 bp, Homo sapiens
gaaaaccacttta

SEQ ID NO: 4849226 - DNA, 16 bp, Homo sapiens
gaaaagaaaacaaaaa

SEQ ID NO: 4849227 - DNA, 15 bp, Homo sapiens
gaaaagaaggaaaga

SEQ ID NO: 4849228 - DNA, 20 bp, Homo sapiens
gaaaagataaagaccagaaa

SEQ ID NO: 4849229 - DNA, 19 bp, Homo sapiens
gaaaaggttgaataatata

SEQ ID NO: 4849230 - DNA, 14 bp, Homo sapiens
gaaaatgaaatgca

SEQ ID NO: 4849231 - DNA, 18 bp, Homo sapiens
gaaaatgaaatgcatatt

SEQ ID NO: 4849232 - DNA, 22 bp, Homo sapiens
gaaaatgtctgtaataatagac

SEQ ID NO: 4849233 - DNA, 12 bp, Homo sapiens
gaaaattgagtt

SEQ ID NO: 4849234 - DNA, 19 bp, Homo sapiens
gaaacaaacaaaactctta

SEQ ID NO: 4849235 - DNA, 20 bp, Homo sapiens
gaaacaaacaaaactcttaa

SEQ ID NO: 4849236 - DNA, 12 bp, Homo sapiens
gaaacaaagatg

SEQ ID NO: 4849237 - DNA, 21 bp, Homo sapiens
gaaacaaataatttgaacttt

SEQ ID NO: 4849238 - DNA, 16 bp, Homo sapiens
gaaacaacatttatat

SEQ ID NO: 4849239 - DNA, 20 bp, Homo sapiens
gaaacactatttgtgacttt

SEQ ID NO: 4849240 - DNA, 18 bp, Homo sapiens
gaaacatgggctgtgatt

SEQ ID NO: 4849241 - DNA, 23 bp, Homo sapiens
gaaacatgggctgtgattactgc

SEQ ID NO: 4849242 - DNA, 13 bp, Homo sapiens
gaaacccagagat

SEQ ID NO: 4849243 - DNA, 14 bp, Homo sapiens
gaaactgaggccca

SEQ ID NO: 4849244 - DNA, 13 bp, Homo sapiens
gaaagaatagaac

SEQ ID NO: 4849245 - DNA, 15 bp, Homo sapiens
gaaagagaggaacca

SEQ ID NO: 4849246 - DNA, 13 bp, Homo sapiens
gaaagagaggact

SEQ ID NO: 4849247 - DNA, 21 bp, Homo sapiens
gaaagagcctaacatctccat

SEQ ID NO: 4849248 - DNA, 22 bp, Homo sapiens
gaaagatgcatcatctcttcct

SEQ ID NO: 4849249 - DNA, 19 bp, Homo sapiens
gaaagatggttaaacattt

SEQ ID NO: 4849250 - DNA, 17 bp, Homo sapiens
gaaagcacaagactggc

SEQ ID NO: 4849251 - DNA, 22 bp, Homo sapiens
gaaagcataaagctcaaatgaa

SEQ ID NO: 4849252 - DNA, 14 bp, Homo sapiens
gaaaggcagggccc

SEQ ID NO: 4849253 - DNA, 13 bp, Homo sapiens
gaaaggccagcag

SEQ ID NO: 4849254 - DNA, 15 bp, Homo sapiens
gaaaggccagcagct

SEQ ID NO: 4849255 - DNA, 21 bp, Homo sapiens
gaaagtcagaatcagaagata

SEQ ID NO: 4849256 - DNA, 14 bp, Homo sapiens
gaaataaactgtgc

SEQ ID NO: 4849257 - DNA, 21 bp, Homo sapiens
gaaataatgctacaattttaa

SEQ ID NO: 4849258 - DNA, 22 bp, Homo sapiens
gaaatacgtttgtgtttctaga

SEQ ID NO: 4849259 - DNA, 14 bp, Homo sapiens
gaaatactcatgtg

SEQ ID NO: 4849260 - DNA, 21 bp, Homo sapiens
gaaatagacaaaaagtatatt

SEQ ID NO: 4849261 - DNA, 16 bp, Homo sapiens
gaaatatcaaagtcat

SEQ ID NO: 4849262 - DNA, 19 bp, Homo sapiens
gaaatccatatatatgaaa

SEQ ID NO: 4849263 - DNA, 14 bp, Homo sapiens
gaaatctgaacatt

SEQ ID NO: 4849264 - DNA, 19 bp, Homo sapiens
gaaatgccagtggtggagg

SEQ ID NO: 4849265 - DNA, 16 bp, Homo sapiens
gaaattacctgtggat

SEQ ID NO: 4849266 - DNA, 17 bp, Homo sapiens
gaaattacctgtggata

SEQ ID NO: 4849267 - DNA, 16 bp, Homo sapiens
gaaattgcatactttg

SEQ ID NO: 4849268 - DNA, 18 bp, Homo sapiens
gaacaagcttcagtaagt

SEQ ID NO: 4849269 - DNA, 19 bp, Homo sapiens
gaacactgtgaccaggctt

SEQ ID NO: 4849270 - DNA, 23 bp, Homo sapiens
gaacactgtgaccaggcttttgt

SEQ ID NO: 4849271 - DNA, 21 bp, Homo sapiens
gaacagcgggtacttatttct

SEQ ID NO: 4849272 - DNA, 18 bp, Homo sapiens
gaacaggaaagagctagg

SEQ ID NO: 4849273 - DNA, 19 bp, Homo sapiens
gaacataaaccctccaagg

SEQ ID NO: 4849274 - DNA, 14 bp, Homo sapiens
gaacatgttctcca

SEQ ID NO: 4849275 - DNA, 19 bp, Homo sapiens
gaaccacattgaagaatgt

SEQ ID NO: 4849276 - DNA, 14 bp, Homo sapiens
gaacccccctccca

SEQ ID NO: 4849277 - DNA, 18 bp, Homo sapiens
gaaccctccaaaggaact

SEQ ID NO: 4849278 - DNA, 12 bp, Homo sapiens
gaaccctggagg

SEQ ID NO: 4849279 - DNA, 18 bp, Homo sapiens
gaacctacagttttaact

SEQ ID NO: 4849280 - DNA, 19 bp, Homo sapiens
gaacctacagttttaactg

SEQ ID NO: 4849281 - DNA, 23 bp, Homo sapiens
gaacctctaagtgctgctgtgga

SEQ ID NO: 4849282 - DNA, 16 bp, Homo sapiens
gaacgaaaatgaaagc

SEQ ID NO: 4849283 - DNA, 20 bp, Homo sapiens
gaacggtggaggcagaggtg

SEQ ID NO: 4849284 - DNA, 17 bp, Homo sapiens
gaactcccccagaggtg

SEQ ID NO: 4849285 - DNA, 19 bp, Homo sapiens
gaactcccccagaggtgga

SEQ ID NO: 4849286 - DNA, 19 bp, Homo sapiens
gaactcctgtcttctttct

SEQ ID NO: 4849287 - DNA, 12 bp, Homo sapiens
gaactcttcctc

SEQ ID NO: 4849288 - DNA, 15 bp, Homo sapiens
gaactcttcctcctc

SEQ ID NO: 4849289 - DNA, 20 bp, Homo sapiens
gaactcttcctcctcccaag

SEQ ID NO: 4849290 - DNA, 20 bp, Homo sapiens
gaacttcagcattgtaatta

SEQ ID NO: 4849291 - DNA, 13 bp, Homo sapiens
gaactttgtcagt

SEQ ID NO: 4849292 - DNA, 13 bp, Homo sapiens
gaactttgtgctt

SEQ ID NO: 4849293 - DNA, 15 bp, Homo sapiens
gaactttttaaagaa

SEQ ID NO: 4849294 - DNA, 19 bp, Homo sapiens
gaagaaaatttgccaatct

SEQ ID NO: 4849295 - DNA, 13 bp, Homo sapiens
gaagaatcttcct

SEQ ID NO: 4849296 - DNA, 14 bp, Homo sapiens
gaagaatgtttctg

SEQ ID NO: 4849297 - DNA, 17 bp, Homo sapiens
gaagaattgaaaagttt

SEQ ID NO: 4849298 - DNA, 18 bp, Homo sapiens
gaagaattgaaaagtttt

SEQ ID NO: 4849299 - DNA, 18 bp, Homo sapiens
gaagacaagcatttttaa

SEQ ID NO: 4849300 - DNA, 15 bp, Homo sapiens
gaagactgagccaga

SEQ ID NO: 4849301 - DNA, 23 bp, Homo sapiens
gaagagacagagacaagtaattt

SEQ ID NO: 4849302 - DNA, 14 bp, Homo sapiens
gaagagaccactca

SEQ ID NO: 4849303 - DNA, 14 bp, Homo sapiens
gagcttcagccagg

SEQ ID NO: 4849304 - DNA, 18 bp, Homo sapiens
gagcttcagccaggtctg

SEQ ID NO: 4849305 - DNA, 19 bp, Homo sapiens
gagcttcagccaggtctga

SEQ ID NO: 4849306 - DNA, 17 bp, Homo sapiens
gaggaagacaagcattt

SEQ ID NO: 4849307 - DNA, 19 bp, Homo sapiens
gaggacagggcccccacag

SEQ ID NO: 4849308 - DNA, 20 bp, Homo sapiens
gaggaccaatgcttgcatgg

SEQ ID NO: 4849309 - DNA, 14 bp, Homo sapiens
gaggacctccctgt

SEQ ID NO: 4849310 - DNA, 16 bp, Homo sapiens
gaggatagagacttgc

SEQ ID NO: 4849311 - DNA, 15 bp, Homo sapiens
gaggatccagggcag

SEQ ID NO: 4849312 - DNA, 17 bp, Homo sapiens
gaggcaagctgaaattt

SEQ ID NO: 4849313 - DNA, 21 bp, Homo sapiens
gaggcagcctagcctatgtct

SEQ ID NO: 4849314 - DNA, 13 bp, Homo sapiens
gaggccttccctt

SEQ ID NO: 4849315 - DNA, 14 bp, Homo sapiens
gaggctgagaaagc

SEQ ID NO: 4849316 - DNA, 19 bp, Homo sapiens
gaggcttgtttacctttct

SEQ ID NO: 4849317 - DNA, 16 bp, Homo sapiens
gagggaaaaggcaggt

SEQ ID NO: 4849318 - DNA, 21 bp, Homo sapiens
gagggaaaaggcaggtgcttt

SEQ ID NO: 4849319 - DNA, 21 bp, Homo sapiens
gagggaagacctgaaagagag

SEQ ID NO: 4849320 - DNA, 21 bp, Homo sapiens
gagggaagatgacctgcccca

SEQ ID NO: 4849321 - DNA, 17 bp, Homo sapiens
gagggaatctagcccaa

SEQ ID NO: 4849322 - DNA, 15 bp, Homo sapiens
gagggaggggccctg

SEQ ID NO: 4849323 - DNA, 12 bp, Homo sapiens
gagggatgatga

SEQ ID NO: 4849324 - DNA, 22 bp, Homo sapiens
gaggggccctgtcactgtccag

SEQ ID NO: 4849325 - DNA, 11 bp, Homo sapiens
gaggggcgcgg

SEQ ID NO: 4849326 - DNA, 13 bp, Homo sapiens
gagggggtaaagc

SEQ ID NO: 4849327 - DNA, 17 bp, Homo sapiens
gagggttggagtgctct

SEQ ID NO: 4849328 - DNA, 15 bp, Homo sapiens
gaggtctagagagaa

SEQ ID NO: 4849329 - DNA, 16 bp, Homo sapiens
gaggtgaactccaggc

SEQ ID NO: 4849330 - DNA, 12 bp, Homo sapiens
gaggtggggtgc

SEQ ID NO: 4849331 - DNA, 14 bp, Homo sapiens
gaggtggggtgctg

SEQ ID NO: 4849332 - DNA, 16 bp, Homo sapiens
gaggtggggtgctggg

SEQ ID NO: 4849333 - DNA, 21 bp, Homo sapiens
gaggtggggtgctggggctgc

SEQ ID NO: 4849334 - DNA, 23 bp, Homo sapiens
gaggtgtattggtgttgcagccg

SEQ ID NO: 4849335 - DNA, 18 bp, Homo sapiens
gaggttgtggggcctcag

SEQ ID NO: 4849336 - DNA, 16 bp, Homo sapiens
gagtagggccctgaca

SEQ ID NO: 4849337 - DNA, 18 bp, Homo sapiens
gagtagggccctgacagg

SEQ ID NO: 4849338 - DNA, 20 bp, Homo sapiens
gagtattgtttaaaatgtaa

SEQ ID NO: 4849339 - DNA, 22 bp, Homo sapiens
gagtcagacatttctttggaaa

SEQ ID NO: 4849340 - DNA, 18 bp, Homo sapiens
gagtcagtgccaggtcct

SEQ ID NO: 4849341 - DNA, 23 bp, Homo sapiens
gagtccaacagacacaatttata

SEQ ID NO: 4849342 - DNA, 15 bp, Homo sapiens
gagtctctgaatttg

SEQ ID NO: 4849343 - DNA, 18 bp, Homo sapiens
gagtctgtatttttctaa

SEQ ID NO: 4849344 - DNA, 13 bp, Homo sapiens
gagtctgtctctt

SEQ ID NO: 4849345 - DNA, 15 bp, Homo sapiens
gagtgaataaatgtc

SEQ ID NO: 4849346 - DNA, 19 bp, Homo sapiens
gagtgagggggtaaagcag

SEQ ID NO: 4849347 - DNA, 14 bp, Homo sapiens
gagtgctcttccca

SEQ ID NO: 4849348 - DNA, 21 bp, Homo sapiens
gagtgggaagggagcattgca

SEQ ID NO: 4849349 - DNA, 22 bp, Homo sapiens
gagtgggctttggtggccaggg

SEQ ID NO: 4849350 - DNA, 14 bp, Homo sapiens
gagtgggtgggatg

SEQ ID NO: 4849351 - DNA, 17 bp, Homo sapiens
gagtgtagtcccggagg

SEQ ID NO: 4849352 - DNA, 13 bp, Homo sapiens
gagtgtatgagta

SEQ ID NO: 4849353 - DNA, 18 bp, Homo sapiens
gagtgtcggatcctgtga

SEQ ID NO: 4849354 - DNA, 23 bp, Homo sapiens
gagttatcatgaattttaaagta

SEQ ID NO: 4849355 - DNA, 15 bp, Homo sapiens
gagttccagttgaag

SEQ ID NO: 4849356 - DNA, 22 bp, Homo sapiens
gagttcccttgaaactttggga

SEQ ID NO: 4849357 - DNA, 22 bp, Homo sapiens
gagttccggggagaaacccaga

SEQ ID NO: 4849358 - DNA, 23 bp, Homo sapiens
gagttccggggagaaacccagag

SEQ ID NO: 4849359 - DNA, 21 bp, Homo sapiens
gagtttcactgtactgcatgt

SEQ ID NO: 4849360 - DNA, 12 bp, Homo sapiens
gataaaatgatg

SEQ ID NO: 4849361 - DNA, 11 bp, Homo sapiens
gataaacaaac

SEQ ID NO: 4849362 - DNA, 16 bp, Homo sapiens
gataaagaataataat

SEQ ID NO: 4849363 - DNA, 16 bp, Homo sapiens
gataaagaccagaaat

SEQ ID NO: 4849364 - DNA, 18 bp, Homo sapiens
gataaagaccagaaattc

SEQ ID NO: 4849365 - DNA, 17 bp, Homo sapiens
gataaatcataaagtca

SEQ ID NO: 4849366 - DNA, 18 bp, Homo sapiens
gataaatcataaagtcag

SEQ ID NO: 4849367 - DNA, 22 bp, Homo sapiens
gataatattgtttggtaaatgt

SEQ ID NO: 4849368 - DNA, 19 bp, Homo sapiens
gataccatgctgtaaggat

SEQ ID NO: 4849369 - DNA, 13 bp, Homo sapiens
gatacctgtgagg

SEQ ID NO: 4849370 - DNA, 16 bp, Homo sapiens
gatacctgtgaggact

SEQ ID NO: 4849371 - DNA, 16 bp, Homo sapiens
gatactaccagggtct

SEQ ID NO: 4849372 - DNA, 21 bp, Homo sapiens
gatactggggggcaggcctcc

SEQ ID NO: 4849373 - DNA, 17 bp, Homo sapiens
gatagtgggatttccag

SEQ ID NO: 4849374 - DNA, 16 bp, Homo sapiens
gatatacaaagtgtac

SEQ ID NO: 4849375 - DNA, 17 bp, Homo sapiens
gatatataagtgtacat

SEQ ID NO: 4849376 - DNA, 14 bp, Homo sapiens
gatatctgcatgtg

SEQ ID NO: 4849377 - DNA, 20 bp, Homo sapiens
gatatgtattcttttctcag

SEQ ID NO: 4849378 - DNA, 16 bp, Homo sapiens
gatattttgaaatgaa

SEQ ID NO: 4849379 - DNA, 14 bp, Homo sapiens
gatcagcaaaaaga

SEQ ID NO: 4849380 - DNA, 16 bp, Homo sapiens
gatcagcaaaaagact

SEQ ID NO: 4849381 - DNA, 18 bp, Homo sapiens
gatcagcaaaaagactgg

SEQ ID NO: 4849382 - DNA, 16 bp, Homo sapiens
gatcatatggtaggac

SEQ ID NO: 4849383 - DNA, 20 bp, Homo sapiens
gatccagcccaaacctggga

SEQ ID NO: 4849384 - DNA, 16 bp, Homo sapiens
gatccagggcagcagg

SEQ ID NO: 4849385 - DNA, 21 bp, Homo sapiens
gatccagggcagcaggccaga

SEQ ID NO: 4849386 - DNA, 17 bp, Homo sapiens
gatccatttccattgct

SEQ ID NO: 4849387 - DNA, 19 bp, Homo sapiens
gatccccctctttgcacag

SEQ ID NO: 4849388 - DNA, 15 bp, Homo sapiens
gatcctcagttctca

SEQ ID NO: 4849389 - DNA, 16 bp, Homo sapiens
gatcctggcctgagaa

SEQ ID NO: 4849390 - DNA, 18 bp, Homo sapiens
gatcgagtgtagctgtga

SEQ ID NO: 4849391 - DNA, 21 bp, Homo sapiens
gatctattgtttgttgcacta

SEQ ID NO: 4849392 - DNA, 23 bp, Homo sapiens
gatctgccccctagttcaggtcc

SEQ ID NO: 4849393 - DNA, 20 bp, Homo sapiens
gatctgctatttttaatttc

SEQ ID NO: 4849394 - DNA, 22 bp, Homo sapiens
gatctgttttgtggtttggaat

SEQ ID NO: 4849395 - DNA, 15 bp, Homo sapiens
gatctttcagaaata

SEQ ID NO: 4849396 - DNA, 23 bp, Homo sapiens
gatgaaaagtatattgataacct

SEQ ID NO: 4849397 - DNA, 18 bp, Homo sapiens
gatgaattgtcacatcta

SEQ ID NO: 4849398 - DNA, 13 bp, Homo sapiens
gatgacctccaga

SEQ ID NO: 4849399 - DNA, 11 bp, Homo sapiens
gatgagagaat

SEQ ID NO: 4849400 - DNA, 18 bp, Homo sapiens
gatgaggacccagagctg

SEQ ID NO: 4849401 - DNA, 19 bp, Homo sapiens
gatgaggcaaacagcaaga

SEQ ID NO: 4849402 - DNA, 17 bp, Homo sapiens
gatgaggctcagagagg

SEQ ID NO: 4849403 - DNA, 14 bp, Homo sapiens
gatgagggctggct

SEQ ID NO: 4849404 - DNA, 15 bp, Homo sapiens
gatgataaaggaaat

SEQ ID NO: 4849405 - DNA, 18 bp, Homo sapiens
gatgattttttgaaagtt

SEQ ID NO: 4849406 - DNA, 23 bp, Homo sapiens
gatgcttgcggcaaaaggaaagc

SEQ ID NO: 4849407 - DNA, 14 bp, Homo sapiens
gatgctttggaaga

SEQ ID NO: 4849408 - DNA, 14 bp, Homo sapiens
gatggagccccagg

SEQ ID NO: 4849409 - DNA, 18 bp, Homo sapiens
gatggagtgtgcagacag

SEQ ID NO: 4849410 - DNA, 13 bp, Homo sapiens
gatgggggcctct

SEQ ID NO: 4849411 - DNA, 16 bp, Homo sapiens
gatgggtgccctttcc

SEQ ID NO: 4849412 - DNA, 22 bp, Homo sapiens
gatgtactgcaaagtcgccagt

SEQ ID NO: 4849413 - DNA, 18 bp, Homo sapiens
gatgtccttaaaatgtgg

SEQ ID NO: 4849414 - DNA, 16 bp, Homo sapiens
gatgtctttttattaa

SEQ ID NO: 4849415 - DNA, 11 bp, Homo sapiens
gatgtgatata

SEQ ID NO: 4849416 - DNA, 18 bp, Homo sapiens
gatgtgatatataagtgt

SEQ ID NO: 4849417 - DNA, 22 bp, Homo sapiens
gattagaaattacctgtggata

SEQ ID NO: 4849418 - DNA, 21 bp, Homo sapiens
gattattgagttccagttgaa

SEQ ID NO: 4849419 - DNA, 20 bp, Homo sapiens
gattccaagttctcacctct

SEQ ID NO: 4849420 - DNA, 20 bp, Homo sapiens
gattctggctttaagccttc

SEQ ID NO: 4849421 - DNA, 18 bp, Homo sapiens
gattgctctggagcagcc

SEQ ID NO: 4849422 - DNA, 19 bp, Homo sapiens
gattgctctggagcagcca

SEQ ID NO: 4849423 - DNA, 21 bp, Homo sapiens
gccgcagagaaatgccccagt

SEQ ID NO: 4849424 - DNA, 15 bp, Homo sapiens
gccgccgccgccgcc

SEQ ID NO: 4849425 - DNA, 14 bp, Homo sapiens
gccgccgctgccct

SEQ ID NO: 4849426 - DNA, 23 bp, Homo sapiens
gccgctgcccttgggtccccccg

SEQ ID NO: 4849427 - DNA, 16 bp, Homo sapiens
gccggagtcagtgcca

SEQ ID NO: 4849428 - DNA, 13 bp, Homo sapiens
gccgtaatttaac

SEQ ID NO: 4849429 - DNA, 18 bp, Homo sapiens
gccgtagcttcagccagg

SEQ ID NO: 4849430 - DNA, 13 bp, Homo sapiens
gccgtctcctccc

SEQ ID NO: 4849431 - DNA, 14 bp, Homo sapiens
gcctaacctgggac

SEQ ID NO: 4849432 - DNA, 23 bp, Homo sapiens
gcctaacctgggacctgtggtca

SEQ ID NO: 4849433 - DNA, 13 bp, Homo sapiens
gcctaagaagaag

SEQ ID NO: 4849434 - DNA, 19 bp, Homo sapiens
gcctaagaagaaggccaga

SEQ ID NO: 4849435 - DNA, 16 bp, Homo sapiens
gcctacctctgtctga

SEQ ID NO: 4849436 - DNA, 20 bp, Homo sapiens
gcctacctctgtctgagaca

SEQ ID NO: 4849437 - DNA, 20 bp, Homo sapiens
gcctagggtcttgggggtca

SEQ ID NO: 4849438 - DNA, 14 bp, Homo sapiens
gcctatgtctggca

SEQ ID NO: 4849439 - DNA, 16 bp, Homo sapiens
gcctatgtctggcaga

SEQ ID NO: 4849440 - DNA, 19 bp, Homo sapiens
gcctatgtctggcagatga

SEQ ID NO: 4849441 - DNA, 14 bp, Homo sapiens
gcctcaccagcccc

SEQ ID NO: 4849442 - DNA, 21 bp, Homo sapiens
gcctcaccatgtgagctcttc

SEQ ID NO: 4849443 - DNA, 21 bp, Homo sapiens
gcctcagcctgctttcctgca

SEQ ID NO: 4849444 - DNA, 19 bp, Homo sapiens
gcctcaggacccatccctg

SEQ ID NO: 4849445 - DNA, 21 bp, Homo sapiens
gcctcaggccaagggaccagg

SEQ ID NO: 4849446 - DNA, 13 bp, Homo sapiens
gcctcaggctccg

SEQ ID NO: 4849447 - DNA, 23 bp, Homo sapiens
gcctcattttgcttcccatctga

SEQ ID NO: 4849448 - DNA, 16 bp, Homo sapiens
gcctccaagcctgcct

SEQ ID NO: 4849449 - DNA, 20 bp, Homo sapiens
gcctccaagcctgcctccca

SEQ ID NO: 4849450 - DNA, 15 bp, Homo sapiens
gcctccagaagctgc

SEQ ID NO: 4849451 - DNA, 11 bp, Homo sapiens
gcctcccaagc

SEQ ID NO: 4849452 - DNA, 16 bp, Homo sapiens
gcctcccaagctgatg

SEQ ID NO: 4849453 - DNA, 19 bp, Homo sapiens
gcctcccaaggtcctctca

SEQ ID NO: 4849454 - DNA, 14 bp, Homo sapiens
gcctcccctgggca

SEQ ID NO: 4849455 - DNA, 15 bp, Homo sapiens
gcctcccctgggcag

SEQ ID NO: 4849456 - DNA, 20 bp, Homo sapiens
gcctccgttgtctggttgct

SEQ ID NO: 4849457 - DNA, 22 bp, Homo sapiens
gcctcggttgcggacctaggac

SEQ ID NO: 4849458 - DNA, 16 bp, Homo sapiens
gcctctcctgccctct

SEQ ID NO: 4849459 - DNA, 17 bp, Homo sapiens
gcctctcctgccctctg

SEQ ID NO: 4849460 - DNA, 22 bp, Homo sapiens
gcctctcctgccctctgctctg

SEQ ID NO: 4849461 - DNA, 17 bp, Homo sapiens
gcctctctggaagaggg

SEQ ID NO: 4849462 - DNA, 19 bp, Homo sapiens
gcctctctggaagagggag

SEQ ID NO: 4849463 - DNA, 12 bp, Homo sapiens
gcctctgcctgg

SEQ ID NO: 4849464 - DNA, 15 bp, Homo sapiens
gcctctgcctggggc

SEQ ID NO: 4849465 - DNA, 23 bp, Homo sapiens
gcctgagaaacactatttgtgac

SEQ ID NO: 4849466 - DNA, 22 bp, Homo sapiens
gcctgcagagcaggacctggga

SEQ ID NO: 4849467 - DNA, 19 bp, Homo sapiens
gcctgctaaggctcctcct

SEQ ID NO: 4849468 - DNA, 13 bp, Homo sapiens
gcctgcttcccac

SEQ ID NO: 4849469 - DNA, 21 bp, Homo sapiens
gcctgcttgactttccagaat

SEQ ID NO: 4849470 - DNA, 14 bp, Homo sapiens
gcctggagcaggcc

SEQ ID NO: 4849471 - DNA, 15 bp, Homo sapiens
gcctggagcaggccc

SEQ ID NO: 4849472 - DNA, 20 bp, Homo sapiens
gcctggaggctcctctaggc

SEQ ID NO: 4849473 - DNA, 13 bp, Homo sapiens
gcctggccaggca

SEQ ID NO: 4849474 - DNA, 16 bp, Homo sapiens
gcctggccaggcaggg

SEQ ID NO: 4849475 - DNA, 17 bp, Homo sapiens
gcctggccaggcaggga

SEQ ID NO: 4849476 - DNA, 15 bp, Homo sapiens
gcctgggctgtgagg

SEQ ID NO: 4849477 - DNA, 20 bp, Homo sapiens
gcctggggcctccagaagct

SEQ ID NO: 4849478 - DNA, 17 bp, Homo sapiens
gcctggtttctgggtgc

SEQ ID NO: 4849479 - DNA, 19 bp, Homo sapiens
gcctgtccctagggctctc

SEQ ID NO: 4849480 - DNA, 18 bp, Homo sapiens
gcctgtgagcatggggcc

SEQ ID NO: 4849481 - DNA, 22 bp, Homo sapiens
gccttacttcaaagtgcctggg

SEQ ID NO: 4849482 - DNA, 21 bp, Homo sapiens
gccttagagctcttgtgttca

SEQ ID NO: 4849483 - DNA, 14 bp, Homo sapiens
gccttcatcagaac

SEQ ID NO: 4849484 - DNA, 22 bp, Homo sapiens
gccttcatcagaactcttcctc

SEQ ID NO: 4849485 - DNA, 22 bp, Homo sapiens
gccttccctttacagctctcct

SEQ ID NO: 4849486 - DNA, 21 bp, Homo sapiens
gccttcctcctctcaaacctg

SEQ ID NO: 4849487 - DNA, 17 bp, Homo sapiens
gccttcgtttatatttt

SEQ ID NO: 4849488 - DNA, 21 bp, Homo sapiens
gccttgtacagtctgctcctc

SEQ ID NO: 4849489 - DNA, 23 bp, Homo sapiens
gccttgtttaatggtagttttac

SEQ ID NO: 4849490 - DNA, 17 bp, Homo sapiens
gcctttatgttctttca

SEQ ID NO: 4849491 - DNA, 23 bp, Homo sapiens
gcctttatttttggcgtggctga

SEQ ID NO: 4849492 - DNA, 23 bp, Homo sapiens
gcctttgcagttggactctcagg

SEQ ID NO: 4849493 - DNA, 18 bp, Homo sapiens
gcctttttacctggccta

SEQ ID NO: 4849494 - DNA, 21 bp, Homo sapiens
gcctttttacctggcctagaa

SEQ ID NO: 4849495 - DNA, 20 bp, Homo sapiens
gcgaagtctttgccttctct

SEQ ID NO: 4849496 - DNA, 17 bp, Homo sapiens
gcgaccccgtcacagcc

SEQ ID NO: 4849497 - DNA, 23 bp, Homo sapiens
gcgagatagggggaagacagata

SEQ ID NO: 4849498 - DNA, 19 bp, Homo sapiens
gcgagggatgatgagggaa

SEQ ID NO: 4849499 - DNA, 19 bp, Homo sapiens
gcggattgctctggagcag

SEQ ID NO: 4849500 - DNA, 16 bp, Homo sapiens
gcggcaaaaggaaagc

SEQ ID NO: 4849501 - DNA, 16 bp, Homo sapiens
gcggggtcccctctgt

SEQ ID NO: 4849502 - DNA, 22 bp, Homo sapiens
gcgggtacttatttctcagctg

SEQ ID NO: 4849503 - DNA, 22 bp, Homo sapiens
gcgtggatcgagtgtagctgtg

SEQ ID NO: 4849504 - DNA, 13 bp, Homo sapiens
gcgtgtggagcag

SEQ ID NO: 4849505 - DNA, 17 bp, Homo sapiens
gcgtgtggagcagagct

SEQ ID NO: 4849506 - DNA, 19 bp, Homo sapiens
gcgtgtgtgacactgatga

SEQ ID NO: 4849507 - DNA, 19 bp, Homo sapiens
gcgttctaaatatgaatga

SEQ ID NO: 4849508 - DNA, 20 bp, Homo sapiens
gctaatttgttttggatata

SEQ ID NO: 4849509 - DNA, 18 bp, Homo sapiens
gctactgtaatgctgcct

SEQ ID NO: 4849510 - DNA, 21 bp, Homo sapiens
gctactgtaatgctgcctcag

SEQ ID NO: 4849511 - DNA, 19 bp, Homo sapiens
gctactgttgtaagaattc

SEQ ID NO: 4849512 - DNA, 15 bp, Homo sapiens
gctagatccagccca

SEQ ID NO: 4849513 - DNA, 20 bp, Homo sapiens
gctagatccagcccaaacct

SEQ ID NO: 4849514 - DNA, 16 bp, Homo sapiens
gctaggaaccctggag

SEQ ID NO: 4849515 - DNA, 18 bp, Homo sapiens
gctaggcgctggggagac

SEQ ID NO: 4849516 - DNA, 23 bp, Homo sapiens
gctagtgggccctctctctgggc

SEQ ID NO: 4849517 - DNA, 15 bp, Homo sapiens
gctatcggcagatga

SEQ ID NO: 4849518 - DNA, 18 bp, Homo sapiens
gctatcggcagatgatgc

SEQ ID NO: 4849519 - DNA, 15 bp, Homo sapiens
gctattaaaaaagtc

SEQ ID NO: 4849520 - DNA, 16 bp, Homo sapiens
gctattaaaaaagtct

SEQ ID NO: 4849521 - DNA, 19 bp, Homo sapiens
gctcaactctacccctgct

SEQ ID NO: 4849522 - DNA, 20 bp, Homo sapiens
gctcaactctacccctgctc

SEQ ID NO: 4849523 - DNA, 15 bp, Homo sapiens
gctcaccgccctgct

SEQ ID NO: 4849524 - DNA, 12 bp, Homo sapiens
gctcactactga

SEQ ID NO: 4849525 - DNA, 15 bp, Homo sapiens
gctcactactgaaca

SEQ ID NO: 4849526 - DNA, 19 bp, Homo sapiens
gctcactcccaagggacag

SEQ ID NO: 4849527 - DNA, 12 bp, Homo sapiens
gctcagcctggt

SEQ ID NO: 4849528 - DNA, 16 bp, Homo sapiens
gctcaggagaagccag

SEQ ID NO: 4849529 - DNA, 20 bp, Homo sapiens
gctcaggagaagccagtgtc

SEQ ID NO: 4849530 - DNA, 14 bp, Homo sapiens
gctcatgctgctcc

SEQ ID NO: 4849531 - DNA, 17 bp, Homo sapiens
gctccaatgactgagca

SEQ ID NO: 4849532 - DNA, 14 bp, Homo sapiens
gctccacactcaga

SEQ ID NO: 4849533 - DNA, 19 bp, Homo sapiens
gctccacgtctgcgccgcc

SEQ ID NO: 4849534 - DNA, 16 bp, Homo sapiens
gctcccattcctccct

SEQ ID NO: 4849535 - DNA, 22 bp, Homo sapiens
gctcccctcccaggggagccag

SEQ ID NO: 4849536 - DNA, 16 bp, Homo sapiens
gctccctgtggcactc

SEQ ID NO: 4849537 - DNA, 12 bp, Homo sapiens
gctcctcttgtt

SEQ ID NO: 4849538 - DNA, 20 bp, Homo sapiens
gctcctgggcattagcaagg

SEQ ID NO: 4849539 - DNA, 21 bp, Homo sapiens
gctcctgggcattagcaaggc

SEQ ID NO: 4849540 - DNA, 14 bp, Homo sapiens
gctcctgtggcagg

SEQ ID NO: 4849541 - DNA, 17 bp, Homo sapiens
gctcctgtggcaggagg

SEQ ID NO: 4849542 - DNA, 16 bp, Homo sapiens
ggccagagagggaaaa

SEQ ID NO: 4849543 - DNA, 20 bp, Homo sapiens
ggccagagagggaaaaggca

SEQ ID NO: 4849544 - DNA, 22 bp, Homo sapiens
ggccagagagggaaaaggcagg

SEQ ID NO: 4849545 - DNA, 23 bp, Homo sapiens
ggccagagagggaaaaggcaggt

SEQ ID NO: 4849546 - DNA, 20 bp, Homo sapiens
ggccagggaggcagcctagc

SEQ ID NO: 4849547 - DNA, 15 bp, Homo sapiens
ggcccaatgctgctt

SEQ ID NO: 4849548 - DNA, 23 bp, Homo sapiens
ggcccaggcagacaaccttgtcc

SEQ ID NO: 4849549 - DNA, 18 bp, Homo sapiens
ggcccatagcagccagtt

SEQ ID NO: 4849550 - DNA, 17 bp, Homo sapiens
ggcccccacaggggatg

SEQ ID NO: 4849551 - DNA, 14 bp, Homo sapiens
ggcccccttcagga

SEQ ID NO: 4849552 - DNA, 18 bp, Homo sapiens
ggcccccttcaggagcct

SEQ ID NO: 4849553 - DNA, 17 bp, Homo sapiens
ggcccctgcgtgggggc

SEQ ID NO: 4849554 - DNA, 21 bp, Homo sapiens
ggccctctagcttctaccctt

SEQ ID NO: 4849555 - DNA, 21 bp, Homo sapiens
ggccgccagcgtgtggagcag

SEQ ID NO: 4849556 - DNA, 23 bp, Homo sapiens
ggccgccagcgtgtggagcagag

SEQ ID NO: 4849557 - DNA, 15 bp, Homo sapiens
ggccgtctcctccct

SEQ ID NO: 4849558 - DNA, 14 bp, Homo sapiens
ggcctccagaagct

SEQ ID NO: 4849559 - DNA, 12 bp, Homo sapiens
ggcctcccaagc

SEQ ID NO: 4849560 - DNA, 14 bp, Homo sapiens
ggcctcccaagctg

SEQ ID NO: 4849561 - DNA, 15 bp, Homo sapiens
ggcctcccctgggca

SEQ ID NO: 4849562 - DNA, 18 bp, Homo sapiens
ggcctctcctgccctctg

SEQ ID NO: 4849563 - DNA, 21 bp, Homo sapiens
ggcctctctggaagagggagg

SEQ ID NO: 4849564 - DNA, 22 bp, Homo sapiens
ggcctctctggaagagggaggg

SEQ ID NO: 4849565 - DNA, 13 bp, Homo sapiens
ggcctctgcctgg

SEQ ID NO: 4849566 - DNA, 23 bp, Homo sapiens
ggcctgagaaacactatttgtga

SEQ ID NO: 4849567 - DNA, 18 bp, Homo sapiens
ggcctgctaaggctcctc

SEQ ID NO: 4849568 - DNA, 20 bp, Homo sapiens
ggcctgggctgtgaggacag

SEQ ID NO: 4849569 - DNA, 21 bp, Homo sapiens
ggcctgggctgtgaggacagg

SEQ ID NO: 4849570 - DNA, 20 bp, Homo sapiens
ggcctgtccctagggctctc

SEQ ID NO: 4849571 - DNA, 14 bp, Homo sapiens
ggccttgagtctct

SEQ ID NO: 4849572 - DNA, 18 bp, Homo sapiens
ggccttgagtctctgaat

SEQ ID NO: 4849573 - DNA, 13 bp, Homo sapiens
ggcgaatctcaaa

SEQ ID NO: 4849574 - DNA, 17 bp, Homo sapiens
ggcgaatctcaaaatta

SEQ ID NO: 4849575 - DNA, 19 bp, Homo sapiens
ggcgaccccgtcacagcct

SEQ ID NO: 4849576 - DNA, 20 bp, Homo sapiens
ggcgagggatgatgagggaa

SEQ ID NO: 4849577 - DNA, 13 bp, Homo sapiens
ggcgtgtgtgaca

SEQ ID NO: 4849578 - DNA, 22 bp, Homo sapiens
ggctaccaacttgtatccaggc

SEQ ID NO: 4849579 - DNA, 18 bp, Homo sapiens
ggctactggttacctgga

SEQ ID NO: 4849580 - DNA, 20 bp, Homo sapiens
ggctactggttacctggaga

SEQ ID NO: 4849581 - DNA, 21 bp, Homo sapiens
ggctactggttacctggagaa

SEQ ID NO: 4849582 - DNA, 23 bp, Homo sapiens
ggctaggcctccgttgtctggtt

SEQ ID NO: 4849583 - DNA, 12 bp, Homo sapiens
ggctcactactg

SEQ ID NO: 4849584 - DNA, 11 bp, Homo sapiens
ggctcaggaga

SEQ ID NO: 4849585 - DNA, 13 bp, Homo sapiens
ggctcaggagaag

SEQ ID NO: 4849586 - DNA, 17 bp, Homo sapiens
ggctcaggagaagccag

SEQ ID NO: 4849587 - DNA, 14 bp, Homo sapiens
ggctcctgttttgc

SEQ ID NO: 4849588 - DNA, 13 bp, Homo sapiens
ggctctagggcct

SEQ ID NO: 4849589 - DNA, 18 bp, Homo sapiens
ggctctataaggcagcct

SEQ ID NO: 4849590 - DNA, 21 bp, Homo sapiens
ggctctcacccccatccctgg

SEQ ID NO: 4849591 - DNA, 14 bp, Homo sapiens
ggctctgtggcaaa

SEQ ID NO: 4849592 - DNA, 19 bp, Homo sapiens
ggctcttatgtgtgccttt

SEQ ID NO: 4849593 - DNA, 20 bp, Homo sapiens
ggctcttatgtgtgcctttg

SEQ ID NO: 4849594 - DNA, 14 bp, Homo sapiens
ggctgaagctggag

SEQ ID NO: 4849595 - DNA, 16 bp, Homo sapiens
ggctgaagctggagca

SEQ ID NO: 4849596 - DNA, 17 bp, Homo sapiens
ggctgaagctggagcag

SEQ ID NO: 4849597 - DNA, 19 bp, Homo sapiens
ggctgaagctggagcagcg

SEQ ID NO: 4849598 - DNA, 15 bp, Homo sapiens
ggctgagccctcctg

SEQ ID NO: 4849599 - DNA, 12 bp, Homo sapiens
ggctgatgggtg

SEQ ID NO: 4849600 - DNA, 11 bp, Homo sapiens
ggctgccaggg

SEQ ID NO: 4849601 - DNA, 16 bp, Homo sapiens
ggctgccaggggctct

SEQ ID NO: 4849602 - DNA, 12 bp, Homo sapiens
ggctgctgctcc

SEQ ID NO: 4849603 - DNA, 12 bp, Homo sapiens
ggctggggacac

SEQ ID NO: 4849604 - DNA, 12 bp, Homo sapiens
ggctgtgaggac

SEQ ID NO: 4849605 - DNA, 14 bp, Homo sapiens
ggctgtgaggacag

SEQ ID NO: 4849606 - DNA, 21 bp, Homo sapiens
ggcttaattattgatgttttc

SEQ ID NO: 4849607 - DNA, 20 bp, Homo sapiens
ggcttcaaaaagccacagca

SEQ ID NO: 4849608 - DNA, 22 bp, Homo sapiens
ggcttgtctatactccttccct

SEQ ID NO: 4849609 - DNA, 23 bp, Homo sapiens
gggaaacaaataatttgaacttt

SEQ ID NO: 4849610 - DNA, 18 bp, Homo sapiens
gggaactcccccagaggt

SEQ ID NO: 4849611 - DNA, 16 bp, Homo sapiens
gggaaggccagccttg

SEQ ID NO: 4849612 - DNA, 19 bp, Homo sapiens
gggaaggggcctgggctgt

SEQ ID NO: 4849613 - DNA, 20 bp, Homo sapiens
gggaagtcgggcatggtggc

SEQ ID NO: 4849614 - DNA, 22 bp, Homo sapiens
gggacacaggatcctggcctga

SEQ ID NO: 4849615 - DNA, 20 bp, Homo sapiens
gggacagcaagtgagcagag

SEQ ID NO: 4849616 - DNA, 20 bp, Homo sapiens
gggactacccatagacatga

SEQ ID NO: 4849617 - DNA, 19 bp, Homo sapiens
gggactccaagccctgggg

SEQ ID NO: 4849618 - DNA, 22 bp, Homo sapiens
gggactccaagccctggggcag

SEQ ID NO: 4849619 - DNA, 14 bp, Homo sapiens
gggagacagcagcc

SEQ ID NO: 4849620 - DNA, 12 bp, Homo sapiens
gggagagagtag

SEQ ID NO: 4849621 - DNA, 10 bp, Homo sapiens
gggagccagg

SEQ ID NO: 4849622 - DNA, 12 bp, Homo sapiens
gggaggggaggc

SEQ ID NO: 4849623 - DNA, 15 bp, Homo sapiens
gggatgatgagggaa

SEQ ID NO: 4849624 - DNA, 13 bp, Homo sapiens
gggatgggtcctc

SEQ ID NO: 4849625 - DNA, 14 bp, Homo sapiens
gggcaccaggggcc

SEQ ID NO: 4849626 - DNA, 12 bp, Homo sapiens
gggcagcaggcc

SEQ ID NO: 4849627 - DNA, 19 bp, Homo sapiens
gggcagcaggccagagaaa

SEQ ID NO: 4849628 - DNA, 13 bp, Homo sapiens
gggcaggcctccc

SEQ ID NO: 4849629 - DNA, 16 bp, Homo sapiens
gggcaggcctcccaag

SEQ ID NO: 4849630 - DNA, 19 bp, Homo sapiens
gggcagggggtatgcagag

SEQ ID NO: 4849631 - DNA, 22 bp, Homo sapiens
gggccctgtcactgtccagagt

SEQ ID NO: 4849632 - DNA, 19 bp, Homo sapiens
gggccgggggaggggcgcg

SEQ ID NO: 4849633 - DNA, 15 bp, Homo sapiens
gggcctcaggctccg

SEQ ID NO: 4849634 - DNA, 13 bp, Homo sapiens
gggcctcccctgg

SEQ ID NO: 4849635 - DNA, 20 bp, Homo sapiens
gggcctctcctgccctctgc

SEQ ID NO: 4849636 - DNA, 11 bp, Homo sapiens
gggcctgggct

SEQ ID NO: 4849637 - DNA, 14 bp, Homo sapiens
gggcctgggctgtg

SEQ ID NO: 4849638 - DNA, 20 bp, Homo sapiens
gggcgaccccgtcacagcct

SEQ ID NO: 4849639 - DNA, 13 bp, Homo sapiens
gggctaatttaac

SEQ ID NO: 4849640 - DNA, 13 bp, Homo sapiens
gggctcagcctgg

SEQ ID NO: 4849641 - DNA, 23 bp, Homo sapiens
gggctgcatgatttttgccctgc

SEQ ID NO: 4849642 - DNA, 22 bp, Homo sapiens
gggctggctgccgttttctggg

SEQ ID NO: 4849643 - DNA, 20 bp, Homo sapiens
gggctggtggagatgtagga

SEQ ID NO: 4849644 - DNA, 21 bp, Homo sapiens
gggctgtgaggacagggcccc

SEQ ID NO: 4849645 - DNA, 21 bp, Homo sapiens
gggctttgttgtgagaatggc

SEQ ID NO: 4849646 - DNA, 12 bp, Homo sapiens
ggggagaaaccc

SEQ ID NO: 4849647 - DNA, 19 bp, Homo sapiens
ggggagccagctgcttgac

SEQ ID NO: 4849648 - DNA, 12 bp, Homo sapiens
ggggaggcaaga

SEQ ID NO: 4849649 - DNA, 13 bp, Homo sapiens
ggggaggcagcag

SEQ ID NO: 4849650 - DNA, 15 bp, Homo sapiens
ggggaggcagcagag

SEQ ID NO: 4849651 - DNA, 19 bp, Homo sapiens
ggggcaggcctcccaagct

SEQ ID NO: 4849652 - DNA, 19 bp, Homo sapiens
ggggcattgagtattgttt

SEQ ID NO: 4849653 - DNA, 21 bp, Homo sapiens
ggggccaacctcaggctccta

SEQ ID NO: 4849654 - DNA, 14 bp, Homo sapiens
ggggccacctctgg

SEQ ID NO: 4849655 - DNA, 20 bp, Homo sapiens
ggggcctccagaagctgctc

SEQ ID NO: 4849656 - DNA, 16 bp, Homo sapiens
gggggcaggcctccca

SEQ ID NO: 4849657 - DNA, 21 bp, Homo sapiens
gggggccatgttcccagaacc

SEQ ID NO: 4849658 - DNA, 11 bp, Homo sapiens
ggggggcaggc

SEQ ID NO: 4849659 - DNA, 24 bp, Homo sapiens
gggtaggggaagaagagctatcag

SEQ ID NO: 4849660 - DNA, 17 bp, Homo sapiens
gggtcacatgactctca

SEQ ID NO: 4849661 - DNA, 21 bp, Homo sapiens
gggtcagcatccagtgtgaga

SEQ ID NO: 4849662 - DNA, 17 bp, Homo sapiens
gtgatagaaaagtgtgg

SEQ ID NO: 4849663 - DNA, 23 bp, Homo sapiens
gtgatatataagtgtacatatgt

SEQ ID NO: 4849664 - DNA, 17 bp, Homo sapiens
gtgatgggctaggcctc

SEQ ID NO: 4849665 - DNA, 18 bp, Homo sapiens
gtgatgggctaggcctcc

SEQ ID NO: 4849666 - DNA, 16 bp, Homo sapiens
gtgatttaatccagtt

SEQ ID NO: 4849667 - DNA, 22 bp, Homo sapiens
gtgatttctcaccctctgtcct

SEQ ID NO: 4849668 - DNA, 14 bp, Homo sapiens
gtgatttgaaaaat

SEQ ID NO: 4849669 - DNA, 17 bp, Homo sapiens
gtgcaacatctctgaat

SEQ ID NO: 4849670 - DNA, 19 bp, Homo sapiens
gtgcactccagactctggg

SEQ ID NO: 4849671 - DNA, 15 bp, Homo sapiens
gtgcactccagcttc

SEQ ID NO: 4849672 - DNA, 20 bp, Homo sapiens
gtgcatagttgtagacaaag

SEQ ID NO: 4849673 - DNA, 18 bp, Homo sapiens
gtgcatccgggggcagct

SEQ ID NO: 4849674 - DNA, 21 bp, Homo sapiens
gtgcccctaaagagcatcctg

SEQ ID NO: 4849675 - DNA, 14 bp, Homo sapiens
gtgccccttccctg

SEQ ID NO: 4849676 - DNA, 15 bp, Homo sapiens
gtgccccttccctgg

SEQ ID NO: 4849677 - DNA, 17 bp, Homo sapiens
gtgccccttccctgggt

SEQ ID NO: 4849678 - DNA, 17 bp, Homo sapiens
gtgcctaacctgggacc

SEQ ID NO: 4849679 - DNA, 11 bp, Homo sapiens
gtgcctgggct

SEQ ID NO: 4849680 - DNA, 20 bp, Homo sapiens
gtgcctgggctcagcctggt

SEQ ID NO: 4849681 - DNA, 23 bp, Homo sapiens
gtgcctgtgagcatggggccagg

SEQ ID NO: 4849682 - DNA, 13 bp, Homo sapiens
gtgccttcccttt

SEQ ID NO: 4849683 - DNA, 13 bp, Homo sapiens
gtgctcttcccac

SEQ ID NO: 4849684 - DNA, 18 bp, Homo sapiens
gtgctcttcccactccag

SEQ ID NO: 4849685 - DNA, 16 bp, Homo sapiens
gtgctgccttgcttct

SEQ ID NO: 4849686 - DNA, 12 bp, Homo sapiens
gtgctgggcaga

SEQ ID NO: 4849687 - DNA, 19 bp, Homo sapiens
gtgctggtgaacactgtga

SEQ ID NO: 4849688 - DNA, 20 bp, Homo sapiens
gtgcttcgactactgctcct

SEQ ID NO: 4849689 - DNA, 20 bp, Homo sapiens
gtgcttctcacactggagga

SEQ ID NO: 4849690 - DNA, 13 bp, Homo sapiens
gtgctttgcattt

SEQ ID NO: 4849691 - DNA, 21 bp, Homo sapiens
gtgctttggaacaatcacagg

SEQ ID NO: 4849692 - DNA, 14 bp, Homo sapiens
gtgcttttggcaga

SEQ ID NO: 4849693 - DNA, 16 bp, Homo sapiens
gtggaaatggggaact

SEQ ID NO: 4849694 - DNA, 17 bp, Homo sapiens
gtggaaggcagagaaat

SEQ ID NO: 4849695 - DNA, 17 bp, Homo sapiens
gtggacgttaggccagg

SEQ ID NO: 4849696 - DNA, 19 bp, Homo sapiens
gtggacgttaggccaggcc

SEQ ID NO: 4849697 - DNA, 12 bp, Homo sapiens
gtggaggcagag

SEQ ID NO: 4849698 - DNA, 23 bp, Homo sapiens
gtggatactggggggcaggcctc

SEQ ID NO: 4849699 - DNA, 20 bp, Homo sapiens
gtggatcgagtgtagctgtg

SEQ ID NO: 4849700 - DNA, 13 bp, Homo sapiens
gtggattctttaa

SEQ ID NO: 4849701 - DNA, 14 bp, Homo sapiens
gtggcagcttgctg

SEQ ID NO: 4849702 - DNA, 19 bp, Homo sapiens
gtggcagcttgctgggctt

SEQ ID NO: 4849703 - DNA, 23 bp, Homo sapiens
gtggcagcttgctgggctttggg

SEQ ID NO: 4849704 - DNA, 13 bp, Homo sapiens
gtggccgtctcct

SEQ ID NO: 4849705 - DNA, 14 bp, Homo sapiens
gtggcctctgcctg

SEQ ID NO: 4849706 - DNA, 15 bp, Homo sapiens
gtggcctctgcctgg

SEQ ID NO: 4849707 - DNA, 15 bp, Homo sapiens
gtggcctgcaggagg

SEQ ID NO: 4849708 - DNA, 14 bp, Homo sapiens
gtggctcatgcctg

SEQ ID NO: 4849709 - DNA, 16 bp, Homo sapiens
gtggctttcagcctct

SEQ ID NO: 4849710 - DNA, 18 bp, Homo sapiens
gtggctttcagcctctgg

SEQ ID NO: 4849711 - DNA, 18 bp, Homo sapiens
gtgggaatgttctttctg

SEQ ID NO: 4849712 - DNA, 15 bp, Homo sapiens
gtgggagacagcagc

SEQ ID NO: 4849713 - DNA, 17 bp, Homo sapiens
gtgggagacagcagcct

SEQ ID NO: 4849714 - DNA, 20 bp, Homo sapiens
gtgggcaaagtcctcctttc

SEQ ID NO: 4849715 - DNA, 22 bp, Homo sapiens
gtgggcaaagtcctcctttcat

SEQ ID NO: 4849716 - DNA, 19 bp, Homo sapiens
gtgggcggcacagccttct

SEQ ID NO: 4849717 - DNA, 15 bp, Homo sapiens
gtgggctttggtggc

SEQ ID NO: 4849718 - DNA, 22 bp, Homo sapiens
gtgggctttgttgtgagaatgg

SEQ ID NO: 4849719 - DNA, 17 bp, Homo sapiens
gtggggaacggaggagg

SEQ ID NO: 4849720 - DNA, 19 bp, Homo sapiens
gtggggaacggaggaggac

SEQ ID NO: 4849721 - DNA, 19 bp, Homo sapiens
gtgggtctatgttccccag

SEQ ID NO: 4849722 - DNA, 16 bp, Homo sapiens
gtggtcatgtgagtct

SEQ ID NO: 4849723 - DNA, 21 bp, Homo sapiens
gtggtcatgtgagtctgggat

SEQ ID NO: 4849724 - DNA, 14 bp, Homo sapiens
gtggtctgccaatc

SEQ ID NO: 4849725 - DNA, 13 bp, Homo sapiens
gtggtgagcaagc

SEQ ID NO: 4849726 - DNA, 13 bp, Homo sapiens
gtggtggaggtgg

SEQ ID NO: 4849727 - DNA, 20 bp, Homo sapiens
gtggtggtgaaggggctggt

SEQ ID NO: 4849728 - DNA, 12 bp, Homo sapiens
gtggtttggaat

SEQ ID NO: 4849729 - DNA, 19 bp, Homo sapiens
gtgtaaccagctcagtgtt

SEQ ID NO: 4849730 - DNA, 16 bp, Homo sapiens
gtgtaatctcaatgca

SEQ ID NO: 4849731 - DNA, 12 bp, Homo sapiens
gtgtacatatgt

SEQ ID NO: 4849732 - DNA, 23 bp, Homo sapiens
gtgtagctgcaaaaataatcatg

SEQ ID NO: 4849733 - DNA, 18 bp, Homo sapiens
gtgtagtcccggaggcct

SEQ ID NO: 4849734 - DNA, 20 bp, Homo sapiens
gtgtctaggcactgagcagg

SEQ ID NO: 4849735 - DNA, 13 bp, Homo sapiens
gtgtgaaatatat

SEQ ID NO: 4849736 - DNA, 21 bp, Homo sapiens
gtgtgaatttgccagaggacc

SEQ ID NO: 4849737 - DNA, 10 bp, Homo sapiens
gtgtgactcc

SEQ ID NO: 4849738 - DNA, 21 bp, Homo sapiens
gtgtgactccttatctctttc

SEQ ID NO: 4849739 - DNA, 14 bp, Homo sapiens
gtgtgaggagagag

SEQ ID NO: 4849740 - DNA, 13 bp, Homo sapiens
gtgtggggtgggg

SEQ ID NO: 4849741 - DNA, 14 bp, Homo sapiens
gtgtggggtggggt

SEQ ID NO: 4849742 - DNA, 17 bp, Homo sapiens
gtgtgttttcagcaaat

SEQ ID NO: 4849743 - DNA, 14 bp, Homo sapiens
gtgttcagaagaat

SEQ ID NO: 4849744 - DNA, 19 bp, Homo sapiens
gtgttgcagccgcagagaa

SEQ ID NO: 4849745 - DNA, 21 bp, Homo sapiens
gtgttgcagccgcagagaaat

SEQ ID NO: 4849746 - DNA, 18 bp, Homo sapiens
gtgtttccacagcctgca

SEQ ID NO: 4849747 - DNA, 15 bp, Homo sapiens
gtgtttgggaaaggc

SEQ ID NO: 4849748 - DNA, 14 bp, Homo sapiens
gtgttttaattgta

SEQ ID NO: 4849749 - DNA, 17 bp, Homo sapiens
gtgtttttagctgtgac

SEQ ID NO: 4849750 - DNA, 14 bp, Homo sapiens
gttaacaggacagt

SEQ ID NO: 4849751 - DNA, 19 bp, Homo sapiens
gttaatttttcctgcatgt

SEQ ID NO: 4849752 - DNA, 23 bp, Homo sapiens
gttaatttttcctgcatgttctg

SEQ ID NO: 4849753 - DNA, 20 bp, Homo sapiens
gttagatgggaggatgaatt

SEQ ID NO: 4849754 - DNA, 16 bp, Homo sapiens
gttaggccaggcctta

SEQ ID NO: 4849755 - DNA, 14 bp, Homo sapiens
gttagtgacattta

SEQ ID NO: 4849756 - DNA, 16 bp, Homo sapiens
gttagtgacatttaat

SEQ ID NO: 4849757 - DNA, 17 bp, Homo sapiens
gttagtgacatttaatg

SEQ ID NO: 4849758 - DNA, 18 bp, Homo sapiens
gttatacatcaatatgta

SEQ ID NO: 4849759 - DNA, 17 bp, Homo sapiens
gttatcaaaatagtcta

SEQ ID NO: 4849760 - DNA, 20 bp, Homo sapiens
gttatcatgaattttaaagt

SEQ ID NO: 4849761 - DNA, 22 bp, Homo sapiens
gttatcatgaattttaaagtat

SEQ ID NO: 4849762 - DNA, 17 bp, Homo sapiens
gttattgcaataaagta

SEQ ID NO: 4849763 - DNA, 23 bp, Homo sapiens
gttatttattttttaagaaaaaa

SEQ ID NO: 4849764 - DNA, 23 bp, Homo sapiens
gttcaacaaagaaacaaagatgt

SEQ ID NO: 4849765 - DNA, 23 bp, Homo sapiens
gttcaatctggattcatatttaa

SEQ ID NO: 4849766 - DNA, 20 bp, Homo sapiens
gttcactccccgcctcccca

SEQ ID NO: 4849767 - DNA, 15 bp, Homo sapiens
gttcagaaaaccact

SEQ ID NO: 4849768 - DNA, 16 bp, Homo sapiens
gttcagaaaaccactt

SEQ ID NO: 4849769 - DNA, 13 bp, Homo sapiens
gttcagctactcc

SEQ ID NO: 4849770 - DNA, 19 bp, Homo sapiens
gttcatattccatatttat

SEQ ID NO: 4849771 - DNA, 21 bp, Homo sapiens
gttcattggcattctttgcaa

SEQ ID NO: 4849772 - DNA, 18 bp, Homo sapiens
gttccatttcagttcagt

SEQ ID NO: 4849773 - DNA, 19 bp, Homo sapiens
gttcccaaaacaatggtgt

SEQ ID NO: 4849774 - DNA, 22 bp, Homo sapiens
gttcccttgaaactttgggaaa

SEQ ID NO: 4849775 - DNA, 15 bp, Homo sapiens
gttccggggagaaac

SEQ ID NO: 4849776 - DNA, 23 bp, Homo sapiens
gttcctcctacttacaacccagg

SEQ ID NO: 4849777 - DNA, 12 bp, Homo sapiens
gttcctgaaatg

SEQ ID NO: 4849778 - DNA, 21 bp, Homo sapiens
gttcctgtgtgaccctgggca

SEQ ID NO: 4849779 - DNA, 21 bp, Homo sapiens
gttccttggtcctagtaagaa

SEQ ID NO: 4849780 - DNA, 14 bp, Homo sapiens
gttctcaaatgtgt

SEQ ID NO: 4849781 - DNA, 18 bp, Homo sapiens
gttctccagtcattatgt

SEQ ID NO: 4849782 - DNA, 23 bp, Homo sapiens
tacatgaagcagaaccttctttg

SEQ ID NO: 4849783 - DNA, 19 bp, Homo sapiens
tacatgtgatacatttttt

SEQ ID NO: 4849784 - DNA, 14 bp, Homo sapiens
tacatttaaatttt

SEQ ID NO: 4849785 - DNA, 23 bp, Homo sapiens
tacattttattaagctttttgga

SEQ ID NO: 4849786 - DNA, 15 bp, Homo sapiens
tacattttttaagct

SEQ ID NO: 4849787 - DNA, 11 bp, Homo sapiens
taccaaaataa

SEQ ID NO: 4849788 - DNA, 23 bp, Homo sapiens
taccaaaattttaaaaaagggag

SEQ ID NO: 4849789 - DNA, 13 bp, Homo sapiens
taccaaattaaaa

SEQ ID NO: 4849790 - DNA, 19 bp, Homo sapiens
taccaaattaaaaaaaaat

SEQ ID NO: 4849791 - DNA, 23 bp, Homo sapiens
taccaaattaaaaaaaaattgta

SEQ ID NO: 4849792 - DNA, 17 bp, Homo sapiens
taccacatcaaataaga

SEQ ID NO: 4849793 - DNA, 18 bp, Homo sapiens
taccagggtctctcaggg

SEQ ID NO: 4849794 - DNA, 17 bp, Homo sapiens
tacccatagacatgaaa

SEQ ID NO: 4849795 - DNA, 17 bp, Homo sapiens
taccggagagagaatgt

SEQ ID NO: 4849796 - DNA, 18 bp, Homo sapiens
tacctactggtgtaatct

SEQ ID NO: 4849797 - DNA, 14 bp, Homo sapiens
tacctactgtgtgc

SEQ ID NO: 4849798 - DNA, 18 bp, Homo sapiens
tacctagctaattattta

SEQ ID NO: 4849799 - DNA, 13 bp, Homo sapiens
tacctgaggccag

SEQ ID NO: 4849800 - DNA, 15 bp, Homo sapiens
tacctggcctagaaa

SEQ ID NO: 4849801 - DNA, 14 bp, Homo sapiens
taccttatcttaca

SEQ ID NO: 4849802 - DNA, 19 bp, Homo sapiens
taccttcaaggctcttctt

SEQ ID NO: 4849803 - DNA, 16 bp, Homo sapiens
taccttgtatactgta

SEQ ID NO: 4849804 - DNA, 16 bp, Homo sapiens
taccttttttttttct

SEQ ID NO: 4849805 - DNA, 17 bp, Homo sapiens
tacgaatgcccctgttc

SEQ ID NO: 4849806 - DNA, 14 bp, Homo sapiens
tacgtttgtgtttc

SEQ ID NO: 4849807 - DNA, 19 bp, Homo sapiens
tactaaaaagtataaaata

SEQ ID NO: 4849808 - DNA, 19 bp, Homo sapiens
tactaaacagtaagatatc

SEQ ID NO: 4849809 - DNA, 16 bp, Homo sapiens
tactaaggacgttgtt

SEQ ID NO: 4849810 - DNA, 15 bp, Homo sapiens
tactagtgtgactcc

SEQ ID NO: 4849811 - DNA, 19 bp, Homo sapiens
tactattcaggtaacacta

SEQ ID NO: 4849812 - DNA, 13 bp, Homo sapiens
tactctccatatc

SEQ ID NO: 4849813 - DNA, 21 bp, Homo sapiens
tactctccttgagtgtatgag

SEQ ID NO: 4849814 - DNA, 15 bp, Homo sapiens
tactgatgagagaat

SEQ ID NO: 4849815 - DNA, 16 bp, Homo sapiens
tactgatgagagaatg

SEQ ID NO: 4849816 - DNA, 17 bp, Homo sapiens
tactgatgagagaatgt

SEQ ID NO: 4849817 - DNA, 16 bp, Homo sapiens
tactgcaaagtcgcca

SEQ ID NO: 4849818 - DNA, 15 bp, Homo sapiens
tactgcaatcactgt

SEQ ID NO: 4849819 - DNA, 20 bp, Homo sapiens
tactgcaatcactgtgctat

SEQ ID NO: 4849820 - DNA, 17 bp, Homo sapiens
tactgccaaaacattta

SEQ ID NO: 4849821 - DNA, 14 bp, Homo sapiens
tactgctcctgtgg

SEQ ID NO: 4849822 - DNA, 18 bp, Homo sapiens
tactgctcctgtggcagg

SEQ ID NO: 4849823 - DNA, 13 bp, Homo sapiens
tactgctgctgct

SEQ ID NO: 4849824 - DNA, 17 bp, Homo sapiens
tactgcttaattgctga

SEQ ID NO: 4849825 - DNA, 18 bp, Homo sapiens
tactggcttacctcctca

SEQ ID NO: 4849826 - DNA, 15 bp, Homo sapiens
tactggggggcaggc

SEQ ID NO: 4849827 - DNA, 19 bp, Homo sapiens
tactggtgtaatctcaatg

SEQ ID NO: 4849828 - DNA, 16 bp, Homo sapiens
tactgtaacattcagg

SEQ ID NO: 4849829 - DNA, 15 bp, Homo sapiens
tactgtatattcagg

SEQ ID NO: 4849830 - DNA, 18 bp, Homo sapiens
tactgtctattaatattc

SEQ ID NO: 4849831 - DNA, 15 bp, Homo sapiens
tactgtggcctgcag

SEQ ID NO: 4849832 - DNA, 19 bp, Homo sapiens
tactgtgtctcatggattt

SEQ ID NO: 4849833 - DNA, 14 bp, Homo sapiens
tacttaaatggtaa

SEQ ID NO: 4849834 - DNA, 21 bp, Homo sapiens
tacttaaatggtaataagcac

SEQ ID NO: 4849835 - DNA, 23 bp, Homo sapiens
tacttaaatggtaataagcactg

SEQ ID NO: 4849836 - DNA, 18 bp, Homo sapiens
tacttatgtagaaactga

SEQ ID NO: 4849837 - DNA, 14 bp, Homo sapiens
tacttatttctcag

SEQ ID NO: 4849838 - DNA, 19 bp, Homo sapiens
tacttatttctcagctgtg

SEQ ID NO: 4849839 - DNA, 19 bp, Homo sapiens
tacttcaaagtgcctgggc

SEQ ID NO: 4849840 - DNA, 22 bp, Homo sapiens
tacttcaaagtgcctgggctca

SEQ ID NO: 4849841 - DNA, 15 bp, Homo sapiens
tacttccctcttgaa

SEQ ID NO: 4849842 - DNA, 16 bp, Homo sapiens
tacttctgtaattgtg

SEQ ID NO: 4849843 - DNA, 17 bp, Homo sapiens
tacttctgtaattgtgt

SEQ ID NO: 4849844 - DNA, 20 bp, Homo sapiens
tacttcttgaatataaaaaa

SEQ ID NO: 4849845 - DNA, 21 bp, Homo sapiens
tacttcttgaatataaaaaat

SEQ ID NO: 4849846 - DNA, 22 bp, Homo sapiens
tacttgactacctactggtgta

SEQ ID NO: 4849847 - DNA, 19 bp, Homo sapiens
tacttggcccccttcagga

SEQ ID NO: 4849848 - DNA, 21 bp, Homo sapiens
tacttggcccccttcaggagc

SEQ ID NO: 4849849 - DNA, 19 bp, Homo sapiens
tacttgggcttcaacagcc

SEQ ID NO: 4849850 - DNA, 20 bp, Homo sapiens
tactttgacagtgtttttag

SEQ ID NO: 4849851 - DNA, 20 bp, Homo sapiens
tactttggtagctgggaaag

SEQ ID NO: 4849852 - DNA, 19 bp, Homo sapiens
tactttggttaatgttgat

SEQ ID NO: 4849853 - DNA, 17 bp, Homo sapiens
tagaactcctgtcttct

SEQ ID NO: 4849854 - DNA, 18 bp, Homo sapiens
tagaactcctgtcttctt

SEQ ID NO: 4849855 - DNA, 16 bp, Homo sapiens
tagaagaaagatgttt

SEQ ID NO: 4849856 - DNA, 18 bp, Homo sapiens
tagaatgttttcaaatgt

SEQ ID NO: 4849857 - DNA, 13 bp, Homo sapiens
tagacaaaaagta

SEQ ID NO: 4849858 - DNA, 12 bp, Homo sapiens
tagacaaagtac

SEQ ID NO: 4849859 - DNA, 12 bp, Homo sapiens
tagacatgaaag

SEQ ID NO: 4849860 - DNA, 18 bp, Homo sapiens
tagactcaaagaagtact

SEQ ID NO: 4849861 - DNA, 19 bp, Homo sapiens
tagactcaaagaagtactg

SEQ ID NO: 4849862 - DNA, 16 bp, Homo sapiens
tagactctagtattta

SEQ ID NO: 4849863 - DNA, 15 bp, Homo sapiens
tagactgctcctggg

SEQ ID NO: 4849864 - DNA, 18 bp, Homo sapiens
tagactgctcctgggcat

SEQ ID NO: 4849865 - DNA, 21 bp, Homo sapiens
tagactggatggaaagacaaa

SEQ ID NO: 4849866 - DNA, 12 bp, Homo sapiens
tagagccaatta

SEQ ID NO: 4849867 - DNA, 17 bp, Homo sapiens
tagagcccctactgtgg

SEQ ID NO: 4849868 - DNA, 21 bp, Homo sapiens
tagagctcttgtgttcagaag

SEQ ID NO: 4849869 - DNA, 22 bp, Homo sapiens
tagagggcgagggatgatgagg

SEQ ID NO: 4849870 - DNA, 14 bp, Homo sapiens
tagagtaatgaaat

SEQ ID NO: 4849871 - DNA, 23 bp, Homo sapiens
tagagttgattgtctagtgagga

SEQ ID NO: 4849872 - DNA, 18 bp, Homo sapiens
tagatccagcccaaacct

SEQ ID NO: 4849873 - DNA, 17 bp, Homo sapiens
tagatcctaagatgtgt

SEQ ID NO: 4849874 - DNA, 16 bp, Homo sapiens
tagatgaggctcagag

SEQ ID NO: 4849875 - DNA, 17 bp, Homo sapiens
tagatgaggctcagaga

SEQ ID NO: 4849876 - DNA, 15 bp, Homo sapiens
tagatgctggctggg

SEQ ID NO: 4849877 - DNA, 15 bp, Homo sapiens
tagatggcgatgtgt

SEQ ID NO: 4849878 - DNA, 20 bp, Homo sapiens
tagatgggaggatgaattgt

SEQ ID NO: 4849879 - DNA, 18 bp, Homo sapiens
tagatgggggaactgtga

SEQ ID NO: 4849880 - DNA, 18 bp, Homo sapiens
tagatgtgcagtttggaa

SEQ ID NO: 4849881 - DNA, 21 bp, Homo sapiens
tagatgtgcagtttggaatta

SEQ ID NO: 4849882 - DNA, 14 bp, Homo sapiens
tagcagagtctgtc

SEQ ID NO: 4849883 - DNA, 16 bp, Homo sapiens
tagcagagtctgtctc

SEQ ID NO: 4849884 - DNA, 13 bp, Homo sapiens
tagcagagttaaa

SEQ ID NO: 4849885 - DNA, 14 bp, Homo sapiens
tagcagagttaaat

SEQ ID NO: 4849886 - DNA, 15 bp, Homo sapiens
tagcataggctgggg

SEQ ID NO: 4849887 - DNA, 17 bp, Homo sapiens
tagcattctttggagtt

SEQ ID NO: 4849888 - DNA, 20 bp, Homo sapiens
tagcattctttggagttaaa

SEQ ID NO: 4849889 - DNA, 14 bp, Homo sapiens
tagccaacatagta

SEQ ID NO: 4849890 - DNA, 19 bp, Homo sapiens
tagcccaacctacattcca

SEQ ID NO: 4849891 - DNA, 21 bp, Homo sapiens
tagcctaaggctcctgttttg

SEQ ID NO: 4849892 - DNA, 15 bp, Homo sapiens
tagcctatgtctggc

SEQ ID NO: 4849893 - DNA, 16 bp, Homo sapiens
tagcctatgtctggca

SEQ ID NO: 4849894 - DNA, 20 bp, Homo sapiens
tagcctctggactggaaagc

SEQ ID NO: 4849895 - DNA, 19 bp, Homo sapiens
tagccttcccagcttcccg

SEQ ID NO: 4849896 - DNA, 18 bp, Homo sapiens
tagcctttacctgtgaag

SEQ ID NO: 4849897 - DNA, 15 bp, Homo sapiens
tagctacagtgcata

SEQ ID NO: 4849898 - DNA, 21 bp, Homo sapiens
tagctgaggctgagaaagcta

SEQ ID NO: 4849899 - DNA, 15 bp, Homo sapiens
tagctgcaaaaataa

SEQ ID NO: 4849900 - DNA, 12 bp, Homo sapiens
tagctgcagcct

SEQ ID NO: 4849901 - DNA, 19 bp, Homo sapiens
tagcttacctgggcacaaa

SEQ ID NO: 4849902 - DNA, 22 bp, Homo sapiens
tccccacaggcacattaactgt

SEQ ID NO: 4849903 - DNA, 23 bp, Homo sapiens
tccccacaggcacattaactgtt

SEQ ID NO: 4849904 - DNA, 17 bp, Homo sapiens
tccccagctcacccctg

SEQ ID NO: 4849905 - DNA, 18 bp, Homo sapiens
tccccagtgactccaggg

SEQ ID NO: 4849906 - DNA, 13 bp, Homo sapiens
tcccccaccctcc

SEQ ID NO: 4849907 - DNA, 21 bp, Homo sapiens
tcccccttcatccatcctgag

SEQ ID NO: 4849908 - DNA, 23 bp, Homo sapiens
tccccgataccatgctgtaagga

SEQ ID NO: 4849909 - DNA, 15 bp, Homo sapiens
tcccctaaagccagg

SEQ ID NO: 4849910 - DNA, 16 bp, Homo sapiens
tcccctaaagccaggc

SEQ ID NO: 4849911 - DNA, 20 bp, Homo sapiens
tcccctcccaggggagccag

SEQ ID NO: 4849912 - DNA, 18 bp, Homo sapiens
tccccttcctcttgtctg

SEQ ID NO: 4849913 - DNA, 15 bp, Homo sapiens
tcccgccccgcccct

SEQ ID NO: 4849914 - DNA, 21 bp, Homo sapiens
tcccgccgccccccctatctc

SEQ ID NO: 4849915 - DNA, 17 bp, Homo sapiens
tcccggaggccttccct

SEQ ID NO: 4849916 - DNA, 19 bp, Homo sapiens
tcccggttcagacccctgc

SEQ ID NO: 4849917 - DNA, 20 bp, Homo sapiens
tcccggttcagacccctgcc

SEQ ID NO: 4849918 - DNA, 13 bp, Homo sapiens
tccctacatgtat

SEQ ID NO: 4849919 - DNA, 14 bp, Homo sapiens
tccctagggctctc

SEQ ID NO: 4849920 - DNA, 13 bp, Homo sapiens
tccctcacctgta

SEQ ID NO: 4849921 - DNA, 14 bp, Homo sapiens
tccctcacctgtag

SEQ ID NO: 4849922 - DNA, 13 bp, Homo sapiens
tccctgttgtcag

SEQ ID NO: 4849923 - DNA, 15 bp, Homo sapiens
tcccttggacatttt

SEQ ID NO: 4849924 - DNA, 22 bp, Homo sapiens
tcccttgtcagttccaaacaga

SEQ ID NO: 4849925 - DNA, 21 bp, Homo sapiens
tccctttacagctctcctcca

SEQ ID NO: 4849926 - DNA, 20 bp, Homo sapiens
tccctttctaagcaaccaca

SEQ ID NO: 4849927 - DNA, 20 bp, Homo sapiens
tcccttttcaccttttcagg

SEQ ID NO: 4849928 - DNA, 16 bp, Homo sapiens
tccgcagttgtagcag

SEQ ID NO: 4849929 - DNA, 18 bp, Homo sapiens
tccgcagttgtagcagaa

SEQ ID NO: 4849930 - DNA, 12 bp, Homo sapiens
tccggaaagaag

SEQ ID NO: 4849931 - DNA, 16 bp, Homo sapiens
tccggccatactgcct

SEQ ID NO: 4849932 - DNA, 18 bp, Homo sapiens
tccgtgccccttccctgg

SEQ ID NO: 4849933 - DNA, 18 bp, Homo sapiens
tcctaaaagttctcaatg

SEQ ID NO: 4849934 - DNA, 13 bp, Homo sapiens
tcctaccgtcttt

SEQ ID NO: 4849935 - DNA, 13 bp, Homo sapiens
tcctactttctat

SEQ ID NO: 4849936 - DNA, 14 bp, Homo sapiens
tcctagactgctcc

SEQ ID NO: 4849937 - DNA, 15 bp, Homo sapiens
tcctagactgctcct

SEQ ID NO: 4849938 - DNA, 19 bp, Homo sapiens
tcctagactgctcctgggc

SEQ ID NO: 4849939 - DNA, 21 bp, Homo sapiens
tcctagactgctcctgggcat

SEQ ID NO: 4849940 - DNA, 13 bp, Homo sapiens
tcctagtaagaag

SEQ ID NO: 4849941 - DNA, 12 bp, Homo sapiens
tcctattatatt

SEQ ID NO: 4849942 - DNA, 15 bp, Homo sapiens
tcctatttttgtgaa

SEQ ID NO: 4849943 - DNA, 13 bp, Homo sapiens
tcctcaccgagca

SEQ ID NO: 4849944 - DNA, 13 bp, Homo sapiens
tcctcagggtggg

SEQ ID NO: 4849945 - DNA, 16 bp, Homo sapiens
tcctccagccctgggc

SEQ ID NO: 4849946 - DNA, 13 bp, Homo sapiens
tcctccagctggg

SEQ ID NO: 4849947 - DNA, 22 bp, Homo sapiens
tcctcctctcaaacctggcaga

SEQ ID NO: 4849948 - DNA, 12 bp, Homo sapiens
tcctcctgatgg

SEQ ID NO: 4849949 - DNA, 23 bp, Homo sapiens
tcctccttgcccagactacaggg

SEQ ID NO: 4849950 - DNA, 22 bp, Homo sapiens
tcctcgatggtaatacccgtcc

SEQ ID NO: 4849951 - DNA, 18 bp, Homo sapiens
tcctctcaaacctggcag

SEQ ID NO: 4849952 - DNA, 15 bp, Homo sapiens
tcctctcaggctctt

SEQ ID NO: 4849953 - DNA, 17 bp, Homo sapiens
tcctctcagttctctcc

SEQ ID NO: 4849954 - DNA, 16 bp, Homo sapiens
tcctctcggctgccag

SEQ ID NO: 4849955 - DNA, 22 bp, Homo sapiens
tcctctgcaagcttcttgctga

SEQ ID NO: 4849956 - DNA, 17 bp, Homo sapiens
tcctcttgttcctgaaa

SEQ ID NO: 4849957 - DNA, 18 bp, Homo sapiens
tcctctttagtttttggt

SEQ ID NO: 4849958 - DNA, 22 bp, Homo sapiens
tcctgaaagtgtttttaaataa

SEQ ID NO: 4849959 - DNA, 20 bp, Homo sapiens
tcctgaaatgtgtttccttt

SEQ ID NO: 4849960 - DNA, 15 bp, Homo sapiens
tcctgataccattct

SEQ ID NO: 4849961 - DNA, 22 bp, Homo sapiens
tcctgataccattctattctcc

SEQ ID NO: 4849962 - DNA, 22 bp, Homo sapiens
tcctgatggagtgtgcagacag

SEQ ID NO: 4849963 - DNA, 11 bp, Homo sapiens
tcctgcaaagt

SEQ ID NO: 4849964 - DNA, 23 bp, Homo sapiens
tcctgccctctgctctgcctgga

SEQ ID NO: 4849965 - DNA, 14 bp, Homo sapiens
tcctgctgggcgtg

SEQ ID NO: 4849966 - DNA, 21 bp, Homo sapiens
tcctggcacaatgttggagca

SEQ ID NO: 4849967 - DNA, 19 bp, Homo sapiens
tcctgggcattagcaaggc

SEQ ID NO: 4849968 - DNA, 22 bp, Homo sapiens
tcctgggcattagcaaggcaga

SEQ ID NO: 4849969 - DNA, 21 bp, Homo sapiens
tcctgtcttctttctccatgg

SEQ ID NO: 4849970 - DNA, 21 bp, Homo sapiens
tcctgtgaggatagagacttg

SEQ ID NO: 4849971 - DNA, 21 bp, Homo sapiens
tcctgtggaaggcagagaaat

SEQ ID NO: 4849972 - DNA, 17 bp, Homo sapiens
tcctgtggatgcaaata

SEQ ID NO: 4849973 - DNA, 16 bp, Homo sapiens
tcctgtggcataaatt

SEQ ID NO: 4849974 - DNA, 19 bp, Homo sapiens
tcctgtggcataaattgca

SEQ ID NO: 4849975 - DNA, 21 bp, Homo sapiens
tcctgttttgcacagccaaat

SEQ ID NO: 4849976 - DNA, 13 bp, Homo sapiens
tccttaaaatgtg

SEQ ID NO: 4849977 - DNA, 14 bp, Homo sapiens
tccttaaaatgtgg

SEQ ID NO: 4849978 - DNA, 15 bp, Homo sapiens
tccttacttttaagg

SEQ ID NO: 4849979 - DNA, 16 bp, Homo sapiens
tccttatctctttcca

SEQ ID NO: 4849980 - DNA, 23 bp, Homo sapiens
tccttcaacctgcatagccggtg

SEQ ID NO: 4849981 - DNA, 17 bp, Homo sapiens
tccttcatgtttggaaa

SEQ ID NO: 4849982 - DNA, 16 bp, Homo sapiens
tccttcccccagcaca

SEQ ID NO: 4849983 - DNA, 18 bp, Homo sapiens
tccttcccccagcacaaa

SEQ ID NO: 4849984 - DNA, 20 bp, Homo sapiens
tccttctaggatagcgctcc

SEQ ID NO: 4849985 - DNA, 17 bp, Homo sapiens
tccttgagattctgaag

SEQ ID NO: 4849986 - DNA, 14 bp, Homo sapiens
tccttgcttcctga

SEQ ID NO: 4849987 - DNA, 19 bp, Homo sapiens
tccttggtcctagtaagaa

SEQ ID NO: 4849988 - DNA, 14 bp, Homo sapiens
tcctttaccctctt

SEQ ID NO: 4849989 - DNA, 19 bp, Homo sapiens
tcctttcattaccctacag

SEQ ID NO: 4849990 - DNA, 14 bp, Homo sapiens
tcctttgaagaagg

SEQ ID NO: 4849991 - DNA, 23 bp, Homo sapiens
tcgactactgctcctgtggcagg

SEQ ID NO: 4849992 - DNA, 17 bp, Homo sapiens
tcgagagccttacttca

SEQ ID NO: 4849993 - DNA, 19 bp, Homo sapiens
tcgagtgtagctgtgaaat

SEQ ID NO: 4849994 - DNA, 16 bp, Homo sapiens
tcggaaacactgactt

SEQ ID NO: 4849995 - DNA, 15 bp, Homo sapiens
tcggatcctgtgagt

SEQ ID NO: 4849996 - DNA, 21 bp, Homo sapiens
tcggcagatgatgctttggaa

SEQ ID NO: 4849997 - DNA, 23 bp, Homo sapiens
tcggccagttttcggaaacactg

SEQ ID NO: 4849998 - DNA, 20 bp, Homo sapiens
tcggctactggttacctgga

SEQ ID NO: 4849999 - DNA, 21 bp, Homo sapiens
tcggctactggttacctggag

SEQ ID NO: 4850000 - DNA, 22 bp, Homo sapiens
tcgtttatatttttttaactgt

SEQ ID NO: 4850001 - DNA, 23 bp, Homo sapiens
tcgtttatatttttttaactgtg

SEQ ID NO: 4850002 - DNA, 22 bp, Homo sapiens
tctaaatatcccttggacattt

SEQ ID NO: 4850003 - DNA, 16 bp, Homo sapiens
tctaaatatgaatgaa

SEQ ID NO: 4850004 - DNA, 12 bp, Homo sapiens
tctaacaagtca

SEQ ID NO: 4850005 - DNA, 23 bp, Homo sapiens
tctaacaagtcataggttaatat

SEQ ID NO: 4850006 - DNA, 16 bp, Homo sapiens
tctaagactatatata

SEQ ID NO: 4850007 - DNA, 21 bp, Homo sapiens
tctaagactatatatataaat

SEQ ID NO: 4850008 - DNA, 23 bp, Homo sapiens
tctaagcaaccacactgcttggc

SEQ ID NO: 4850009 - DNA, 13 bp, Homo sapiens
tctaagtgatata

SEQ ID NO: 4850010 - DNA, 13 bp, Homo sapiens
tctaagtgctgct

SEQ ID NO: 4850011 - DNA, 17 bp, Homo sapiens
tctaagtgctgctgtgg

SEQ ID NO: 4850012 - DNA, 22 bp, Homo sapiens
tctacaatctctttttgtttgc

SEQ ID NO: 4850013 - DNA, 22 bp, Homo sapiens
tctagatgattttttgaaagtt

SEQ ID NO: 4850014 - DNA, 12 bp, Homo sapiens
tctagcctctgg

SEQ ID NO: 4850015 - DNA, 17 bp, Homo sapiens
tctagcctctggactgg

SEQ ID NO: 4850016 - DNA, 21 bp, Homo sapiens
tctagcctctggactggaaag

SEQ ID NO: 4850017 - DNA, 23 bp, Homo sapiens
tctaggccctgtgagcacaaaga

SEQ ID NO: 4850018 - DNA, 16 bp, Homo sapiens
tctagggcctcagtct

SEQ ID NO: 4850019 - DNA, 14 bp, Homo sapiens
tctataaactataa

SEQ ID NO: 4850020 - DNA, 19 bp, Homo sapiens
tctatactgtggcctgcag

SEQ ID NO: 4850021 - DNA, 12 bp, Homo sapiens
tcttttctttac

SEQ ID NO: 4850022 - DNA, 12 bp, Homo sapiens
tcttttgaagca

SEQ ID NO: 4850023 - DNA, 20 bp, Homo sapiens
tcttttgctgaacaggaaag

SEQ ID NO: 4850024 - DNA, 19 bp, Homo sapiens
tcttttgttctcctatatc

SEQ ID NO: 4850025 - DNA, 12 bp, Homo sapiens
tcttttgtttgg

SEQ ID NO: 4850026 - DNA, 14 bp, Homo sapiens
tctttttgaaatgt

SEQ ID NO: 4850027 - DNA, 17 bp, Homo sapiens
tcttttttagtgttaaa

SEQ ID NO: 4850028 - DNA, 15 bp, Homo sapiens
tgaaaagaaggaaag

SEQ ID NO: 4850029 - DNA, 20 bp, Homo sapiens
tgaaaagggtgttgggaggg

SEQ ID NO: 4850030 - DNA, 18 bp, Homo sapiens
tgaaaagtgtgtatatat

SEQ ID NO: 4850031 - DNA, 19 bp, Homo sapiens
tgaaaagtgtgtatatatt

SEQ ID NO: 4850032 - DNA, 18 bp, Homo sapiens
tgaaacatgggctgtgat

SEQ ID NO: 4850033 - DNA, 22 bp, Homo sapiens
tgaaacctgatgtcagctgctg

SEQ ID NO: 4850034 - DNA, 15 bp, Homo sapiens
tgaaagaaaattgag

SEQ ID NO: 4850035 - DNA, 17 bp, Homo sapiens
tgaaagaaaattgagtt

SEQ ID NO: 4850036 - DNA, 22 bp, Homo sapiens
tgaaagaaaattgagttgcact

SEQ ID NO: 4850037 - DNA, 15 bp, Homo sapiens
tgaaagagaggactg

SEQ ID NO: 4850038 - DNA, 16 bp, Homo sapiens
tgaaagctgatttttt

SEQ ID NO: 4850039 - DNA, 12 bp, Homo sapiens
tgaaataaaata

SEQ ID NO: 4850040 - DNA, 20 bp, Homo sapiens
tgaaatccatatatatgaaa

SEQ ID NO: 4850041 - DNA, 20 bp, Homo sapiens
tgaaatccctgcctcaggcc

SEQ ID NO: 4850042 - DNA, 13 bp, Homo sapiens
tgaaatgtcaacc

SEQ ID NO: 4850043 - DNA, 13 bp, Homo sapiens
tgaaattcttcct

SEQ ID NO: 4850044 - DNA, 17 bp, Homo sapiens
tgaaattgcatactttg

SEQ ID NO: 4850045 - DNA, 12 bp, Homo sapiens
tgaacactgtga

SEQ ID NO: 4850046 - DNA, 16 bp, Homo sapiens
tgaacactgtgaccag

SEQ ID NO: 4850047 - DNA, 18 bp, Homo sapiens
tgaacatgtttaatgggt

SEQ ID NO: 4850048 - DNA, 11 bp, Homo sapiens
tgaactccagg

SEQ ID NO: 4850049 - DNA, 14 bp, Homo sapiens
tgaactccaggcat

SEQ ID NO: 4850050 - DNA, 15 bp, Homo sapiens
tgaactccaggcatg

SEQ ID NO: 4850051 - DNA, 19 bp, Homo sapiens
tgaactctgttcccccacc

SEQ ID NO: 4850052 - DNA, 14 bp, Homo sapiens
tgaactttgtcagt

SEQ ID NO: 4850053 - DNA, 19 bp, Homo sapiens
tgaactttttaaagaagtg

SEQ ID NO: 4850054 - DNA, 14 bp, Homo sapiens
tgaagaaggcaagg

SEQ ID NO: 4850055 - DNA, 15 bp, Homo sapiens
tgaagaaggcaaggc

SEQ ID NO: 4850056 - DNA, 23 bp, Homo sapiens
tgaagaatgttagagtaatgaaa

SEQ ID NO: 4850057 - DNA, 23 bp, Homo sapiens
tgaagagacagagacaagtaatt

SEQ ID NO: 4850058 - DNA, 17 bp, Homo sapiens
tgaagatctttatattt

SEQ ID NO: 4850059 - DNA, 21 bp, Homo sapiens
tgaagatctttatatttcaat

SEQ ID NO: 4850060 - DNA, 22 bp, Homo sapiens
tgaagcatagataatattgttt

SEQ ID NO: 4850061 - DNA, 15 bp, Homo sapiens
tgaagctggagcagc

SEQ ID NO: 4850062 - DNA, 19 bp, Homo sapiens
tgaagctggagcagcggat

SEQ ID NO: 4850063 - DNA, 9 bp, Homo sapiens
tgaaggggc

SEQ ID NO: 4850064 - DNA, 11 bp, Homo sapiens
tgaaggggctg

SEQ ID NO: 4850065 - DNA, 22 bp, Homo sapiens
tgaagtttcaagttttaaagtt

SEQ ID NO: 4850066 - DNA, 16 bp, Homo sapiens
tgaagtttggagatag

SEQ ID NO: 4850067 - DNA, 16 bp, Homo sapiens
tgaataatggaaaatg

SEQ ID NO: 4850068 - DNA, 18 bp, Homo sapiens
tgaatagatatgaaagct

SEQ ID NO: 4850069 - DNA, 21 bp, Homo sapiens
tgaatagatatgaaagctgat

SEQ ID NO: 4850070 - DNA, 15 bp, Homo sapiens
tgaatccgtacttgg

SEQ ID NO: 4850071 - DNA, 16 bp, Homo sapiens
tgaatccttttaatct

SEQ ID NO: 4850072 - DNA, 13 bp, Homo sapiens
tgaatgaatggga

SEQ ID NO: 4850073 - DNA, 20 bp, Homo sapiens
tgaatgtgctggtgaacact

SEQ ID NO: 4850074 - DNA, 17 bp, Homo sapiens
tgaattacctggatgtt

SEQ ID NO: 4850075 - DNA, 15 bp, Homo sapiens
tgaattagtgagtat

SEQ ID NO: 4850076 - DNA, 20 bp, Homo sapiens
tgaattatcagcaaagaaaa

SEQ ID NO: 4850077 - DNA, 16 bp, Homo sapiens
tgaattgaagtttcaa

SEQ ID NO: 4850078 - DNA, 19 bp, Homo sapiens
tgaatttgccagaggacca

SEQ ID NO: 4850079 - DNA, 11 bp, Homo sapiens
tgaatttggag

SEQ ID NO: 4850080 - DNA, 13 bp, Homo sapiens
tgaattttaaagt

SEQ ID NO: 4850081 - DNA, 16 bp, Homo sapiens
tgaattttaaagtatg

SEQ ID NO: 4850082 - DNA, 17 bp, Homo sapiens
tgaattttctaaaagct

SEQ ID NO: 4850083 - DNA, 19 bp, Homo sapiens
tgacaaccattaaagtcag

SEQ ID NO: 4850084 - DNA, 21 bp, Homo sapiens
tgacaagctgtatcactgcct

SEQ ID NO: 4850085 - DNA, 18 bp, Homo sapiens
tgacagaggtttgaagga

SEQ ID NO: 4850086 - DNA, 22 bp, Homo sapiens
tgacagaggtttgaaggagaat

SEQ ID NO: 4850087 - DNA, 12 bp, Homo sapiens
tgacagccacac

SEQ ID NO: 4850088 - DNA, 20 bp, Homo sapiens
tgacagccacaccgtggcag

SEQ ID NO: 4850089 - DNA, 14 bp, Homo sapiens
tgacaggttttcca

SEQ ID NO: 4850090 - DNA, 22 bp, Homo sapiens
tgacaggttttccaaaagtaaa

SEQ ID NO: 4850091 - DNA, 12 bp, Homo sapiens
tgacagtgcctt

SEQ ID NO: 4850092 - DNA, 16 bp, Homo sapiens
tgacagttcccagagt

SEQ ID NO: 4850093 - DNA, 19 bp, Homo sapiens
tgacagttcccagagtggg

SEQ ID NO: 4850094 - DNA, 24 bp, Homo sapiens
tgacatttgggagacatgtgacat

SEQ ID NO: 4850095 - DNA, 14 bp, Homo sapiens
tgaccagtgcctgt

SEQ ID NO: 4850096 - DNA, 17 bp, Homo sapiens
tgaccagtgcctgtgag

SEQ ID NO: 4850097 - DNA, 16 bp, Homo sapiens
tgaccccattcctgat

SEQ ID NO: 4850098 - DNA, 22 bp, Homo sapiens
tgacccttacagcctctgactt

SEQ ID NO: 4850099 - DNA, 10 bp, Homo sapiens
tgacctgccc

SEQ ID NO: 4850100 - DNA, 13 bp, Homo sapiens
tgacctgccccaa

SEQ ID NO: 4850101 - DNA, 22 bp, Homo sapiens
tgactaactcaaatacacattt

SEQ ID NO: 4850102 - DNA, 23 bp, Homo sapiens
tgactaagaaatgccagtggtgg

SEQ ID NO: 4850103 - DNA, 18 bp, Homo sapiens
tgactagaactcctgtct

SEQ ID NO: 4850104 - DNA, 11 bp, Homo sapiens
tgactccaggg

SEQ ID NO: 4850105 - DNA, 17 bp, Homo sapiens
tgactccttatctcttt

SEQ ID NO: 4850106 - DNA, 15 bp, Homo sapiens
tgactctataagcaa

SEQ ID NO: 4850107 - DNA, 21 bp, Homo sapiens
tgactctataagcaaattgct

SEQ ID NO: 4850108 - DNA, 13 bp, Homo sapiens
tgactcttattta

SEQ ID NO: 4850109 - DNA, 14 bp, Homo sapiens
tgactcttatttat

SEQ ID NO: 4850110 - DNA, 20 bp, Homo sapiens
tgacttaggtttcaggaagt

SEQ ID NO: 4850111 - DNA, 17 bp, Homo sapiens
tgacttttataaagcat

SEQ ID NO: 4850112 - DNA, 12 bp, Homo sapiens
tgagaaaacatg

SEQ ID NO: 4850113 - DNA, 17 bp, Homo sapiens
tgagaagtacagggcag

SEQ ID NO: 4850114 - DNA, 10 bp, Homo sapiens
tgagaatggc

SEQ ID NO: 4850115 - DNA, 22 bp, Homo sapiens
tgagaatggcctggagcaggcc

SEQ ID NO: 4850116 - DNA, 22 bp, Homo sapiens
tgagacaggtgcctaacctggg

SEQ ID NO: 4850117 - DNA, 16 bp, Homo sapiens
tgagacagtgaatttg

SEQ ID NO: 4850118 - DNA, 13 bp, Homo sapiens
tgagagcataatt

SEQ ID NO: 4850119 - DNA, 13 bp, Homo sapiens
tgagatactgtgt

SEQ ID NO: 4850120 - DNA, 14 bp, Homo sapiens
tgagattctgaagt

SEQ ID NO: 4850121 - DNA, 21 bp, Homo sapiens
tgagattctgaagtatgaagt

SEQ ID NO: 4850122 - DNA, 15 bp, Homo sapiens
tgagattggttttcc

SEQ ID NO: 4850123 - DNA, 20 bp, Homo sapiens
tgagcaagcaccaacctcca

SEQ ID NO: 4850124 - DNA, 17 bp, Homo sapiens
tgagcacaaagaagaaa

SEQ ID NO: 4850125 - DNA, 21 bp, Homo sapiens
tgagcacaaagaagaaagctg

SEQ ID NO: 4850126 - DNA, 17 bp, Homo sapiens
tgagcagagatgtactg

SEQ ID NO: 4850127 - DNA, 22 bp, Homo sapiens
tgagcagagatgtactgcaaag

SEQ ID NO: 4850128 - DNA, 16 bp, Homo sapiens
tgagccaaatttcttt

SEQ ID NO: 4850129 - DNA, 19 bp, Homo sapiens
tgagccctcctgagggccg

SEQ ID NO: 4850130 - DNA, 15 bp, Homo sapiens
tgagccttgcagata

SEQ ID NO: 4850131 - DNA, 23 bp, Homo sapiens
tgagccttgcagatatctgcatg

SEQ ID NO: 4850132 - DNA, 15 bp, Homo sapiens
tgaggaaaattctta

SEQ ID NO: 4850133 - DNA, 18 bp, Homo sapiens
tgaggaagacaagcattt

SEQ ID NO: 4850134 - DNA, 14 bp, Homo sapiens
tgaggacccagagc

SEQ ID NO: 4850135 - DNA, 12 bp, Homo sapiens
tgaggagagagg

SEQ ID NO: 4850136 - DNA, 19 bp, Homo sapiens
tgaggatccagggcagcag

SEQ ID NO: 4850137 - DNA, 20 bp, Homo sapiens
tgaggatccagggcagcagg

SEQ ID NO: 4850138 - DNA, 16 bp, Homo sapiens
tgaggcaaacagcaag

SEQ ID NO: 4850139 - DNA, 17 bp, Homo sapiens
tgaggcccagagaggga

SEQ ID NO: 4850140 - DNA, 19 bp, Homo sapiens
tgaggcccagagagggaag

SEQ ID NO: 4850141 - DNA, 13 bp, Homo sapiens
tgaggctcagaga

SEQ ID NO: 4850142 - DNA, 12 bp, Homo sapiens
tggaatattaaa

SEQ ID NO: 4850143 - DNA, 13 bp, Homo sapiens
tggaatattaaaa

SEQ ID NO: 4850144 - DNA, 15 bp, Homo sapiens
tggaatggatttttc

SEQ ID NO: 4850145 - DNA, 21 bp, Homo sapiens
tggaattatgttggtgtgaat

SEQ ID NO: 4850146 - DNA, 13 bp, Homo sapiens
tggacatgagagt

SEQ ID NO: 4850147 - DNA, 17 bp, Homo sapiens
tggacatttagaagaaa

SEQ ID NO: 4850148 - DNA, 11 bp, Homo sapiens
tggacatttta

SEQ ID NO: 4850149 - DNA, 13 bp, Homo sapiens
tggacattttatg

SEQ ID NO: 4850150 - DNA, 17 bp, Homo sapiens
tggacattttatgtctt

SEQ ID NO: 4850151 - DNA, 17 bp, Homo sapiens
tggacgttaggccaggc

SEQ ID NO: 4850152 - DNA, 19 bp, Homo sapiens
tggacgttaggccaggcct

SEQ ID NO: 4850153 - DNA, 21 bp, Homo sapiens
tggactgcatggggaggcagc

SEQ ID NO: 4850154 - DNA, 15 bp, Homo sapiens
tggacttctgaagag

SEQ ID NO: 4850155 - DNA, 13 bp, Homo sapiens
tggagaatactgc

SEQ ID NO: 4850156 - DNA, 22 bp, Homo sapiens
tggagaatactgccaaaacatt

SEQ ID NO: 4850157 - DNA, 13 bp, Homo sapiens
tggagcagcaggc

SEQ ID NO: 4850158 - DNA, 22 bp, Homo sapiens
tggagcagcaggcctctgggac

SEQ ID NO: 4850159 - DNA, 13 bp, Homo sapiens
tggagcagccaag

SEQ ID NO: 4850160 - DNA, 15 bp, Homo sapiens
tggagcagccaaggc

SEQ ID NO: 4850161 - DNA, 22 bp, Homo sapiens
tggagcagccaaggccgccagc

SEQ ID NO: 4850162 - DNA, 20 bp, Homo sapiens
tggagcagcggattgctctg

SEQ ID NO: 4850163 - DNA, 12 bp, Homo sapiens
tggagcaggccc

SEQ ID NO: 4850164 - DNA, 18 bp, Homo sapiens
tggagcaggcccaatgct

SEQ ID NO: 4850165 - DNA, 21 bp, Homo sapiens
tggagcaggcccaatgctgct

SEQ ID NO: 4850166 - DNA, 13 bp, Homo sapiens
tggagccccaggg

SEQ ID NO: 4850167 - DNA, 20 bp, Homo sapiens
tggagcctacctctgtctga

SEQ ID NO: 4850168 - DNA, 16 bp, Homo sapiens
tggagcttcagccagg

SEQ ID NO: 4850169 - DNA, 11 bp, Homo sapiens
tggaggctcct

SEQ ID NO: 4850170 - DNA, 15 bp, Homo sapiens
tggagggaagacctg

SEQ ID NO: 4850171 - DNA, 21 bp, Homo sapiens
tggaggggatgataaaggaaa

SEQ ID NO: 4850172 - DNA, 20 bp, Homo sapiens
tggagtgtcggatcctgtga

SEQ ID NO: 4850173 - DNA, 17 bp, Homo sapiens
tggatactggggggcag

SEQ ID NO: 4850174 - DNA, 19 bp, Homo sapiens
tggatactggggggcaggc

SEQ ID NO: 4850175 - DNA, 19 bp, Homo sapiens
tggatatataggctatttt

SEQ ID NO: 4850176 - DNA, 13 bp, Homo sapiens
tggatatttgtat

SEQ ID NO: 4850177 - DNA, 20 bp, Homo sapiens
tggatcccgttcagaaaacc

SEQ ID NO: 4850178 - DNA, 22 bp, Homo sapiens
tggatcgagtgtagctgtgaaa

SEQ ID NO: 4850179 - DNA, 23 bp, Homo sapiens
tggatcgagtgtagctgtgaaat

SEQ ID NO: 4850180 - DNA, 12 bp, Homo sapiens
tggatgtctggc

SEQ ID NO: 4850181 - DNA, 14 bp, Homo sapiens
tggattcatattta

SEQ ID NO: 4850182 - DNA, 18 bp, Homo sapiens
tggatttaaaagcctgct

SEQ ID NO: 4850183 - DNA, 14 bp, Homo sapiens
tggattttcctgaa

SEQ ID NO: 4850184 - DNA, 19 bp, Homo sapiens
tggattttcctgaaagtgt

SEQ ID NO: 4850185 - DNA, 21 bp, Homo sapiens
tggcaaaaagagtcagacatt

SEQ ID NO: 4850186 - DNA, 21 bp, Homo sapiens
tggcacaatgttggagcagca

SEQ ID NO: 4850187 - DNA, 22 bp, Homo sapiens
tggcacaatgttggagcagcag

SEQ ID NO: 4850188 - DNA, 22 bp, Homo sapiens
tggcagagaccataagagaaac

SEQ ID NO: 4850189 - DNA, 13 bp, Homo sapiens
tggcagatggggg

SEQ ID NO: 4850190 - DNA, 14 bp, Homo sapiens
tggcagcttgctgg

SEQ ID NO: 4850191 - DNA, 15 bp, Homo sapiens
tggcagcttgctggg

SEQ ID NO: 4850192 - DNA, 19 bp, Homo sapiens
tggcagcttgctgggcttt

SEQ ID NO: 4850193 - DNA, 16 bp, Homo sapiens
tggcaggagtctctgc

SEQ ID NO: 4850194 - DNA, 18 bp, Homo sapiens
tggcaggagtctctgcca

SEQ ID NO: 4850195 - DNA, 14 bp, Homo sapiens
tggcagtgggaatg

SEQ ID NO: 4850196 - DNA, 22 bp, Homo sapiens
tggcagtgggaatgttctttct

SEQ ID NO: 4850197 - DNA, 23 bp, Homo sapiens
tggcagtgggaatgttctttctg

SEQ ID NO: 4850198 - DNA, 16 bp, Homo sapiens
tggcatgcttaaattt

SEQ ID NO: 4850199 - DNA, 18 bp, Homo sapiens
tggcatgcttaaatttta

SEQ ID NO: 4850200 - DNA, 18 bp, Homo sapiens
tggcattctttgcaatac

SEQ ID NO: 4850201 - DNA, 18 bp, Homo sapiens
tggccaattaaaaacgaa

SEQ ID NO: 4850202 - DNA, 12 bp, Homo sapiens
tggccagcccgc

SEQ ID NO: 4850203 - DNA, 23 bp, Homo sapiens
tggccagcccgcagaggtggggt

SEQ ID NO: 4850204 - DNA, 16 bp, Homo sapiens
tggccaggcagggaga

SEQ ID NO: 4850205 - DNA, 15 bp, Homo sapiens
tggccatcttctttc

SEQ ID NO: 4850206 - DNA, 19 bp, Homo sapiens
tggccatcttctttcttcc

SEQ ID NO: 4850207 - DNA, 21 bp, Homo sapiens
tggcccccttcaggagcctgg

SEQ ID NO: 4850208 - DNA, 22 bp, Homo sapiens
tggccggagcaaactctgctgt

SEQ ID NO: 4850209 - DNA, 15 bp, Homo sapiens
tggcctctgcctggg

SEQ ID NO: 4850210 - DNA, 17 bp, Homo sapiens
tggcctctgcctggggc

SEQ ID NO: 4850211 - DNA, 12 bp, Homo sapiens
tggcctggagca

SEQ ID NO: 4850212 - DNA, 13 bp, Homo sapiens
tggcctggagcag

SEQ ID NO: 4850213 - DNA, 15 bp, Homo sapiens
tggcctgtccctagg

SEQ ID NO: 4850214 - DNA, 20 bp, Homo sapiens
tggcctgtccctagggctct

SEQ ID NO: 4850215 - DNA, 21 bp, Homo sapiens
tggcctttatgttctttcacc

SEQ ID NO: 4850216 - DNA, 18 bp, Homo sapiens
tggcgaatctcaaaatta

SEQ ID NO: 4850217 - DNA, 16 bp, Homo sapiens
tggcggaggctgctcg

SEQ ID NO: 4850218 - DNA, 16 bp, Homo sapiens
tggctcaaagcagcag

SEQ ID NO: 4850219 - DNA, 18 bp, Homo sapiens
tggctgaagctggagcag

SEQ ID NO: 4850220 - DNA, 18 bp, Homo sapiens
tggctgccgttttctggg

SEQ ID NO: 4850221 - DNA, 13 bp, Homo sapiens
tggctgctaacaa

SEQ ID NO: 4850222 - DNA, 14 bp, Homo sapiens
tggctgctgttgct

SEQ ID NO: 4850223 - DNA, 18 bp, Homo sapiens
tggctggggtggagtggg

SEQ ID NO: 4850224 - DNA, 14 bp, Homo sapiens
tgggaaaacatttg

SEQ ID NO: 4850225 - DNA, 23 bp, Homo sapiens
tgggaaacaaataatttgaactt

SEQ ID NO: 4850226 - DNA, 13 bp, Homo sapiens
tgggaaggccagc

SEQ ID NO: 4850227 - DNA, 16 bp, Homo sapiens
tgggaaggccagcctt

SEQ ID NO: 4850228 - DNA, 14 bp, Homo sapiens
tgggaagggagcat

SEQ ID NO: 4850229 - DNA, 22 bp, Homo sapiens
tgggaagggagcattgcagcct

SEQ ID NO: 4850230 - DNA, 17 bp, Homo sapiens
tgggaatgttctttctg

SEQ ID NO: 4850231 - DNA, 20 bp, Homo sapiens
tgggactaggacctgagcct

SEQ ID NO: 4850232 - DNA, 18 bp, Homo sapiens
tgggagaaggactatcaa

SEQ ID NO: 4850233 - DNA, 13 bp, Homo sapiens
tgggagacagcag

SEQ ID NO: 4850234 - DNA, 14 bp, Homo sapiens
tgggagacatgtga

SEQ ID NO: 4850235 - DNA, 15 bp, Homo sapiens
tgggagacatgtgac

SEQ ID NO: 4850236 - DNA, 16 bp, Homo sapiens
tgggagagccatacat

SEQ ID NO: 4850237 - DNA, 17 bp, Homo sapiens
tgggagccacttctccc

SEQ ID NO: 4850238 - DNA, 10 bp, Homo sapiens
tgggagccag

SEQ ID NO: 4850239 - DNA, 11 bp, Homo sapiens
tgggagccagg

SEQ ID NO: 4850240 - DNA, 16 bp, Homo sapiens
tgggagccaggactcc

SEQ ID NO: 4850241 - DNA, 20 bp, Homo sapiens
tgggagccaggactcccaga

SEQ ID NO: 4850242 - DNA, 21 bp, Homo sapiens
tgggagccaggactcccagaa

SEQ ID NO: 4850243 - DNA, 23 bp, Homo sapiens
tgggagccaggactcccagaacc

SEQ ID NO: 4850244 - DNA, 13 bp, Homo sapiens
tgggatcctccct

SEQ ID NO: 4850245 - DNA, 13 bp, Homo sapiens
tgggcactggggc

SEQ ID NO: 4850246 - DNA, 14 bp, Homo sapiens
tgggcattagcaag

SEQ ID NO: 4850247 - DNA, 15 bp, Homo sapiens
tgggcctcccctggg

SEQ ID NO: 4850248 - DNA, 16 bp, Homo sapiens
tgggcctctcctgccc

SEQ ID NO: 4850249 - DNA, 15 bp, Homo sapiens
tgggcggcacagcct

SEQ ID NO: 4850250 - DNA, 13 bp, Homo sapiens
tgggctgtgagga

SEQ ID NO: 4850251 - DNA, 16 bp, Homo sapiens
tgggctgtgaggacag

SEQ ID NO: 4850252 - DNA, 21 bp, Homo sapiens
tgggctgtgattactgcaatc

SEQ ID NO: 4850253 - DNA, 19 bp, Homo sapiens
tgggcttcaacagccaagc

SEQ ID NO: 4850254 - DNA, 16 bp, Homo sapiens
tgggctttgggaagtt

SEQ ID NO: 4850255 - DNA, 22 bp, Homo sapiens
tgggctttgggaagtttgctgt

SEQ ID NO: 4850256 - DNA, 17 bp, Homo sapiens
tgggctttgttgtgaga

SEQ ID NO: 4850257 - DNA, 17 bp, Homo sapiens
tggggaactcccccaga

SEQ ID NO: 4850258 - DNA, 16 bp, Homo sapiens
tggggaagggcctgcc

SEQ ID NO: 4850259 - DNA, 13 bp, Homo sapiens
tggggaaggggcc

SEQ ID NO: 4850260 - DNA, 15 bp, Homo sapiens
tggggaaggggcctg

SEQ ID NO: 4850261 - DNA, 18 bp, Homo sapiens
tggggaaggggcctgggc

SEQ ID NO: 4850262 - DNA, 23 bp, Homo sapiens
tggggaaggggcctgggctgtga

SEQ ID NO: 4850263 - DNA, 16 bp, Homo sapiens
ttaaatgcttcatttg

SEQ ID NO: 4850264 - DNA, 14 bp, Homo sapiens
ttaaattttttggc

SEQ ID NO: 4850265 - DNA, 18 bp, Homo sapiens
ttaactaaattttaaagc

SEQ ID NO: 4850266 - DNA, 19 bp, Homo sapiens
ttaactatcttctttggac

SEQ ID NO: 4850267 - DNA, 19 bp, Homo sapiens
ttaactgccgtaatttaac

SEQ ID NO: 4850268 - DNA, 16 bp, Homo sapiens
ttaagaactaaaatgt

SEQ ID NO: 4850269 - DNA, 19 bp, Homo sapiens
ttaagcaaatgttaaaagt

SEQ ID NO: 4850270 - DNA, 19 bp, Homo sapiens
ttaagcagtacaaatgttt

SEQ ID NO: 4850271 - DNA, 13 bp, Homo sapiens
ttaagctttttgg

SEQ ID NO: 4850272 - DNA, 14 bp, Homo sapiens
ttaagctttttgga

SEQ ID NO: 4850273 - DNA, 16 bp, Homo sapiens
ttaagctttttggaat

SEQ ID NO: 4850274 - DNA, 20 bp, Homo sapiens
ttaaggacccttttaagcat

SEQ ID NO: 4850275 - DNA, 23 bp, Homo sapiens
ttaaggacccttttaagcatgtg

SEQ ID NO: 4850276 - DNA, 14 bp, Homo sapiens
ttaaggataaatca

SEQ ID NO: 4850277 - DNA, 23 bp, Homo sapiens
ttaaggataaatcataaagtcag

SEQ ID NO: 4850278 - DNA, 18 bp, Homo sapiens
ttaaggggaagaatgaaa

SEQ ID NO: 4850279 - DNA, 13 bp, Homo sapiens
ttaagggtatgat

SEQ ID NO: 4850280 - DNA, 16 bp, Homo sapiens
ttaataaagatgagtt

SEQ ID NO: 4850281 - DNA, 14 bp, Homo sapiens
ttaatagatttggg

SEQ ID NO: 4850282 - DNA, 21 bp, Homo sapiens
ttaatccagttataagaagaa

SEQ ID NO: 4850283 - DNA, 19 bp, Homo sapiens
ttaatccatttcaggactc

SEQ ID NO: 4850284 - DNA, 14 bp, Homo sapiens
ttaatgacaatatt

SEQ ID NO: 4850285 - DNA, 18 bp, Homo sapiens
ttaatggtttattctttg

SEQ ID NO: 4850286 - DNA, 14 bp, Homo sapiens
ttaatgttttcaaa

SEQ ID NO: 4850287 - DNA, 16 bp, Homo sapiens
ttaatgttttcaaaag

SEQ ID NO: 4850288 - DNA, 22 bp, Homo sapiens
ttaatttggagcacaaaattca

SEQ ID NO: 4850289 - DNA, 13 bp, Homo sapiens
ttaatttgtgtgt

SEQ ID NO: 4850290 - DNA, 16 bp, Homo sapiens
ttaattttaaagtgca

SEQ ID NO: 4850291 - DNA, 18 bp, Homo sapiens
ttaatttttcctgcatgt

SEQ ID NO: 4850292 - DNA, 20 bp, Homo sapiens
ttacaagggcataaagtaaa

SEQ ID NO: 4850293 - DNA, 17 bp, Homo sapiens
ttacaataggagtggtg

SEQ ID NO: 4850294 - DNA, 21 bp, Homo sapiens
ttacagaggtattaaaactaa

SEQ ID NO: 4850295 - DNA, 14 bp, Homo sapiens
ttacagcctctgac

SEQ ID NO: 4850296 - DNA, 15 bp, Homo sapiens
ttacagcctctgact

SEQ ID NO: 4850297 - DNA, 12 bp, Homo sapiens
ttacaggagcca

SEQ ID NO: 4850298 - DNA, 18 bp, Homo sapiens
ttacaggagccagcctgc

SEQ ID NO: 4850299 - DNA, 20 bp, Homo sapiens
ttacattttattaagctttt

SEQ ID NO: 4850300 - DNA, 16 bp, Homo sapiens
ttaccctacagacagc

SEQ ID NO: 4850301 - DNA, 13 bp, Homo sapiens
ttacctccatcca

SEQ ID NO: 4850302 - DNA, 14 bp, Homo sapiens
ttacctccatccat

SEQ ID NO: 4850303 - DNA, 15 bp, Homo sapiens
ttacctggatgttct

SEQ ID NO: 4850304 - DNA, 12 bp, Homo sapiens
ttacctggccta

SEQ ID NO: 4850305 - DNA, 21 bp, Homo sapiens
ttacctggcttatttaatatg

SEQ ID NO: 4850306 - DNA, 13 bp, Homo sapiens
ttacctgtggata

SEQ ID NO: 4850307 - DNA, 16 bp, Homo sapiens
ttaccttgtatactgt

SEQ ID NO: 4850308 - DNA, 19 bp, Homo sapiens
ttaccttttttttttcttg

SEQ ID NO: 4850309 - DNA, 12 bp, Homo sapiens
ttactcactgct

SEQ ID NO: 4850310 - DNA, 15 bp, Homo sapiens
ttactgatgagagaa

SEQ ID NO: 4850311 - DNA, 16 bp, Homo sapiens
ttactgcaatcactgt

SEQ ID NO: 4850312 - DNA, 17 bp, Homo sapiens
ttactgctttaatcaga

SEQ ID NO: 4850313 - DNA, 21 bp, Homo sapiens
ttacttcaaagtgcctgggct

SEQ ID NO: 4850314 - DNA, 18 bp, Homo sapiens
ttactttagaagcctgca

SEQ ID NO: 4850315 - DNA, 20 bp, Homo sapiens
ttagaaacaaacaaaactct

SEQ ID NO: 4850316 - DNA, 14 bp, Homo sapiens
ttagaaataataaa

SEQ ID NO: 4850317 - DNA, 23 bp, Homo sapiens
ttagaaattacctgtggatattt

SEQ ID NO: 4850318 - DNA, 12 bp, Homo sapiens
ttagaagaaaga

SEQ ID NO: 4850319 - DNA, 23 bp, Homo sapiens
ttagaagcctgcataatgtttct

SEQ ID NO: 4850320 - DNA, 20 bp, Homo sapiens
ttagactcaaagaagtactg

SEQ ID NO: 4850321 - DNA, 21 bp, Homo sapiens
ttagagaagtatacataagtt

SEQ ID NO: 4850322 - DNA, 15 bp, Homo sapiens
ttagattgagaaatg

SEQ ID NO: 4850323 - DNA, 18 bp, Homo sapiens
ttagattgtattaactat

SEQ ID NO: 4850324 - DNA, 13 bp, Homo sapiens
ttagcaaggcaga

SEQ ID NO: 4850325 - DNA, 16 bp, Homo sapiens
ttagcagagtctgtct

SEQ ID NO: 4850326 - DNA, 14 bp, Homo sapiens
ttagccctgtctgc

SEQ ID NO: 4850327 - DNA, 20 bp, Homo sapiens
ttagctgaggctgagaaagc

SEQ ID NO: 4850328 - DNA, 14 bp, Homo sapiens
ttaggattgtgggt

SEQ ID NO: 4850329 - DNA, 12 bp, Homo sapiens
ttaggccaggcc

SEQ ID NO: 4850330 - DNA, 23 bp, Homo sapiens
ttagggactacccatagacatga

SEQ ID NO: 4850331 - DNA, 19 bp, Homo sapiens
ttaggggaaggagaagtaa

SEQ ID NO: 4850332 - DNA, 12 bp, Homo sapiens
ttagtgatgtcc

SEQ ID NO: 4850333 - DNA, 23 bp, Homo sapiens
ttagtttttggttgggaatgagg

SEQ ID NO: 4850334 - DNA, 16 bp, Homo sapiens
ttataaaagtgttcat

SEQ ID NO: 4850335 - DNA, 17 bp, Homo sapiens
ttataaacagaaatgga

SEQ ID NO: 4850336 - DNA, 13 bp, Homo sapiens
ttataaagcatgt

SEQ ID NO: 4850337 - DNA, 19 bp, Homo sapiens
ttataaagtggaagtatgt

SEQ ID NO: 4850338 - DNA, 17 bp, Homo sapiens
ttataaggaaattttac

SEQ ID NO: 4850339 - DNA, 19 bp, Homo sapiens
ttatacatcaatatgtata

SEQ ID NO: 4850340 - DNA, 20 bp, Homo sapiens
ttatacatgtgatacatttt

SEQ ID NO: 4850341 - DNA, 19 bp, Homo sapiens
ttatattactgacatttct

SEQ ID NO: 4850342 - DNA, 19 bp, Homo sapiens
ttatatttcaataaatgat

SEQ ID NO: 4850343 - DNA, 18 bp, Homo sapiens
ttatattttagaaataat

SEQ ID NO: 4850344 - DNA, 23 bp, Homo sapiens
ttatatttttttaactgtgataa

SEQ ID NO: 4850345 - DNA, 14 bp, Homo sapiens
ttatcatgaatttt

SEQ ID NO: 4850346 - DNA, 20 bp, Homo sapiens
ttatcttacaatattgattg

SEQ ID NO: 4850347 - DNA, 13 bp, Homo sapiens
ttatgagggccac

SEQ ID NO: 4850348 - DNA, 17 bp, Homo sapiens
ttatgcaattcagtgtt

SEQ ID NO: 4850349 - DNA, 17 bp, Homo sapiens
ttattaaattgtaaaac

SEQ ID NO: 4850350 - DNA, 12 bp, Homo sapiens
ttattaatgttt

SEQ ID NO: 4850351 - DNA, 13 bp, Homo sapiens
ttattaatgtttt

SEQ ID NO: 4850352 - DNA, 17 bp, Homo sapiens
ttattaatgttttcaaa

SEQ ID NO: 4850353 - DNA, 21 bp, Homo sapiens
ttattcattagttttgaagat

SEQ ID NO: 4850354 - DNA, 21 bp, Homo sapiens
ttattccccagtgactccagg

SEQ ID NO: 4850355 - DNA, 19 bp, Homo sapiens
ttatttgattatttaagac

SEQ ID NO: 4850356 - DNA, 20 bp, Homo sapiens
ttatttgattatttaagact

SEQ ID NO: 4850357 - DNA, 20 bp, Homo sapiens
ttattttgggcctgttcctt

SEQ ID NO: 4850358 - DNA, 23 bp, Homo sapiens
ttatttttggcgtggctgactta

SEQ ID NO: 4850359 - DNA, 14 bp, Homo sapiens
ttattttttaagaa

SEQ ID NO: 4850360 - DNA, 16 bp, Homo sapiens
ttatttttttaaaatt

SEQ ID NO: 4850361 - DNA, 14 bp, Homo sapiens
ttcaaaaagccaca

SEQ ID NO: 4850362 - DNA, 23 bp, Homo sapiens
ttcaaagcatggacatttagaag

SEQ ID NO: 4850363 - DNA, 18 bp, Homo sapiens
ttcaaagtgcctgggctc

SEQ ID NO: 4850364 - DNA, 16 bp, Homo sapiens
ttcaaagttttgttgt

SEQ ID NO: 4850365 - DNA, 21 bp, Homo sapiens
ttcaaagttttgttgtactta

SEQ ID NO: 4850366 - DNA, 19 bp, Homo sapiens
ttcaacagccaagctggca

SEQ ID NO: 4850367 - DNA, 21 bp, Homo sapiens
ttcaacagccaagctggcaca

SEQ ID NO: 4850368 - DNA, 20 bp, Homo sapiens
ttcaagaatcagacagcagg

SEQ ID NO: 4850369 - DNA, 20 bp, Homo sapiens
ttcacccatcctaggaacca

SEQ ID NO: 4850370 - DNA, 13 bp, Homo sapiens
ttcactgtactgc

SEQ ID NO: 4850371 - DNA, 19 bp, Homo sapiens
ttcactgtactgcatgtga

SEQ ID NO: 4850372 - DNA, 11 bp, Homo sapiens
ttcagaagaat

SEQ ID NO: 4850373 - DNA, 17 bp, Homo sapiens
ttcagaagtcacacatt

SEQ ID NO: 4850374 - DNA, 18 bp, Homo sapiens
ttcagacccctgcctgga

SEQ ID NO: 4850375 - DNA, 12 bp, Homo sapiens
ttcagccaggca

SEQ ID NO: 4850376 - DNA, 17 bp, Homo sapiens
ttcagccaggcaagaaa

SEQ ID NO: 4850377 - DNA, 11 bp, Homo sapiens
ttcagccaggt

SEQ ID NO: 4850378 - DNA, 14 bp, Homo sapiens
ttcagccaggtctg

SEQ ID NO: 4850379 - DNA, 20 bp, Homo sapiens
ttcagccaggtctgactcca

SEQ ID NO: 4850380 - DNA, 21 bp, Homo sapiens
ttcagccaggtctgactccaa

SEQ ID NO: 4850381 - DNA, 15 bp, Homo sapiens
ttcaggactctctcc

SEQ ID NO: 4850382 - DNA, 17 bp, Homo sapiens
ttcaggagatggggaat

SEQ ID NO: 4850383 - DNA, 21 bp, Homo sapiens
ttgttgtgagaatggcctgga

SEQ ID NO: 4850384 - DNA, 21 bp, Homo sapiens
ttgtttaaaatgtaatttaaa

SEQ ID NO: 4850385 - DNA, 18 bp, Homo sapiens
ttgtttataataaaaata

SEQ ID NO: 4850386 - DNA, 13 bp, Homo sapiens
ttgtttgccagga

SEQ ID NO: 4850387 - DNA, 17 bp, Homo sapiens
ttgtttggtaaatgttt

SEQ ID NO: 4850388 - DNA, 19 bp, Homo sapiens
ttgtttggtaaatgtttct

SEQ ID NO: 4850389 - DNA, 14 bp, Homo sapiens
ttgttttgaaaata

SEQ ID NO: 4850390 - DNA, 11 bp, Homo sapiens
tttaaaaatat

SEQ ID NO: 4850391 - DNA, 15 bp, Homo sapiens
tttaaaaattgttat

SEQ ID NO: 4850392 - DNA, 13 bp, Homo sapiens
tttaaaagcctgc

SEQ ID NO: 4850393 - DNA, 12 bp, Homo sapiens
tttaaaatgtaa

SEQ ID NO: 4850394 - DNA, 18 bp, Homo sapiens
tttaaaatgtaatttaaa

SEQ ID NO: 4850395 - DNA, 21 bp, Homo sapiens
tttaaagtatgcattattaaa

SEQ ID NO: 4850396 - DNA, 16 bp, Homo sapiens
tttaaataaagaacaa

SEQ ID NO: 4850397 - DNA, 19 bp, Homo sapiens
tttaaatcctgaagagcat

SEQ ID NO: 4850398 - DNA, 11 bp, Homo sapiens
tttaaattgtg

SEQ ID NO: 4850399 - DNA, 14 bp, Homo sapiens
tttaactaaatttt

SEQ ID NO: 4850400 - DNA, 12 bp, Homo sapiens
tttaactgtgat

SEQ ID NO: 4850401 - DNA, 17 bp, Homo sapiens
tttaactgtggatattg

SEQ ID NO: 4850402 - DNA, 18 bp, Homo sapiens
tttaactgtggatattgt

SEQ ID NO: 4850403 - DNA, 18 bp, Homo sapiens
tttaagaaaaaaagctgc

SEQ ID NO: 4850404 - DNA, 21 bp, Homo sapiens
tttaagccgcagacctggagc

SEQ ID NO: 4850405 - DNA, 14 bp, Homo sapiens
tttaagtgtgctgg

SEQ ID NO: 4850406 - DNA, 12 bp, Homo sapiens
tttaatcagaaa

SEQ ID NO: 4850407 - DNA, 12 bp, Homo sapiens
tttaatccagtt

SEQ ID NO: 4850408 - DNA, 17 bp, Homo sapiens
tttaatttcctgtgagg

SEQ ID NO: 4850409 - DNA, 22 bp, Homo sapiens
tttaatttgaaggtagaatgtt

SEQ ID NO: 4850410 - DNA, 15 bp, Homo sapiens
tttacagctgtgctc

SEQ ID NO: 4850411 - DNA, 18 bp, Homo sapiens
tttacatgaagcagaacc

SEQ ID NO: 4850412 - DNA, 19 bp, Homo sapiens
tttacctggcctagaaagg

SEQ ID NO: 4850413 - DNA, 21 bp, Homo sapiens
tttacctggcttatttaatat

SEQ ID NO: 4850414 - DNA, 23 bp, Homo sapiens
tttactgtctattaatattcagg

SEQ ID NO: 4850415 - DNA, 15 bp, Homo sapiens
tttacttgttttgga

SEQ ID NO: 4850416 - DNA, 22 bp, Homo sapiens
tttagatgaatgtcagttgtta

SEQ ID NO: 4850417 - DNA, 12 bp, Homo sapiens
tttagcttacct

SEQ ID NO: 4850418 - DNA, 23 bp, Homo sapiens
tttagtgggggatgggtcctcta

SEQ ID NO: 4850419 - DNA, 16 bp, Homo sapiens
tttataataaaaatat

SEQ ID NO: 4850420 - DNA, 17 bp, Homo sapiens
tttatagaatttaatat

SEQ ID NO: 4850421 - DNA, 22 bp, Homo sapiens
tttatagaatttaatatatata

SEQ ID NO: 4850422 - DNA, 13 bp, Homo sapiens
tttatatatttat

SEQ ID NO: 4850423 - DNA, 16 bp, Homo sapiens
tttatatttcaataaa

SEQ ID NO: 4850424 - DNA, 20 bp, Homo sapiens
tttatatttcaataaatgat

SEQ ID NO: 4850425 - DNA, 15 bp, Homo sapiens
tttatcttattttct

SEQ ID NO: 4850426 - DNA, 16 bp, Homo sapiens
tttatgatgacaatca

SEQ ID NO: 4850427 - DNA, 17 bp, Homo sapiens
tttatgtaacttcctgt

SEQ ID NO: 4850428 - DNA, 19 bp, Homo sapiens
tttattaaagcatttccta

SEQ ID NO: 4850429 - DNA, 20 bp, Homo sapiens
tttattaagcagtacaaatg

SEQ ID NO: 4850430 - DNA, 20 bp, Homo sapiens
tttattaagctttttggaat

SEQ ID NO: 4850431 - DNA, 18 bp, Homo sapiens
tttattaatgttttcaaa

SEQ ID NO: 4850432 - DNA, 18 bp, Homo sapiens
tttattccccagtgactc

SEQ ID NO: 4850433 - DNA, 17 bp, Homo sapiens
tttattctttgcaaata

SEQ ID NO: 4850434 - DNA, 18 bp, Homo sapiens
tttattctttgcaaataa

SEQ ID NO: 4850435 - DNA, 13 bp, Homo sapiens
tttatttatttat

SEQ ID NO: 4850436 - DNA, 20 bp, Homo sapiens
tttattttaaaatttcatag

SEQ ID NO: 4850437 - DNA, 10 bp, Homo sapiens
tttcaagaat

SEQ ID NO: 4850438 - DNA, 19 bp, Homo sapiens
tttcaagctggaagaagtg

SEQ ID NO: 4850439 - DNA, 17 bp, Homo sapiens
tttcaagttttaaagtt

SEQ ID NO: 4850440 - DNA, 18 bp, Homo sapiens
tttcaagttttaaagttc

SEQ ID NO: 4850441 - DNA, 13 bp, Homo sapiens
tttcaataaatga

SEQ ID NO: 4850442 - DNA, 14 bp, Homo sapiens
tttcaataaatgat

SEQ ID NO: 4850443 - DNA, 22 bp, Homo sapiens
tttcacagtgtgtggtcaacat

SEQ ID NO: 4850444 - DNA, 12 bp, Homo sapiens
tttcacccatcc

SEQ ID NO: 4850445 - DNA, 18 bp, Homo sapiens
tttcacccatcctaggaa

SEQ ID NO: 4850446 - DNA, 19 bp, Homo sapiens
tttcacccatcctaggaac

SEQ ID NO: 4850447 - DNA, 16 bp, Homo sapiens
tttcaccttttcagga

SEQ ID NO: 4850448 - DNA, 19 bp, Homo sapiens
tttcactaggactcagaaa

SEQ ID NO: 4850449 - DNA, 20 bp, Homo sapiens
tttcagaaatataacacatt

SEQ ID NO: 4850450 - DNA, 22 bp, Homo sapiens
tttcagaaatataacacatttt

SEQ ID NO: 4850451 - DNA, 22 bp, Homo sapiens
tttcagagtgactacacacagt

SEQ ID NO: 4850452 - DNA, 14 bp, Homo sapiens
tttcaggagatggg

SEQ ID NO: 4850453 - DNA, 18 bp, Homo sapiens
tttcataaattatttgat

SEQ ID NO: 4850454 - DNA, 13 bp, Homo sapiens
tttcatattgtaa

SEQ ID NO: 4850455 - DNA, 17 bp, Homo sapiens
tttcatgaaaataccat

SEQ ID NO: 4850456 - DNA, 19 bp, Homo sapiens
tttcatgaaaataccattt

SEQ ID NO: 4850457 - DNA, 16 bp, Homo sapiens
tttcatgattagaaat

SEQ ID NO: 4850458 - DNA, 12 bp, Homo sapiens
tttccaaaagta

SEQ ID NO: 4850459 - DNA, 20 bp, Homo sapiens
tttccaccataccttagaga

SEQ ID NO: 4850460 - DNA, 21 bp, Homo sapiens
tttccagaaccacacttgaaa

SEQ ID NO: 4850461 - DNA, 13 bp, Homo sapiens
tttcctgaaagtg

SEQ ID NO: 4850462 - DNA, 12 bp, Homo sapiens
tttcctgtgagg

SEQ ID NO: 4850463 - DNA, 21 bp, Homo sapiens
tttccttcaggcagctgaaat

SEQ ID NO: 4850464 - DNA, 22 bp, Homo sapiens
tttccttcaggcagctgaaatt

SEQ ID NO: 4850465 - DNA, 14 bp, Homo sapiens
tttccttctgaagt

SEQ ID NO: 4850466 - DNA, 15 bp, Homo sapiens
tttccttttcttaaa

SEQ ID NO: 4850467 - DNA, 20 bp, Homo sapiens
tttctatattcctccagctg

SEQ ID NO: 4850468 - DNA, 13 bp, Homo sapiens
tttctcatgttga

SEQ ID NO: 4850469 - DNA, 22 bp, Homo sapiens
tttctctgcatttaaaaaaatc

SEQ ID NO: 4850470 - DNA, 19 bp, Homo sapiens
tttctgaaggtagcattct

SEQ ID NO: 4850471 - DNA, 19 bp, Homo sapiens
tttctgctctatactgtgg

SEQ ID NO: 4850472 - DNA, 15 bp, Homo sapiens
tttctggatttcata

SEQ ID NO: 4850473 - DNA, 13 bp, Homo sapiens
tttctttaactgc

SEQ ID NO: 4850474 - DNA, 17 bp, Homo sapiens
tttgaaactcgagacca

SEQ ID NO: 4850475 - DNA, 16 bp, Homo sapiens
tttgaaatgaactttg

SEQ ID NO: 4850476 - DNA, 15 bp, Homo sapiens
tttgaactttggaac

SEQ ID NO: 4850477 - DNA, 16 bp, Homo sapiens
tttgaagattctatgt

SEQ ID NO: 4850478 - DNA, 15 bp, Homo sapiens
tttgaaggagaatgg

SEQ ID NO: 4850479 - DNA, 16 bp, Homo sapiens
tttgaattatcagcaa

SEQ ID NO: 4850480 - DNA, 17 bp, Homo sapiens
tttgacaggttttccaa

SEQ ID NO: 4850481 - DNA, 15 bp, Homo sapiens
tttgacatttatatt

SEQ ID NO: 4850482 - DNA, 19 bp, Homo sapiens
tttgaggtctagagagaac

SEQ ID NO: 4850483 - DNA, 14 bp, Homo sapiens
tttgagtaatgtga

SEQ ID NO: 4850484 - DNA, 19 bp, Homo sapiens
tttgagtcaaagacttaaa

SEQ ID NO: 4850485 - DNA, 21 bp, Homo sapiens
tttgatataccaaattaaaaa

SEQ ID NO: 4850486 - DNA, 13 bp, Homo sapiens
tttgcaatactgc

SEQ ID NO: 4850487 - DNA, 22 bp, Homo sapiens
tttgcagttggactctcaggga

SEQ ID NO: 4850488 - DNA, 17 bp, Homo sapiens
tttgccaggacatgcaa

SEQ ID NO: 4850489 - DNA, 19 bp, Homo sapiens
tttgccctgcgtcccttct

SEQ ID NO: 4850490 - DNA, 23 bp, Homo sapiens
tttgctgacaaccattaaagtca

SEQ ID NO: 4850491 - DNA, 11 bp, Homo sapiens
tttgcttccca

SEQ ID NO: 4850492 - DNA, 21 bp, Homo sapiens
tttgggagacatgtgacattt

SEQ ID NO: 4850493 - DNA, 14 bp, Homo sapiens
tttgggagccagga

SEQ ID NO: 4850494 - DNA, 16 bp, Homo sapiens
tttgggagccaggact

SEQ ID NO: 4850495 - DNA, 19 bp, Homo sapiens
tttgggggtcagcatccag

SEQ ID NO: 4850496 - DNA, 23 bp, Homo sapiens
tttgggtggggggcattgagtat

SEQ ID NO: 4850497 - DNA, 23 bp, Homo sapiens
tttgtaactgtttagatgaatgt

SEQ ID NO: 4850498 - DNA, 12 bp, Homo sapiens
tttgtagatggc

SEQ ID NO: 4850499 - DNA, 15 bp, Homo sapiens
tttgtattttcatga

SEQ ID NO: 4850500 - DNA, 15 bp, Homo sapiens
tttgtcacttttcct

SEQ ID NO: 4850501 - DNA, 15 bp, Homo sapiens
tttgtgactttttaa

SEQ ID NO: 4850502 - DNA, 20 bp, Homo sapiens
tttgtggaaagtcacaggtc

SEQ ID NO: 4850503 - DNA, 15 bp, Homo sapiens
tttgtggtttggaat

SEQ ID NO: 4850504 - DNA, 13 bp, Homo sapiens
aaaaaaaagcttc

SEQ ID NO: 4850505 - DNA, 10 bp, Homo sapiens
aaaaaacatt

SEQ ID NO: 4850506 - DNA, 12 bp, Homo sapiens
aaaaagagacat

SEQ ID NO: 4850507 - DNA, 16 bp, Homo sapiens
aaaaagggagtttttg

SEQ ID NO: 4850508 - DNA, 14 bp, Homo sapiens
aaaaataaacacta

SEQ ID NO: 4850509 - DNA, 22 bp, Homo sapiens
aaaaatataaaattatgagatt

SEQ ID NO: 4850510 - DNA, 19 bp, Homo sapiens
aaaaatgtccagccacccc

SEQ ID NO: 4850511 - DNA, 17 bp, Homo sapiens
aaaaattatatattgca

SEQ ID NO: 4850512 - DNA, 16 bp, Homo sapiens
aaaaattatgcaattc

SEQ ID NO: 4850513 - DNA, 11 bp, Homo sapiens
aaaaattgtta

SEQ ID NO: 4850514 - DNA, 19 bp, Homo sapiens
aaaacactcaacaaactta

SEQ ID NO: 4850515 - DNA, 15 bp, Homo sapiens
aaaacagataaacaa

SEQ ID NO: 4850516 - DNA, 19 bp, Homo sapiens
aaaacagtggatcacaaag

SEQ ID NO: 4850517 - DNA, 15 bp, Homo sapiens
aaaacgtgtaaatga

SEQ ID NO: 4850518 - DNA, 18 bp, Homo sapiens
aaaactcttaagtcctaa

SEQ ID NO: 4850519 - DNA, 22 bp, Homo sapiens
aaaagaaaatctttataaatgt

SEQ ID NO: 4850520 - DNA, 14 bp, Homo sapiens
aaaagaaatcaata

SEQ ID NO: 4850521 - DNA, 12 bp, Homo sapiens
aaaagataaaga

SEQ ID NO: 4850522 - DNA, 15 bp, Homo sapiens
aaaagcaatggttga

SEQ ID NO: 4850523 - DNA, 14 bp, Homo sapiens
aaaagccacagcag

SEQ ID NO: 4850524 - DNA, 14 bp, Homo sapiens
aaaaggtattatac

SEQ ID NO: 4850525 - DNA, 15 bp, Homo sapiens
aaaaggttgaataat

SEQ ID NO: 4850526 - DNA, 13 bp, Homo sapiens
aaaagtaaagatg

SEQ ID NO: 4850527 - DNA, 17 bp, Homo sapiens
aaaagtatattaaacaa

SEQ ID NO: 4850528 - DNA, 22 bp, Homo sapiens
aaaagtatattaaacaaagttt

SEQ ID NO: 4850529 - DNA, 19 bp, Homo sapiens
aaaagtgtggcttgggcat

SEQ ID NO: 4850530 - DNA, 19 bp, Homo sapiens
aaaagtgtgtatatatttt

SEQ ID NO: 4850531 - DNA, 15 bp, Homo sapiens
aaaataaacactaca

SEQ ID NO: 4850532 - DNA, 15 bp, Homo sapiens
aaaataactgaattt

SEQ ID NO: 4850533 - DNA, 18 bp, Homo sapiens
aaaataacttagactcta

SEQ ID NO: 4850534 - DNA, 12 bp, Homo sapiens
aaaatatatctt

SEQ ID NO: 4850535 - DNA, 11 bp, Homo sapiens
aaaatatttat

SEQ ID NO: 4850536 - DNA, 17 bp, Homo sapiens
aaaatcactttcataat

SEQ ID NO: 4850537 - DNA, 20 bp, Homo sapiens
aaaatcactttcataatctt

SEQ ID NO: 4850538 - DNA, 17 bp, Homo sapiens
aaaatcatgccagtatt

SEQ ID NO: 4850539 - DNA, 14 bp, Homo sapiens
aaaatgaaatgcat

SEQ ID NO: 4850540 - DNA, 16 bp, Homo sapiens
aaaatgatgttataca

SEQ ID NO: 4850541 - DNA, 16 bp, Homo sapiens
aaaatgccatgaatta

SEQ ID NO: 4850542 - DNA, 20 bp, Homo sapiens
aaaatgtccagccaccccca

SEQ ID NO: 4850543 - DNA, 20 bp, Homo sapiens
aaaattaagcaaatgttaaa

SEQ ID NO: 4850544 - DNA, 21 bp, Homo sapiens
aaaattatatattgcaaggtg

SEQ ID NO: 4850545 - DNA, 22 bp, Homo sapiens
aaaattttgtatgttaaagaga

SEQ ID NO: 4850546 - DNA, 15 bp, Homo sapiens
aaacaaaactcttaa

SEQ ID NO: 4850547 - DNA, 14 bp, Homo sapiens
aaacaaagccatgc

SEQ ID NO: 4850548 - DNA, 15 bp, Homo sapiens
aaacaaagtttcaga

SEQ ID NO: 4850549 - DNA, 19 bp, Homo sapiens
aaacaaagtttcagagtat

SEQ ID NO: 4850550 - DNA, 22 bp, Homo sapiens
aaacaaataatttgaactttgg

SEQ ID NO: 4850551 - DNA, 17 bp, Homo sapiens
aaacaacatttatatgt

SEQ ID NO: 4850552 - DNA, 16 bp, Homo sapiens
aaacaagccccctgcc

SEQ ID NO: 4850553 - DNA, 14 bp, Homo sapiens
aaacagaaatggaa

SEQ ID NO: 4850554 - DNA, 20 bp, Homo sapiens
aaacagaattttccatttat

SEQ ID NO: 4850555 - DNA, 15 bp, Homo sapiens
aaacatgggctgtga

SEQ ID NO: 4850556 - DNA, 17 bp, Homo sapiens
aaacatgggctgtgatt

SEQ ID NO: 4850557 - DNA, 20 bp, Homo sapiens
aaacatgttcccaaggcccc

SEQ ID NO: 4850558 - DNA, 14 bp, Homo sapiens
aaacatttatgaca

SEQ ID NO: 4850559 - DNA, 17 bp, Homo sapiens
aaaccagagtctgtatt

SEQ ID NO: 4850560 - DNA, 15 bp, Homo sapiens
aaaccatttttgaac

SEQ ID NO: 4850561 - DNA, 16 bp, Homo sapiens
aaaccccaagcttccc

SEQ ID NO: 4850562 - DNA, 14 bp, Homo sapiens
aacatgttctccat

SEQ ID NO: 4850563 - DNA, 18 bp, Homo sapiens
aacattaatgcctgcttt

SEQ ID NO: 4850564 - DNA, 12 bp, Homo sapiens
aacatttgctgc

SEQ ID NO: 4850565 - DNA, 16 bp, Homo sapiens
aacatttgctgccatt

SEQ ID NO: 4850566 - DNA, 13 bp, Homo sapiens
aacattttaagtt

SEQ ID NO: 4850567 - DNA, 21 bp, Homo sapiens
aacattttaagttttactgat

SEQ ID NO: 4850568 - DNA, 18 bp, Homo sapiens
aagcttcagttgcttgtc

SEQ ID NO: 4850569 - DNA, 16 bp, Homo sapiens
aagcttcatccacagc

SEQ ID NO: 4850570 - DNA, 17 bp, Homo sapiens
aagcttggttctgtgaa

SEQ ID NO: 4850571 - DNA, 21 bp, Homo sapiens
aagcttggttctgtgaacaag

SEQ ID NO: 4850572 - DNA, 14 bp, Homo sapiens
aagctttaaattat

SEQ ID NO: 4850573 - DNA, 18 bp, Homo sapiens
aagctttttggaatcttt

SEQ ID NO: 4850574 - DNA, 20 bp, Homo sapiens
aaggacccttttaagcatgt

SEQ ID NO: 4850575 - DNA, 17 bp, Homo sapiens
aaggacctgctcccaca

SEQ ID NO: 4850576 - DNA, 20 bp, Homo sapiens
aaggagaatggcatggcagg

SEQ ID NO: 4850577 - DNA, 18 bp, Homo sapiens
aaggagcatccttggcag

SEQ ID NO: 4850578 - DNA, 20 bp, Homo sapiens
aaggataaatcataaagtca

SEQ ID NO: 4850579 - DNA, 17 bp, Homo sapiens
aaggataccttcttatt

SEQ ID NO: 4850580 - DNA, 19 bp, Homo sapiens
aaggataccttcttattta

SEQ ID NO: 4850581 - DNA, 17 bp, Homo sapiens
aaggatccggaaagaag

SEQ ID NO: 4850582 - DNA, 13 bp, Homo sapiens
aaggcaaggctga

SEQ ID NO: 4850583 - DNA, 13 bp, Homo sapiens
aaggcagagaaat

SEQ ID NO: 4850584 - DNA, 15 bp, Homo sapiens
aaggcagagaaatct

SEQ ID NO: 4850585 - DNA, 14 bp, Homo sapiens
aaggcattctccca

SEQ ID NO: 4850586 - DNA, 23 bp, Homo sapiens
aaggccagagagggaaaaggcag

SEQ ID NO: 4850587 - DNA, 19 bp, Homo sapiens
aaggccagcagctgatgct

SEQ ID NO: 4850588 - DNA, 24 bp, Homo sapiens
aaggccagccttgtacagtctgct

SEQ ID NO: 4850589 - DNA, 20 bp, Homo sapiens
aaggctgataatatgacaaa

SEQ ID NO: 4850590 - DNA, 19 bp, Homo sapiens
aaggctgtgtttagattgt

SEQ ID NO: 4850591 - DNA, 20 bp, Homo sapiens
aaggctgtgtttagattgta

SEQ ID NO: 4850592 - DNA, 19 bp, Homo sapiens
aagggacagcaagtgagca

SEQ ID NO: 4850593 - DNA, 13 bp, Homo sapiens
aagggaccccaga

SEQ ID NO: 4850594 - DNA, 13 bp, Homo sapiens
aagggagaaaaaa

SEQ ID NO: 4850595 - DNA, 14 bp, Homo sapiens
aagggcataaagta

SEQ ID NO: 4850596 - DNA, 15 bp, Homo sapiens
aagggcataaagtaa

SEQ ID NO: 4850597 - DNA, 13 bp, Homo sapiens
aaggggtaaaagg

SEQ ID NO: 4850598 - DNA, 21 bp, Homo sapiens
aagggtgttgggagggtggtt

SEQ ID NO: 4850599 - DNA, 13 bp, Homo sapiens
aaggtagaatgtt

SEQ ID NO: 4850600 - DNA, 14 bp, Homo sapiens
aaggtcctctcagt

SEQ ID NO: 4850601 - DNA, 13 bp, Homo sapiens
aaggtgaggtgaa

SEQ ID NO: 4850602 - DNA, 19 bp, Homo sapiens
aaggtgaggtgaactccag

SEQ ID NO: 4850603 - DNA, 22 bp, Homo sapiens
aaggtgaggtgaactccaggca

SEQ ID NO: 4850604 - DNA, 19 bp, Homo sapiens
aaggtgataagggaaaaga

SEQ ID NO: 4850605 - DNA, 17 bp, Homo sapiens
aaggtggcctctgcctg

SEQ ID NO: 4850606 - DNA, 21 bp, Homo sapiens
aaggtggcctctgcctggggc

SEQ ID NO: 4850607 - DNA, 15 bp, Homo sapiens
aaggtggtggtggtg

SEQ ID NO: 4850608 - DNA, 14 bp, Homo sapiens
aagtaactgtgaga

SEQ ID NO: 4850609 - DNA, 20 bp, Homo sapiens
aagtaaggtgcttggagttt

SEQ ID NO: 4850610 - DNA, 14 bp, Homo sapiens
aagtaatttcagtg

SEQ ID NO: 4850611 - DNA, 13 bp, Homo sapiens
aagtacagaattt

SEQ ID NO: 4850612 - DNA, 16 bp, Homo sapiens
aagtacagaatttgaa

SEQ ID NO: 4850613 - DNA, 19 bp, Homo sapiens
aagtacagaatttgaatta

SEQ ID NO: 4850614 - DNA, 13 bp, Homo sapiens
aagtataatgttt

SEQ ID NO: 4850615 - DNA, 21 bp, Homo sapiens
aagtatgcattattaaattgt

SEQ ID NO: 4850616 - DNA, 21 bp, Homo sapiens
aagtcacacattacaaagtta

SEQ ID NO: 4850617 - DNA, 17 bp, Homo sapiens
aagtcactcccaagccc

SEQ ID NO: 4850618 - DNA, 19 bp, Homo sapiens
aagtcagaatttttaactg

SEQ ID NO: 4850619 - DNA, 16 bp, Homo sapiens
aagtcattggcaaagt

SEQ ID NO: 4850620 - DNA, 15 bp, Homo sapiens
aagtcctaaaagttc

SEQ ID NO: 4850621 - DNA, 13 bp, Homo sapiens
aagtctctgtgta

SEQ ID NO: 4850622 - DNA, 14 bp, Homo sapiens
aagtctctgtgtaa

SEQ ID NO: 4850623 - DNA, 17 bp, Homo sapiens
aagtctttgccttctct

SEQ ID NO: 4850624 - DNA, 22 bp, Homo sapiens
aagtgagcagagatgtactgca

SEQ ID NO: 4850625 - DNA, 15 bp, Homo sapiens
aagtgagcagtgttg

SEQ ID NO: 4850626 - DNA, 18 bp, Homo sapiens
aagtgcatgaaaaaccat

SEQ ID NO: 4850627 - DNA, 19 bp, Homo sapiens
aagtgcttattacatttta

SEQ ID NO: 4850628 - DNA, 20 bp, Homo sapiens
aagtggaacgaaaatgaaag

SEQ ID NO: 4850629 - DNA, 16 bp, Homo sapiens
aagtggaagtatgtat

SEQ ID NO: 4850630 - DNA, 15 bp, Homo sapiens
aagtggtgagcaagc

SEQ ID NO: 4850631 - DNA, 15 bp, Homo sapiens
aagtgtgtatatatt

SEQ ID NO: 4850632 - DNA, 22 bp, Homo sapiens
aagttagtggaaatctgaacat

SEQ ID NO: 4850633 - DNA, 21 bp, Homo sapiens
aagttcatgtccaaacgtcct

SEQ ID NO: 4850634 - DNA, 20 bp, Homo sapiens
aagttcattgcaattaaact

SEQ ID NO: 4850635 - DNA, 13 bp, Homo sapiens
aagttggaaggga

SEQ ID NO: 4850636 - DNA, 20 bp, Homo sapiens
aagtttcaagttttaaagtt

SEQ ID NO: 4850637 - DNA, 16 bp, Homo sapiens
aagtttcagagtatat

SEQ ID NO: 4850638 - DNA, 18 bp, Homo sapiens
aagtttcagagtatattg

SEQ ID NO: 4850639 - DNA, 13 bp, Homo sapiens
aagtttctcttct

SEQ ID NO: 4850640 - DNA, 13 bp, Homo sapiens
aagtttgctgtgc

SEQ ID NO: 4850641 - DNA, 15 bp, Homo sapiens
aagtttgctgtgctt

SEQ ID NO: 4850642 - DNA, 15 bp, Homo sapiens
aagtttggttttgac

SEQ ID NO: 4850643 - DNA, 16 bp, Homo sapiens
aataaaagtggtaatt

SEQ ID NO: 4850644 - DNA, 13 bp, Homo sapiens
aataaaatttaaa

SEQ ID NO: 4850645 - DNA, 12 bp, Homo sapiens
aataaagtactt

SEQ ID NO: 4850646 - DNA, 15 bp, Homo sapiens
aataaagtataatgt

SEQ ID NO: 4850647 - DNA, 11 bp, Homo sapiens
aataaagtgat

SEQ ID NO: 4850648 - DNA, 22 bp, Homo sapiens
aataaattttttataaaagtgt

SEQ ID NO: 4850649 - DNA, 14 bp, Homo sapiens
aataacatgtttct

SEQ ID NO: 4850650 - DNA, 16 bp, Homo sapiens
aataaccgcttggttt

SEQ ID NO: 4850651 - DNA, 20 bp, Homo sapiens
aataaccgcttggtttgcaa

SEQ ID NO: 4850652 - DNA, 23 bp, Homo sapiens
aataacttagactctagtattta

SEQ ID NO: 4850653 - DNA, 15 bp, Homo sapiens
aataatgtaacatga

SEQ ID NO: 4850654 - DNA, 19 bp, Homo sapiens
aataattattcatctaatg

SEQ ID NO: 4850655 - DNA, 14 bp, Homo sapiens
aataatttccttca

SEQ ID NO: 4850656 - DNA, 14 bp, Homo sapiens
aataatttctcttg

SEQ ID NO: 4850657 - DNA, 16 bp, Homo sapiens
aataatttgaactttg

SEQ ID NO: 4850658 - DNA, 18 bp, Homo sapiens
aataattttcattttgca

SEQ ID NO: 4850659 - DNA, 15 bp, Homo sapiens
aatacagaatcttgt

SEQ ID NO: 4850660 - DNA, 15 bp, Homo sapiens
aatacatgcatataa

SEQ ID NO: 4850661 - DNA, 19 bp, Homo sapiens
aataccacatcaaataaga

SEQ ID NO: 4850662 - DNA, 21 bp, Homo sapiens
aataccttcaaggctcttctt

SEQ ID NO: 4850663 - DNA, 17 bp, Homo sapiens
aatactactactgttat

SEQ ID NO: 4850664 - DNA, 16 bp, Homo sapiens
aatactgccaaaacat

SEQ ID NO: 4850665 - DNA, 12 bp, Homo sapiens
aatacttccaga

SEQ ID NO: 4850666 - DNA, 13 bp, Homo sapiens
aatagaaggtgat

SEQ ID NO: 4850667 - DNA, 17 bp, Homo sapiens
aatagacaaaaagtata

SEQ ID NO: 4850668 - DNA, 18 bp, Homo sapiens
aatagacaaaaagtatat

SEQ ID NO: 4850669 - DNA, 21 bp, Homo sapiens
aatagactgtaacttccaaat

SEQ ID NO: 4850670 - DNA, 16 bp, Homo sapiens
aatagacttaaatctc

SEQ ID NO: 4850671 - DNA, 21 bp, Homo sapiens
aatagatttgggtcatttaga

SEQ ID NO: 4850672 - DNA, 19 bp, Homo sapiens
aatagctttagtgaattaa

SEQ ID NO: 4850673 - DNA, 19 bp, Homo sapiens
aataggaatcattcagaaa

SEQ ID NO: 4850674 - DNA, 20 bp, Homo sapiens
aataggaatcattcagaaat

SEQ ID NO: 4850675 - DNA, 20 bp, Homo sapiens
aataggctattaaaaaagtc

SEQ ID NO: 4850676 - DNA, 17 bp, Homo sapiens
aattattgatgttttca

SEQ ID NO: 4850677 - DNA, 22 bp, Homo sapiens
aattatttcatgattagaaatt

SEQ ID NO: 4850678 - DNA, 19 bp, Homo sapiens
aattcaaagcatggacatt

SEQ ID NO: 4850679 - DNA, 14 bp, Homo sapiens
aattcaactttgta

SEQ ID NO: 4850680 - DNA, 13 bp, Homo sapiens
aattcaccttccc

SEQ ID NO: 4850681 - DNA, 14 bp, Homo sapiens
aattcagttttttt

SEQ ID NO: 4850682 - DNA, 15 bp, Homo sapiens
aattccagatttgtt

SEQ ID NO: 4850683 - DNA, 11 bp, Homo sapiens
aattcttaaaa

SEQ ID NO: 4850684 - DNA, 21 bp, Homo sapiens
aattgactcttatttatagaa

SEQ ID NO: 4850685 - DNA, 18 bp, Homo sapiens
aattgaggggaggtggcc

SEQ ID NO: 4850686 - DNA, 19 bp, Homo sapiens
aattgtgtggattctttaa

SEQ ID NO: 4850687 - DNA, 17 bp, Homo sapiens
aatttaaaaatatattt

SEQ ID NO: 4850688 - DNA, 12 bp, Homo sapiens
aatttaaatgaa

SEQ ID NO: 4850689 - DNA, 22 bp, Homo sapiens
aatttaaatgaaagaaaattga

SEQ ID NO: 4850690 - DNA, 20 bp, Homo sapiens
aatttaataccagatacctt

SEQ ID NO: 4850691 - DNA, 16 bp, Homo sapiens
aatttacttgttttgg

SEQ ID NO: 4850692 - DNA, 23 bp, Homo sapiens
aatttatattttagaaataataa

SEQ ID NO: 4850693 - DNA, 17 bp, Homo sapiens
acttcaaagtgcctggg

SEQ ID NO: 4850694 - DNA, 18 bp, Homo sapiens
acttcaaagtgcctgggc

SEQ ID NO: 4850695 - DNA, 18 bp, Homo sapiens
acttcagcattgtaatta

SEQ ID NO: 4850696 - DNA, 23 bp, Homo sapiens
acttcagtgtcccaccttgacca

SEQ ID NO: 4850697 - DNA, 23 bp, Homo sapiens
acttcatgtaattttattttaaa

SEQ ID NO: 4850698 - DNA, 15 bp, Homo sapiens
acttccaaagaaagt

SEQ ID NO: 4850699 - DNA, 20 bp, Homo sapiens
acttcctgtggatgcaaata

SEQ ID NO: 4850700 - DNA, 15 bp, Homo sapiens
acttccttactttta

SEQ ID NO: 4850701 - DNA, 13 bp, Homo sapiens
acttctcccctgc

SEQ ID NO: 4850702 - DNA, 20 bp, Homo sapiens
acttctgaagagaccactca

SEQ ID NO: 4850703 - DNA, 18 bp, Homo sapiens
acttctgcaacaagcatg

SEQ ID NO: 4850704 - DNA, 21 bp, Homo sapiens
acttcttgaatataaaaaatc

SEQ ID NO: 4850705 - DNA, 20 bp, Homo sapiens
acttgaaatacgtttgtgtt

SEQ ID NO: 4850706 - DNA, 24 bp, Homo sapiens
acttgaatgctagttatacttatt

SEQ ID NO: 4850707 - DNA, 21 bp, Homo sapiens
acttgccattccaaaatatta

SEQ ID NO: 4850708 - DNA, 13 bp, Homo sapiens
acttgctcccaac

SEQ ID NO: 4850709 - DNA, 22 bp, Homo sapiens
acttgggcttcaacagccaagc

SEQ ID NO: 4850710 - DNA, 12 bp, Homo sapiens
acttggggaagg

SEQ ID NO: 4850711 - DNA, 18 bp, Homo sapiens
acttggggaaggggcctg

SEQ ID NO: 4850712 - DNA, 14 bp, Homo sapiens
acttggggaggcaa

SEQ ID NO: 4850713 - DNA, 12 bp, Homo sapiens
acttgtggcctt

SEQ ID NO: 4850714 - DNA, 22 bp, Homo sapiens
acttgtgtccctaatgtgttta

SEQ ID NO: 4850715 - DNA, 18 bp, Homo sapiens
acttgttttggatggctt

SEQ ID NO: 4850716 - DNA, 13 bp, Homo sapiens
actttaaattgtg

SEQ ID NO: 4850717 - DNA, 13 bp, Homo sapiens
actttattgcaat

SEQ ID NO: 4850718 - DNA, 15 bp, Homo sapiens
actttattgcaatgc

SEQ ID NO: 4850719 - DNA, 18 bp, Homo sapiens
actttattgcaatgcaga

SEQ ID NO: 4850720 - DNA, 19 bp, Homo sapiens
actttcaagaatcagacag

SEQ ID NO: 4850721 - DNA, 20 bp, Homo sapiens
actttccagaatgaccttga

SEQ ID NO: 4850722 - DNA, 12 bp, Homo sapiens
actttctatttt

SEQ ID NO: 4850723 - DNA, 18 bp, Homo sapiens
actttctgttatgggctt

SEQ ID NO: 4850724 - DNA, 20 bp, Homo sapiens
actttgacctaaattattta

SEQ ID NO: 4850725 - DNA, 18 bp, Homo sapiens
actttgatactaccaggg

SEQ ID NO: 4850726 - DNA, 17 bp, Homo sapiens
actttgtaaaaatcttt

SEQ ID NO: 4850727 - DNA, 21 bp, Homo sapiens
actttgtaaaaatcttttgaa

SEQ ID NO: 4850728 - DNA, 22 bp, Homo sapiens
actttgtcagtgttgcctcttg

SEQ ID NO: 4850729 - DNA, 20 bp, Homo sapiens
acttttaaggataaatcata

SEQ ID NO: 4850730 - DNA, 20 bp, Homo sapiens
acttttccttttcttaaaac

SEQ ID NO: 4850731 - DNA, 22 bp, Homo sapiens
actttttaaagaagtgcatgaa

SEQ ID NO: 4850732 - DNA, 19 bp, Homo sapiens
agaaaaaaagctgcaaaaa

SEQ ID NO: 4850733 - DNA, 14 bp, Homo sapiens
agaaaaactaactt

SEQ ID NO: 4850734 - DNA, 12 bp, Homo sapiens
agaaaacaaaaa

SEQ ID NO: 4850735 - DNA, 21 bp, Homo sapiens
agaaaacaaaaaacgaatgaa

SEQ ID NO: 4850736 - DNA, 15 bp, Homo sapiens
agaaaacatgcctct

SEQ ID NO: 4850737 - DNA, 15 bp, Homo sapiens
agaaaattccctggg

SEQ ID NO: 4850738 - DNA, 18 bp, Homo sapiens
agaaaattccctggggtc

SEQ ID NO: 4850739 - DNA, 15 bp, Homo sapiens
agaaacaaacaaaac

SEQ ID NO: 4850740 - DNA, 15 bp, Homo sapiens
agaaaccaacaagaa

SEQ ID NO: 4850741 - DNA, 14 bp, Homo sapiens
agaaacccagagat

SEQ ID NO: 4850742 - DNA, 21 bp, Homo sapiens
agaaaccctcattgtgtttct

SEQ ID NO: 4850743 - DNA, 19 bp, Homo sapiens
agaaacctgccaaggagca

SEQ ID NO: 4850744 - DNA, 13 bp, Homo sapiens
agaaactgaggcc

SEQ ID NO: 4850745 - DNA, 17 bp, Homo sapiens
agaaactgaggcccaga

SEQ ID NO: 4850746 - DNA, 21 bp, Homo sapiens
agaaagcctgggtgacatttg

SEQ ID NO: 4850747 - DNA, 15 bp, Homo sapiens
agaaagcttcatcca

SEQ ID NO: 4850748 - DNA, 21 bp, Homo sapiens
agaaagcttcatccacagcct

SEQ ID NO: 4850749 - DNA, 13 bp, Homo sapiens
agaaagcttcctt

SEQ ID NO: 4850750 - DNA, 13 bp, Homo sapiens
agaaagggcaagg

SEQ ID NO: 4850751 - DNA, 16 bp, Homo sapiens
agaaaggtgtgaggag

SEQ ID NO: 4850752 - DNA, 21 bp, Homo sapiens
agaaaggtgtgaggagagagg

SEQ ID NO: 4850753 - DNA, 22 bp, Homo sapiens
agaaagtgggcttaatggagtt

SEQ ID NO: 4850754 - DNA, 14 bp, Homo sapiens
agaaataaaccaaa

SEQ ID NO: 4850755 - DNA, 20 bp, Homo sapiens
agaaataatgctacaatttt

SEQ ID NO: 4850756 - DNA, 15 bp, Homo sapiens
agaaatactcatgtg

SEQ ID NO: 4850757 - DNA, 22 bp, Homo sapiens
agaaatagacaaaaagtatatt

SEQ ID NO: 4850758 - DNA, 18 bp, Homo sapiens
agaaatataacacatttt

SEQ ID NO: 4850759 - DNA, 15 bp, Homo sapiens
agaaatatagtgcaa

SEQ ID NO: 4850760 - DNA, 18 bp, Homo sapiens
agaaatatagtgcaatag

SEQ ID NO: 4850761 - DNA, 19 bp, Homo sapiens
agaaatcaatagttgaatt

SEQ ID NO: 4850762 - DNA, 15 bp, Homo sapiens
agaaatctaagctgt

SEQ ID NO: 4850763 - DNA, 18 bp, Homo sapiens
agaaatgccagtggtgga

SEQ ID NO: 4850764 - DNA, 14 bp, Homo sapiens
agaaatgccccagt

SEQ ID NO: 4850765 - DNA, 17 bp, Homo sapiens
agaaatgccccagtgtt

SEQ ID NO: 4850766 - DNA, 18 bp, Homo sapiens
agaaattacctgtggata

SEQ ID NO: 4850767 - DNA, 20 bp, Homo sapiens
agaacaaaggggcttaatta

SEQ ID NO: 4850768 - DNA, 20 bp, Homo sapiens
agaacaaagtaaaagtagtg

SEQ ID NO: 4850769 - DNA, 17 bp, Homo sapiens
agaaccaataaaagtgg

SEQ ID NO: 4850770 - DNA, 18 bp, Homo sapiens
agaaccactccttcatgt

SEQ ID NO: 4850771 - DNA, 13 bp, Homo sapiens
agaaccttctttg

SEQ ID NO: 4850772 - DNA, 19 bp, Homo sapiens
agaacgtggctctgctggc

SEQ ID NO: 4850773 - DNA, 17 bp, Homo sapiens
agaactaaaatgttcta

SEQ ID NO: 4850774 - DNA, 21 bp, Homo sapiens
agaactattgtgctcagagac

SEQ ID NO: 4850775 - DNA, 19 bp, Homo sapiens
agaactcctgtcttctttc

SEQ ID NO: 4850776 - DNA, 21 bp, Homo sapiens
agaactcctgtcttctttctc

SEQ ID NO: 4850777 - DNA, 12 bp, Homo sapiens
agaactcttcct

SEQ ID NO: 4850778 - DNA, 14 bp, Homo sapiens
agaactcttcctcc

SEQ ID NO: 4850779 - DNA, 15 bp, Homo sapiens
agaactcttcctcct

SEQ ID NO: 4850780 - DNA, 20 bp, Homo sapiens
agaactcttcctcctcccaa

SEQ ID NO: 4850781 - DNA, 13 bp, Homo sapiens
agaagaaaatttg

SEQ ID NO: 4850782 - DNA, 14 bp, Homo sapiens
agaagaaggccaga

SEQ ID NO: 4850783 - DNA, 14 bp, Homo sapiens
agaagaatcttcct

SEQ ID NO: 4850784 - DNA, 19 bp, Homo sapiens
agaagaatcttcctggcac

SEQ ID NO: 4850785 - DNA, 14 bp, Homo sapiens
agatatctgcatgt

SEQ ID NO: 4850786 - DNA, 19 bp, Homo sapiens
agatcaaatagttgcatag

SEQ ID NO: 4850787 - DNA, 17 bp, Homo sapiens
agatccagcccaaacct

SEQ ID NO: 4850788 - DNA, 23 bp, Homo sapiens
agatccagcccaaacctgggaag

SEQ ID NO: 4850789 - DNA, 14 bp, Homo sapiens
agatcctaagatgt

SEQ ID NO: 4850790 - DNA, 23 bp, Homo sapiens
agatctgttttgtggtttggaat

SEQ ID NO: 4850791 - DNA, 16 bp, Homo sapiens
agatctttcagaaata

SEQ ID NO: 4850792 - DNA, 19 bp, Homo sapiens
agatctttcagaaatataa

SEQ ID NO: 4850793 - DNA, 11 bp, Homo sapiens
agatgaatgtc

SEQ ID NO: 4850794 - DNA, 15 bp, Homo sapiens
agatgaatgtcagtt

SEQ ID NO: 4850795 - DNA, 17 bp, Homo sapiens
agatgaatgtcctgaaa

SEQ ID NO: 4850796 - DNA, 23 bp, Homo sapiens
agatgacagaggtttgaaggaga

SEQ ID NO: 4850797 - DNA, 20 bp, Homo sapiens
agatgaggagtaaaattcag

SEQ ID NO: 4850798 - DNA, 17 bp, Homo sapiens
agatgaggctcagagag

SEQ ID NO: 4850799 - DNA, 23 bp, Homo sapiens
agatgaggctcagagaggtagca

SEQ ID NO: 4850800 - DNA, 13 bp, Homo sapiens
agatgagggctgg

SEQ ID NO: 4850801 - DNA, 17 bp, Homo sapiens
agatgatgctttggaag

SEQ ID NO: 4850802 - DNA, 19 bp, Homo sapiens
agatgcatcatctcttcct

SEQ ID NO: 4850803 - DNA, 21 bp, Homo sapiens
agatgcatcatctcttcctca

SEQ ID NO: 4850804 - DNA, 17 bp, Homo sapiens
agatgcctgatttcatt

SEQ ID NO: 4850805 - DNA, 14 bp, Homo sapiens
agatgctggctggg

SEQ ID NO: 4850806 - DNA, 13 bp, Homo sapiens
agatggagcccat

SEQ ID NO: 4850807 - DNA, 17 bp, Homo sapiens
agatggcgatgtgttat

SEQ ID NO: 4850808 - DNA, 22 bp, Homo sapiens
agatggggaataatttccttca

SEQ ID NO: 4850809 - DNA, 15 bp, Homo sapiens
agatggttaaacatt

SEQ ID NO: 4850810 - DNA, 14 bp, Homo sapiens
agatgtaggaaccg

SEQ ID NO: 4850811 - DNA, 16 bp, Homo sapiens
agatgtgcagtttgga

SEQ ID NO: 4850812 - DNA, 16 bp, Homo sapiens
agatgtgttcttattt

SEQ ID NO: 4850813 - DNA, 14 bp, Homo sapiens
agatgtttgcctca

SEQ ID NO: 4850814 - DNA, 15 bp, Homo sapiens
agattcagagaaatt

SEQ ID NO: 4850815 - DNA, 21 bp, Homo sapiens
agattctatgttaatatttta

SEQ ID NO: 4850816 - DNA, 21 bp, Homo sapiens
agattctttcagttctttgga

SEQ ID NO: 4850817 - DNA, 13 bp, Homo sapiens
agattgagaaatg

SEQ ID NO: 4850818 - DNA, 14 bp, Homo sapiens
agattgagaaatgt

SEQ ID NO: 4850819 - DNA, 18 bp, Homo sapiens
agatttctcattgacttt

SEQ ID NO: 4850820 - DNA, 19 bp, Homo sapiens
agcaaaaagactggatttg

SEQ ID NO: 4850821 - DNA, 19 bp, Homo sapiens
agcaaaggtgcactccaga

SEQ ID NO: 4850822 - DNA, 21 bp, Homo sapiens
agcaaaggtgcactccagact

SEQ ID NO: 4850823 - DNA, 17 bp, Homo sapiens
agcaaccacactgcttg

SEQ ID NO: 4850824 - DNA, 21 bp, Homo sapiens
agcaacccttcctgctgctgc

SEQ ID NO: 4850825 - DNA, 22 bp, Homo sapiens
agcaagaggcaagctgaaattt

SEQ ID NO: 4850826 - DNA, 20 bp, Homo sapiens
agcaagcaccaacctccaga

SEQ ID NO: 4850827 - DNA, 22 bp, Homo sapiens
agcaagcaccaacctccagact

SEQ ID NO: 4850828 - DNA, 19 bp, Homo sapiens
agcaataggtagctgggga

SEQ ID NO: 4850829 - DNA, 18 bp, Homo sapiens
agcaatttactgatgaga

SEQ ID NO: 4850830 - DNA, 21 bp, Homo sapiens
agcaatttactgatgagagaa

SEQ ID NO: 4850831 - DNA, 23 bp, Homo sapiens
agcaatttactgatgagagaatg

SEQ ID NO: 4850832 - DNA, 12 bp, Homo sapiens
agcacaaaattc

SEQ ID NO: 4850833 - DNA, 15 bp, Homo sapiens
agcacaaaattcaaa

SEQ ID NO: 4850834 - DNA, 15 bp, Homo sapiens
agcacaaagcactgg

SEQ ID NO: 4850835 - DNA, 17 bp, Homo sapiens
agcaccaacctccagac

SEQ ID NO: 4850836 - DNA, 17 bp, Homo sapiens
agcaccagggctcacgt

SEQ ID NO: 4850837 - DNA, 11 bp, Homo sapiens
agcactctcag

SEQ ID NO: 4850838 - DNA, 12 bp, Homo sapiens
agcactctcaga

SEQ ID NO: 4850839 - DNA, 19 bp, Homo sapiens
agcagagaagtacaggtca

SEQ ID NO: 4850840 - DNA, 15 bp, Homo sapiens
agcagagatgtactg

SEQ ID NO: 4850841 - DNA, 21 bp, Homo sapiens
agcagagctctcccctcctgc

SEQ ID NO: 4850842 - DNA, 16 bp, Homo sapiens
agcagagtctgtctct

SEQ ID NO: 4850843 - DNA, 11 bp, Homo sapiens
agcagcaggcc

SEQ ID NO: 4850844 - DNA, 14 bp, Homo sapiens
agcagcaggcctct

SEQ ID NO: 4850845 - DNA, 18 bp, Homo sapiens
agcagcaggcctctggga

SEQ ID NO: 4850846 - DNA, 19 bp, Homo sapiens
agcagcaggcctctgggac

SEQ ID NO: 4850847 - DNA, 23 bp, Homo sapiens
agcagcaggcctctgggacccac

SEQ ID NO: 4850848 - DNA, 22 bp, Homo sapiens
agcagcggattgctctggagca

SEQ ID NO: 4850849 - DNA, 14 bp, Homo sapiens
agcagctgatgctg

SEQ ID NO: 4850850 - DNA, 16 bp, Homo sapiens
agcagctgatgctgta

SEQ ID NO: 4850851 - DNA, 15 bp, Homo sapiens
agcaggactgtggga

SEQ ID NO: 4850852 - DNA, 16 bp, Homo sapiens
agcaggccagagaaag

SEQ ID NO: 4850853 - DNA, 16 bp, Homo sapiens
agcaggcccaatgctg

SEQ ID NO: 4850854 - DNA, 21 bp, Homo sapiens
agcaggcccaatgctgctttt

SEQ ID NO: 4850855 - DNA, 15 bp, Homo sapiens
agcaggcctctggga

SEQ ID NO: 4850856 - DNA, 14 bp, Homo sapiens
agcagtatatgtta

SEQ ID NO: 4850857 - DNA, 15 bp, Homo sapiens
agcagtatatgttaa

SEQ ID NO: 4850858 - DNA, 20 bp, Homo sapiens
agcagtatatgttaatttgt

SEQ ID NO: 4850859 - DNA, 20 bp, Homo sapiens
agcagtcgcccaagcagaca

SEQ ID NO: 4850860 - DNA, 17 bp, Homo sapiens
agcagtgttacttgcag

SEQ ID NO: 4850861 - DNA, 23 bp, Homo sapiens
agcataaagctcaaatgaaatgt

SEQ ID NO: 4850862 - DNA, 16 bp, Homo sapiens
agcataatttaaaaat

SEQ ID NO: 4850863 - DNA, 18 bp, Homo sapiens
agcataatttaaaaatat

SEQ ID NO: 4850864 - DNA, 20 bp, Homo sapiens
agcataatttaaaaatatat

SEQ ID NO: 4850865 - DNA, 22 bp, Homo sapiens
agcataatttaaaaatatattt

SEQ ID NO: 4850866 - DNA, 15 bp, Homo sapiens
agcatagataatatt

SEQ ID NO: 4850867 - DNA, 11 bp, Homo sapiens
agcatcctgat

SEQ ID NO: 4850868 - DNA, 19 bp, Homo sapiens
agcatcgcttaggagaagt

SEQ ID NO: 4850869 - DNA, 19 bp, Homo sapiens
agcatgaaataaaatatat

SEQ ID NO: 4850870 - DNA, 14 bp, Homo sapiens
agcatggacattta

SEQ ID NO: 4850871 - DNA, 18 bp, Homo sapiens
agcatggacatttagaag

SEQ ID NO: 4850872 - DNA, 13 bp, Homo sapiens
agcatggggccag

SEQ ID NO: 4850873 - DNA, 16 bp, Homo sapiens
agcatgtgtcccagga

SEQ ID NO: 4850874 - DNA, 19 bp, Homo sapiens
agcattctttggagttaaa

SEQ ID NO: 4850875 - DNA, 24 bp, Homo sapiens
agcattctttggagttaaaatgca

SEQ ID NO: 4850876 - DNA, 12 bp, Homo sapiens
agcattgcagcc

SEQ ID NO: 4850877 - DNA, 20 bp, Homo sapiens
agcattgtcaccgcaggtgc

SEQ ID NO: 4850878 - DNA, 15 bp, Homo sapiens
agcattgtgtggaat

SEQ ID NO: 4850879 - DNA, 15 bp, Homo sapiens
agccaaatttctttt

SEQ ID NO: 4850880 - DNA, 15 bp, Homo sapiens
agccaagctggcaca

SEQ ID NO: 4850881 - DNA, 22 bp, Homo sapiens
agccaagctttaaattatgtga

SEQ ID NO: 4850882 - DNA, 14 bp, Homo sapiens
agccacagcagagc

SEQ ID NO: 4850883 - DNA, 14 bp, Homo sapiens
agccacccccaggc

SEQ ID NO: 4850884 - DNA, 22 bp, Homo sapiens
agccacccccaggcatctgtta

SEQ ID NO: 4850885 - DNA, 21 bp, Homo sapiens
agccagattggccaattaaaa

SEQ ID NO: 4850886 - DNA, 20 bp, Homo sapiens
agccagccaagctttaaatt

SEQ ID NO: 4850887 - DNA, 13 bp, Homo sapiens
agccagcctgctt

SEQ ID NO: 4850888 - DNA, 18 bp, Homo sapiens
agccagcctgcttcccac

SEQ ID NO: 4850889 - DNA, 12 bp, Homo sapiens
agccagctgctt

SEQ ID NO: 4850890 - DNA, 14 bp, Homo sapiens
agccagctgcttga

SEQ ID NO: 4850891 - DNA, 14 bp, Homo sapiens
agccaggactccca

SEQ ID NO: 4850892 - DNA, 15 bp, Homo sapiens
agccaggactcccag

SEQ ID NO: 4850893 - DNA, 19 bp, Homo sapiens
agccaggactcccagaacc

SEQ ID NO: 4850894 - DNA, 23 bp, Homo sapiens
agccaggactcccagaacctcta

SEQ ID NO: 4850895 - DNA, 16 bp, Homo sapiens
agccaggctcaggaga

SEQ ID NO: 4850896 - DNA, 15 bp, Homo sapiens
agccaggtctgactc

SEQ ID NO: 4850897 - DNA, 14 bp, Homo sapiens
agccagtgtctagg

SEQ ID NO: 4850898 - DNA, 20 bp, Homo sapiens
agccagtgtctaggcactga

SEQ ID NO: 4850899 - DNA, 16 bp, Homo sapiens
agccatacataaaaga

SEQ ID NO: 4850900 - DNA, 22 bp, Homo sapiens
agccatacataaaagaaataaa

SEQ ID NO: 4850901 - DNA, 23 bp, Homo sapiens
agccatacataaaagaaataaac

SEQ ID NO: 4850902 - DNA, 14 bp, Homo sapiens
agcccaaacctggg

SEQ ID NO: 4850903 - DNA, 22 bp, Homo sapiens
agcccaaacctgggaaggccag

SEQ ID NO: 4850904 - DNA, 17 bp, Homo sapiens
agcccaacctacattcc

SEQ ID NO: 4850905 - DNA, 19 bp, Homo sapiens
aggtccaaattcaccttcc

SEQ ID NO: 4850906 - DNA, 14 bp, Homo sapiens
aggtctagagagaa

SEQ ID NO: 4850907 - DNA, 15 bp, Homo sapiens
aggtctagagagaac

SEQ ID NO: 4850908 - DNA, 15 bp, Homo sapiens
aggtctcctcagggt

SEQ ID NO: 4850909 - DNA, 20 bp, Homo sapiens
aggtctcctcagggtggggg

SEQ ID NO: 4850910 - DNA, 15 bp, Homo sapiens
aggtctgactccaaa

SEQ ID NO: 4850911 - DNA, 16 bp, Homo sapiens
aggtctgactccaaag

SEQ ID NO: 4850912 - DNA, 13 bp, Homo sapiens
aggtgaactccag

SEQ ID NO: 4850913 - DNA, 15 bp, Homo sapiens
aggtgaactccaggc

SEQ ID NO: 4850914 - DNA, 17 bp, Homo sapiens
aggtgaactccaggcat

SEQ ID NO: 4850915 - DNA, 18 bp, Homo sapiens
aggtgaactccaggcatg

SEQ ID NO: 4850916 - DNA, 19 bp, Homo sapiens
aggtgaactccaggcatgt

SEQ ID NO: 4850917 - DNA, 23 bp, Homo sapiens
aggtgaactccaggcatgtgtct

SEQ ID NO: 4850918 - DNA, 21 bp, Homo sapiens
aggtgcaacagacttgaatgc

SEQ ID NO: 4850919 - DNA, 14 bp, Homo sapiens
aggtgcactccaga

SEQ ID NO: 4850920 - DNA, 19 bp, Homo sapiens
aggtgcactccagactctg

SEQ ID NO: 4850921 - DNA, 21 bp, Homo sapiens
aggtgcctaacctgggacctg

SEQ ID NO: 4850922 - DNA, 23 bp, Homo sapiens
aggtgctaatttgttttggatat

SEQ ID NO: 4850923 - DNA, 15 bp, Homo sapiens
aggtgctcatgctgc

SEQ ID NO: 4850924 - DNA, 17 bp, Homo sapiens
aggtgctcatgctgctc

SEQ ID NO: 4850925 - DNA, 18 bp, Homo sapiens
aggtgctcatgctgctcc

SEQ ID NO: 4850926 - DNA, 19 bp, Homo sapiens
aggtgcttttggcagagac

SEQ ID NO: 4850927 - DNA, 20 bp, Homo sapiens
aggtgcttttggcagagacc

SEQ ID NO: 4850928 - DNA, 22 bp, Homo sapiens
aggtggatactggggggcaggc

SEQ ID NO: 4850929 - DNA, 17 bp, Homo sapiens
aggtggcctctgcctgg

SEQ ID NO: 4850930 - DNA, 18 bp, Homo sapiens
aggtggcctctgcctggg

SEQ ID NO: 4850931 - DNA, 16 bp, Homo sapiens
aggtgggatcctccct

SEQ ID NO: 4850932 - DNA, 17 bp, Homo sapiens
aggtggggtgctggggc

SEQ ID NO: 4850933 - DNA, 20 bp, Homo sapiens
aggtggggtgctggggctgc

SEQ ID NO: 4850934 - DNA, 12 bp, Homo sapiens
aggtgtgaggag

SEQ ID NO: 4850935 - DNA, 16 bp, Homo sapiens
aggtgtgatggtctgg

SEQ ID NO: 4850936 - DNA, 18 bp, Homo sapiens
aggtgtttgtggggctgg

SEQ ID NO: 4850937 - DNA, 18 bp, Homo sapiens
aggttaaaaaaaaaagtc

SEQ ID NO: 4850938 - DNA, 21 bp, Homo sapiens
aggttattgcaataaagtata

SEQ ID NO: 4850939 - DNA, 15 bp, Homo sapiens
aggttccccaatcca

SEQ ID NO: 4850940 - DNA, 14 bp, Homo sapiens
aggttgactaagaa

SEQ ID NO: 4850941 - DNA, 18 bp, Homo sapiens
aggttgtggggcctcagg

SEQ ID NO: 4850942 - DNA, 17 bp, Homo sapiens
aggtttgaaggagaatg

SEQ ID NO: 4850943 - DNA, 18 bp, Homo sapiens
aggtttgaaggagaatgg

SEQ ID NO: 4850944 - DNA, 17 bp, Homo sapiens
aggtttgttttgtgaat

SEQ ID NO: 4850945 - DNA, 18 bp, Homo sapiens
agtaaaattcagtttttt

SEQ ID NO: 4850946 - DNA, 19 bp, Homo sapiens
agtaacccccttaaattta

SEQ ID NO: 4850947 - DNA, 13 bp, Homo sapiens
agtaagcagtgtt

SEQ ID NO: 4850948 - DNA, 17 bp, Homo sapiens
agtaagtgcgaagactg

SEQ ID NO: 4850949 - DNA, 21 bp, Homo sapiens
agtaagtgcgaagactgagcc

SEQ ID NO: 4850950 - DNA, 22 bp, Homo sapiens
agtaatcagattactgctttaa

SEQ ID NO: 4850951 - DNA, 21 bp, Homo sapiens
agtaatgctaaatgtgtaata

SEQ ID NO: 4850952 - DNA, 13 bp, Homo sapiens
agtaatttcagtg

SEQ ID NO: 4850953 - DNA, 14 bp, Homo sapiens
agtaatttcagtgt

SEQ ID NO: 4850954 - DNA, 22 bp, Homo sapiens
agtaatttcagtgtaaagtgtg

SEQ ID NO: 4850955 - DNA, 16 bp, Homo sapiens
agtacagaatttgaat

SEQ ID NO: 4850956 - DNA, 20 bp, Homo sapiens
agtacagggcagaaccaaga

SEQ ID NO: 4850957 - DNA, 15 bp, Homo sapiens
agtacatttaaattt

SEQ ID NO: 4850958 - DNA, 21 bp, Homo sapiens
agtacatttaaattttttggc

SEQ ID NO: 4850959 - DNA, 16 bp, Homo sapiens
agtacgaacctacagt

SEQ ID NO: 4850960 - DNA, 18 bp, Homo sapiens
agtacgaacctacagttt

SEQ ID NO: 4850961 - DNA, 23 bp, Homo sapiens
agtagctgcagccttcatcagaa

SEQ ID NO: 4850962 - DNA, 13 bp, Homo sapiens
agtaggtgatgag

SEQ ID NO: 4850963 - DNA, 14 bp, Homo sapiens
agtaggtgatgagt

SEQ ID NO: 4850964 - DNA, 19 bp, Homo sapiens
agtatgcattattaaattg

SEQ ID NO: 4850965 - DNA, 18 bp, Homo sapiens
agtatgtatattaaaaaa

SEQ ID NO: 4850966 - DNA, 23 bp, Homo sapiens
agtatgtatattaaaaaagagac

SEQ ID NO: 4850967 - DNA, 22 bp, Homo sapiens
agtattgtttaaaatgtaattt

SEQ ID NO: 4850968 - DNA, 13 bp, Homo sapiens
agtatttactttt

SEQ ID NO: 4850969 - DNA, 13 bp, Homo sapiens
agtatttatgggt

SEQ ID NO: 4850970 - DNA, 14 bp, Homo sapiens
agtatttttaaagg

SEQ ID NO: 4850971 - DNA, 21 bp, Homo sapiens
agtcaactacacaaagcaggc

SEQ ID NO: 4850972 - DNA, 21 bp, Homo sapiens
agtcaacttattctttgagta

SEQ ID NO: 4850973 - DNA, 22 bp, Homo sapiens
agtcaccaaaagacactgcaga

SEQ ID NO: 4850974 - DNA, 20 bp, Homo sapiens
agtcaccaaatagtgtgaaa

SEQ ID NO: 4850975 - DNA, 23 bp, Homo sapiens
agtcactggtctgtttgcatttg

SEQ ID NO: 4850976 - DNA, 18 bp, Homo sapiens
agtcagaatttttaactg

SEQ ID NO: 4850977 - DNA, 22 bp, Homo sapiens
agtcagaatttttaactgtact

SEQ ID NO: 4850978 - DNA, 21 bp, Homo sapiens
agtcagacatttctttggaaa

SEQ ID NO: 4850979 - DNA, 18 bp, Homo sapiens
agtcattatgttaatatt

SEQ ID NO: 4850980 - DNA, 16 bp, Homo sapiens
agtccactcccagtgc

SEQ ID NO: 4850981 - DNA, 20 bp, Homo sapiens
agtccactcccagtgcttgc

SEQ ID NO: 4850982 - DNA, 12 bp, Homo sapiens
agtcccttcaat

SEQ ID NO: 4850983 - DNA, 21 bp, Homo sapiens
agtcctaattcaatcctactt

SEQ ID NO: 4850984 - DNA, 16 bp, Homo sapiens
agtccttaggctactg

SEQ ID NO: 4850985 - DNA, 23 bp, Homo sapiens
agtcgccagtcactgctgcaagg

SEQ ID NO: 4850986 - DNA, 18 bp, Homo sapiens
agtctaaggccatggcat

SEQ ID NO: 4850987 - DNA, 16 bp, Homo sapiens
agtctttcttcactct

SEQ ID NO: 4850988 - DNA, 15 bp, Homo sapiens
agtctttgccttctc

SEQ ID NO: 4850989 - DNA, 14 bp, Homo sapiens
agtgaataaatgtc

SEQ ID NO: 4850990 - DNA, 17 bp, Homo sapiens
agtgaataaatgtcttg

SEQ ID NO: 4850991 - DNA, 10 bp, Homo sapiens
agtgactcca

SEQ ID NO: 4850992 - DNA, 14 bp, Homo sapiens
agtgcctattgata

SEQ ID NO: 4850993 - DNA, 19 bp, Homo sapiens
agtgcctgggctcagcctg

SEQ ID NO: 4850994 - DNA, 21 bp, Homo sapiens
agtgctcttcccactccagct

SEQ ID NO: 4850995 - DNA, 22 bp, Homo sapiens
agtgctcttcccactccagctg

SEQ ID NO: 4850996 - DNA, 23 bp, Homo sapiens
agtgctcttcccactccagctga

SEQ ID NO: 4850997 - DNA, 13 bp, Homo sapiens
agtgctgctgtgg

SEQ ID NO: 4850998 - DNA, 20 bp, Homo sapiens
agtggaagtatgtatattaa

SEQ ID NO: 4850999 - DNA, 18 bp, Homo sapiens
agtggacgttaggccagg

SEQ ID NO: 4851000 - DNA, 19 bp, Homo sapiens
agtggacgttaggccaggc

SEQ ID NO: 4851001 - DNA, 22 bp, Homo sapiens
agtggacgttaggccaggcctt

SEQ ID NO: 4851002 - DNA, 16 bp, Homo sapiens
agtggctggggtggag

SEQ ID NO: 4851003 - DNA, 16 bp, Homo sapiens
agtgggaagggagcat

SEQ ID NO: 4851004 - DNA, 17 bp, Homo sapiens
agtggtgtgtgaagttt

SEQ ID NO: 4851005 - DNA, 17 bp, Homo sapiens
agtgtagctgtgaaatc

SEQ ID NO: 4851006 - DNA, 17 bp, Homo sapiens
agtgtattaggaagtgt

SEQ ID NO: 4851007 - DNA, 23 bp, Homo sapiens
agtgtctaggcactgagcaggga

SEQ ID NO: 4851008 - DNA, 13 bp, Homo sapiens
agtgtgactcctt

SEQ ID NO: 4851009 - DNA, 21 bp, Homo sapiens
agtgtgaggacctccctgtct

SEQ ID NO: 4851010 - DNA, 15 bp, Homo sapiens
agtgtgctgggcaga

SEQ ID NO: 4851011 - DNA, 18 bp, Homo sapiens
agtgtgtatatattttgt

SEQ ID NO: 4851012 - DNA, 19 bp, Homo sapiens
agtgtgtgcataatagcta

SEQ ID NO: 4851013 - DNA, 13 bp, Homo sapiens
agtgtgtgccaag

SEQ ID NO: 4851014 - DNA, 14 bp, Homo sapiens
agtgttacttgcag

SEQ ID NO: 4851015 - DNA, 17 bp, Homo sapiens
agtgttccaagtctctg

SEQ ID NO: 4851016 - DNA, 18 bp, Homo sapiens
agtgtttatgttgtttat

SEQ ID NO: 4851017 - DNA, 22 bp, Homo sapiens
agttaaaattgttatcaaaata

SEQ ID NO: 4851018 - DNA, 14 bp, Homo sapiens
agttaaagaaagga

SEQ ID NO: 4851019 - DNA, 12 bp, Homo sapiens
agttaaatctca

SEQ ID NO: 4851020 - DNA, 13 bp, Homo sapiens
agttagactcaaa

SEQ ID NO: 4851021 - DNA, 23 bp, Homo sapiens
agttagactcaaagaagtactgt

SEQ ID NO: 4851022 - DNA, 20 bp, Homo sapiens
agttatcatgaattttaaag

SEQ ID NO: 4851023 - DNA, 18 bp, Homo sapiens
agttatctttgaatatgt

SEQ ID NO: 4851024 - DNA, 15 bp, Homo sapiens
atctttataaatgta

SEQ ID NO: 4851025 - DNA, 19 bp, Homo sapiens
atctttatatttcaataaa

SEQ ID NO: 4851026 - DNA, 17 bp, Homo sapiens
atctttcagaaatataa

SEQ ID NO: 4851027 - DNA, 15 bp, Homo sapiens
atcttttttagtgtt

SEQ ID NO: 4851028 - DNA, 16 bp, Homo sapiens
atgaaaagtatattga

SEQ ID NO: 4851029 - DNA, 14 bp, Homo sapiens
atgaaaataccatt

SEQ ID NO: 4851030 - DNA, 24 bp, Homo sapiens
atgaaaataccatttagtaagaat

SEQ ID NO: 4851031 - DNA, 13 bp, Homo sapiens
atgaaacttctca

SEQ ID NO: 4851032 - DNA, 18 bp, Homo sapiens
atgaaagctgttccttgg

SEQ ID NO: 4851033 - DNA, 19 bp, Homo sapiens
atgaagatctttatatttc

SEQ ID NO: 4851034 - DNA, 17 bp, Homo sapiens
atgaagcagaaccttct

SEQ ID NO: 4851035 - DNA, 20 bp, Homo sapiens
atgaataatggaaaatgcca

SEQ ID NO: 4851036 - DNA, 19 bp, Homo sapiens
atgaatgggatattttgaa

SEQ ID NO: 4851037 - DNA, 20 bp, Homo sapiens
atgaatgggatattttgaaa

SEQ ID NO: 4851038 - DNA, 20 bp, Homo sapiens
atgacaagctgtatcactgc

SEQ ID NO: 4851039 - DNA, 21 bp, Homo sapiens
atgacagaggtttgaaggaga

SEQ ID NO: 4851040 - DNA, 15 bp, Homo sapiens
atgacagccttgcaa

SEQ ID NO: 4851041 - DNA, 13 bp, Homo sapiens
atgacctccagaa

SEQ ID NO: 4851042 - DNA, 14 bp, Homo sapiens
atgacctccagaag

SEQ ID NO: 4851043 - DNA, 15 bp, Homo sapiens
atgacctccagaagt

SEQ ID NO: 4851044 - DNA, 13 bp, Homo sapiens
atgacctgcccca

SEQ ID NO: 4851045 - DNA, 16 bp, Homo sapiens
atgactctcattttat

SEQ ID NO: 4851046 - DNA, 16 bp, Homo sapiens
atgactgcatttgtgt

SEQ ID NO: 4851047 - DNA, 20 bp, Homo sapiens
atgactgcatttgtgtgtgt

SEQ ID NO: 4851048 - DNA, 12 bp, Homo sapiens
atgagagaatgt

SEQ ID NO: 4851049 - DNA, 17 bp, Homo sapiens
atgagagaatgtggaaa

SEQ ID NO: 4851050 - DNA, 13 bp, Homo sapiens
atgagagcataat

SEQ ID NO: 4851051 - DNA, 16 bp, Homo sapiens
atgagagcataattta

SEQ ID NO: 4851052 - DNA, 15 bp, Homo sapiens
atgagagtagggccc

SEQ ID NO: 4851053 - DNA, 20 bp, Homo sapiens
atgagattggttttcctgtg

SEQ ID NO: 4851054 - DNA, 22 bp, Homo sapiens
atgagccttgcagatatctgca

SEQ ID NO: 4851055 - DNA, 22 bp, Homo sapiens
atgagctctgaaatcttcccat

SEQ ID NO: 4851056 - DNA, 19 bp, Homo sapiens
atgaggagtaaaattcagt

SEQ ID NO: 4851057 - DNA, 17 bp, Homo sapiens
atgaggatccagggcag

SEQ ID NO: 4851058 - DNA, 15 bp, Homo sapiens
atgaggcaaaaatgt

SEQ ID NO: 4851059 - DNA, 21 bp, Homo sapiens
atgagggctggctgccgtttt

SEQ ID NO: 4851060 - DNA, 16 bp, Homo sapiens
atgagtgaataaatgt

SEQ ID NO: 4851061 - DNA, 17 bp, Homo sapiens
atgagtgaataaatgtc

SEQ ID NO: 4851062 - DNA, 13 bp, Homo sapiens
atgagtttcactg

SEQ ID NO: 4851063 - DNA, 17 bp, Homo sapiens
atgagtttcactgtact

SEQ ID NO: 4851064 - DNA, 20 bp, Homo sapiens
atgataacaccagtgggaat

SEQ ID NO: 4851065 - DNA, 12 bp, Homo sapiens
atgatgacaatc

SEQ ID NO: 4851066 - DNA, 14 bp, Homo sapiens
atgatggttcacgt

SEQ ID NO: 4851067 - DNA, 19 bp, Homo sapiens
atgatgtctttttattaaa

SEQ ID NO: 4851068 - DNA, 17 bp, Homo sapiens
atgatgttatacatcaa

SEQ ID NO: 4851069 - DNA, 22 bp, Homo sapiens
atgatgttatacatcaatatgt

SEQ ID NO: 4851070 - DNA, 23 bp, Homo sapiens
atgatttccctccagagaaagca

SEQ ID NO: 4851071 - DNA, 15 bp, Homo sapiens
atgatttttgccctg

SEQ ID NO: 4851072 - DNA, 15 bp, Homo sapiens
atgattttttgaaag

SEQ ID NO: 4851073 - DNA, 23 bp, Homo sapiens
atgattttttgaaagttaacatt

SEQ ID NO: 4851074 - DNA, 21 bp, Homo sapiens
atgcaaatgagctctgaaatc

SEQ ID NO: 4851075 - DNA, 23 bp, Homo sapiens
atgcaaatgagctctgaaatctt

SEQ ID NO: 4851076 - DNA, 23 bp, Homo sapiens
atgcaataaaatttaaaaaataa

SEQ ID NO: 4851077 - DNA, 19 bp, Homo sapiens
atgcaattcagtgttccaa

SEQ ID NO: 4851078 - DNA, 21 bp, Homo sapiens
atgcagaaatagacaaaaagt

SEQ ID NO: 4851079 - DNA, 18 bp, Homo sapiens
atgcagagcttgtggtgg

SEQ ID NO: 4851080 - DNA, 22 bp, Homo sapiens
atgcaggagcttctgggagatt

SEQ ID NO: 4851081 - DNA, 20 bp, Homo sapiens
atgcagttagctgaagaatt

SEQ ID NO: 4851082 - DNA, 13 bp, Homo sapiens
atgcattattaaa

SEQ ID NO: 4851083 - DNA, 14 bp, Homo sapiens
atgcatttaataaa

SEQ ID NO: 4851084 - DNA, 16 bp, Homo sapiens
atgcatttaataaaga

SEQ ID NO: 4851085 - DNA, 19 bp, Homo sapiens
atgcatttaataaagatga

SEQ ID NO: 4851086 - DNA, 21 bp, Homo sapiens
atgcatttaataaagatgagt

SEQ ID NO: 4851087 - DNA, 22 bp, Homo sapiens
atgcccagacatcagcctcctt

SEQ ID NO: 4851088 - DNA, 16 bp, Homo sapiens
atgcctatggtggatc

SEQ ID NO: 4851089 - DNA, 19 bp, Homo sapiens
atgcctgctttttggaaag

SEQ ID NO: 4851090 - DNA, 19 bp, Homo sapiens
atgcctttttttctctgca

SEQ ID NO: 4851091 - DNA, 19 bp, Homo sapiens
atgctaacatctaaaaata

SEQ ID NO: 4851092 - DNA, 13 bp, Homo sapiens
atgctacttccca

SEQ ID NO: 4851093 - DNA, 22 bp, Homo sapiens
atgctcccacctgaatttgtat

SEQ ID NO: 4851094 - DNA, 15 bp, Homo sapiens
atgctgcctcaggac

SEQ ID NO: 4851095 - DNA, 23 bp, Homo sapiens
atgctgcctcaggacccatccct

SEQ ID NO: 4851096 - DNA, 21 bp, Homo sapiens
atgcttcatttgtatgtcaaa

SEQ ID NO: 4851097 - DNA, 13 bp, Homo sapiens
atgcttgcatgga

SEQ ID NO: 4851098 - DNA, 15 bp, Homo sapiens
atgcttgcatggaga

SEQ ID NO: 4851099 - DNA, 23 bp, Homo sapiens
atgcttgcggcaaaaggaaagct

SEQ ID NO: 4851100 - DNA, 22 bp, Homo sapiens
atgctttattaatgttttcaaa

SEQ ID NO: 4851101 - DNA, 15 bp, Homo sapiens
atggaaagacaaact

SEQ ID NO: 4851102 - DNA, 16 bp, Homo sapiens
atggaaagacaaactg

SEQ ID NO: 4851103 - DNA, 13 bp, Homo sapiens
atggaagaaagta

SEQ ID NO: 4851104 - DNA, 17 bp, Homo sapiens
atggacatgagagtagg

SEQ ID NO: 4851105 - DNA, 12 bp, Homo sapiens
atggagaatggg

SEQ ID NO: 4851106 - DNA, 15 bp, Homo sapiens
atggagggaagacct

SEQ ID NO: 4851107 - DNA, 18 bp, Homo sapiens
atggagggaagacctgaa

SEQ ID NO: 4851108 - DNA, 22 bp, Homo sapiens
atggatttggcactagccaaag

SEQ ID NO: 4851109 - DNA, 15 bp, Homo sapiens
atggatttttcttta

SEQ ID NO: 4851110 - DNA, 16 bp, Homo sapiens
atggatttttctttaa

SEQ ID NO: 4851111 - DNA, 19 bp, Homo sapiens
atggatttttctttaactg

SEQ ID NO: 4851112 - DNA, 20 bp, Homo sapiens
atggatttttctttaactgc

SEQ ID NO: 4851113 - DNA, 15 bp, Homo sapiens
atggcagctagtgcc

SEQ ID NO: 4851114 - DNA, 14 bp, Homo sapiens
atggcaggagtctc

SEQ ID NO: 4851115 - DNA, 19 bp, Homo sapiens
atggcaggagtctctgcca

SEQ ID NO: 4851116 - DNA, 24 bp, Homo sapiens
atggcagggggtggaattattact

SEQ ID NO: 4851117 - DNA, 16 bp, Homo sapiens
atggcatggcaggagt

SEQ ID NO: 4851118 - DNA, 17 bp, Homo sapiens
atggccacaaacctgcc

SEQ ID NO: 4851119 - DNA, 20 bp, Homo sapiens
atggccaggtggttgtctta

SEQ ID NO: 4851120 - DNA, 17 bp, Homo sapiens
atggccatcttctttct

SEQ ID NO: 4851121 - DNA, 18 bp, Homo sapiens
atggccatcttctttctt

SEQ ID NO: 4851122 - DNA, 20 bp, Homo sapiens
atggccatcttctttcttcc

SEQ ID NO: 4851123 - DNA, 16 bp, Homo sapiens
atggcctggagcaggc

SEQ ID NO: 4851124 - DNA, 17 bp, Homo sapiens
atggcctggagcaggcc

SEQ ID NO: 4851125 - DNA, 14 bp, Homo sapiens
atggcctgtcccta

SEQ ID NO: 4851126 - DNA, 23 bp, Homo sapiens
atggctgaagctggagcagcgga

SEQ ID NO: 4851127 - DNA, 12 bp, Homo sapiens
atgggaaacaaa

SEQ ID NO: 4851128 - DNA, 15 bp, Homo sapiens
atgggctaggcctcc

SEQ ID NO: 4851129 - DNA, 20 bp, Homo sapiens
atgggctgtgattactgcaa

SEQ ID NO: 4851130 - DNA, 19 bp, Homo sapiens
atggggaactcccccagag

SEQ ID NO: 4851131 - DNA, 19 bp, Homo sapiens
atggggaggttgtggggcc

SEQ ID NO: 4851132 - DNA, 16 bp, Homo sapiens
atgggggcacttgagt

SEQ ID NO: 4851133 - DNA, 18 bp, Homo sapiens
atgggtgtttttaataaa

SEQ ID NO: 4851134 - DNA, 14 bp, Homo sapiens
atggtaatagcttt

SEQ ID NO: 4851135 - DNA, 23 bp, Homo sapiens
atggtaggaccctcgagagcctt

SEQ ID NO: 4851136 - DNA, 22 bp, Homo sapiens
atggtagttttacagtgtttct

SEQ ID NO: 4851137 - DNA, 22 bp, Homo sapiens
atggtcatcttggagggaccaa

SEQ ID NO: 4851138 - DNA, 19 bp, Homo sapiens
atggtcctatttttgtgaa

SEQ ID NO: 4851139 - DNA, 17 bp, Homo sapiens
atggtggctcatgcctg

SEQ ID NO: 4851140 - DNA, 17 bp, Homo sapiens
atggttgatgatacttc

SEQ ID NO: 4851141 - DNA, 18 bp, Homo sapiens
atgtacaaaaattatgca

SEQ ID NO: 4851142 - DNA, 15 bp, Homo sapiens
atgtacagattcttt

SEQ ID NO: 4851143 - DNA, 21 bp, Homo sapiens
attctgattctggctttaagc

SEQ ID NO: 4851144 - DNA, 19 bp, Homo sapiens
attctggctttaagccttc

SEQ ID NO: 4851145 - DNA, 22 bp, Homo sapiens
attcttgtgggagacagcagcc

SEQ ID NO: 4851146 - DNA, 18 bp, Homo sapiens
attctttagcttacctgg

SEQ ID NO: 4851147 - DNA, 13 bp, Homo sapiens
attcttttctcag

SEQ ID NO: 4851148 - DNA, 19 bp, Homo sapiens
attgaaaagtttttgtttg

SEQ ID NO: 4851149 - DNA, 20 bp, Homo sapiens
attgaaaagtttttgtttgg

SEQ ID NO: 4851150 - DNA, 23 bp, Homo sapiens
attgaaaagtttttgtttggaga

SEQ ID NO: 4851151 - DNA, 16 bp, Homo sapiens
attgaaaattgaaaag

SEQ ID NO: 4851152 - DNA, 12 bp, Homo sapiens
attgaaattcta

SEQ ID NO: 4851153 - DNA, 11 bp, Homo sapiens
attgaactttc

SEQ ID NO: 4851154 - DNA, 22 bp, Homo sapiens
attgaaggtgataagggaaaag

SEQ ID NO: 4851155 - DNA, 15 bp, Homo sapiens
attgaagtttcaagt

SEQ ID NO: 4851156 - DNA, 20 bp, Homo sapiens
attgaagtttcaagttttaa

SEQ ID NO: 4851157 - DNA, 13 bp, Homo sapiens
attgaccattttt

SEQ ID NO: 4851158 - DNA, 17 bp, Homo sapiens
attgactcttatttata

SEQ ID NO: 4851159 - DNA, 14 bp, Homo sapiens
attgacttgtatat

SEQ ID NO: 4851160 - DNA, 18 bp, Homo sapiens
attgacttttataaagca

SEQ ID NO: 4851161 - DNA, 19 bp, Homo sapiens
attgaggggaggtggccag

SEQ ID NO: 4851162 - DNA, 16 bp, Homo sapiens
attgatgttttcatag

SEQ ID NO: 4851163 - DNA, 14 bp, Homo sapiens
attgatttgattgg

SEQ ID NO: 4851164 - DNA, 15 bp, Homo sapiens
attgcaataaagtat

SEQ ID NO: 4851165 - DNA, 13 bp, Homo sapiens
attgcaattaaac

SEQ ID NO: 4851166 - DNA, 18 bp, Homo sapiens
attgcagcctaagaagaa

SEQ ID NO: 4851167 - DNA, 16 bp, Homo sapiens
attgcatcactgtatc

SEQ ID NO: 4851168 - DNA, 12 bp, Homo sapiens
attgctctggag

SEQ ID NO: 4851169 - DNA, 19 bp, Homo sapiens
attgcttattatgtaggta

SEQ ID NO: 4851170 - DNA, 21 bp, Homo sapiens
attgcttttttccaaaacaaa

SEQ ID NO: 4851171 - DNA, 22 bp, Homo sapiens
attggatattttttactttaga

SEQ ID NO: 4851172 - DNA, 21 bp, Homo sapiens
attggcaaagtgacaaagcaa

SEQ ID NO: 4851173 - DNA, 23 bp, Homo sapiens
attggcattctttgcaatactgc

SEQ ID NO: 4851174 - DNA, 15 bp, Homo sapiens
attggccaattaaaa

SEQ ID NO: 4851175 - DNA, 16 bp, Homo sapiens
attggtgttgcagccg

SEQ ID NO: 4851176 - DNA, 20 bp, Homo sapiens
attggtgttgcagccgcaga

SEQ ID NO: 4851177 - DNA, 14 bp, Homo sapiens
attgtcacatctat

SEQ ID NO: 4851178 - DNA, 22 bp, Homo sapiens
attgtcaccgcaggtgctcatg

SEQ ID NO: 4851179 - DNA, 23 bp, Homo sapiens
attgtccagtttgtcttggatat

SEQ ID NO: 4851180 - DNA, 16 bp, Homo sapiens
attgtgcccctaaaga

SEQ ID NO: 4851181 - DNA, 15 bp, Homo sapiens
attgtgctcagagac

SEQ ID NO: 4851182 - DNA, 19 bp, Homo sapiens
attgtgtggattctttaaa

SEQ ID NO: 4851183 - DNA, 17 bp, Homo sapiens
attgtttaaaatgtaat

SEQ ID NO: 4851184 - DNA, 19 bp, Homo sapiens
attgtttggtaaatgtttc

SEQ ID NO: 4851185 - DNA, 15 bp, Homo sapiens
attgtttgttgcact

SEQ ID NO: 4851186 - DNA, 13 bp, Homo sapiens
atttaaaacaatc

SEQ ID NO: 4851187 - DNA, 21 bp, Homo sapiens
atttaaaacaatccttactaa

SEQ ID NO: 4851188 - DNA, 14 bp, Homo sapiens
atttaaaagcctgc

SEQ ID NO: 4851189 - DNA, 18 bp, Homo sapiens
atttaaacttacaaactt

SEQ ID NO: 4851190 - DNA, 16 bp, Homo sapiens
atttaaatccttggct

SEQ ID NO: 4851191 - DNA, 11 bp, Homo sapiens
atttaataaag

SEQ ID NO: 4851192 - DNA, 17 bp, Homo sapiens
atttaataaagatgagt

SEQ ID NO: 4851193 - DNA, 19 bp, Homo sapiens
atttaataccagatacctt

SEQ ID NO: 4851194 - DNA, 21 bp, Homo sapiens
atttaatggcagctagtgcct

SEQ ID NO: 4851195 - DNA, 19 bp, Homo sapiens
atttactgatgagagaatg

SEQ ID NO: 4851196 - DNA, 12 bp, Homo sapiens
atttacttgttt

SEQ ID NO: 4851197 - DNA, 21 bp, Homo sapiens
atttagaaaagtgaattgaag

SEQ ID NO: 4851198 - DNA, 18 bp, Homo sapiens
atttagaagaaagatgtt

SEQ ID NO: 4851199 - DNA, 19 bp, Homo sapiens
atttagaagcctgacaact

SEQ ID NO: 4851200 - DNA, 14 bp, Homo sapiens
atttagtaagaata

SEQ ID NO: 4851201 - DNA, 15 bp, Homo sapiens
atttagtaagaatac

SEQ ID NO: 4851202 - DNA, 18 bp, Homo sapiens
atttataatacagaatct

SEQ ID NO: 4851203 - DNA, 14 bp, Homo sapiens
atttatatatttat

SEQ ID NO: 4851204 - DNA, 20 bp, Homo sapiens
atttatattaaataacatgt

SEQ ID NO: 4851205 - DNA, 14 bp, Homo sapiens
atttatgcactgtg

SEQ ID NO: 4851206 - DNA, 21 bp, Homo sapiens
atttattaagcagtacaaatg

SEQ ID NO: 4851207 - DNA, 18 bp, Homo sapiens
atttattccccagtgact

SEQ ID NO: 4851208 - DNA, 13 bp, Homo sapiens
atttattgaaatg

SEQ ID NO: 4851209 - DNA, 22 bp, Homo sapiens
atttattgaaatgatttcacag

SEQ ID NO: 4851210 - DNA, 14 bp, Homo sapiens
atttatttattcat

SEQ ID NO: 4851211 - DNA, 14 bp, Homo sapiens
atttatttatttat

SEQ ID NO: 4851212 - DNA, 18 bp, Homo sapiens
atttcaaagttttgttgt

SEQ ID NO: 4851213 - DNA, 17 bp, Homo sapiens
atttcaataaatgatat

SEQ ID NO: 4851214 - DNA, 17 bp, Homo sapiens
atttcacagtgtgtggt

SEQ ID NO: 4851215 - DNA, 15 bp, Homo sapiens
atttcactaggactc

SEQ ID NO: 4851216 - DNA, 17 bp, Homo sapiens
atttcaggactctctcc

SEQ ID NO: 4851217 - DNA, 18 bp, Homo sapiens
atttcagtaagtctcata

SEQ ID NO: 4851218 - DNA, 22 bp, Homo sapiens
atttccagaaccacacttgaaa

SEQ ID NO: 4851219 - DNA, 21 bp, Homo sapiens
atttcccccttcatccatcct

SEQ ID NO: 4851220 - DNA, 21 bp, Homo sapiens
atttctagtacctgtgactct

SEQ ID NO: 4851221 - DNA, 22 bp, Homo sapiens
atttctatatagacttggagaa

SEQ ID NO: 4851222 - DNA, 22 bp, Homo sapiens
atttctcattgacttttataaa

SEQ ID NO: 4851223 - DNA, 11 bp, Homo sapiens
atttgaacttt

SEQ ID NO: 4851224 - DNA, 15 bp, Homo sapiens
atttgaactttggaa

SEQ ID NO: 4851225 - DNA, 16 bp, Homo sapiens
atttgaactttggaac

SEQ ID NO: 4851226 - DNA, 16 bp, Homo sapiens
atttgattatttaaga

SEQ ID NO: 4851227 - DNA, 19 bp, Homo sapiens
atttgattatttaagacta

SEQ ID NO: 4851228 - DNA, 22 bp, Homo sapiens
atttgccagaggaccaatgctt

SEQ ID NO: 4851229 - DNA, 23 bp, Homo sapiens
atttgctgacaaccattaaagtc

SEQ ID NO: 4851230 - DNA, 20 bp, Homo sapiens
atttggagcacaaaattcaa

SEQ ID NO: 4851231 - DNA, 17 bp, Homo sapiens
atttgggagacatgtga

SEQ ID NO: 4851232 - DNA, 19 bp, Homo sapiens
atttgtcgggttctcccat

SEQ ID NO: 4851233 - DNA, 16 bp, Homo sapiens
atttgttttggatata

SEQ ID NO: 4851234 - DNA, 12 bp, Homo sapiens
attttaaaaaag

SEQ ID NO: 4851235 - DNA, 13 bp, Homo sapiens
attttaaaatttc

SEQ ID NO: 4851236 - DNA, 18 bp, Homo sapiens
attttaaagccattctga

SEQ ID NO: 4851237 - DNA, 19 bp, Homo sapiens
attttaaagtatgcattat

SEQ ID NO: 4851238 - DNA, 22 bp, Homo sapiens
attttattaagctttttggaat

SEQ ID NO: 4851239 - DNA, 23 bp, Homo sapiens
attttatttacagctgtgctcca

SEQ ID NO: 4851240 - DNA, 16 bp, Homo sapiens
attttcatattgtaat

SEQ ID NO: 4851241 - DNA, 20 bp, Homo sapiens
attttcccactcattctgaa

SEQ ID NO: 4851242 - DNA, 21 bp, Homo sapiens
attttctaaaagctttcatgt

SEQ ID NO: 4851243 - DNA, 14 bp, Homo sapiens
attttctaaagact

SEQ ID NO: 4851244 - DNA, 15 bp, Homo sapiens
attttctaaagactt

SEQ ID NO: 4851245 - DNA, 15 bp, Homo sapiens
attttctcaatctcc

SEQ ID NO: 4851246 - DNA, 16 bp, Homo sapiens
attttgaaatgaactt

SEQ ID NO: 4851247 - DNA, 19 bp, Homo sapiens
attttgaaatgaactttgt

SEQ ID NO: 4851248 - DNA, 13 bp, Homo sapiens
attttgcttccca

SEQ ID NO: 4851249 - DNA, 19 bp, Homo sapiens
attttggggggttatttat

SEQ ID NO: 4851250 - DNA, 12 bp, Homo sapiens
atttttataatt

SEQ ID NO: 4851251 - DNA, 11 bp, Homo sapiens
atttttatgat

SEQ ID NO: 4851252 - DNA, 16 bp, Homo sapiens
atttttattaaagcat

SEQ ID NO: 4851253 - DNA, 21 bp, Homo sapiens
atttttattaaagcatttcct

SEQ ID NO: 4851254 - DNA, 12 bp, Homo sapiens
atttttgccctg

SEQ ID NO: 4851255 - DNA, 19 bp, Homo sapiens
atttttggtgggaatccaa

SEQ ID NO: 4851256 - DNA, 11 bp, Homo sapiens
attttttaaga

SEQ ID NO: 4851257 - DNA, 14 bp, Homo sapiens
attttttgaaagtt

SEQ ID NO: 4851258 - DNA, 16 bp, Homo sapiens
attttttggcacttgc

SEQ ID NO: 4851259 - DNA, 13 bp, Homo sapiens
atttttttctatt

SEQ ID NO: 4851260 - DNA, 22 bp, Homo sapiens
atttttttgcatgcatgcaaat

SEQ ID NO: 4851261 - DNA, 16 bp, Homo sapiens
caaaaagagtcagaca

SEQ ID NO: 4851262 - DNA, 13 bp, Homo sapiens
caaaaagccacag

SEQ ID NO: 4851263 - DNA, 20 bp, Homo sapiens
caaaaagccacagcagagca

SEQ ID NO: 4851264 - DNA, 14 bp, Homo sapiens
caaaaagtatatta

SEQ ID NO: 4851265 - DNA, 19 bp, Homo sapiens
caaaaatgtccagccaccc

SEQ ID NO: 4851266 - DNA, 22 bp, Homo sapiens
caaaaattatgcaattcagtgt

SEQ ID NO: 4851267 - DNA, 22 bp, Homo sapiens
caaaaatttctgtaaaacaggt

SEQ ID NO: 4851268 - DNA, 18 bp, Homo sapiens
caaaacaaaaagatgtct

SEQ ID NO: 4851269 - DNA, 22 bp, Homo sapiens
caaaatatattttgtttacaaa

SEQ ID NO: 4851270 - DNA, 19 bp, Homo sapiens
caaaatggtcctatttttg

SEQ ID NO: 4851271 - DNA, 16 bp, Homo sapiens
caaaattaagcaaatg

SEQ ID NO: 4851272 - DNA, 15 bp, Homo sapiens
caaaattcaaagcat

SEQ ID NO: 4851273 - DNA, 17 bp, Homo sapiens
caaaattcaaagcatgg

SEQ ID NO: 4851274 - DNA, 15 bp, Homo sapiens
caaaatttatatttt

SEQ ID NO: 4851275 - DNA, 14 bp, Homo sapiens
caaaattttaaaaa

SEQ ID NO: 4851276 - DNA, 14 bp, Homo sapiens
caaacaaaactctt

SEQ ID NO: 4851277 - DNA, 16 bp, Homo sapiens
caaacaagccccctgc

SEQ ID NO: 4851278 - DNA, 15 bp, Homo sapiens
caaacagaattttcc

SEQ ID NO: 4851279 - DNA, 19 bp, Homo sapiens
caaacagacaaaacagata

SEQ ID NO: 4851280 - DNA, 13 bp, Homo sapiens
caaacctgggaag

SEQ ID NO: 4851281 - DNA, 16 bp, Homo sapiens
caaacctgggaaggcc

SEQ ID NO: 4851282 - DNA, 22 bp, Homo sapiens
caaacctgggaaggccagcctt

SEQ ID NO: 4851283 - DNA, 21 bp, Homo sapiens
caaactactgaatgaagcagt

SEQ ID NO: 4851284 - DNA, 22 bp, Homo sapiens
caaactactgaatgaagcagta

SEQ ID NO: 4851285 - DNA, 23 bp, Homo sapiens
caaactactgaatgaagcagtat

SEQ ID NO: 4851286 - DNA, 13 bp, Homo sapiens
caaactccaggct

SEQ ID NO: 4851287 - DNA, 15 bp, Homo sapiens
caaactccaggctgg

SEQ ID NO: 4851288 - DNA, 21 bp, Homo sapiens
caaagaaaaaaaaaaaagcca

SEQ ID NO: 4851289 - DNA, 14 bp, Homo sapiens
caaagaagaaagct

SEQ ID NO: 4851290 - DNA, 17 bp, Homo sapiens
caaagcatggacattta

SEQ ID NO: 4851291 - DNA, 23 bp, Homo sapiens
caaagccggcctgagaaacacta

SEQ ID NO: 4851292 - DNA, 16 bp, Homo sapiens
caaagccttctcccta

SEQ ID NO: 4851293 - DNA, 16 bp, Homo sapiens
caaaggaactctagag

SEQ ID NO: 4851294 - DNA, 21 bp, Homo sapiens
caaaggatgtgatatataagt

SEQ ID NO: 4851295 - DNA, 18 bp, Homo sapiens
caaaggtgcactccagac

SEQ ID NO: 4851296 - DNA, 23 bp, Homo sapiens
caaaggtgcactccagactctgg

SEQ ID NO: 4851297 - DNA, 15 bp, Homo sapiens
caaagtacagaattt

SEQ ID NO: 4851298 - DNA, 16 bp, Homo sapiens
caaagtacagaatttg

SEQ ID NO: 4851299 - DNA, 12 bp, Homo sapiens
caaagtcattaa

SEQ ID NO: 4851300 - DNA, 16 bp, Homo sapiens
caaagtcattaaagac

SEQ ID NO: 4851301 - DNA, 19 bp, Homo sapiens
caaagtctccagaagaaaa

SEQ ID NO: 4851302 - DNA, 20 bp, Homo sapiens
caaagtctccagaagaaaat

SEQ ID NO: 4851303 - DNA, 23 bp, Homo sapiens
caaagtctgctctcatataagac

SEQ ID NO: 4851304 - DNA, 20 bp, Homo sapiens
caaagtgatagaaaagtgtg

SEQ ID NO: 4851305 - DNA, 14 bp, Homo sapiens
caaagtgcctgggc

SEQ ID NO: 4851306 - DNA, 16 bp, Homo sapiens
caaagtgcctgggctc

SEQ ID NO: 4851307 - DNA, 18 bp, Homo sapiens
caaagtgcctgggctcag

SEQ ID NO: 4851308 - DNA, 11 bp, Homo sapiens
caaagtggaac

SEQ ID NO: 4851309 - DNA, 22 bp, Homo sapiens
caaagtgtattaggaagtgttt

SEQ ID NO: 4851310 - DNA, 14 bp, Homo sapiens
caaataagaaataa

SEQ ID NO: 4851311 - DNA, 16 bp, Homo sapiens
caaataatttgaactt

SEQ ID NO: 4851312 - DNA, 22 bp, Homo sapiens
caaataatttgaactttggaac

SEQ ID NO: 4851313 - DNA, 17 bp, Homo sapiens
caaataggctattaaaa

SEQ ID NO: 4851314 - DNA, 13 bp, Homo sapiens
caaatgaaatgta

SEQ ID NO: 4851315 - DNA, 18 bp, Homo sapiens
caaatgaaatgtatgcat

SEQ ID NO: 4851316 - DNA, 21 bp, Homo sapiens
caaatgagctctgaaatcttc

SEQ ID NO: 4851317 - DNA, 20 bp, Homo sapiens
caaatgcagggaggggaggc

SEQ ID NO: 4851318 - DNA, 21 bp, Homo sapiens
caaattaaaaaaaaattgtat

SEQ ID NO: 4851319 - DNA, 13 bp, Homo sapiens
caaattctgtctg

SEQ ID NO: 4851320 - DNA, 17 bp, Homo sapiens
caaattctgtctgggga

SEQ ID NO: 4851321 - DNA, 21 bp, Homo sapiens
caaattgactcttatttatag

SEQ ID NO: 4851322 - DNA, 20 bp, Homo sapiens
caaattgcttttttccaaaa

SEQ ID NO: 4851323 - DNA, 15 bp, Homo sapiens
caacaaagaaacaaa

SEQ ID NO: 4851324 - DNA, 21 bp, Homo sapiens
caacagacacaatttatactg

SEQ ID NO: 4851325 - DNA, 18 bp, Homo sapiens
caacagactgttgagtta

SEQ ID NO: 4851326 - DNA, 15 bp, Homo sapiens
caacagcaaacaggt

SEQ ID NO: 4851327 - DNA, 17 bp, Homo sapiens
caacagcaaacaggtgc

SEQ ID NO: 4851328 - DNA, 14 bp, Homo sapiens
caacagccaagctg

SEQ ID NO: 4851329 - DNA, 20 bp, Homo sapiens
caacatatatttattgagta

SEQ ID NO: 4851330 - DNA, 21 bp, Homo sapiens
caacatatatttattgagtac

SEQ ID NO: 4851331 - DNA, 16 bp, Homo sapiens
caaccacactgcttgg

SEQ ID NO: 4851332 - DNA, 16 bp, Homo sapiens
caaccacgcaggaagc

SEQ ID NO: 4851333 - DNA, 13 bp, Homo sapiens
caaccatcatgtg

SEQ ID NO: 4851334 - DNA, 14 bp, Homo sapiens
caaccattaaagtc

SEQ ID NO: 4851335 - DNA, 17 bp, Homo sapiens
caaccattaaagtcaga

SEQ ID NO: 4851336 - DNA, 19 bp, Homo sapiens
caacctacattccaccctg

SEQ ID NO: 4851337 - DNA, 14 bp, Homo sapiens
caacctcaggctcc

SEQ ID NO: 4851338 - DNA, 12 bp, Homo sapiens
caacctccagac

SEQ ID NO: 4851339 - DNA, 20 bp, Homo sapiens
caacctccagactcagcaga

SEQ ID NO: 4851340 - DNA, 14 bp, Homo sapiens
caaccttgtttaat

SEQ ID NO: 4851341 - DNA, 18 bp, Homo sapiens
caactactagtgtgactc

SEQ ID NO: 4851342 - DNA, 22 bp, Homo sapiens
caactgtgtgattaaaaggtat

SEQ ID NO: 4851343 - DNA, 18 bp, Homo sapiens
caacttattctttgagta

SEQ ID NO: 4851344 - DNA, 19 bp, Homo sapiens
caacttattctttgagtaa

SEQ ID NO: 4851345 - DNA, 18 bp, Homo sapiens
caacttgtatccaggcct

SEQ ID NO: 4851346 - DNA, 19 bp, Homo sapiens
caactttgtaaaaatcttt

SEQ ID NO: 4851347 - DNA, 16 bp, Homo sapiens
caagactggcccagtg

SEQ ID NO: 4851348 - DNA, 20 bp, Homo sapiens
caagagctactcccacagca

SEQ ID NO: 4851349 - DNA, 21 bp, Homo sapiens
caagagggactccaagccctg

SEQ ID NO: 4851350 - DNA, 16 bp, Homo sapiens
caagagtaagcagtgt

SEQ ID NO: 4851351 - DNA, 18 bp, Homo sapiens
caagcaccaacctccaga

SEQ ID NO: 4851352 - DNA, 23 bp, Homo sapiens
caagcaccaacctccagactcag

SEQ ID NO: 4851353 - DNA, 15 bp, Homo sapiens
caagcagatgacaga

SEQ ID NO: 4851354 - DNA, 13 bp, Homo sapiens
caagccagccaac

SEQ ID NO: 4851355 - DNA, 14 bp, Homo sapiens
caagccccaacttt

SEQ ID NO: 4851356 - DNA, 13 bp, Homo sapiens
caagccccctgcc

SEQ ID NO: 4851357 - DNA, 15 bp, Homo sapiens
caagcctgcctccca

SEQ ID NO: 4851358 - DNA, 14 bp, Homo sapiens
caagctgaaatttt

SEQ ID NO: 4851359 - DNA, 21 bp, Homo sapiens
caagctgaaattttagaaata

SEQ ID NO: 4851360 - DNA, 12 bp, Homo sapiens
caagctggcaca

SEQ ID NO: 4851361 - DNA, 13 bp, Homo sapiens
caagctggcacaa

SEQ ID NO: 4851362 - DNA, 14 bp, Homo sapiens
caagctggcacaaa

SEQ ID NO: 4851363 - DNA, 15 bp, Homo sapiens
caagctggcacaaaa

SEQ ID NO: 4851364 - DNA, 12 bp, Homo sapiens
caagcttcccaa

SEQ ID NO: 4851365 - DNA, 14 bp, Homo sapiens
caagctttaaatta

SEQ ID NO: 4851366 - DNA, 16 bp, Homo sapiens
caagctttaaattatg

SEQ ID NO: 4851367 - DNA, 13 bp, Homo sapiens
caaggagcatcct

SEQ ID NO: 4851368 - DNA, 17 bp, Homo sapiens
caaggcattctcccagc

SEQ ID NO: 4851369 - DNA, 16 bp, Homo sapiens
caaggcctgcttgact

SEQ ID NO: 4851370 - DNA, 18 bp, Homo sapiens
caaggctcttcttcctca

SEQ ID NO: 4851371 - DNA, 22 bp, Homo sapiens
caaggggtgaggataggacaga

SEQ ID NO: 4851372 - DNA, 14 bp, Homo sapiens
caagggtcagggtg

SEQ ID NO: 4851373 - DNA, 21 bp, Homo sapiens
caaggtgaggtgaactccagg

SEQ ID NO: 4851374 - DNA, 22 bp, Homo sapiens
caaggtgaggtgaactccaggc

SEQ ID NO: 4851375 - DNA, 14 bp, Homo sapiens
caaggtggcctctg

SEQ ID NO: 4851376 - DNA, 22 bp, Homo sapiens
caaggtggcctctgcctggggc

SEQ ID NO: 4851377 - DNA, 14 bp, Homo sapiens
caagtcactcccaa

SEQ ID NO: 4851378 - DNA, 19 bp, Homo sapiens
caagtggacgttaggccag

SEQ ID NO: 4851379 - DNA, 22 bp, Homo sapiens
caagtggacgttaggccaggcc

SEQ ID NO: 4851380 - DNA, 13 bp, Homo sapiens
caataaaatttaa

SEQ ID NO: 4851381 - DNA, 16 bp, Homo sapiens
caataaagtataatgt

SEQ ID NO: 4851382 - DNA, 22 bp, Homo sapiens
caataccttcaaggctcttctt

SEQ ID NO: 4851383 - DNA, 17 bp, Homo sapiens
caataggtagctgggga

SEQ ID NO: 4851384 - DNA, 13 bp, Homo sapiens
caatagtgcaaca

SEQ ID NO: 4851385 - DNA, 21 bp, Homo sapiens
caatagtgcaacatctctgaa

SEQ ID NO: 4851386 - DNA, 12 bp, Homo sapiens
caatatgtatat

SEQ ID NO: 4851387 - DNA, 14 bp, Homo sapiens
caatatgtatatat

SEQ ID NO: 4851388 - DNA, 23 bp, Homo sapiens
caatattgattgggaaaacattt

SEQ ID NO: 4851389 - DNA, 23 bp, Homo sapiens
caatctcctctctctttcctcca

SEQ ID NO: 4851390 - DNA, 20 bp, Homo sapiens
caatctggatgcctcattat

SEQ ID NO: 4851391 - DNA, 20 bp, Homo sapiens
caatctggattcatatttaa

SEQ ID NO: 4851392 - DNA, 16 bp, Homo sapiens
caatctgtacaaaatg

SEQ ID NO: 4851393 - DNA, 16 bp, Homo sapiens
caatgaaccataaatt

SEQ ID NO: 4851394 - DNA, 19 bp, Homo sapiens
caatgaaccataaattcaa

SEQ ID NO: 4851395 - DNA, 14 bp, Homo sapiens
caatgcttgcatgg

SEQ ID NO: 4851396 - DNA, 16 bp, Homo sapiens
caatggaaaatataat

SEQ ID NO: 4851397 - DNA, 15 bp, Homo sapiens
caatgttggagcagc

SEQ ID NO: 4851398 - DNA, 20 bp, Homo sapiens
caatgttggagcagcaggcc

SEQ ID NO: 4851399 - DNA, 20 bp, Homo sapiens
caattaaaaacgaaaacctg

SEQ ID NO: 4851400 - DNA, 11 bp, Homo sapiens
caattaactgc

SEQ ID NO: 4851401 - DNA, 15 bp, Homo sapiens
caattactttggtag

SEQ ID NO: 4851402 - DNA, 13 bp, Homo sapiens
caattagacttga

SEQ ID NO: 4851403 - DNA, 21 bp, Homo sapiens
caattttatccctcacctgta

SEQ ID NO: 4851404 - DNA, 13 bp, Homo sapiens
cacaaactccagg

SEQ ID NO: 4851405 - DNA, 14 bp, Homo sapiens
cacaaactccaggc

SEQ ID NO: 4851406 - DNA, 16 bp, Homo sapiens
cacaaactccaggctg

SEQ ID NO: 4851407 - DNA, 17 bp, Homo sapiens
cacaaactccaggctgg

SEQ ID NO: 4851408 - DNA, 13 bp, Homo sapiens
cacaaagaagaaa

SEQ ID NO: 4851409 - DNA, 15 bp, Homo sapiens
cacaactactagtgt

SEQ ID NO: 4851410 - DNA, 17 bp, Homo sapiens
cacaactcccttgcacg

SEQ ID NO: 4851411 - DNA, 15 bp, Homo sapiens
cacaagactggccca

SEQ ID NO: 4851412 - DNA, 19 bp, Homo sapiens
cacaagactggcccagtgc

SEQ ID NO: 4851413 - DNA, 12 bp, Homo sapiens
cacaagtggtgt

SEQ ID NO: 4851414 - DNA, 21 bp, Homo sapiens
cacaatgttggagcagcaggc

SEQ ID NO: 4851415 - DNA, 22 bp, Homo sapiens
cacaatgttggagcagcaggcc

SEQ ID NO: 4851416 - DNA, 16 bp, Homo sapiens
cacaatttaaaacaat

SEQ ID NO: 4851417 - DNA, 9 bp, Homo sapiens
cacacacac

SEQ ID NO: 4851418 - DNA, 16 bp, Homo sapiens
cacacacacacacacg

SEQ ID NO: 4851419 - DNA, 15 bp, Homo sapiens
cacacacacacgatg

SEQ ID NO: 4851420 - DNA, 11 bp, Homo sapiens
cacacacacga

SEQ ID NO: 4851421 - DNA, 16 bp, Homo sapiens
cacacacacgatgcat

SEQ ID NO: 4851422 - DNA, 13 bp, Homo sapiens
cacacacgatgca

SEQ ID NO: 4851423 - DNA, 20 bp, Homo sapiens
cacaccgagggcgaccccgt

SEQ ID NO: 4851424 - DNA, 13 bp, Homo sapiens
cacacgatgcatt

SEQ ID NO: 4851425 - DNA, 22 bp, Homo sapiens
cacacgatgcatttaataaaga

SEQ ID NO: 4851426 - DNA, 13 bp, Homo sapiens
cacagcagagcat

SEQ ID NO: 4851427 - DNA, 17 bp, Homo sapiens
cacagccttgcagcggc

SEQ ID NO: 4851428 - DNA, 15 bp, Homo sapiens
cacaggagagactgg

SEQ ID NO: 4851429 - DNA, 15 bp, Homo sapiens
cacaggatcctggcc

SEQ ID NO: 4851430 - DNA, 17 bp, Homo sapiens
cacaggcacattaactg

SEQ ID NO: 4851431 - DNA, 23 bp, Homo sapiens
cacagtgtgtggtcaacatttct

SEQ ID NO: 4851432 - DNA, 21 bp, Homo sapiens
cacatagcataggctggggac

SEQ ID NO: 4851433 - DNA, 18 bp, Homo sapiens
cacatgactctcatttta

SEQ ID NO: 4851434 - DNA, 15 bp, Homo sapiens
cacatttctttgcat

SEQ ID NO: 4851435 - DNA, 21 bp, Homo sapiens
cacatttgctactgttgtaag

SEQ ID NO: 4851436 - DNA, 14 bp, Homo sapiens
caccaacctccaga

SEQ ID NO: 4851437 - DNA, 16 bp, Homo sapiens
caccaacctccagact

SEQ ID NO: 4851438 - DNA, 18 bp, Homo sapiens
caccaacctccagactca

SEQ ID NO: 4851439 - DNA, 19 bp, Homo sapiens
caccaacctccagactcag

SEQ ID NO: 4851440 - DNA, 21 bp, Homo sapiens
caccaggggccaacctcaggc

SEQ ID NO: 4851441 - DNA, 17 bp, Homo sapiens
caccagttgctgctgcc

SEQ ID NO: 4851442 - DNA, 22 bp, Homo sapiens
caccatactccttgcttcctga

SEQ ID NO: 4851443 - DNA, 11 bp, Homo sapiens
cacccatccta

SEQ ID NO: 4851444 - DNA, 15 bp, Homo sapiens
caccccgtagattcc

SEQ ID NO: 4851445 - DNA, 14 bp, Homo sapiens
caccctccatgctc

SEQ ID NO: 4851446 - DNA, 21 bp, Homo sapiens
caccgccacaataaagatcgc

SEQ ID NO: 4851447 - DNA, 14 bp, Homo sapiens
caccgtattcctct

SEQ ID NO: 4851448 - DNA, 19 bp, Homo sapiens
caccgtggcagcttgctgg

SEQ ID NO: 4851449 - DNA, 21 bp, Homo sapiens
tttttattaaagcatttccta

SEQ ID NO: 4851450 - DNA, 23 bp, Homo sapiens
tttttgccctgcgtcccttctct

SEQ ID NO: 4851451 - DNA, 17 bp, Homo sapiens
tttttggaaagtcagaa

SEQ ID NO: 4851452 - DNA, 14 bp, Homo sapiens
tttttggttgggaa

SEQ ID NO: 4851453 - DNA, 12 bp, Homo sapiens
tttttgtttgcc

SEQ ID NO: 4851454 - DNA, 11 bp, Homo sapiens
tttttgtttgg

SEQ ID NO: 4851455 - DNA, 23 bp, Homo sapiens
ttttttaagcttcagttgcttgt

SEQ ID NO: 4851456 - DNA, 11 bp, Homo sapiens
ttttttattat

SEQ ID NO: 4851457 - DNA, 14 bp, Homo sapiens
tttttttaactgtg

SEQ ID NO: 4851458 - DNA, 20 bp, Homo sapiens
ttattccccagtgactccag

SEQ ID NO: 4851459 - DNA, 13 bp, Homo sapiens
ttattgaccattt

SEQ ID NO: 4851460 - DNA, 17 bp, Homo sapiens
ttattgcaataaagtat

SEQ ID NO: 4851461 - DNA, 15 bp, Homo sapiens
ttatttaagactaaa

SEQ ID NO: 4851462 - DNA, 15 bp, Homo sapiens
ttatttacagctgtg

SEQ ID NO: 4851463 - DNA, 11 bp, Homo sapiens
ttatttattga

SEQ ID NO: 4851464 - DNA, 16 bp, Homo sapiens
ttatttctcagctgtg

SEQ ID NO: 4851465 - DNA, 16 bp, Homo sapiens
ttattttaaaatttca

SEQ ID NO: 4851466 - DNA, 15 bp, Homo sapiens
ttcaaaaagccacag

SEQ ID NO: 4851467 - DNA, 22 bp, Homo sapiens
ttcaaaaagccacagcagagca

SEQ ID NO: 4851468 - DNA, 20 bp, Homo sapiens
ttcaaaaggtattatacatg

SEQ ID NO: 4851469 - DNA, 21 bp, Homo sapiens
ttcaaaaggtattatacatgt

SEQ ID NO: 4851470 - DNA, 17 bp, Homo sapiens
ttcaaagccttctccct

SEQ ID NO: 4851471 - DNA, 21 bp, Homo sapiens
ttcaacaaagaaacaaagatg

SEQ ID NO: 4851472 - DNA, 22 bp, Homo sapiens
ttcaacaaagaaacaaagatgt

SEQ ID NO: 4851473 - DNA, 18 bp, Homo sapiens
ttcaaccacgcaggaagc

SEQ ID NO: 4851474 - DNA, 19 bp, Homo sapiens
ttcaaggacattggtgaga

SEQ ID NO: 4851475 - DNA, 16 bp, Homo sapiens
ttcaagttttaaagtt

SEQ ID NO: 4851476 - DNA, 16 bp, Homo sapiens
ttcaataaatgatata

SEQ ID NO: 4851477 - DNA, 17 bp, Homo sapiens
ttcaataaatgatatat

SEQ ID NO: 4851478 - DNA, 17 bp, Homo sapiens
ttcaatcctacttttcg

SEQ ID NO: 4851479 - DNA, 23 bp, Homo sapiens
ttcaatctggattcatatttaat

SEQ ID NO: 4851480 - DNA, 13 bp, Homo sapiens
ttcacaggcactc

SEQ ID NO: 4851481 - DNA, 22 bp, Homo sapiens
ttcacccttatagtctaagact

SEQ ID NO: 4851482 - DNA, 22 bp, Homo sapiens
ttcactgtactgcatgtgactt

SEQ ID NO: 4851483 - DNA, 15 bp, Homo sapiens
ttcagaaatataaca

SEQ ID NO: 4851484 - DNA, 22 bp, Homo sapiens
ttcagaaatataacacattttt

SEQ ID NO: 4851485 - DNA, 19 bp, Homo sapiens
ttcagaagaatcttcctgg

SEQ ID NO: 4851486 - DNA, 11 bp, Homo sapiens
ttcagagaaat

SEQ ID NO: 4851487 - DNA, 13 bp, Homo sapiens
ttcagatgtatgt

SEQ ID NO: 4851488 - DNA, 16 bp, Homo sapiens
ttcaggagcctggcca

SEQ ID NO: 4851489 - DNA, 14 bp, Homo sapiens
ttcagggtaaatag

SEQ ID NO: 4851490 - DNA, 16 bp, Homo sapiens
ttcaggttagtgacat

SEQ ID NO: 4851491 - DNA, 16 bp, Homo sapiens
ttcagtgtaaagtgtg

SEQ ID NO: 4851492 - DNA, 20 bp, Homo sapiens
ttgcatcactgtatcatttt

SEQ ID NO: 4851493 - DNA, 17 bp, Homo sapiens
ttgcatgcatgcaaatg

SEQ ID NO: 4851494 - DNA, 16 bp, Homo sapiens
ttgcatggagaatggg

SEQ ID NO: 4851495 - DNA, 17 bp, Homo sapiens
ttgcatttttattaaag

SEQ ID NO: 4851496 - DNA, 21 bp, Homo sapiens
ttgcatttttattaaagcatt

SEQ ID NO: 4851497 - DNA, 16 bp, Homo sapiens
ttgcccccattcccag

SEQ ID NO: 4851498 - DNA, 16 bp, Homo sapiens
ttgcctatttccccct

SEQ ID NO: 4851499 - DNA, 21 bp, Homo sapiens
ttgcctcattttgcttcccat

SEQ ID NO: 4851500 - DNA, 22 bp, Homo sapiens
ttgcctccaggaccttgcttcc

SEQ ID NO: 4851501 - DNA, 19 bp, Homo sapiens
ttgcgaccttaatttaact

SEQ ID NO: 4851502 - DNA, 13 bp, Homo sapiens
ttgctctggagca

SEQ ID NO: 4851503 - DNA, 16 bp, Homo sapiens
ttgctctggagcagcc

SEQ ID NO: 4851504 - DNA, 23 bp, Homo sapiens
ttgctgacaaccattaaagtcag

SEQ ID NO: 4851505 - DNA, 15 bp, Homo sapiens
ttgctgggctttggg

SEQ ID NO: 4851506 - DNA, 11 bp, Homo sapiens
ttgctgtgctt

SEQ ID NO: 4851507 - DNA, 11 bp, Homo sapiens
ttgcttcctga

SEQ ID NO: 4851508 - DNA, 12 bp, Homo sapiens
ttggaaagtcag

SEQ ID NO: 4851509 - DNA, 14 bp, Homo sapiens
ttggaaagtcagaa

SEQ ID NO: 4851510 - DNA, 13 bp, Homo sapiens
ttggaatattaaa

SEQ ID NO: 4851511 - DNA, 16 bp, Homo sapiens
ttggaatattaaaaaa

SEQ ID NO: 4851512 - DNA, 23 bp, Homo sapiens
ttggaatattaaaaaacttcatg

SEQ ID NO: 4851513 - DNA, 20 bp, Homo sapiens
ttggacattttatgtctttc

SEQ ID NO: 4851514 - DNA, 11 bp, Homo sapiens
ttggacctgcc

SEQ ID NO: 4851515 - DNA, 17 bp, Homo sapiens
ttggacgggatgacctc

SEQ ID NO: 4851516 - DNA, 20 bp, Homo sapiens
ttggacgggatgacctccag

SEQ ID NO: 4851517 - DNA, 22 bp, Homo sapiens
ttggacgggatgacctccagaa

SEQ ID NO: 4851518 - DNA, 12 bp, Homo sapiens
ttggacttctga

SEQ ID NO: 4851519 - DNA, 14 bp, Homo sapiens
ttggagcagcaggc

SEQ ID NO: 4851520 - DNA, 22 bp, Homo sapiens
ttggagcagcaggcctctggga

SEQ ID NO: 4851521 - DNA, 18 bp, Homo sapiens
ttggagtgctcttcccac

SEQ ID NO: 4851522 - DNA, 19 bp, Homo sapiens
ttggatattttttacttta

SEQ ID NO: 4851523 - DNA, 20 bp, Homo sapiens
ttggcacttgccattccaaa

SEQ ID NO: 4851524 - DNA, 23 bp, Homo sapiens
ttggcagagaccataagagaaac

SEQ ID NO: 4851525 - DNA, 15 bp, Homo sapiens
ttggcattctttgca

SEQ ID NO: 4851526 - DNA, 20 bp, Homo sapiens
ttggcattctttgcaatact

SEQ ID NO: 4851527 - DNA, 17 bp, Homo sapiens
ttggcccccttcaggag

SEQ ID NO: 4851528 - DNA, 21 bp, Homo sapiens
ttggcccccttcaggagcctg

SEQ ID NO: 4851529 - DNA, 22 bp, Homo sapiens
ttggcgtagcagagttaaatct

SEQ ID NO: 4851530 - DNA, 16 bp, Homo sapiens
ttgggaaaacatgtta

SEQ ID NO: 4851531 - DNA, 16 bp, Homo sapiens
ttgggaaaacatttgc

SEQ ID NO: 4851532 - DNA, 16 bp, Homo sapiens
ttgggaaaggcagggc

SEQ ID NO: 4851533 - DNA, 20 bp, Homo sapiens
ttgggaaaggcagggccctg

SEQ ID NO: 4851534 - DNA, 22 bp, Homo sapiens
ttgggaactgaaatccttgaga

SEQ ID NO: 4851535 - DNA, 21 bp, Homo sapiens
ttgggagagccatacataaaa

SEQ ID NO: 4851536 - DNA, 14 bp, Homo sapiens
ttgggagccaggac

SEQ ID NO: 4851537 - DNA, 20 bp, Homo sapiens
ttgggagccaggactcccag

SEQ ID NO: 4851538 - DNA, 20 bp, Homo sapiens
ttgggcctctcctgccctct

SEQ ID NO: 4851539 - DNA, 15 bp, Homo sapiens
ttgggcctgttcctt

SEQ ID NO: 4851540 - DNA, 22 bp, Homo sapiens
ttgggcttcaacagccaagctg

SEQ ID NO: 4851541 - DNA, 20 bp, Homo sapiens
ttggggaaggggcctgggct

SEQ ID NO: 4851542 - DNA, 11 bp, Homo sapiens
ttggggctcct

SEQ ID NO: 4851543 - DNA, 18 bp, Homo sapiens
ttggggtgtggggtgggg

SEQ ID NO: 4851544 - DNA, 19 bp, Homo sapiens
ttggggtgtggggtggggt

SEQ ID NO: 4851545 - DNA, 14 bp, Homo sapiens
ttgggtgaatttca

SEQ ID NO: 4851546 - DNA, 21 bp, Homo sapiens
ttgggtggggggcattgagta

SEQ ID NO: 4851547 - DNA, 20 bp, Homo sapiens
ttgggtgtctccttaagctg

SEQ ID NO: 4851548 - DNA, 18 bp, Homo sapiens
ttggtgttgcagccgcag

SEQ ID NO: 4851549 - DNA, 22 bp, Homo sapiens
ttggttgggaatgaggaaaatt

SEQ ID NO: 4851550 - DNA, 12 bp, Homo sapiens
ttggttttgaca

SEQ ID NO: 4851551 - DNA, 17 bp, Homo sapiens
ttgtaaaattatttcat

SEQ ID NO: 4851552 - DNA, 21 bp, Homo sapiens
ttgtaactgtttagatgaatg

SEQ ID NO: 4851553 - DNA, 17 bp, Homo sapiens
ttgtaattatgtaaata

SEQ ID NO: 4851554 - DNA, 15 bp, Homo sapiens
ttgtacttaaatggt

SEQ ID NO: 4851555 - DNA, 19 bp, Homo sapiens
ttgtagtgccactgttgtt

SEQ ID NO: 4851556 - DNA, 19 bp, Homo sapiens
ttgtatatgactgcatttg

SEQ ID NO: 4851557 - DNA, 15 bp, Homo sapiens
ttgtcacttttcctt

SEQ ID NO: 4851558 - DNA, 23 bp, Homo sapiens
ttgtcacttttccttttcttaaa

SEQ ID NO: 4851559 - DNA, 13 bp, Homo sapiens
ttgtccaggaagt

SEQ ID NO: 4851560 - DNA, 20 bp, Homo sapiens
ttgtcccaaggaatcagcag

SEQ ID NO: 4851561 - DNA, 13 bp, Homo sapiens
ttgtcttattgca

SEQ ID NO: 4851562 - DNA, 22 bp, Homo sapiens
ttgtgaaggcaggggaatgtat

SEQ ID NO: 4851563 - DNA, 22 bp, Homo sapiens
ttgtgttcagaagaatcttcct

SEQ ID NO: 4851564 - DNA, 13 bp, Homo sapiens
ttgtgtttctaga

SEQ ID NO: 4851565 - DNA, 12 bp, Homo sapiens
ttgttatcaaaa

SEQ ID NO: 4851566 - DNA, 14 bp, Homo sapiens
ttgttgtacttaaa

SEQ ID NO: 4851567 - DNA, 12 bp, Homo sapiens
ttgtttaatggt

SEQ ID NO: 4851568 - DNA, 21 bp, Homo sapiens
ttgtttggagacgtttataaa

SEQ ID NO: 4851569 - DNA, 12 bp, Homo sapiens
tttaaaaattgt

SEQ ID NO: 4851570 - DNA, 15 bp, Homo sapiens
tttaaaacgtgtaaa

SEQ ID NO: 4851571 - DNA, 22 bp, Homo sapiens
tttaaaacgtgtaaatgaagat

SEQ ID NO: 4851572 - DNA, 15 bp, Homo sapiens
tttaaaactgttgga

SEQ ID NO: 4851573 - DNA, 23 bp, Homo sapiens
tttaaaatgtaatttaaatgaaa

SEQ ID NO: 4851574 - DNA, 20 bp, Homo sapiens
tttaaagaagtgcatgaaaa

SEQ ID NO: 4851575 - DNA, 18 bp, Homo sapiens
tttaaagccattctgatt

SEQ ID NO: 4851576 - DNA, 15 bp, Homo sapiens
tttaaagtatgcatt

SEQ ID NO: 4851577 - DNA, 23 bp, Homo sapiens
tttaaccggtaagagtttcagtt

SEQ ID NO: 4851578 - DNA, 12 bp, Homo sapiens
tttaactgccgt

SEQ ID NO: 4851579 - DNA, 12 bp, Homo sapiens
tttaactgtgga

SEQ ID NO: 4851580 - DNA, 15 bp, Homo sapiens
tttaactgtggatat

SEQ ID NO: 4851581 - DNA, 16 bp, Homo sapiens
tttaagaaaaaaagct

SEQ ID NO: 4851582 - DNA, 13 bp, Homo sapiens
tttaagccgcaga

SEQ ID NO: 4851583 - DNA, 14 bp, Homo sapiens
tttaatccatttca

SEQ ID NO: 4851584 - DNA, 20 bp, Homo sapiens
tttacaagggcataaagtaa

SEQ ID NO: 4851585 - DNA, 14 bp, Homo sapiens
tttacagctgtgct

SEQ ID NO: 4851586 - DNA, 19 bp, Homo sapiens
tttacagtgtttctggctt

SEQ ID NO: 4851587 - DNA, 13 bp, Homo sapiens
tttaccctcttgg

SEQ ID NO: 4851588 - DNA, 12 bp, Homo sapiens
tttacctggcct

SEQ ID NO: 4851589 - DNA, 22 bp, Homo sapiens
tttactccaggttattgcaata

SEQ ID NO: 4851590 - DNA, 22 bp, Homo sapiens
tttactgtttgatataccaaat

SEQ ID NO: 4851591 - DNA, 18 bp, Homo sapiens
tttagattgagaaatgtg

SEQ ID NO: 4851592 - DNA, 15 bp, Homo sapiens
tttagtcatgtgacc

SEQ ID NO: 4851593 - DNA, 15 bp, Homo sapiens
tttagtgaattaaat

SEQ ID NO: 4851594 - DNA, 16 bp, Homo sapiens
tttataaacagaaatg

SEQ ID NO: 4851595 - DNA, 17 bp, Homo sapiens
tttataacatctttatt

SEQ ID NO: 4851596 - DNA, 14 bp, Homo sapiens
tttataataaaaat

SEQ ID NO: 4851597 - DNA, 19 bp, Homo sapiens
tttataataaaaatatatt

SEQ ID NO: 4851598 - DNA, 20 bp, Homo sapiens
tttataattgtacaaaatta

SEQ ID NO: 4851599 - DNA, 18 bp, Homo sapiens
tttatatttcaataaatg

SEQ ID NO: 4851600 - DNA, 20 bp, Homo sapiens
tttatattttagaaataata

SEQ ID NO: 4851601 - DNA, 17 bp, Homo sapiens
tttatcatgaatgcttt

SEQ ID NO: 4851602 - DNA, 20 bp, Homo sapiens
tttatcttattttctcaatc

SEQ ID NO: 4851603 - DNA, 18 bp, Homo sapiens
tttatgatgacaatcaaa

SEQ ID NO: 4851604 - DNA, 14 bp, Homo sapiens
tttattaaaatatt

SEQ ID NO: 4851605 - DNA, 19 bp, Homo sapiens
tttattaaaatatttcagg

SEQ ID NO: 4851606 - DNA, 12 bp, Homo sapiens
tttattgagtac

SEQ ID NO: 4851607 - DNA, 16 bp, Homo sapiens
tttatttacagctgtg

SEQ ID NO: 4851608 - DNA, 20 bp, Homo sapiens
tttcaaagttttgttgtact

SEQ ID NO: 4851609 - DNA, 21 bp, Homo sapiens
tttcaaagttttgttgtactt

SEQ ID NO: 4851610 - DNA, 23 bp, Homo sapiens
tttcaacggaaagtgctgtctta

SEQ ID NO: 4851611 - DNA, 17 bp, Homo sapiens
tttcacccatcctagga

SEQ ID NO: 4851612 - DNA, 22 bp, Homo sapiens
tgtcccacatggccatcttctt

SEQ ID NO: 4851613 - DNA, 22 bp, Homo sapiens
tgtccctagggctctccaagca

SEQ ID NO: 4851614 - DNA, 22 bp, Homo sapiens
tgtcctctgcaagcttcttgct

SEQ ID NO: 4851615 - DNA, 18 bp, Homo sapiens
tgtccttaaaatgtggtc

SEQ ID NO: 4851616 - DNA, 17 bp, Homo sapiens
tgtctaagtagggccag

SEQ ID NO: 4851617 - DNA, 22 bp, Homo sapiens
tgtctcttggctttgtcacttt

SEQ ID NO: 4851618 - DNA, 14 bp, Homo sapiens
tgtctgagacaggt

SEQ ID NO: 4851619 - DNA, 21 bp, Homo sapiens
tgtctgctaggcgctggggag

SEQ ID NO: 4851620 - DNA, 11 bp, Homo sapiens
tgtctggcaga

SEQ ID NO: 4851621 - DNA, 15 bp, Homo sapiens
tgtctggcagatgag

SEQ ID NO: 4851622 - DNA, 20 bp, Homo sapiens
tgtctggcagatgagggctg

SEQ ID NO: 4851623 - DNA, 13 bp, Homo sapiens
tgtcttattgcac

SEQ ID NO: 4851624 - DNA, 13 bp, Homo sapiens
tgtcttctttctc

SEQ ID NO: 4851625 - DNA, 22 bp, Homo sapiens
tgtcttctttctccatggagcc

SEQ ID NO: 4851626 - DNA, 18 bp, Homo sapiens
tgtgaaattgcatacttt

SEQ ID NO: 4851627 - DNA, 23 bp, Homo sapiens
tgtgaagagggacataagataaa

SEQ ID NO: 4851628 - DNA, 19 bp, Homo sapiens
tgtgaagtttggagataga

SEQ ID NO: 4851629 - DNA, 14 bp, Homo sapiens
tgtgaatttgccag

SEQ ID NO: 4851630 - DNA, 22 bp, Homo sapiens
tgtgaattttctaaaagctttc

SEQ ID NO: 4851631 - DNA, 16 bp, Homo sapiens
tgtgaccagaaagctt

SEQ ID NO: 4851632 - DNA, 20 bp, Homo sapiens
tgtgaccagaaagcttcatc

SEQ ID NO: 4851633 - DNA, 13 bp, Homo sapiens
tgtgaccctgggc

SEQ ID NO: 4851634 - DNA, 14 bp, Homo sapiens
tgtgaccctgggca

SEQ ID NO: 4851635 - DNA, 22 bp, Homo sapiens
tgtgactccttatctctttcca

SEQ ID NO: 4851636 - DNA, 22 bp, Homo sapiens
tgtgactgaagaagatgagcct

SEQ ID NO: 4851637 - DNA, 18 bp, Homo sapiens
tgtgacttctcccctgcc

SEQ ID NO: 4851638 - DNA, 12 bp, Homo sapiens
tgtgacttttta

SEQ ID NO: 4851639 - DNA, 20 bp, Homo sapiens
tgtgagaatggcctggagca

SEQ ID NO: 4851640 - DNA, 13 bp, Homo sapiens
tgtgagagcccat

SEQ ID NO: 4851641 - DNA, 15 bp, Homo sapiens
tgtgaggacagggcc

SEQ ID NO: 4851642 - DNA, 22 bp, Homo sapiens
tgtgaggacagggcccccacag

SEQ ID NO: 4851643 - DNA, 12 bp, Homo sapiens
tgtgaggactgg

SEQ ID NO: 4851644 - DNA, 16 bp, Homo sapiens
tgtgaggatagagact

SEQ ID NO: 4851645 - DNA, 20 bp, Homo sapiens
tgtgaggatagagacttgca

SEQ ID NO: 4851646 - DNA, 13 bp, Homo sapiens
tgtgagtctggga

SEQ ID NO: 4851647 - DNA, 21 bp, Homo sapiens
tgtgagtttaccttgtatact

SEQ ID NO: 4851648 - DNA, 13 bp, Homo sapiens
tgtgatatataag

SEQ ID NO: 4851649 - DNA, 15 bp, Homo sapiens
tgtgatatataagtg

SEQ ID NO: 4851650 - DNA, 20 bp, Homo sapiens
tgtgatgttgtcttagcatg

SEQ ID NO: 4851651 - DNA, 13 bp, Homo sapiens
tgtgattactgca

SEQ ID NO: 4851652 - DNA, 15 bp, Homo sapiens
tgtgcagacagccat

SEQ ID NO: 4851653 - DNA, 18 bp, Homo sapiens
tgtgcagacagccatgcg

SEQ ID NO: 4851654 - DNA, 15 bp, Homo sapiens
tgtgcagtttggaat

SEQ ID NO: 4851655 - DNA, 14 bp, Homo sapiens
tgtgccaagagcta

SEQ ID NO: 4851656 - DNA, 23 bp, Homo sapiens
tgtgcccctaaagagcatcctga

SEQ ID NO: 4851657 - DNA, 14 bp, Homo sapiens
tgtgcctaatgtgt

SEQ ID NO: 4851658 - DNA, 15 bp, Homo sapiens
tgtgcctaatgtgtt

SEQ ID NO: 4851659 - DNA, 13 bp, Homo sapiens
tgtgccttccctt

SEQ ID NO: 4851660 - DNA, 17 bp, Homo sapiens
tgtgccttccctttcta

SEQ ID NO: 4851661 - DNA, 18 bp, Homo sapiens
tgtgctccacactcagaa

SEQ ID NO: 4851662 - DNA, 21 bp, Homo sapiens
tgtggaaagtcacaggtcaca

SEQ ID NO: 4851663 - DNA, 15 bp, Homo sapiens
tgtggagcagagctc

SEQ ID NO: 4851664 - DNA, 22 bp, Homo sapiens
tgtggcaaaaagagtcagacat

SEQ ID NO: 4851665 - DNA, 17 bp, Homo sapiens
tgtggccgtctcctccc

SEQ ID NO: 4851666 - DNA, 15 bp, Homo sapiens
tgtggcctgcaggag

SEQ ID NO: 4851667 - DNA, 16 bp, Homo sapiens
tgtggcctgcaggagg

SEQ ID NO: 4851668 - DNA, 14 bp, Homo sapiens
tgtggcctttatgt

SEQ ID NO: 4851669 - DNA, 21 bp, Homo sapiens
tgtggcctttatgttctttca

SEQ ID NO: 4851670 - DNA, 18 bp, Homo sapiens
tgtgggagacagcagcct

SEQ ID NO: 4851671 - DNA, 19 bp, Homo sapiens
tgtgggagacagcagcctg

SEQ ID NO: 4851672 - DNA, 12 bp, Homo sapiens
tgtgggcaaagt

SEQ ID NO: 4851673 - DNA, 13 bp, Homo sapiens
tgtggtctgccaa

SEQ ID NO: 4851674 - DNA, 23 bp, Homo sapiens
tgtgtaaattaatggtttattct

SEQ ID NO: 4851675 - DNA, 20 bp, Homo sapiens
tgtgtaaccagctcagtgtt

SEQ ID NO: 4851676 - DNA, 18 bp, Homo sapiens
tgtgtagctgcaaaaata

SEQ ID NO: 4851677 - DNA, 15 bp, Homo sapiens
tgtgtatataaacta

SEQ ID NO: 4851678 - DNA, 19 bp, Homo sapiens
tgtgtatatattttgtgtg

SEQ ID NO: 4851679 - DNA, 22 bp, Homo sapiens
tgtgtatatattttgtgtgaaa

SEQ ID NO: 4851680 - DNA, 16 bp, Homo sapiens
tgtgtcattagtcctt

SEQ ID NO: 4851681 - DNA, 13 bp, Homo sapiens
tgtgtctggccct

SEQ ID NO: 4851682 - DNA, 15 bp, Homo sapiens
tgtgtgattaaaagg

SEQ ID NO: 4851683 - DNA, 14 bp, Homo sapiens
tgtgtgattgaagg

SEQ ID NO: 4851684 - DNA, 23 bp, Homo sapiens
tgtgtggtcaacatttctcatgt

SEQ ID NO: 4851685 - DNA, 12 bp, Homo sapiens
tgtgtgtgtttt

SEQ ID NO: 4851686 - DNA, 22 bp, Homo sapiens
tgtgttcagaagaatcttcctg

SEQ ID NO: 4851687 - DNA, 15 bp, Homo sapiens
tgtgttttttaagat

SEQ ID NO: 4851688 - DNA, 20 bp, Homo sapiens
tgttaaaagttttatatgct

SEQ ID NO: 4851689 - DNA, 15 bp, Homo sapiens
tgttaaagagataaa

SEQ ID NO: 4851690 - DNA, 19 bp, Homo sapiens
tgttaaagagataaagaat

SEQ ID NO: 4851691 - DNA, 16 bp, Homo sapiens
tgttacgtagcctaag

SEQ ID NO: 4851692 - DNA, 12 bp, Homo sapiens
tgttagcagagt

SEQ ID NO: 4851693 - DNA, 13 bp, Homo sapiens
tgttatcaaaata

SEQ ID NO: 4851694 - DNA, 15 bp, Homo sapiens
tgttatttattgaaa

SEQ ID NO: 4851695 - DNA, 18 bp, Homo sapiens
tgttatttattgaaatga

SEQ ID NO: 4851696 - DNA, 13 bp, Homo sapiens
tgttcagaagaat

SEQ ID NO: 4851697 - DNA, 21 bp, Homo sapiens
tgttcaggaaaaggttgaata

SEQ ID NO: 4851698 - DNA, 19 bp, Homo sapiens
tgttccaagtctctgtgta

SEQ ID NO: 4851699 - DNA, 23 bp, Homo sapiens
tgttccattacaccacagcattg

SEQ ID NO: 4851700 - DNA, 22 bp, Homo sapiens
tgttcctactcacacttcagct

SEQ ID NO: 4851701 - DNA, 21 bp, Homo sapiens
tgttctccagtcattatgtta

SEQ ID NO: 4851702 - DNA, 20 bp, Homo sapiens
tgttctcctatatcctcctt

SEQ ID NO: 4851703 - DNA, 11 bp, Homo sapiens
tgttctttctg

SEQ ID NO: 4851704 - DNA, 22 bp, Homo sapiens
tgttgatgaggacccagagctg

SEQ ID NO: 4851705 - DNA, 23 bp, Homo sapiens
tgttgcactaaaatgaggatcca

SEQ ID NO: 4851706 - DNA, 15 bp, Homo sapiens
tgttgcagccgcaga

SEQ ID NO: 4851707 - DNA, 13 bp, Homo sapiens
tgttggaaagtaa

SEQ ID NO: 4851708 - DNA, 21 bp, Homo sapiens
tgttggagcagcaggcctctg

SEQ ID NO: 4851709 - DNA, 20 bp, Homo sapiens
tgttggggaagggcctgccc

SEQ ID NO: 4851710 - DNA, 15 bp, Homo sapiens
tgttggtgctttgca

SEQ ID NO: 4851711 - DNA, 18 bp, Homo sapiens
tgttgtaagaattctgat

SEQ ID NO: 4851712 - DNA, 22 bp, Homo sapiens
tgttgtgagaatggcctggagc

SEQ ID NO: 4851713 - DNA, 17 bp, Homo sapiens
tgtttaatgggtatgct

SEQ ID NO: 4851714 - DNA, 21 bp, Homo sapiens
tgtttacaaaaatttctgtaa

SEQ ID NO: 4851715 - DNA, 21 bp, Homo sapiens
tgtttacgatttcactaggac

SEQ ID NO: 4851716 - DNA, 14 bp, Homo sapiens
tgtttagattgtat

SEQ ID NO: 4851717 - DNA, 16 bp, Homo sapiens
tgtttataataaaaat

SEQ ID NO: 4851718 - DNA, 20 bp, Homo sapiens
tgtttctaccggagagagaa

SEQ ID NO: 4851719 - DNA, 24 bp, Homo sapiens
tgtttctctataaagtatggtaat

SEQ ID NO: 4851720 - DNA, 18 bp, Homo sapiens
tgtttgccaggacatgca

SEQ ID NO: 4851721 - DNA, 17 bp, Homo sapiens
tgtttggaaaagacagt

SEQ ID NO: 4851722 - DNA, 19 bp, Homo sapiens
tgtttggagacgtttataa

SEQ ID NO: 4851723 - DNA, 21 bp, Homo sapiens
tgtttgggaaaggcagggccc

SEQ ID NO: 4851724 - DNA, 18 bp, Homo sapiens
tgttttaaaacgtgtaaa

SEQ ID NO: 4851725 - DNA, 13 bp, Homo sapiens
tgttttaattgta

SEQ ID NO: 4851726 - DNA, 13 bp, Homo sapiens
tgttttcaaatgt

SEQ ID NO: 4851727 - DNA, 15 bp, Homo sapiens
tgttttggtggaaaa

SEQ ID NO: 4851728 - DNA, 15 bp, Homo sapiens
ttaaaaaagagacat

SEQ ID NO: 4851729 - DNA, 16 bp, Homo sapiens
ttaaaactaaatttca

SEQ ID NO: 4851730 - DNA, 17 bp, Homo sapiens
ttaaaatatttatttat

SEQ ID NO: 4851731 - DNA, 14 bp, Homo sapiens
ttaaacaaagtttc

SEQ ID NO: 4851732 - DNA, 12 bp, Homo sapiens
ttaaacttacaa

SEQ ID NO: 4851733 - DNA, 16 bp, Homo sapiens
ttaaagaaaggaaaag

SEQ ID NO: 4851734 - DNA, 18 bp, Homo sapiens
ttaaagacaggagacaaa

SEQ ID NO: 4851735 - DNA, 14 bp, Homo sapiens
ttaaagagaatgag

SEQ ID NO: 4851736 - DNA, 15 bp, Homo sapiens
ttaaagagaatgagt

SEQ ID NO: 4851737 - DNA, 13 bp, Homo sapiens
ttaaagagataaa

SEQ ID NO: 4851738 - DNA, 15 bp, Homo sapiens
ttaaagcatttccta

SEQ ID NO: 4851739 - DNA, 18 bp, Homo sapiens
ttaaagccattctgatta

SEQ ID NO: 4851740 - DNA, 17 bp, Homo sapiens
ttaaagggcccaatgaa

SEQ ID NO: 4851741 - DNA, 23 bp, Homo sapiens
ttaaagtatgcattattaaattg

SEQ ID NO: 4851742 - DNA, 13 bp, Homo sapiens
ttaaatcctttta

SEQ ID NO: 4851743 - DNA, 12 bp, Homo sapiens
ttaaatgaaaga

SEQ ID NO: 4851744 - DNA, 15 bp, Homo sapiens
ttaaattgtgtttta

SEQ ID NO: 4851745 - DNA, 15 bp, Homo sapiens
ttaaatttaatacca

SEQ ID NO: 4851746 - DNA, 12 bp, Homo sapiens
ttaacaggacag

SEQ ID NO: 4851747 - DNA, 21 bp, Homo sapiens
ttaaccggtaagagtttcagt

SEQ ID NO: 4851748 - DNA, 20 bp, Homo sapiens
ttaactaaattttaaagcca

SEQ ID NO: 4851749 - DNA, 20 bp, Homo sapiens
ttaactatcttctttggact

SEQ ID NO: 4851750 - DNA, 13 bp, Homo sapiens
ttaactgtggata

SEQ ID NO: 4851751 - DNA, 15 bp, Homo sapiens
ttaagaaatagaatt

SEQ ID NO: 4851752 - DNA, 16 bp, Homo sapiens
ttaagccttcaaaact

SEQ ID NO: 4851753 - DNA, 19 bp, Homo sapiens
ttaagctgcagagatttct

SEQ ID NO: 4851754 - DNA, 23 bp, Homo sapiens
ttaagctgcagagatttctcatt

SEQ ID NO: 4851755 - DNA, 23 bp, Homo sapiens
ttaagtcctaaaagttctcaatg

SEQ ID NO: 4851756 - DNA, 14 bp, Homo sapiens
ttaataaagatgag

SEQ ID NO: 4851757 - DNA, 15 bp, Homo sapiens
ttaataaagatgagt

SEQ ID NO: 4851758 - DNA, 16 bp, Homo sapiens
ttaatatattaaaatt

SEQ ID NO: 4851759 - DNA, 20 bp, Homo sapiens
ttaatatattaaaattccaa

SEQ ID NO: 4851760 - DNA, 18 bp, Homo sapiens
ttaatccagttataagaa

SEQ ID NO: 4851761 - DNA, 20 bp, Homo sapiens
ttaatccagttataagaaga

SEQ ID NO: 4851762 - DNA, 17 bp, Homo sapiens
ttaatccatttcaggac

SEQ ID NO: 4851763 - DNA, 20 bp, Homo sapiens
ttaatcttcaaagccttctc

SEQ ID NO: 4851764 - DNA, 18 bp, Homo sapiens
ttaatgcctgctttttgg

SEQ ID NO: 4851765 - DNA, 21 bp, Homo sapiens
ttaatgcctgctttttggaaa

SEQ ID NO: 4851766 - DNA, 20 bp, Homo sapiens
ttaattaatttggagcacaa

SEQ ID NO: 4851767 - DNA, 13 bp, Homo sapiens
ttaattttaaagt

SEQ ID NO: 4851768 - DNA, 19 bp, Homo sapiens
ttaattttaaagtgcaaaa

SEQ ID NO: 4851769 - DNA, 21 bp, Homo sapiens
ttacaatattgattgggaaaa

SEQ ID NO: 4851770 - DNA, 23 bp, Homo sapiens
ttacagctctcctccagccctgg

SEQ ID NO: 4851771 - DNA, 14 bp, Homo sapiens
ttacagctgtgctc

SEQ ID NO: 4851772 - DNA, 11 bp, Homo sapiens
ttacaggagcc

SEQ ID NO: 4851773 - DNA, 13 bp, Homo sapiens
ttacaggagccag

SEQ ID NO: 4851774 - DNA, 14 bp, Homo sapiens
ttacaggagccagc

SEQ ID NO: 4851775 - DNA, 19 bp, Homo sapiens
ttaccccaaagagaaagag

SEQ ID NO: 4851776 - DNA, 21 bp, Homo sapiens
ttacctccatccatccttcca

SEQ ID NO: 4851777 - DNA, 13 bp, Homo sapiens
ttacctggagaag

SEQ ID NO: 4851778 - DNA, 17 bp, Homo sapiens
ttacctggcctagaaag

SEQ ID NO: 4851779 - DNA, 19 bp, Homo sapiens
ttacctgtgaagtgttact

SEQ ID NO: 4851780 - DNA, 17 bp, Homo sapiens
ttacgatttcactagga

SEQ ID NO: 4851781 - DNA, 18 bp, Homo sapiens
ttacgatttcactaggac

SEQ ID NO: 4851782 - DNA, 17 bp, Homo sapiens
ttactaaaaaaaagatg

SEQ ID NO: 4851783 - DNA, 15 bp, Homo sapiens
ttactaaaaagtata

SEQ ID NO: 4851784 - DNA, 22 bp, Homo sapiens
ttactccaggttattgcaataa

SEQ ID NO: 4851785 - DNA, 12 bp, Homo sapiens
ttactgatgaga

SEQ ID NO: 4851786 - DNA, 13 bp, Homo sapiens
ttacttatgtaga

SEQ ID NO: 4851787 - DNA, 13 bp, Homo sapiens
ttagaaatattca

SEQ ID NO: 4851788 - DNA, 15 bp, Homo sapiens
ttagaaatattcaca

SEQ ID NO: 4851789 - DNA, 19 bp, Homo sapiens
ttagaaattacctgtggat

SEQ ID NO: 4851790 - DNA, 13 bp, Homo sapiens
ttagactcaaaga

SEQ ID NO: 4851791 - DNA, 13 bp, Homo sapiens
ttagattgagaaa

SEQ ID NO: 4851792 - DNA, 12 bp, Homo sapiens
ttagcagagtct

SEQ ID NO: 4851793 - DNA, 16 bp, Homo sapiens
ttagctgaagaattga

SEQ ID NO: 4851794 - DNA, 15 bp, Homo sapiens
ttagcttacctgggc

SEQ ID NO: 4851795 - DNA, 16 bp, Homo sapiens
ttagcttacctgggca

SEQ ID NO: 4851796 - DNA, 15 bp, Homo sapiens
ttaggggaactgggt

SEQ ID NO: 4851797 - DNA, 16 bp, Homo sapiens
ttaggtttcaggaagt

SEQ ID NO: 4851798 - DNA, 13 bp, Homo sapiens
ttagtattatctt

SEQ ID NO: 4851799 - DNA, 18 bp, Homo sapiens
ttagtttttggttgggaa

SEQ ID NO: 4851800 - DNA, 23 bp, Homo sapiens
ttataaatgtaccagagagagtt

SEQ ID NO: 4851801 - DNA, 21 bp, Homo sapiens
ttataatactactactgttat

SEQ ID NO: 4851802 - DNA, 20 bp, Homo sapiens
ttataattgtacaaaattaa

SEQ ID NO: 4851803 - DNA, 20 bp, Homo sapiens
ttatatgctttattaatgtt

SEQ ID NO: 4851804 - DNA, 18 bp, Homo sapiens
ttatattaaataacatgt

SEQ ID NO: 4851805 - DNA, 17 bp, Homo sapiens
ttatatttttttaactg

SEQ ID NO: 4851806 - DNA, 20 bp, Homo sapiens
ttatatttttttaactgtga

SEQ ID NO: 4851807 - DNA, 20 bp, Homo sapiens
ttatcaaaatagtctaaggc

SEQ ID NO: 4851808 - DNA, 14 bp, Homo sapiens
ttatctctttccac

SEQ ID NO: 4851809 - DNA, 15 bp, Homo sapiens
ttatcttacaatatt

SEQ ID NO: 4851810 - DNA, 18 bp, Homo sapiens
ttatgagggccacgggtc

SEQ ID NO: 4851811 - DNA, 17 bp, Homo sapiens
ttatgatgacaatcaaa

SEQ ID NO: 4851812 - DNA, 21 bp, Homo sapiens
ttatgcaattcagtgttccaa

SEQ ID NO: 4851813 - DNA, 19 bp, Homo sapiens
ttatgttgtttataataaa

SEQ ID NO: 4851814 - DNA, 17 bp, Homo sapiens
ttattaaatgcttcatt

SEQ ID NO: 4851815 - DNA, 19 bp, Homo sapiens
ttattaagctttttggaat

SEQ ID NO: 4851816 - DNA, 16 bp, Homo sapiens
ttattaatgttttcaa

SEQ ID NO: 4851817 - DNA, 16 bp, Homo sapiens
tgcatattataaagga

SEQ ID NO: 4851818 - DNA, 21 bp, Homo sapiens
tgcatcactgtatcattttct

SEQ ID NO: 4851819 - DNA, 15 bp, Homo sapiens
tgcattattaaattg

SEQ ID NO: 4851820 - DNA, 17 bp, Homo sapiens
tgcattttgatattgct

SEQ ID NO: 4851821 - DNA, 19 bp, Homo sapiens
tgcattttgatattgctgt

SEQ ID NO: 4851822 - DNA, 16 bp, Homo sapiens
tgccaaaggatgtgat

SEQ ID NO: 4851823 - DNA, 19 bp, Homo sapiens
tgccaaaggatgtgatata

SEQ ID NO: 4851824 - DNA, 11 bp, Homo sapiens
tgccaaagtac

SEQ ID NO: 4851825 - DNA, 12 bp, Homo sapiens
tgccaagagcta

SEQ ID NO: 4851826 - DNA, 22 bp, Homo sapiens
tgccaagagctactcccacagc

SEQ ID NO: 4851827 - DNA, 14 bp, Homo sapiens
tgccaataaagtga

SEQ ID NO: 4851828 - DNA, 22 bp, Homo sapiens
tgccacatcaaacctttgagta

SEQ ID NO: 4851829 - DNA, 12 bp, Homo sapiens
tgccactgttgt

SEQ ID NO: 4851830 - DNA, 19 bp, Homo sapiens
tgccagccccctaaaagca

SEQ ID NO: 4851831 - DNA, 22 bp, Homo sapiens
tgccagccccctaaaagcactc

SEQ ID NO: 4851832 - DNA, 23 bp, Homo sapiens
tgccagccccctaaaagcactcc

SEQ ID NO: 4851833 - DNA, 17 bp, Homo sapiens
tgccagctgcagcctgg

SEQ ID NO: 4851834 - DNA, 20 bp, Homo sapiens
tgccaggggctctgtggcaa

SEQ ID NO: 4851835 - DNA, 18 bp, Homo sapiens
tgccagtatttttaaagg

SEQ ID NO: 4851836 - DNA, 16 bp, Homo sapiens
tgccatctatctagtt

SEQ ID NO: 4851837 - DNA, 22 bp, Homo sapiens
tgccatggctaggtagaagtga

SEQ ID NO: 4851838 - DNA, 19 bp, Homo sapiens
tgccattggggtagttgtg

SEQ ID NO: 4851839 - DNA, 15 bp, Homo sapiens
tgcccaatgaataat

SEQ ID NO: 4851840 - DNA, 20 bp, Homo sapiens
tgcccacaactcccttgcac

SEQ ID NO: 4851841 - DNA, 19 bp, Homo sapiens
tgcccagcccctggtggtg

SEQ ID NO: 4851842 - DNA, 15 bp, Homo sapiens
tgcccagtacattta

SEQ ID NO: 4851843 - DNA, 18 bp, Homo sapiens
tgccccaagtggtgagca

SEQ ID NO: 4851844 - DNA, 14 bp, Homo sapiens
tgcccgcctaagac

SEQ ID NO: 4851845 - DNA, 15 bp, Homo sapiens
tgccctcctctccct

SEQ ID NO: 4851846 - DNA, 17 bp, Homo sapiens
tgccctctgctctgcct

SEQ ID NO: 4851847 - DNA, 20 bp, Homo sapiens
tgccctctgctctgcctgga

SEQ ID NO: 4851848 - DNA, 22 bp, Homo sapiens
tgccctctgctctgcctggagt

SEQ ID NO: 4851849 - DNA, 19 bp, Homo sapiens
tgccctgcgtcccttctct

SEQ ID NO: 4851850 - DNA, 13 bp, Homo sapiens
tgccctgggccac

SEQ ID NO: 4851851 - DNA, 17 bp, Homo sapiens
tgccctttcctggcagt

SEQ ID NO: 4851852 - DNA, 14 bp, Homo sapiens
tgccctttggggtc

SEQ ID NO: 4851853 - DNA, 19 bp, Homo sapiens
tgccgtagcttcagccagg

SEQ ID NO: 4851854 - DNA, 15 bp, Homo sapiens
tgcctaacctgggac

SEQ ID NO: 4851855 - DNA, 12 bp, Homo sapiens
tgcctcaggacc

SEQ ID NO: 4851856 - DNA, 22 bp, Homo sapiens
tgcctcaggccaagggaccagg

SEQ ID NO: 4851857 - DNA, 22 bp, Homo sapiens
tgcctccaggaccttgcttcct

SEQ ID NO: 4851858 - DNA, 19 bp, Homo sapiens
tgcctcggacagtccgcag

SEQ ID NO: 4851859 - DNA, 10 bp, Homo sapiens
tgcctctgtc

SEQ ID NO: 4851860 - DNA, 21 bp, Homo sapiens
tgcctgctttttggaaagtca

SEQ ID NO: 4851861 - DNA, 22 bp, Homo sapiens
tgcctgctttttggaaagtcag

SEQ ID NO: 4851862 - DNA, 10 bp, Homo sapiens
tgcctggagg

SEQ ID NO: 4851863 - DNA, 20 bp, Homo sapiens
tgcctggaggctcctctagg

SEQ ID NO: 4851864 - DNA, 14 bp, Homo sapiens
tgcctggagtgtcg

SEQ ID NO: 4851865 - DNA, 11 bp, Homo sapiens
tgcctgggctc

SEQ ID NO: 4851866 - DNA, 14 bp, Homo sapiens
tgcctgggctcagc

SEQ ID NO: 4851867 - DNA, 19 bp, Homo sapiens
tgcgaccttaatttaactt

SEQ ID NO: 4851868 - DNA, 15 bp, Homo sapiens
tgcggcaaaaggaaa

SEQ ID NO: 4851869 - DNA, 23 bp, Homo sapiens
tgcgtcccttctctttggggctc

SEQ ID NO: 4851870 - DNA, 24 bp, Homo sapiens
tgcgtggccacgggggcagtgtga

SEQ ID NO: 4851871 - DNA, 16 bp, Homo sapiens
tgctaacatctaaaaa

SEQ ID NO: 4851872 - DNA, 19 bp, Homo sapiens
tgctaaggctcctccttgc

SEQ ID NO: 4851873 - DNA, 20 bp, Homo sapiens
tgctaagtcattggcaaagt

SEQ ID NO: 4851874 - DNA, 23 bp, Homo sapiens
tgctaagtgcttattacatttta

SEQ ID NO: 4851875 - DNA, 13 bp, Homo sapiens
tgctaatttgttt

SEQ ID NO: 4851876 - DNA, 20 bp, Homo sapiens
tgctactgttgtaagaattc

SEQ ID NO: 4851877 - DNA, 21 bp, Homo sapiens
tgctactgttgtaagaattct

SEQ ID NO: 4851878 - DNA, 12 bp, Homo sapiens
tgctacttccca

SEQ ID NO: 4851879 - DNA, 16 bp, Homo sapiens
tgctagatccagccca

SEQ ID NO: 4851880 - DNA, 14 bp, Homo sapiens
tgctatacacacac

SEQ ID NO: 4851881 - DNA, 23 bp, Homo sapiens
tgctcaactctacccctgctccc

SEQ ID NO: 4851882 - DNA, 17 bp, Homo sapiens
tgctcacgtcaaatgca

SEQ ID NO: 4851883 - DNA, 19 bp, Homo sapiens
tgctccacactcagaaaat

SEQ ID NO: 4851884 - DNA, 17 bp, Homo sapiens
tgctcccattcctccct

SEQ ID NO: 4851885 - DNA, 18 bp, Homo sapiens
tgctcccctaaagccagg

SEQ ID NO: 4851886 - DNA, 16 bp, Homo sapiens
tgctcctcacctgtct

SEQ ID NO: 4851887 - DNA, 20 bp, Homo sapiens
tgctcctcttgttcctgaaa

SEQ ID NO: 4851888 - DNA, 18 bp, Homo sapiens
tgctcctttaccctcttg

SEQ ID NO: 4851889 - DNA, 20 bp, Homo sapiens
tgctcggctactggttacct

SEQ ID NO: 4851890 - DNA, 14 bp, Homo sapiens
tgctctatactgtg

SEQ ID NO: 4851891 - DNA, 13 bp, Homo sapiens
tgctctgcctgga

SEQ ID NO: 4851892 - DNA, 16 bp, Homo sapiens
tgctctggagcagcca

SEQ ID NO: 4851893 - DNA, 21 bp, Homo sapiens
tgctgataccatatgaatgaa

SEQ ID NO: 4851894 - DNA, 22 bp, Homo sapiens
tgctgataccatatgaatgaaa

SEQ ID NO: 4851895 - DNA, 19 bp, Homo sapiens
tgctgatcagagttcctcc

SEQ ID NO: 4851896 - DNA, 20 bp, Homo sapiens
tgctgatcagagttcctcct

SEQ ID NO: 4851897 - DNA, 14 bp, Homo sapiens
tgctgcaacccaag

SEQ ID NO: 4851898 - DNA, 22 bp, Homo sapiens
tgctgcaaggtggcctctgcct

SEQ ID NO: 4851899 - DNA, 23 bp, Homo sapiens
tgctgcaaggtggcctctgcctg

SEQ ID NO: 4851900 - DNA, 15 bp, Homo sapiens
tgctgccttgcttct

SEQ ID NO: 4851901 - DNA, 16 bp, Homo sapiens
tgctgctactgctgct

SEQ ID NO: 4851902 - DNA, 16 bp, Homo sapiens
tgctgctgccgccgcc

SEQ ID NO: 4851903 - DNA, 23 bp, Homo sapiens
tgctgcttttgggggtcagcatc

SEQ ID NO: 4851904 - DNA, 20 bp, Homo sapiens
tgctgggcgtgtgtgacact

SEQ ID NO: 4851905 - DNA, 21 bp, Homo sapiens
tgctgggcgtgtgtgacactg

SEQ ID NO: 4851906 - DNA, 13 bp, Homo sapiens
tgctggggctgca

SEQ ID NO: 4851907 - DNA, 14 bp, Homo sapiens
tgctgtacaaaagc

SEQ ID NO: 4851908 - DNA, 18 bp, Homo sapiens
tgctgtctaacctgtgac

SEQ ID NO: 4851909 - DNA, 21 bp, Homo sapiens
tgctgtcttaaactaaatgtg

SEQ ID NO: 4851910 - DNA, 23 bp, Homo sapiens
tgctgtgctttggaacaatcaca

SEQ ID NO: 4851911 - DNA, 12 bp, Homo sapiens
tgctgttgctta

SEQ ID NO: 4851912 - DNA, 21 bp, Homo sapiens
tgcttaaaccacttaaacgaa

SEQ ID NO: 4851913 - DNA, 15 bp, Homo sapiens
tgcttaattgctgat

SEQ ID NO: 4851914 - DNA, 14 bp, Homo sapiens
tgcttcccacaact

SEQ ID NO: 4851915 - DNA, 20 bp, Homo sapiens
tgcttcctgatgctgggcaa

SEQ ID NO: 4851916 - DNA, 15 bp, Homo sapiens
tgcttcgactactgc

SEQ ID NO: 4851917 - DNA, 19 bp, Homo sapiens
tgcttgactttccagaatg

SEQ ID NO: 4851918 - DNA, 17 bp, Homo sapiens
tgcttgatatcccaagt

SEQ ID NO: 4851919 - DNA, 18 bp, Homo sapiens
tgcttgccaaagtacaga

SEQ ID NO: 4851920 - DNA, 19 bp, Homo sapiens
tgcttgcggcaaaaggaaa

SEQ ID NO: 4851921 - DNA, 23 bp, Homo sapiens
tgcttggcccttcaagggtcagg

SEQ ID NO: 4851922 - DNA, 22 bp, Homo sapiens
tgcttgtcttctggtactttct

SEQ ID NO: 4851923 - DNA, 15 bp, Homo sapiens
tgctttattaatgtt

SEQ ID NO: 4851924 - DNA, 18 bp, Homo sapiens
tgctttattaatgttttc

SEQ ID NO: 4851925 - DNA, 17 bp, Homo sapiens
tgctttctttgacctct

SEQ ID NO: 4851926 - DNA, 19 bp, Homo sapiens
tgcttttagtgtgtgcata

SEQ ID NO: 4851927 - DNA, 15 bp, Homo sapiens
tgcttttggcagaga

SEQ ID NO: 4851928 - DNA, 14 bp, Homo sapiens
tgctttttccaact

SEQ ID NO: 4851929 - DNA, 21 bp, Homo sapiens
tgctttttccaactcagaaat

SEQ ID NO: 4851930 - DNA, 14 bp, Homo sapiens
tgctttttggaaag

SEQ ID NO: 4851931 - DNA, 21 bp, Homo sapiens
tggaaaacagcgaacagcctt

SEQ ID NO: 4851932 - DNA, 15 bp, Homo sapiens
tggaaagtaactgtg

SEQ ID NO: 4851933 - DNA, 22 bp, Homo sapiens
tggaaatggggaactcccccag

SEQ ID NO: 4851934 - DNA, 22 bp, Homo sapiens
tggaaattcctgtactgtgtct

SEQ ID NO: 4851935 - DNA, 17 bp, Homo sapiens
tggaaccacattgaaga

SEQ ID NO: 4851936 - DNA, 21 bp, Homo sapiens
tgggcattagcaaggcagagc

SEQ ID NO: 4851937 - DNA, 15 bp, Homo sapiens
tgggcccaggggctg

SEQ ID NO: 4851938 - DNA, 13 bp, Homo sapiens
tgggccctctctc

SEQ ID NO: 4851939 - DNA, 16 bp, Homo sapiens
tgggccctctctctgg

SEQ ID NO: 4851940 - DNA, 14 bp, Homo sapiens
tgggcctcccctgg

SEQ ID NO: 4851941 - DNA, 16 bp, Homo sapiens
tgggcctcccctgggc

SEQ ID NO: 4851942 - DNA, 20 bp, Homo sapiens
tgggcctctcctgccctctg

SEQ ID NO: 4851943 - DNA, 21 bp, Homo sapiens
tgggcctctcctgccctctgc

SEQ ID NO: 4851944 - DNA, 20 bp, Homo sapiens
tgggcgtgtgtgacactgat

SEQ ID NO: 4851945 - DNA, 14 bp, Homo sapiens
tgggctaggcctcc

SEQ ID NO: 4851946 - DNA, 15 bp, Homo sapiens
tgggctgtgaggaca

SEQ ID NO: 4851947 - DNA, 20 bp, Homo sapiens
tgggcttcaacagccaagct

SEQ ID NO: 4851948 - DNA, 22 bp, Homo sapiens
tgggctttgttgtgagaatggc

SEQ ID NO: 4851949 - DNA, 21 bp, Homo sapiens
tggggaaacaacatttatatg

SEQ ID NO: 4851950 - DNA, 15 bp, Homo sapiens
tggggaacggaggag

SEQ ID NO: 4851951 - DNA, 19 bp, Homo sapiens
tggggaacggaggaggaca

SEQ ID NO: 4851952 - DNA, 18 bp, Homo sapiens
tggggaactcccccagag

SEQ ID NO: 4851953 - DNA, 16 bp, Homo sapiens
tggggaaggggcctgg

SEQ ID NO: 4851954 - DNA, 17 bp, Homo sapiens
tggggaaggggcctggg

SEQ ID NO: 4851955 - DNA, 19 bp, Homo sapiens
tggggaaggggcctgggct

SEQ ID NO: 4851956 - DNA, 20 bp, Homo sapiens
tggggaaggggcctgggctg

SEQ ID NO: 4851957 - DNA, 18 bp, Homo sapiens
tggggacacaggatcctg

SEQ ID NO: 4851958 - DNA, 14 bp, Homo sapiens
tggggaggcctcac

SEQ ID NO: 4851959 - DNA, 16 bp, Homo sapiens
tggggaggttgtgggg

SEQ ID NO: 4851960 - DNA, 13 bp, Homo sapiens
tggggcctcagcc

SEQ ID NO: 4851961 - DNA, 16 bp, Homo sapiens
tggggcctcaggctcc

SEQ ID NO: 4851962 - DNA, 16 bp, Homo sapiens
tggggcctccagaagc

SEQ ID NO: 4851963 - DNA, 23 bp, Homo sapiens
tggggctgagccctcctgagggc

SEQ ID NO: 4851964 - DNA, 12 bp, Homo sapiens
tgggggcctctc

SEQ ID NO: 4851965 - DNA, 16 bp, Homo sapiens
tggggggcaggcctcc

SEQ ID NO: 4851966 - DNA, 15 bp, Homo sapiens
tggggggcattgagt

SEQ ID NO: 4851967 - DNA, 22 bp, Homo sapiens
tgggggtcagcatccagtgtga

SEQ ID NO: 4851968 - DNA, 18 bp, Homo sapiens
tggggtgctggggctgca

SEQ ID NO: 4851969 - DNA, 22 bp, Homo sapiens
tgggtagggtagtggctggggt

SEQ ID NO: 4851970 - DNA, 15 bp, Homo sapiens
tgggtatgctcaggt

SEQ ID NO: 4851971 - DNA, 17 bp, Homo sapiens
tgggtgctagatccagc

SEQ ID NO: 4851972 - DNA, 23 bp, Homo sapiens
tgggtggaagtgtgtgccaagag

SEQ ID NO: 4851973 - DNA, 18 bp, Homo sapiens
tgggtggctcactactga

SEQ ID NO: 4851974 - DNA, 23 bp, Homo sapiens
tgggtgtttgggaaaggcagggc

SEQ ID NO: 4851975 - DNA, 21 bp, Homo sapiens
tggtcatgtgagtctgggata

SEQ ID NO: 4851976 - DNA, 13 bp, Homo sapiens
tggtcccatggct

SEQ ID NO: 4851977 - DNA, 19 bp, Homo sapiens
tggtcccatggctgaagct

SEQ ID NO: 4851978 - DNA, 17 bp, Homo sapiens
tggtctggttcctgtgt

SEQ ID NO: 4851979 - DNA, 15 bp, Homo sapiens
tggtgaaggggctgg

SEQ ID NO: 4851980 - DNA, 19 bp, Homo sapiens
tggtgatttgaaaaatata

SEQ ID NO: 4851981 - DNA, 18 bp, Homo sapiens
tggtgctgccttgcttct

SEQ ID NO: 4851982 - DNA, 22 bp, Homo sapiens
tggtggaaaaaacattttaagt

SEQ ID NO: 4851983 - DNA, 17 bp, Homo sapiens
tggtggctcatgcctgt

SEQ ID NO: 4851984 - DNA, 22 bp, Homo sapiens
tggtgggtctatgttccccagg

SEQ ID NO: 4851985 - DNA, 18 bp, Homo sapiens
tggtgtaatctcaatgca

SEQ ID NO: 4851986 - DNA, 18 bp, Homo sapiens
tggtgtgaatttgccaga

SEQ ID NO: 4851987 - DNA, 14 bp, Homo sapiens
tggtgtgtgaagtt

SEQ ID NO: 4851988 - DNA, 14 bp, Homo sapiens
tggtgttgcagccg

SEQ ID NO: 4851989 - DNA, 22 bp, Homo sapiens
tggtgttgcagccgcagagaaa

SEQ ID NO: 4851990 - DNA, 13 bp, Homo sapiens
tggtgtttattgc

SEQ ID NO: 4851991 - DNA, 22 bp, Homo sapiens
tggttaatttttcctgcatgtt

SEQ ID NO: 4851992 - DNA, 14 bp, Homo sapiens
tggttacctggaga

SEQ ID NO: 4851993 - DNA, 19 bp, Homo sapiens
tggttctgaggccagaaag

SEQ ID NO: 4851994 - DNA, 18 bp, Homo sapiens
tggttgatgtttaaagag

SEQ ID NO: 4851995 - DNA, 20 bp, Homo sapiens
tggtttggaatattaaaaaa

SEQ ID NO: 4851996 - DNA, 16 bp, Homo sapiens
tgtaaaaatcttttga

SEQ ID NO: 4851997 - DNA, 13 bp, Homo sapiens
tgtaaatgaagat

SEQ ID NO: 4851998 - DNA, 20 bp, Homo sapiens
tgtaaatgaagatctttata

SEQ ID NO: 4851999 - DNA, 16 bp, Homo sapiens
tgtaacatgatttccc

SEQ ID NO: 4852000 - DNA, 15 bp, Homo sapiens
tgtaacttccaaata

SEQ ID NO: 4852001 - DNA, 20 bp, Homo sapiens
tgtaacttccaaataaataa

SEQ ID NO: 4852002 - DNA, 14 bp, Homo sapiens
tgtaacttcctgtg

SEQ ID NO: 4852003 - DNA, 17 bp, Homo sapiens
tgtaagaattctgattg

SEQ ID NO: 4852004 - DNA, 21 bp, Homo sapiens
tgtaaggatccggaaagaaga

SEQ ID NO: 4852005 - DNA, 16 bp, Homo sapiens
tgtaagtttgtgtaaa

SEQ ID NO: 4852006 - DNA, 20 bp, Homo sapiens
tgtaatccaggggtgtagat

SEQ ID NO: 4852007 - DNA, 16 bp, Homo sapiens
tgtaatctcaatgcaa

SEQ ID NO: 4852008 - DNA, 18 bp, Homo sapiens
tgtaatgctgcctcagga

SEQ ID NO: 4852009 - DNA, 22 bp, Homo sapiens
tgtaatgctgcctcaggaccca

SEQ ID NO: 4852010 - DNA, 15 bp, Homo sapiens
tgtaatttaaatgaa

SEQ ID NO: 4852011 - DNA, 16 bp, Homo sapiens
tgtaatttaaatgaaa

SEQ ID NO: 4852012 - DNA, 17 bp, Homo sapiens
tgtaatttaaatgaaag

SEQ ID NO: 4852013 - DNA, 12 bp, Homo sapiens
tcctccagctgg

SEQ ID NO: 4852014 - DNA, 13 bp, Homo sapiens
tcctcctcccaag

SEQ ID NO: 4852015 - DNA, 16 bp, Homo sapiens
tcctcctctcaaacct

SEQ ID NO: 4852016 - DNA, 21 bp, Homo sapiens
tcctctcggctgccaggggct

SEQ ID NO: 4852017 - DNA, 23 bp, Homo sapiens
tcctctcggctgccaggggctct

SEQ ID NO: 4852018 - DNA, 14 bp, Homo sapiens
tcctctcttgggta

SEQ ID NO: 4852019 - DNA, 20 bp, Homo sapiens
tcctcttgtctgatttctta

SEQ ID NO: 4852020 - DNA, 21 bp, Homo sapiens
tcctcttgttcctgaaatgtg

SEQ ID NO: 4852021 - DNA, 19 bp, Homo sapiens
tcctctttagtttttggtt

SEQ ID NO: 4852022 - DNA, 18 bp, Homo sapiens
tcctgaaatgtgtttcct

SEQ ID NO: 4852023 - DNA, 19 bp, Homo sapiens
tcctgataccattctattc

SEQ ID NO: 4852024 - DNA, 15 bp, Homo sapiens
tcctgatgcccctga

SEQ ID NO: 4852025 - DNA, 18 bp, Homo sapiens
tcctgatggagtgtgcag

SEQ ID NO: 4852026 - DNA, 17 bp, Homo sapiens
tcctgccctctgctctg

SEQ ID NO: 4852027 - DNA, 20 bp, Homo sapiens
tcctgctccctgtggcactc

SEQ ID NO: 4852028 - DNA, 17 bp, Homo sapiens
tcctgctgctgctactg

SEQ ID NO: 4852029 - DNA, 18 bp, Homo sapiens
tcctggcacaatgttgga

SEQ ID NO: 4852030 - DNA, 22 bp, Homo sapiens
tcctggcacaatgttggagcag

SEQ ID NO: 4852031 - DNA, 10 bp, Homo sapiens
tcctggcagt

SEQ ID NO: 4852032 - DNA, 11 bp, Homo sapiens
tcctggcctga

SEQ ID NO: 4852033 - DNA, 14 bp, Homo sapiens
tcctggcctgagaa

SEQ ID NO: 4852034 - DNA, 14 bp, Homo sapiens
tcctgggtttccat

SEQ ID NO: 4852035 - DNA, 22 bp, Homo sapiens
tcctgtctaacttggggaaggg

SEQ ID NO: 4852036 - DNA, 15 bp, Homo sapiens
tcctgtcttctttct

SEQ ID NO: 4852037 - DNA, 16 bp, Homo sapiens
tcctgtcttctttctc

SEQ ID NO: 4852038 - DNA, 22 bp, Homo sapiens
tcctgtcttctttctccatgga

SEQ ID NO: 4852039 - DNA, 10 bp, Homo sapiens
tcctgtgagg

SEQ ID NO: 4852040 - DNA, 23 bp, Homo sapiens
tcctgtgaggatagagacttgca

SEQ ID NO: 4852041 - DNA, 16 bp, Homo sapiens
tcctgtggcaggaggc

SEQ ID NO: 4852042 - DNA, 20 bp, Homo sapiens
tcctgttccatttcagttca

SEQ ID NO: 4852043 - DNA, 18 bp, Homo sapiens
tcctgtttcctagctgtg

SEQ ID NO: 4852044 - DNA, 17 bp, Homo sapiens
tcctgttttgcacagcc

SEQ ID NO: 4852045 - DNA, 13 bp, Homo sapiens
tccttcaggcagc

SEQ ID NO: 4852046 - DNA, 17 bp, Homo sapiens
tccttcaggcagctgaa

SEQ ID NO: 4852047 - DNA, 19 bp, Homo sapiens
tccttcatgacagcctcca

SEQ ID NO: 4852048 - DNA, 14 bp, Homo sapiens
tccttcccccagca

SEQ ID NO: 4852049 - DNA, 22 bp, Homo sapiens
tccttcccccagcacaaagcac

SEQ ID NO: 4852050 - DNA, 14 bp, Homo sapiens
tccttctcatcttg

SEQ ID NO: 4852051 - DNA, 21 bp, Homo sapiens
tccttctcatcttgcctcatt

SEQ ID NO: 4852052 - DNA, 15 bp, Homo sapiens
tccttctgaagtgtt

SEQ ID NO: 4852053 - DNA, 19 bp, Homo sapiens
tccttctgcagtcagactg

SEQ ID NO: 4852054 - DNA, 20 bp, Homo sapiens
tccttctgcagtcagactga

SEQ ID NO: 4852055 - DNA, 22 bp, Homo sapiens
tccttctttctagttcagctgc

SEQ ID NO: 4852056 - DNA, 14 bp, Homo sapiens
tccttgatttcaaa

SEQ ID NO: 4852057 - DNA, 18 bp, Homo sapiens
tccttggattttcctgaa

SEQ ID NO: 4852058 - DNA, 15 bp, Homo sapiens
tcctttgaagaaggc

SEQ ID NO: 4852059 - DNA, 16 bp, Homo sapiens
tcgacctccccacccg

SEQ ID NO: 4852060 - DNA, 16 bp, Homo sapiens
tcgactactgctcctg

SEQ ID NO: 4852061 - DNA, 16 bp, Homo sapiens
tcgactcagcctcagg

SEQ ID NO: 4852062 - DNA, 12 bp, Homo sapiens
tcgagagcctta

SEQ ID NO: 4852063 - DNA, 18 bp, Homo sapiens
tcgagtgtagctgtgaaa

SEQ ID NO: 4852064 - DNA, 13 bp, Homo sapiens
tcggaaacactga

SEQ ID NO: 4852065 - DNA, 22 bp, Homo sapiens
tcggcagatgatgctttggaag

SEQ ID NO: 4852066 - DNA, 22 bp, Homo sapiens
tcggctactggttacctggaga

SEQ ID NO: 4852067 - DNA, 12 bp, Homo sapiens
tcggctgccagg

SEQ ID NO: 4852068 - DNA, 12 bp, Homo sapiens
tcgggaagcaga

SEQ ID NO: 4852069 - DNA, 23 bp, Homo sapiens
tctaaactccctggctgttctga

SEQ ID NO: 4852070 - DNA, 13 bp, Homo sapiens
tctaaagagcatc

SEQ ID NO: 4852071 - DNA, 14 bp, Homo sapiens
tctaaagagcatct

SEQ ID NO: 4852072 - DNA, 22 bp, Homo sapiens
tctaacagtgaagttttactgt

SEQ ID NO: 4852073 - DNA, 18 bp, Homo sapiens
tctaaccaaggctgtgtt

SEQ ID NO: 4852074 - DNA, 20 bp, Homo sapiens
tctaaccaaggctgtgttta

SEQ ID NO: 4852075 - DNA, 14 bp, Homo sapiens
tctaagcaaccaca

SEQ ID NO: 4852076 - DNA, 13 bp, Homo sapiens
tgactccaaagct

SEQ ID NO: 4852077 - DNA, 18 bp, Homo sapiens
tgactccagggtgacaag

SEQ ID NO: 4852078 - DNA, 23 bp, Homo sapiens
tgactccttatctctttccacca

SEQ ID NO: 4852079 - DNA, 20 bp, Homo sapiens
tgactcttagccctcaccac

SEQ ID NO: 4852080 - DNA, 21 bp, Homo sapiens
tgactcttagccctcaccaca

SEQ ID NO: 4852081 - DNA, 22 bp, Homo sapiens
tgactcttagccctcaccacag

SEQ ID NO: 4852082 - DNA, 22 bp, Homo sapiens
tgactcttatttatagaattta

SEQ ID NO: 4852083 - DNA, 14 bp, Homo sapiens
tgacttatggcatg

SEQ ID NO: 4852084 - DNA, 14 bp, Homo sapiens
tgacttctcccctg

SEQ ID NO: 4852085 - DNA, 14 bp, Homo sapiens
tgactttccagaat

SEQ ID NO: 4852086 - DNA, 13 bp, Homo sapiens
tgagaaaaactaa

SEQ ID NO: 4852087 - DNA, 20 bp, Homo sapiens
tgagaaacactatttgtgac

SEQ ID NO: 4852088 - DNA, 23 bp, Homo sapiens
tgagaaacactatttgtgacttt

SEQ ID NO: 4852089 - DNA, 18 bp, Homo sapiens
tgagaaagctaaagtttg

SEQ ID NO: 4852090 - DNA, 20 bp, Homo sapiens
tgagaagtacagggcagaac

SEQ ID NO: 4852091 - DNA, 13 bp, Homo sapiens
tgagaatggcctg

SEQ ID NO: 4852092 - DNA, 17 bp, Homo sapiens
tgagaatggcctggagc

SEQ ID NO: 4852093 - DNA, 20 bp, Homo sapiens
tgagaatggcctggagcagg

SEQ ID NO: 4852094 - DNA, 21 bp, Homo sapiens
tgagaatggcctggagcaggc

SEQ ID NO: 4852095 - DNA, 21 bp, Homo sapiens
tgagaattgaggggaggtggc

SEQ ID NO: 4852096 - DNA, 14 bp, Homo sapiens
tgagacagtgaatt

SEQ ID NO: 4852097 - DNA, 17 bp, Homo sapiens
tgagacagtgaatttgg

SEQ ID NO: 4852098 - DNA, 15 bp, Homo sapiens
tgagagaatgtggaa

SEQ ID NO: 4852099 - DNA, 16 bp, Homo sapiens
tgagagaatgtggaaa

SEQ ID NO: 4852100 - DNA, 18 bp, Homo sapiens
tgagagaatgtggaaata

SEQ ID NO: 4852101 - DNA, 15 bp, Homo sapiens
tgagagtagggccct

SEQ ID NO: 4852102 - DNA, 18 bp, Homo sapiens
tgagagtagggccctgac

SEQ ID NO: 4852103 - DNA, 22 bp, Homo sapiens
tgagagttccggggagaaaccc

SEQ ID NO: 4852104 - DNA, 12 bp, Homo sapiens
tgagatactgtg

SEQ ID NO: 4852105 - DNA, 13 bp, Homo sapiens
tgagattggtttt

SEQ ID NO: 4852106 - DNA, 21 bp, Homo sapiens
tgagcaagcaccaacctccag

SEQ ID NO: 4852107 - DNA, 22 bp, Homo sapiens
tgagcatagagaacaaagtaaa

SEQ ID NO: 4852108 - DNA, 16 bp, Homo sapiens
tgagcctggtcctggc

SEQ ID NO: 4852109 - DNA, 15 bp, Homo sapiens
tgagctctgaaatct

SEQ ID NO: 4852110 - DNA, 21 bp, Homo sapiens
tgagctcttcctatccctctc

SEQ ID NO: 4852111 - DNA, 14 bp, Homo sapiens
tgaggacagggccc

SEQ ID NO: 4852112 - DNA, 16 bp, Homo sapiens
tgaggacccagagctg

SEQ ID NO: 4852113 - DNA, 17 bp, Homo sapiens
tgaggactgatttcaga

SEQ ID NO: 4852114 - DNA, 16 bp, Homo sapiens
tgaggagtaaaattca

SEQ ID NO: 4852115 - DNA, 15 bp, Homo sapiens
tgaggataggacaga

SEQ ID NO: 4852116 - DNA, 12 bp, Homo sapiens
tgaggatccagg

SEQ ID NO: 4852117 - DNA, 14 bp, Homo sapiens
tgaggatccagggc

SEQ ID NO: 4852118 - DNA, 16 bp, Homo sapiens
tgaggatccagggcag

SEQ ID NO: 4852119 - DNA, 23 bp, Homo sapiens
tgaggatccagggcagcaggcca

SEQ ID NO: 4852120 - DNA, 14 bp, Homo sapiens
tgaggccagaaagg

SEQ ID NO: 4852121 - DNA, 15 bp, Homo sapiens
tgaggccagaaaggt

SEQ ID NO: 4852122 - DNA, 20 bp, Homo sapiens
tgaggcccagagagggaaga

SEQ ID NO: 4852123 - DNA, 23 bp, Homo sapiens
tgaggcccagagagggaagatga

SEQ ID NO: 4852124 - DNA, 21 bp, Homo sapiens
tgaggctcagagaggtagcac

SEQ ID NO: 4852125 - DNA, 17 bp, Homo sapiens
tgaggggaggtggccag

SEQ ID NO: 4852126 - DNA, 19 bp, Homo sapiens
tgaggggctaccctgggaa

SEQ ID NO: 4852127 - DNA, 18 bp, Homo sapiens
tgaggtgaactccaggca

SEQ ID NO: 4852128 - DNA, 15 bp, Homo sapiens
tgagtattgtttaaa

SEQ ID NO: 4852129 - DNA, 13 bp, Homo sapiens
tgagtctctgaat

SEQ ID NO: 4852130 - DNA, 19 bp, Homo sapiens
tgagtgacaaagcctctga

SEQ ID NO: 4852131 - DNA, 23 bp, Homo sapiens
tgagtttaccttgtatactgtag

SEQ ID NO: 4852132 - DNA, 13 bp, Homo sapiens
tgataaaaactca

SEQ ID NO: 4852133 - DNA, 13 bp, Homo sapiens
tgataaaggaaat

SEQ ID NO: 4852134 - DNA, 20 bp, Homo sapiens
tgataagggaaaagataaag

SEQ ID NO: 4852135 - DNA, 19 bp, Homo sapiens
tgataccatatgaatgaaa

SEQ ID NO: 4852136 - DNA, 13 bp, Homo sapiens
tgatactaccagg

SEQ ID NO: 4852137 - DNA, 12 bp, Homo sapiens
tgatattgctgt

SEQ ID NO: 4852138 - DNA, 20 bp, Homo sapiens
tgatctacttctgtaattgt

SEQ ID NO: 4852139 - DNA, 21 bp, Homo sapiens
tgatctacttctgtaattgtg

SEQ ID NO: 4852140 - DNA, 22 bp, Homo sapiens
tcccatgggggcacttgagttt

SEQ ID NO: 4852141 - DNA, 18 bp, Homo sapiens
tccccaagtcagcagtcc

SEQ ID NO: 4852142 - DNA, 10 bp, Homo sapiens
tccccagtga

SEQ ID NO: 4852143 - DNA, 14 bp, Homo sapiens
tccccagtgactcc

SEQ ID NO: 4852144 - DNA, 15 bp, Homo sapiens
tccccagtgactcca

SEQ ID NO: 4852145 - DNA, 15 bp, Homo sapiens
tcccccagaggtgga

SEQ ID NO: 4852146 - DNA, 17 bp, Homo sapiens
tcccctaaagccaggct

SEQ ID NO: 4852147 - DNA, 21 bp, Homo sapiens
tcccctcccaggggagccagc

SEQ ID NO: 4852148 - DNA, 23 bp, Homo sapiens
tcccctcccaggggagccagctg

SEQ ID NO: 4852149 - DNA, 14 bp, Homo sapiens
tcccctcgctgctg

SEQ ID NO: 4852150 - DNA, 10 bp, Homo sapiens
tcccctctgt

SEQ ID NO: 4852151 - DNA, 13 bp, Homo sapiens
tcccctctgtgct

SEQ ID NO: 4852152 - DNA, 15 bp, Homo sapiens
tcccctctgtgcttc

SEQ ID NO: 4852153 - DNA, 14 bp, Homo sapiens
tcccgccccgcccc

SEQ ID NO: 4852154 - DNA, 21 bp, Homo sapiens
tcccggttcagacccctgcct

SEQ ID NO: 4852155 - DNA, 22 bp, Homo sapiens
tccctaagcatgtgtcccagga

SEQ ID NO: 4852156 - DNA, 21 bp, Homo sapiens
tccctaggatcccgtcttcca

SEQ ID NO: 4852157 - DNA, 20 bp, Homo sapiens
tccctcacctgtagcagcca

SEQ ID NO: 4852158 - DNA, 18 bp, Homo sapiens
tccctccattcatccttc

SEQ ID NO: 4852159 - DNA, 20 bp, Homo sapiens
tccctccattcatccttcca

SEQ ID NO: 4852160 - DNA, 14 bp, Homo sapiens
tccctctcctaact

SEQ ID NO: 4852161 - DNA, 20 bp, Homo sapiens
tccctgaggactgatttcag

SEQ ID NO: 4852162 - DNA, 18 bp, Homo sapiens
tccctgcctcaggccaag

SEQ ID NO: 4852163 - DNA, 13 bp, Homo sapiens
tccctgcctggag

SEQ ID NO: 4852164 - DNA, 17 bp, Homo sapiens
tccctgggggccttggg

SEQ ID NO: 4852165 - DNA, 19 bp, Homo sapiens
tccctggggtcaccttcta

SEQ ID NO: 4852166 - DNA, 20 bp, Homo sapiens
tccctgggtttgggagccag

SEQ ID NO: 4852167 - DNA, 22 bp, Homo sapiens
tccctgggtttgggagccagga

SEQ ID NO: 4852168 - DNA, 23 bp, Homo sapiens
tccctgggtttgggagccaggac

SEQ ID NO: 4852169 - DNA, 14 bp, Homo sapiens
tcccttcctctctc

SEQ ID NO: 4852170 - DNA, 20 bp, Homo sapiens
tcccttgcaggggtcccccc

SEQ ID NO: 4852171 - DNA, 21 bp, Homo sapiens
tcccttgcaggggtcccccct

SEQ ID NO: 4852172 - DNA, 21 bp, Homo sapiens
tcccttggacattttatgtct

SEQ ID NO: 4852173 - DNA, 18 bp, Homo sapiens
tccctttacagctctcct

SEQ ID NO: 4852174 - DNA, 21 bp, Homo sapiens
tccctttctaagcaaccacac

SEQ ID NO: 4852175 - DNA, 18 bp, Homo sapiens
tccgcccactcctgggac

SEQ ID NO: 4852176 - DNA, 20 bp, Homo sapiens
tccggggagaaacccagaga

SEQ ID NO: 4852177 - DNA, 22 bp, Homo sapiens
tccgggggcagctctggagggg

SEQ ID NO: 4852178 - DNA, 20 bp, Homo sapiens
tccgtgccccttccctgggt

SEQ ID NO: 4852179 - DNA, 19 bp, Homo sapiens
tcctaaaagttctcaatgt

SEQ ID NO: 4852180 - DNA, 20 bp, Homo sapiens
tcctaaaagttctcaatgta

SEQ ID NO: 4852181 - DNA, 23 bp, Homo sapiens
tcctaagatgtgttcttattttt

SEQ ID NO: 4852182 - DNA, 19 bp, Homo sapiens
tcctaatcaaattctgtct

SEQ ID NO: 4852183 - DNA, 22 bp, Homo sapiens
tcctaatcaaattctgtctggg

SEQ ID NO: 4852184 - DNA, 14 bp, Homo sapiens
tcctaattgtgccc

SEQ ID NO: 4852185 - DNA, 21 bp, Homo sapiens
tcctactttctatttttatga

SEQ ID NO: 4852186 - DNA, 18 bp, Homo sapiens
tcctagactgctcctggg

SEQ ID NO: 4852187 - DNA, 17 bp, Homo sapiens
tcctagctgtgtgaata

SEQ ID NO: 4852188 - DNA, 17 bp, Homo sapiens
tcctaggaaccagccaa

SEQ ID NO: 4852189 - DNA, 22 bp, Homo sapiens
tcctataaagtgcctcggacag

SEQ ID NO: 4852190 - DNA, 15 bp, Homo sapiens
tcctattctataaaa

SEQ ID NO: 4852191 - DNA, 14 bp, Homo sapiens
tcctatttttgtga

SEQ ID NO: 4852192 - DNA, 22 bp, Homo sapiens
tcctcatggcagcctactctcc

SEQ ID NO: 4852193 - DNA, 23 bp, Homo sapiens
tcctcatgtcttctcacaagcca

SEQ ID NO: 4852194 - DNA, 17 bp, Homo sapiens
tcctccagccctgggca

SEQ ID NO: 4852195 - DNA, 16 bp, Homo sapiens
gtaaacttctgcaaca

SEQ ID NO: 4852196 - DNA, 17 bp, Homo sapiens
gtaaataggaatcattc

SEQ ID NO: 4852197 - DNA, 18 bp, Homo sapiens
gtaaatgaagatctttat

SEQ ID NO: 4852198 - DNA, 11 bp, Homo sapiens
gtaaatgtttc

SEQ ID NO: 4852199 - DNA, 13 bp, Homo sapiens
gtaaatgtttctt

SEQ ID NO: 4852200 - DNA, 14 bp, Homo sapiens
gtaaatgtttcttt

SEQ ID NO: 4852201 - DNA, 19 bp, Homo sapiens
gtaacttccaaataaataa

SEQ ID NO: 4852202 - DNA, 13 bp, Homo sapiens
gtaagaattctga

SEQ ID NO: 4852203 - DNA, 22 bp, Homo sapiens
gtaagatatctcaatgaaccat

SEQ ID NO: 4852204 - DNA, 18 bp, Homo sapiens
gtaaggatccggaaagaa

SEQ ID NO: 4852205 - DNA, 16 bp, Homo sapiens
gtaagttatctttgaa

SEQ ID NO: 4852206 - DNA, 17 bp, Homo sapiens
gtaataaatgtgactca

SEQ ID NO: 4852207 - DNA, 17 bp, Homo sapiens
gtaatacccgtcctctc

SEQ ID NO: 4852208 - DNA, 15 bp, Homo sapiens
gtaatagctttagtg

SEQ ID NO: 4852209 - DNA, 16 bp, Homo sapiens
gtaatattgacttgta

SEQ ID NO: 4852210 - DNA, 19 bp, Homo sapiens
gtaatattgacttgtatat

SEQ ID NO: 4852211 - DNA, 17 bp, Homo sapiens
gtaatcccctaaaataa

SEQ ID NO: 4852212 - DNA, 16 bp, Homo sapiens
gtaatctatgtttata

SEQ ID NO: 4852213 - DNA, 22 bp, Homo sapiens
gtaatctatgtttataatacta

SEQ ID NO: 4852214 - DNA, 20 bp, Homo sapiens
gtaattatgtaaataactct

SEQ ID NO: 4852215 - DNA, 12 bp, Homo sapiens
gtaattgggaac

SEQ ID NO: 4852216 - DNA, 23 bp, Homo sapiens
gtaatttaaatgaaagaaaattg

SEQ ID NO: 4852217 - DNA, 14 bp, Homo sapiens
gtacaaaatggtcc

SEQ ID NO: 4852218 - DNA, 15 bp, Homo sapiens
gtacagaatttgaat

SEQ ID NO: 4852219 - DNA, 14 bp, Homo sapiens
gtacagtctgctcc

SEQ ID NO: 4852220 - DNA, 15 bp, Homo sapiens
gtacgatgacagtgt

SEQ ID NO: 4852221 - DNA, 13 bp, Homo sapiens
gtactaacccagt

SEQ ID NO: 4852222 - DNA, 15 bp, Homo sapiens
gtactgatttcagta

SEQ ID NO: 4852223 - DNA, 15 bp, Homo sapiens
gtactgcatgtgact

SEQ ID NO: 4852224 - DNA, 17 bp, Homo sapiens
gtactgtactttcccag

SEQ ID NO: 4852225 - DNA, 22 bp, Homo sapiens
gtactgtactttcccaggttga

SEQ ID NO: 4852226 - DNA, 20 bp, Homo sapiens
gtacttcttgaatataaaaa

SEQ ID NO: 4852227 - DNA, 22 bp, Homo sapiens
gtacttgactacctactggtgt

SEQ ID NO: 4852228 - DNA, 20 bp, Homo sapiens
gtactttatcatgaatgctt

SEQ ID NO: 4852229 - DNA, 13 bp, Homo sapiens
gtactttcccagg

SEQ ID NO: 4852230 - DNA, 19 bp, Homo sapiens
gtagagcccctactgtggg

SEQ ID NO: 4852231 - DNA, 18 bp, Homo sapiens
gtagatatgtattctttt

SEQ ID NO: 4852232 - DNA, 15 bp, Homo sapiens
gtagatccatttcca

SEQ ID NO: 4852233 - DNA, 21 bp, Homo sapiens
gtagatctatattagatcaaa

SEQ ID NO: 4852234 - DNA, 21 bp, Homo sapiens
gtagcattctttggagttaaa

SEQ ID NO: 4852235 - DNA, 13 bp, Homo sapiens
gtagccagctgtg

SEQ ID NO: 4852236 - DNA, 16 bp, Homo sapiens
gtaggaaccgatctgc

SEQ ID NO: 4852237 - DNA, 15 bp, Homo sapiens
gtaggaccctcgaga

SEQ ID NO: 4852238 - DNA, 13 bp, Homo sapiens
gtaggtaagactg

SEQ ID NO: 4852239 - DNA, 12 bp, Homo sapiens
gtataaatatac

SEQ ID NO: 4852240 - DNA, 20 bp, Homo sapiens
gtatagcatgaaataaaata

SEQ ID NO: 4852241 - DNA, 13 bp, Homo sapiens
gtatataaactgg

SEQ ID NO: 4852242 - DNA, 17 bp, Homo sapiens
gtatatatgtatttcta

SEQ ID NO: 4852243 - DNA, 16 bp, Homo sapiens
gtatatggtatttatt

SEQ ID NO: 4852244 - DNA, 11 bp, Homo sapiens
gtatattaaac

SEQ ID NO: 4852245 - DNA, 23 bp, Homo sapiens
gtatattcaggacttgaaagaaa

SEQ ID NO: 4852246 - DNA, 15 bp, Homo sapiens
gtatgagtgtatgtg

SEQ ID NO: 4852247 - DNA, 23 bp, Homo sapiens
gtatgtatattaaaaaagagaca

SEQ ID NO: 4852248 - DNA, 22 bp, Homo sapiens
gtattaaaaaacaattaactgc

SEQ ID NO: 4852249 - DNA, 22 bp, Homo sapiens
gtattaactatcttctttggac

SEQ ID NO: 4852250 - DNA, 18 bp, Homo sapiens
gtattgcacattgtaaaa

SEQ ID NO: 4852251 - DNA, 21 bp, Homo sapiens
gtattgcacattgtaaaaagt

SEQ ID NO: 4852252 - DNA, 23 bp, Homo sapiens
gtatttctatatagacttggaga

SEQ ID NO: 4852253 - DNA, 13 bp, Homo sapiens
gtatttttaaagg

SEQ ID NO: 4852254 - DNA, 14 bp, Homo sapiens
gtcaactacacaaa

SEQ ID NO: 4852255 - DNA, 22 bp, Homo sapiens
gtcaagggctgtcattgcacat

SEQ ID NO: 4852256 - DNA, 15 bp, Homo sapiens
gtcacatccatccct

SEQ ID NO: 4852257 - DNA, 11 bp, Homo sapiens
gtcactcccaa

SEQ ID NO: 4852258 - DNA, 13 bp, Homo sapiens
gtcactgtccaga

SEQ ID NO: 4852259 - DNA, 17 bp, Homo sapiens
gtcacttttccttttct

SEQ ID NO: 4852260 - DNA, 22 bp, Homo sapiens
gtcacttttccttttcttaaaa

SEQ ID NO: 4852261 - DNA, 17 bp, Homo sapiens
gtcagaatttttaactg

SEQ ID NO: 4852262 - DNA, 14 bp, Homo sapiens
gtcagacatttctt

SEQ ID NO: 4852263 - DNA, 20 bp, Homo sapiens
gtcagacatttctttggaaa

SEQ ID NO: 4852264 - DNA, 13 bp, Homo sapiens
gtcagatgaggca

SEQ ID NO: 4852265 - DNA, 17 bp, Homo sapiens
gtcagctgctgttgaac

SEQ ID NO: 4852266 - DNA, 15 bp, Homo sapiens
gtcataggttaatat

SEQ ID NO: 4852267 - DNA, 19 bp, Homo sapiens
gtcatgtgagtctgggata

SEQ ID NO: 4852268 - DNA, 19 bp, Homo sapiens
gtcattatgttaatatttc

SEQ ID NO: 4852269 - DNA, 19 bp, Homo sapiens
gtcattgcacataagcttc

SEQ ID NO: 4852270 - DNA, 14 bp, Homo sapiens
gtcattggcaaagt

SEQ ID NO: 4852271 - DNA, 13 bp, Homo sapiens
gtccagccacccc

SEQ ID NO: 4852272 - DNA, 16 bp, Homo sapiens
gtcccatggctgaagc

SEQ ID NO: 4852273 - DNA, 23 bp, Homo sapiens
gtcccatggctgaagctggagca

SEQ ID NO: 4852274 - DNA, 11 bp, Homo sapiens
gtcccctctgt

SEQ ID NO: 4852275 - DNA, 15 bp, Homo sapiens
gtcccctctgtgctt

SEQ ID NO: 4852276 - DNA, 16 bp, Homo sapiens
gtccctagggctctcc

SEQ ID NO: 4852277 - DNA, 20 bp, Homo sapiens
gtccctagggctctccaagc

SEQ ID NO: 4852278 - DNA, 15 bp, Homo sapiens
gtcccttcaatttct

SEQ ID NO: 4852279 - DNA, 18 bp, Homo sapiens
gtccgcagttgtagcaga

SEQ ID NO: 4852280 - DNA, 23 bp, Homo sapiens
gtccgcagttgtagcagaaacca

SEQ ID NO: 4852281 - DNA, 13 bp, Homo sapiens
gtccgtgcccctt

SEQ ID NO: 4852282 - DNA, 17 bp, Homo sapiens
gtcctaaaagttctcaa

SEQ ID NO: 4852283 - DNA, 17 bp, Homo sapiens
gtcctaacaaatgctcc

SEQ ID NO: 4852284 - DNA, 23 bp, Homo sapiens
gtcctagccccaaaccagcccag

SEQ ID NO: 4852285 - DNA, 14 bp, Homo sapiens
gtcctagtaagaag

SEQ ID NO: 4852286 - DNA, 21 bp, Homo sapiens
gtcctattatattcattcttt

SEQ ID NO: 4852287 - DNA, 15 bp, Homo sapiens
gtcctatttttgtga

SEQ ID NO: 4852288 - DNA, 18 bp, Homo sapiens
gtcctctcggctgccagg

SEQ ID NO: 4852289 - DNA, 21 bp, Homo sapiens
gtcctctcggctgccaggggc

SEQ ID NO: 4852290 - DNA, 16 bp, Homo sapiens
gtcctggaatttggac

SEQ ID NO: 4852291 - DNA, 13 bp, Homo sapiens
gtccttcccccag

SEQ ID NO: 4852292 - DNA, 15 bp, Homo sapiens
gtccttcccccagca

SEQ ID NO: 4852293 - DNA, 14 bp, Homo sapiens
gtccttgatttcaa

SEQ ID NO: 4852294 - DNA, 23 bp, Homo sapiens
gtctaagactatatatataaatg

SEQ ID NO: 4852295 - DNA, 19 bp, Homo sapiens
gtctaggtctcctcagggt

SEQ ID NO: 4852296 - DNA, 14 bp, Homo sapiens
gtctcagtttcttg

SEQ ID NO: 4852297 - DNA, 19 bp, Homo sapiens
gtctcccatatgcagaaat

SEQ ID NO: 4852298 - DNA, 22 bp, Homo sapiens
gtctcctcagggtggggggtga

SEQ ID NO: 4852299 - DNA, 13 bp, Homo sapiens
gtctctcagggat

SEQ ID NO: 4852300 - DNA, 20 bp, Homo sapiens
gtctgagacaggtgcctaac

SEQ ID NO: 4852301 - DNA, 14 bp, Homo sapiens
gtctgagtcatggc

SEQ ID NO: 4852302 - DNA, 15 bp, Homo sapiens
gtctgctaggcgctg

SEQ ID NO: 4852303 - DNA, 18 bp, Homo sapiens
gtctgctaggcgctgggg

SEQ ID NO: 4852304 - DNA, 15 bp, Homo sapiens
gtctggttcctgtgt

SEQ ID NO: 4852305 - DNA, 20 bp, Homo sapiens
gtctggttgctaatgacagc

SEQ ID NO: 4852306 - DNA, 12 bp, Homo sapiens
gtcttctattta

SEQ ID NO: 4852307 - DNA, 18 bp, Homo sapiens
gtcttctcacaagccagc

SEQ ID NO: 4852308 - DNA, 19 bp, Homo sapiens
gtcttgggggtcagggggg

SEQ ID NO: 4852309 - DNA, 19 bp, Homo sapiens
gtctttcatggctgctgtt

SEQ ID NO: 4852310 - DNA, 23 bp, Homo sapiens
gtctttcatggctgctgttgctt

SEQ ID NO: 4852311 - DNA, 15 bp, Homo sapiens
gtctttgccttctct

SEQ ID NO: 4852312 - DNA, 13 bp, Homo sapiens
gtgaataaatgtc

SEQ ID NO: 4852313 - DNA, 17 bp, Homo sapiens
gtgaatgtgtgagaaaa

SEQ ID NO: 4852314 - DNA, 21 bp, Homo sapiens
gtgaatgtgtgagaaaaacta

SEQ ID NO: 4852315 - DNA, 17 bp, Homo sapiens
gtgacagtgccttctct

SEQ ID NO: 4852316 - DNA, 14 bp, Homo sapiens
gttctgtgactgaa

SEQ ID NO: 4852317 - DNA, 22 bp, Homo sapiens
gttctgtgactgaagaagatga

SEQ ID NO: 4852318 - DNA, 17 bp, Homo sapiens
gttcttatttttataac

SEQ ID NO: 4852319 - DNA, 14 bp, Homo sapiens
gttctttggattct

SEQ ID NO: 4852320 - DNA, 15 bp, Homo sapiens
gttcttttctctctt

SEQ ID NO: 4852321 - DNA, 12 bp, Homo sapiens
gttgataaaaac

SEQ ID NO: 4852322 - DNA, 17 bp, Homo sapiens
gttgatggagccccagg

SEQ ID NO: 4852323 - DNA, 19 bp, Homo sapiens
gttgcactaaaatgaggat

SEQ ID NO: 4852324 - DNA, 22 bp, Homo sapiens
gttgcactaaaatgaggatcca

SEQ ID NO: 4852325 - DNA, 16 bp, Homo sapiens
gttgcacttttgaatg

SEQ ID NO: 4852326 - DNA, 18 bp, Homo sapiens
gttgcacttttgaatgtc

SEQ ID NO: 4852327 - DNA, 19 bp, Homo sapiens
gttgcagccgcagagaaat

SEQ ID NO: 4852328 - DNA, 16 bp, Homo sapiens
gttgcatagcagtata

SEQ ID NO: 4852329 - DNA, 16 bp, Homo sapiens
gttgcctcttgcaatg

SEQ ID NO: 4852330 - DNA, 14 bp, Homo sapiens
gttgcttgtcttct

SEQ ID NO: 4852331 - DNA, 22 bp, Homo sapiens
gttggaatggatttttctttaa

SEQ ID NO: 4852332 - DNA, 16 bp, Homo sapiens
gttggagcagcaggcc

SEQ ID NO: 4852333 - DNA, 17 bp, Homo sapiens
gttggagcagcaggcct

SEQ ID NO: 4852334 - DNA, 23 bp, Homo sapiens
gttggagcagcaggcctctggga

SEQ ID NO: 4852335 - DNA, 15 bp, Homo sapiens
gttgtagacaaagta

SEQ ID NO: 4852336 - DNA, 21 bp, Homo sapiens
gttgtctctcttcggtggcct

SEQ ID NO: 4852337 - DNA, 21 bp, Homo sapiens
gttgtgagaatggcctggagc

SEQ ID NO: 4852338 - DNA, 22 bp, Homo sapiens
gttgtgagaatggcctggagca

SEQ ID NO: 4852339 - DNA, 20 bp, Homo sapiens
gttgtggggcctcaggctcc

SEQ ID NO: 4852340 - DNA, 18 bp, Homo sapiens
gttgtttataataaaaat

SEQ ID NO: 4852341 - DNA, 14 bp, Homo sapiens
gtttaatagatttg

SEQ ID NO: 4852342 - DNA, 18 bp, Homo sapiens
gtttaatgggtatgctca

SEQ ID NO: 4852343 - DNA, 20 bp, Homo sapiens
gtttacaaaaatttctgtaa

SEQ ID NO: 4852344 - DNA, 19 bp, Homo sapiens
gtttacatgaagcagaacc

SEQ ID NO: 4852345 - DNA, 12 bp, Homo sapiens
gtttaccttgta

SEQ ID NO: 4852346 - DNA, 14 bp, Homo sapiens
gtttataataaaaa

SEQ ID NO: 4852347 - DNA, 21 bp, Homo sapiens
gtttatatttttttaactgtg

SEQ ID NO: 4852348 - DNA, 14 bp, Homo sapiens
gtttattaaatgct

SEQ ID NO: 4852349 - DNA, 18 bp, Homo sapiens
gtttcaacggaaagtgct

SEQ ID NO: 4852350 - DNA, 20 bp, Homo sapiens
gtttcactgtactgcatgtg

SEQ ID NO: 4852351 - DNA, 21 bp, Homo sapiens
gtttcactgtactgcatgtga

SEQ ID NO: 4852352 - DNA, 16 bp, Homo sapiens
ggaatgaggaaaattc

SEQ ID NO: 4852353 - DNA, 22 bp, Homo sapiens
ggaatggatttttctttaactg

SEQ ID NO: 4852354 - DNA, 17 bp, Homo sapiens
ggacagcaagtgagcag

SEQ ID NO: 4852355 - DNA, 20 bp, Homo sapiens
ggacagggcccccacagggg

SEQ ID NO: 4852356 - DNA, 23 bp, Homo sapiens
ggacagtccgcagttgtagcaga

SEQ ID NO: 4852357 - DNA, 15 bp, Homo sapiens
ggacattttatgtct

SEQ ID NO: 4852358 - DNA, 18 bp, Homo sapiens
ggaccaggtttgcaggag

SEQ ID NO: 4852359 - DNA, 17 bp, Homo sapiens
ggacccttctgggtcca

SEQ ID NO: 4852360 - DNA, 23 bp, Homo sapiens
ggaccgtgccctcgtcagctggg

SEQ ID NO: 4852361 - DNA, 21 bp, Homo sapiens
ggacctgagcctggtcctggc

SEQ ID NO: 4852362 - DNA, 14 bp, Homo sapiens
ggacctgggacagg

SEQ ID NO: 4852363 - DNA, 14 bp, Homo sapiens
ggacgttaggccag

SEQ ID NO: 4852364 - DNA, 15 bp, Homo sapiens
ggacgttaggccagg

SEQ ID NO: 4852365 - DNA, 16 bp, Homo sapiens
ggacgttaggccaggc

SEQ ID NO: 4852366 - DNA, 16 bp, Homo sapiens
ggactaaatgatctct

SEQ ID NO: 4852367 - DNA, 20 bp, Homo sapiens
ggactaggacctgagcctgg

SEQ ID NO: 4852368 - DNA, 16 bp, Homo sapiens
ggactccaagccctgg

SEQ ID NO: 4852369 - DNA, 22 bp, Homo sapiens
ggactccaagccctggggcagg

SEQ ID NO: 4852370 - DNA, 11 bp, Homo sapiens
ggactctcagg

SEQ ID NO: 4852371 - DNA, 13 bp, Homo sapiens
ggactctcaggga

SEQ ID NO: 4852372 - DNA, 16 bp, Homo sapiens
ggactctctccaggag

SEQ ID NO: 4852373 - DNA, 20 bp, Homo sapiens
ggactgcatggggaggcagc

SEQ ID NO: 4852374 - DNA, 22 bp, Homo sapiens
ggactgcatggggaggcagcag

SEQ ID NO: 4852375 - DNA, 23 bp, Homo sapiens
ggactggaaagcacaagactggc

SEQ ID NO: 4852376 - DNA, 19 bp, Homo sapiens
ggactggttctgaggccag

SEQ ID NO: 4852377 - DNA, 14 bp, Homo sapiens
ggactggttgtctc

SEQ ID NO: 4852378 - DNA, 19 bp, Homo sapiens
ggagaagtcttctatttat

SEQ ID NO: 4852379 - DNA, 17 bp, Homo sapiens
ggagaatggcatggcag

SEQ ID NO: 4852380 - DNA, 12 bp, Homo sapiens
ggagacagcagc

SEQ ID NO: 4852381 - DNA, 14 bp, Homo sapiens
ggagacatgtgaca

SEQ ID NO: 4852382 - DNA, 12 bp, Homo sapiens
ggagagagcaga

SEQ ID NO: 4852383 - DNA, 22 bp, Homo sapiens
ggagatggggaataatttcctt

SEQ ID NO: 4852384 - DNA, 22 bp, Homo sapiens
ggagatgtaggaaccgatctgc

SEQ ID NO: 4852385 - DNA, 16 bp, Homo sapiens
ggagcagagctctccc

SEQ ID NO: 4852386 - DNA, 21 bp, Homo sapiens
ggagcagagctctcccctcct

SEQ ID NO: 4852387 - DNA, 15 bp, Homo sapiens
ggagcagcaggcctc

SEQ ID NO: 4852388 - DNA, 21 bp, Homo sapiens
ggagcagcggattgctctgga

SEQ ID NO: 4852389 - DNA, 13 bp, Homo sapiens
ggagcaggcccaa

SEQ ID NO: 4852390 - DNA, 17 bp, Homo sapiens
ggagcagtgagtgacaa

SEQ ID NO: 4852391 - DNA, 15 bp, Homo sapiens
ggagcattgcagcct

SEQ ID NO: 4852392 - DNA, 21 bp, Homo sapiens
ggagcatttaatggcagctag

SEQ ID NO: 4852393 - DNA, 15 bp, Homo sapiens
ggagccacttctccc

SEQ ID NO: 4852394 - DNA, 19 bp, Homo sapiens
ggagccagcctgcttccca

SEQ ID NO: 4852395 - DNA, 13 bp, Homo sapiens
ggagccagctgct

SEQ ID NO: 4852396 - DNA, 13 bp, Homo sapiens
ggagccaggactc

SEQ ID NO: 4852397 - DNA, 14 bp, Homo sapiens
ggagccaggactcc

SEQ ID NO: 4852398 - DNA, 18 bp, Homo sapiens
ggagccaggactcccaga

SEQ ID NO: 4852399 - DNA, 17 bp, Homo sapiens
ggagccctattgctgct

SEQ ID NO: 4852400 - DNA, 16 bp, Homo sapiens
ggagcctacctctgtc

SEQ ID NO: 4852401 - DNA, 12 bp, Homo sapiens
ggagcctggcca

SEQ ID NO: 4852402 - DNA, 14 bp, Homo sapiens
ggagcctggccagg

SEQ ID NO: 4852403 - DNA, 18 bp, Homo sapiens
ggagcctggccaggcagg

SEQ ID NO: 4852404 - DNA, 23 bp, Homo sapiens
ggagcgttctaaatatgaatgaa

SEQ ID NO: 4852405 - DNA, 14 bp, Homo sapiens
ggagcttcagccag

SEQ ID NO: 4852406 - DNA, 15 bp, Homo sapiens
ggagcttcagccagg

SEQ ID NO: 4852407 - DNA, 18 bp, Homo sapiens
ggagcttcagccaggtct

SEQ ID NO: 4852408 - DNA, 20 bp, Homo sapiens
ggaggcaagagactgggagc

SEQ ID NO: 4852409 - DNA, 13 bp, Homo sapiens
ggaggcagaggtg

SEQ ID NO: 4852410 - DNA, 12 bp, Homo sapiens
ggaggcagcaga

SEQ ID NO: 4852411 - DNA, 22 bp, Homo sapiens
ggaggctcctctaggccctgtg

SEQ ID NO: 4852412 - DNA, 18 bp, Homo sapiens
ggaggggaggcagatgga

SEQ ID NO: 4852413 - DNA, 20 bp, Homo sapiens
ggaggggatgataaaggaaa

SEQ ID NO: 4852414 - DNA, 22 bp, Homo sapiens
ggaggggatgataaaggaaata

SEQ ID NO: 4852415 - DNA, 20 bp, Homo sapiens
ggagggttctaagtgggaga

SEQ ID NO: 4852416 - DNA, 24 bp, Homo sapiens
ggaggtggccagcccgcagaggtg

SEQ ID NO: 4852417 - DNA, 19 bp, Homo sapiens
ggagtccactcccagtgct

SEQ ID NO: 4852418 - DNA, 14 bp, Homo sapiens
ggagtgggatagga

SEQ ID NO: 4852419 - DNA, 18 bp, Homo sapiens
ggataaatcataaagtca

SEQ ID NO: 4852420 - DNA, 14 bp, Homo sapiens
ggatagagacttgc

SEQ ID NO: 4852421 - DNA, 19 bp, Homo sapiens
ggatatataggctattttc

SEQ ID NO: 4852422 - DNA, 23 bp, Homo sapiens
ggatattctttagcttacctggg

SEQ ID NO: 4852423 - DNA, 18 bp, Homo sapiens
ggatattgaatgttaaag

SEQ ID NO: 4852424 - DNA, 13 bp, Homo sapiens
ggatattttgaaa

SEQ ID NO: 4852425 - DNA, 20 bp, Homo sapiens
ggatattttgaaatgaactt

SEQ ID NO: 4852426 - DNA, 17 bp, Homo sapiens
ggatccaaactgatcca

SEQ ID NO: 4852427 - DNA, 17 bp, Homo sapiens
ggatccagggcagcagg

SEQ ID NO: 4852428 - DNA, 22 bp, Homo sapiens
ggatccagggcagcaggccaga

SEQ ID NO: 4852429 - DNA, 19 bp, Homo sapiens
ggatcccgttcagaaaacc

SEQ ID NO: 4852430 - DNA, 23 bp, Homo sapiens
ggatcctcagttctcaaatgtgt

SEQ ID NO: 4852431 - DNA, 23 bp, Homo sapiens
ggatcgagtgtagctgtgaaatc

SEQ ID NO: 4852432 - DNA, 18 bp, Homo sapiens
ggatgacctccagaagtc

SEQ ID NO: 4852433 - DNA, 18 bp, Homo sapiens
ggatggactaaatgatct

SEQ ID NO: 4852434 - DNA, 21 bp, Homo sapiens
ggattaggtttcagcagagct

SEQ ID NO: 4852435 - DNA, 15 bp, Homo sapiens
ggattctaaatacat

SEQ ID NO: 4852436 - DNA, 18 bp, Homo sapiens
ggattgctctggagcagc

SEQ ID NO: 4852437 - DNA, 19 bp, Homo sapiens
ggattggggggtgggcttt

SEQ ID NO: 4852438 - DNA, 13 bp, Homo sapiens
ggattttcctgaa

SEQ ID NO: 4852439 - DNA, 19 bp, Homo sapiens
ggcaaagtgacaaagcaat

SEQ ID NO: 4852440 - DNA, 17 bp, Homo sapiens
ggcaaatgcctgactca

SEQ ID NO: 4852441 - DNA, 14 bp, Homo sapiens
ggcaagagactggg

SEQ ID NO: 4852442 - DNA, 17 bp, Homo sapiens
ggcaagagactgggagc

SEQ ID NO: 4852443 - DNA, 14 bp, Homo sapiens
ggcaagcagatgac

SEQ ID NO: 4852444 - DNA, 21 bp, Homo sapiens
ggcacaaaagacagctggcgg

SEQ ID NO: 4852445 - DNA, 22 bp, Homo sapiens
ggcacaatgttggagcagcagg

SEQ ID NO: 4852446 - DNA, 23 bp, Homo sapiens
ggcacaatgttggagcagcaggc

SEQ ID NO: 4852447 - DNA, 22 bp, Homo sapiens
ggcacatagcataggctgggga

SEQ ID NO: 4852448 - DNA, 14 bp, Homo sapiens
ggcacattaactgt

SEQ ID NO: 4852449 - DNA, 15 bp, Homo sapiens
ggcacattaactgtt

SEQ ID NO: 4852450 - DNA, 21 bp, Homo sapiens
ggcacattaactgttgcactt

SEQ ID NO: 4852451 - DNA, 22 bp, Homo sapiens
ggcacattaactgttgcacttt

SEQ ID NO: 4852452 - DNA, 15 bp, Homo sapiens
ggcactgagcaggga

SEQ ID NO: 4852453 - DNA, 23 bp, Homo sapiens
ggcagagaccataagagaaacct

SEQ ID NO: 4852454 - DNA, 22 bp, Homo sapiens
ggcagagcctttttacctggcc

SEQ ID NO: 4852455 - DNA, 14 bp, Homo sapiens
ggcagatgagggct

SEQ ID NO: 4852456 - DNA, 15 bp, Homo sapiens
ggcagatgagggctg

SEQ ID NO: 4852457 - DNA, 13 bp, Homo sapiens
ggcagcaggccag

SEQ ID NO: 4852458 - DNA, 14 bp, Homo sapiens
ggcagcaggccaga

SEQ ID NO: 4852459 - DNA, 18 bp, Homo sapiens
ggcagcaggccagagaaa

SEQ ID NO: 4852460 - DNA, 19 bp, Homo sapiens
ggcagcaggccagagaaag

SEQ ID NO: 4852461 - DNA, 20 bp, Homo sapiens
ggcagcatgcacggaggcgg

SEQ ID NO: 4852462 - DNA, 13 bp, Homo sapiens
ggcagctagtgcc

SEQ ID NO: 4852463 - DNA, 16 bp, Homo sapiens
ggcagctagtgccttt

SEQ ID NO: 4852464 - DNA, 14 bp, Homo sapiens
ggcagcttgctggg

SEQ ID NO: 4852465 - DNA, 20 bp, Homo sapiens
ggcagcttgctgggctttgg

SEQ ID NO: 4852466 - DNA, 16 bp, Homo sapiens
ggcaggcctcccaagc

SEQ ID NO: 4852467 - DNA, 14 bp, Homo sapiens
ggcagggccctgaa

SEQ ID NO: 4852468 - DNA, 17 bp, Homo sapiens
ggcagggccctgaaatg

SEQ ID NO: 4852469 - DNA, 20 bp, Homo sapiens
ggcagggggtatgcagagct

SEQ ID NO: 4852470 - DNA, 21 bp, Homo sapiens
ggcagggggtatgcagagctt

SEQ ID NO: 4852471 - DNA, 22 bp, Homo sapiens
ggcaggtgcttttggcagagac

SEQ ID NO: 4852472 - DNA, 16 bp, Homo sapiens
gggcattagcaaggca

SEQ ID NO: 4852473 - DNA, 22 bp, Homo sapiens
gggcattagcaaggcagagcct

SEQ ID NO: 4852474 - DNA, 15 bp, Homo sapiens
gggccagtcaggctg

SEQ ID NO: 4852475 - DNA, 17 bp, Homo sapiens
gggccctctctctgggc

SEQ ID NO: 4852476 - DNA, 23 bp, Homo sapiens
gggccctggagctcagggtcctt

SEQ ID NO: 4852477 - DNA, 19 bp, Homo sapiens
gggccggttctaaggctca

SEQ ID NO: 4852478 - DNA, 14 bp, Homo sapiens
gggcctcaggctcc

SEQ ID NO: 4852479 - DNA, 19 bp, Homo sapiens
gggcctcaggctccgggca

SEQ ID NO: 4852480 - DNA, 21 bp, Homo sapiens
gggcctccagaagctgctcct

SEQ ID NO: 4852481 - DNA, 16 bp, Homo sapiens
gggcctcccctgggca

SEQ ID NO: 4852482 - DNA, 22 bp, Homo sapiens
gggcctcccctgggcagggttc

SEQ ID NO: 4852483 - DNA, 15 bp, Homo sapiens
gggcctctcctgccc

SEQ ID NO: 4852484 - DNA, 22 bp, Homo sapiens
gggcctctctggaagagggagg

SEQ ID NO: 4852485 - DNA, 19 bp, Homo sapiens
gggcctgggctgtgaggac

SEQ ID NO: 4852486 - DNA, 22 bp, Homo sapiens
gggcctgggctgtgaggacagg

SEQ ID NO: 4852487 - DNA, 16 bp, Homo sapiens
gggcgcgggagggggc

SEQ ID NO: 4852488 - DNA, 20 bp, Homo sapiens
gggcgtggatcgagtgtagc

SEQ ID NO: 4852489 - DNA, 21 bp, Homo sapiens
gggcgtggatcgagtgtagct

SEQ ID NO: 4852490 - DNA, 20 bp, Homo sapiens
gggctaccctgggaagctgc

SEQ ID NO: 4852491 - DNA, 17 bp, Homo sapiens
gggctgagccctcctga

SEQ ID NO: 4852492 - DNA, 21 bp, Homo sapiens
gggctgatgggtgccctttcc

SEQ ID NO: 4852493 - DNA, 22 bp, Homo sapiens
gggcttcaacagccaagctggc

SEQ ID NO: 4852494 - DNA, 24 bp, Homo sapiens
gggctttgggaagtttgctgtgct

SEQ ID NO: 4852495 - DNA, 15 bp, Homo sapiens
ggggaactcccccag

SEQ ID NO: 4852496 - DNA, 17 bp, Homo sapiens
ggggaactcccccagag

SEQ ID NO: 4852497 - DNA, 20 bp, Homo sapiens
ggggaactcccccagaggtg

SEQ ID NO: 4852498 - DNA, 17 bp, Homo sapiens
ggggacacaggatcctg

SEQ ID NO: 4852499 - DNA, 19 bp, Homo sapiens
gcagttggactctcaggga

SEQ ID NO: 4852500 - DNA, 15 bp, Homo sapiens
gcataaattgcatca

SEQ ID NO: 4852501 - DNA, 17 bp, Homo sapiens
gcataatttaaaaatat

SEQ ID NO: 4852502 - DNA, 19 bp, Homo sapiens
gcataatttaaaaatatat

SEQ ID NO: 4852503 - DNA, 20 bp, Homo sapiens
gcataatttaaaaatatatt

SEQ ID NO: 4852504 - DNA, 20 bp, Homo sapiens
gcatacaagtttcattctcc

SEQ ID NO: 4852505 - DNA, 21 bp, Homo sapiens
gcatagttgtagacaaagtac

SEQ ID NO: 4852506 - DNA, 16 bp, Homo sapiens
gcatccagtgtgagat

SEQ ID NO: 4852507 - DNA, 20 bp, Homo sapiens
gcatgaaaaaccatttttga

SEQ ID NO: 4852508 - DNA, 21 bp, Homo sapiens
gcatgacatcctttcttttaa

SEQ ID NO: 4852509 - DNA, 17 bp, Homo sapiens
gcatgatttttgccctg

SEQ ID NO: 4852510 - DNA, 16 bp, Homo sapiens
gcatgcaaatgagctc

SEQ ID NO: 4852511 - DNA, 18 bp, Homo sapiens
gcatgcaaatgagctctg

SEQ ID NO: 4852512 - DNA, 14 bp, Homo sapiens
gcatgcagctttgc

SEQ ID NO: 4852513 - DNA, 17 bp, Homo sapiens
gcatgcagctttgcaaa

SEQ ID NO: 4852514 - DNA, 14 bp, Homo sapiens
gcatgcttaaattt

SEQ ID NO: 4852515 - DNA, 15 bp, Homo sapiens
gcatggagaatggga

SEQ ID NO: 4852516 - DNA, 15 bp, Homo sapiens
gcatggcaggagtct

SEQ ID NO: 4852517 - DNA, 16 bp, Homo sapiens
gcatggggccaggaaa

SEQ ID NO: 4852518 - DNA, 17 bp, Homo sapiens
gcatggtggctcatgcc

SEQ ID NO: 4852519 - DNA, 20 bp, Homo sapiens
gcatgttcacccttatagtc

SEQ ID NO: 4852520 - DNA, 21 bp, Homo sapiens
gcatgttcacccttatagtct

SEQ ID NO: 4852521 - DNA, 21 bp, Homo sapiens
gcattcaaccacgcaggaagc

SEQ ID NO: 4852522 - DNA, 19 bp, Homo sapiens
gcattcacatttagaaaag

SEQ ID NO: 4852523 - DNA, 13 bp, Homo sapiens
gcattctcccagc

SEQ ID NO: 4852524 - DNA, 13 bp, Homo sapiens
gcattctttgcaa

SEQ ID NO: 4852525 - DNA, 15 bp, Homo sapiens
gcattgagtattgtt

SEQ ID NO: 4852526 - DNA, 20 bp, Homo sapiens
gcatttaataaagatgagtt

SEQ ID NO: 4852527 - DNA, 17 bp, Homo sapiens
gcatttaatggcagcta

SEQ ID NO: 4852528 - DNA, 23 bp, Homo sapiens
gcatttaatggcagctagtgcct

SEQ ID NO: 4852529 - DNA, 18 bp, Homo sapiens
gcattttgatattgctgt

SEQ ID NO: 4852530 - DNA, 19 bp, Homo sapiens
gcatttttattaaagcatt

SEQ ID NO: 4852531 - DNA, 17 bp, Homo sapiens
gccaaaggatgtgatat

SEQ ID NO: 4852532 - DNA, 17 bp, Homo sapiens
gccaaagtacagaattt

SEQ ID NO: 4852533 - DNA, 15 bp, Homo sapiens
gccaaatttcttttg

SEQ ID NO: 4852534 - DNA, 14 bp, Homo sapiens
gccaaccatcatgt

SEQ ID NO: 4852535 - DNA, 21 bp, Homo sapiens
gccaacctcaggctcctaaag

SEQ ID NO: 4852536 - DNA, 22 bp, Homo sapiens
gccaacctctttgcgtttcctt

SEQ ID NO: 4852537 - DNA, 21 bp, Homo sapiens
gccaagctgaggaggtgctgc

SEQ ID NO: 4852538 - DNA, 16 bp, Homo sapiens
gccaagctggcacaaa

SEQ ID NO: 4852539 - DNA, 22 bp, Homo sapiens
gccaaggaaaggcatgtacaaa

SEQ ID NO: 4852540 - DNA, 15 bp, Homo sapiens
gccaaggccgccagc

SEQ ID NO: 4852541 - DNA, 16 bp, Homo sapiens
gccaaggccgccagcg

SEQ ID NO: 4852542 - DNA, 19 bp, Homo sapiens
gccaaggccgccagcgtgt

SEQ ID NO: 4852543 - DNA, 14 bp, Homo sapiens
gccaagggaccagg

SEQ ID NO: 4852544 - DNA, 18 bp, Homo sapiens
gccaataaagtgatctgt

SEQ ID NO: 4852545 - DNA, 14 bp, Homo sapiens
gccacaaacctgcc

SEQ ID NO: 4852546 - DNA, 21 bp, Homo sapiens
gccacaccgtggcagcttgct

SEQ ID NO: 4852547 - DNA, 22 bp, Homo sapiens
gccacaccgtggcagcttgctg

SEQ ID NO: 4852548 - DNA, 18 bp, Homo sapiens
gccacagaaggtgaactt

SEQ ID NO: 4852549 - DNA, 13 bp, Homo sapiens
gccacagcagagc

SEQ ID NO: 4852550 - DNA, 14 bp, Homo sapiens
gccacagcagagca

SEQ ID NO: 4852551 - DNA, 15 bp, Homo sapiens
gccacatcaaacctt

SEQ ID NO: 4852552 - DNA, 13 bp, Homo sapiens
gccacccccaggc

SEQ ID NO: 4852553 - DNA, 21 bp, Homo sapiens
gccagaaaggtgtgaggagag

SEQ ID NO: 4852554 - DNA, 22 bp, Homo sapiens
gccagaaaggtgtgaggagaga

SEQ ID NO: 4852555 - DNA, 18 bp, Homo sapiens
gccagaacgtggctctgc

SEQ ID NO: 4852556 - DNA, 20 bp, Homo sapiens
gccagaacgtggctctgctg

SEQ ID NO: 4852557 - DNA, 14 bp, Homo sapiens
gccagcctgcttcc

SEQ ID NO: 4852558 - DNA, 16 bp, Homo sapiens
gccagcctgcttccca

SEQ ID NO: 4852559 - DNA, 21 bp, Homo sapiens
gccagcctgcttcccacaact

SEQ ID NO: 4852560 - DNA, 17 bp, Homo sapiens
gccagcgtgtggagcag

SEQ ID NO: 4852561 - DNA, 13 bp, Homo sapiens
gccagctgcttga

SEQ ID NO: 4852562 - DNA, 22 bp, Homo sapiens
gccaggacgtctggggtgtggg

SEQ ID NO: 4852563 - DNA, 18 bp, Homo sapiens
gccaggactcccagaacc

SEQ ID NO: 4852564 - DNA, 19 bp, Homo sapiens
gccaggactcccagaacct

SEQ ID NO: 4852565 - DNA, 23 bp, Homo sapiens
gccagtaaaatactattgcctca

SEQ ID NO: 4852566 - DNA, 13 bp, Homo sapiens
gccagtcactgct

SEQ ID NO: 4852567 - DNA, 14 bp, Homo sapiens
gccagtcactgctg

SEQ ID NO: 4852568 - DNA, 18 bp, Homo sapiens
gccagtggtggaggtggg

SEQ ID NO: 4852569 - DNA, 15 bp, Homo sapiens
gccagttacttgggc

SEQ ID NO: 4852570 - DNA, 20 bp, Homo sapiens
gccagttttcggaaacactg

SEQ ID NO: 4852571 - DNA, 19 bp, Homo sapiens
gccatacataaaagaaata

SEQ ID NO: 4852572 - DNA, 19 bp, Homo sapiens
gccatagatgctggctggg

SEQ ID NO: 4852573 - DNA, 18 bp, Homo sapiens
gccatcgccgggactcca

SEQ ID NO: 4852574 - DNA, 15 bp, Homo sapiens
gccatcttctttctt

SEQ ID NO: 4852575 - DNA, 15 bp, Homo sapiens
gccatgccaataaag

SEQ ID NO: 4852576 - DNA, 22 bp, Homo sapiens
gccatgttcccagaaccttgat

SEQ ID NO: 4852577 - DNA, 15 bp, Homo sapiens
gccattctgattatt

SEQ ID NO: 4852578 - DNA, 22 bp, Homo sapiens
gccattttggggggttatttat

SEQ ID NO: 4852579 - DNA, 16 bp, Homo sapiens
gcccaaacctgggaag

SEQ ID NO: 4852580 - DNA, 14 bp, Homo sapiens
gcccaatgaataat

SEQ ID NO: 4852581 - DNA, 14 bp, Homo sapiens
gcccaatgctgctt

SEQ ID NO: 4852582 - DNA, 15 bp, Homo sapiens
gcccagactacaggg

SEQ ID NO: 4852583 - DNA, 12 bp, Homo sapiens
gcccaggggctg

SEQ ID NO: 4852584 - DNA, 14 bp, Homo sapiens
gcccattcccacca

SEQ ID NO: 4852585 - DNA, 20 bp, Homo sapiens
gccccaagtggtgagcaagc

SEQ ID NO: 4852586 - DNA, 22 bp, Homo sapiens
gccccaagtggtgagcaagcac

SEQ ID NO: 4852587 - DNA, 21 bp, Homo sapiens
gccccatctccacaggagaga

SEQ ID NO: 4852588 - DNA, 13 bp, Homo sapiens
gcccccattccca

SEQ ID NO: 4852589 - DNA, 15 bp, Homo sapiens
gcccccattcccagc

SEQ ID NO: 4852590 - DNA, 13 bp, Homo sapiens
gccccccgcgcgc

SEQ ID NO: 4852591 - DNA, 15 bp, Homo sapiens
gcccccttcaggagc

SEQ ID NO: 4852592 - DNA, 18 bp, Homo sapiens
gccccgcccctcccacgc

SEQ ID NO: 4852593 - DNA, 19 bp, Homo sapiens
gcccctggtggtgggggct

SEQ ID NO: 4852594 - DNA, 12 bp, Homo sapiens
gccccttccctg

SEQ ID NO: 4852595 - DNA, 14 bp, Homo sapiens
gccccttccctggg

SEQ ID NO: 4852596 - DNA, 17 bp, Homo sapiens
gcccgcctaagaccctg

SEQ ID NO: 4852597 - DNA, 22 bp, Homo sapiens
gccctattgctgctaagtcatt

SEQ ID NO: 4852598 - DNA, 15 bp, Homo sapiens
gccctcaccacagcc

SEQ ID NO: 4852599 - DNA, 19 bp, Homo sapiens
gccctcaccacagccttct

SEQ ID NO: 4852600 - DNA, 12 bp, Homo sapiens
gccctcctgagg

SEQ ID NO: 4852601 - DNA, 13 bp, Homo sapiens
gccctctctctgg

SEQ ID NO: 4852602 - DNA, 16 bp, Homo sapiens
gccctctgctctgcct

SEQ ID NO: 4852603 - DNA, 19 bp, Homo sapiens
gccctgaaatggcctgtcc

SEQ ID NO: 4852604 - DNA, 21 bp, Homo sapiens
gccctgaaatggcctgtccct

SEQ ID NO: 4852605 - DNA, 18 bp, Homo sapiens
gctctcccctcctgctgg

SEQ ID NO: 4852606 - DNA, 11 bp, Homo sapiens
gctctcctcca

SEQ ID NO: 4852607 - DNA, 17 bp, Homo sapiens
gctctcctccagccctg

SEQ ID NO: 4852608 - DNA, 20 bp, Homo sapiens
gctctcctccagccctgggc

SEQ ID NO: 4852609 - DNA, 15 bp, Homo sapiens
gctctcctcccgccc

SEQ ID NO: 4852610 - DNA, 16 bp, Homo sapiens
gctctcctcccgcccc

SEQ ID NO: 4852611 - DNA, 19 bp, Homo sapiens
gctctctgtactaaggaga

SEQ ID NO: 4852612 - DNA, 14 bp, Homo sapiens
gctctggagcagcc

SEQ ID NO: 4852613 - DNA, 16 bp, Homo sapiens
gctctggagcagccaa

SEQ ID NO: 4852614 - DNA, 14 bp, Homo sapiens
gctctggcacagtg

SEQ ID NO: 4852615 - DNA, 11 bp, Homo sapiens
gctcttcccac

SEQ ID NO: 4852616 - DNA, 18 bp, Homo sapiens
gctgaaattcaccaagaa

SEQ ID NO: 4852617 - DNA, 20 bp, Homo sapiens
gctgaacaggaaagagctag

SEQ ID NO: 4852618 - DNA, 15 bp, Homo sapiens
gctgaagctggagca

SEQ ID NO: 4852619 - DNA, 23 bp, Homo sapiens
gctgacagccacaccgtggcagc

SEQ ID NO: 4852620 - DNA, 15 bp, Homo sapiens
gctgagccctcctga

SEQ ID NO: 4852621 - DNA, 16 bp, Homo sapiens
gctgagccctcctgag

SEQ ID NO: 4852622 - DNA, 16 bp, Homo sapiens
gctgaggctgagaaag

SEQ ID NO: 4852623 - DNA, 17 bp, Homo sapiens
gctgcaagagcccagat

SEQ ID NO: 4852624 - DNA, 23 bp, Homo sapiens
gacatggggaggttgtggggcct

SEQ ID NO: 4852625 - DNA, 14 bp, Homo sapiens
gacatttatattaa

SEQ ID NO: 4852626 - DNA, 15 bp, Homo sapiens
gacatttatattaaa

SEQ ID NO: 4852627 - DNA, 14 bp, Homo sapiens
gacatttctttgga

SEQ ID NO: 4852628 - DNA, 16 bp, Homo sapiens
gacatttctttggaaa

SEQ ID NO: 4852629 - DNA, 22 bp, Homo sapiens
gacatttgggagacatgtgaca

SEQ ID NO: 4852630 - DNA, 23 bp, Homo sapiens
gacatttgggagacatgtgacat

SEQ ID NO: 4852631 - DNA, 19 bp, Homo sapiens
gaccaggtttgcaggagcc

SEQ ID NO: 4852632 - DNA, 13 bp, Homo sapiens
gacccacagaact

SEQ ID NO: 4852633 - DNA, 18 bp, Homo sapiens
gacccatccctgcctgga

SEQ ID NO: 4852634 - DNA, 20 bp, Homo sapiens
gaccccaatatatgtatttt

SEQ ID NO: 4852635 - DNA, 22 bp, Homo sapiens
gaccccagatacctgtgaggac

SEQ ID NO: 4852636 - DNA, 15 bp, Homo sapiens
gaccccattcctgat

SEQ ID NO: 4852637 - DNA, 12 bp, Homo sapiens
gaccctgggcag

SEQ ID NO: 4852638 - DNA, 17 bp, Homo sapiens
gacccttacagcctctg

SEQ ID NO: 4852639 - DNA, 15 bp, Homo sapiens
gacccttctgggtcc

SEQ ID NO: 4852640 - DNA, 15 bp, Homo sapiens
gacctccagaagtcc

SEQ ID NO: 4852641 - DNA, 21 bp, Homo sapiens
gacctcttctctcctccccta

SEQ ID NO: 4852642 - DNA, 19 bp, Homo sapiens
gacctggagcttcagccag

SEQ ID NO: 4852643 - DNA, 20 bp, Homo sapiens
gacctggagcttcagccagg

SEQ ID NO: 4852644 - DNA, 22 bp, Homo sapiens
gaccttgagttaacaggacagt

SEQ ID NO: 4852645 - DNA, 12 bp, Homo sapiens
gaccttgcttcc

SEQ ID NO: 4852646 - DNA, 13 bp, Homo sapiens
gaccttgcttcct

SEQ ID NO: 4852647 - DNA, 15 bp, Homo sapiens
gaccttgcttccttc

SEQ ID NO: 4852648 - DNA, 21 bp, Homo sapiens
gacggtattaaaatggagcga

SEQ ID NO: 4852649 - DNA, 18 bp, Homo sapiens
gactaagaaatgccagtg

SEQ ID NO: 4852650 - DNA, 22 bp, Homo sapiens
gactacctactggtgtaatctc

SEQ ID NO: 4852651 - DNA, 14 bp, Homo sapiens
gactactgctcctg

SEQ ID NO: 4852652 - DNA, 15 bp, Homo sapiens
gactactgctcctgt

SEQ ID NO: 4852653 - DNA, 19 bp, Homo sapiens
gactactgctcctgtggca

SEQ ID NO: 4852654 - DNA, 20 bp, Homo sapiens
gactatatatataaatgtat

SEQ ID NO: 4852655 - DNA, 19 bp, Homo sapiens
gactccaaagctgttccat

SEQ ID NO: 4852656 - DNA, 19 bp, Homo sapiens
gactccaagccctggggca

SEQ ID NO: 4852657 - DNA, 20 bp, Homo sapiens
gactccaagccctggggcag

SEQ ID NO: 4852658 - DNA, 21 bp, Homo sapiens
gactccaagccctggggcagg

SEQ ID NO: 4852659 - DNA, 10 bp, Homo sapiens
gactccaggg

SEQ ID NO: 4852660 - DNA, 12 bp, Homo sapiens
gactcccagaac

SEQ ID NO: 4852661 - DNA, 20 bp, Homo sapiens
gactccttatctctttccac

SEQ ID NO: 4852662 - DNA, 13 bp, Homo sapiens
gactctctccagg

SEQ ID NO: 4852663 - DNA, 18 bp, Homo sapiens
gactctctccaggagggc

SEQ ID NO: 4852664 - DNA, 14 bp, Homo sapiens
gactgcatttgtgt

SEQ ID NO: 4852665 - DNA, 17 bp, Homo sapiens
gactgcatttgtgtgtg

SEQ ID NO: 4852666 - DNA, 17 bp, Homo sapiens
gactgccctctcgactg

SEQ ID NO: 4852667 - DNA, 17 bp, Homo sapiens
gactggcccagtgccag

SEQ ID NO: 4852668 - DNA, 18 bp, Homo sapiens
gactggcccagtgccagc

SEQ ID NO: 4852669 - DNA, 21 bp, Homo sapiens
gactgggagccacttctcccc

SEQ ID NO: 4852670 - DNA, 18 bp, Homo sapiens
gactgggcactggggcct

SEQ ID NO: 4852671 - DNA, 15 bp, Homo sapiens
gactggttctgaggc

SEQ ID NO: 4852672 - DNA, 17 bp, Homo sapiens
gactggttctgaggcca

SEQ ID NO: 4852673 - DNA, 19 bp, Homo sapiens
gactggttctgaggccaga

SEQ ID NO: 4852674 - DNA, 23 bp, Homo sapiens
gactggttctgaggccagaaagg

SEQ ID NO: 4852675 - DNA, 20 bp, Homo sapiens
gactgtagatatgtattctt

SEQ ID NO: 4852676 - DNA, 22 bp, Homo sapiens
gactgtcagtggggcagcctct

SEQ ID NO: 4852677 - DNA, 21 bp, Homo sapiens
gacttggagaatactgccaaa

SEQ ID NO: 4852678 - DNA, 15 bp, Homo sapiens
gactttccagaatga

SEQ ID NO: 4852679 - DNA, 19 bp, Homo sapiens
gactttccagaatgacctt

SEQ ID NO: 4852680 - DNA, 19 bp, Homo sapiens
gactttgatactaccaggg

SEQ ID NO: 4852681 - DNA, 21 bp, Homo sapiens
gactttgatactaccagggtc

SEQ ID NO: 4852682 - DNA, 14 bp, Homo sapiens
gagaaaagagagaa

SEQ ID NO: 4852683 - DNA, 15 bp, Homo sapiens
gagaaacccagagat

SEQ ID NO: 4852684 - DNA, 21 bp, Homo sapiens
gagaaacctgccaaggagcat

SEQ ID NO: 4852685 - DNA, 15 bp, Homo sapiens
gagaaatgccccagt

SEQ ID NO: 4852686 - DNA, 17 bp, Homo sapiens
gagaaatgccccagtgt

SEQ ID NO: 4852687 - DNA, 21 bp, Homo sapiens
gagaagtcttctatttattta

SEQ ID NO: 4852688 - DNA, 23 bp, Homo sapiens
gagaatgagtccttgatttcaaa

SEQ ID NO: 4852689 - DNA, 16 bp, Homo sapiens
gagaatggcatggcag

SEQ ID NO: 4852690 - DNA, 18 bp, Homo sapiens
gagaatggcatggcagga

SEQ ID NO: 4852691 - DNA, 17 bp, Homo sapiens
gagaatggcctggagca

SEQ ID NO: 4852692 - DNA, 18 bp, Homo sapiens
gagaatgggacgaggaca

SEQ ID NO: 4852693 - DNA, 11 bp, Homo sapiens
gagacagcagc

SEQ ID NO: 4852694 - DNA, 14 bp, Homo sapiens
gagacagcagcctg

SEQ ID NO: 4852695 - DNA, 17 bp, Homo sapiens
gagacagcagcctgtat

SEQ ID NO: 4852696 - DNA, 21 bp, Homo sapiens
gagacaggtgcctaacctggg

SEQ ID NO: 4852697 - DNA, 16 bp, Homo sapiens
gagacagtgaatttgg

SEQ ID NO: 4852698 - DNA, 17 bp, Homo sapiens
gagaccataagagaaac

SEQ ID NO: 4852699 - DNA, 16 bp, Homo sapiens
gagactgggagccact

SEQ ID NO: 4852700 - DNA, 18 bp, Homo sapiens
gagagagtagctgcagcc

SEQ ID NO: 4852701 - DNA, 15 bp, Homo sapiens
gagagcccgggagct

SEQ ID NO: 4852702 - DNA, 21 bp, Homo sapiens
gagaggactggttctgaggcc

SEQ ID NO: 4852703 - DNA, 23 bp, Homo sapiens
gagaggactggttctgaggccag

SEQ ID NO: 4852704 - DNA, 13 bp, Homo sapiens
gagagggaaaagg

SEQ ID NO: 4852705 - DNA, 13 bp, Homo sapiens
gagatactgtgta

SEQ ID NO: 4852706 - DNA, 14 bp, Homo sapiens
gagatcaaagatga

SEQ ID NO: 4852707 - DNA, 16 bp, Homo sapiens
gagatgaggagtaaaa

SEQ ID NO: 4852708 - DNA, 20 bp, Homo sapiens
gagatgaggagtaaaattca

SEQ ID NO: 4852709 - DNA, 21 bp, Homo sapiens
gagatggggaataatttcctt

SEQ ID NO: 4852710 - DNA, 23 bp, Homo sapiens
gagatggggaataatttccttca

SEQ ID NO: 4852711 - DNA, 23 bp, Homo sapiens
gagcaagcaccaacctccagact

SEQ ID NO: 4852712 - DNA, 16 bp, Homo sapiens
gagcacaaaattcaaa

SEQ ID NO: 4852713 - DNA, 19 bp, Homo sapiens
gagcacaaagaagaaagct

SEQ ID NO: 4852714 - DNA, 20 bp, Homo sapiens
gagcagagaagtacaggtca

SEQ ID NO: 4852715 - DNA, 16 bp, Homo sapiens
gagcagcaggcctctg

SEQ ID NO: 4852716 - DNA, 18 bp, Homo sapiens
gagcagcaggcctctggg

SEQ ID NO: 4852717 - DNA, 21 bp, Homo sapiens
gagcagccaaggccgccagcg

SEQ ID NO: 4852718 - DNA, 18 bp, Homo sapiens
gagcaggacctgggacag

SEQ ID NO: 4852719 - DNA, 22 bp, Homo sapiens
gagcaggacctgggacaggaaa

SEQ ID NO: 4852720 - DNA, 16 bp, Homo sapiens
gagcaggcccaatgct

SEQ ID NO: 4852721 - DNA, 17 bp, Homo sapiens
gagcaggcccaatgctg

SEQ ID NO: 4852722 - DNA, 20 bp, Homo sapiens
gagcaggcccaatgctgctt

SEQ ID NO: 4852723 - DNA, 17 bp, Homo sapiens
gagcagggatctgcccc

SEQ ID NO: 4852724 - DNA, 14 bp, Homo sapiens
gagcatagagaaca

SEQ ID NO: 4852725 - DNA, 13 bp, Homo sapiens
gagcatggggcca

SEQ ID NO: 4852726 - DNA, 15 bp, Homo sapiens
gagcatggggccagg

SEQ ID NO: 4852727 - DNA, 22 bp, Homo sapiens
gagcattgtcaccgcaggtgct

SEQ ID NO: 4852728 - DNA, 15 bp, Homo sapiens
gagccaattagactt

SEQ ID NO: 4852729 - DNA, 22 bp, Homo sapiens
gagcccgggagctgctgccctg

SEQ ID NO: 4852730 - DNA, 12 bp, Homo sapiens
gagccctcctga

SEQ ID NO: 4852731 - DNA, 17 bp, Homo sapiens
gagccctcctgagggcc

SEQ ID NO: 4852732 - DNA, 19 bp, Homo sapiens
gagccctcctgagggccgg

SEQ ID NO: 4852733 - DNA, 13 bp, Homo sapiens
gagcctacctctg

SEQ ID NO: 4852734 - DNA, 15 bp, Homo sapiens
gagcctacctctgtc

SEQ ID NO: 4852735 - DNA, 21 bp, Homo sapiens
gagccttgcagatatctgcat

SEQ ID NO: 4852736 - DNA, 22 bp, Homo sapiens
gagccttgcagatatctgcatg

SEQ ID NO: 4852737 - DNA, 19 bp, Homo sapiens
gagcgagagatcaaagatg

SEQ ID NO: 4852738 - DNA, 13 bp, Homo sapiens
gagctaggaaccc

SEQ ID NO: 4852739 - DNA, 15 bp, Homo sapiens
gagctctgaaatctt

SEQ ID NO: 4852740 - DNA, 19 bp, Homo sapiens
gagctctgaaatcttccca

SEQ ID NO: 4852741 - DNA, 14 bp, Homo sapiens
gagctgctgccctg

SEQ ID NO: 4852742 - DNA, 23 bp, Homo sapiens
gagctggctctataaggcagcct

SEQ ID NO: 4852743 - DNA, 21 bp, Homo sapiens
gagcttaatgctacatgtgag

SEQ ID NO: 4852744 - DNA, 12 bp, Homo sapiens
gaggaaaattct

SEQ ID NO: 4852745 - DNA, 13 bp, Homo sapiens
gaggacagggccc

SEQ ID NO: 4852746 - DNA, 14 bp, Homo sapiens
gaggacatggggag

SEQ ID NO: 4852747 - DNA, 17 bp, Homo sapiens
gaggacatttgtgggca

SEQ ID NO: 4852748 - DNA, 21 bp, Homo sapiens
gaggacatttgtgggcaagca

SEQ ID NO: 4852749 - DNA, 15 bp, Homo sapiens
gaggaccaatgcttg

SEQ ID NO: 4852750 - DNA, 12 bp, Homo sapiens
gaggacctccct

SEQ ID NO: 4852751 - DNA, 19 bp, Homo sapiens
gaggactggttctgaggcc

SEQ ID NO: 4852752 - DNA, 22 bp, Homo sapiens
gaggactggttctgaggccaga

SEQ ID NO: 4852753 - DNA, 13 bp, Homo sapiens
gaggagagaggag

SEQ ID NO: 4852754 - DNA, 16 bp, Homo sapiens
gaggagagaggaggaa

SEQ ID NO: 4852755 - DNA, 20 bp, Homo sapiens
gaggagagaggaggaaaagt

SEQ ID NO: 4852756 - DNA, 22 bp, Homo sapiens
gaggaggacttggttgatgttt

SEQ ID NO: 4852757 - DNA, 15 bp, Homo sapiens
gaggaggtgctgcag

SEQ ID NO: 4852758 - DNA, 14 bp, Homo sapiens
gaggataggacaga

SEQ ID NO: 4852759 - DNA, 15 bp, Homo sapiens
gaggataggacagag

SEQ ID NO: 4852760 - DNA, 13 bp, Homo sapiens
gaggatccagggc

SEQ ID NO: 4852761 - DNA, 17 bp, Homo sapiens
gaggatccagggcagca

SEQ ID NO: 4852762 - DNA, 23 bp, Homo sapiens
gaggcaaaaatgtccagccaccc

SEQ ID NO: 4852763 - DNA, 15 bp, Homo sapiens
gaggcacttccacct

SEQ ID NO: 4852764 - DNA, 17 bp, Homo sapiens
gaggccaagctgaggag

SEQ ID NO: 4852765 - DNA, 21 bp, Homo sapiens
gaggccagaaaggtgtgagga

SEQ ID NO: 4852766 - DNA, 12 bp, Homo sapiens
gaggctcctcta

SEQ ID NO: 4852767 - DNA, 14 bp, Homo sapiens
gaggctcctctagg

SEQ ID NO: 4852768 - DNA, 15 bp, Homo sapiens
gaggctcctctaggc

SEQ ID NO: 4852769 - DNA, 23 bp, Homo sapiens
gaggcttgtttacctttctctct

SEQ ID NO: 4852770 - DNA, 16 bp, Homo sapiens
gaggctttgggtggct

SEQ ID NO: 4852771 - DNA, 15 bp, Homo sapiens
gagggaaaaggcagg

SEQ ID NO: 4852772 - DNA, 24 bp, Homo sapiens
gagggacataagataaaatgatgt

SEQ ID NO: 4852773 - DNA, 15 bp, Homo sapiens
gagggactccaagcc

SEQ ID NO: 4852774 - DNA, 24 bp, Homo sapiens
gagggactccaagccctggggcag

SEQ ID NO: 4852775 - DNA, 21 bp, Homo sapiens
gagggaggggccctgtcactg

SEQ ID NO: 4852776 - DNA, 16 bp, Homo sapiens
gagggatgatgaggga

SEQ ID NO: 4852777 - DNA, 13 bp, Homo sapiens
gaggggatgataa

SEQ ID NO: 4852778 - DNA, 17 bp, Homo sapiens
gaggggatgataaagga

SEQ ID NO: 4852779 - DNA, 14 bp, Homo sapiens
gaggggcgcgggag

SEQ ID NO: 4852780 - DNA, 19 bp, Homo sapiens
gaggggcgcgggagggggc

SEQ ID NO: 4852781 - DNA, 20 bp, Homo sapiens
gaggggttccttccacttct

SEQ ID NO: 4852782 - DNA, 16 bp, Homo sapiens
gagggttggagtgctc

SEQ ID NO: 4852783 - DNA, 14 bp, Homo sapiens
gaggtattaaaact

SEQ ID NO: 4852784 - DNA, 15 bp, Homo sapiens
gaggtgaactccagg

SEQ ID NO: 4852785 - DNA, 17 bp, Homo sapiens
gaggtgaactccaggca

SEQ ID NO: 4852786 - DNA, 20 bp, Homo sapiens
gaggtggatactggggggca

SEQ ID NO: 4852787 - DNA, 22 bp, Homo sapiens
gaggtggatactggggggcagg

SEQ ID NO: 4852788 - DNA, 17 bp, Homo sapiens
gaggtggggtgctgggg

SEQ ID NO: 4852789 - DNA, 23 bp, Homo sapiens
gaggttgtggggcctcaggctcc

SEQ ID NO: 4852790 - DNA, 20 bp, Homo sapiens
gagtaatgtgactaaaggaa

SEQ ID NO: 4852791 - DNA, 19 bp, Homo sapiens
gagtacctactgtgtgcca

SEQ ID NO: 4852792 - DNA, 14 bp, Homo sapiens
gagtagctgcagcc

SEQ ID NO: 4852793 - DNA, 15 bp, Homo sapiens
gagtagctgcagcct

SEQ ID NO: 4852794 - DNA, 17 bp, Homo sapiens
gagtagggccctgacag

SEQ ID NO: 4852795 - DNA, 15 bp, Homo sapiens
gagtcagtgccaggt

SEQ ID NO: 4852796 - DNA, 17 bp, Homo sapiens
gagtctgtctcttggct

SEQ ID NO: 4852797 - DNA, 13 bp, Homo sapiens
gagtgtagctgtg

SEQ ID NO: 4852798 - DNA, 18 bp, Homo sapiens
gagtgtagctgtgaaatc

SEQ ID NO: 4852799 - DNA, 14 bp, Homo sapiens
gagtgtgcagacag

SEQ ID NO: 4852800 - DNA, 20 bp, Homo sapiens
gagtgtgcagacagccatgc

SEQ ID NO: 4852801 - DNA, 13 bp, Homo sapiens
gagttaaaatgca

SEQ ID NO: 4852802 - DNA, 15 bp, Homo sapiens
gagttaacaggacag

SEQ ID NO: 4852803 - DNA, 19 bp, Homo sapiens
gagttatcatgaattttaa

SEQ ID NO: 4852804 - DNA, 21 bp, Homo sapiens
gagtttgacagtttttgacat

SEQ ID NO: 4852805 - DNA, 19 bp, Homo sapiens
gataaatcataaagtcagt

SEQ ID NO: 4852806 - DNA, 16 bp, Homo sapiens
gataacttggggaggc

SEQ ID NO: 4852807 - DNA, 15 bp, Homo sapiens
gataatattgtttgg

SEQ ID NO: 4852808 - DNA, 13 bp, Homo sapiens
gatacaaagtgtt

SEQ ID NO: 4852809 - DNA, 16 bp, Homo sapiens
gatacagatctcaggg

SEQ ID NO: 4852810 - DNA, 16 bp, Homo sapiens
gataccatatgaatga

SEQ ID NO: 4852811 - DNA, 18 bp, Homo sapiens
gataccatatgaatgaaa

SEQ ID NO: 4852812 - DNA, 22 bp, Homo sapiens
gataccattctattctccagac

SEQ ID NO: 4852813 - DNA, 15 bp, Homo sapiens
gatacctgtgaggac

SEQ ID NO: 4852814 - DNA, 18 bp, Homo sapiens
gataccttcttatttaat

SEQ ID NO: 4852815 - DNA, 20 bp, Homo sapiens
gataccttcttatttaatct

SEQ ID NO: 4852816 - DNA, 13 bp, Homo sapiens
gatactaaggacg

SEQ ID NO: 4852817 - DNA, 22 bp, Homo sapiens
gatactaccagggtctctcagg

SEQ ID NO: 4852818 - DNA, 14 bp, Homo sapiens
gatactgtgtatat

SEQ ID NO: 4852819 - DNA, 14 bp, Homo sapiens
gatacttacatgtt

SEQ ID NO: 4852820 - DNA, 19 bp, Homo sapiens
gatacttcccacaccacaa

SEQ ID NO: 4852821 - DNA, 21 bp, Homo sapiens
gatagagacttgcagttagac

SEQ ID NO: 4852822 - DNA, 13 bp, Homo sapiens
gatataccaaatt

SEQ ID NO: 4852823 - DNA, 19 bp, Homo sapiens
gatatataggctattttct

SEQ ID NO: 4852824 - DNA, 21 bp, Homo sapiens
gatatataggctattttctaa

SEQ ID NO: 4852825 - DNA, 13 bp, Homo sapiens
gatatctgcatgt

SEQ ID NO: 4852826 - DNA, 15 bp, Homo sapiens
gatatctgcatgtgt

SEQ ID NO: 4852827 - DNA, 14 bp, Homo sapiens
gatattttgaaatg

SEQ ID NO: 4852828 - DNA, 20 bp, Homo sapiens
gatattttgaaatgaacttt

SEQ ID NO: 4852829 - DNA, 12 bp, Homo sapiens
gatcaaagatga

SEQ ID NO: 4852830 - DNA, 15 bp, Homo sapiens
gatcaaagatgaaaa

SEQ ID NO: 4852831 - DNA, 18 bp, Homo sapiens
gatcaaagatgaaaagta

SEQ ID NO: 4852832 - DNA, 22 bp, Homo sapiens
gatcacccattccgggttcact

SEQ ID NO: 4852833 - DNA, 19 bp, Homo sapiens
gatcagcaaaaagactgga

SEQ ID NO: 4852834 - DNA, 20 bp, Homo sapiens
gatcatatggtaggaccctc

SEQ ID NO: 4852835 - DNA, 17 bp, Homo sapiens
gatccagcccaaacctg

SEQ ID NO: 4852836 - DNA, 19 bp, Homo sapiens
gatccagcccaaacctggg

SEQ ID NO: 4852837 - DNA, 12 bp, Homo sapiens
gatccagggcag

SEQ ID NO: 4852838 - DNA, 15 bp, Homo sapiens
gatccagggcagcag

SEQ ID NO: 4852839 - DNA, 19 bp, Homo sapiens
gatccagggcagcaggcca

SEQ ID NO: 4852840 - DNA, 20 bp, Homo sapiens
gatccagggcagcaggccag

SEQ ID NO: 4852841 - DNA, 16 bp, Homo sapiens
gatccagtataagact

SEQ ID NO: 4852842 - DNA, 14 bp, Homo sapiens
gatcccatggccag

SEQ ID NO: 4852843 - DNA, 20 bp, Homo sapiens
gatcctcagttctcaaatgt

SEQ ID NO: 4852844 - DNA, 16 bp, Homo sapiens
gatcctccctcatggc

SEQ ID NO: 4852845 - DNA, 19 bp, Homo sapiens
gatcgagtgtagctgtgaa

SEQ ID NO: 4852846 - DNA, 20 bp, Homo sapiens
gatcgagtgtagctgtgaaa

SEQ ID NO: 4852847 - DNA, 14 bp, Homo sapiens
gatcgcccccacct

SEQ ID NO: 4852848 - DNA, 13 bp, Homo sapiens
gatcgggaagcag

SEQ ID NO: 4852849 - DNA, 23 bp, Homo sapiens
gatctttatatttcaataaatga

SEQ ID NO: 4852850 - DNA, 16 bp, Homo sapiens
gatctttcagaaatat

SEQ ID NO: 4852851 - DNA, 18 bp, Homo sapiens
gatctttcagaaatataa

SEQ ID NO: 4852852 - DNA, 12 bp, Homo sapiens
gatgacctccag

SEQ ID NO: 4852853 - DNA, 16 bp, Homo sapiens
gatgacctccagaagt

SEQ ID NO: 4852854 - DNA, 12 bp, Homo sapiens
gatgagagaatg

SEQ ID NO: 4852855 - DNA, 19 bp, Homo sapiens
gatgagtttcactgtactg

SEQ ID NO: 4852856 - DNA, 16 bp, Homo sapiens
gatgatgctttggaag

SEQ ID NO: 4852857 - DNA, 22 bp, Homo sapiens
gatgcaaatagattcagagaaa

SEQ ID NO: 4852858 - DNA, 23 bp, Homo sapiens
gatgcaaatagattcagagaaat

SEQ ID NO: 4852859 - DNA, 16 bp, Homo sapiens
gatgcatcatctcttc

SEQ ID NO: 4852860 - DNA, 15 bp, Homo sapiens
gatgcatttaataaa

SEQ ID NO: 4852861 - DNA, 17 bp, Homo sapiens
gatgcatttaataaaga

SEQ ID NO: 4852862 - DNA, 14 bp, Homo sapiens
gcagggaggggagg

SEQ ID NO: 4852863 - DNA, 14 bp, Homo sapiens
gcagggatctgccc

SEQ ID NO: 4852864 - DNA, 16 bp, Homo sapiens
gcagggtggggggcca

SEQ ID NO: 4852865 - DNA, 16 bp, Homo sapiens
gcaggtgctcatgctg

SEQ ID NO: 4852866 - DNA, 18 bp, Homo sapiens
gcaggtgctcatgctgct

SEQ ID NO: 4852867 - DNA, 20 bp, Homo sapiens
gcaggtgcttttggcagaga

SEQ ID NO: 4852868 - DNA, 20 bp, Homo sapiens
gcagtgtgaggacctccctg

SEQ ID NO: 4852869 - DNA, 22 bp, Homo sapiens
gcagttagctgaagaattgaaa

SEQ ID NO: 4852870 - DNA, 18 bp, Homo sapiens
gcagttcctgtcccacat

SEQ ID NO: 4852871 - DNA, 14 bp, Homo sapiens
ctgactagaactcc

SEQ ID NO: 4852872 - DNA, 18 bp, Homo sapiens
ctgactagaactcctgtc

SEQ ID NO: 4852873 - DNA, 14 bp, Homo sapiens
ctgactcagtgacc

SEQ ID NO: 4852874 - DNA, 20 bp, Homo sapiens
ctgactcagtgaccagtgcc

SEQ ID NO: 4852875 - DNA, 14 bp, Homo sapiens
ctgacttaggtttc

SEQ ID NO: 4852876 - DNA, 20 bp, Homo sapiens
ctgagaaacactatttgtga

SEQ ID NO: 4852877 - DNA, 18 bp, Homo sapiens
ctgagaattgaggggagg

SEQ ID NO: 4852878 - DNA, 14 bp, Homo sapiens
ctgagacaggtgcc

SEQ ID NO: 4852879 - DNA, 15 bp, Homo sapiens
ctgagacaggtgcct

SEQ ID NO: 4852880 - DNA, 21 bp, Homo sapiens
ctgagcagggatctgccccct

SEQ ID NO: 4852881 - DNA, 15 bp, Homo sapiens
ctgagccctcctgag

SEQ ID NO: 4852882 - DNA, 14 bp, Homo sapiens
ctgaggaggtgctg

SEQ ID NO: 4852883 - DNA, 15 bp, Homo sapiens
ctgaggaggtgctgc

SEQ ID NO: 4852884 - DNA, 16 bp, Homo sapiens
ctgaggccagaaaggt

SEQ ID NO: 4852885 - DNA, 14 bp, Homo sapiens
ctgaggcccagaga

SEQ ID NO: 4852886 - DNA, 18 bp, Homo sapiens
ctgataacttggggaggc

SEQ ID NO: 4852887 - DNA, 20 bp, Homo sapiens
ctgataacttggggaggcaa

SEQ ID NO: 4852888 - DNA, 18 bp, Homo sapiens
ctgataccatatgaatga

SEQ ID NO: 4852889 - DNA, 16 bp, Homo sapiens
ctgatgaaagctttgg

SEQ ID NO: 4852890 - DNA, 20 bp, Homo sapiens
ctgatgagagaatgtggaaa

SEQ ID NO: 4852891 - DNA, 18 bp, Homo sapiens
ctgatgagtttcactgta

SEQ ID NO: 4852892 - DNA, 20 bp, Homo sapiens
ctgatggagtgtgcagacag

SEQ ID NO: 4852893 - DNA, 21 bp, Homo sapiens
ctgatggagtgtgcagacagc

SEQ ID NO: 4852894 - DNA, 22 bp, Homo sapiens
ctgatggagtgtgcagacagcc

SEQ ID NO: 4852895 - DNA, 14 bp, Homo sapiens
ctgattctggcttt

SEQ ID NO: 4852896 - DNA, 15 bp, Homo sapiens
ctgattctggcttta

SEQ ID NO: 4852897 - DNA, 19 bp, Homo sapiens
ctgcaaaaattatatattg

SEQ ID NO: 4852898 - DNA, 15 bp, Homo sapiens
ctgcaaaactccagg

SEQ ID NO: 4852899 - DNA, 18 bp, Homo sapiens
ctgcaaaactccaggcag

SEQ ID NO: 4852900 - DNA, 20 bp, Homo sapiens
ctgcaaaactccaggcagga

SEQ ID NO: 4852901 - DNA, 17 bp, Homo sapiens
ctgcaagagcccagatc

SEQ ID NO: 4852902 - DNA, 12 bp, Homo sapiens
ctgcaaggtggc

SEQ ID NO: 4852903 - DNA, 21 bp, Homo sapiens
ctgcaaggtggcctctgcctg

SEQ ID NO: 4852904 - DNA, 22 bp, Homo sapiens
ctgcaaggtggcctctgcctgg

SEQ ID NO: 4852905 - DNA, 16 bp, Homo sapiens
ctgcaatcactgtgct

SEQ ID NO: 4852906 - DNA, 20 bp, Homo sapiens
ctgcacacactcacctctaa

SEQ ID NO: 4852907 - DNA, 17 bp, Homo sapiens
ctgcacccgcctcgacc

SEQ ID NO: 4852908 - DNA, 20 bp, Homo sapiens
ctgcagaaaccctgagcaga

SEQ ID NO: 4852909 - DNA, 15 bp, Homo sapiens
ctgcagtcagactga

SEQ ID NO: 4852910 - DNA, 18 bp, Homo sapiens
ctgcatcttggttatttc

SEQ ID NO: 4852911 - DNA, 19 bp, Homo sapiens
ctgcatgatttttgccctg

SEQ ID NO: 4852912 - DNA, 20 bp, Homo sapiens
ctgcatgatttttgccctgc

SEQ ID NO: 4852913 - DNA, 21 bp, Homo sapiens
ctgcatggggaggcagcagag

SEQ ID NO: 4852914 - DNA, 20 bp, Homo sapiens
ctgcatgtagaggcttgttt

SEQ ID NO: 4852915 - DNA, 17 bp, Homo sapiens
ctgcatgtgacttctcc

SEQ ID NO: 4852916 - DNA, 20 bp, Homo sapiens
ctgcatgtgacttctcccct

SEQ ID NO: 4852917 - DNA, 15 bp, Homo sapiens
ctgcatttaaaaaaa

SEQ ID NO: 4852918 - DNA, 18 bp, Homo sapiens
ctgccaaaggatgtgata

SEQ ID NO: 4852919 - DNA, 22 bp, Homo sapiens
ctgccaaaggatgtgatatata

SEQ ID NO: 4852920 - DNA, 14 bp, Homo sapiens
ctgccaaggagcat

SEQ ID NO: 4852921 - DNA, 15 bp, Homo sapiens
ctgccaaggagcatc

SEQ ID NO: 4852922 - DNA, 20 bp, Homo sapiens
ctgccaaggagcatccttgg

SEQ ID NO: 4852923 - DNA, 15 bp, Homo sapiens
ctgccaccttcaagt

SEQ ID NO: 4852924 - DNA, 19 bp, Homo sapiens
ctgccagctgcagcctggt

SEQ ID NO: 4852925 - DNA, 21 bp, Homo sapiens
ctgccaggggctctgtggcaa

SEQ ID NO: 4852926 - DNA, 17 bp, Homo sapiens
ctgccagttacttgggc

SEQ ID NO: 4852927 - DNA, 20 bp, Homo sapiens
ctgccagttacttgggcttc

SEQ ID NO: 4852928 - DNA, 22 bp, Homo sapiens
ctgccattacagaggtattaaa

SEQ ID NO: 4852929 - DNA, 21 bp, Homo sapiens
ctgcccacaactcccttgcac

SEQ ID NO: 4852930 - DNA, 13 bp, Homo sapiens
ctgcccagttgca

SEQ ID NO: 4852931 - DNA, 18 bp, Homo sapiens
ctgccctctgctctgcct

SEQ ID NO: 4852932 - DNA, 21 bp, Homo sapiens
ctgccctctgctctgcctgga

SEQ ID NO: 4852933 - DNA, 18 bp, Homo sapiens
ctgcccttcctcctgatg

SEQ ID NO: 4852934 - DNA, 20 bp, Homo sapiens
ctgcccttcctcctgatgga

SEQ ID NO: 4852935 - DNA, 18 bp, Homo sapiens
ctgccgttttctgggctg

SEQ ID NO: 4852936 - DNA, 13 bp, Homo sapiens
ctgcctcaggacc

SEQ ID NO: 4852937 - DNA, 20 bp, Homo sapiens
ctgcctcaggacccatccct

SEQ ID NO: 4852938 - DNA, 22 bp, Homo sapiens
ctgcctcaggacccatccctgc

SEQ ID NO: 4852939 - DNA, 13 bp, Homo sapiens
ctgcctcaggcca

SEQ ID NO: 4852940 - DNA, 16 bp, Homo sapiens
ctgcctcccactccat

SEQ ID NO: 4852941 - DNA, 22 bp, Homo sapiens
ctgcctggaggctcctctaggc

SEQ ID NO: 4852942 - DNA, 22 bp, Homo sapiens
ctgcctggagtgtcggatcctg

SEQ ID NO: 4852943 - DNA, 19 bp, Homo sapiens
ctgcctggggcctccagaa

SEQ ID NO: 4852944 - DNA, 13 bp, Homo sapiens
ctgccttcgttta

SEQ ID NO: 4852945 - DNA, 16 bp, Homo sapiens
ctgccttgcttctgta

SEQ ID NO: 4852946 - DNA, 23 bp, Homo sapiens
ctgccttgcttctgtatttcctt

SEQ ID NO: 4852947 - DNA, 19 bp, Homo sapiens
ctgcgccgccgccggagtc

SEQ ID NO: 4852948 - DNA, 13 bp, Homo sapiens
ctgcgtcccttct

SEQ ID NO: 4852949 - DNA, 14 bp, Homo sapiens
ctgctaacaagtca

SEQ ID NO: 4852950 - DNA, 17 bp, Homo sapiens
ctgctaaggctcctcct

SEQ ID NO: 4852951 - DNA, 22 bp, Homo sapiens
ctgctatttttaatttcctgtg

SEQ ID NO: 4852952 - DNA, 18 bp, Homo sapiens
ctgctcacgtcaaatgca

SEQ ID NO: 4852953 - DNA, 18 bp, Homo sapiens
ctgctcccattcctccct

SEQ ID NO: 4852954 - DNA, 11 bp, Homo sapiens
ctgctcctctc

SEQ ID NO: 4852955 - DNA, 15 bp, Homo sapiens
ctgctcctctcttgg

SEQ ID NO: 4852956 - DNA, 22 bp, Homo sapiens
ctgctcggctactggttacctg

SEQ ID NO: 4852957 - DNA, 21 bp, Homo sapiens
ctgctctatactgtggcctgc

SEQ ID NO: 4852958 - DNA, 22 bp, Homo sapiens
ctgctctatactgtggcctgca

SEQ ID NO: 4852959 - DNA, 17 bp, Homo sapiens
ctgctctcatataagac

SEQ ID NO: 4852960 - DNA, 17 bp, Homo sapiens
ctgctctgcctggagtg

SEQ ID NO: 4852961 - DNA, 15 bp, Homo sapiens
ctgctgctcctctct

SEQ ID NO: 4852962 - DNA, 15 bp, Homo sapiens
ctgctggccggagca

SEQ ID NO: 4852963 - DNA, 21 bp, Homo sapiens
ctgctgggcgtgtgtgacact

SEQ ID NO: 4852964 - DNA, 20 bp, Homo sapiens
ctgctgtctaacctgtgacc

SEQ ID NO: 4852965 - DNA, 14 bp, Homo sapiens
ctgctgttgaactt

SEQ ID NO: 4852966 - DNA, 23 bp, Homo sapiens
ctgcttaatcttcaaagccttct

SEQ ID NO: 4852967 - DNA, 20 bp, Homo sapiens
ctgcttcccttactttgctg

SEQ ID NO: 4852968 - DNA, 17 bp, Homo sapiens
ctgcttgatatcccaag

SEQ ID NO: 4852969 - DNA, 11 bp, Homo sapiens
ctgcttggccc

SEQ ID NO: 4852970 - DNA, 17 bp, Homo sapiens
ctgcttggcccttcaag

SEQ ID NO: 4852971 - DNA, 13 bp, Homo sapiens
ctgctttaatcag

SEQ ID NO: 4852972 - DNA, 20 bp, Homo sapiens
ctgctttttggaaagtcaga

SEQ ID NO: 4852973 - DNA, 16 bp, Homo sapiens
ctggaaagcacaagac

SEQ ID NO: 4852974 - DNA, 23 bp, Homo sapiens
ctggaaagcacaagactggccca

SEQ ID NO: 4852975 - DNA, 13 bp, Homo sapiens
ctggaagagggag

SEQ ID NO: 4852976 - DNA, 14 bp, Homo sapiens
ctggaagagggagg

SEQ ID NO: 4852977 - DNA, 24 bp, Homo sapiens
ctggaagagggaggggccctgtca

SEQ ID NO: 4852978 - DNA, 15 bp, Homo sapiens
ctggaagtacttggc

SEQ ID NO: 4852979 - DNA, 17 bp, Homo sapiens
ctggaagtacttggccc

SEQ ID NO: 4852980 - DNA, 22 bp, Homo sapiens
ctggagcagcggattgctctgg

SEQ ID NO: 4852981 - DNA, 12 bp, Homo sapiens
ctggagcaggcc

SEQ ID NO: 4852982 - DNA, 14 bp, Homo sapiens
ctggagcaggccca

SEQ ID NO: 4852983 - DNA, 15 bp, Homo sapiens
ctggagcaggcccaa

SEQ ID NO: 4852984 - DNA, 22 bp, Homo sapiens
ctggagcaggcccaatgctgct

SEQ ID NO: 4852985 - DNA, 16 bp, Homo sapiens
ctggagcttcagccag

SEQ ID NO: 4852986 - DNA, 18 bp, Homo sapiens
ctggagcttcagccaggt

SEQ ID NO: 4852987 - DNA, 19 bp, Homo sapiens
ctggagcttcagccaggtc

SEQ ID NO: 4852988 - DNA, 15 bp, Homo sapiens
ctggaggctcctcta

SEQ ID NO: 4852989 - DNA, 17 bp, Homo sapiens
ctggaggctcctctagg

SEQ ID NO: 4852990 - DNA, 23 bp, Homo sapiens
cgagagccttacttcaaagtgcc

SEQ ID NO: 4852991 - DNA, 17 bp, Homo sapiens
cgagatcgggaagcaga

SEQ ID NO: 4852992 - DNA, 14 bp, Homo sapiens
cgaggacatttgtg

SEQ ID NO: 4852993 - DNA, 17 bp, Homo sapiens
cgagtgtagctgtgaaa

SEQ ID NO: 4852994 - DNA, 14 bp, Homo sapiens
cgatgcatttaata

SEQ ID NO: 4852995 - DNA, 15 bp, Homo sapiens
cgatgcatttaataa

SEQ ID NO: 4852996 - DNA, 16 bp, Homo sapiens
cgatgcatttaataaa

SEQ ID NO: 4852997 - DNA, 23 bp, Homo sapiens
cgatgcatttaataaagatgagt

SEQ ID NO: 4852998 - DNA, 24 bp, Homo sapiens
cgatgcatttaataaagatgagtt

SEQ ID NO: 4852999 - DNA, 15 bp, Homo sapiens
cgattagtgatgtcc

SEQ ID NO: 4853000 - DNA, 22 bp, Homo sapiens
cgatttcactaggactcagaaa

SEQ ID NO: 4853001 - DNA, 13 bp, Homo sapiens
cgcagacctggag

SEQ ID NO: 4853002 - DNA, 17 bp, Homo sapiens
cgcagagaaatgcccca

SEQ ID NO: 4853003 - DNA, 14 bp, Homo sapiens
cgcagaggtggggt

SEQ ID NO: 4853004 - DNA, 13 bp, Homo sapiens
cgcaggtgctcat

SEQ ID NO: 4853005 - DNA, 23 bp, Homo sapiens
cgcaggtgctcatgctgctcccc

SEQ ID NO: 4853006 - DNA, 23 bp, Homo sapiens
cgccaaggaaaggcatgtacaaa

SEQ ID NO: 4853007 - DNA, 19 bp, Homo sapiens
cgccagcgtgtggagcaga

SEQ ID NO: 4853008 - DNA, 18 bp, Homo sapiens
cgcccctcccacgcctca

SEQ ID NO: 4853009 - DNA, 23 bp, Homo sapiens
cgccctgcttcactgccccctcc

SEQ ID NO: 4853010 - DNA, 22 bp, Homo sapiens
cgccgccggagtccactcccag

SEQ ID NO: 4853011 - DNA, 19 bp, Homo sapiens
cgcctcaccagccccccgc

SEQ ID NO: 4853012 - DNA, 18 bp, Homo sapiens
cgcctcgacctccccacc

SEQ ID NO: 4853013 - DNA, 22 bp, Homo sapiens
cgcctcgacctccccacccgct

SEQ ID NO: 4853014 - DNA, 20 bp, Homo sapiens
ctcctcccgccccgcccctc

SEQ ID NO: 4853015 - DNA, 22 bp, Homo sapiens
ctcctccctcagctctctggga

SEQ ID NO: 4853016 - DNA, 18 bp, Homo sapiens
ctcctctaggccctgtga

SEQ ID NO: 4853017 - DNA, 15 bp, Homo sapiens
ctcctctctctttcc

SEQ ID NO: 4853018 - DNA, 14 bp, Homo sapiens
ctcctcttgttcct

SEQ ID NO: 4853019 - DNA, 17 bp, Homo sapiens
ctcctcttgttcctgaa

SEQ ID NO: 4853020 - DNA, 12 bp, Homo sapiens
ctcctgccctct

SEQ ID NO: 4853021 - DNA, 14 bp, Homo sapiens
ctcctgccctctgc

SEQ ID NO: 4853022 - DNA, 19 bp, Homo sapiens
ctcctgccctctgctctgc

SEQ ID NO: 4853023 - DNA, 21 bp, Homo sapiens
ctcctgggcattagcaaggca

SEQ ID NO: 4853024 - DNA, 23 bp, Homo sapiens
ctcctgggcattagcaaggcaga

SEQ ID NO: 4853025 - DNA, 17 bp, Homo sapiens
ctccttagccctgtctg

SEQ ID NO: 4853026 - DNA, 19 bp, Homo sapiens
ctccttatagacacttgct

SEQ ID NO: 4853027 - DNA, 21 bp, Homo sapiens
ctccttatagacacttgctcc

SEQ ID NO: 4853028 - DNA, 18 bp, Homo sapiens
ctccttcatgtttggaaa

SEQ ID NO: 4853029 - DNA, 14 bp, Homo sapiens
ctccttgcccagac

SEQ ID NO: 4853030 - DNA, 17 bp, Homo sapiens
ctcctttcccctctcat

SEQ ID NO: 4853031 - DNA, 16 bp, Homo sapiens
ctcgacctccccaccc

SEQ ID NO: 4853032 - DNA, 22 bp, Homo sapiens
ctcgactgtcagtggggcagcc

SEQ ID NO: 4853033 - DNA, 12 bp, Homo sapiens
ctcgctgctggg

SEQ ID NO: 4853034 - DNA, 22 bp, Homo sapiens
ctctaaaaggtaatgtgtggat

SEQ ID NO: 4853035 - DNA, 15 bp, Homo sapiens
ctctaaaattataaa

SEQ ID NO: 4853036 - DNA, 17 bp, Homo sapiens
ctctaaaattataaatg

SEQ ID NO: 4853037 - DNA, 19 bp, Homo sapiens
ctctaagtgctgctgtgga

SEQ ID NO: 4853038 - DNA, 22 bp, Homo sapiens
ctctacccctgctcccattcct

SEQ ID NO: 4853039 - DNA, 15 bp, Homo sapiens
ctctagagggcgagg

SEQ ID NO: 4853040 - DNA, 18 bp, Homo sapiens
ctctaggccctgtgagca

SEQ ID NO: 4853041 - DNA, 20 bp, Homo sapiens
ctctaggccctgtgagcaca

SEQ ID NO: 4853042 - DNA, 13 bp, Homo sapiens
ctctatactgtgg

SEQ ID NO: 4853043 - DNA, 15 bp, Homo sapiens
ctctatagcaccagg

SEQ ID NO: 4853044 - DNA, 19 bp, Homo sapiens
ctctattgggcacagccta

SEQ ID NO: 4853045 - DNA, 16 bp, Homo sapiens
ctctcaaacctggcag

SEQ ID NO: 4853046 - DNA, 19 bp, Homo sapiens
ctctcaaacctggcagatg

SEQ ID NO: 4853047 - DNA, 15 bp, Homo sapiens
ctctcagttctctcc

SEQ ID NO: 4853048 - DNA, 14 bp, Homo sapiens
ctctccaagcacta

SEQ ID NO: 4853049 - DNA, 18 bp, Homo sapiens
ctctccaagcactagcct

SEQ ID NO: 4853050 - DNA, 23 bp, Homo sapiens
ctctccaagcactagccttccca

SEQ ID NO: 4853051 - DNA, 13 bp, Homo sapiens
ctctcccctcctg

SEQ ID NO: 4853052 - DNA, 20 bp, Homo sapiens
ctctcctccagccctgggca

SEQ ID NO: 4853053 - DNA, 13 bp, Homo sapiens
ctctcctccccta

SEQ ID NO: 4853054 - DNA, 20 bp, Homo sapiens
ctctcctcccgccccgcccc

SEQ ID NO: 4853055 - DNA, 22 bp, Homo sapiens
ctctccttcatgacagcctcca

SEQ ID NO: 4853056 - DNA, 22 bp, Homo sapiens
ctctcgactgtcagtggggcag

SEQ ID NO: 4853057 - DNA, 22 bp, Homo sapiens
ctctcggctgccaggggctctg

SEQ ID NO: 4853058 - DNA, 19 bp, Homo sapiens
ctctgcaagcttcttgctg

SEQ ID NO: 4853059 - DNA, 14 bp, Homo sapiens
ctctgccaaaggat

SEQ ID NO: 4853060 - DNA, 21 bp, Homo sapiens
ctctgcctggggcctccagaa

SEQ ID NO: 4853061 - DNA, 13 bp, Homo sapiens
ctctgctctgcct

SEQ ID NO: 4853062 - DNA, 15 bp, Homo sapiens
ctctgctctgcctgg

SEQ ID NO: 4853063 - DNA, 16 bp, Homo sapiens
ctctgctctgcctgga

SEQ ID NO: 4853064 - DNA, 15 bp, Homo sapiens
ctctggaagagggag

SEQ ID NO: 4853065 - DNA, 17 bp, Homo sapiens
ctctggaagagggaggg

SEQ ID NO: 4853066 - DNA, 15 bp, Homo sapiens
ctctggactggaaag

SEQ ID NO: 4853067 - DNA, 11 bp, Homo sapiens
ctctggagcag

SEQ ID NO: 4853068 - DNA, 12 bp, Homo sapiens
ctctggagcagc

SEQ ID NO: 4853069 - DNA, 20 bp, Homo sapiens
ctctggcttcaaaaagccac

SEQ ID NO: 4853070 - DNA, 21 bp, Homo sapiens
ctctggcttcaaaaagccaca

SEQ ID NO: 4853071 - DNA, 19 bp, Homo sapiens
ctctgggacccacagaact

SEQ ID NO: 4853072 - DNA, 20 bp, Homo sapiens
ctctgggacccacagaactt

SEQ ID NO: 4853073 - DNA, 14 bp, Homo sapiens
ctctgggcccaggg

SEQ ID NO: 4853074 - DNA, 22 bp, Homo sapiens
ctctgggcccaggggctgtggc

SEQ ID NO: 4853075 - DNA, 22 bp, Homo sapiens
ctctgggttgtgcacatttctt

SEQ ID NO: 4853076 - DNA, 17 bp, Homo sapiens
ctctggtaatattgact

SEQ ID NO: 4853077 - DNA, 16 bp, Homo sapiens
ctctgtactaaggaga

SEQ ID NO: 4853078 - DNA, 17 bp, Homo sapiens
ctctgtccgtgcccctt

SEQ ID NO: 4853079 - DNA, 23 bp, Homo sapiens
ctctgtccgtgccccttccctgg

SEQ ID NO: 4853080 - DNA, 21 bp, Homo sapiens
ctctgtctgagacaggtgcct

SEQ ID NO: 4853081 - DNA, 16 bp, Homo sapiens
ctctgtcttgtgtttc

SEQ ID NO: 4853082 - DNA, 16 bp, Homo sapiens
ctctgtggcaaaaaga

SEQ ID NO: 4853083 - DNA, 21 bp, Homo sapiens
ctctgtggcaaaaagagtcag

SEQ ID NO: 4853084 - DNA, 13 bp, Homo sapiens
ctctgtgtaacca

SEQ ID NO: 4853085 - DNA, 22 bp, Homo sapiens
ctctgtgtaaccagctcagtgt

SEQ ID NO: 4853086 - DNA, 16 bp, Homo sapiens
ctctgttcccccaccc

SEQ ID NO: 4853087 - DNA, 22 bp, Homo sapiens
ctcttaaagaaaacccaccccg

SEQ ID NO: 4853088 - DNA, 16 bp, Homo sapiens
ctcttatttatagaat

SEQ ID NO: 4853089 - DNA, 22 bp, Homo sapiens
ctcttatttatagaatttaata

SEQ ID NO: 4853090 - DNA, 10 bp, Homo sapiens
ctcttcccac

SEQ ID NO: 4853091 - DNA, 16 bp, Homo sapiens
ctcttcccactccagc

SEQ ID NO: 4853092 - DNA, 20 bp, Homo sapiens
ctcttcctatccctctccta

SEQ ID NO: 4853093 - DNA, 14 bp, Homo sapiens
ctcttcggtggcct

SEQ ID NO: 4853094 - DNA, 21 bp, Homo sapiens
ctcttctagatgattttttga

SEQ ID NO: 4853095 - DNA, 15 bp, Homo sapiens
ctcttctctcctccc

SEQ ID NO: 4853096 - DNA, 12 bp, Homo sapiens
ctcttcttcctc

SEQ ID NO: 4853097 - DNA, 14 bp, Homo sapiens
ctcttgaaacctga

SEQ ID NO: 4853098 - DNA, 22 bp, Homo sapiens
ctctttgggcctctcctgccct

SEQ ID NO: 4853099 - DNA, 21 bp, Homo sapiens
ctcttttgcttgccaaagtac

SEQ ID NO: 4853100 - DNA, 17 bp, Homo sapiens
ctgaaagagaggactgg

SEQ ID NO: 4853101 - DNA, 14 bp, Homo sapiens
ctgaaatccttgag

SEQ ID NO: 4853102 - DNA, 21 bp, Homo sapiens
ctgaaatcttcccatgcattc

SEQ ID NO: 4853103 - DNA, 23 bp, Homo sapiens
ctgaaatcttcccatgcattctg

SEQ ID NO: 4853104 - DNA, 24 bp, Homo sapiens
ctgaaatggcctgtccctagggct

SEQ ID NO: 4853105 - DNA, 22 bp, Homo sapiens
ctgaaattttagaaatattcac

SEQ ID NO: 4853106 - DNA, 12 bp, Homo sapiens
ctgaacacatgt

SEQ ID NO: 4853107 - DNA, 15 bp, Homo sapiens
ctgaacacatgtgta

SEQ ID NO: 4853108 - DNA, 16 bp, Homo sapiens
ctgaacacatgtgtat

SEQ ID NO: 4853109 - DNA, 14 bp, Homo sapiens
ctgaacagaattaa

SEQ ID NO: 4853110 - DNA, 13 bp, Homo sapiens
ctgaacaggaaag

SEQ ID NO: 4853111 - DNA, 18 bp, Homo sapiens
ctgaagaattgaaaagtt

SEQ ID NO: 4853112 - DNA, 20 bp, Homo sapiens
ctgaagagaccactcaatcc

SEQ ID NO: 4853113 - DNA, 12 bp, Homo sapiens
ctgaagagcatt

SEQ ID NO: 4853114 - DNA, 13 bp, Homo sapiens
ctgaagagtggaa

SEQ ID NO: 4853115 - DNA, 15 bp, Homo sapiens
ctgaagctggagcag

SEQ ID NO: 4853116 - DNA, 13 bp, Homo sapiens
ctgaagtatgaag

SEQ ID NO: 4853117 - DNA, 15 bp, Homo sapiens
ctgaatagatatgaa

SEQ ID NO: 4853118 - DNA, 15 bp, Homo sapiens
ccctcagctctctgg

SEQ ID NO: 4853119 - DNA, 16 bp, Homo sapiens
ccctcagctctctggg

SEQ ID NO: 4853120 - DNA, 20 bp, Homo sapiens
ccctccaaaggaactctaga

SEQ ID NO: 4853121 - DNA, 16 bp, Homo sapiens
ccctccaagggatctg

SEQ ID NO: 4853122 - DNA, 23 bp, Homo sapiens
ccctccagagaaagcacaattta

SEQ ID NO: 4853123 - DNA, 12 bp, Homo sapiens
ccctcccaccca

SEQ ID NO: 4853124 - DNA, 23 bp, Homo sapiens
ccctccggcgggtgacagctccg

SEQ ID NO: 4853125 - DNA, 13 bp, Homo sapiens
ccctctctctggg

SEQ ID NO: 4853126 - DNA, 14 bp, Homo sapiens
ccctctctctgggc

SEQ ID NO: 4853127 - DNA, 23 bp, Homo sapiens
ccctctgtccttcccccagcaca

SEQ ID NO: 4853128 - DNA, 24 bp, Homo sapiens
ccctgaaatggcctgtccctaggg

SEQ ID NO: 4853129 - DNA, 16 bp, Homo sapiens
ccctgacaggccttcc

SEQ ID NO: 4853130 - DNA, 22 bp, Homo sapiens
ccctgcaaaactccaggcagga

SEQ ID NO: 4853131 - DNA, 22 bp, Homo sapiens
ccctgccagctgcagcctggtt

SEQ ID NO: 4853132 - DNA, 23 bp, Homo sapiens
ccctgcccttcctcctgatggag

SEQ ID NO: 4853133 - DNA, 24 bp, Homo sapiens
ccctgcctcaggccaagggaccag

SEQ ID NO: 4853134 - DNA, 14 bp, Homo sapiens
ccctgcctggaggc

SEQ ID NO: 4853135 - DNA, 23 bp, Homo sapiens
ccctgcctggaggctcctctagg

SEQ ID NO: 4853136 - DNA, 13 bp, Homo sapiens
ccctgggcacata

SEQ ID NO: 4853137 - DNA, 18 bp, Homo sapiens
ccctgggcatgcccagcc

SEQ ID NO: 4853138 - DNA, 19 bp, Homo sapiens
ccctggggcagggtggggg

SEQ ID NO: 4853139 - DNA, 20 bp, Homo sapiens
ccctgggtttgggagccagg

SEQ ID NO: 4853140 - DNA, 16 bp, Homo sapiens
ccctgtcactgtccag

SEQ ID NO: 4853141 - DNA, 17 bp, Homo sapiens
ccctgttcagctactcc

SEQ ID NO: 4853142 - DNA, 14 bp, Homo sapiens
ccctgttcatgttt

SEQ ID NO: 4853143 - DNA, 19 bp, Homo sapiens
cccttacagcctctgactt

SEQ ID NO: 4853144 - DNA, 22 bp, Homo sapiens
cccttagagggaatctagccca

SEQ ID NO: 4853145 - DNA, 24 bp, Homo sapiens
cccttcaggagcctggccaggcag

SEQ ID NO: 4853146 - DNA, 16 bp, Homo sapiens
cccttcctctctcctt

SEQ ID NO: 4853147 - DNA, 14 bp, Homo sapiens
cccttctgggtcca

SEQ ID NO: 4853148 - DNA, 18 bp, Homo sapiens
ccacagaaggtgaacttt

SEQ ID NO: 4853149 - DNA, 14 bp, Homo sapiens
ccacagcagagcat

SEQ ID NO: 4853150 - DNA, 16 bp, Homo sapiens
ccacatcaaataagaa

SEQ ID NO: 4853151 - DNA, 13 bp, Homo sapiens
ccacatggccatc

SEQ ID NO: 4853152 - DNA, 16 bp, Homo sapiens
ccacattgaagaatgt

SEQ ID NO: 4853153 - DNA, 13 bp, Homo sapiens
ccaccagttgctg

SEQ ID NO: 4853154 - DNA, 19 bp, Homo sapiens
ccaccataccttagagact

SEQ ID NO: 4853155 - DNA, 12 bp, Homo sapiens
ccacccacaaac

SEQ ID NO: 4853156 - DNA, 21 bp, Homo sapiens
ccacccacaaactccaggctg

SEQ ID NO: 4853157 - DNA, 15 bp, Homo sapiens
ccaccctccatgctc

SEQ ID NO: 4853158 - DNA, 17 bp, Homo sapiens
ccaccctccatgctcct

SEQ ID NO: 4853159 - DNA, 17 bp, Homo sapiens
ccacctcatcactggac

SEQ ID NO: 4853160 - DNA, 22 bp, Homo sapiens
ccacctcatcactggactgcat

SEQ ID NO: 4853161 - DNA, 18 bp, Homo sapiens
ccacgcctcaccagcccc

SEQ ID NO: 4853162 - DNA, 13 bp, Homo sapiens
ccactacaggccc

SEQ ID NO: 4853163 - DNA, 23 bp, Homo sapiens
ccactaggaatcccagaggtggg

SEQ ID NO: 4853164 - DNA, 14 bp, Homo sapiens
ccactcccagtgct

SEQ ID NO: 4853165 - DNA, 15 bp, Homo sapiens
ccactggctgctaac

SEQ ID NO: 4853166 - DNA, 14 bp, Homo sapiens
ccagaaaggtgtga

SEQ ID NO: 4853167 - DNA, 22 bp, Homo sapiens
ccagaaaggtgtgaggagagag

SEQ ID NO: 4853168 - DNA, 24 bp, Homo sapiens
ccagaaaggtgtgaggagagagga

SEQ ID NO: 4853169 - DNA, 22 bp, Homo sapiens
ccagaaccacacttgaaacctt

SEQ ID NO: 4853170 - DNA, 19 bp, Homo sapiens
ccagaacctctaagtgctg

SEQ ID NO: 4853171 - DNA, 21 bp, Homo sapiens
ccagaacctctaagtgctgct

SEQ ID NO: 4853172 - DNA, 18 bp, Homo sapiens
ccagaacgtggctctgct

SEQ ID NO: 4853173 - DNA, 19 bp, Homo sapiens
ccagaacgtggctctgctg

SEQ ID NO: 4853174 - DNA, 17 bp, Homo sapiens
ccagaacttagccttta

SEQ ID NO: 4853175 - DNA, 11 bp, Homo sapiens
ccagaagctgc

SEQ ID NO: 4853176 - DNA, 19 bp, Homo sapiens
ccagacgtggtgcttctca

SEQ ID NO: 4853177 - DNA, 20 bp, Homo sapiens
ccagacgtggtgcttctcac

SEQ ID NO: 4853178 - DNA, 12 bp, Homo sapiens
ccagactacagg

SEQ ID NO: 4853179 - DNA, 14 bp, Homo sapiens
ccagactacagggc

SEQ ID NO: 4853180 - DNA, 14 bp, Homo sapiens
ccagactcagcaga

SEQ ID NO: 4853181 - DNA, 16 bp, Homo sapiens
ccagactcagcagagt

SEQ ID NO: 4853182 - DNA, 16 bp, Homo sapiens
ccagagagggaaaagg

SEQ ID NO: 4853183 - DNA, 19 bp, Homo sapiens
ccagagagggaaaaggcag

SEQ ID NO: 4853184 - DNA, 14 bp, Homo sapiens
ccagagcagggtct

SEQ ID NO: 4853185 - DNA, 15 bp, Homo sapiens
ccagaggaccaatgc

SEQ ID NO: 4853186 - DNA, 22 bp, Homo sapiens
ccagaggtgggatcctccctca

SEQ ID NO: 4853187 - DNA, 17 bp, Homo sapiens
ccagagtctgtattttt

SEQ ID NO: 4853188 - DNA, 21 bp, Homo sapiens
ccagcaagtccttaggctact

SEQ ID NO: 4853189 - DNA, 23 bp, Homo sapiens
ccagcacaaagcactggccttgc

SEQ ID NO: 4853190 - DNA, 22 bp, Homo sapiens
ccagccagaacgtggctctgct

SEQ ID NO: 4853191 - DNA, 14 bp, Homo sapiens
ccagcccaaacctg

SEQ ID NO: 4853192 - DNA, 15 bp, Homo sapiens
ccagcccgcagaggt

SEQ ID NO: 4853193 - DNA, 13 bp, Homo sapiens
ccagccctgggca

SEQ ID NO: 4853194 - DNA, 14 bp, Homo sapiens
ccagcctgactaga

SEQ ID NO: 4853195 - DNA, 22 bp, Homo sapiens
ccagcctgactagaactcctgt

SEQ ID NO: 4853196 - DNA, 15 bp, Homo sapiens
ccagcgtgtggagca

SEQ ID NO: 4853197 - DNA, 16 bp, Homo sapiens
ccagcgtgtggagcag

SEQ ID NO: 4853198 - DNA, 22 bp, Homo sapiens
ccagcgtgtggagcagagctct

SEQ ID NO: 4853199 - DNA, 14 bp, Homo sapiens
ccagctcagtgttt

SEQ ID NO: 4853200 - DNA, 17 bp, Homo sapiens
ccagctgacagccacac

SEQ ID NO: 4853201 - DNA, 15 bp, Homo sapiens
ccagctgcagcctgg

SEQ ID NO: 4853202 - DNA, 20 bp, Homo sapiens
ccagctgcagcctggttggc

SEQ ID NO: 4853203 - DNA, 23 bp, Homo sapiens
ccaggacatgcaataaaatttaa

SEQ ID NO: 4853204 - DNA, 20 bp, Homo sapiens
ccaggacgtctggggtgtgg

SEQ ID NO: 4853205 - DNA, 15 bp, Homo sapiens
ccaggactcccagaa

SEQ ID NO: 4853206 - DNA, 17 bp, Homo sapiens
ccaggactcccagaacc

SEQ ID NO: 4853207 - DNA, 21 bp, Homo sapiens
ccaggcaagaaagcttccttc

SEQ ID NO: 4853208 - DNA, 22 bp, Homo sapiens
ccaggcagggagagagtagctg

SEQ ID NO: 4853209 - DNA, 21 bp, Homo sapiens
ccaggcatctgttagcagagt

SEQ ID NO: 4853210 - DNA, 21 bp, Homo sapiens
ccaggccttatctgaaaggcc

SEQ ID NO: 4853211 - DNA, 14 bp, Homo sapiens
ccaggctcaggaga

SEQ ID NO: 4853212 - DNA, 15 bp, Homo sapiens
ccaggctcaggagaa

SEQ ID NO: 4853213 - DNA, 14 bp, Homo sapiens
ccagggaggggtcc

SEQ ID NO: 4853214 - DNA, 15 bp, Homo sapiens
ccagggcagcaggcc

SEQ ID NO: 4853215 - DNA, 18 bp, Homo sapiens
ccagggcagcaggccaga

SEQ ID NO: 4853216 - DNA, 19 bp, Homo sapiens
ccagggcagcaggccagag

SEQ ID NO: 4853217 - DNA, 21 bp, Homo sapiens
ccagggcagcaggccagagaa

SEQ ID NO: 4853218 - DNA, 14 bp, Homo sapiens
ccaggggagccagc

SEQ ID NO: 4853219 - DNA, 17 bp, Homo sapiens
ccaggggagccagctgc

SEQ ID NO: 4853220 - DNA, 19 bp, Homo sapiens
ccaggggagccagctgctt

SEQ ID NO: 4853221 - DNA, 18 bp, Homo sapiens
ccaggggccaacctcagg

SEQ ID NO: 4853222 - DNA, 20 bp, Homo sapiens
ccagggtgacaaggcctgct

SEQ ID NO: 4853223 - DNA, 20 bp, Homo sapiens
ccagggtttacatgaagcag

SEQ ID NO: 4853224 - DNA, 16 bp, Homo sapiens
ccaggtctgactccaa

SEQ ID NO: 4853225 - DNA, 15 bp, Homo sapiens
ccagtcacactgtgg

SEQ ID NO: 4853226 - DNA, 18 bp, Homo sapiens
ccagtcactgctgcaagg

SEQ ID NO: 4853227 - DNA, 12 bp, Homo sapiens
ccagtctttctt

SEQ ID NO: 4853228 - DNA, 17 bp, Homo sapiens
ccagtctttcttcactc

SEQ ID NO: 4853229 - DNA, 22 bp, Homo sapiens
ccagtctttcttcactctggct

SEQ ID NO: 4853230 - DNA, 13 bp, Homo sapiens
ctgttagcagagt

SEQ ID NO: 4853231 - DNA, 22 bp, Homo sapiens
ctgttagcagagtctgtctctt

SEQ ID NO: 4853232 - DNA, 12 bp, Homo sapiens
ctgttgaacttt

SEQ ID NO: 4853233 - DNA, 18 bp, Homo sapiens
ctgttgataaaaactcag

SEQ ID NO: 4853234 - DNA, 17 bp, Homo sapiens
ctgttgcacttttgaat

SEQ ID NO: 4853235 - DNA, 19 bp, Homo sapiens
ctgttgcacttttgaatgt

SEQ ID NO: 4853236 - DNA, 17 bp, Homo sapiens
ctgttgtaagaattctg

SEQ ID NO: 4853237 - DNA, 23 bp, Homo sapiens
aagctgcagagatttctcattga

SEQ ID NO: 4853238 - DNA, 16 bp, Homo sapiens
aagctgcctcaaggaa

SEQ ID NO: 4853239 - DNA, 19 bp, Homo sapiens
aagctggtggcagagtcct

SEQ ID NO: 4853240 - DNA, 15 bp, Homo sapiens
aagcttcagttgctt

SEQ ID NO: 4853241 - DNA, 14 bp, Homo sapiens
aagcttcccaacag

SEQ ID NO: 4853242 - DNA, 14 bp, Homo sapiens
aagcttcttgctga

SEQ ID NO: 4853243 - DNA, 13 bp, Homo sapiens
aagctttaaatta

SEQ ID NO: 4853244 - DNA, 21 bp, Homo sapiens
aagctttcatgtcccagaact

SEQ ID NO: 4853245 - DNA, 12 bp, Homo sapiens
aagctttttgga

SEQ ID NO: 4853246 - DNA, 14 bp, Homo sapiens
aagctttttggaat

SEQ ID NO: 4853247 - DNA, 16 bp, Homo sapiens
aaggacccttttaagc

SEQ ID NO: 4853248 - DNA, 22 bp, Homo sapiens
aaggacccttttaagcatgtga

SEQ ID NO: 4853249 - DNA, 12 bp, Homo sapiens
aaggataaagaa

SEQ ID NO: 4853250 - DNA, 15 bp, Homo sapiens
aaggataaatcataa

SEQ ID NO: 4853251 - DNA, 22 bp, Homo sapiens
aaggataaatcataaagtcagt

SEQ ID NO: 4853252 - DNA, 21 bp, Homo sapiens
aaggcagggccctgaaatggc

SEQ ID NO: 4853253 - DNA, 20 bp, Homo sapiens
aaggcaggggaatgtatgtg

SEQ ID NO: 4853254 - DNA, 12 bp, Homo sapiens
aaggcaggtgct

SEQ ID NO: 4853255 - DNA, 18 bp, Homo sapiens
aaggcattctcccagctc

SEQ ID NO: 4853256 - DNA, 16 bp, Homo sapiens
aaggccagagagggaa

SEQ ID NO: 4853257 - DNA, 15 bp, Homo sapiens
aaggccgccagcgtg

SEQ ID NO: 4853258 - DNA, 23 bp, Homo sapiens
aaggctgagacagtgaatttggg

SEQ ID NO: 4853259 - DNA, 15 bp, Homo sapiens
aagggagtttttgat

SEQ ID NO: 4853260 - DNA, 14 bp, Homo sapiens
aaggggcctgggct

SEQ ID NO: 4853261 - DNA, 20 bp, Homo sapiens
aaggggcctgggctgtgagg

SEQ ID NO: 4853262 - DNA, 21 bp, Homo sapiens
aagggggctgctgctcctctc

SEQ ID NO: 4853263 - DNA, 14 bp, Homo sapiens
aaggtagaatgttt

SEQ ID NO: 4853264 - DNA, 23 bp, Homo sapiens
aaggtcctctcagttctctccct

SEQ ID NO: 4853265 - DNA, 24 bp, Homo sapiens
aaggtcctgctcaactctacccct

SEQ ID NO: 4853266 - DNA, 13 bp, Homo sapiens
aaggtgaactttg

SEQ ID NO: 4853267 - DNA, 20 bp, Homo sapiens
aaggtgaggtgaactccagg

SEQ ID NO: 4853268 - DNA, 21 bp, Homo sapiens
aaggtgaggtgaactccaggc

SEQ ID NO: 4853269 - DNA, 13 bp, Homo sapiens
aaggtgcactcca

SEQ ID NO: 4853270 - DNA, 14 bp, Homo sapiens
aaggtgcactccag

SEQ ID NO: 4853271 - DNA, 17 bp, Homo sapiens
aaggtgcactccagact

SEQ ID NO: 4853272 - DNA, 15 bp, Homo sapiens
aaggtgtgaggagag

SEQ ID NO: 4853273 - DNA, 14 bp, Homo sapiens
aaggtgtgatggtc

SEQ ID NO: 4853274 - DNA, 13 bp, Homo sapiens
aaggttgaataat

SEQ ID NO: 4853275 - DNA, 12 bp, Homo sapiens
aagtaaagatgc

SEQ ID NO: 4853276 - DNA, 18 bp, Homo sapiens
aagtaaatacatgcatat

SEQ ID NO: 4853277 - DNA, 23 bp, Homo sapiens
aagtaatttcagtgtaaagtgtg

SEQ ID NO: 4853278 - DNA, 21 bp, Homo sapiens
aagtactgtactttcccaggt

SEQ ID NO: 4853279 - DNA, 23 bp, Homo sapiens
aagtacttggcccccttcaggag

SEQ ID NO: 4853280 - DNA, 22 bp, Homo sapiens
aagtataatgtttattaaatgc

SEQ ID NO: 4853281 - DNA, 18 bp, Homo sapiens
aagtatgcattattaaat

SEQ ID NO: 4853282 - DNA, 18 bp, Homo sapiens
aagtatggtaatagcttt

SEQ ID NO: 4853283 - DNA, 19 bp, Homo sapiens
aagtatgtatattaaaaaa

SEQ ID NO: 4853284 - DNA, 23 bp, Homo sapiens
aagtcactcccaagccccctcct

SEQ ID NO: 4853285 - DNA, 18 bp, Homo sapiens
aagtcagaatcagaagat

SEQ ID NO: 4853286 - DNA, 23 bp, Homo sapiens
aagtcagaatcagaagatagtct

SEQ ID NO: 4853287 - DNA, 18 bp, Homo sapiens
aagtcagaatttttaact

SEQ ID NO: 4853288 - DNA, 15 bp, Homo sapiens
aagtcattaaagaca

SEQ ID NO: 4853289 - DNA, 14 bp, Homo sapiens
aagtcattggcaaa

SEQ ID NO: 4853290 - DNA, 21 bp, Homo sapiens
aagtctcataggttaaaaaaa

SEQ ID NO: 4853291 - DNA, 22 bp, Homo sapiens
aagtctgctctcatataagaca

SEQ ID NO: 4853292 - DNA, 22 bp, Homo sapiens
aagtcttcctaattgtgcccct

SEQ ID NO: 4853293 - DNA, 15 bp, Homo sapiens
aagtctttcatggct

SEQ ID NO: 4853294 - DNA, 15 bp, Homo sapiens
aagtgaattgaagtt

SEQ ID NO: 4853295 - DNA, 21 bp, Homo sapiens
aagtgaattgaagtttcaagt

SEQ ID NO: 4853296 - DNA, 16 bp, Homo sapiens
aagtgatctgtgttca

SEQ ID NO: 4853297 - DNA, 15 bp, Homo sapiens
aagtgcctcggacag

SEQ ID NO: 4853298 - DNA, 17 bp, Homo sapiens
aagtgcctgggctcagc

SEQ ID NO: 4853299 - DNA, 24 bp, Homo sapiens
atgatttccctccagagaaagcac

SEQ ID NO: 4853300 - DNA, 16 bp, Homo sapiens
atgatttttgccctgc

SEQ ID NO: 4853301 - DNA, 21 bp, Homo sapiens
atgcaaatagattcagagaaa

SEQ ID NO: 4853302 - DNA, 22 bp, Homo sapiens
atgcaaatagattcagagaaat

SEQ ID NO: 4853303 - DNA, 19 bp, Homo sapiens
atgcaaatgagctctgaaa

SEQ ID NO: 4853304 - DNA, 17 bp, Homo sapiens
atgcaagccccaacttt

SEQ ID NO: 4853305 - DNA, 14 bp, Homo sapiens
atgcaataaaattt

SEQ ID NO: 4853306 - DNA, 15 bp, Homo sapiens
atgcaattcagtgtt

SEQ ID NO: 4853307 - DNA, 15 bp, Homo sapiens
atgcagctttgcaaa

SEQ ID NO: 4853308 - DNA, 19 bp, Homo sapiens
atgcagggaggggaggcag

SEQ ID NO: 4853309 - DNA, 14 bp, Homo sapiens
atgcatacaagttt

SEQ ID NO: 4853310 - DNA, 18 bp, Homo sapiens
atgcatataatgaataaa

SEQ ID NO: 4853311 - DNA, 12 bp, Homo sapiens
atgcatatttgc

SEQ ID NO: 4853312 - DNA, 16 bp, Homo sapiens
atgcatgcaaatgagc

SEQ ID NO: 4853313 - DNA, 16 bp, Homo sapiens
atgcattattaaattg

SEQ ID NO: 4853314 - DNA, 22 bp, Homo sapiens
atgcattcacatttagaaaagt

SEQ ID NO: 4853315 - DNA, 23 bp, Homo sapiens
atgcattcacatttagaaaagtg

SEQ ID NO: 4853316 - DNA, 14 bp, Homo sapiens
atgccagtattttt

SEQ ID NO: 4853317 - DNA, 22 bp, Homo sapiens
atgccagtatttttaaaggcat

SEQ ID NO: 4853318 - DNA, 19 bp, Homo sapiens
atgcctatggtggatccaa

SEQ ID NO: 4853319 - DNA, 18 bp, Homo sapiens
atgcctctgccaaaggat

SEQ ID NO: 4853320 - DNA, 22 bp, Homo sapiens
atgcctctgccaaaggatgtga

SEQ ID NO: 4853321 - DNA, 22 bp, Homo sapiens
atgcgtggccacgggggcagtg

SEQ ID NO: 4853322 - DNA, 16 bp, Homo sapiens
atgctgcctcaggacc

SEQ ID NO: 4853323 - DNA, 18 bp, Homo sapiens
atgctgcctcaggaccca

SEQ ID NO: 4853324 - DNA, 20 bp, Homo sapiens
atgctgctcccctaaagcca

SEQ ID NO: 4853325 - DNA, 14 bp, Homo sapiens
atgcttaaatttta

SEQ ID NO: 4853326 - DNA, 16 bp, Homo sapiens
atgcttgcatggagaa

SEQ ID NO: 4853327 - DNA, 19 bp, Homo sapiens
atgcttgcatggagaatgg

SEQ ID NO: 4853328 - DNA, 18 bp, Homo sapiens
atgctttattaatgtttt

SEQ ID NO: 4853329 - DNA, 23 bp, Homo sapiens
atggaaagcagagttttcattaa

SEQ ID NO: 4853330 - DNA, 20 bp, Homo sapiens
atggacatttagaagaaaga

SEQ ID NO: 4853331 - DNA, 20 bp, Homo sapiens
atggactaaatgatctctga

SEQ ID NO: 4853332 - DNA, 10 bp, Homo sapiens
atggagccta

SEQ ID NO: 4853333 - DNA, 21 bp, Homo sapiens
atggagcctacctctgtctga

SEQ ID NO: 4853334 - DNA, 21 bp, Homo sapiens
atggaggatctctaaagagca

SEQ ID NO: 4853335 - DNA, 14 bp, Homo sapiens
atggagtgtgcaga

SEQ ID NO: 4853336 - DNA, 19 bp, Homo sapiens
atggcagcctactctcctt

SEQ ID NO: 4853337 - DNA, 14 bp, Homo sapiens
atggccaaacccaa

SEQ ID NO: 4853338 - DNA, 19 bp, Homo sapiens
atggcctggagcaggccca

SEQ ID NO: 4853339 - DNA, 21 bp, Homo sapiens
atggcctgtccctagggctct

SEQ ID NO: 4853340 - DNA, 22 bp, Homo sapiens
atggcctgtccctagggctctc

SEQ ID NO: 4853341 - DNA, 17 bp, Homo sapiens
atggctgaagctggagc

SEQ ID NO: 4853342 - DNA, 18 bp, Homo sapiens
atggctgaagctggagca

SEQ ID NO: 4853343 - DNA, 19 bp, Homo sapiens
atggctgaagctggagcag

SEQ ID NO: 4853344 - DNA, 15 bp, Homo sapiens
atggctgctgttgct

SEQ ID NO: 4853345 - DNA, 13 bp, Homo sapiens
atggcttgtctat

SEQ ID NO: 4853346 - DNA, 20 bp, Homo sapiens
atggcttgtctatactcctt

SEQ ID NO: 4853347 - DNA, 23 bp, Homo sapiens
atgggatattttgaaatgaactt

SEQ ID NO: 4853348 - DNA, 15 bp, Homo sapiens
atgggattagaaaca

SEQ ID NO: 4853349 - DNA, 18 bp, Homo sapiens
atgggctgtgattactgc

SEQ ID NO: 4853350 - DNA, 21 bp, Homo sapiens
atgggctgtgattactgcaat

SEQ ID NO: 4853351 - DNA, 17 bp, Homo sapiens
atggggaactcccccag

SEQ ID NO: 4853352 - DNA, 18 bp, Homo sapiens
atggggaggcagcagagc

SEQ ID NO: 4853353 - DNA, 22 bp, Homo sapiens
atgggtgccctttcctggcagt

SEQ ID NO: 4853354 - DNA, 15 bp, Homo sapiens
atggtaagagaaaag

SEQ ID NO: 4853355 - DNA, 19 bp, Homo sapiens
atggtaggaccctcgagag

SEQ ID NO: 4853356 - DNA, 21 bp, Homo sapiens
atggtcctatttttgtgaaga

SEQ ID NO: 4853357 - DNA, 17 bp, Homo sapiens
atggtgtggtgaatgtg

SEQ ID NO: 4853358 - DNA, 23 bp, Homo sapiens
atggttaatttttcctgcatgtt

SEQ ID NO: 4853359 - DNA, 14 bp, Homo sapiens
atgtaaataactct

SEQ ID NO: 4853360 - DNA, 23 bp, Homo sapiens
atgtaacatgatttccctccaga

SEQ ID NO: 4853361 - DNA, 12 bp, Homo sapiens
atgtaatttaaa

SEQ ID NO: 4853362 - DNA, 15 bp, Homo sapiens
atgtaatttaaatga

SEQ ID NO: 4853363 - DNA, 14 bp, Homo sapiens
atgtacaaaaatta

SEQ ID NO: 4853364 - DNA, 20 bp, Homo sapiens
atgtacaaaaattatgcaat

SEQ ID NO: 4853365 - DNA, 16 bp, Homo sapiens
atgtacagattctttc

SEQ ID NO: 4853366 - DNA, 17 bp, Homo sapiens
atgtactgatttcagta

SEQ ID NO: 4853367 - DNA, 12 bp, Homo sapiens
atgtacttccct

SEQ ID NO: 4853368 - DNA, 17 bp, Homo sapiens
atgtagaaactgaggcc

SEQ ID NO: 4853369 - DNA, 22 bp, Homo sapiens
atgtagaaactgaggcccagag

SEQ ID NO: 4853370 - DNA, 18 bp, Homo sapiens
atgtaggtaagactgtag

SEQ ID NO: 4853371 - DNA, 19 bp, Homo sapiens
atgtaggtaagactgtaga

SEQ ID NO: 4853372 - DNA, 17 bp, Homo sapiens
atgtatatatgtatttc

SEQ ID NO: 4853373 - DNA, 14 bp, Homo sapiens
atgtatattaaaaa

SEQ ID NO: 4853374 - DNA, 16 bp, Homo sapiens
atgtatattaaaaaag

SEQ ID NO: 4853375 - DNA, 22 bp, Homo sapiens
atgtatattaaaaaagagacat

SEQ ID NO: 4853376 - DNA, 14 bp, Homo sapiens
atgtatgcattcac

SEQ ID NO: 4853377 - DNA, 15 bp, Homo sapiens
atgtattttttgaat

SEQ ID NO: 4853378 - DNA, 21 bp, Homo sapiens
atgtattttttgaatctatga

SEQ ID NO: 4853379 - DNA, 22 bp, Homo sapiens
atgtcagctgctgttgaacttt

SEQ ID NO: 4853380 - DNA, 23 bp, Homo sapiens
atgtcagctgctgttgaactttt

SEQ ID NO: 4853381 - DNA, 17 bp, Homo sapiens
atgtcagttgttattta

SEQ ID NO: 4853382 - DNA, 19 bp, Homo sapiens
atgtccagccacccccagg

SEQ ID NO: 4853383 - DNA, 13 bp, Homo sapiens
atgtcctctctta

SEQ ID NO: 4853384 - DNA, 17 bp, Homo sapiens
atgtccttaaaatgtgg

SEQ ID NO: 4853385 - DNA, 12 bp, Homo sapiens
atgtctggcaga

SEQ ID NO: 4853386 - DNA, 20 bp, Homo sapiens
atgtctggcagatgagggct

SEQ ID NO: 4853387 - DNA, 14 bp, Homo sapiens
atgtcttctcacaa

SEQ ID NO: 4853388 - DNA, 20 bp, Homo sapiens
atgtcttctcacaagccagc

SEQ ID NO: 4853389 - DNA, 22 bp, Homo sapiens
atgtcttctcacaagccagcca

SEQ ID NO: 4853390 - DNA, 15 bp, Homo sapiens
atgtctttttattaa

SEQ ID NO: 4853391 - DNA, 19 bp, Homo sapiens
atgtgaccactctgtcttg

SEQ ID NO: 4853392 - DNA, 16 bp, Homo sapiens
atgtgaccataatgta

SEQ ID NO: 4853393 - DNA, 16 bp, Homo sapiens
atgtgatatataagtg

SEQ ID NO: 4853394 - DNA, 19 bp, Homo sapiens
atgtgatatataagtgtac

SEQ ID NO: 4853395 - DNA, 21 bp, Homo sapiens
atgtgatatataagtgtacat

SEQ ID NO: 4853396 - DNA, 22 bp, Homo sapiens
atgtgatatataagtgtacata

SEQ ID NO: 4853397 - DNA, 13 bp, Homo sapiens
atgtgcaatagaa

SEQ ID NO: 4853398 - DNA, 18 bp, Homo sapiens
atgtgcaatagaaggtga

SEQ ID NO: 4853399 - DNA, 22 bp, Homo sapiens
atgtgctataatctgtttttac

SEQ ID NO: 4853400 - DNA, 17 bp, Homo sapiens
atgtgctggtgaacact

SEQ ID NO: 4853401 - DNA, 20 bp, Homo sapiens
atgtggcctttgaattctgt

SEQ ID NO: 4853402 - DNA, 19 bp, Homo sapiens
atgtgggatattgaatgtt

SEQ ID NO: 4853403 - DNA, 15 bp, Homo sapiens
atgtggtctgccaat

SEQ ID NO: 4853404 - DNA, 21 bp, Homo sapiens
atgtggtctgccaatctgtac

SEQ ID NO: 4853405 - DNA, 22 bp, Homo sapiens
atgtggtctgccaatctgtaca

SEQ ID NO: 4853406 - DNA, 15 bp, Homo sapiens
atgtgtcatgaagaa

SEQ ID NO: 4853407 - DNA, 23 bp, Homo sapiens
atgtgtcatgaagaatgtttctg

SEQ ID NO: 4853408 - DNA, 16 bp, Homo sapiens
atgtgtgagaaaaact

SEQ ID NO: 4853409 - DNA, 19 bp, Homo sapiens
atgtgttattacttcctca

SEQ ID NO: 4853410 - DNA, 23 bp, Homo sapiens
atgtgttcttctttctctgtatt

SEQ ID NO: 4853411 - DNA, 22 bp, Homo sapiens
atgtgttggggaagggcctgcc

SEQ ID NO: 4853412 - DNA, 17 bp, Homo sapiens
atgtgtttccttttcag

SEQ ID NO: 4853413 - DNA, 21 bp, Homo sapiens
atgtgtttccttttcaggaga

SEQ ID NO: 4853414 - DNA, 18 bp, Homo sapiens
atgttaaagagaatgagt

SEQ ID NO: 4853415 - DNA, 14 bp, Homo sapiens
atgttaagttatat

SEQ ID NO: 4853416 - DNA, 13 bp, Homo sapiens
atgttaatatttc

SEQ ID NO: 4853417 - DNA, 13 bp, Homo sapiens
atgttaatatttt

SEQ ID NO: 4853418 - DNA, 23 bp, Homo sapiens
attgctgataccatatgaatgaa

SEQ ID NO: 4853419 - DNA, 22 bp, Homo sapiens
attgctgctaagtcattggcaa

SEQ ID NO: 4853420 - DNA, 22 bp, Homo sapiens
attgctggaggaaccagaggca

SEQ ID NO: 4853421 - DNA, 17 bp, Homo sapiens
attgctgtgagccttgc

SEQ ID NO: 4853422 - DNA, 15 bp, Homo sapiens
attggcaaagtgaca

SEQ ID NO: 4853423 - DNA, 15 bp, Homo sapiens
attgggaaaacattt

SEQ ID NO: 4853424 - DNA, 15 bp, Homo sapiens
attggttttcctgtg

SEQ ID NO: 4853425 - DNA, 13 bp, Homo sapiens
attgtaatctatg

SEQ ID NO: 4853426 - DNA, 18 bp, Homo sapiens
attgtaattatgtaaata

SEQ ID NO: 4853427 - DNA, 21 bp, Homo sapiens
attgtacaaaattaagcaaat

SEQ ID NO: 4853428 - DNA, 22 bp, Homo sapiens
attgtacaaaattaagcaaatg

SEQ ID NO: 4853429 - DNA, 23 bp, Homo sapiens
attgtcacatctatccacactgt

SEQ ID NO: 4853430 - DNA, 17 bp, Homo sapiens
attgtcaccgcaggtgc

SEQ ID NO: 4853431 - DNA, 18 bp, Homo sapiens
attgtcaccgcaggtgct

SEQ ID NO: 4853432 - DNA, 14 bp, Homo sapiens
attgtccagtttgt

SEQ ID NO: 4853433 - DNA, 23 bp, Homo sapiens
attgtgtggtctggttcctgtgt

SEQ ID NO: 4853434 - DNA, 16 bp, Homo sapiens
attgtttaaaatgtaa

SEQ ID NO: 4853435 - DNA, 17 bp, Homo sapiens
attgtttggtaaatgtt

SEQ ID NO: 4853436 - DNA, 18 bp, Homo sapiens
attgtttggtaaatgttt

SEQ ID NO: 4853437 - DNA, 22 bp, Homo sapiens
atttaaaaaataaataaaaact

SEQ ID NO: 4853438 - DNA, 20 bp, Homo sapiens
atttaaaacaatccttacta

SEQ ID NO: 4853439 - DNA, 13 bp, Homo sapiens
atttaaaactgtt

SEQ ID NO: 4853440 - DNA, 15 bp, Homo sapiens
atttaaaagcctgct

SEQ ID NO: 4853441 - DNA, 20 bp, Homo sapiens
atttaaatcctgaagagcat

SEQ ID NO: 4853442 - DNA, 13 bp, Homo sapiens
atttaaatgaaag

SEQ ID NO: 4853443 - DNA, 17 bp, Homo sapiens
atttaaatgaaagaaaa

SEQ ID NO: 4853444 - DNA, 15 bp, Homo sapiens
atttaactttccagt

SEQ ID NO: 4853445 - DNA, 13 bp, Homo sapiens
atttaataaagat

SEQ ID NO: 4853446 - DNA, 15 bp, Homo sapiens
atttaataaagatga

SEQ ID NO: 4853447 - DNA, 15 bp, Homo sapiens
atttaatggcagcta

SEQ ID NO: 4853448 - DNA, 15 bp, Homo sapiens
atttaatttgaaggt

SEQ ID NO: 4853449 - DNA, 22 bp, Homo sapiens
atttaatttgaaggtagaatgt

SEQ ID NO: 4853450 - DNA, 15 bp, Homo sapiens
atttacttgttttgg

SEQ ID NO: 4853451 - DNA, 14 bp, Homo sapiens
atttagaagaaaga

SEQ ID NO: 4853452 - DNA, 17 bp, Homo sapiens
atttagagctaaaaagg

SEQ ID NO: 4853453 - DNA, 16 bp, Homo sapiens
atttataaggaaattt

SEQ ID NO: 4853454 - DNA, 15 bp, Homo sapiens
atttataatacagaa

SEQ ID NO: 4853455 - DNA, 17 bp, Homo sapiens
atttatagaatttaata

SEQ ID NO: 4853456 - DNA, 13 bp, Homo sapiens
atttatattaaat

SEQ ID NO: 4853457 - DNA, 15 bp, Homo sapiens
atttatggttgttaa

SEQ ID NO: 4853458 - DNA, 23 bp, Homo sapiens
atttatggttgttaaaaatgtca

SEQ ID NO: 4853459 - DNA, 20 bp, Homo sapiens
atttattccccagtgactcc

SEQ ID NO: 4853460 - DNA, 21 bp, Homo sapiens
atttattccccagtgactcca

SEQ ID NO: 4853461 - DNA, 16 bp, Homo sapiens
atttatttatttattc

SEQ ID NO: 4853462 - DNA, 17 bp, Homo sapiens
atttattttttaagaaa

SEQ ID NO: 4853463 - DNA, 17 bp, Homo sapiens
atttattttttcttttc

SEQ ID NO: 4853464 - DNA, 22 bp, Homo sapiens
atttattttttcttttctttac

SEQ ID NO: 4853465 - DNA, 15 bp, Homo sapiens
atttcaataaatgat

SEQ ID NO: 4853466 - DNA, 22 bp, Homo sapiens
atttcaataaatgatatataat

SEQ ID NO: 4853467 - DNA, 18 bp, Homo sapiens
atttcactactagattga

SEQ ID NO: 4853468 - DNA, 20 bp, Homo sapiens
atttcactaggactcagaaa

SEQ ID NO: 4853469 - DNA, 21 bp, Homo sapiens
atttcaggactctctccagga

SEQ ID NO: 4853470 - DNA, 22 bp, Homo sapiens
atttcaggactctctccaggag

SEQ ID NO: 4853471 - DNA, 19 bp, Homo sapiens
atttcaggcattggatatt

SEQ ID NO: 4853472 - DNA, 14 bp, Homo sapiens
atttcagtaagtct

SEQ ID NO: 4853473 - DNA, 13 bp, Homo sapiens
atttccattgctt

SEQ ID NO: 4853474 - DNA, 22 bp, Homo sapiens
atttcccccttcatccatcctg

SEQ ID NO: 4853475 - DNA, 18 bp, Homo sapiens
atttccctccagagaaag

SEQ ID NO: 4853476 - DNA, 19 bp, Homo sapiens
atttccctccagagaaagc

SEQ ID NO: 4853477 - DNA, 20 bp, Homo sapiens
atttccctccagagaaagca

SEQ ID NO: 4853478 - DNA, 14 bp, Homo sapiens
atttcctgtgagga

SEQ ID NO: 4853479 - DNA, 16 bp, Homo sapiens
atttcctgtgaggata

SEQ ID NO: 4853480 - DNA, 14 bp, Homo sapiens
atttccttcaggca

SEQ ID NO: 4853481 - DNA, 23 bp, Homo sapiens
atttccttcaggcagctgaaatt

SEQ ID NO: 4853482 - DNA, 20 bp, Homo sapiens
atttccttggattttcctga

SEQ ID NO: 4853483 - DNA, 19 bp, Homo sapiens
atttctagtacctgtgact

SEQ ID NO: 4853484 - DNA, 16 bp, Homo sapiens
atttctatattcctcc

SEQ ID NO: 4853485 - DNA, 18 bp, Homo sapiens
atttctatattcctccag

SEQ ID NO: 4853486 - DNA, 13 bp, Homo sapiens
atttctcagctgt

SEQ ID NO: 4853487 - DNA, 15 bp, Homo sapiens
atttctcattgactt

SEQ ID NO: 4853488 - DNA, 17 bp, Homo sapiens
atttctcattgactttt

SEQ ID NO: 4853489 - DNA, 13 bp, Homo sapiens
atttctttggaaa

SEQ ID NO: 4853490 - DNA, 20 bp, Homo sapiens
atttgaaaaatataaaatta

SEQ ID NO: 4853491 - DNA, 23 bp, Homo sapiens
atttgaattatcagcaaagaaaa

SEQ ID NO: 4853492 - DNA, 16 bp, Homo sapiens
atttgaggtctagaga

SEQ ID NO: 4853493 - DNA, 21 bp, Homo sapiens
atttgaggtctagagagaacc

SEQ ID NO: 4853494 - DNA, 21 bp, Homo sapiens
atttgctgacaaccattaaag

SEQ ID NO: 4853495 - DNA, 22 bp, Homo sapiens
atttgctgacaaccattaaagt

SEQ ID NO: 4853496 - DNA, 13 bp, Homo sapiens
atttgctgccatt

SEQ ID NO: 4853497 - DNA, 23 bp, Homo sapiens
atttggatttaaaagcctgctca

SEQ ID NO: 4853498 - DNA, 19 bp, Homo sapiens
atttgggagacatgtgaca

SEQ ID NO: 4853499 - DNA, 18 bp, Homo sapiens
atttgtatgtcaaagctt

SEQ ID NO: 4853500 - DNA, 22 bp, Homo sapiens
atttgtgtgtttttagctgtga

SEQ ID NO: 4853501 - DNA, 23 bp, Homo sapiens
atttgtttccttttggcctcctg

SEQ ID NO: 4853502 - DNA, 13 bp, Homo sapiens
attttaaaaaagg

SEQ ID NO: 4853503 - DNA, 14 bp, Homo sapiens
attttaaaaaaggg

SEQ ID NO: 4853504 - DNA, 17 bp, Homo sapiens
attttaaagtatgcatt

SEQ ID NO: 4853505 - DNA, 22 bp, Homo sapiens
attttaaagtatgcattattaa

SEQ ID NO: 4853506 - DNA, 16 bp, Homo sapiens
attttaactaaatttt

SEQ ID NO: 4853507 - DNA, 22 bp, Homo sapiens
attttacaagggcataaagtaa

SEQ ID NO: 4853508 - DNA, 17 bp, Homo sapiens
attttacctagctaatt

SEQ ID NO: 4853509 - DNA, 19 bp, Homo sapiens
attttacctagctaattat

SEQ ID NO: 4853510 - DNA, 14 bp, Homo sapiens
attttagaaataat

SEQ ID NO: 4853511 - DNA, 13 bp, Homo sapiens
attttagaaatat

SEQ ID NO: 4853512 - DNA, 17 bp, Homo sapiens
attttagaaatattcac

SEQ ID NO: 4853513 - DNA, 21 bp, Homo sapiens
attttccgcccactcctggga

SEQ ID NO: 4853514 - DNA, 19 bp, Homo sapiens
attttctaaaagctttcat

SEQ ID NO: 4853515 - DNA, 12 bp, Homo sapiens
attttgaaatga

SEQ ID NO: 4853516 - DNA, 20 bp, Homo sapiens
attttgaaatgaactttgtc

SEQ ID NO: 4853517 - DNA, 18 bp, Homo sapiens
attttgggcctgttcctt

SEQ ID NO: 4853518 - DNA, 10 bp, Homo sapiens
attttgtatg

SEQ ID NO: 4853519 - DNA, 11 bp, Homo sapiens
attttgtttac

SEQ ID NO: 4853520 - DNA, 17 bp, Homo sapiens
atttttaaaatatttat

SEQ ID NO: 4853521 - DNA, 15 bp, Homo sapiens
atttttaaaggcatt

SEQ ID NO: 4853522 - DNA, 18 bp, Homo sapiens
atttttataacatcttta

SEQ ID NO: 4853523 - DNA, 14 bp, Homo sapiens
atttttcctgcatg

SEQ ID NO: 4853524 - DNA, 15 bp, Homo sapiens
atttttctttaactg

SEQ ID NO: 4853525 - DNA, 13 bp, Homo sapiens
atttttgtgaaga

SEQ ID NO: 4853526 - DNA, 13 bp, Homo sapiens
attttttaagaaa

SEQ ID NO: 4853527 - DNA, 12 bp, Homo sapiens
attttttaagct

SEQ ID NO: 4853528 - DNA, 16 bp, Homo sapiens
attttttgaatctatg

SEQ ID NO: 4853529 - DNA, 17 bp, Homo sapiens
agtacagaatttgaatt

SEQ ID NO: 4853530 - DNA, 21 bp, Homo sapiens
agtacaggtcatctgctggga

SEQ ID NO: 4853531 - DNA, 13 bp, Homo sapiens
agtacatttaaat

SEQ ID NO: 4853532 - DNA, 14 bp, Homo sapiens
agtacctgtgactc

SEQ ID NO: 4853533 - DNA, 20 bp, Homo sapiens
agtactgtactttcccaggt

SEQ ID NO: 4853534 - DNA, 21 bp, Homo sapiens
agtacttggcccccttcagga

SEQ ID NO: 4853535 - DNA, 12 bp, Homo sapiens
agtagacattta

SEQ ID NO: 4853536 - DNA, 23 bp, Homo sapiens
agtagatctatattagatcaaat

SEQ ID NO: 4853537 - DNA, 17 bp, Homo sapiens
agtagcatctcagtggt

SEQ ID NO: 4853538 - DNA, 14 bp, Homo sapiens
agtagctgcagcct

SEQ ID NO: 4853539 - DNA, 17 bp, Homo sapiens
agtagctgcagccttca

SEQ ID NO: 4853540 - DNA, 13 bp, Homo sapiens
agtagggccaggg

SEQ ID NO: 4853541 - DNA, 18 bp, Homo sapiens
agtatattgttgaagaga

SEQ ID NO: 4853542 - DNA, 20 bp, Homo sapiens
agtatattgttgaagagaca

SEQ ID NO: 4853543 - DNA, 19 bp, Homo sapiens
agtatgaaaatggaaattt

SEQ ID NO: 4853544 - DNA, 16 bp, Homo sapiens
agtatgcattattaaa

SEQ ID NO: 4853545 - DNA, 15 bp, Homo sapiens
agtatgtatattaaa

SEQ ID NO: 4853546 - DNA, 22 bp, Homo sapiens
agtatgtatattaaaaaagaga

SEQ ID NO: 4853547 - DNA, 23 bp, Homo sapiens
agtattatcttgttcaggaaaag

SEQ ID NO: 4853548 - DNA, 18 bp, Homo sapiens
agtcacacattacaaagt

SEQ ID NO: 4853549 - DNA, 15 bp, Homo sapiens
agtcagcagtcctag

SEQ ID NO: 4853550 - DNA, 21 bp, Homo sapiens
agtcagttgctcaaaaagaaa

SEQ ID NO: 4853551 - DNA, 22 bp, Homo sapiens
agtcataggttaatatttaaga

SEQ ID NO: 4853552 - DNA, 12 bp, Homo sapiens
agtcattatgtt

SEQ ID NO: 4853553 - DNA, 13 bp, Homo sapiens
agtcattggcaaa

SEQ ID NO: 4853554 - DNA, 22 bp, Homo sapiens
agtccgcagttgtagcagaaac

SEQ ID NO: 4853555 - DNA, 13 bp, Homo sapiens
ataataaaaatat

SEQ ID NO: 4853556 - DNA, 23 bp, Homo sapiens
ataataagagaatgttcctactc

SEQ ID NO: 4853557 - DNA, 21 bp, Homo sapiens
ataatacagaatcttgttttg

SEQ ID NO: 4853558 - DNA, 15 bp, Homo sapiens
ataataggccacaga

SEQ ID NO: 4853559 - DNA, 12 bp, Homo sapiens
ataatattgaaa

SEQ ID NO: 4853560 - DNA, 14 bp, Homo sapiens
ataatattgaaaat

SEQ ID NO: 4853561 - DNA, 18 bp, Homo sapiens
ataatattgaaaattgaa

SEQ ID NO: 4853562 - DNA, 19 bp, Homo sapiens
ataatattgaaaattgaaa

SEQ ID NO: 4853563 - DNA, 14 bp, Homo sapiens
ataatgctacaatt

SEQ ID NO: 4853564 - DNA, 17 bp, Homo sapiens
ataatgctacaatttta

SEQ ID NO: 4853565 - DNA, 16 bp, Homo sapiens
ataatggaaaatgcca

SEQ ID NO: 4853566 - DNA, 19 bp, Homo sapiens
ataatgtttattaaatgct

SEQ ID NO: 4853567 - DNA, 21 bp, Homo sapiens
ataattaaccaaccttgttta

SEQ ID NO: 4853568 - DNA, 15 bp, Homo sapiens
ataattgtacaaaat

SEQ ID NO: 4853569 - DNA, 21 bp, Homo sapiens
ataatttaaaaatatatttat

SEQ ID NO: 4853570 - DNA, 18 bp, Homo sapiens
ataatttgaactttggaa

SEQ ID NO: 4853571 - DNA, 19 bp, Homo sapiens
ataatttgaactttggaac

SEQ ID NO: 4853572 - DNA, 14 bp, Homo sapiens
atacacatttgcta

SEQ ID NO: 4853573 - DNA, 22 bp, Homo sapiens
atacacatttgctactgttgta

SEQ ID NO: 4853574 - DNA, 18 bp, Homo sapiens
atacagaatcttgttttg

SEQ ID NO: 4853575 - DNA, 10 bp, Homo sapiens
atacataaaa

SEQ ID NO: 4853576 - DNA, 18 bp, Homo sapiens
atacataaaagaaataaa

SEQ ID NO: 4853577 - DNA, 14 bp, Homo sapiens
atacatcaatatgt

SEQ ID NO: 4853578 - DNA, 17 bp, Homo sapiens
atacatcaatatgtata

SEQ ID NO: 4853579 - DNA, 13 bp, Homo sapiens
atacatgcatata

SEQ ID NO: 4853580 - DNA, 20 bp, Homo sapiens
atacatgcatataatgaata

SEQ ID NO: 4853581 - DNA, 18 bp, Homo sapiens
atacatgtgatacatttt

SEQ ID NO: 4853582 - DNA, 15 bp, Homo sapiens
ataccatatgaatga

SEQ ID NO: 4853583 - DNA, 21 bp, Homo sapiens
ataccattctattctccagac

SEQ ID NO: 4853584 - DNA, 12 bp, Homo sapiens
atacctgtgagg

SEQ ID NO: 4853585 - DNA, 15 bp, Homo sapiens
atacctgtgaggact

SEQ ID NO: 4853586 - DNA, 17 bp, Homo sapiens
atacctgtgaggactgg

SEQ ID NO: 4853587 - DNA, 13 bp, Homo sapiens
ataccttcttatt

SEQ ID NO: 4853588 - DNA, 14 bp, Homo sapiens
atactaccagggtc

SEQ ID NO: 4853589 - DNA, 20 bp, Homo sapiens
atactaccagggtctctcag

SEQ ID NO: 4853590 - DNA, 22 bp, Homo sapiens
atactaccagggtctctcaggg

SEQ ID NO: 4853591 - DNA, 19 bp, Homo sapiens
atactccttgcttcctgat

SEQ ID NO: 4853592 - DNA, 21 bp, Homo sapiens
atactgccaaaacatttatga

SEQ ID NO: 4853593 - DNA, 23 bp, Homo sapiens
atactggggggcaggcctcccaa

SEQ ID NO: 4853594 - DNA, 15 bp, Homo sapiens
atactgtggcctgca

SEQ ID NO: 4853595 - DNA, 21 bp, Homo sapiens
atactgtggcctgcaggaggg

SEQ ID NO: 4853596 - DNA, 18 bp, Homo sapiens
atacttatttgtatatgg

SEQ ID NO: 4853597 - DNA, 13 bp, Homo sapiens
atagaaggtgatg

SEQ ID NO: 4853598 - DNA, 16 bp, Homo sapiens
atagacaaaaagtata

SEQ ID NO: 4853599 - DNA, 15 bp, Homo sapiens
atagacttaaatctc

SEQ ID NO: 4853600 - DNA, 20 bp, Homo sapiens
atagacttggagaatactgc

SEQ ID NO: 4853601 - DNA, 23 bp, Homo sapiens
atagacttggagaatactgccaa

SEQ ID NO: 4853602 - DNA, 19 bp, Homo sapiens
atagcagccagttcaaaaa

SEQ ID NO: 4853603 - DNA, 15 bp, Homo sapiens
atagcataggctggg

SEQ ID NO: 4853604 - DNA, 16 bp, Homo sapiens
atagcataggctgggg

SEQ ID NO: 4853605 - DNA, 15 bp, Homo sapiens
atagcatgaaataaa

SEQ ID NO: 4853606 - DNA, 16 bp, Homo sapiens
atagcatgaaataaaa

SEQ ID NO: 4853607 - DNA, 14 bp, Homo sapiens
atagctttagtgaa

SEQ ID NO: 4853608 - DNA, 14 bp, Homo sapiens
ataggacagaggga

SEQ ID NO: 4853609 - DNA, 18 bp, Homo sapiens
ataggctattttctaaag

SEQ ID NO: 4853610 - DNA, 21 bp, Homo sapiens
ataggttaaaaaaaaaagtca

SEQ ID NO: 4853611 - DNA, 19 bp, Homo sapiens
atagtaagacccccatctc

SEQ ID NO: 4853612 - DNA, 21 bp, Homo sapiens
atagtctaagactatatatat

SEQ ID NO: 4853613 - DNA, 16 bp, Homo sapiens
atagtgcaatagtgca

SEQ ID NO: 4853614 - DNA, 15 bp, Homo sapiens
atagtgtgaaatata

SEQ ID NO: 4853615 - DNA, 12 bp, Homo sapiens
atataaaattat

SEQ ID NO: 4853616 - DNA, 18 bp, Homo sapiens
atataaatgtataaatat

SEQ ID NO: 4853617 - DNA, 19 bp, Homo sapiens
atataatgatcagcaaaaa

SEQ ID NO: 4853618 - DNA, 21 bp, Homo sapiens
atataatgatcagcaaaaaga

SEQ ID NO: 4853619 - DNA, 13 bp, Homo sapiens
atataatttaaag

SEQ ID NO: 4853620 - DNA, 18 bp, Homo sapiens
atatacatactgcatctt

SEQ ID NO: 4853621 - DNA, 15 bp, Homo sapiens
atatagacttggaga

SEQ ID NO: 4853622 - DNA, 22 bp, Homo sapiens
atataggctattttctaaagac

SEQ ID NO: 4853623 - DNA, 13 bp, Homo sapiens
atatataaatgta

SEQ ID NO: 4853624 - DNA, 20 bp, Homo sapiens
atatataagtgtacatatgt

SEQ ID NO: 4853625 - DNA, 11 bp, Homo sapiens
atatatatata

SEQ ID NO: 4853626 - DNA, 16 bp, Homo sapiens
atatattaaaattcca

SEQ ID NO: 4853627 - DNA, 16 bp, Homo sapiens
atatattttgtttaca

SEQ ID NO: 4853628 - DNA, 22 bp, Homo sapiens
atatcccttggacattttatgt

SEQ ID NO: 4853629 - DNA, 23 bp, Homo sapiens
atatcccttggacattttatgtc

SEQ ID NO: 4853630 - DNA, 13 bp, Homo sapiens
atatgaaagctga

SEQ ID NO: 4853631 - DNA, 12 bp, Homo sapiens
atatgaatgaat

SEQ ID NO: 4853632 - DNA, 18 bp, Homo sapiens
atatgcagaaatagacaa

SEQ ID NO: 4853633 - DNA, 20 bp, Homo sapiens
atatgctttattaatgtttt

SEQ ID NO: 4853634 - DNA, 14 bp, Homo sapiens
atatggaagaaagt

SEQ ID NO: 4853635 - DNA, 16 bp, Homo sapiens
atatgtatatatgtat

SEQ ID NO: 4853636 - DNA, 19 bp, Homo sapiens
atatgtatatatgtatttc

SEQ ID NO: 4853637 - DNA, 19 bp, Homo sapiens
atatgtattttttgaatct

SEQ ID NO: 4853638 - DNA, 12 bp, Homo sapiens
atattaaaaaac

SEQ ID NO: 4853639 - DNA, 12 bp, Homo sapiens
atattaaacaaa

SEQ ID NO: 4853640 - DNA, 18 bp, Homo sapiens
atattaaacaaagtttca

SEQ ID NO: 4853641 - DNA, 14 bp, Homo sapiens
atattaaataacat

SEQ ID NO: 4853642 - DNA, 16 bp, Homo sapiens
atattaaataacatgt

SEQ ID NO: 4853643 - DNA, 19 bp, Homo sapiens
atattaaataacatgtttc

SEQ ID NO: 4853644 - DNA, 22 bp, Homo sapiens
atattaaataacatgtttctct

SEQ ID NO: 4853645 - DNA, 16 bp, Homo sapiens
atattacccaatggaa

SEQ ID NO: 4853646 - DNA, 16 bp, Homo sapiens
atattactgacatttc

SEQ ID NO: 4853647 - DNA, 13 bp, Homo sapiens
atattagatcaaa

SEQ ID NO: 4853648 - DNA, 19 bp, Homo sapiens
atattagtattatcttgtt

SEQ ID NO: 4853649 - DNA, 13 bp, Homo sapiens
atattataaagga

SEQ ID NO: 4853650 - DNA, 20 bp, Homo sapiens
atattataaaggataaagaa

SEQ ID NO: 4853651 - DNA, 16 bp, Homo sapiens
atattcagatgtatgt

SEQ ID NO: 4853652 - DNA, 20 bp, Homo sapiens
atattcagggtaaataggaa

SEQ ID NO: 4853653 - DNA, 15 bp, Homo sapiens
atattccagatcttt

SEQ ID NO: 4853654 - DNA, 17 bp, Homo sapiens
atattccagatctttca

SEQ ID NO: 4853655 - DNA, 20 bp, Homo sapiens
atattgaaaattgaaaagta

SEQ ID NO: 4853656 - DNA, 17 bp, Homo sapiens
ccctgcgtcccttctct

SEQ ID NO: 4853657 - DNA, 17 bp, Homo sapiens
ccctgcgtgggggccag

SEQ ID NO: 4853658 - DNA, 22 bp, Homo sapiens
ccctgcgtgggggccagtcagg

SEQ ID NO: 4853659 - DNA, 13 bp, Homo sapiens
ccctggggcaggg

SEQ ID NO: 4853660 - DNA, 22 bp, Homo sapiens
ccctggggcagggtggggggcc

SEQ ID NO: 4853661 - DNA, 18 bp, Homo sapiens
ccctgggtttgggagcca

SEQ ID NO: 4853662 - DNA, 15 bp, Homo sapiens
ccctgtcactgtcca

SEQ ID NO: 4853663 - DNA, 23 bp, Homo sapiens
ccctgttacttatgtagaaactg

SEQ ID NO: 4853664 - DNA, 13 bp, Homo sapiens
cccttcaggagcc

SEQ ID NO: 4853665 - DNA, 19 bp, Homo sapiens
cccttcaggagcctggcca

SEQ ID NO: 4853666 - DNA, 17 bp, Homo sapiens
cccttcatccatcctga

SEQ ID NO: 4853667 - DNA, 13 bp, Homo sapiens
cccttcctcctga

SEQ ID NO: 4853668 - DNA, 20 bp, Homo sapiens
cccttcctcttgtctgattt

SEQ ID NO: 4853669 - DNA, 19 bp, Homo sapiens
cccttctctttggggctcc

SEQ ID NO: 4853670 - DNA, 18 bp, Homo sapiens
cccttgattcattctgaa

SEQ ID NO: 4853671 - DNA, 14 bp, Homo sapiens
cccttggacatttt

SEQ ID NO: 4853672 - DNA, 15 bp, Homo sapiens
cccttggacatttta

SEQ ID NO: 4853673 - DNA, 12 bp, Homo sapiens
ccctttcctggc

SEQ ID NO: 4853674 - DNA, 14 bp, Homo sapiens
ccgacgtcatgtat

SEQ ID NO: 4853675 - DNA, 19 bp, Homo sapiens
ccgaggacgctccctgctc

SEQ ID NO: 4853676 - DNA, 15 bp, Homo sapiens
ccgagggcgaccccg

SEQ ID NO: 4853677 - DNA, 22 bp, Homo sapiens
ccgcagaagcctccccagctca

SEQ ID NO: 4853678 - DNA, 14 bp, Homo sapiens
ccgcagacctggag

SEQ ID NO: 4853679 - DNA, 13 bp, Homo sapiens
ccgcagagaaatg

SEQ ID NO: 4853680 - DNA, 17 bp, Homo sapiens
ccgcagagaaatgcccc

SEQ ID NO: 4853681 - DNA, 18 bp, Homo sapiens
ccgcagagaaatgcccca

SEQ ID NO: 4853682 - DNA, 20 bp, Homo sapiens
ccgcagagaaatgccccagt

SEQ ID NO: 4853683 - DNA, 22 bp, Homo sapiens
ccgcagagaaatgccccagtgt

SEQ ID NO: 4853684 - DNA, 20 bp, Homo sapiens
ccgcagaggtggggtgctgg

SEQ ID NO: 4853685 - DNA, 23 bp, Homo sapiens
ccgcagaggtggggtgctggggc

SEQ ID NO: 4853686 - DNA, 15 bp, Homo sapiens
ccgcagttgtagcag

SEQ ID NO: 4853687 - DNA, 13 bp, Homo sapiens
ccgcccactcctg

SEQ ID NO: 4853688 - DNA, 16 bp, Homo sapiens
ccgcccactcctggga

SEQ ID NO: 4853689 - DNA, 13 bp, Homo sapiens
ccgccgctgccct

SEQ ID NO: 4853690 - DNA, 18 bp, Homo sapiens
ccgcctaagaccctgaat

SEQ ID NO: 4853691 - DNA, 19 bp, Homo sapiens
ccgcctcgacctccccacc

SEQ ID NO: 4853692 - DNA, 16 bp, Homo sapiens
ccgctcccacacccct

SEQ ID NO: 4853693 - DNA, 11 bp, Homo sapiens
ccggaaagaag

SEQ ID NO: 4853694 - DNA, 19 bp, Homo sapiens
ccggagcaaactctgctgt

SEQ ID NO: 4853695 - DNA, 17 bp, Homo sapiens
ccggagtccactcccag

SEQ ID NO: 4853696 - DNA, 15 bp, Homo sapiens
ccggccatactgcct

SEQ ID NO: 4853697 - DNA, 14 bp, Homo sapiens
ccgggtgggcggca

SEQ ID NO: 4853698 - DNA, 19 bp, Homo sapiens
ccggttcagacccctgcct

SEQ ID NO: 4853699 - DNA, 20 bp, Homo sapiens
ccggttcagacccctgcctg

SEQ ID NO: 4853700 - DNA, 14 bp, Homo sapiens
ccgtaatttaactt

SEQ ID NO: 4853701 - DNA, 17 bp, Homo sapiens
ccgtagcttcagccagg

SEQ ID NO: 4853702 - DNA, 13 bp, Homo sapiens
ccgtctcctccct

SEQ ID NO: 4853703 - DNA, 18 bp, Homo sapiens
ccgtgccccttccctggg

SEQ ID NO: 4853704 - DNA, 16 bp, Homo sapiens
ccgtggcagcttgctg

SEQ ID NO: 4853705 - DNA, 17 bp, Homo sapiens
ccgtggcagcttgctgg

SEQ ID NO: 4853706 - DNA, 13 bp, Homo sapiens
cctaaaagcactc

SEQ ID NO: 4853707 - DNA, 19 bp, Homo sapiens
cctaaaataacagtatgtg

SEQ ID NO: 4853708 - DNA, 21 bp, Homo sapiens
cctaaaccccaagcttcccaa

SEQ ID NO: 4853709 - DNA, 17 bp, Homo sapiens
cctaaagagcatcctga

SEQ ID NO: 4853710 - DNA, 18 bp, Homo sapiens
cctaaagagcatcctgat

SEQ ID NO: 4853711 - DNA, 20 bp, Homo sapiens
cctaaagagcatcctgatac

SEQ ID NO: 4853712 - DNA, 15 bp, Homo sapiens
cctaaagccaggctc

SEQ ID NO: 4853713 - DNA, 14 bp, Homo sapiens
cctaacctgggacc

SEQ ID NO: 4853714 - DNA, 24 bp, Homo sapiens
cctaagaagaaggccagagaggga

SEQ ID NO: 4853715 - DNA, 13 bp, Homo sapiens
cctaatgtgttta

SEQ ID NO: 4853716 - DNA, 21 bp, Homo sapiens
cctaattaatatattaaaatt

SEQ ID NO: 4853717 - DNA, 15 bp, Homo sapiens
cctaattgtgcccct

SEQ ID NO: 4853718 - DNA, 15 bp, Homo sapiens
cctacagacagctta

SEQ ID NO: 4853719 - DNA, 15 bp, Homo sapiens
cctacattccaccct

SEQ ID NO: 4853720 - DNA, 16 bp, Homo sapiens
cctacattccaccctg

SEQ ID NO: 4853721 - DNA, 21 bp, Homo sapiens
cctactctccttgagtgtatg

SEQ ID NO: 4853722 - DNA, 16 bp, Homo sapiens
cctactgtgggcaaag

SEQ ID NO: 4853723 - DNA, 14 bp, Homo sapiens
cctactttctattt

SEQ ID NO: 4853724 - DNA, 19 bp, Homo sapiens
cctagactgctcctgggca

SEQ ID NO: 4853725 - DNA, 14 bp, Homo sapiens
cctagcctatgtct

SEQ ID NO: 4853726 - DNA, 16 bp, Homo sapiens
cctagcctatgtctgg

SEQ ID NO: 4853727 - DNA, 20 bp, Homo sapiens
cctagctcctccccttcctc

SEQ ID NO: 4853728 - DNA, 16 bp, Homo sapiens
cctagctgtgtgaata

SEQ ID NO: 4853729 - DNA, 18 bp, Homo sapiens
cctagggctctccaagca

SEQ ID NO: 4853730 - DNA, 20 bp, Homo sapiens
cctagggtcttgggggtcag

SEQ ID NO: 4853731 - DNA, 19 bp, Homo sapiens
cctagttaaagaaaggaaa

SEQ ID NO: 4853732 - DNA, 20 bp, Homo sapiens
cctagttaaagaaaggaaaa

SEQ ID NO: 4853733 - DNA, 15 bp, Homo sapiens
cctagttcaggtcca

SEQ ID NO: 4853734 - DNA, 15 bp, Homo sapiens
cctatccctctccta

SEQ ID NO: 4853735 - DNA, 14 bp, Homo sapiens
cctatcctctgagt

SEQ ID NO: 4853736 - DNA, 11 bp, Homo sapiens
cctatgtctgg

SEQ ID NO: 4853737 - DNA, 13 bp, Homo sapiens
cctatgtctggca

SEQ ID NO: 4853738 - DNA, 21 bp, Homo sapiens
cctatgtctggcagatgaggg

SEQ ID NO: 4853739 - DNA, 14 bp, Homo sapiens
cctatttttgtgaa

SEQ ID NO: 4853740 - DNA, 23 bp, Homo sapiens
cctatttttttagattgagaaat

SEQ ID NO: 4853741 - DNA, 20 bp, Homo sapiens
cctcaagtcactcccaagcc

SEQ ID NO: 4853742 - DNA, 14 bp, Homo sapiens
cctcacctgtctag

SEQ ID NO: 4853743 - DNA, 21 bp, Homo sapiens
cctcagcctgctttcctgcag

SEQ ID NO: 4853744 - DNA, 15 bp, Homo sapiens
cctcagctctctggg

SEQ ID NO: 4853745 - DNA, 15 bp, Homo sapiens
cctcaggccaaggga

SEQ ID NO: 4853746 - DNA, 20 bp, Homo sapiens
cctcaggccaagggaccagg

SEQ ID NO: 4853747 - DNA, 11 bp, Homo sapiens
cctcaggctcc

SEQ ID NO: 4853748 - DNA, 18 bp, Homo sapiens
cctcaggctcctaaagag

SEQ ID NO: 4853749 - DNA, 21 bp, Homo sapiens
cctcaggctcctaaagagaca

SEQ ID NO: 4853750 - DNA, 14 bp, Homo sapiens
cctcagggtggggg

SEQ ID NO: 4853751 - DNA, 20 bp, Homo sapiens
cctcagtagcatctcagtgg

SEQ ID NO: 4853752 - DNA, 22 bp, Homo sapiens
cctcagttctcaaatgtgtgtg

SEQ ID NO: 4853753 - DNA, 18 bp, Homo sapiens
cctcatcactggactgca

SEQ ID NO: 4853754 - DNA, 22 bp, Homo sapiens
ccagggcaccgtattcctctcc

SEQ ID NO: 4853755 - DNA, 13 bp, Homo sapiens
ccaggggagccag

SEQ ID NO: 4853756 - DNA, 22 bp, Homo sapiens
ccaggggccaacctcaggctcc

SEQ ID NO: 4853757 - DNA, 21 bp, Homo sapiens
ccaggggctggtgggacagtg

SEQ ID NO: 4853758 - DNA, 14 bp, Homo sapiens
ccagggtctctcag

SEQ ID NO: 4853759 - DNA, 17 bp, Homo sapiens
ccagggtctctcaggga

SEQ ID NO: 4853760 - DNA, 15 bp, Homo sapiens
ccagggtgacaaggc

SEQ ID NO: 4853761 - DNA, 18 bp, Homo sapiens
ccagggtgacaaggcctg

SEQ ID NO: 4853762 - DNA, 19 bp, Homo sapiens
ccagggtgacaaggcctgc

SEQ ID NO: 4853763 - DNA, 21 bp, Homo sapiens
ccaggtctgactccaaagctg

SEQ ID NO: 4853764 - DNA, 19 bp, Homo sapiens
ccaggtgtttgtggggctg

SEQ ID NO: 4853765 - DNA, 19 bp, Homo sapiens
ccaggttgactaagaaatg

SEQ ID NO: 4853766 - DNA, 22 bp, Homo sapiens
ccagtaaaatactattgcctca

SEQ ID NO: 4853767 - DNA, 22 bp, Homo sapiens
ccagtcacttctgggggtcact

SEQ ID NO: 4853768 - DNA, 21 bp, Homo sapiens
ccagtcaggctgcagaggcac

SEQ ID NO: 4853769 - DNA, 15 bp, Homo sapiens
ccagtcctaacaaat

SEQ ID NO: 4853770 - DNA, 20 bp, Homo sapiens
ccagtcgtcatcagatgctt

SEQ ID NO: 4853771 - DNA, 13 bp, Homo sapiens
ccagtctgaccct

SEQ ID NO: 4853772 - DNA, 11 bp, Homo sapiens
ccagtgactcc

SEQ ID NO: 4853773 - DNA, 14 bp, Homo sapiens
atcaaataagaaat

SEQ ID NO: 4853774 - DNA, 15 bp, Homo sapiens
atcaaataagaaata

SEQ ID NO: 4853775 - DNA, 15 bp, Homo sapiens
atcacaaagtggaac

SEQ ID NO: 4853776 - DNA, 17 bp, Homo sapiens
atcactggactgcatgg

SEQ ID NO: 4853777 - DNA, 19 bp, Homo sapiens
atcactgtatcattttctt

SEQ ID NO: 4853778 - DNA, 14 bp, Homo sapiens
atcagacagcagga

SEQ ID NO: 4853779 - DNA, 20 bp, Homo sapiens
atcagcaaaaagactggatt

SEQ ID NO: 4853780 - DNA, 19 bp, Homo sapiens
atcagcaacccttcctgct

SEQ ID NO: 4853781 - DNA, 23 bp, Homo sapiens
atcaggagaaagcttggttctgt

SEQ ID NO: 4853782 - DNA, 23 bp, Homo sapiens
atcagtaacccccttaaatttaa

SEQ ID NO: 4853783 - DNA, 14 bp, Homo sapiens
atcataaagtcagt

SEQ ID NO: 4853784 - DNA, 17 bp, Homo sapiens
atcatacacttccttct

SEQ ID NO: 4853785 - DNA, 18 bp, Homo sapiens
atcatcattcttgtggga

SEQ ID NO: 4853786 - DNA, 14 bp, Homo sapiens
atcatctcttcctc

SEQ ID NO: 4853787 - DNA, 23 bp, Homo sapiens
atcatgagtgaataaatgtcttg

SEQ ID NO: 4853788 - DNA, 13 bp, Homo sapiens
atcattcagaaat

SEQ ID NO: 4853789 - DNA, 18 bp, Homo sapiens
atcattcttactaaaaag

SEQ ID NO: 4853790 - DNA, 16 bp, Homo sapiens
atccaactttttcata

SEQ ID NO: 4853791 - DNA, 13 bp, Homo sapiens
atccaagagggac

SEQ ID NO: 4853792 - DNA, 15 bp, Homo sapiens
atccagcccaaacct

SEQ ID NO: 4853793 - DNA, 19 bp, Homo sapiens
atccagcccaaacctggga

SEQ ID NO: 4853794 - DNA, 16 bp, Homo sapiens
atccagggcagcaggc

SEQ ID NO: 4853795 - DNA, 17 bp, Homo sapiens
atccagggcagcaggcc

SEQ ID NO: 4853796 - DNA, 13 bp, Homo sapiens
atccagtataaga

SEQ ID NO: 4853797 - DNA, 14 bp, Homo sapiens
atccagtgtgagat

SEQ ID NO: 4853798 - DNA, 15 bp, Homo sapiens
atccagtgtgagata

SEQ ID NO: 4853799 - DNA, 12 bp, Homo sapiens
atccatcctgag

SEQ ID NO: 4853800 - DNA, 15 bp, Homo sapiens
atccatcctgagcca

SEQ ID NO: 4853801 - DNA, 20 bp, Homo sapiens
atccatcgtattaaaaaaca

SEQ ID NO: 4853802 - DNA, 16 bp, Homo sapiens
atccatttccattgct

SEQ ID NO: 4853803 - DNA, 13 bp, Homo sapiens
atcccgtcttcca

SEQ ID NO: 4853804 - DNA, 12 bp, Homo sapiens
atccctacatgt

SEQ ID NO: 4853805 - DNA, 15 bp, Homo sapiens
atccctacatgtatt

SEQ ID NO: 4853806 - DNA, 13 bp, Homo sapiens
atccctcacctgt

SEQ ID NO: 4853807 - DNA, 19 bp, Homo sapiens
atccctccattcatccttc

SEQ ID NO: 4853808 - DNA, 18 bp, Homo sapiens
atccctgaggactgattt

SEQ ID NO: 4853809 - DNA, 20 bp, Homo sapiens
atccctgcctggaggctcct

SEQ ID NO: 4853810 - DNA, 23 bp, Homo sapiens
atccctgcctggaggctcctcta

SEQ ID NO: 4853811 - DNA, 22 bp, Homo sapiens
atccctttttcataaattattt

SEQ ID NO: 4853812 - DNA, 18 bp, Homo sapiens
atcctaagatgtgttctt

SEQ ID NO: 4853813 - DNA, 21 bp, Homo sapiens
atcctaagatgtgttcttatt

SEQ ID NO: 4853814 - DNA, 21 bp, Homo sapiens
atcctcagttctcaaatgtgt

SEQ ID NO: 4853815 - DNA, 21 bp, Homo sapiens
atcctccttctcctgttccat

SEQ ID NO: 4853816 - DNA, 11 bp, Homo sapiens
atcctgagcca

SEQ ID NO: 4853817 - DNA, 13 bp, Homo sapiens
atccttccatcca

SEQ ID NO: 4853818 - DNA, 16 bp, Homo sapiens
atccttgagattctga

SEQ ID NO: 4853819 - DNA, 18 bp, Homo sapiens
atccttgagattctgaag

SEQ ID NO: 4853820 - DNA, 17 bp, Homo sapiens
atccttggcttcaggtt

SEQ ID NO: 4853821 - DNA, 21 bp, Homo sapiens
atcggccatcaagggaagaac

SEQ ID NO: 4853822 - DNA, 18 bp, Homo sapiens
atcgtattaaaaaacaat

SEQ ID NO: 4853823 - DNA, 19 bp, Homo sapiens
atctaaaaatagacttaaa

SEQ ID NO: 4853824 - DNA, 20 bp, Homo sapiens
atctacttctgtaattgtgt

SEQ ID NO: 4853825 - DNA, 23 bp, Homo sapiens
atctacttctgtaattgtgtgga

SEQ ID NO: 4853826 - DNA, 18 bp, Homo sapiens
atctagcccaacctacat

SEQ ID NO: 4853827 - DNA, 15 bp, Homo sapiens
atctataaactataa

SEQ ID NO: 4853828 - DNA, 12 bp, Homo sapiens
atctcaaaatta

SEQ ID NO: 4853829 - DNA, 17 bp, Homo sapiens
atctcattgcttacaag

SEQ ID NO: 4853830 - DNA, 16 bp, Homo sapiens
atctcctttgaagaag

SEQ ID NO: 4853831 - DNA, 15 bp, Homo sapiens
atctctaaagagcat

SEQ ID NO: 4853832 - DNA, 19 bp, Homo sapiens
atctctttccaccatacct

SEQ ID NO: 4853833 - DNA, 15 bp, Homo sapiens
atctgaaaggccagc

SEQ ID NO: 4853834 - DNA, 16 bp, Homo sapiens
atctgaaaggccagca

SEQ ID NO: 4853835 - DNA, 14 bp, Homo sapiens
atctgaagagtgga

SEQ ID NO: 4853836 - DNA, 18 bp, Homo sapiens
atctgctaccaaaacagt

SEQ ID NO: 4853837 - DNA, 14 bp, Homo sapiens
atctgctgggatct

SEQ ID NO: 4853838 - DNA, 16 bp, Homo sapiens
atctgtacaaaatggt

SEQ ID NO: 4853839 - DNA, 20 bp, Homo sapiens
atctgtgaagaaagaggtta

SEQ ID NO: 4853840 - DNA, 22 bp, Homo sapiens
atctgttttgtggtttggaata

SEQ ID NO: 4853841 - DNA, 16 bp, Homo sapiens
atcttattttctcaat

SEQ ID NO: 4853842 - DNA, 12 bp, Homo sapiens
atcttcctggca

SEQ ID NO: 4853843 - DNA, 19 bp, Homo sapiens
atcttcctggcacaatgtt

SEQ ID NO: 4853844 - DNA, 15 bp, Homo sapiens
atcttctttcttcca

SEQ ID NO: 4853845 - DNA, 22 bp, Homo sapiens
atcttctttggacttctgaaga

SEQ ID NO: 4853846 - DNA, 18 bp, Homo sapiens
atcttgcctcattttgct

SEQ ID NO: 4853847 - DNA, 17 bp, Homo sapiens
atcttgttcaggaaaag

SEQ ID NO: 4853848 - DNA, 19 bp, Homo sapiens
atcttgttcaggaaaaggt

SEQ ID NO: 4853849 - DNA, 17 bp, Homo sapiens
atcttgttttgaaaata

SEQ ID NO: 4853850 - DNA, 13 bp, Homo sapiens
atctttattgaaa

SEQ ID NO: 4853851 - DNA, 16 bp, Homo sapiens
atctttattgaaattc

SEQ ID NO: 4853852 - DNA, 22 bp, Homo sapiens
atctttcagaaatataacacat

SEQ ID NO: 4853853 - DNA, 15 bp, Homo sapiens
atcttttgttctcct

SEQ ID NO: 4853854 - DNA, 13 bp, Homo sapiens
atgaaaaaccatt

SEQ ID NO: 4853855 - DNA, 21 bp, Homo sapiens
atgaaacatgggctgtgatta

SEQ ID NO: 4853856 - DNA, 12 bp, Homo sapiens
atgaaacttctc

SEQ ID NO: 4853857 - DNA, 12 bp, Homo sapiens
atgaaagaaaat

SEQ ID NO: 4853858 - DNA, 16 bp, Homo sapiens
atgaaagctgttcctt

SEQ ID NO: 4853859 - DNA, 18 bp, Homo sapiens
atgaaatgcatatttgca

SEQ ID NO: 4853860 - DNA, 16 bp, Homo sapiens
atgaaattcttcctaa

SEQ ID NO: 4853861 - DNA, 14 bp, Homo sapiens
atgaacctgaaaag

SEQ ID NO: 4853862 - DNA, 14 bp, Homo sapiens
atgaagcagaacct

SEQ ID NO: 4853863 - DNA, 22 bp, Homo sapiens
atgaagcagaaccttctttggt

SEQ ID NO: 4853864 - DNA, 18 bp, Homo sapiens
atgaagtctgagggaaac

SEQ ID NO: 4853865 - DNA, 20 bp, Homo sapiens
atgaagtctgagggaaacca

SEQ ID NO: 4853866 - DNA, 22 bp, Homo sapiens
atgaagtctgagggaaaccaga

SEQ ID NO: 4853867 - DNA, 15 bp, Homo sapiens
atgaatgaatgggat

SEQ ID NO: 4853868 - DNA, 21 bp, Homo sapiens
atgaatgtgctggtgaacact

SEQ ID NO: 4853869 - DNA, 16 bp, Homo sapiens
atgaattttaaagtat

SEQ ID NO: 4853870 - DNA, 14 bp, Homo sapiens
atgacaatcaaagc

SEQ ID NO: 4853871 - DNA, 16 bp, Homo sapiens
atgacagaggtttgaa

SEQ ID NO: 4853872 - DNA, 22 bp, Homo sapiens
atgacagaggtttgaaggagaa

SEQ ID NO: 4853873 - DNA, 23 bp, Homo sapiens
atgacagaggtttgaaggagaat

SEQ ID NO: 4853874 - DNA, 12 bp, Homo sapiens
atgacctccaga

SEQ ID NO: 4853875 - DNA, 23 bp, Homo sapiens
atgaccttgagttaacaggacag

SEQ ID NO: 4853876 - DNA, 17 bp, Homo sapiens
atgagctctgaaatctt

SEQ ID NO: 4853877 - DNA, 16 bp, Homo sapiens
cattttttaatttact

SEQ ID NO: 4853878 - DNA, 21 bp, Homo sapiens
cattttttaatttacttgttt

SEQ ID NO: 4853879 - DNA, 19 bp, Homo sapiens
ccaaaaggtttaagaaata

SEQ ID NO: 4853880 - DNA, 23 bp, Homo sapiens
ccaaaaggtttaagaaatagaat

SEQ ID NO: 4853881 - DNA, 14 bp, Homo sapiens
ccaaaatcagcttt

SEQ ID NO: 4853882 - DNA, 14 bp, Homo sapiens
ccaaacagacaaaa

SEQ ID NO: 4853883 - DNA, 14 bp, Homo sapiens
ccaaacctgggaag

SEQ ID NO: 4853884 - DNA, 16 bp, Homo sapiens
ccaaactactgaatga

SEQ ID NO: 4853885 - DNA, 11 bp, Homo sapiens
ccaaagagaaa

SEQ ID NO: 4853886 - DNA, 17 bp, Homo sapiens
ccaaagctgttccatta

SEQ ID NO: 4853887 - DNA, 14 bp, Homo sapiens
ccaaaggaactcta

SEQ ID NO: 4853888 - DNA, 24 bp, Homo sapiens
ccaaatcctagactgctcctgggc

SEQ ID NO: 4853889 - DNA, 22 bp, Homo sapiens
ccaaattcaccttcccctaaac

SEQ ID NO: 4853890 - DNA, 11 bp, Homo sapiens
ccaaatttaaa

SEQ ID NO: 4853891 - DNA, 17 bp, Homo sapiens
ccaacagacacaattta

SEQ ID NO: 4853892 - DNA, 12 bp, Homo sapiens
ccaacctccaga

SEQ ID NO: 4853893 - DNA, 21 bp, Homo sapiens
caaaaatttctgtaaaacagg

SEQ ID NO: 4853894 - DNA, 11 bp, Homo sapiens
caaaacaaaaa

SEQ ID NO: 4853895 - DNA, 18 bp, Homo sapiens
caaaacatttatgacaag

SEQ ID NO: 4853896 - DNA, 11 bp, Homo sapiens
caaaaggaaag

SEQ ID NO: 4853897 - DNA, 16 bp, Homo sapiens
caaaaggaaagctgtg

SEQ ID NO: 4853898 - DNA, 23 bp, Homo sapiens
caaaatggtcctatttttgtgaa

SEQ ID NO: 4853899 - DNA, 23 bp, Homo sapiens
caaaattagatcctaagatgtgt

SEQ ID NO: 4853900 - DNA, 13 bp, Homo sapiens
caaaatttatatt

SEQ ID NO: 4853901 - DNA, 18 bp, Homo sapiens
caaaatttatattttaga

SEQ ID NO: 4853902 - DNA, 12 bp, Homo sapiens
caaaattttaaa

SEQ ID NO: 4853903 - DNA, 18 bp, Homo sapiens
caaacaagccccctgccc

SEQ ID NO: 4853904 - DNA, 15 bp, Homo sapiens
caaacatcattgttt

SEQ ID NO: 4853905 - DNA, 16 bp, Homo sapiens
caaacatcattgttta

SEQ ID NO: 4853906 - DNA, 22 bp, Homo sapiens
caaacatgttcccaaggcccca

SEQ ID NO: 4853907 - DNA, 15 bp, Homo sapiens
caaacctttgagtag

SEQ ID NO: 4853908 - DNA, 11 bp, Homo sapiens
caaactccagg

SEQ ID NO: 4853909 - DNA, 12 bp, Homo sapiens
caaactccaggc

SEQ ID NO: 4853910 - DNA, 14 bp, Homo sapiens
caaactccaggctg

SEQ ID NO: 4853911 - DNA, 18 bp, Homo sapiens
caaactccaggctggaag

SEQ ID NO: 4853912 - DNA, 18 bp, Homo sapiens
caaactctgctgtctaac

SEQ ID NO: 4853913 - DNA, 14 bp, Homo sapiens
caaagaaaatgaaa

SEQ ID NO: 4853914 - DNA, 16 bp, Homo sapiens
caaagaaacaaagatg

SEQ ID NO: 4853915 - DNA, 21 bp, Homo sapiens
caaagcaatttactgatgaga

SEQ ID NO: 4853916 - DNA, 14 bp, Homo sapiens
caaagcactggcct

SEQ ID NO: 4853917 - DNA, 21 bp, Homo sapiens
caaagcactggccttgcctcc

SEQ ID NO: 4853918 - DNA, 13 bp, Homo sapiens
caaagcctctgaa

SEQ ID NO: 4853919 - DNA, 17 bp, Homo sapiens
caaaggaaaatgtctgt

SEQ ID NO: 4853920 - DNA, 13 bp, Homo sapiens
caaaggatgtgat

SEQ ID NO: 4853921 - DNA, 16 bp, Homo sapiens
caaaggtgcactccag

SEQ ID NO: 4853922 - DNA, 21 bp, Homo sapiens
caaagtcgccagtcactgctg

SEQ ID NO: 4853923 - DNA, 13 bp, Homo sapiens
caaagtctccaga

SEQ ID NO: 4853924 - DNA, 20 bp, Homo sapiens
caaagtctgctctcatataa

SEQ ID NO: 4853925 - DNA, 14 bp, Homo sapiens
caaagtgacaaagc

SEQ ID NO: 4853926 - DNA, 16 bp, Homo sapiens
caaataaaacgctttc

SEQ ID NO: 4853927 - DNA, 17 bp, Homo sapiens
caaataaataattttca

SEQ ID NO: 4853928 - DNA, 20 bp, Homo sapiens
caaataatttgaactttgga

SEQ ID NO: 4853929 - DNA, 23 bp, Homo sapiens
caaataatttgaactttggaaca

SEQ ID NO: 4853930 - DNA, 16 bp, Homo sapiens
caaatacacatttgct

SEQ ID NO: 4853931 - DNA, 18 bp, Homo sapiens
caaatagattcagagaaa

SEQ ID NO: 4853932 - DNA, 20 bp, Homo sapiens
caaataggctattaaaaaag

SEQ ID NO: 4853933 - DNA, 23 bp, Homo sapiens
caaataggctattaaaaaagtct

SEQ ID NO: 4853934 - DNA, 15 bp, Homo sapiens
caaatagtgtgaaat

SEQ ID NO: 4853935 - DNA, 19 bp, Homo sapiens
caaatagttgcatagcagt

SEQ ID NO: 4853936 - DNA, 16 bp, Homo sapiens
caaatgagctctgaaa

SEQ ID NO: 4853937 - DNA, 20 bp, Homo sapiens
caaatgagctctgaaatctt

SEQ ID NO: 4853938 - DNA, 22 bp, Homo sapiens
caaatgcagggaggggaggcag

SEQ ID NO: 4853939 - DNA, 13 bp, Homo sapiens
caaattaaaaaaa

SEQ ID NO: 4853940 - DNA, 19 bp, Homo sapiens
caaattaaaaaaaaattgt

SEQ ID NO: 4853941 - DNA, 23 bp, Homo sapiens
caaattcatggcatgcttaaatt

SEQ ID NO: 4853942 - DNA, 21 bp, Homo sapiens
caaattttggcgaatctcaaa

SEQ ID NO: 4853943 - DNA, 14 bp, Homo sapiens
caacaagaaccact

SEQ ID NO: 4853944 - DNA, 22 bp, Homo sapiens
caacaccactaggaatcccaga

SEQ ID NO: 4853945 - DNA, 13 bp, Homo sapiens
caacagaacatat

SEQ ID NO: 4853946 - DNA, 17 bp, Homo sapiens
caacatatatttattga

SEQ ID NO: 4853947 - DNA, 17 bp, Homo sapiens
caaccatcatgtgtaga

SEQ ID NO: 4853948 - DNA, 21 bp, Homo sapiens
caaccatcatgtgtagagccc

SEQ ID NO: 4853949 - DNA, 20 bp, Homo sapiens
caacccagtcacactgtggc

SEQ ID NO: 4853950 - DNA, 23 bp, Homo sapiens
caaccccgaggtccctgttgtca

SEQ ID NO: 4853951 - DNA, 15 bp, Homo sapiens
caacctcaggctcct

SEQ ID NO: 4853952 - DNA, 13 bp, Homo sapiens
caacctccagact

SEQ ID NO: 4853953 - DNA, 14 bp, Homo sapiens
caacctccagactc

SEQ ID NO: 4853954 - DNA, 22 bp, Homo sapiens
caacctgcatagccggtgggtg

SEQ ID NO: 4853955 - DNA, 13 bp, Homo sapiens
caaccttgtttaa

SEQ ID NO: 4853956 - DNA, 18 bp, Homo sapiens
caactacacaaagcaggc

SEQ ID NO: 4853957 - DNA, 19 bp, Homo sapiens
caactactagtgtgactcc

SEQ ID NO: 4853958 - DNA, 13 bp, Homo sapiens
caactcccttgca

SEQ ID NO: 4853959 - DNA, 15 bp, Homo sapiens
caactctacccctgc

SEQ ID NO: 4853960 - DNA, 16 bp, Homo sapiens
caactctacccctgct

SEQ ID NO: 4853961 - DNA, 12 bp, Homo sapiens
caactgattgca

SEQ ID NO: 4853962 - DNA, 20 bp, Homo sapiens
caacttgtatccaggcctgg

SEQ ID NO: 4853963 - DNA, 22 bp, Homo sapiens
caactttgtaaaaatcttttga

SEQ ID NO: 4853964 - DNA, 21 bp, Homo sapiens
caagaacataaaccctccaag

SEQ ID NO: 4853965 - DNA, 21 bp, Homo sapiens
caagaaccactccttcatgtt

SEQ ID NO: 4853966 - DNA, 16 bp, Homo sapiens
caagagataagtcttt

SEQ ID NO: 4853967 - DNA, 19 bp, Homo sapiens
caagagctactcccacagc

SEQ ID NO: 4853968 - DNA, 19 bp, Homo sapiens
caagaggcaagctgaaatt

SEQ ID NO: 4853969 - DNA, 21 bp, Homo sapiens
caagcaccaacctccagactc

SEQ ID NO: 4853970 - DNA, 17 bp, Homo sapiens
caagcactagccttccc

SEQ ID NO: 4853971 - DNA, 17 bp, Homo sapiens
caagcattctgtttatc

SEQ ID NO: 4853972 - DNA, 20 bp, Homo sapiens
caagctgaaattttagaaat

SEQ ID NO: 4853973 - DNA, 13 bp, Homo sapiens
caagcttcttgct

SEQ ID NO: 4853974 - DNA, 14 bp, Homo sapiens
caagcttcttgctg

SEQ ID NO: 4853975 - DNA, 18 bp, Homo sapiens
caaggagcatccttggca

SEQ ID NO: 4853976 - DNA, 18 bp, Homo sapiens
caaggataccttcttatt

SEQ ID NO: 4853977 - DNA, 15 bp, Homo sapiens
caaggccgccagcgt

SEQ ID NO: 4853978 - DNA, 14 bp, Homo sapiens
caaggcctgcttga

SEQ ID NO: 4853979 - DNA, 13 bp, Homo sapiens
caaggctcttctt

SEQ ID NO: 4853980 - DNA, 20 bp, Homo sapiens
caagggacagcaagtgagca

SEQ ID NO: 4853981 - DNA, 22 bp, Homo sapiens
caagggacagcaagtgagcaga

SEQ ID NO: 4853982 - DNA, 16 bp, Homo sapiens
caagggcataaagtaa

SEQ ID NO: 4853983 - DNA, 17 bp, Homo sapiens
caagggctgtcattgca

SEQ ID NO: 4853984 - DNA, 17 bp, Homo sapiens
caagggggctgctgctc

SEQ ID NO: 4853985 - DNA, 20 bp, Homo sapiens
caagggggctgctgctcctc

SEQ ID NO: 4853986 - DNA, 21 bp, Homo sapiens
caaggggtgaggataggacag

SEQ ID NO: 4853987 - DNA, 15 bp, Homo sapiens
caaggtcctctcagt

SEQ ID NO: 4853988 - DNA, 14 bp, Homo sapiens
caaggtcctgctca

SEQ ID NO: 4853989 - DNA, 15 bp, Homo sapiens
caaggtcctgctcaa

SEQ ID NO: 4853990 - DNA, 14 bp, Homo sapiens
caaggtgaggtgaa

SEQ ID NO: 4853991 - DNA, 23 bp, Homo sapiens
caagtaatttcagtgtaaagtgt

SEQ ID NO: 4853992 - DNA, 23 bp, Homo sapiens
caagtcagtccaggatgctaaca

SEQ ID NO: 4853993 - DNA, 16 bp, Homo sapiens
caagtggtgagcaagc

SEQ ID NO: 4853994 - DNA, 17 bp, Homo sapiens
caagtggtgagcaagca

SEQ ID NO: 4853995 - DNA, 17 bp, Homo sapiens
caagtggtgtttattgc

SEQ ID NO: 4853996 - DNA, 16 bp, Homo sapiens
caagttagttcaatct

SEQ ID NO: 4853997 - DNA, 21 bp, Homo sapiens
caagtttgctgcaacccaagt

SEQ ID NO: 4853998 - DNA, 22 bp, Homo sapiens
caagtttgctgcaacccaagtg

SEQ ID NO: 4853999 - DNA, 14 bp, Homo sapiens
caagttttaaagtt

SEQ ID NO: 4854000 - DNA, 15 bp, Homo sapiens
caagttttaaagttc

SEQ ID NO: 4854001 - DNA, 11 bp, Homo sapiens
caataaaattt

SEQ ID NO: 4854002 - DNA, 20 bp, Homo sapiens
caataaaatttaaaaaataa

SEQ ID NO: 4854003 - DNA, 20 bp, Homo sapiens
caataaagtataatgtttat

SEQ ID NO: 4854004 - DNA, 16 bp, Homo sapiens
caataaagtgatctgt

SEQ ID NO: 4854005 - DNA, 12 bp, Homo sapiens
caatacaaaatg

SEQ ID NO: 4854006 - DNA, 13 bp, Homo sapiens
caatacaaaatgt

SEQ ID NO: 4854007 - DNA, 22 bp, Homo sapiens
caataggagtggtgatttgaaa

SEQ ID NO: 4854008 - DNA, 20 bp, Homo sapiens
caatagtgcaacatctctga

SEQ ID NO: 4854009 - DNA, 20 bp, Homo sapiens
caatatatgtattttttgaa

SEQ ID NO: 4854010 - DNA, 20 bp, Homo sapiens
caatattgattgggaaaaca

SEQ ID NO: 4854011 - DNA, 15 bp, Homo sapiens
caatcactgtgctat

SEQ ID NO: 4854012 - DNA, 15 bp, Homo sapiens
caatccatccatgta

SEQ ID NO: 4854013 - DNA, 23 bp, Homo sapiens
catcttggttatttctgaaggta

SEQ ID NO: 4854014 - DNA, 17 bp, Homo sapiens
catgaaaaaccattttt

SEQ ID NO: 4854015 - DNA, 20 bp, Homo sapiens
catgaaaaaccatttttgaa

SEQ ID NO: 4854016 - DNA, 14 bp, Homo sapiens
catgaaataaaata

SEQ ID NO: 4854017 - DNA, 17 bp, Homo sapiens
catgaagaatgtttctg

SEQ ID NO: 4854018 - DNA, 16 bp, Homo sapiens
catgaagcagaacctt

SEQ ID NO: 4854019 - DNA, 22 bp, Homo sapiens
catgaagcagaaccttctttgg

SEQ ID NO: 4854020 - DNA, 21 bp, Homo sapiens
catgaattacctggatgttct

SEQ ID NO: 4854021 - DNA, 19 bp, Homo sapiens
ctaagaagaaggccagaga

SEQ ID NO: 4854022 - DNA, 22 bp, Homo sapiens
ctaagactatatatataaatgt

SEQ ID NO: 4854023 - DNA, 16 bp, Homo sapiens
ctaagcaaccacactg

SEQ ID NO: 4854024 - DNA, 19 bp, Homo sapiens
ctaagcatgtgtcccagga

SEQ ID NO: 4854025 - DNA, 18 bp, Homo sapiens
ctaagtcattggcaaagt

SEQ ID NO: 4854026 - DNA, 15 bp, Homo sapiens
ctaagtgctgctgtg

SEQ ID NO: 4854027 - DNA, 18 bp, Homo sapiens
ctaagtgctgctgtggag

SEQ ID NO: 4854028 - DNA, 17 bp, Homo sapiens
ctaagtgcttattacat

SEQ ID NO: 4854029 - DNA, 13 bp, Homo sapiens
ctaattaatatat

SEQ ID NO: 4854030 - DNA, 23 bp, Homo sapiens
ctaattaatatattaaaattcca

SEQ ID NO: 4854031 - DNA, 18 bp, Homo sapiens
ctaattatttaattgtcc

SEQ ID NO: 4854032 - DNA, 23 bp, Homo sapiens
ctacagacagcttacaggagcca

SEQ ID NO: 4854033 - DNA, 18 bp, Homo sapiens
ctacagttttaactgtgg

SEQ ID NO: 4854034 - DNA, 19 bp, Homo sapiens
ctacagttttaactgtgga

SEQ ID NO: 4854035 - DNA, 17 bp, Homo sapiens
ctaccaatacaaaatgt

SEQ ID NO: 4854036 - DNA, 20 bp, Homo sapiens
ctaccagggtctctcaggga

SEQ ID NO: 4854037 - DNA, 22 bp, Homo sapiens
ctaccagggtctctcagggatg

SEQ ID NO: 4854038 - DNA, 18 bp, Homo sapiens
ctacctctgtctgagaca

SEQ ID NO: 4854039 - DNA, 20 bp, Homo sapiens
ctacctctgtctgagacagg

SEQ ID NO: 4854040 - DNA, 18 bp, Homo sapiens
ctactaggagaggggggc

SEQ ID NO: 4854041 - DNA, 16 bp, Homo sapiens
ctactgaacacatgtg

SEQ ID NO: 4854042 - DNA, 15 bp, Homo sapiens
ctactgctcctgtgg

SEQ ID NO: 4854043 - DNA, 18 bp, Homo sapiens
ctactgctcctgtggcag

SEQ ID NO: 4854044 - DNA, 19 bp, Homo sapiens
ctactggttacctggagaa

SEQ ID NO: 4854045 - DNA, 19 bp, Homo sapiens
ctactgtaatgctgcctca

SEQ ID NO: 4854046 - DNA, 16 bp, Homo sapiens
ctactgtgggcaaagt

SEQ ID NO: 4854047 - DNA, 16 bp, Homo sapiens
ctacttcccactgtat

SEQ ID NO: 4854048 - DNA, 16 bp, Homo sapiens
ctagactgctcctggg

SEQ ID NO: 4854049 - DNA, 20 bp, Homo sapiens
ctagatccagcccaaacctg

SEQ ID NO: 4854050 - DNA, 19 bp, Homo sapiens
ctagatcctgggtttccat

SEQ ID NO: 4854051 - DNA, 14 bp, Homo sapiens
ctagatgatttttt

SEQ ID NO: 4854052 - DNA, 17 bp, Homo sapiens
ctagatgattttttgaa

SEQ ID NO: 4854053 - DNA, 12 bp, Homo sapiens
ctagattgacta

SEQ ID NO: 4854054 - DNA, 12 bp, Homo sapiens
ctagatttatta

SEQ ID NO: 4854055 - DNA, 23 bp, Homo sapiens
ctagcattgtaaaattatttcat

SEQ ID NO: 4854056 - DNA, 13 bp, Homo sapiens
ctagcccaaccta

SEQ ID NO: 4854057 - DNA, 14 bp, Homo sapiens
ctagcctatgtctg

SEQ ID NO: 4854058 - DNA, 16 bp, Homo sapiens
ctagcctatgtctggc

SEQ ID NO: 4854059 - DNA, 14 bp, Homo sapiens
ctagcctctggact

SEQ ID NO: 4854060 - DNA, 15 bp, Homo sapiens
ctagctcctcccctt

SEQ ID NO: 4854061 - DNA, 14 bp, Homo sapiens
ctagctctttgggc

SEQ ID NO: 4854062 - DNA, 19 bp, Homo sapiens
ctagctctttgggcctctc

SEQ ID NO: 4854063 - DNA, 20 bp, Homo sapiens
ctaggaaccagccaaccatc

SEQ ID NO: 4854064 - DNA, 15 bp, Homo sapiens
ctaggaaccctggag

SEQ ID NO: 4854065 - DNA, 16 bp, Homo sapiens
ctaggaaccctggagg

SEQ ID NO: 4854066 - DNA, 14 bp, Homo sapiens
ctaggcactgagca

SEQ ID NO: 4854067 - DNA, 15 bp, Homo sapiens
ctaggcactgagcag

SEQ ID NO: 4854068 - DNA, 18 bp, Homo sapiens
ctaggcactgagcaggga

SEQ ID NO: 4854069 - DNA, 19 bp, Homo sapiens
ctaggcctccgttgtctgg

SEQ ID NO: 4854070 - DNA, 22 bp, Homo sapiens
ctaggctcttatgtgtgccttt

SEQ ID NO: 4854071 - DNA, 16 bp, Homo sapiens
ctagggccttggaaat

SEQ ID NO: 4854072 - DNA, 15 bp, Homo sapiens
ctagggctctccaag

SEQ ID NO: 4854073 - DNA, 20 bp, Homo sapiens
ctagggctctccaagcacta

SEQ ID NO: 4854074 - DNA, 14 bp, Homo sapiens
ctaggtacgatgac

SEQ ID NO: 4854075 - DNA, 20 bp, Homo sapiens
ctaggtacgatgacagtgtt

SEQ ID NO: 4854076 - DNA, 16 bp, Homo sapiens
ctaggtctcctcaggg

SEQ ID NO: 4854077 - DNA, 20 bp, Homo sapiens
ctaggtctcctcagggtggg

SEQ ID NO: 4854078 - DNA, 20 bp, Homo sapiens
ctaggttctgtagagccaat

SEQ ID NO: 4854079 - DNA, 22 bp, Homo sapiens
ctagtaagaagacaaactgctt

SEQ ID NO: 4854080 - DNA, 16 bp, Homo sapiens
ctagtacctgtgactc

SEQ ID NO: 4854081 - DNA, 17 bp, Homo sapiens
ctagtacctgtgactct

SEQ ID NO: 4854082 - DNA, 17 bp, Homo sapiens
ctagtgaggaagacaag

SEQ ID NO: 4854083 - DNA, 19 bp, Homo sapiens
ctagtggtatggggctgag

SEQ ID NO: 4854084 - DNA, 16 bp, Homo sapiens
ctagttctaacagtga

SEQ ID NO: 4854085 - DNA, 16 bp, Homo sapiens
ctatactgtggcctgc

SEQ ID NO: 4854086 - DNA, 20 bp, Homo sapiens
ctatactgtggcctgcagga

SEQ ID NO: 4854087 - DNA, 15 bp, Homo sapiens
ctatagcattttgct

SEQ ID NO: 4854088 - DNA, 17 bp, Homo sapiens
ctatatagacttggaga

SEQ ID NO: 4854089 - DNA, 18 bp, Homo sapiens
ctatatcctccttctcct

SEQ ID NO: 4854090 - DNA, 17 bp, Homo sapiens
ctatattagatcaaata

SEQ ID NO: 4854091 - DNA, 15 bp, Homo sapiens
ctatattcctccagc

SEQ ID NO: 4854092 - DNA, 18 bp, Homo sapiens
ctatattcctccagctgg

SEQ ID NO: 4854093 - DNA, 13 bp, Homo sapiens
ctatccacactgt

SEQ ID NO: 4854094 - DNA, 15 bp, Homo sapiens
ctatccacactgtca

SEQ ID NO: 4854095 - DNA, 17 bp, Homo sapiens
ctatccacactgtcaaa

SEQ ID NO: 4854096 - DNA, 18 bp, Homo sapiens
ctatctagttctaacagt

SEQ ID NO: 4854097 - DNA, 12 bp, Homo sapiens
ctatctcttcct

SEQ ID NO: 4854098 - DNA, 12 bp, Homo sapiens
ctatctgtattc

SEQ ID NO: 4854099 - DNA, 17 bp, Homo sapiens
ctatctgtattcccaaa

SEQ ID NO: 4854100 - DNA, 15 bp, Homo sapiens
ctatcttctttggac

SEQ ID NO: 4854101 - DNA, 20 bp, Homo sapiens
ctatcttttttagtgttaaa

SEQ ID NO: 4854102 - DNA, 21 bp, Homo sapiens
ctatcttttttagtgttaaag

SEQ ID NO: 4854103 - DNA, 12 bp, Homo sapiens
ctatgtctggca

SEQ ID NO: 4854104 - DNA, 13 bp, Homo sapiens
ctatgttaatatt

SEQ ID NO: 4854105 - DNA, 14 bp, Homo sapiens
ctatgttaatattt

SEQ ID NO: 4854106 - DNA, 15 bp, Homo sapiens
ctatgttaatatttt

SEQ ID NO: 4854107 - DNA, 18 bp, Homo sapiens
ctattatttttataattg

SEQ ID NO: 4854108 - DNA, 13 bp, Homo sapiens
ctattctccagac

SEQ ID NO: 4854109 - DNA, 12 bp, Homo sapiens
ctatttatttat

SEQ ID NO: 4854110 - DNA, 22 bp, Homo sapiens
ctcgtcagctgggatgtgaagt

SEQ ID NO: 4854111 - DNA, 21 bp, Homo sapiens
ctctaaccaaggctgtgttta

SEQ ID NO: 4854112 - DNA, 16 bp, Homo sapiens
ctctacccctgctccc

SEQ ID NO: 4854113 - DNA, 17 bp, Homo sapiens
ctctagcctctggactg

SEQ ID NO: 4854114 - DNA, 13 bp, Homo sapiens
ctctataaagtat

SEQ ID NO: 4854115 - DNA, 16 bp, Homo sapiens
ctctataaggcagcct

SEQ ID NO: 4854116 - DNA, 22 bp, Homo sapiens
ctctatactgtggcctgcagga

SEQ ID NO: 4854117 - DNA, 22 bp, Homo sapiens
ctctattgggcacagcctaggg

SEQ ID NO: 4854118 - DNA, 14 bp, Homo sapiens
ctctcacccccatc

SEQ ID NO: 4854119 - DNA, 16 bp, Homo sapiens
ctctcagttctctccc

SEQ ID NO: 4854120 - DNA, 17 bp, Homo sapiens
ctctcagttctctccct

SEQ ID NO: 4854121 - DNA, 15 bp, Homo sapiens
ctctcatacataaaa

SEQ ID NO: 4854122 - DNA, 20 bp, Homo sapiens
ctctccaagcactagccttc

SEQ ID NO: 4854123 - DNA, 15 bp, Homo sapiens
ctctccaggagggct

SEQ ID NO: 4854124 - DNA, 20 bp, Homo sapiens
ctctccaggagggctcgggg

SEQ ID NO: 4854125 - DNA, 11 bp, Homo sapiens
ctctccatatc

SEQ ID NO: 4854126 - DNA, 14 bp, Homo sapiens
ctctcccctcctgc

SEQ ID NO: 4854127 - DNA, 17 bp, Homo sapiens
ctctcccctcctgctgg

SEQ ID NO: 4854128 - DNA, 16 bp, Homo sapiens
ctctcctccagccctg

SEQ ID NO: 4854129 - DNA, 18 bp, Homo sapiens
ctctcctcccgccccgcc

SEQ ID NO: 4854130 - DNA, 14 bp, Homo sapiens
ctctccttgagtgt

SEQ ID NO: 4854131 - DNA, 18 bp, Homo sapiens
ctctcggctgccaggggc

SEQ ID NO: 4854132 - DNA, 19 bp, Homo sapiens
ctctcggctgccaggggct

SEQ ID NO: 4854133 - DNA, 14 bp, Homo sapiens
ctctctccaggagg

SEQ ID NO: 4854134 - DNA, 12 bp, Homo sapiens
ctctctctgggc

SEQ ID NO: 4854135 - DNA, 12 bp, Homo sapiens
ctctctggaaga

SEQ ID NO: 4854136 - DNA, 17 bp, Homo sapiens
ctctctgggacctcctt

SEQ ID NO: 4854137 - DNA, 20 bp, Homo sapiens
ctctctgggcccaggggctg

SEQ ID NO: 4854138 - DNA, 19 bp, Homo sapiens
ctctcttcggtggccttga

SEQ ID NO: 4854139 - DNA, 17 bp, Homo sapiens
ctctctttcctccaccc

SEQ ID NO: 4854140 - DNA, 19 bp, Homo sapiens
ctctctttcctccacccat

SEQ ID NO: 4854141 - DNA, 21 bp, Homo sapiens
ctctgaatttgtcgggttctc

SEQ ID NO: 4854142 - DNA, 20 bp, Homo sapiens
ctctgcaagcttcttgctga

SEQ ID NO: 4854143 - DNA, 17 bp, Homo sapiens
ctctgcacccgcctcga

SEQ ID NO: 4854144 - DNA, 23 bp, Homo sapiens
ctctgcacccgcctcgacctccc

SEQ ID NO: 4854145 - DNA, 12 bp, Homo sapiens
ctctgcaggcca

SEQ ID NO: 4854146 - DNA, 17 bp, Homo sapiens
ctctgcatttaaaaaaa

SEQ ID NO: 4854147 - DNA, 21 bp, Homo sapiens
cctccttctgcagtcagactg

SEQ ID NO: 4854148 - DNA, 22 bp, Homo sapiens
cctccttctgcagtcagactga

SEQ ID NO: 4854149 - DNA, 22 bp, Homo sapiens
cctcgacctccccacccgctcc

SEQ ID NO: 4854150 - DNA, 12 bp, Homo sapiens
cctcgagagcct

SEQ ID NO: 4854151 - DNA, 13 bp, Homo sapiens
cctcgctgctggg

SEQ ID NO: 4854152 - DNA, 21 bp, Homo sapiens
cctcggttgcggacctaggac

SEQ ID NO: 4854153 - DNA, 15 bp, Homo sapiens
cctctcccaggtgtt

SEQ ID NO: 4854154 - DNA, 16 bp, Homo sapiens
cctctccgactctgca

SEQ ID NO: 4854155 - DNA, 23 bp, Homo sapiens
cctctccgactctgcacccgcct

SEQ ID NO: 4854156 - DNA, 17 bp, Homo sapiens
cctctcctgccctctgc

SEQ ID NO: 4854157 - DNA, 18 bp, Homo sapiens
cctctcctgccctctgct

SEQ ID NO: 4854158 - DNA, 17 bp, Homo sapiens
cctctcggctgccaggg

SEQ ID NO: 4854159 - DNA, 13 bp, Homo sapiens
cctctctctgggc

SEQ ID NO: 4854160 - DNA, 23 bp, Homo sapiens
cctctctctgggcccaggggctg

SEQ ID NO: 4854161 - DNA, 20 bp, Homo sapiens
cctctctctttcctccaccc

SEQ ID NO: 4854162 - DNA, 23 bp, Homo sapiens
cctctctctttcctccacccata

SEQ ID NO: 4854163 - DNA, 22 bp, Homo sapiens
cctctctggaagagggaggggc

SEQ ID NO: 4854164 - DNA, 22 bp, Homo sapiens
cctctgaaagatgcatcatctc

SEQ ID NO: 4854165 - DNA, 19 bp, Homo sapiens
cctctgcaagcttcttgct

SEQ ID NO: 4854166 - DNA, 21 bp, Homo sapiens
cctctgcaagcttcttgctga

SEQ ID NO: 4854167 - DNA, 16 bp, Homo sapiens
cctctgctctgcctgg

SEQ ID NO: 4854168 - DNA, 18 bp, Homo sapiens
cctctgtccgtgcccctt

SEQ ID NO: 4854169 - DNA, 19 bp, Homo sapiens
cctctgtccttcccccagc

SEQ ID NO: 4854170 - DNA, 21 bp, Homo sapiens
cctctgtccttcccccagcac

SEQ ID NO: 4854171 - DNA, 20 bp, Homo sapiens
cctctgtgcttcgactactg

SEQ ID NO: 4854172 - DNA, 19 bp, Homo sapiens
cctcttaaagaaaacccac

SEQ ID NO: 4854173 - DNA, 14 bp, Homo sapiens
cctcttgtctgatt

SEQ ID NO: 4854174 - DNA, 17 bp, Homo sapiens
cctctttgcgtttcctt

SEQ ID NO: 4854175 - DNA, 16 bp, Homo sapiens
cctgaaagagaggact

SEQ ID NO: 4854176 - DNA, 19 bp, Homo sapiens
cctgaatccgtacttgggt

SEQ ID NO: 4854177 - DNA, 14 bp, Homo sapiens
cctgaatttgtata

SEQ ID NO: 4854178 - DNA, 17 bp, Homo sapiens
cctgaccccattcctga

SEQ ID NO: 4854179 - DNA, 22 bp, Homo sapiens
cctgagaattgaggggaggtgg

SEQ ID NO: 4854180 - DNA, 19 bp, Homo sapiens
cctgaggactgatttcaga

SEQ ID NO: 4854181 - DNA, 23 bp, Homo sapiens
cctgaggactgatttcagagtga

SEQ ID NO: 4854182 - DNA, 23 bp, Homo sapiens
cctgatggagtgtgcagacagcc

SEQ ID NO: 4854183 - DNA, 17 bp, Homo sapiens
cctgatgtcagctgctg

SEQ ID NO: 4854184 - DNA, 21 bp, Homo sapiens
cctgatgtcagctgctgttga

SEQ ID NO: 4854185 - DNA, 19 bp, Homo sapiens
cctgcaaaactccaggcag

SEQ ID NO: 4854186 - DNA, 22 bp, Homo sapiens
cctgcagcagtcgcccaagcag

SEQ ID NO: 4854187 - DNA, 22 bp, Homo sapiens
cctgcataatgtttctggattt

SEQ ID NO: 4854188 - DNA, 10 bp, Homo sapiens
cctgcatgtt

SEQ ID NO: 4854189 - DNA, 13 bp, Homo sapiens
cctgcatgttctg

SEQ ID NO: 4854190 - DNA, 15 bp, Homo sapiens
cctgccaaggagcat

SEQ ID NO: 4854191 - DNA, 24 bp, Homo sapiens
cctgccaaggagcatccttggcag

SEQ ID NO: 4854192 - DNA, 20 bp, Homo sapiens
cctgccagctgcagcctggt

SEQ ID NO: 4854193 - DNA, 20 bp, Homo sapiens
cctgcccacaactcccttgc

SEQ ID NO: 4854194 - DNA, 22 bp, Homo sapiens
cctgcccagttgcactcaggtg

SEQ ID NO: 4854195 - DNA, 23 bp, Homo sapiens
cctgccccaagtggtgagcaagc

SEQ ID NO: 4854196 - DNA, 16 bp, Homo sapiens
cctgccctctgctctg

SEQ ID NO: 4854197 - DNA, 20 bp, Homo sapiens
cctgccctctgctctgcctg

SEQ ID NO: 4854198 - DNA, 21 bp, Homo sapiens
cctgccctctgctctgcctgg

SEQ ID NO: 4854199 - DNA, 13 bp, Homo sapiens
cctgcctcccaag

SEQ ID NO: 4854200 - DNA, 12 bp, Homo sapiens
cctgcctggagg

SEQ ID NO: 4854201 - DNA, 15 bp, Homo sapiens
cctgcctggaggctc

SEQ ID NO: 4854202 - DNA, 12 bp, Homo sapiens
cctgcgtggggg

SEQ ID NO: 4854203 - DNA, 13 bp, Homo sapiens
cctgcgtgggggc

SEQ ID NO: 4854204 - DNA, 18 bp, Homo sapiens
cctgctaaggctcctcct

SEQ ID NO: 4854205 - DNA, 19 bp, Homo sapiens
cctgctcacgtcaaatgca

SEQ ID NO: 4854206 - DNA, 22 bp, Homo sapiens
cctgctcccattcctccctccg

SEQ ID NO: 4854207 - DNA, 23 bp, Homo sapiens
cctgcttaatcttcaaagccttc

SEQ ID NO: 4854208 - DNA, 12 bp, Homo sapiens
cctgcttcccac

SEQ ID NO: 4854209 - DNA, 21 bp, Homo sapiens
cctgcttgactttccagaatg

SEQ ID NO: 4854210 - DNA, 23 bp, Homo sapiens
cctgcttgactttccagaatgac

SEQ ID NO: 4854211 - DNA, 17 bp, Homo sapiens
cctggagcttcagccag

SEQ ID NO: 4854212 - DNA, 18 bp, Homo sapiens
cctggagcttcagccagg

SEQ ID NO: 4854213 - DNA, 18 bp, Homo sapiens
cctggaggctcctctagg

SEQ ID NO: 4854214 - DNA, 22 bp, Homo sapiens
cctggaggctcctctaggccct

SEQ ID NO: 4854215 - DNA, 22 bp, Homo sapiens
cctggagtgtcggatcctgtga

SEQ ID NO: 4854216 - DNA, 19 bp, Homo sapiens
cctggcaaatgcctgactc

SEQ ID NO: 4854217 - DNA, 22 bp, Homo sapiens
cctggcacaatgttggagcagc

SEQ ID NO: 4854218 - DNA, 18 bp, Homo sapiens
cctggcagatgggggcct

SEQ ID NO: 4854219 - DNA, 16 bp, Homo sapiens
cctggccaggcaggga

SEQ ID NO: 4854220 - DNA, 17 bp, Homo sapiens
cctggccaggcagggag

SEQ ID NO: 4854221 - DNA, 15 bp, Homo sapiens
cctgggaagctgccg

SEQ ID NO: 4854222 - DNA, 12 bp, Homo sapiens
cctgggcacaaa

SEQ ID NO: 4854223 - DNA, 23 bp, Homo sapiens
cctgggcacatagcataggctgg

SEQ ID NO: 4854224 - DNA, 16 bp, Homo sapiens
cctgggcatccttctt

SEQ ID NO: 4854225 - DNA, 18 bp, Homo sapiens
cctgggcatgcccagccc

SEQ ID NO: 4854226 - DNA, 20 bp, Homo sapiens
cctgggcattagcaaggcag

SEQ ID NO: 4854227 - DNA, 21 bp, Homo sapiens
cctgggctcagcctggtttct

SEQ ID NO: 4854228 - DNA, 14 bp, Homo sapiens
cctgggctgtgagg

SEQ ID NO: 4854229 - DNA, 16 bp, Homo sapiens
cctgggctgtgaggac

SEQ ID NO: 4854230 - DNA, 22 bp, Homo sapiens
cctgggctgtgaggacagggcc

SEQ ID NO: 4854231 - DNA, 23 bp, Homo sapiens
cctggggcctccagaagctgctc

SEQ ID NO: 4854232 - DNA, 19 bp, Homo sapiens
cctgggggccttgggtgag

SEQ ID NO: 4854233 - DNA, 22 bp, Homo sapiens
cctgggggccttgggtgagtgg

SEQ ID NO: 4854234 - DNA, 18 bp, Homo sapiens
cctgggtttgggagccag

SEQ ID NO: 4854235 - DNA, 22 bp, Homo sapiens
cctgggtttgggagccaggact

SEQ ID NO: 4854236 - DNA, 23 bp, Homo sapiens
cctgggtttgggagccaggactc

SEQ ID NO: 4854237 - DNA, 14 bp, Homo sapiens
cctggttggcagca

SEQ ID NO: 4854238 - DNA, 19 bp, Homo sapiens
cctgtatgtggtgtggggc

SEQ ID NO: 4854239 - DNA, 13 bp, Homo sapiens
ccctactgtgggc

SEQ ID NO: 4854240 - DNA, 21 bp, Homo sapiens
ccctaggatcccgtcttccag

SEQ ID NO: 4854241 - DNA, 14 bp, Homo sapiens
ccctatcctctgag

SEQ ID NO: 4854242 - DNA, 14 bp, Homo sapiens
ccctatctgtattc

SEQ ID NO: 4854243 - DNA, 15 bp, Homo sapiens
ccctattgctgctaa

SEQ ID NO: 4854244 - DNA, 15 bp, Homo sapiens
ccctcaccacagcct

SEQ ID NO: 4854245 - DNA, 16 bp, Homo sapiens
ccctccaaaggaactc

SEQ ID NO: 4854246 - DNA, 15 bp, Homo sapiens
ccctcccacccaccg

SEQ ID NO: 4854247 - DNA, 23 bp, Homo sapiens
ccctcccaggggagccagctgct

SEQ ID NO: 4854248 - DNA, 11 bp, Homo sapiens
ccctcccatgg

SEQ ID NO: 4854249 - DNA, 13 bp, Homo sapiens
ccctcctgctggg

SEQ ID NO: 4854250 - DNA, 15 bp, Homo sapiens
ccctcctgctgggcg

SEQ ID NO: 4854251 - DNA, 12 bp, Homo sapiens
ccctccttgtct

SEQ ID NO: 4854252 - DNA, 18 bp, Homo sapiens
ccctcgagagccttactt

SEQ ID NO: 4854253 - DNA, 14 bp, Homo sapiens
ccctctgctctgcc

SEQ ID NO: 4854254 - DNA, 16 bp, Homo sapiens
ccctctgctctgcctg

SEQ ID NO: 4854255 - DNA, 21 bp, Homo sapiens
ccctctgctctgcctggagtg

SEQ ID NO: 4854256 - DNA, 22 bp, Homo sapiens
ccctctgtgcttcgactactgc

SEQ ID NO: 4854257 - DNA, 16 bp, Homo sapiens
ccctctttgcacagca

SEQ ID NO: 4854258 - DNA, 19 bp, Homo sapiens
ccctgcaaaactccaggca

SEQ ID NO: 4854259 - DNA, 13 bp, Homo sapiens
ccctgcctggagg

SEQ ID NO: 4854260 - DNA, 20 bp, Homo sapiens
ccctgcctggaggctcctct

SEQ ID NO: 4854261 - DNA, 16 bp, Homo sapiens
gccttgtacagtctgc

SEQ ID NO: 4854262 - DNA, 21 bp, Homo sapiens
gccttgtataatattgaaaat

SEQ ID NO: 4854263 - DNA, 21 bp, Homo sapiens
gcctttgcagttggactctca

SEQ ID NO: 4854264 - DNA, 20 bp, Homo sapiens
gcgaacagccttagagctct

SEQ ID NO: 4854265 - DNA, 16 bp, Homo sapiens
gcgaagactgagccag

SEQ ID NO: 4854266 - DNA, 19 bp, Homo sapiens
gcgaagtctttgccttctc

SEQ ID NO: 4854267 - DNA, 19 bp, Homo sapiens
gcgagagatcaaagatgaa

SEQ ID NO: 4854268 - DNA, 18 bp, Homo sapiens
gcggacccttctgggtcc

SEQ ID NO: 4854269 - DNA, 16 bp, Homo sapiens
gcggattgctctggag

SEQ ID NO: 4854270 - DNA, 13 bp, Homo sapiens
gcgggagggggcg

SEQ ID NO: 4854271 - DNA, 22 bp, Homo sapiens
gcgggtgacagctccgggatca

SEQ ID NO: 4854272 - DNA, 22 bp, Homo sapiens
gcgtggccacgggggcagtgtg

SEQ ID NO: 4854273 - DNA, 23 bp, Homo sapiens
gcgtggctctaaaaggtaatgtg

SEQ ID NO: 4854274 - DNA, 12 bp, Homo sapiens
gcgtgtggagca

SEQ ID NO: 4854275 - DNA, 20 bp, Homo sapiens
gcgttctaaatatgaatgaa

SEQ ID NO: 4854276 - DNA, 19 bp, Homo sapiens
gctaaaaaggcccttagag

SEQ ID NO: 4854277 - DNA, 17 bp, Homo sapiens
gctaaggctcctccttg

SEQ ID NO: 4854278 - DNA, 21 bp, Homo sapiens
gctaaggtttccagtcagatg

SEQ ID NO: 4854279 - DNA, 19 bp, Homo sapiens
gctaagtcattggcaaagt

SEQ ID NO: 4854280 - DNA, 13 bp, Homo sapiens
gctacaattttaa

SEQ ID NO: 4854281 - DNA, 19 bp, Homo sapiens
gctaccctgggaagctgcc

SEQ ID NO: 4854282 - DNA, 21 bp, Homo sapiens
gctactgctgctgctgctgcc

SEQ ID NO: 4854283 - DNA, 21 bp, Homo sapiens
gctactggttacctggagaag

SEQ ID NO: 4854284 - DNA, 18 bp, Homo sapiens
gctactgttgtaagaatt

SEQ ID NO: 4854285 - DNA, 13 bp, Homo sapiens
gctagtgccttta

SEQ ID NO: 4854286 - DNA, 14 bp, Homo sapiens
gctatacacacaca

SEQ ID NO: 4854287 - DNA, 16 bp, Homo sapiens
gctatcaggagaaagc

SEQ ID NO: 4854288 - DNA, 18 bp, Homo sapiens
gctattttctaaagactt

SEQ ID NO: 4854289 - DNA, 20 bp, Homo sapiens
gctcaatccctgaggactga

SEQ ID NO: 4854290 - DNA, 15 bp, Homo sapiens
gctcacccctggagg

SEQ ID NO: 4854291 - DNA, 14 bp, Homo sapiens
gctcactactgaac

SEQ ID NO: 4854292 - DNA, 22 bp, Homo sapiens
gctcactcccaagggacagcaa

SEQ ID NO: 4854293 - DNA, 21 bp, Homo sapiens
gctcagactgggcactggggc

SEQ ID NO: 4854294 - DNA, 22 bp, Homo sapiens
gctcagagaggtagcactctca

SEQ ID NO: 4854295 - DNA, 24 bp, Homo sapiens
gctcagagaggtagcactctcaga

SEQ ID NO: 4854296 - DNA, 21 bp, Homo sapiens
gctcagcctggtttctgggtg

SEQ ID NO: 4854297 - DNA, 22 bp, Homo sapiens
gctcagcctggtttctgggtgc

SEQ ID NO: 4854298 - DNA, 12 bp, Homo sapiens
gctcaggagaag

SEQ ID NO: 4854299 - DNA, 19 bp, Homo sapiens
gctccacactcagaaaatt

SEQ ID NO: 4854300 - DNA, 15 bp, Homo sapiens
gctcccattcctccc

SEQ ID NO: 4854301 - DNA, 18 bp, Homo sapiens
gctcccctcccaggggag

SEQ ID NO: 4854302 - DNA, 15 bp, Homo sapiens
gctccgggcaccagg

SEQ ID NO: 4854303 - DNA, 23 bp, Homo sapiens
gctcctccccttcctcttgtctg

SEQ ID NO: 4854304 - DNA, 20 bp, Homo sapiens
gctcctctaggccctgtgag

SEQ ID NO: 4854305 - DNA, 21 bp, Homo sapiens
gctcctctaggccctgtgagc

SEQ ID NO: 4854306 - DNA, 21 bp, Homo sapiens
gctcctcttgttcctgaaatg

SEQ ID NO: 4854307 - DNA, 22 bp, Homo sapiens
gctcctgttttgcacagccaaa

SEQ ID NO: 4854308 - DNA, 17 bp, Homo sapiens
gctcctttaccctcttg

SEQ ID NO: 4854309 - DNA, 12 bp, Homo sapiens
gctcctttcccc

SEQ ID NO: 4854310 - DNA, 21 bp, Homo sapiens
gctctagcctctggactggaa

SEQ ID NO: 4854311 - DNA, 13 bp, Homo sapiens
gctctatactgtg

SEQ ID NO: 4854312 - DNA, 20 bp, Homo sapiens
gctctcccctcctgctgggc

SEQ ID NO: 4854313 - DNA, 14 bp, Homo sapiens
gctctcctccagcc

SEQ ID NO: 4854314 - DNA, 19 bp, Homo sapiens
gctctcctccagccctggg

SEQ ID NO: 4854315 - DNA, 21 bp, Homo sapiens
gctctcctccagccctgggca

SEQ ID NO: 4854316 - DNA, 11 bp, Homo sapiens
gctctctggga

SEQ ID NO: 4854317 - DNA, 11 bp, Homo sapiens
gctctgcctgg

SEQ ID NO: 4854318 - DNA, 12 bp, Homo sapiens
gctctgcctgga

SEQ ID NO: 4854319 - DNA, 20 bp, Homo sapiens
gctcttcctatccctctcct

SEQ ID NO: 4854320 - DNA, 20 bp, Homo sapiens
gctcttgtgttcagaagaat

SEQ ID NO: 4854321 - DNA, 16 bp, Homo sapiens
gctgaaattttagaaa

SEQ ID NO: 4854322 - DNA, 15 bp, Homo sapiens
gctgaacaggaaaga

SEQ ID NO: 4854323 - DNA, 21 bp, Homo sapiens
gctgaacaggaaagagctagg

SEQ ID NO: 4854324 - DNA, 23 bp, Homo sapiens
gctgaacaggaaagagctaggaa

SEQ ID NO: 4854325 - DNA, 18 bp, Homo sapiens
gctgaacataacttctca

SEQ ID NO: 4854326 - DNA, 16 bp, Homo sapiens
gctgaagaattgaaaa

SEQ ID NO: 4854327 - DNA, 20 bp, Homo sapiens
gctgacaaccattaaagtca

SEQ ID NO: 4854328 - DNA, 14 bp, Homo sapiens
gctgacagccacac

SEQ ID NO: 4854329 - DNA, 21 bp, Homo sapiens
gctgagaaggcaaactgaggc

SEQ ID NO: 4854330 - DNA, 18 bp, Homo sapiens
gctgaggaggcacctaca

SEQ ID NO: 4854331 - DNA, 15 bp, Homo sapiens
gctgaggctgagaaa

SEQ ID NO: 4854332 - DNA, 17 bp, Homo sapiens
gctgaggctgagaaagc

SEQ ID NO: 4854333 - DNA, 19 bp, Homo sapiens
gctgaggctgagaaagcta

SEQ ID NO: 4854334 - DNA, 14 bp, Homo sapiens
gctgagggtttgaa

SEQ ID NO: 4854335 - DNA, 13 bp, Homo sapiens
gctgataccatat

SEQ ID NO: 4854336 - DNA, 17 bp, Homo sapiens
gctgataccatatgaat

SEQ ID NO: 4854337 - DNA, 11 bp, Homo sapiens
gctgatttttt

SEQ ID NO: 4854338 - DNA, 18 bp, Homo sapiens
gctgcaaggtggcctctg

SEQ ID NO: 4854339 - DNA, 19 bp, Homo sapiens
gctgcaaggtggcctctgc

SEQ ID NO: 4854340 - DNA, 21 bp, Homo sapiens
gctgcagccttcatcagaact

SEQ ID NO: 4854341 - DNA, 15 bp, Homo sapiens
gctgccaggggctct

SEQ ID NO: 4854342 - DNA, 17 bp, Homo sapiens
gctgccaggggctctgt

SEQ ID NO: 4854343 - DNA, 14 bp, Homo sapiens
gctgcctcaggacc

SEQ ID NO: 4854344 - DNA, 13 bp, Homo sapiens
gctgctactgctg

SEQ ID NO: 4854345 - DNA, 19 bp, Homo sapiens
gctgctgcacacactcacc

SEQ ID NO: 4854346 - DNA, 15 bp, Homo sapiens
gctgctgctcctctc

SEQ ID NO: 4854347 - DNA, 19 bp, Homo sapiens
gctgctgggccccatctcc

SEQ ID NO: 4854348 - DNA, 15 bp, Homo sapiens
gctgcttgacctagc

SEQ ID NO: 4854349 - DNA, 15 bp, Homo sapiens
gctggaagtacttgg

SEQ ID NO: 4854350 - DNA, 12 bp, Homo sapiens
gctggagcagcg

SEQ ID NO: 4854351 - DNA, 14 bp, Homo sapiens
gctggagcagcgga

SEQ ID NO: 4854352 - DNA, 23 bp, Homo sapiens
gctggagcagcggattgctctgg

SEQ ID NO: 4854353 - DNA, 22 bp, Homo sapiens
gctggccggagcaaactctgct

SEQ ID NO: 4854354 - DNA, 23 bp, Homo sapiens
gctgggattggggggtgggcttt

SEQ ID NO: 4854355 - DNA, 19 bp, Homo sapiens
gctgggccccatctccaca

SEQ ID NO: 4854356 - DNA, 17 bp, Homo sapiens
gctgggcctcccctggg

SEQ ID NO: 4854357 - DNA, 17 bp, Homo sapiens
gctgggcgtgtgtgaca

SEQ ID NO: 4854358 - DNA, 18 bp, Homo sapiens
gctgggcgtgtgtgacac

SEQ ID NO: 4854359 - DNA, 20 bp, Homo sapiens
gctggggagccctattgctg

SEQ ID NO: 4854360 - DNA, 14 bp, Homo sapiens
gctggtggcagagt

SEQ ID NO: 4854361 - DNA, 20 bp, Homo sapiens
gctgtacttcttgaatataa

SEQ ID NO: 4854362 - DNA, 21 bp, Homo sapiens
gctgtcttaaactaaatgtgc

SEQ ID NO: 4854363 - DNA, 12 bp, Homo sapiens
gctgtgaaatcc

SEQ ID NO: 4854364 - DNA, 11 bp, Homo sapiens
gctgtgaggac

SEQ ID NO: 4854365 - DNA, 12 bp, Homo sapiens
gctgtgaggaca

SEQ ID NO: 4854366 - DNA, 14 bp, Homo sapiens
gctgtgccttccct

SEQ ID NO: 4854367 - DNA, 20 bp, Homo sapiens
gctgtgctccacactcagaa

SEQ ID NO: 4854368 - DNA, 13 bp, Homo sapiens
gctgtgctttgga

SEQ ID NO: 4854369 - DNA, 15 bp, Homo sapiens
gctgtggccgtctcc

SEQ ID NO: 4854370 - DNA, 19 bp, Homo sapiens
gctgtggccgtctcctccc

SEQ ID NO: 4854371 - DNA, 22 bp, Homo sapiens
gctgtggccgtctcctccctca

SEQ ID NO: 4854372 - DNA, 18 bp, Homo sapiens
gctgtgtgaatacctgct

SEQ ID NO: 4854373 - DNA, 22 bp, Homo sapiens
gctgttccattacaccacagca

SEQ ID NO: 4854374 - DNA, 16 bp, Homo sapiens
gctgttgaacttttta

SEQ ID NO: 4854375 - DNA, 19 bp, Homo sapiens
gctgttgcttaaaccactt

SEQ ID NO: 4854376 - DNA, 13 bp, Homo sapiens
gctgttgggatat

SEQ ID NO: 4854377 - DNA, 12 bp, Homo sapiens
gctgtttggaaa

SEQ ID NO: 4854378 - DNA, 13 bp, Homo sapiens
gcttaaattttaa

SEQ ID NO: 4854379 - DNA, 22 bp, Homo sapiens
gcttaatcttcaaagccttctc

SEQ ID NO: 4854380 - DNA, 18 bp, Homo sapiens
gcttaatggagttcttgt

SEQ ID NO: 4854381 - DNA, 21 bp, Homo sapiens
ggagggcccctgcgtgggggc

SEQ ID NO: 4854382 - DNA, 22 bp, Homo sapiens
ggagggggtttgctggggaact

SEQ ID NO: 4854383 - DNA, 14 bp, Homo sapiens
ggaggtgctgcagg

SEQ ID NO: 4854384 - DNA, 18 bp, Homo sapiens
ggagtcagtgccaggtcc

SEQ ID NO: 4854385 - DNA, 17 bp, Homo sapiens
ggagtgctcttcccact

SEQ ID NO: 4854386 - DNA, 22 bp, Homo sapiens
ggagtgctcttcccactccagc

SEQ ID NO: 4854387 - DNA, 16 bp, Homo sapiens
ggagtgggaagggagc

SEQ ID NO: 4854388 - DNA, 18 bp, Homo sapiens
ggagtggtgatttgaaaa

SEQ ID NO: 4854389 - DNA, 21 bp, Homo sapiens
ggagtgtcggatcctgtgagt

SEQ ID NO: 4854390 - DNA, 17 bp, Homo sapiens
ggagtgtgcagacagcc

SEQ ID NO: 4854391 - DNA, 17 bp, Homo sapiens
ggataccttcttattta

SEQ ID NO: 4854392 - DNA, 18 bp, Homo sapiens
ggatactggggggcaggc

SEQ ID NO: 4854393 - DNA, 23 bp, Homo sapiens
ggatcagcaacccttcctgctgc

SEQ ID NO: 4854394 - DNA, 12 bp, Homo sapiens
ggatccagggca

SEQ ID NO: 4854395 - DNA, 13 bp, Homo sapiens
ggatccccctctt

SEQ ID NO: 4854396 - DNA, 14 bp, Homo sapiens
ggatcctggcctga

SEQ ID NO: 4854397 - DNA, 19 bp, Homo sapiens
ggatcgagtgtagctgtga

SEQ ID NO: 4854398 - DNA, 20 bp, Homo sapiens
ggatgaattgtcacatctat

SEQ ID NO: 4854399 - DNA, 14 bp, Homo sapiens
ggatgacctccaga

SEQ ID NO: 4854400 - DNA, 17 bp, Homo sapiens
ggatgacctccagaagt

SEQ ID NO: 4854401 - DNA, 19 bp, Homo sapiens
ggatgatgagggaagcaat

SEQ ID NO: 4854402 - DNA, 23 bp, Homo sapiens
ggatgatgtctttttattaaaat

SEQ ID NO: 4854403 - DNA, 16 bp, Homo sapiens
ggatgctaacatctaa

SEQ ID NO: 4854404 - DNA, 18 bp, Homo sapiens
ggatggggacatttgaac

SEQ ID NO: 4854405 - DNA, 14 bp, Homo sapiens
ggattctaaataca

SEQ ID NO: 4854406 - DNA, 12 bp, Homo sapiens
ggattctttaaa

SEQ ID NO: 4854407 - DNA, 20 bp, Homo sapiens
ggattggggggtgggctttg

SEQ ID NO: 4854408 - DNA, 17 bp, Homo sapiens
ggcaaactgaggcagca

SEQ ID NO: 4854409 - DNA, 23 bp, Homo sapiens
ggcaaggggtgaggataggacag

SEQ ID NO: 4854410 - DNA, 20 bp, Homo sapiens
ggcacatagcataggctggg

SEQ ID NO: 4854411 - DNA, 21 bp, Homo sapiens
ggcacatagcataggctgggg

SEQ ID NO: 4854412 - DNA, 22 bp, Homo sapiens
ggcaccgtattcctctcccagg

SEQ ID NO: 4854413 - DNA, 21 bp, Homo sapiens
ggcacctacactcacctgcac

SEQ ID NO: 4854414 - DNA, 20 bp, Homo sapiens
ggcagagaccataagagaaa

SEQ ID NO: 4854415 - DNA, 14 bp, Homo sapiens
ggcagaggtgacag

SEQ ID NO: 4854416 - DNA, 15 bp, Homo sapiens
ggcagagtcctggag

SEQ ID NO: 4854417 - DNA, 16 bp, Homo sapiens
ggcagatgagggctgg

SEQ ID NO: 4854418 - DNA, 13 bp, Homo sapiens
ggcagatggagcc

SEQ ID NO: 4854419 - DNA, 14 bp, Homo sapiens
ggcagatgggggcc

SEQ ID NO: 4854420 - DNA, 15 bp, Homo sapiens
ggcagcaggccagag

SEQ ID NO: 4854421 - DNA, 16 bp, Homo sapiens
ggcagcaggccagaga

SEQ ID NO: 4854422 - DNA, 16 bp, Homo sapiens
ggcagcatctgctcca

SEQ ID NO: 4854423 - DNA, 22 bp, Homo sapiens
ggcaggaacggtggaggcagag

SEQ ID NO: 4854424 - DNA, 21 bp, Homo sapiens
ggcaggaggctttgggtggct

SEQ ID NO: 4854425 - DNA, 14 bp, Homo sapiens
ggcaggagtctctg

SEQ ID NO: 4854426 - DNA, 19 bp, Homo sapiens
ggcaggcctcccaagctga

SEQ ID NO: 4854427 - DNA, 13 bp, Homo sapiens
ggcagggccctga

SEQ ID NO: 4854428 - DNA, 15 bp, Homo sapiens
ggcagggccctgaaa

SEQ ID NO: 4854429 - DNA, 22 bp, Homo sapiens
ggcagggccctgaaatggcctg

SEQ ID NO: 4854430 - DNA, 13 bp, Homo sapiens
ggcagggtggggg

SEQ ID NO: 4854431 - DNA, 10 bp, Homo sapiens
ggcaggtgct

SEQ ID NO: 4854432 - DNA, 22 bp, Homo sapiens
ggcatctgttagcagagtctgt

SEQ ID NO: 4854433 - DNA, 15 bp, Homo sapiens
ggcatggcaggagtc

SEQ ID NO: 4854434 - DNA, 21 bp, Homo sapiens
ggcatggtggctcatgcctgt

SEQ ID NO: 4854435 - DNA, 18 bp, Homo sapiens
ggcattagcaaggcagag

SEQ ID NO: 4854436 - DNA, 21 bp, Homo sapiens
ggcattagcaaggcagagcct

SEQ ID NO: 4854437 - DNA, 22 bp, Homo sapiens
ggcattcaaccacgcaggaagc

SEQ ID NO: 4854438 - DNA, 13 bp, Homo sapiens
ggcattctcccag

SEQ ID NO: 4854439 - DNA, 19 bp, Homo sapiens
ggcattgagtattgtttaa

SEQ ID NO: 4854440 - DNA, 17 bp, Homo sapiens
ggccaacctcaggctcc

SEQ ID NO: 4854441 - DNA, 18 bp, Homo sapiens
ggccaacctcaggctcct

SEQ ID NO: 4854442 - DNA, 22 bp, Homo sapiens
ggccaagctgaggaggtgctgc

SEQ ID NO: 4854443 - DNA, 22 bp, Homo sapiens
ggccacagaggactcacttgcc

SEQ ID NO: 4854444 - DNA, 23 bp, Homo sapiens
ggccagagaaagcaaaggtgcac

SEQ ID NO: 4854445 - DNA, 14 bp, Homo sapiens
ggccagagagggaa

SEQ ID NO: 4854446 - DNA, 14 bp, Homo sapiens
ggccagcagctgat

SEQ ID NO: 4854447 - DNA, 12 bp, Homo sapiens
ggccagcccgca

SEQ ID NO: 4854448 - DNA, 14 bp, Homo sapiens
ggccagcccgcaga

SEQ ID NO: 4854449 - DNA, 16 bp, Homo sapiens
ggccagcccgcagagg

SEQ ID NO: 4854450 - DNA, 17 bp, Homo sapiens
ggccagcccgcagaggt

SEQ ID NO: 4854451 - DNA, 21 bp, Homo sapiens
ggccagcccgcagaggtgggg

SEQ ID NO: 4854452 - DNA, 13 bp, Homo sapiens
ggccagcgtggct

SEQ ID NO: 4854453 - DNA, 18 bp, Homo sapiens
ggccaggccttatctgaa

SEQ ID NO: 4854454 - DNA, 13 bp, Homo sapiens
ggccatactgcct

SEQ ID NO: 4854455 - DNA, 15 bp, Homo sapiens
ggccatcttctttct

SEQ ID NO: 4854456 - DNA, 16 bp, Homo sapiens
ggccatcttctttctt

SEQ ID NO: 4854457 - DNA, 15 bp, Homo sapiens
ggccatgttcccaga

SEQ ID NO: 4854458 - DNA, 23 bp, Homo sapiens
ggccattttggggggttatttat

SEQ ID NO: 4854459 - DNA, 15 bp, Homo sapiens
ggcccagagagggaa

SEQ ID NO: 4854460 - DNA, 21 bp, Homo sapiens
ggcccccttcaggagcctggc

SEQ ID NO: 4854461 - DNA, 19 bp, Homo sapiens
ggccctgaaatggcctgtc

SEQ ID NO: 4854462 - DNA, 20 bp, Homo sapiens
ggccctgaaatggcctgtcc

SEQ ID NO: 4854463 - DNA, 16 bp, Homo sapiens
ggccctgacaggcctt

SEQ ID NO: 4854464 - DNA, 16 bp, Homo sapiens
ggccctgtcactgtcc

SEQ ID NO: 4854465 - DNA, 19 bp, Homo sapiens
ggccctgtcactgtccaga

SEQ ID NO: 4854466 - DNA, 13 bp, Homo sapiens
ggccgccagcgtg

SEQ ID NO: 4854467 - DNA, 16 bp, Homo sapiens
ggccgccagcgtgtgg

SEQ ID NO: 4854468 - DNA, 17 bp, Homo sapiens
ggccgccagcgtgtgga

SEQ ID NO: 4854469 - DNA, 17 bp, Homo sapiens
ggccgggggaggggcgc

SEQ ID NO: 4854470 - DNA, 13 bp, Homo sapiens
ggccgtctcctcc

SEQ ID NO: 4854471 - DNA, 18 bp, Homo sapiens
ggccgtctcctccctcag

SEQ ID NO: 4854472 - DNA, 13 bp, Homo sapiens
ggcctcagcctgc

SEQ ID NO: 4854473 - DNA, 23 bp, Homo sapiens
ggcctcagcctgctttcctgcag

SEQ ID NO: 4854474 - DNA, 19 bp, Homo sapiens
ggcctcagctcaatgcagt

SEQ ID NO: 4854475 - DNA, 18 bp, Homo sapiens
ggcctccagaagctgctc

SEQ ID NO: 4854476 - DNA, 17 bp, Homo sapiens
ggcctctcctgccctct

SEQ ID NO: 4854477 - DNA, 14 bp, Homo sapiens
ggcctctgcctggg

SEQ ID NO: 4854478 - DNA, 20 bp, Homo sapiens
ggcctctgggacccacagaa

SEQ ID NO: 4854479 - DNA, 23 bp, Homo sapiens
ggcctgagaattgaggggaggtg

SEQ ID NO: 4854480 - DNA, 12 bp, Homo sapiens
ggcctgcaggag

SEQ ID NO: 4854481 - DNA, 21 bp, Homo sapiens
ggcctgctaaggctcctcctt

SEQ ID NO: 4854482 - DNA, 15 bp, Homo sapiens
ggcctggagcaggcc

SEQ ID NO: 4854483 - DNA, 17 bp, Homo sapiens
ggcctggagcaggccca

SEQ ID NO: 4854484 - DNA, 15 bp, Homo sapiens
ggcctgggctgtgag

SEQ ID NO: 4854485 - DNA, 16 bp, Homo sapiens
ggcctgggctgtgagg

SEQ ID NO: 4854486 - DNA, 15 bp, Homo sapiens
ggccttatctgaaag

SEQ ID NO: 4854487 - DNA, 12 bp, Homo sapiens
ggccttggaaat

SEQ ID NO: 4854488 - DNA, 18 bp, Homo sapiens
ggcctttatgttctttca

SEQ ID NO: 4854489 - DNA, 22 bp, Homo sapiens
ggcctttatgttctttcaccca

SEQ ID NO: 4854490 - DNA, 22 bp, Homo sapiens
ggcgagggatgatgagggaagc

SEQ ID NO: 4854491 - DNA, 15 bp, Homo sapiens
ggcgcgggagggggc

SEQ ID NO: 4854492 - DNA, 14 bp, Homo sapiens
ggcggcacagcctt

SEQ ID NO: 4854493 - DNA, 22 bp, Homo sapiens
ggctactgtaatgctgcctcag

SEQ ID NO: 4854494 - DNA, 12 bp, Homo sapiens
ggctcatgcctg

SEQ ID NO: 4854495 - DNA, 20 bp, Homo sapiens
ggctcccctcccaggggagc

SEQ ID NO: 4854496 - DNA, 23 bp, Homo sapiens
ggctcccctcccaggggagccag

SEQ ID NO: 4854497 - DNA, 19 bp, Homo sapiens
ggctccgggcaccaggggc

SEQ ID NO: 4854498 - DNA, 23 bp, Homo sapiens
ggctccgggcaccaggggccaac

SEQ ID NO: 4854499 - DNA, 18 bp, Homo sapiens
ggctcgggagccatgtca

SEQ ID NO: 4854500 - DNA, 22 bp, Homo sapiens
ggctcgggagccatgtcatgtg

SEQ ID NO: 4854501 - DNA, 21 bp, Homo sapiens
ggtctaccaatacaaaatgta

SEQ ID NO: 4854502 - DNA, 13 bp, Homo sapiens
ggtctagagagaa

SEQ ID NO: 4854503 - DNA, 15 bp, Homo sapiens
ggtctatgttcccca

SEQ ID NO: 4854504 - DNA, 14 bp, Homo sapiens
ggtctcctcagggt

SEQ ID NO: 4854505 - DNA, 13 bp, Homo sapiens
ggtctgactccaa

SEQ ID NO: 4854506 - DNA, 16 bp, Homo sapiens
ggtctggttcctgtgt

SEQ ID NO: 4854507 - DNA, 21 bp, Homo sapiens
ggtcttgggggtcagggggga

SEQ ID NO: 4854508 - DNA, 15 bp, Homo sapiens
ggtgaacactgtgac

SEQ ID NO: 4854509 - DNA, 13 bp, Homo sapiens
ggtgaactccagg

SEQ ID NO: 4854510 - DNA, 12 bp, Homo sapiens
ggtgaactttgt

SEQ ID NO: 4854511 - DNA, 17 bp, Homo sapiens
ggtgaaggggctggtgg

SEQ ID NO: 4854512 - DNA, 20 bp, Homo sapiens
ggtgacagctccgggatcag

SEQ ID NO: 4854513 - DNA, 18 bp, Homo sapiens
ggtgacagtgccttctct

SEQ ID NO: 4854514 - DNA, 12 bp, Homo sapiens
ggtgagaagtac

SEQ ID NO: 4854515 - DNA, 17 bp, Homo sapiens
ggtgagaagtacagggc

SEQ ID NO: 4854516 - DNA, 14 bp, Homo sapiens
ggtgataagggaaa

SEQ ID NO: 4854517 - DNA, 22 bp, Homo sapiens
ggtgcctgccaccttcaagttc

SEQ ID NO: 4854518 - DNA, 13 bp, Homo sapiens
ggtgctcactccc

SEQ ID NO: 4854519 - DNA, 13 bp, Homo sapiens
ggtgctcatgctg

SEQ ID NO: 4854520 - DNA, 13 bp, Homo sapiens
ggtgctggggctg

SEQ ID NO: 4854521 - DNA, 21 bp, Homo sapiens
ggtgcttctcacactggagga

SEQ ID NO: 4854522 - DNA, 22 bp, Homo sapiens
ggtgcttctcacactggaggag

SEQ ID NO: 4854523 - DNA, 22 bp, Homo sapiens
ggtggccagcccgcagaggtgg

SEQ ID NO: 4854524 - DNA, 19 bp, Homo sapiens
ggtggcctctgcctggggc

SEQ ID NO: 4854525 - DNA, 20 bp, Homo sapiens
ggtggccttgagtctctgaa

SEQ ID NO: 4854526 - DNA, 15 bp, Homo sapiens
ggtggctcactactg

SEQ ID NO: 4854527 - DNA, 20 bp, Homo sapiens
ggtgggcggcacagccttct

SEQ ID NO: 4854528 - DNA, 14 bp, Homo sapiens
ggtggggtgctggg

SEQ ID NO: 4854529 - DNA, 15 bp, Homo sapiens
ggtggggtgctgggg

SEQ ID NO: 4854530 - DNA, 16 bp, Homo sapiens
ggtggtgaaggggctg

SEQ ID NO: 4854531 - DNA, 18 bp, Homo sapiens
ggtggtgaaggggctggt

SEQ ID NO: 4854532 - DNA, 17 bp, Homo sapiens
ggtgtgaatttgccaga

SEQ ID NO: 4854533 - DNA, 21 bp, Homo sapiens
ggtgtgaatttgccagaggac

SEQ ID NO: 4854534 - DNA, 13 bp, Homo sapiens
ggtgtgaggagag

SEQ ID NO: 4854535 - DNA, 14 bp, Homo sapiens
ggtgtgtcatttct

SEQ ID NO: 4854536 - DNA, 14 bp, Homo sapiens
ggtgtgtgaagttt

SEQ ID NO: 4854537 - DNA, 16 bp, Homo sapiens
ggttaaaaaaaaaagt

SEQ ID NO: 4854538 - DNA, 19 bp, Homo sapiens
ggttaatttttcctgcatg

SEQ ID NO: 4854539 - DNA, 20 bp, Homo sapiens
ggttaatttttcctgcatgt

SEQ ID NO: 4854540 - DNA, 17 bp, Homo sapiens
ggttcactccccgcctc

SEQ ID NO: 4854541 - DNA, 20 bp, Homo sapiens
ggttcactccccgcctcccc

SEQ ID NO: 4854542 - DNA, 21 bp, Homo sapiens
ggttcggctctagggcctcag

SEQ ID NO: 4854543 - DNA, 13 bp, Homo sapiens
ggttctaaggctc

SEQ ID NO: 4854544 - DNA, 22 bp, Homo sapiens
ggttctcccatgatttggggtg

SEQ ID NO: 4854545 - DNA, 23 bp, Homo sapiens
ggttctcccatgatttggggtga

SEQ ID NO: 4854546 - DNA, 15 bp, Homo sapiens
ggttctgaggccaga

SEQ ID NO: 4854547 - DNA, 14 bp, Homo sapiens
ggttgtcttattgc

SEQ ID NO: 4854548 - DNA, 22 bp, Homo sapiens
ggtttacatgaagcagaacctt

SEQ ID NO: 4854549 - DNA, 14 bp, Homo sapiens
ggtttatgactctt

SEQ ID NO: 4854550 - DNA, 10 bp, Homo sapiens
ggtttattct

SEQ ID NO: 4854551 - DNA, 15 bp, Homo sapiens
ggtttgaaggagaat

SEQ ID NO: 4854552 - DNA, 15 bp, Homo sapiens
gtaaacaaagacttt

SEQ ID NO: 4854553 - DNA, 16 bp, Homo sapiens
gtaaatacatgcatat

SEQ ID NO: 4854554 - DNA, 17 bp, Homo sapiens
gtaaatacatgcatata

SEQ ID NO: 4854555 - DNA, 20 bp, Homo sapiens
gtaaatgaagatctttatat

SEQ ID NO: 4854556 - DNA, 17 bp, Homo sapiens
gtaaccagctcagtgtt

SEQ ID NO: 4854557 - DNA, 18 bp, Homo sapiens
gtaacttccaaataaata

SEQ ID NO: 4854558 - DNA, 16 bp, Homo sapiens
gtaacttcctgtggat

SEQ ID NO: 4854559 - DNA, 17 bp, Homo sapiens
gtaacttcctgtggatg

SEQ ID NO: 4854560 - DNA, 16 bp, Homo sapiens
gtaagaagacaaactg

SEQ ID NO: 4854561 - DNA, 13 bp, Homo sapiens
gtaataatagact

SEQ ID NO: 4854562 - DNA, 17 bp, Homo sapiens
gtaataatgtaacatga

SEQ ID NO: 4854563 - DNA, 20 bp, Homo sapiens
gtaatattgacttgtatatt

SEQ ID NO: 4854564 - DNA, 14 bp, Homo sapiens
gtaatctatgttta

SEQ ID NO: 4854565 - DNA, 15 bp, Homo sapiens
gtaatctatgtttat

SEQ ID NO: 4854566 - DNA, 15 bp, Homo sapiens
gtaattgtgtggatt

SEQ ID NO: 4854567 - DNA, 21 bp, Homo sapiens
gtaattgtgtggattctttaa

SEQ ID NO: 4854568 - DNA, 10 bp, Homo sapiens
gtaatttaaa

SEQ ID NO: 4854569 - DNA, 12 bp, Homo sapiens
gtaatttaactt

SEQ ID NO: 4854570 - DNA, 16 bp, Homo sapiens
gtaattttattttaaa

SEQ ID NO: 4854571 - DNA, 14 bp, Homo sapiens
gtacaaaattaagc

SEQ ID NO: 4854572 - DNA, 17 bp, Homo sapiens
gtacaaatgtttttcat

SEQ ID NO: 4854573 - DNA, 18 bp, Homo sapiens
gtacagaatttgaattat

SEQ ID NO: 4854574 - DNA, 20 bp, Homo sapiens
gtacaggtcatctgctggga

SEQ ID NO: 4854575 - DNA, 14 bp, Homo sapiens
gtacatatgtgctg

SEQ ID NO: 4854576 - DNA, 14 bp, Homo sapiens
gtacatttaaattt

SEQ ID NO: 4854577 - DNA, 20 bp, Homo sapiens
gtaccaaaattttaaaaaag

SEQ ID NO: 4854578 - DNA, 14 bp, Homo sapiens
gtacctgtgactct

SEQ ID NO: 4854579 - DNA, 20 bp, Homo sapiens
gtactgtactttcccaggtt

SEQ ID NO: 4854580 - DNA, 19 bp, Homo sapiens
gtacttcttgaatataaaa

SEQ ID NO: 4854581 - DNA, 20 bp, Homo sapiens
gtacttggcccccttcagga

SEQ ID NO: 4854582 - DNA, 22 bp, Homo sapiens
gtacttggcccccttcaggagc

SEQ ID NO: 4854583 - DNA, 14 bp, Homo sapiens
gtactttcccaggt

SEQ ID NO: 4854584 - DNA, 14 bp, Homo sapiens
gtagaatgttttca

SEQ ID NO: 4854585 - DNA, 15 bp, Homo sapiens
gtagacatttataac

SEQ ID NO: 4854586 - DNA, 13 bp, Homo sapiens
gtagagccaatta

SEQ ID NO: 4854587 - DNA, 16 bp, Homo sapiens
tcaccacagccttcta

SEQ ID NO: 4854588 - DNA, 15 bp, Homo sapiens
tcaccctctgtcctt

SEQ ID NO: 4854589 - DNA, 22 bp, Homo sapiens
tcacccttatagtctaagacta

SEQ ID NO: 4854590 - DNA, 14 bp, Homo sapiens
tcacctccttctgc

SEQ ID NO: 4854591 - DNA, 17 bp, Homo sapiens
tcacctccttctgcagt

SEQ ID NO: 4854592 - DNA, 15 bp, Homo sapiens
tcaccttttcaggaa

SEQ ID NO: 4854593 - DNA, 14 bp, Homo sapiens
tcactctggcttca

SEQ ID NO: 4854594 - DNA, 18 bp, Homo sapiens
tcactctgtgcctttcta

SEQ ID NO: 4854595 - DNA, 21 bp, Homo sapiens
tcactgccccctccgtcccac

SEQ ID NO: 4854596 - DNA, 20 bp, Homo sapiens
tcactgcctctttgcagtag

SEQ ID NO: 4854597 - DNA, 19 bp, Homo sapiens
tcactgccttcgtttatat

SEQ ID NO: 4854598 - DNA, 14 bp, Homo sapiens
tcactgctgcaagg

SEQ ID NO: 4854599 - DNA, 16 bp, Homo sapiens
tcactggactgcatgg

SEQ ID NO: 4854600 - DNA, 18 bp, Homo sapiens
tccatccttccaacatat

SEQ ID NO: 4854601 - DNA, 22 bp, Homo sapiens
tccatgagttatcatgaatttt

SEQ ID NO: 4854602 - DNA, 22 bp, Homo sapiens
tccatggagcctacctctgtct

SEQ ID NO: 4854603 - DNA, 22 bp, Homo sapiens
tccatgtacttccctcttgaaa

SEQ ID NO: 4854604 - DNA, 16 bp, Homo sapiens
tccatgttgactgact

SEQ ID NO: 4854605 - DNA, 18 bp, Homo sapiens
tccattacctccatccat

SEQ ID NO: 4854606 - DNA, 16 bp, Homo sapiens
tccattcatccttcca

SEQ ID NO: 4854607 - DNA, 23 bp, Homo sapiens
tccatttcaggactctctccagg

SEQ ID NO: 4854608 - DNA, 15 bp, Homo sapiens
tccatttccattgct

SEQ ID NO: 4854609 - DNA, 19 bp, Homo sapiens
tccatttccattgcttatt

SEQ ID NO: 4854610 - DNA, 14 bp, Homo sapiens
tccattttcaagct

SEQ ID NO: 4854611 - DNA, 12 bp, Homo sapiens
tcccaaaacaat

SEQ ID NO: 4854612 - DNA, 15 bp, Homo sapiens
tcccaaatcctagac

SEQ ID NO: 4854613 - DNA, 23 bp, Homo sapiens
tcccaaatcctagactgctcctg

SEQ ID NO: 4854614 - DNA, 20 bp, Homo sapiens
tcccaagggacagcaagtga

SEQ ID NO: 4854615 - DNA, 18 bp, Homo sapiens
tcccaaggtcctctcagt

SEQ ID NO: 4854616 - DNA, 23 bp, Homo sapiens
tcccacatggccatcttctttct

SEQ ID NO: 4854617 - DNA, 15 bp, Homo sapiens
tcccactccagctga

SEQ ID NO: 4854618 - DNA, 16 bp, Homo sapiens
tcccagaacctctaag

SEQ ID NO: 4854619 - DNA, 19 bp, Homo sapiens
tcccagaaccttgatgggg

SEQ ID NO: 4854620 - DNA, 23 bp, Homo sapiens
tcccagaggtgggatcctccctc

SEQ ID NO: 4854621 - DNA, 15 bp, Homo sapiens
tcccagcctgactag

SEQ ID NO: 4854622 - DNA, 15 bp, Homo sapiens
tcccagctctagcct

SEQ ID NO: 4854623 - DNA, 20 bp, Homo sapiens
tcccagctctagcctctgga

SEQ ID NO: 4854624 - DNA, 15 bp, Homo sapiens
tcccaggggagccag

SEQ ID NO: 4854625 - DNA, 20 bp, Homo sapiens
tcccaggggagccagctgct

SEQ ID NO: 4854626 - DNA, 18 bp, Homo sapiens
tcccatcccactgctccc

SEQ ID NO: 4854627 - DNA, 14 bp, Homo sapiens
tcccatctgaagag

SEQ ID NO: 4854628 - DNA, 14 bp, Homo sapiens
tcccatggctgaag

SEQ ID NO: 4854629 - DNA, 15 bp, Homo sapiens
tcccatggctgaagc

SEQ ID NO: 4854630 - DNA, 17 bp, Homo sapiens
tcccatggctgaagctg

SEQ ID NO: 4854631 - DNA, 19 bp, Homo sapiens
tcccatggctgaagctgga

SEQ ID NO: 4854632 - DNA, 14 bp, Homo sapiens
tcccattcctccct

SEQ ID NO: 4854633 - DNA, 22 bp, Homo sapiens
tccccagctcacccctggagga

SEQ ID NO: 4854634 - DNA, 17 bp, Homo sapiens
tccccagtgactccagg

SEQ ID NO: 4854635 - DNA, 21 bp, Homo sapiens
tccccagtgactccagggtga

SEQ ID NO: 4854636 - DNA, 16 bp, Homo sapiens
tcccccagcacaaagc

SEQ ID NO: 4854637 - DNA, 19 bp, Homo sapiens
tccccccgagtctccggga

SEQ ID NO: 4854638 - DNA, 23 bp, Homo sapiens
tcccctaaagccaggctcaggag

SEQ ID NO: 4854639 - DNA, 22 bp, Homo sapiens
tcccctcccaggggagccagct

SEQ ID NO: 4854640 - DNA, 11 bp, Homo sapiens
tcccctctcat

SEQ ID NO: 4854641 - DNA, 13 bp, Homo sapiens
tcccctgcccttc

SEQ ID NO: 4854642 - DNA, 13 bp, Homo sapiens
tcccctgggcagg

SEQ ID NO: 4854643 - DNA, 17 bp, Homo sapiens
tcccgccccgcccctcc

SEQ ID NO: 4854644 - DNA, 15 bp, Homo sapiens
tccctcatggctctg

SEQ ID NO: 4854645 - DNA, 16 bp, Homo sapiens
tccctccattcatcct

SEQ ID NO: 4854646 - DNA, 19 bp, Homo sapiens
tccctgcaaaactccaggc

SEQ ID NO: 4854647 - DNA, 21 bp, Homo sapiens
tccctgcaaaactccaggcag

SEQ ID NO: 4854648 - DNA, 16 bp, Homo sapiens
tccctgcctcaggcca

SEQ ID NO: 4854649 - DNA, 14 bp, Homo sapiens
tccctgcctggagg

SEQ ID NO: 4854650 - DNA, 15 bp, Homo sapiens
tccctgcctggaggc

SEQ ID NO: 4854651 - DNA, 22 bp, Homo sapiens
tccctgggggccttgggtgagt

SEQ ID NO: 4854652 - DNA, 21 bp, Homo sapiens
tccctgggtttgggagccagg

SEQ ID NO: 4854653 - DNA, 21 bp, Homo sapiens
tccctgtggcactcagggagc

SEQ ID NO: 4854654 - DNA, 15 bp, Homo sapiens
tcccttactttgctg

SEQ ID NO: 4854655 - DNA, 16 bp, Homo sapiens
tcccttcctctctcct

SEQ ID NO: 4854656 - DNA, 21 bp, Homo sapiens
tcccttctctttggggctcct

SEQ ID NO: 4854657 - DNA, 20 bp, Homo sapiens
tcccttgaaactttgggaaa

SEQ ID NO: 4854658 - DNA, 18 bp, Homo sapiens
tcccttggacattttatg

SEQ ID NO: 4854659 - DNA, 15 bp, Homo sapiens
tccggggagaaaccc

SEQ ID NO: 4854660 - DNA, 17 bp, Homo sapiens
tccgtgccccttccctg

SEQ ID NO: 4854661 - DNA, 19 bp, Homo sapiens
tccgtgccccttccctggg

SEQ ID NO: 4854662 - DNA, 20 bp, Homo sapiens
tcctaattgtgcccctaaag

SEQ ID NO: 4854663 - DNA, 12 bp, Homo sapiens
tcctacttacaa

SEQ ID NO: 4854664 - DNA, 22 bp, Homo sapiens
tcctactttctatttttatgat

SEQ ID NO: 4854665 - DNA, 16 bp, Homo sapiens
tcctagactgctcctg

SEQ ID NO: 4854666 - DNA, 13 bp, Homo sapiens
tcctaggaaccag

SEQ ID NO: 4854667 - DNA, 14 bp, Homo sapiens
tcctagtaagaaga

SEQ ID NO: 4854668 - DNA, 14 bp, Homo sapiens
tcctataaagtgcc

SEQ ID NO: 4854669 - DNA, 17 bp, Homo sapiens
tcctataaagtgcctcg

SEQ ID NO: 4854670 - DNA, 18 bp, Homo sapiens
tcctattctataaaactc

SEQ ID NO: 4854671 - DNA, 16 bp, Homo sapiens
tcctatttttgtgaag

SEQ ID NO: 4854672 - DNA, 22 bp, Homo sapiens
tcctcagcttcttcacaggcac

SEQ ID NO: 4854673 - DNA, 16 bp, Homo sapiens
tcctcagggtgggggg

SEQ ID NO: 4854674 - DNA, 17 bp, Homo sapiens
tcctcagggtggggggt

SEQ ID NO: 4854675 - DNA, 19 bp, Homo sapiens
tcctcatggcagcctactc

SEQ ID NO: 4854676 - DNA, 14 bp, Homo sapiens
tcctccagccctgg

SEQ ID NO: 4854677 - DNA, 18 bp, Homo sapiens
tcctccagccctgggcac

SEQ ID NO: 4854678 - DNA, 21 bp, Homo sapiens
tcctcccaaggcattctccca

SEQ ID NO: 4854679 - DNA, 22 bp, Homo sapiens
tcctcccaaggcattctcccag

SEQ ID NO: 4854680 - DNA, 16 bp, Homo sapiens
tcctccccttcctctt

SEQ ID NO: 4854681 - DNA, 14 bp, Homo sapiens
tcctcccgccccgc

SEQ ID NO: 4854682 - DNA, 19 bp, Homo sapiens
tcctccctcatggctctgg

SEQ ID NO: 4854683 - DNA, 24 bp, Homo sapiens
tcctccttgcccagactacagggc

SEQ ID NO: 4854684 - DNA, 18 bp, Homo sapiens
tcctctaggccctgtgag

SEQ ID NO: 4854685 - DNA, 17 bp, Homo sapiens
tcctctcaaacctggca

SEQ ID NO: 4854686 - DNA, 22 bp, Homo sapiens
tcctctcaaacctggcagatgg

SEQ ID NO: 4854687 - DNA, 18 bp, Homo sapiens
tcctctcaccttgtccct

SEQ ID NO: 4854688 - DNA, 21 bp, Homo sapiens
tcctcttttgtgctgcttctc

SEQ ID NO: 4854689 - DNA, 18 bp, Homo sapiens
tcctgcaaagtctccaga

SEQ ID NO: 4854690 - DNA, 14 bp, Homo sapiens
tcctgcatgttctg

SEQ ID NO: 4854691 - DNA, 13 bp, Homo sapiens
tcctgccctctgc

SEQ ID NO: 4854692 - DNA, 21 bp, Homo sapiens
tcctgccctctgctctgcctg

SEQ ID NO: 4854693 - DNA, 22 bp, Homo sapiens
tcctgccctctgctctgcctgg

SEQ ID NO: 4854694 - DNA, 18 bp, Homo sapiens
tcctgcctgtctgaagcc

SEQ ID NO: 4854695 - DNA, 23 bp, Homo sapiens
tcctgctcaactctacccctgct

SEQ ID NO: 4854696 - DNA, 12 bp, Homo sapiens
tcctgctgctgc

SEQ ID NO: 4854697 - DNA, 19 bp, Homo sapiens
tcctgctgggcgtgtgtga

SEQ ID NO: 4854698 - DNA, 20 bp, Homo sapiens
tcctggaatttggacaagtg

SEQ ID NO: 4854699 - DNA, 19 bp, Homo sapiens
tcctggcagtctcagtcca

SEQ ID NO: 4854700 - DNA, 14 bp, Homo sapiens
tcctgtcttctttc

SEQ ID NO: 4854701 - DNA, 11 bp, Homo sapiens
tcctgtgagga

SEQ ID NO: 4854702 - DNA, 22 bp, Homo sapiens
tcctgtgaggatagagacttgc

SEQ ID NO: 4854703 - DNA, 23 bp, Homo sapiens
tcctgtggaaggcagagaaatct

SEQ ID NO: 4854704 - DNA, 20 bp, Homo sapiens
tcctgtggcataaattgcat

SEQ ID NO: 4854705 - DNA, 19 bp, Homo sapiens
tcctgtgtgaccctgggca

SEQ ID NO: 4854706 - DNA, 14 bp, Homo sapiens
tccttaggctactg

SEQ ID NO: 4854707 - DNA, 22 bp, Homo sapiens
tccttcaacctgcatagccggt

SEQ ID NO: 4854708 - DNA, 12 bp, Homo sapiens
tccttcaggcag

SEQ ID NO: 4854709 - DNA, 20 bp, Homo sapiens
tccttcaggcagctgaaatt

SEQ ID NO: 4854710 - DNA, 22 bp, Homo sapiens
tccttgatttcaaagttttgtt

SEQ ID NO: 4854711 - DNA, 14 bp, Homo sapiens
tcttcaaagccttc

SEQ ID NO: 4854712 - DNA, 13 bp, Homo sapiens
tcttcactctggc

SEQ ID NO: 4854713 - DNA, 20 bp, Homo sapiens
tcttcatgagtagtgggcta

SEQ ID NO: 4854714 - DNA, 22 bp, Homo sapiens
tcttccacccacaaactccagg

SEQ ID NO: 4854715 - DNA, 17 bp, Homo sapiens
tcttcccactccagctg

SEQ ID NO: 4854716 - DNA, 13 bp, Homo sapiens
tcttcctggcaca

SEQ ID NO: 4854717 - DNA, 15 bp, Homo sapiens
tcttcggtggccttg

SEQ ID NO: 4854718 - DNA, 22 bp, Homo sapiens
tcttctagatgattttttgaaa

SEQ ID NO: 4854719 - DNA, 23 bp, Homo sapiens
tcttctagatgattttttgaaag

SEQ ID NO: 4854720 - DNA, 22 bp, Homo sapiens
tcttctggtactttctgttatg

SEQ ID NO: 4854721 - DNA, 14 bp, Homo sapiens
tcttctttctccat

SEQ ID NO: 4854722 - DNA, 21 bp, Homo sapiens
tcttctttctccatggagcct

SEQ ID NO: 4854723 - DNA, 15 bp, Homo sapiens
tcttctttcttccac

SEQ ID NO: 4854724 - DNA, 13 bp, Homo sapiens
tcttgaaacctga

SEQ ID NO: 4854725 - DNA, 15 bp, Homo sapiens
tcttgaatataaaaa

SEQ ID NO: 4854726 - DNA, 23 bp, Homo sapiens
tcttgcctcattttgcttcccat

SEQ ID NO: 4854727 - DNA, 20 bp, Homo sapiens
tcttgcttggggaacttgtg

SEQ ID NO: 4854728 - DNA, 19 bp, Homo sapiens
tcttggaagctgtttggaa

SEQ ID NO: 4854729 - DNA, 11 bp, Homo sapiens
tcttgggggtc

SEQ ID NO: 4854730 - DNA, 21 bp, Homo sapiens
tcttgtattatctcctttgaa

SEQ ID NO: 4854731 - DNA, 16 bp, Homo sapiens
tcttgtctgatttctt

SEQ ID NO: 4854732 - DNA, 18 bp, Homo sapiens
tcttgtgggagacagcag

SEQ ID NO: 4854733 - DNA, 16 bp, Homo sapiens
tcttgttcctgaaatg

SEQ ID NO: 4854734 - DNA, 11 bp, Homo sapiens
tctttaactgc

SEQ ID NO: 4854735 - DNA, 12 bp, Homo sapiens
tctttagttttt

SEQ ID NO: 4854736 - DNA, 16 bp, Homo sapiens
tctttatatttcaata

SEQ ID NO: 4854737 - DNA, 12 bp, Homo sapiens
tctttattgaaa

SEQ ID NO: 4854738 - DNA, 15 bp, Homo sapiens
tctttattgaaattc

SEQ ID NO: 4854739 - DNA, 17 bp, Homo sapiens
tctttcctactttctat

SEQ ID NO: 4854740 - DNA, 12 bp, Homo sapiens
tctttctgctct

SEQ ID NO: 4854741 - DNA, 14 bp, Homo sapiens
tctttgagtaatgt

SEQ ID NO: 4854742 - DNA, 14 bp, Homo sapiens
tctttggagttaaa

SEQ ID NO: 4854743 - DNA, 17 bp, Homo sapiens
tctttgggcctctcctg

SEQ ID NO: 4854744 - DNA, 20 bp, Homo sapiens
tctttgggcctctcctgccc

SEQ ID NO: 4854745 - DNA, 12 bp, Homo sapiens
tcttttcttatt

SEQ ID NO: 4854746 - DNA, 20 bp, Homo sapiens
tcttttgcttgccaaagtac

SEQ ID NO: 4854747 - DNA, 12 bp, Homo sapiens
tctttttgtttg

SEQ ID NO: 4854748 - DNA, 12 bp, Homo sapiens
tcttttttaacc

SEQ ID NO: 4854749 - DNA, 12 bp, Homo sapiens
tgaaaaatataa

SEQ ID NO: 4854750 - DNA, 17 bp, Homo sapiens
tgaaaaatataaaatta

SEQ ID NO: 4854751 - DNA, 19 bp, Homo sapiens
tgaaaaatataaaattatg

SEQ ID NO: 4854752 - DNA, 22 bp, Homo sapiens
tgaaaaatataaaattatgaga

SEQ ID NO: 4854753 - DNA, 16 bp, Homo sapiens
tgaaaagaaggaaaga

SEQ ID NO: 4854754 - DNA, 21 bp, Homo sapiens
tgaaaagtatattgataacct

SEQ ID NO: 4854755 - DNA, 14 bp, Homo sapiens
tgaaaagtgtgtat

SEQ ID NO: 4854756 - DNA, 18 bp, Homo sapiens
tgaaaataactgaatttg

SEQ ID NO: 4854757 - DNA, 19 bp, Homo sapiens
tgaaacatgggctgtgatt

SEQ ID NO: 4854758 - DNA, 20 bp, Homo sapiens
tgaaacatgggctgtgatta

SEQ ID NO: 4854759 - DNA, 14 bp, Homo sapiens
tgaaacttctcagt

SEQ ID NO: 4854760 - DNA, 16 bp, Homo sapiens
tgaaactttgggaaaa

SEQ ID NO: 4854761 - DNA, 19 bp, Homo sapiens
tgaaactttgggaaaacat

SEQ ID NO: 4854762 - DNA, 22 bp, Homo sapiens
tgaaactttgggaaaacatgtt

SEQ ID NO: 4854763 - DNA, 23 bp, Homo sapiens
tgaaactttgggaaaacatgtta

SEQ ID NO: 4854764 - DNA, 13 bp, Homo sapiens
tgaaagaaaattg

SEQ ID NO: 4854765 - DNA, 17 bp, Homo sapiens
tgaaagctggtggcaga

SEQ ID NO: 4854766 - DNA, 15 bp, Homo sapiens
tgaaaggccagcagc

SEQ ID NO: 4854767 - DNA, 14 bp, Homo sapiens
tgaaataaaatata

SEQ ID NO: 4854768 - DNA, 23 bp, Homo sapiens
tgaaatccatatatatgaaatgt

SEQ ID NO: 4854769 - DNA, 12 bp, Homo sapiens
tgaaatccctgc

SEQ ID NO: 4854770 - DNA, 15 bp, Homo sapiens
tgaaatccctgcctc

SEQ ID NO: 4854771 - DNA, 19 bp, Homo sapiens
tgaaatcttcccatgcatt

SEQ ID NO: 4854772 - DNA, 22 bp, Homo sapiens
tgaaatgaactttgtcagtgtt

SEQ ID NO: 4854773 - DNA, 13 bp, Homo sapiens
tgaaatgcatatt

SEQ ID NO: 4854774 - DNA, 16 bp, Homo sapiens
tgaaatgtgtttcctt

SEQ ID NO: 4854775 - DNA, 23 bp, Homo sapiens
tgaaatgtgtttccttttcagga

SEQ ID NO: 4854776 - DNA, 13 bp, Homo sapiens
tgaaattctattt

SEQ ID NO: 4854777 - DNA, 16 bp, Homo sapiens
tgaaattgcatacttt

SEQ ID NO: 4854778 - DNA, 18 bp, Homo sapiens
tgaaattttagaaatatt

SEQ ID NO: 4854779 - DNA, 13 bp, Homo sapiens
tgaacacatgtgt

SEQ ID NO: 4854780 - DNA, 19 bp, Homo sapiens
tgaacacatgtgtatgata

SEQ ID NO: 4854781 - DNA, 14 bp, Homo sapiens
tgaacactgtgacc

SEQ ID NO: 4854782 - DNA, 16 bp, Homo sapiens
tgaacataacttctca

SEQ ID NO: 4854783 - DNA, 19 bp, Homo sapiens
tgaacattctcctgtggaa

SEQ ID NO: 4854784 - DNA, 13 bp, Homo sapiens
tgaaccctccaaa

SEQ ID NO: 4854785 - DNA, 14 bp, Homo sapiens
tgaaccctccaaag

SEQ ID NO: 4854786 - DNA, 20 bp, Homo sapiens
tgaactccaggcatgtgtct

SEQ ID NO: 4854787 - DNA, 18 bp, Homo sapiens
tgaactttgtcagtgttg

SEQ ID NO: 4854788 - DNA, 13 bp, Homo sapiens
tgaactttgtgct

SEQ ID NO: 4854789 - DNA, 17 bp, Homo sapiens
tgaagaaggcaaggctg

SEQ ID NO: 4854790 - DNA, 13 bp, Homo sapiens
tgaagaattgaaa

SEQ ID NO: 4854791 - DNA, 19 bp, Homo sapiens
tgaagagacagagacaagt

SEQ ID NO: 4854792 - DNA, 21 bp, Homo sapiens
tgaagagacagagacaagtaa

SEQ ID NO: 4854793 - DNA, 22 bp, Homo sapiens
tgaagagggacataagataaaa

SEQ ID NO: 4854794 - DNA, 11 bp, Homo sapiens
tgaagagtgga

SEQ ID NO: 4854795 - DNA, 22 bp, Homo sapiens
tgaagcaaactctaaaattata

SEQ ID NO: 4854796 - DNA, 17 bp, Homo sapiens
tgaagcagaaccttctt

SEQ ID NO: 4854797 - DNA, 18 bp, Homo sapiens
tgaagcagaaccttcttt

SEQ ID NO: 4854798 - DNA, 16 bp, Homo sapiens
tgaagctggagcagcg

SEQ ID NO: 4854799 - DNA, 14 bp, Homo sapiens
tgaaggagaatggc

SEQ ID NO: 4854800 - DNA, 17 bp, Homo sapiens
tgaaggggctggtggag

SEQ ID NO: 4854801 - DNA, 18 bp, Homo sapiens
tgaaggtgataagggaaa

SEQ ID NO: 4854802 - DNA, 16 bp, Homo sapiens
tgaagttagtggaaat

SEQ ID NO: 4854803 - DNA, 18 bp, Homo sapiens
tgaagtttggagatagat

SEQ ID NO: 4854804 - DNA, 16 bp, Homo sapiens
tgaagttttactgtct

SEQ ID NO: 4854805 - DNA, 17 bp, Homo sapiens
tgaagttttactgtcta

SEQ ID NO: 4854806 - DNA, 12 bp, Homo sapiens
tgaataaatgtc

SEQ ID NO: 4854807 - DNA, 15 bp, Homo sapiens
tgaataaatgtcttg

SEQ ID NO: 4854808 - DNA, 14 bp, Homo sapiens
tgaataatggaaaa

SEQ ID NO: 4854809 - DNA, 19 bp, Homo sapiens
tgaataatggaaaatgcca

SEQ ID NO: 4854810 - DNA, 12 bp, Homo sapiens
tgaatataaaaa

SEQ ID NO: 4854811 - DNA, 23 bp, Homo sapiens
tgaatatgtagtatctatatgac

SEQ ID NO: 4854812 - DNA, 15 bp, Homo sapiens
tgaatgtcagttgtt

SEQ ID NO: 4854813 - DNA, 14 bp, Homo sapiens
tgaatgtccaaaat

SEQ ID NO: 4854814 - DNA, 17 bp, Homo sapiens
tgaatgtccaaaattta

SEQ ID NO: 4854815 - DNA, 14 bp, Homo sapiens
tgaatgtgctggtg

SEQ ID NO: 4854816 - DNA, 14 bp, Homo sapiens
tgaatgtgtgagaa

SEQ ID NO: 4854817 - DNA, 21 bp, Homo sapiens
tgaatgttaaagggatatttt

SEQ ID NO: 4854818 - DNA, 18 bp, Homo sapiens
tgaattagtgagtatagt

SEQ ID NO: 4854819 - DNA, 17 bp, Homo sapiens
tgaattgaagtttcaag

SEQ ID NO: 4854820 - DNA, 14 bp, Homo sapiens
tgaattttaaagta

SEQ ID NO: 4854821 - DNA, 22 bp, Homo sapiens
tgaattttaaagtatgcattat

SEQ ID NO: 4854822 - DNA, 21 bp, Homo sapiens
tgacaaccattaaagtcagaa

SEQ ID NO: 4854823 - DNA, 18 bp, Homo sapiens
tgacaactcattttcata

SEQ ID NO: 4854824 - DNA, 22 bp, Homo sapiens
tgacaactcattttcatattgt

SEQ ID NO: 4854825 - DNA, 16 bp, Homo sapiens
tgacaagctgtatcac

SEQ ID NO: 4854826 - DNA, 22 bp, Homo sapiens
tgacaagctgtatcactgcctt

SEQ ID NO: 4854827 - DNA, 15 bp, Homo sapiens
tgacaaggcctgctt

SEQ ID NO: 4854828 - DNA, 16 bp, Homo sapiens
tgacaaggcctgcttg

SEQ ID NO: 4854829 - DNA, 22 bp, Homo sapiens
tgacacaactgtgtgattaaaa

SEQ ID NO: 4854830 - DNA, 13 bp, Homo sapiens
gcagatgagggct

SEQ ID NO: 4854831 - DNA, 18 bp, Homo sapiens
gcagatgatgctttggaa

SEQ ID NO: 4854832 - DNA, 14 bp, Homo sapiens
gcagatgggggcct

SEQ ID NO: 4854833 - DNA, 16 bp, Homo sapiens
gcagatgggggcctct

SEQ ID NO: 4854834 - DNA, 12 bp, Homo sapiens
gcagcaggccag

SEQ ID NO: 4854835 - DNA, 13 bp, Homo sapiens
gcagcaggccaga

SEQ ID NO: 4854836 - DNA, 16 bp, Homo sapiens
gcagcaggccagagaa

SEQ ID NO: 4854837 - DNA, 23 bp, Homo sapiens
gcagcaggcctctgggacccaca

SEQ ID NO: 4854838 - DNA, 22 bp, Homo sapiens
gcagcagtcgcccaagcagaca

SEQ ID NO: 4854839 - DNA, 19 bp, Homo sapiens
gcagccaaggccgccagcg

SEQ ID NO: 4854840 - DNA, 14 bp, Homo sapiens
gcagccgcagagaa

SEQ ID NO: 4854841 - DNA, 17 bp, Homo sapiens
gcagccgcagagaaatg

SEQ ID NO: 4854842 - DNA, 18 bp, Homo sapiens
gcagccgcagagaaatgc

SEQ ID NO: 4854843 - DNA, 23 bp, Homo sapiens
gcagccgcagagaaatgccccag

SEQ ID NO: 4854844 - DNA, 16 bp, Homo sapiens
gcagcctaagaagaag

SEQ ID NO: 4854845 - DNA, 20 bp, Homo sapiens
gcagcctaagaagaaggcca

SEQ ID NO: 4854846 - DNA, 23 bp, Homo sapiens
gcagcctaagaagaaggccagag

SEQ ID NO: 4854847 - DNA, 22 bp, Homo sapiens
gcagcctagcctatgtctggca

SEQ ID NO: 4854848 - DNA, 19 bp, Homo sapiens
gcagcctctccgactctgc

SEQ ID NO: 4854849 - DNA, 18 bp, Homo sapiens
gcagcctggttggcagca

SEQ ID NO: 4854850 - DNA, 17 bp, Homo sapiens
gcagcctgtatgtggtg

SEQ ID NO: 4854851 - DNA, 20 bp, Homo sapiens
gcagcctgtatgtggtgtgg

SEQ ID NO: 4854852 - DNA, 22 bp, Homo sapiens
gcagcctgtatgtggtgtgggg

SEQ ID NO: 4854853 - DNA, 18 bp, Homo sapiens
gcagccttcatcagaact

SEQ ID NO: 4854854 - DNA, 13 bp, Homo sapiens
gcagctagtgcct

SEQ ID NO: 4854855 - DNA, 14 bp, Homo sapiens
gcagctagtgcctt

SEQ ID NO: 4854856 - DNA, 13 bp, Homo sapiens
gcagctgatgctg

SEQ ID NO: 4854857 - DNA, 12 bp, Homo sapiens
gcagcttgctgg

SEQ ID NO: 4854858 - DNA, 20 bp, Homo sapiens
gcagcttgctgggctttggg

SEQ ID NO: 4854859 - DNA, 22 bp, Homo sapiens
gcaggagcttctgggagatttt

SEQ ID NO: 4854860 - DNA, 14 bp, Homo sapiens
gcaggccagagaaa

SEQ ID NO: 4854861 - DNA, 15 bp, Homo sapiens
gcaggcccaatgctg

SEQ ID NO: 4854862 - DNA, 18 bp, Homo sapiens
gcaggcccaatgctgctt

SEQ ID NO: 4854863 - DNA, 23 bp, Homo sapiens
gcaggcccaatgctgcttttggg

SEQ ID NO: 4854864 - DNA, 13 bp, Homo sapiens
gcaggcctcccaa

SEQ ID NO: 4854865 - DNA, 16 bp, Homo sapiens
gcaggcctcccaagct

SEQ ID NO: 4854866 - DNA, 13 bp, Homo sapiens
gcaggcctctggg

SEQ ID NO: 4854867 - DNA, 23 bp, Homo sapiens
gcagggagagagtagctgcagcc

SEQ ID NO: 4854868 - DNA, 22 bp, Homo sapiens
gcagggccctgaaatggcctgt

SEQ ID NO: 4854869 - DNA, 9 bp, Homo sapiens
gcaggtgct

SEQ ID NO: 4854870 - DNA, 15 bp, Homo sapiens
gcaggtgctcatgct

SEQ ID NO: 4854871 - DNA, 20 bp, Homo sapiens
gcaggtgctcatgctgctcc

SEQ ID NO: 4854872 - DNA, 22 bp, Homo sapiens
gcaggtgcttttggcagagacc

SEQ ID NO: 4854873 - DNA, 13 bp, Homo sapiens
gcagtacaaatgt

SEQ ID NO: 4854874 - DNA, 19 bp, Homo sapiens
gcagtacaaatgtttttca

SEQ ID NO: 4854875 - DNA, 18 bp, Homo sapiens
gcagtgttacttgcaggt

SEQ ID NO: 4854876 - DNA, 13 bp, Homo sapiens
gcataaagtaaat

SEQ ID NO: 4854877 - DNA, 22 bp, Homo sapiens
gcatactgccttgtttaatggt

SEQ ID NO: 4854878 - DNA, 19 bp, Homo sapiens
gcatagataatattgtttg

SEQ ID NO: 4854879 - DNA, 23 bp, Homo sapiens
gcatagataatattgtttggtaa

SEQ ID NO: 4854880 - DNA, 20 bp, Homo sapiens
gcatagcagtatatgttaat

SEQ ID NO: 4854881 - DNA, 14 bp, Homo sapiens
gcataggctgggga

SEQ ID NO: 4854882 - DNA, 20 bp, Homo sapiens
gcataggctggggacacagg

SEQ ID NO: 4854883 - DNA, 16 bp, Homo sapiens
gcatattataaaggat

SEQ ID NO: 4854884 - DNA, 19 bp, Homo sapiens
gcatatttgcaaagtgtat

SEQ ID NO: 4854885 - DNA, 17 bp, Homo sapiens
gcatcaatgtattttat

SEQ ID NO: 4854886 - DNA, 15 bp, Homo sapiens
gcatcatctcttcct

SEQ ID NO: 4854887 - DNA, 20 bp, Homo sapiens
gcatccagtgtgagatactg

SEQ ID NO: 4854888 - DNA, 20 bp, Homo sapiens
gcatctcagtggtgtgtgaa

SEQ ID NO: 4854889 - DNA, 21 bp, Homo sapiens
gcatgcaaatgagctctgaaa

SEQ ID NO: 4854890 - DNA, 14 bp, Homo sapiens
gcatgcatgcaaat

SEQ ID NO: 4854891 - DNA, 20 bp, Homo sapiens
gcatggacatttagaagaaa

SEQ ID NO: 4854892 - DNA, 22 bp, Homo sapiens
gcatggacatttagaagaaaga

SEQ ID NO: 4854893 - DNA, 13 bp, Homo sapiens
gcatggagaatgg

SEQ ID NO: 4854894 - DNA, 13 bp, Homo sapiens
gcatggcaggagt

SEQ ID NO: 4854895 - DNA, 15 bp, Homo sapiens
gcatggggaggcagc

SEQ ID NO: 4854896 - DNA, 22 bp, Homo sapiens
gtcaccaaaagacactgcagaa

SEQ ID NO: 4854897 - DNA, 19 bp, Homo sapiens
gtcactgtccagagtctct

SEQ ID NO: 4854898 - DNA, 19 bp, Homo sapiens
gtcacttctgggggtcact

SEQ ID NO: 4854899 - DNA, 18 bp, Homo sapiens
gtcacttttccttttctt

SEQ ID NO: 4854900 - DNA, 18 bp, Homo sapiens
gtcagaagcctccaagcc

SEQ ID NO: 4854901 - DNA, 13 bp, Homo sapiens
gtcagaatcagaa

SEQ ID NO: 4854902 - DNA, 19 bp, Homo sapiens
gtcagaatttttaactgta

SEQ ID NO: 4854903 - DNA, 17 bp, Homo sapiens
gtcagacatttctttgg

SEQ ID NO: 4854904 - DNA, 16 bp, Homo sapiens
gtcagcagtcctagcc

SEQ ID NO: 4854905 - DNA, 19 bp, Homo sapiens
gtcagctgctgttgaactt

SEQ ID NO: 4854906 - DNA, 20 bp, Homo sapiens
gtcagtgttgcctcttgcaa

SEQ ID NO: 4854907 - DNA, 19 bp, Homo sapiens
gtcagttgtgttttttaag

SEQ ID NO: 4854908 - DNA, 16 bp, Homo sapiens
gtcagttgttatttat

SEQ ID NO: 4854909 - DNA, 14 bp, Homo sapiens
gtcatgaagaatgt

SEQ ID NO: 4854910 - DNA, 11 bp, Homo sapiens
gtcatgtgacc

SEQ ID NO: 4854911 - DNA, 15 bp, Homo sapiens
gtcattagtcctttg

SEQ ID NO: 4854912 - DNA, 13 bp, Homo sapiens
gtcattggcaaag

SEQ ID NO: 4854913 - DNA, 21 bp, Homo sapiens
gtcattggcaaagtgacaaag

SEQ ID NO: 4854914 - DNA, 18 bp, Homo sapiens
gtccaaaatttatatttt

SEQ ID NO: 4854915 - DNA, 21 bp, Homo sapiens
gtccaaaatttatattttaga

SEQ ID NO: 4854916 - DNA, 12 bp, Homo sapiens
gtccagccaccc

SEQ ID NO: 4854917 - DNA, 21 bp, Homo sapiens
gtccaggatgctaacatctaa

SEQ ID NO: 4854918 - DNA, 17 bp, Homo sapiens
gtcccatggctgaagct

SEQ ID NO: 4854919 - DNA, 22 bp, Homo sapiens
gtcccatggctgaagctggagc

SEQ ID NO: 4854920 - DNA, 21 bp, Homo sapiens
gtccgcagttgtagcagaaac

SEQ ID NO: 4854921 - DNA, 18 bp, Homo sapiens
gtccgtgccccttccctg

SEQ ID NO: 4854922 - DNA, 20 bp, Homo sapiens
gtccgtgccccttccctggg

SEQ ID NO: 4854923 - DNA, 19 bp, Homo sapiens
gtcctaaaagttctcaatg

SEQ ID NO: 4854924 - DNA, 17 bp, Homo sapiens
gtcctagtaagaagaca

SEQ ID NO: 4854925 - DNA, 19 bp, Homo sapiens
gtcctctcagttctctccc

SEQ ID NO: 4854926 - DNA, 19 bp, Homo sapiens
gtcctctcggctgccaggg

SEQ ID NO: 4854927 - DNA, 23 bp, Homo sapiens
gtcctgcctgtctgaagccaatg

SEQ ID NO: 4854928 - DNA, 22 bp, Homo sapiens
gtcctggaatttggacaagtgc

SEQ ID NO: 4854929 - DNA, 16 bp, Homo sapiens
gtccttgatttcaaag

SEQ ID NO: 4854930 - DNA, 12 bp, Homo sapiens
gtccttgccctt

SEQ ID NO: 4854931 - DNA, 17 bp, Homo sapiens
gtcgcagaccagagctg

SEQ ID NO: 4854932 - DNA, 19 bp, Homo sapiens
gtcgcagaccagagctgtc

SEQ ID NO: 4854933 - DNA, 17 bp, Homo sapiens
gtcgccagtcactgctg

SEQ ID NO: 4854934 - DNA, 19 bp, Homo sapiens
gtcgccagtcactgctgca

SEQ ID NO: 4854935 - DNA, 22 bp, Homo sapiens
gtcgccagtcactgctgcaagg

SEQ ID NO: 4854936 - DNA, 14 bp, Homo sapiens
gtcggatcctgtga

SEQ ID NO: 4854937 - DNA, 22 bp, Homo sapiens
gtcgggcatggtggctcatgcc

SEQ ID NO: 4854938 - DNA, 21 bp, Homo sapiens
gtctaacttggggaaggggcc

SEQ ID NO: 4854939 - DNA, 18 bp, Homo sapiens
gtctaagtagggccaggg

SEQ ID NO: 4854940 - DNA, 15 bp, Homo sapiens
gtctagagagaacca

SEQ ID NO: 4854941 - DNA, 16 bp, Homo sapiens
gtctaggcactgagca

SEQ ID NO: 4854942 - DNA, 18 bp, Homo sapiens
gtctaggcactgagcagg

SEQ ID NO: 4854943 - DNA, 16 bp, Homo sapiens
gtctaggtctcctcag

SEQ ID NO: 4854944 - DNA, 17 bp, Homo sapiens
gtctccagaagaaaatt

SEQ ID NO: 4854945 - DNA, 19 bp, Homo sapiens
gtctcctcagggtgggggg

SEQ ID NO: 4854946 - DNA, 20 bp, Homo sapiens
gtctctcagggatggaggga

SEQ ID NO: 4854947 - DNA, 18 bp, Homo sapiens
gtctctcttcggtggcct

SEQ ID NO: 4854948 - DNA, 22 bp, Homo sapiens
gtctctcttcggtggccttgag

SEQ ID NO: 4854949 - DNA, 15 bp, Homo sapiens
gtctctgtgtaacca

SEQ ID NO: 4854950 - DNA, 22 bp, Homo sapiens
gtctctgtgtaaccagctcagt

SEQ ID NO: 4854951 - DNA, 16 bp, Homo sapiens
gtctgagacaggtgcc

SEQ ID NO: 4854952 - DNA, 16 bp, Homo sapiens
gtctgctccaatgact

SEQ ID NO: 4854953 - DNA, 20 bp, Homo sapiens
gtctggctcaaagcagcagg

SEQ ID NO: 4854954 - DNA, 14 bp, Homo sapiens
gtctggctccagcc

SEQ ID NO: 4854955 - DNA, 17 bp, Homo sapiens
gtctgggatattcttta

SEQ ID NO: 4854956 - DNA, 17 bp, Homo sapiens
gtcttccagagaacctg

SEQ ID NO: 4854957 - DNA, 13 bp, Homo sapiens
gtcttctttctcc

SEQ ID NO: 4854958 - DNA, 15 bp, Homo sapiens
gtcttctttctccat

SEQ ID NO: 4854959 - DNA, 21 bp, Homo sapiens
gtcttggaagctgtttggaaa

SEQ ID NO: 4854960 - DNA, 16 bp, Homo sapiens
gtctttcatggctgct

SEQ ID NO: 4854961 - DNA, 13 bp, Homo sapiens
gtctttgccttct

SEQ ID NO: 4854962 - DNA, 13 bp, Homo sapiens
gtgaactccaggc

SEQ ID NO: 4854963 - DNA, 18 bp, Homo sapiens
gtgaagttttactgtcta

SEQ ID NO: 4854964 - DNA, 17 bp, Homo sapiens
gtgacaaagcaatttac

SEQ ID NO: 4854965 - DNA, 14 bp, Homo sapiens
gtgacaaggcctgc

SEQ ID NO: 4854966 - DNA, 17 bp, Homo sapiens
gtgaccactctgtcttg

SEQ ID NO: 4854967 - DNA, 15 bp, Homo sapiens
gtgaccagaaagctt

SEQ ID NO: 4854968 - DNA, 15 bp, Homo sapiens
gtgaccctgggcagt

SEQ ID NO: 4854969 - DNA, 19 bp, Homo sapiens
gtgactgaagaagatgagc

SEQ ID NO: 4854970 - DNA, 18 bp, Homo sapiens
gtgacttctcccctgccc

SEQ ID NO: 4854971 - DNA, 17 bp, Homo sapiens
gtgagaacccagtttcc

SEQ ID NO: 4854972 - DNA, 17 bp, Homo sapiens
gtgagaatggcctggag

SEQ ID NO: 4854973 - DNA, 20 bp, Homo sapiens
gtgagaatggcctggagcag

SEQ ID NO: 4854974 - DNA, 21 bp, Homo sapiens
gtgagaatggcctggagcagg

SEQ ID NO: 4854975 - DNA, 13 bp, Homo sapiens
gtgagagaatgta

SEQ ID NO: 4854976 - DNA, 15 bp, Homo sapiens
gtgagagaatgtatt

SEQ ID NO: 4854977 - DNA, 23 bp, Homo sapiens
gtgagagaatgtattttcataga

SEQ ID NO: 4854978 - DNA, 14 bp, Homo sapiens
gtgagcaagcacca

SEQ ID NO: 4854979 - DNA, 23 bp, Homo sapiens
gtgagcaagcaccaacctccaga

SEQ ID NO: 4854980 - DNA, 17 bp, Homo sapiens
gtgagcacaaagaagaa

SEQ ID NO: 4854981 - DNA, 18 bp, Homo sapiens
gtgagcacaaagaagaaa

SEQ ID NO: 4854982 - DNA, 19 bp, Homo sapiens
gtgagcagagatgtactgc

SEQ ID NO: 4854983 - DNA, 19 bp, Homo sapiens
gtgagcatggggccaggaa

SEQ ID NO: 4854984 - DNA, 12 bp, Homo sapiens
gtgaggacaggg

SEQ ID NO: 4854985 - DNA, 18 bp, Homo sapiens
gtgaggacagggccccca

SEQ ID NO: 4854986 - DNA, 13 bp, Homo sapiens
gtgaggagagagg

SEQ ID NO: 4854987 - DNA, 16 bp, Homo sapiens
gtgaggataggacaga

SEQ ID NO: 4854988 - DNA, 16 bp, Homo sapiens
gtgaggtgaactccag

SEQ ID NO: 4854989 - DNA, 16 bp, Homo sapiens
gtgatgggctaggcct

SEQ ID NO: 4854990 - DNA, 22 bp, Homo sapiens
gtgatttgaaaaatataaaatt

SEQ ID NO: 4854991 - DNA, 14 bp, Homo sapiens
gtgcaacatctctg

SEQ ID NO: 4854992 - DNA, 16 bp, Homo sapiens
gtgcaacatctctgaa

SEQ ID NO: 4854993 - DNA, 15 bp, Homo sapiens
gtgcaataggtgaga

SEQ ID NO: 4854994 - DNA, 13 bp, Homo sapiens
gtgcacatttctt

SEQ ID NO: 4854995 - DNA, 13 bp, Homo sapiens
gtgcactccagac

SEQ ID NO: 4854996 - DNA, 20 bp, Homo sapiens
gtgcactccagactctgggg

SEQ ID NO: 4854997 - DNA, 16 bp, Homo sapiens
gtgcagacagccatgc

SEQ ID NO: 4854998 - DNA, 14 bp, Homo sapiens
gtgccaacctcttt

SEQ ID NO: 4854999 - DNA, 16 bp, Homo sapiens
gtgccccttccctggg

SEQ ID NO: 4855000 - DNA, 15 bp, Homo sapiens
gtgcctgccaccttc

SEQ ID NO: 4855001 - DNA, 12 bp, Homo sapiens
gtgcctgggctc

SEQ ID NO: 4855002 - DNA, 11 bp, Homo sapiens
gtgccttctct

SEQ ID NO: 4855003 - DNA, 16 bp, Homo sapiens
gtgctagatccagccc

SEQ ID NO: 4855004 - DNA, 22 bp, Homo sapiens
gtgctataatctgtttttacgt

SEQ ID NO: 4855005 - DNA, 23 bp, Homo sapiens
gtgctataatctgtttttacgta

SEQ ID NO: 4855006 - DNA, 17 bp, Homo sapiens
gtgctatacacacacac

SEQ ID NO: 4855007 - DNA, 13 bp, Homo sapiens
gtgctcatgctgc

SEQ ID NO: 4855008 - DNA, 19 bp, Homo sapiens
gtgctcttcccactccagc

SEQ ID NO: 4855009 - DNA, 22 bp, Homo sapiens
gtgctcttcccactccagctga

SEQ ID NO: 4855010 - DNA, 14 bp, Homo sapiens
gtgctggggctgca

SEQ ID NO: 4855011 - DNA, 15 bp, Homo sapiens
gtgctggtgaacact

SEQ ID NO: 4855012 - DNA, 18 bp, Homo sapiens
gtgctggtgaacactgtg

SEQ ID NO: 4855013 - DNA, 21 bp, Homo sapiens
gtgctggtgaacactgtgacc

SEQ ID NO: 4855014 - DNA, 22 bp, Homo sapiens
gtgcttctcacactggaggagc

SEQ ID NO: 4855015 - DNA, 15 bp, Homo sapiens
gtgcttttggcagag

SEQ ID NO: 4855016 - DNA, 20 bp, Homo sapiens
gtttgtcttggatatatagg

SEQ ID NO: 4855017 - DNA, 15 bp, Homo sapiens
gtttgtggggctgga

SEQ ID NO: 4855018 - DNA, 15 bp, Homo sapiens
gttttaactgtggat

SEQ ID NO: 4855019 - DNA, 16 bp, Homo sapiens
gttttgaagattctat

SEQ ID NO: 4855020 - DNA, 17 bp, Homo sapiens
gttttgaagattctatg

SEQ ID NO: 4855021 - DNA, 14 bp, Homo sapiens
gtttttgacattta

SEQ ID NO: 4855022 - DNA, 18 bp, Homo sapiens
gtttttgacatttatatt

SEQ ID NO: 4855023 - DNA, 21 bp, Homo sapiens
gtttttgacatttatattaaa

SEQ ID NO: 4855024 - DNA, 15 bp, Homo sapiens
gtttttgtttggaga

SEQ ID NO: 4855025 - DNA, 15 bp, Homo sapiens
taaaaaaaaaagtca

SEQ ID NO: 4855026 - DNA, 16 bp, Homo sapiens
taaaaaaaaaagtcac

SEQ ID NO: 4855027 - DNA, 22 bp, Homo sapiens
taaaaaggcccttagagggaat

SEQ ID NO: 4855028 - DNA, 12 bp, Homo sapiens
taaaaattgtta

SEQ ID NO: 4855029 - DNA, 17 bp, Homo sapiens
taaaacaatccttacta

SEQ ID NO: 4855030 - DNA, 16 bp, Homo sapiens
taaaacgtgtaaatga

SEQ ID NO: 4855031 - DNA, 17 bp, Homo sapiens
taaaactaaatttcact

SEQ ID NO: 4855032 - DNA, 16 bp, Homo sapiens
taaaagaaataaacca

SEQ ID NO: 4855033 - DNA, 14 bp, Homo sapiens
taaaagcctgctca

SEQ ID NO: 4855034 - DNA, 17 bp, Homo sapiens
taaaagttctcaatgta

SEQ ID NO: 4855035 - DNA, 12 bp, Homo sapiens
taaaatatttat

SEQ ID NO: 4855036 - DNA, 15 bp, Homo sapiens
taaaatgtaatttaa

SEQ ID NO: 4855037 - DNA, 16 bp, Homo sapiens
taaaatgtaatttaaa

SEQ ID NO: 4855038 - DNA, 17 bp, Homo sapiens
taaaatgtaatttaaat

SEQ ID NO: 4855039 - DNA, 19 bp, Homo sapiens
taaaatgtaatttaaatga

SEQ ID NO: 4855040 - DNA, 20 bp, Homo sapiens
taaaatgtaatttaaatgaa

SEQ ID NO: 4855041 - DNA, 15 bp, Homo sapiens
taaaattatgagatt

SEQ ID NO: 4855042 - DNA, 12 bp, Homo sapiens
taaaattgttat

SEQ ID NO: 4855043 - DNA, 23 bp, Homo sapiens
taaaattttgtatgttaaagaga

SEQ ID NO: 4855044 - DNA, 18 bp, Homo sapiens
taaaccccaagcttccca

SEQ ID NO: 4855045 - DNA, 21 bp, Homo sapiens
taaacctaggacttccgagct

SEQ ID NO: 4855046 - DNA, 14 bp, Homo sapiens
taaacgattagtga

SEQ ID NO: 4855047 - DNA, 19 bp, Homo sapiens
taaacgattagtgatgtcc

SEQ ID NO: 4855048 - DNA, 13 bp, Homo sapiens
taaactaaatgtg

SEQ ID NO: 4855049 - DNA, 18 bp, Homo sapiens
taaactatatataatgta

SEQ ID NO: 4855050 - DNA, 14 bp, Homo sapiens
taaacttcacctac

SEQ ID NO: 4855051 - DNA, 13 bp, Homo sapiens
taaacttccaaag

SEQ ID NO: 4855052 - DNA, 21 bp, Homo sapiens
taaacttccaaagaaagttct

SEQ ID NO: 4855053 - DNA, 15 bp, Homo sapiens
taaagaaaggaaaag

SEQ ID NO: 4855054 - DNA, 15 bp, Homo sapiens
taaagaagtgcatga

SEQ ID NO: 4855055 - DNA, 15 bp, Homo sapiens
taaagacaggagaca

SEQ ID NO: 4855056 - DNA, 23 bp, Homo sapiens
taaagacaggagacaaaagagca

SEQ ID NO: 4855057 - DNA, 15 bp, Homo sapiens
taaagagataaagaa

SEQ ID NO: 4855058 - DNA, 20 bp, Homo sapiens
taaagcagttcctgtcccac

SEQ ID NO: 4855059 - DNA, 14 bp, Homo sapiens
taaagcatttccta

SEQ ID NO: 4855060 - DNA, 16 bp, Homo sapiens
taaagccaggctcagg

SEQ ID NO: 4855061 - DNA, 18 bp, Homo sapiens
taaagccaggctcaggag

SEQ ID NO: 4855062 - DNA, 18 bp, Homo sapiens
taaagggcccaatgaatt

SEQ ID NO: 4855063 - DNA, 19 bp, Homo sapiens
taaagggcccaatgaatta

SEQ ID NO: 4855064 - DNA, 13 bp, Homo sapiens
taaagtaaataca

SEQ ID NO: 4855065 - DNA, 17 bp, Homo sapiens
taaagtacttgactacc

SEQ ID NO: 4855066 - DNA, 22 bp, Homo sapiens
taaagtacttgactacctactg

SEQ ID NO: 4855067 - DNA, 19 bp, Homo sapiens
taaataaaaactaattaag

SEQ ID NO: 4855068 - DNA, 21 bp, Homo sapiens
taaataggaatcattcagaaa

SEQ ID NO: 4855069 - DNA, 22 bp, Homo sapiens
taaatatcccttggacatttta

SEQ ID NO: 4855070 - DNA, 13 bp, Homo sapiens
taaatatgaatga

SEQ ID NO: 4855071 - DNA, 22 bp, Homo sapiens
taaatcaaccacctatttttga

SEQ ID NO: 4855072 - DNA, 15 bp, Homo sapiens
taaatcataaagtca

SEQ ID NO: 4855073 - DNA, 14 bp, Homo sapiens
taaatcctgaagag

SEQ ID NO: 4855074 - DNA, 14 bp, Homo sapiens
taaatgaaagaaaa

SEQ ID NO: 4855075 - DNA, 18 bp, Homo sapiens
taaatgaagatctttata

SEQ ID NO: 4855076 - DNA, 19 bp, Homo sapiens
taaatgtgcaatagaaggt

SEQ ID NO: 4855077 - DNA, 12 bp, Homo sapiens
taaatgtgtaat

SEQ ID NO: 4855078 - DNA, 18 bp, Homo sapiens
taaatgtgtaataatgta

SEQ ID NO: 4855079 - DNA, 20 bp, Homo sapiens
taaattatttgattatttaa

SEQ ID NO: 4855080 - DNA, 22 bp, Homo sapiens
taaattatttgattatttaaga

SEQ ID NO: 4855081 - DNA, 16 bp, Homo sapiens
taaattcaactttgta

SEQ ID NO: 4855082 - DNA, 13 bp, Homo sapiens
taaattttaaagc

SEQ ID NO: 4855083 - DNA, 17 bp, Homo sapiens
taaattttaactaaatt

SEQ ID NO: 4855084 - DNA, 19 bp, Homo sapiens
taacaagaactttaaattg

SEQ ID NO: 4855085 - DNA, 19 bp, Homo sapiens
taacacatttttttgcatg

SEQ ID NO: 4855086 - DNA, 21 bp, Homo sapiens
taacacatttttttgcatgca

SEQ ID NO: 4855087 - DNA, 11 bp, Homo sapiens
taacaggacag

SEQ ID NO: 4855088 - DNA, 20 bp, Homo sapiens
taacatctaaaaatagactt

SEQ ID NO: 4855089 - DNA, 17 bp, Homo sapiens
taacatctttattgaaa

SEQ ID NO: 4855090 - DNA, 22 bp, Homo sapiens
taacatctttattgaaattcta

SEQ ID NO: 4855091 - DNA, 22 bp, Homo sapiens
taacatgtttctctataaagta

SEQ ID NO: 4855092 - DNA, 15 bp, Homo sapiens
taaccaaccttgttt

SEQ ID NO: 4855093 - DNA, 18 bp, Homo sapiens
taaccagctcagtgtttt

SEQ ID NO: 4855094 - DNA, 15 bp, Homo sapiens
taacccagtctttct

SEQ ID NO: 4855095 - DNA, 13 bp, Homo sapiens
taacctagttaaa

SEQ ID NO: 4855096 - DNA, 16 bp, Homo sapiens
taacctcgggcctgct

SEQ ID NO: 4855097 - DNA, 14 bp, Homo sapiens
taacgcaaccaagt

SEQ ID NO: 4855098 - DNA, 18 bp, Homo sapiens
taactatcttctttggac

SEQ ID NO: 4855099 - DNA, 22 bp, Homo sapiens
taactcaaggataccttcttat

SEQ ID NO: 4855100 - DNA, 23 bp, Homo sapiens
taactgtaaagatgtttatttca

SEQ ID NO: 4855101 - DNA, 14 bp, Homo sapiens
taactgtactgaat

SEQ ID NO: 4855102 - DNA, 15 bp, Homo sapiens
taactgttgcacttt

SEQ ID NO: 4855103 - DNA, 13 bp, Homo sapiens
taacttggggaag

SEQ ID NO: 4855104 - DNA, 15 bp, Homo sapiens
taacttggggaaggg

SEQ ID NO: 4855105 - DNA, 16 bp, Homo sapiens
taagaaatactcatgt

SEQ ID NO: 4855106 - DNA, 23 bp, Homo sapiens
taagaataccacatcaaataaga

SEQ ID NO: 4855107 - DNA, 15 bp, Homo sapiens
taagagaaaagagag

SEQ ID NO: 4855108 - DNA, 16 bp, Homo sapiens
taagagaaacctgcca

SEQ ID NO: 4855109 - DNA, 15 bp, Homo sapiens
taagagaatgttcct

SEQ ID NO: 4855110 - DNA, 22 bp, Homo sapiens
taagataaaatgatgttataca

SEQ ID NO: 4855111 - DNA, 19 bp, Homo sapiens
taagcaaccacactgcttg

SEQ ID NO: 4855112 - DNA, 15 bp, Homo sapiens
gacaaccattaaagt

SEQ ID NO: 4855113 - DNA, 16 bp, Homo sapiens
gacaaccattaaagtc

SEQ ID NO: 4855114 - DNA, 23 bp, Homo sapiens
gacaactcattttcatattgtaa

SEQ ID NO: 4855115 - DNA, 17 bp, Homo sapiens
gacactgttgataaaaa

SEQ ID NO: 4855116 - DNA, 23 bp, Homo sapiens
gacagaacttcagcattgtaatt

SEQ ID NO: 4855117 - DNA, 17 bp, Homo sapiens
gacagcaagtgagcaga

SEQ ID NO: 4855118 - DNA, 17 bp, Homo sapiens
gacagcagcctgtatgt

SEQ ID NO: 4855119 - DNA, 21 bp, Homo sapiens
gacagcagcctgtatgtggtg

SEQ ID NO: 4855120 - DNA, 19 bp, Homo sapiens
gacagcttacaggagccag

SEQ ID NO: 4855121 - DNA, 20 bp, Homo sapiens
gacagcttacaggagccagc

SEQ ID NO: 4855122 - DNA, 21 bp, Homo sapiens
gacaggccttcctcctctcaa

SEQ ID NO: 4855123 - DNA, 22 bp, Homo sapiens
gacaggccttcctcctctcaaa

SEQ ID NO: 4855124 - DNA, 20 bp, Homo sapiens
gacaggtgcctaacctggga

SEQ ID NO: 4855125 - DNA, 15 bp, Homo sapiens
gacagtgaatttggg

SEQ ID NO: 4855126 - DNA, 19 bp, Homo sapiens
gacataagataaaatgatg

SEQ ID NO: 4855127 - DNA, 20 bp, Homo sapiens
gacatgagagtagggccctg

SEQ ID NO: 4855128 - DNA, 15 bp, Homo sapiens
gacatgcaataaaat

SEQ ID NO: 4855129 - DNA, 19 bp, Homo sapiens
gacatgcaataaaatttaa

SEQ ID NO: 4855130 - DNA, 14 bp, Homo sapiens
gacatggaaatgaa

SEQ ID NO: 4855131 - DNA, 15 bp, Homo sapiens
gacatggaaatgaag

SEQ ID NO: 4855132 - DNA, 16 bp, Homo sapiens
gacatgtgacatttat

SEQ ID NO: 4855133 - DNA, 20 bp, Homo sapiens
gacatttatattaaataaca

SEQ ID NO: 4855134 - DNA, 20 bp, Homo sapiens
gacattttatgtctttcttg

SEQ ID NO: 4855135 - DNA, 18 bp, Homo sapiens
gaccaaggggtgggccac

SEQ ID NO: 4855136 - DNA, 14 bp, Homo sapiens
gaccagagctgtct

SEQ ID NO: 4855137 - DNA, 16 bp, Homo sapiens
gaccagagctgtctga

SEQ ID NO: 4855138 - DNA, 12 bp, Homo sapiens
gaccagtgcctg

SEQ ID NO: 4855139 - DNA, 15 bp, Homo sapiens
gaccagtgcctgtga

SEQ ID NO: 4855140 - DNA, 18 bp, Homo sapiens
gaccataagagaaacctg

SEQ ID NO: 4855141 - DNA, 21 bp, Homo sapiens
gaccataagagaaacctgcca

SEQ ID NO: 4855142 - DNA, 19 bp, Homo sapiens
gaccattttttaatttact

SEQ ID NO: 4855143 - DNA, 20 bp, Homo sapiens
gaccattttttaatttactt

SEQ ID NO: 4855144 - DNA, 23 bp, Homo sapiens
gaccattttttaatttacttgtt

SEQ ID NO: 4855145 - DNA, 15 bp, Homo sapiens
gacccacagaacttg

SEQ ID NO: 4855146 - DNA, 12 bp, Homo sapiens
gacccagagctg

SEQ ID NO: 4855147 - DNA, 17 bp, Homo sapiens
gacccagagctgctgca

SEQ ID NO: 4855148 - DNA, 22 bp, Homo sapiens
gacccatccctgcctggaggct

SEQ ID NO: 4855149 - DNA, 19 bp, Homo sapiens
gaccccagatacctgtgag

SEQ ID NO: 4855150 - DNA, 13 bp, Homo sapiens
gaccctcccatgg

SEQ ID NO: 4855151 - DNA, 15 bp, Homo sapiens
gaccctcgagagcct

SEQ ID NO: 4855152 - DNA, 21 bp, Homo sapiens
gacccttctgggtccagggag

SEQ ID NO: 4855153 - DNA, 17 bp, Homo sapiens
gacccttgacacctgct

SEQ ID NO: 4855154 - DNA, 21 bp, Homo sapiens
gacccttgacacctgctgaga

SEQ ID NO: 4855155 - DNA, 19 bp, Homo sapiens
gacccttgattcattctga

SEQ ID NO: 4855156 - DNA, 17 bp, Homo sapiens
gacctagctctttgggc

SEQ ID NO: 4855157 - DNA, 11 bp, Homo sapiens
gacctccagaa

SEQ ID NO: 4855158 - DNA, 21 bp, Homo sapiens
gacctccagaagtcccttcaa

SEQ ID NO: 4855159 - DNA, 13 bp, Homo sapiens
gacctccccaccc

SEQ ID NO: 4855160 - DNA, 14 bp, Homo sapiens
gacctccccacccg

SEQ ID NO: 4855161 - DNA, 16 bp, Homo sapiens
gacctcttctctcctc

SEQ ID NO: 4855162 - DNA, 19 bp, Homo sapiens
gacctcttctctcctcccc

SEQ ID NO: 4855163 - DNA, 20 bp, Homo sapiens
gacctcttctctcctcccct

SEQ ID NO: 4855164 - DNA, 19 bp, Homo sapiens
gacctgaccccattcctga

SEQ ID NO: 4855165 - DNA, 16 bp, Homo sapiens
gacctgtggtcatgtg

SEQ ID NO: 4855166 - DNA, 18 bp, Homo sapiens
gaccttaatttaactttc

SEQ ID NO: 4855167 - DNA, 22 bp, Homo sapiens
gaccttaatttaactttccagt

SEQ ID NO: 4855168 - DNA, 20 bp, Homo sapiens
gaccttgagttaacaggaca

SEQ ID NO: 4855169 - DNA, 16 bp, Homo sapiens
cttaaattttaactaa

SEQ ID NO: 4855170 - DNA, 18 bp, Homo sapiens
cttaaattttaactaaat

SEQ ID NO: 4855171 - DNA, 23 bp, Homo sapiens
cttaagcgaagtctttgccttct

SEQ ID NO: 4855172 - DNA, 17 bp, Homo sapiens
cttaatggagttcttgt

SEQ ID NO: 4855173 - DNA, 16 bp, Homo sapiens
cttacctgggcacaaa

SEQ ID NO: 4855174 - DNA, 18 bp, Homo sapiens
cttactaaaaagtataaa

SEQ ID NO: 4855175 - DNA, 21 bp, Homo sapiens
cttactaaaaagtataaaata

SEQ ID NO: 4855176 - DNA, 19 bp, Homo sapiens
cttacttcaaagtgcctgg

SEQ ID NO: 4855177 - DNA, 18 bp, Homo sapiens
cttagactctagtattta

SEQ ID NO: 4855178 - DNA, 16 bp, Homo sapiens
cttagccctcaccaca

SEQ ID NO: 4855179 - DNA, 19 bp, Homo sapiens
cttagctgaggctgagaaa

SEQ ID NO: 4855180 - DNA, 22 bp, Homo sapiens
cttaggctactgtaatgctgcc

SEQ ID NO: 4855181 - DNA, 17 bp, Homo sapiens
cttaggtttcaggaagt

SEQ ID NO: 4855182 - DNA, 18 bp, Homo sapiens
cttataaagtggaagtat

SEQ ID NO: 4855183 - DNA, 20 bp, Homo sapiens
cttataaagtggaagtatgt

SEQ ID NO: 4855184 - DNA, 24 bp, Homo sapiens
cttataaagtggaagtatgtatat

SEQ ID NO: 4855185 - DNA, 17 bp, Homo sapiens
cttataacctagttaaa

SEQ ID NO: 4855186 - DNA, 19 bp, Homo sapiens
cttatagacacttgctccc

SEQ ID NO: 4855187 - DNA, 16 bp, Homo sapiens
cttatagtctaagact

SEQ ID NO: 4855188 - DNA, 13 bp, Homo sapiens
cttatccaacttt

SEQ ID NO: 4855189 - DNA, 15 bp, Homo sapiens
cttatctctttccac

SEQ ID NO: 4855190 - DNA, 22 bp, Homo sapiens
cttatctctttccaccatacct

SEQ ID NO: 4855191 - DNA, 20 bp, Homo sapiens
cttatcttacaatattgatt

SEQ ID NO: 4855192 - DNA, 15 bp, Homo sapiens
cttatggcatgactc

SEQ ID NO: 4855193 - DNA, 16 bp, Homo sapiens
cttatggcatgactct

SEQ ID NO: 4855194 - DNA, 21 bp, Homo sapiens
cttatggtatgtagccagctg

SEQ ID NO: 4855195 - DNA, 20 bp, Homo sapiens
cttatgtagaaactgaggcc

SEQ ID NO: 4855196 - DNA, 21 bp, Homo sapiens
cttatgtagaaactgaggccc

SEQ ID NO: 4855197 - DNA, 16 bp, Homo sapiens
cttattgaccattttt

SEQ ID NO: 4855198 - DNA, 16 bp, Homo sapiens
cttatttctcagctgt

SEQ ID NO: 4855199 - DNA, 20 bp, Homo sapiens
cttatttctcagctgtgcct

SEQ ID NO: 4855200 - DNA, 17 bp, Homo sapiens
cttcaaaaagccacagc

SEQ ID NO: 4855201 - DNA, 20 bp, Homo sapiens
cttcaaaaagccacagcaga

SEQ ID NO: 4855202 - DNA, 13 bp, Homo sapiens
cttcaaagccttc

SEQ ID NO: 4855203 - DNA, 23 bp, Homo sapiens
cttcaacagccaagctggcacaa

SEQ ID NO: 4855204 - DNA, 18 bp, Homo sapiens
cttcaaggacattggtga

SEQ ID NO: 4855205 - DNA, 18 bp, Homo sapiens
cttcaagggtcagggtga

SEQ ID NO: 4855206 - DNA, 19 bp, Homo sapiens
cttcaatttctagtacctg

SEQ ID NO: 4855207 - DNA, 14 bp, Homo sapiens
cttcacaggcactc

SEQ ID NO: 4855208 - DNA, 15 bp, Homo sapiens
cttcacctccttctg

SEQ ID NO: 4855209 - DNA, 19 bp, Homo sapiens
cttcacctccttctgcagt

SEQ ID NO: 4855210 - DNA, 21 bp, Homo sapiens
cttcactgccccctccgtccc

SEQ ID NO: 4855211 - DNA, 16 bp, Homo sapiens
cttcagccaggcaaga

SEQ ID NO: 4855212 - DNA, 15 bp, Homo sapiens
cttcagccaggtctg

SEQ ID NO: 4855213 - DNA, 13 bp, Homo sapiens
cttcaggagcctg

SEQ ID NO: 4855214 - DNA, 15 bp, Homo sapiens
cttcaggagcctggc

SEQ ID NO: 4855215 - DNA, 16 bp, Homo sapiens
cttcaggagcctggcc

SEQ ID NO: 4855216 - DNA, 14 bp, Homo sapiens
tttaaaagcctgct

SEQ ID NO: 4855217 - DNA, 21 bp, Homo sapiens
tttaaaatgtaatttaaatga

SEQ ID NO: 4855218 - DNA, 22 bp, Homo sapiens
tttaaaatgtaatttaaatgaa

SEQ ID NO: 4855219 - DNA, 10 bp, Homo sapiens
tttaaaattt

SEQ ID NO: 4855220 - DNA, 17 bp, Homo sapiens
tttaaaattttgtatgt

SEQ ID NO: 4855221 - DNA, 21 bp, Homo sapiens
tttaaaattttgtatgttaaa

SEQ ID NO: 4855222 - DNA, 12 bp, Homo sapiens
tttaaagagaag

SEQ ID NO: 4855223 - DNA, 18 bp, Homo sapiens
tttaaaggcattagagtc

SEQ ID NO: 4855224 - DNA, 18 bp, Homo sapiens
tttaaagtctcagtttct

SEQ ID NO: 4855225 - DNA, 21 bp, Homo sapiens
tttaactgccgtaatttaact

SEQ ID NO: 4855226 - DNA, 13 bp, Homo sapiens
tttaactgtgata

SEQ ID NO: 4855227 - DNA, 13 bp, Homo sapiens
tttaactgtggat

SEQ ID NO: 4855228 - DNA, 17 bp, Homo sapiens
tttaagaactaaaatgt

SEQ ID NO: 4855229 - DNA, 18 bp, Homo sapiens
tttaagccttcaaaacta

SEQ ID NO: 4855230 - DNA, 14 bp, Homo sapiens
tttaagcttcagtt

SEQ ID NO: 4855231 - DNA, 21 bp, Homo sapiens
tttaagcttcagttgcttgtc

SEQ ID NO: 4855232 - DNA, 19 bp, Homo sapiens
tttaaggataaatcataaa

SEQ ID NO: 4855233 - DNA, 16 bp, Homo sapiens
tttaataaagatgagt

SEQ ID NO: 4855234 - DNA, 17 bp, Homo sapiens
tttaataaagatgagtt

SEQ ID NO: 4855235 - DNA, 13 bp, Homo sapiens
tttaatatatata

SEQ ID NO: 4855236 - DNA, 14 bp, Homo sapiens
tttaatggcagcta

SEQ ID NO: 4855237 - DNA, 18 bp, Homo sapiens
tttaatttcctgtgagga

SEQ ID NO: 4855238 - DNA, 14 bp, Homo sapiens
tttaattttcactt

SEQ ID NO: 4855239 - DNA, 20 bp, Homo sapiens
tttacagctgtgctccacac

SEQ ID NO: 4855240 - DNA, 13 bp, Homo sapiens
tttacccttcagg

SEQ ID NO: 4855241 - DNA, 13 bp, Homo sapiens
tttaccttgtata

SEQ ID NO: 4855242 - DNA, 18 bp, Homo sapiens
tttactgatgagagaatg

SEQ ID NO: 4855243 - DNA, 20 bp, Homo sapiens
tttactgatgagagaatgtg

SEQ ID NO: 4855244 - DNA, 11 bp, Homo sapiens
tttagaaatat

SEQ ID NO: 4855245 - DNA, 23 bp, Homo sapiens
tttagaagcctgacaactcattt

SEQ ID NO: 4855246 - DNA, 16 bp, Homo sapiens
tttagcttacctgggc

SEQ ID NO: 4855247 - DNA, 23 bp, Homo sapiens
tttagcttacctgggcacaaaca

SEQ ID NO: 4855248 - DNA, 17 bp, Homo sapiens
tttaggataaaataatg

SEQ ID NO: 4855249 - DNA, 22 bp, Homo sapiens
tttataaaagtgttcattgttt

SEQ ID NO: 4855250 - DNA, 15 bp, Homo sapiens
tttataaacagaaat

SEQ ID NO: 4855251 - DNA, 23 bp, Homo sapiens
tttataaacagaaatggaaagca

SEQ ID NO: 4855252 - DNA, 15 bp, Homo sapiens
tttataatactacta

SEQ ID NO: 4855253 - DNA, 15 bp, Homo sapiens
tttataattgtacaa

SEQ ID NO: 4855254 - DNA, 17 bp, Homo sapiens
tttataattgtacaaaa

SEQ ID NO: 4855255 - DNA, 18 bp, Homo sapiens
tttatattaaataacatg

SEQ ID NO: 4855256 - DNA, 19 bp, Homo sapiens
tttatattaaataacatgt

SEQ ID NO: 4855257 - DNA, 19 bp, Homo sapiens
tttatatttttttaactgt

SEQ ID NO: 4855258 - DNA, 19 bp, Homo sapiens
tttatcatgaatgctttta

SEQ ID NO: 4855259 - DNA, 14 bp, Homo sapiens
tttatgttctttca

SEQ ID NO: 4855260 - DNA, 19 bp, Homo sapiens
tttatgttctttcacccat

SEQ ID NO: 4855261 - DNA, 21 bp, Homo sapiens
tttattaaaatatttcaggtt

SEQ ID NO: 4855262 - DNA, 18 bp, Homo sapiens
tttattaaagcatttcct

SEQ ID NO: 4855263 - DNA, 12 bp, Homo sapiens
tttattaatgtt

SEQ ID NO: 4855264 - DNA, 21 bp, Homo sapiens
tttattccccagtgactccag

SEQ ID NO: 4855265 - DNA, 21 bp, Homo sapiens
tttattgagtacctactgtgt

SEQ ID NO: 4855266 - DNA, 12 bp, Homo sapiens
tttattgcaatg

SEQ ID NO: 4855267 - DNA, 16 bp, Homo sapiens
tttattgcaatgcaga

SEQ ID NO: 4855268 - DNA, 18 bp, Homo sapiens
tttatttacagctgtgct

SEQ ID NO: 4855269 - DNA, 16 bp, Homo sapiens
tttatttatttattca

SEQ ID NO: 4855270 - DNA, 16 bp, Homo sapiens
tttattttttaagaaa

SEQ ID NO: 4855271 - DNA, 20 bp, Homo sapiens
tttcaaaaggtattatacat

SEQ ID NO: 4855272 - DNA, 21 bp, Homo sapiens
tttcaaaaggtattatacatg

SEQ ID NO: 4855273 - DNA, 15 bp, Homo sapiens
tttcaacggaaagtg

SEQ ID NO: 4855274 - DNA, 13 bp, Homo sapiens
tttcactgtactg

SEQ ID NO: 4855275 - DNA, 17 bp, Homo sapiens
tttcactgtactgcatg

SEQ ID NO: 4855276 - DNA, 14 bp, Homo sapiens
tttcagaaatataa

SEQ ID NO: 4855277 - DNA, 20 bp, Homo sapiens
tttcaggactctctccagga

SEQ ID NO: 4855278 - DNA, 19 bp, Homo sapiens
tttcaggcattggatattt

SEQ ID NO: 4855279 - DNA, 12 bp, Homo sapiens
tttcatagatgt

SEQ ID NO: 4855280 - DNA, 14 bp, Homo sapiens
tttcatatttgggg

SEQ ID NO: 4855281 - DNA, 20 bp, Homo sapiens
tttcatggctgctgttgctt

SEQ ID NO: 4855282 - DNA, 16 bp, Homo sapiens
tttcattaaatccttt

SEQ ID NO: 4855283 - DNA, 19 bp, Homo sapiens
tttcatttagtcatgtgac

SEQ ID NO: 4855284 - DNA, 15 bp, Homo sapiens
tttccaaaacaaaaa

SEQ ID NO: 4855285 - DNA, 13 bp, Homo sapiens
tttcccctctcat

SEQ ID NO: 4855286 - DNA, 12 bp, Homo sapiens
tttcctccaccc

SEQ ID NO: 4855287 - DNA, 12 bp, Homo sapiens
tttcctgcatgt

SEQ ID NO: 4855288 - DNA, 22 bp, Homo sapiens
tttcctgtggcataaattgcat

SEQ ID NO: 4855289 - DNA, 18 bp, Homo sapiens
tttccttcaggcagctga

SEQ ID NO: 4855290 - DNA, 16 bp, Homo sapiens
tttccttttcaggaga

SEQ ID NO: 4855291 - DNA, 16 bp, Homo sapiens
tttccttttcttaaaa

SEQ ID NO: 4855292 - DNA, 16 bp, Homo sapiens
tttcgtaacacagcat

SEQ ID NO: 4855293 - DNA, 13 bp, Homo sapiens
tttctaaaagctt

SEQ ID NO: 4855294 - DNA, 12 bp, Homo sapiens
tttctaaagact

SEQ ID NO: 4855295 - DNA, 18 bp, Homo sapiens
tttctatattcctccagc

SEQ ID NO: 4855296 - DNA, 21 bp, Homo sapiens
tttctatattcctccagctgg

SEQ ID NO: 4855297 - DNA, 22 bp, Homo sapiens
tttctatattcctccagctggg

SEQ ID NO: 4855298 - DNA, 15 bp, Homo sapiens
tttctcatgttgaaa

SEQ ID NO: 4855299 - DNA, 15 bp, Homo sapiens
tttctttgcattcca

SEQ ID NO: 4855300 - DNA, 12 bp, Homo sapiens
tttctttggaaa

SEQ ID NO: 4855301 - DNA, 9 bp, Homo sapiens
tttcttttc

SEQ ID NO: 4855302 - DNA, 12 bp, Homo sapiens
tttgaaaaatat

SEQ ID NO: 4855303 - DNA, 20 bp, Homo sapiens
tttgaacatgtttaatgggt

SEQ ID NO: 4855304 - DNA, 11 bp, Homo sapiens
tttgaactttg

SEQ ID NO: 4855305 - DNA, 11 bp, Homo sapiens
tttgaagaagg

SEQ ID NO: 4855306 - DNA, 16 bp, Homo sapiens
tttgaaggagaatggc

SEQ ID NO: 4855307 - DNA, 21 bp, Homo sapiens
tttgaaggtagaatgttttca

SEQ ID NO: 4855308 - DNA, 21 bp, Homo sapiens
tttgaccagtttaagccgcag

SEQ ID NO: 4855309 - DNA, 16 bp, Homo sapiens
tttgatataccaaatt

SEQ ID NO: 4855310 - DNA, 17 bp, Homo sapiens
tttgattgggatgaatg

SEQ ID NO: 4855311 - DNA, 14 bp, Homo sapiens
tgcaaaaataatca

SEQ ID NO: 4855312 - DNA, 22 bp, Homo sapiens
tgcaaagtcgccagtcactgct

SEQ ID NO: 4855313 - DNA, 23 bp, Homo sapiens
tgcaaagtcgccagtcactgctg

SEQ ID NO: 4855314 - DNA, 20 bp, Homo sapiens
tgcaaatgagctctgaaatc

SEQ ID NO: 4855315 - DNA, 16 bp, Homo sapiens
tgcaacatctctgaat

SEQ ID NO: 4855316 - DNA, 16 bp, Homo sapiens
tgcaataaagtataat

SEQ ID NO: 4855317 - DNA, 16 bp, Homo sapiens
tgcaatagaaggtgat

SEQ ID NO: 4855318 - DNA, 20 bp, Homo sapiens
tgcaatagtgcaacatctct

SEQ ID NO: 4855319 - DNA, 17 bp, Homo sapiens
tgcaatcactgtgctat

SEQ ID NO: 4855320 - DNA, 19 bp, Homo sapiens
tgcaattaaacttccaaag

SEQ ID NO: 4855321 - DNA, 22 bp, Homo sapiens
tgcaattaaacttccaaagaaa

SEQ ID NO: 4855322 - DNA, 21 bp, Homo sapiens
tgcacactgtcctattatatt

SEQ ID NO: 4855323 - DNA, 21 bp, Homo sapiens
tgcacaggcagatgtttgcct

SEQ ID NO: 4855324 - DNA, 22 bp, Homo sapiens
tgcacataagcttccattttaa

SEQ ID NO: 4855325 - DNA, 17 bp, Homo sapiens
tgcacccgcctcgacct

SEQ ID NO: 4855326 - DNA, 12 bp, Homo sapiens
tgcactccagac

SEQ ID NO: 4855327 - DNA, 14 bp, Homo sapiens
tgcactccagactc

SEQ ID NO: 4855328 - DNA, 15 bp, Homo sapiens
tgcactccagactct

SEQ ID NO: 4855329 - DNA, 19 bp, Homo sapiens
tgcacttttgaatgtccaa

SEQ ID NO: 4855330 - DNA, 16 bp, Homo sapiens
tgcagaaatagacaaa

SEQ ID NO: 4855331 - DNA, 21 bp, Homo sapiens
tgcagaaatagacaaaaagta

SEQ ID NO: 4855332 - DNA, 15 bp, Homo sapiens
tgcagaactgtagct

SEQ ID NO: 4855333 - DNA, 15 bp, Homo sapiens
tgcagaagcaataat

SEQ ID NO: 4855334 - DNA, 13 bp, Homo sapiens
tgcagagatttct

SEQ ID NO: 4855335 - DNA, 18 bp, Homo sapiens
tgcagcagtcgcccaagc

SEQ ID NO: 4855336 - DNA, 15 bp, Homo sapiens
tgcagccgcagagaa

SEQ ID NO: 4855337 - DNA, 18 bp, Homo sapiens
tgcagccgcagagaaatg

SEQ ID NO: 4855338 - DNA, 22 bp, Homo sapiens
tgcagcctaagaagaaggccag

SEQ ID NO: 4855339 - DNA, 19 bp, Homo sapiens
tgcagccttcatcagaact

SEQ ID NO: 4855340 - DNA, 20 bp, Homo sapiens
tgcagccttcatcagaactc

SEQ ID NO: 4855341 - DNA, 13 bp, Homo sapiens
tgcaggagcttct

SEQ ID NO: 4855342 - DNA, 15 bp, Homo sapiens
tgcagggaggggagg

SEQ ID NO: 4855343 - DNA, 11 bp, Homo sapiens
tgcagtcagac

SEQ ID NO: 4855344 - DNA, 15 bp, Homo sapiens
tgcagtcagactgaa

SEQ ID NO: 4855345 - DNA, 19 bp, Homo sapiens
tgcagttggactctcaggg

SEQ ID NO: 4855346 - DNA, 13 bp, Homo sapiens
tgcagtttggaat

SEQ ID NO: 4855347 - DNA, 17 bp, Homo sapiens
tgcataatagctacagt

SEQ ID NO: 4855348 - DNA, 17 bp, Homo sapiens
tgcataatgtttctgga

SEQ ID NO: 4855349 - DNA, 22 bp, Homo sapiens
tgcatactttgtattttgatta

SEQ ID NO: 4855350 - DNA, 15 bp, Homo sapiens
tgcatagcagtatat

SEQ ID NO: 4855351 - DNA, 17 bp, Homo sapiens
tgcatataatgaataaa

SEQ ID NO: 4855352 - DNA, 19 bp, Homo sapiens
tgcatccgggggcagctct

SEQ ID NO: 4855353 - DNA, 22 bp, Homo sapiens
tgcatgcaaatgagctctgaaa

SEQ ID NO: 4855354 - DNA, 18 bp, Homo sapiens
tgcatgcatgcaaatgag

SEQ ID NO: 4855355 - DNA, 15 bp, Homo sapiens
tgcatggagaatggg

SEQ ID NO: 4855356 - DNA, 16 bp, Homo sapiens
tgcatggagaatggga

SEQ ID NO: 4855357 - DNA, 16 bp, Homo sapiens
tgcatgtgacttctcc

SEQ ID NO: 4855358 - DNA, 17 bp, Homo sapiens
tgcattattaaattgta

SEQ ID NO: 4855359 - DNA, 14 bp, Homo sapiens
tgcatttaataaag

SEQ ID NO: 4855360 - DNA, 16 bp, Homo sapiens
tgcatttgatacattt

SEQ ID NO: 4855361 - DNA, 15 bp, Homo sapiens
tgcatttttattaaa

SEQ ID NO: 4855362 - DNA, 15 bp, Homo sapiens
tgccaaaggatgtga

SEQ ID NO: 4855363 - DNA, 17 bp, Homo sapiens
tgccaaaggatgtgata

SEQ ID NO: 4855364 - DNA, 13 bp, Homo sapiens
tgccaaggagcat

SEQ ID NO: 4855365 - DNA, 20 bp, Homo sapiens
tgccaataaagtgatctgtg

SEQ ID NO: 4855366 - DNA, 20 bp, Homo sapiens
tgccaatctgtacaaaatgg

SEQ ID NO: 4855367 - DNA, 15 bp, Homo sapiens
tgccagcaagtcctt

SEQ ID NO: 4855368 - DNA, 21 bp, Homo sapiens
tgccagccccctaaaagcact

SEQ ID NO: 4855369 - DNA, 13 bp, Homo sapiens
tgccaggggctct

SEQ ID NO: 4855370 - DNA, 14 bp, Homo sapiens
tgccaggggctctg

SEQ ID NO: 4855371 - DNA, 18 bp, Homo sapiens
tgccaggggctctgtggc

SEQ ID NO: 4855372 - DNA, 13 bp, Homo sapiens
tgccagtattttt

SEQ ID NO: 4855373 - DNA, 19 bp, Homo sapiens
tgccagttacttgggcttc

SEQ ID NO: 4855374 - DNA, 19 bp, Homo sapiens
tgccataaatatttctcaa

SEQ ID NO: 4855375 - DNA, 20 bp, Homo sapiens
tgcccaatgaataatggaaa

SEQ ID NO: 4855376 - DNA, 17 bp, Homo sapiens
tgcccagactacagggc

SEQ ID NO: 4855377 - DNA, 23 bp, Homo sapiens
tgcccaggcatgaaattcttcct

SEQ ID NO: 4855378 - DNA, 17 bp, Homo sapiens
tgccccactacaggccc

SEQ ID NO: 4855379 - DNA, 13 bp, Homo sapiens
tgcccccattccc

SEQ ID NO: 4855380 - DNA, 20 bp, Homo sapiens
tgcccccattcccagcctga

SEQ ID NO: 4855381 - DNA, 19 bp, Homo sapiens
tgcccctaaagagcatcct

SEQ ID NO: 4855382 - DNA, 21 bp, Homo sapiens
tgcccctaaagagcatcctga

SEQ ID NO: 4855383 - DNA, 23 bp, Homo sapiens
tgcccctaaagagcatcctgata

SEQ ID NO: 4855384 - DNA, 18 bp, Homo sapiens
tgccccttccctgggttt

SEQ ID NO: 4855385 - DNA, 18 bp, Homo sapiens
tgcccgcctaagaccctg

SEQ ID NO: 4855386 - DNA, 20 bp, Homo sapiens
tgcccgcctaagaccctgaa

SEQ ID NO: 4855387 - DNA, 22 bp, Homo sapiens
tgccctcactgcctctttgcag

SEQ ID NO: 4855388 - DNA, 12 bp, Homo sapiens
tgccctcctctc

SEQ ID NO: 4855389 - DNA, 18 bp, Homo sapiens
tgccctctgctctgcctg

SEQ ID NO: 4855390 - DNA, 23 bp, Homo sapiens
tgccctgccagctgcagcctggt

SEQ ID NO: 4855391 - DNA, 23 bp, Homo sapiens
tgcccttcctcctgatggagtgt

SEQ ID NO: 4855392 - DNA, 20 bp, Homo sapiens
tgccgtagcttcagccaggc

SEQ ID NO: 4855393 - DNA, 14 bp, Homo sapiens
tgcctaacctggga

SEQ ID NO: 4855394 - DNA, 18 bp, Homo sapiens
tgcctatttcccccttca

SEQ ID NO: 4855395 - DNA, 20 bp, Homo sapiens
tgcctcagtagcatctcagt

SEQ ID NO: 4855396 - DNA, 18 bp, Homo sapiens
tgcctcattttgcttccc

SEQ ID NO: 4855397 - DNA, 19 bp, Homo sapiens
tgcctcattttgcttccca

SEQ ID NO: 4855398 - DNA, 20 bp, Homo sapiens
tgcctccaggaccttgcttc

SEQ ID NO: 4855399 - DNA, 12 bp, Homo sapiens
tgcctcggacag

SEQ ID NO: 4855400 - DNA, 17 bp, Homo sapiens
tgcctggaggctcctct

SEQ ID NO: 4855401 - DNA, 24 bp, Homo sapiens
tgcctggaggctcctctaggccct

SEQ ID NO: 4855402 - DNA, 18 bp, Homo sapiens
tgcctgggctcagcctgg

SEQ ID NO: 4855403 - DNA, 19 bp, Homo sapiens
tgcctgggctcagcctggt

SEQ ID NO: 4855404 - DNA, 17 bp, Homo sapiens
tgcctggggcctccaga

SEQ ID NO: 4855405 - DNA, 21 bp, Homo sapiens
tgcctggggcctccagaagct

SEQ ID NO: 4855406 - DNA, 14 bp, Homo sapiens
tgcctgtctgaagc

SEQ ID NO: 4855407 - DNA, 16 bp, Homo sapiens
tgccttcgtttatatt

SEQ ID NO: 4855408 - DNA, 13 bp, Homo sapiens
tgctaaatgtgta

SEQ ID NO: 4855409 - DNA, 14 bp, Homo sapiens
tgctaaatgtgtaa

SEQ ID NO: 4855410 - DNA, 16 bp, Homo sapiens
tgctaaggctcctcct

SEQ ID NO: 4855411 - DNA, 19 bp, Homo sapiens
tgctaagtcattggcaaag

SEQ ID NO: 4855412 - DNA, 15 bp, Homo sapiens
tgctactgctgctgc

SEQ ID NO: 4855413 - DNA, 23 bp, Homo sapiens
tgctagatccagcccaaacctgg

SEQ ID NO: 4855414 - DNA, 19 bp, Homo sapiens
tgctagtgggccctctctc

SEQ ID NO: 4855415 - DNA, 22 bp, Homo sapiens
tgctagtgggccctctctctgg

SEQ ID NO: 4855416 - DNA, 19 bp, Homo sapiens
tgctatcttttttagtgtt

SEQ ID NO: 4855417 - DNA, 23 bp, Homo sapiens
tgctatttttaatttcctgtgag

SEQ ID NO: 4855418 - DNA, 15 bp, Homo sapiens
tgctcaaaaagaaat

SEQ ID NO: 4855419 - DNA, 22 bp, Homo sapiens
tgctcactcccaagggacagca

SEQ ID NO: 4855420 - DNA, 13 bp, Homo sapiens
tgctcatgctgct

SEQ ID NO: 4855421 - DNA, 15 bp, Homo sapiens
tgctccacactcaga

SEQ ID NO: 4855422 - DNA, 16 bp, Homo sapiens
tgctccacactcagaa

SEQ ID NO: 4855423 - DNA, 17 bp, Homo sapiens
tgctccacactcagaaa

SEQ ID NO: 4855424 - DNA, 20 bp, Homo sapiens
tgctccacactcagaaaatt

SEQ ID NO: 4855425 - DNA, 19 bp, Homo sapiens
tgctcccctaaagccaggc

SEQ ID NO: 4855426 - DNA, 21 bp, Homo sapiens
tgctcccctaaagccaggctc

SEQ ID NO: 4855427 - DNA, 15 bp, Homo sapiens
tgctcctcacctgtc

SEQ ID NO: 4855428 - DNA, 19 bp, Homo sapiens
tgctcctgtggcaggaggc

SEQ ID NO: 4855429 - DNA, 14 bp, Homo sapiens
tgctcctttaccct

SEQ ID NO: 4855430 - DNA, 16 bp, Homo sapiens
ttctccatggagccta

SEQ ID NO: 4855431 - DNA, 16 bp, Homo sapiens
ttctcccctgcccttc

SEQ ID NO: 4855432 - DNA, 19 bp, Homo sapiens
ttctctcccttcctctctc

SEQ ID NO: 4855433 - DNA, 20 bp, Homo sapiens
ttctctcctcccctacacca

SEQ ID NO: 4855434 - DNA, 20 bp, Homo sapiens
ttctgaagtatgaagtctga

SEQ ID NO: 4855435 - DNA, 13 bp, Homo sapiens
ttctgaggccaga

SEQ ID NO: 4855436 - DNA, 16 bp, Homo sapiens
ttctgcagtcagactg

SEQ ID NO: 4855437 - DNA, 15 bp, Homo sapiens
ttctgccctgccagc

SEQ ID NO: 4855438 - DNA, 15 bp, Homo sapiens
ttctgggtccaggga

SEQ ID NO: 4855439 - DNA, 15 bp, Homo sapiens
ttctggtactttctg

SEQ ID NO: 4855440 - DNA, 17 bp, Homo sapiens
ttctggtactttctgtt

SEQ ID NO: 4855441 - DNA, 17 bp, Homo sapiens
ttctgtagagccaatta

SEQ ID NO: 4855442 - DNA, 13 bp, Homo sapiens
ttctgtatttcct

SEQ ID NO: 4855443 - DNA, 23 bp, Homo sapiens
ttctgtgactgaagaagatgagc

SEQ ID NO: 4855444 - DNA, 14 bp, Homo sapiens
ttctgtttaatttt

SEQ ID NO: 4855445 - DNA, 18 bp, Homo sapiens
ttcttcactcaaattttg

SEQ ID NO: 4855446 - DNA, 21 bp, Homo sapiens
ttcttgtgggagacagcagcc

SEQ ID NO: 4855447 - DNA, 19 bp, Homo sapiens
ttctttagcttacctgggc

SEQ ID NO: 4855448 - DNA, 20 bp, Homo sapiens
ttctttagcttacctgggca

SEQ ID NO: 4855449 - DNA, 19 bp, Homo sapiens
ttctttcagttctttggat

SEQ ID NO: 4855450 - DNA, 12 bp, Homo sapiens
ttctttctccat

SEQ ID NO: 4855451 - DNA, 19 bp, Homo sapiens
ttctttcttccacccacaa

SEQ ID NO: 4855452 - DNA, 13 bp, Homo sapiens
aaaaaaaaagtca

SEQ ID NO: 4855453 - DNA, 18 bp, Homo sapiens
aaaaaaacagtggatcac

SEQ ID NO: 4855454 - DNA, 14 bp, Homo sapiens
aaaaacaattaact

SEQ ID NO: 4855455 - DNA, 19 bp, Homo sapiens
aaaaacaattaactgccct

SEQ ID NO: 4855456 - DNA, 11 bp, Homo sapiens
aaaaacatttt

SEQ ID NO: 4855457 - DNA, 13 bp, Homo sapiens
aaaaagccacagc

SEQ ID NO: 4855458 - DNA, 21 bp, Homo sapiens
aaaaatcatgccagtattttt

SEQ ID NO: 4855459 - DNA, 22 bp, Homo sapiens
aaaaatgagcttgattaaatca

SEQ ID NO: 4855460 - DNA, 19 bp, Homo sapiens
aaaaatggaaaaataaaca

SEQ ID NO: 4855461 - DNA, 15 bp, Homo sapiens
aaaacaaaaagatgt

SEQ ID NO: 4855462 - DNA, 13 bp, Homo sapiens
aaaacatttgctg

SEQ ID NO: 4855463 - DNA, 14 bp, Homo sapiens
aaaactaaatttca

SEQ ID NO: 4855464 - DNA, 20 bp, Homo sapiens
aaaagaaagatacttacatg

SEQ ID NO: 4855465 - DNA, 18 bp, Homo sapiens
aaaagctgcaaaaattat

SEQ ID NO: 4855466 - DNA, 13 bp, Homo sapiens
aaaagctttcatg

SEQ ID NO: 4855467 - DNA, 14 bp, Homo sapiens
aaaagggagttttt

SEQ ID NO: 4855468 - DNA, 17 bp, Homo sapiens
aaaagggtcagaaggat

SEQ ID NO: 4855469 - DNA, 16 bp, Homo sapiens
aaaagtataaaatagt

SEQ ID NO: 4855470 - DNA, 23 bp, Homo sapiens
aaaagttgggttttctccattca

SEQ ID NO: 4855471 - DNA, 20 bp, Homo sapiens
aaaataaataaaaactaatt

SEQ ID NO: 4855472 - DNA, 18 bp, Homo sapiens
aaaatatatttataagga

SEQ ID NO: 4855473 - DNA, 15 bp, Homo sapiens
aaaatcactttcata

SEQ ID NO: 4855474 - DNA, 16 bp, Homo sapiens
aaaatcttttgaagca

SEQ ID NO: 4855475 - DNA, 14 bp, Homo sapiens
aaaatgaaagctac

SEQ ID NO: 4855476 - DNA, 19 bp, Homo sapiens
aaaatgaaagctactcata

SEQ ID NO: 4855477 - DNA, 16 bp, Homo sapiens
aaaatgagcttgatta

SEQ ID NO: 4855478 - DNA, 17 bp, Homo sapiens
aaaatgtctgtaataat

SEQ ID NO: 4855479 - DNA, 18 bp, Homo sapiens
aaaatgtctgtaataata

SEQ ID NO: 4855480 - DNA, 23 bp, Homo sapiens
aaaattatgcaattcagtgttcc

SEQ ID NO: 4855481 - DNA, 23 bp, Homo sapiens
aaaattccctggggtcaccttct

SEQ ID NO: 4855482 - DNA, 13 bp, Homo sapiens
aaaatttatattt

SEQ ID NO: 4855483 - DNA, 18 bp, Homo sapiens
aaaattttgtatgttaaa

SEQ ID NO: 4855484 - DNA, 16 bp, Homo sapiens
aaacaaaaagatgtct

SEQ ID NO: 4855485 - DNA, 12 bp, Homo sapiens
aaacaaagatgt

SEQ ID NO: 4855486 - DNA, 23 bp, Homo sapiens
aaacaaagtttcagagtatattg

SEQ ID NO: 4855487 - DNA, 20 bp, Homo sapiens
aaacacccgacgtcatgtat

SEQ ID NO: 4855488 - DNA, 23 bp, Homo sapiens
aaacagtggatcacaaagtggaa

SEQ ID NO: 4855489 - DNA, 13 bp, Homo sapiens
aaacatcattgtt

SEQ ID NO: 4855490 - DNA, 22 bp, Homo sapiens
aaacatgggctgtgattactgc

SEQ ID NO: 4855491 - DNA, 16 bp, Homo sapiens
aaacatgttaatgaca

SEQ ID NO: 4855492 - DNA, 19 bp, Homo sapiens
aaaccaacaagaaccactc

SEQ ID NO: 4855493 - DNA, 18 bp, Homo sapiens
aaaccctcattgtgtttc

SEQ ID NO: 4855494 - DNA, 12 bp, Homo sapiens
aaacctggcaga

SEQ ID NO: 4855495 - DNA, 17 bp, Homo sapiens
aaacctgggaaggccag

SEQ ID NO: 4855496 - DNA, 18 bp, Homo sapiens
aaacgaaaacctgactag

SEQ ID NO: 4855497 - DNA, 16 bp, Homo sapiens
aaacgattagtgatgt

SEQ ID NO: 4855498 - DNA, 23 bp, Homo sapiens
aaacgtcctctttagtttttggt

SEQ ID NO: 4855499 - DNA, 16 bp, Homo sapiens
aaactactgaatgaag

SEQ ID NO: 4855500 - DNA, 21 bp, Homo sapiens
aaactactgaatgaagcagta

SEQ ID NO: 4855501 - DNA, 23 bp, Homo sapiens
aaactcaggatggtcatcttgga

SEQ ID NO: 4855502 - DNA, 16 bp, Homo sapiens
aaactccctggctgtt

SEQ ID NO: 4855503 - DNA, 11 bp, Homo sapiens
aaactctgctg

SEQ ID NO: 4855504 - DNA, 22 bp, Homo sapiens
aaactgcttcccttactttgct

SEQ ID NO: 4855505 - DNA, 16 bp, Homo sapiens
aaacttcatgtaattt

SEQ ID NO: 4855506 - DNA, 18 bp, Homo sapiens
aaacttccaaagaaagtt

SEQ ID NO: 4855507 - DNA, 17 bp, Homo sapiens
aaactttgggaaaacat

SEQ ID NO: 4855508 - DNA, 15 bp, Homo sapiens
aaagataaagaccag

SEQ ID NO: 4855509 - DNA, 23 bp, Homo sapiens
aaagatgcatcatctcttcctca

SEQ ID NO: 4855510 - DNA, 17 bp, Homo sapiens
aaagcaaaggtgcactc

SEQ ID NO: 4855511 - DNA, 22 bp, Homo sapiens
aaagcaaaggtgcactccagac

SEQ ID NO: 4855512 - DNA, 23 bp, Homo sapiens
aaagcaatttactgatgagagaa

SEQ ID NO: 4855513 - DNA, 15 bp, Homo sapiens
aaagcacaagactgg

SEQ ID NO: 4855514 - DNA, 19 bp, Homo sapiens
aaagcacaagactggccca

SEQ ID NO: 4855515 - DNA, 17 bp, Homo sapiens
aaagcactggccttgcc

SEQ ID NO: 4855516 - DNA, 22 bp, Homo sapiens
aaagcaggcttgcccagtacat

SEQ ID NO: 4855517 - DNA, 24 bp, Homo sapiens
aaagcaggcttgcccagtacattt

SEQ ID NO: 4855518 - DNA, 18 bp, Homo sapiens
aaagcagttcctgtccca

SEQ ID NO: 4855519 - DNA, 16 bp, Homo sapiens
aaccagctcagtgttt

SEQ ID NO: 4855520 - DNA, 16 bp, Homo sapiens
aacccagtttcccgtc

SEQ ID NO: 4855521 - DNA, 18 bp, Homo sapiens
aaccctccaaaggaactc

SEQ ID NO: 4855522 - DNA, 23 bp, Homo sapiens
aaccctccaaaggaactctagag

SEQ ID NO: 4855523 - DNA, 14 bp, Homo sapiens
aacctaattaatat

SEQ ID NO: 4855524 - DNA, 18 bp, Homo sapiens
aacctaattaatatatta

SEQ ID NO: 4855525 - DNA, 13 bp, Homo sapiens
aacctacattcca

SEQ ID NO: 4855526 - DNA, 16 bp, Homo sapiens
aacctacattccaccc

SEQ ID NO: 4855527 - DNA, 21 bp, Homo sapiens
aacctagttaaagaaaggaaa

SEQ ID NO: 4855528 - DNA, 22 bp, Homo sapiens
aacctagttaaagaaaggaaaa

SEQ ID NO: 4855529 - DNA, 12 bp, Homo sapiens
aacctccagact

SEQ ID NO: 4855530 - DNA, 13 bp, Homo sapiens
aacctccagactc

SEQ ID NO: 4855531 - DNA, 19 bp, Homo sapiens
aacctccagactcagcaga

SEQ ID NO: 4855532 - DNA, 16 bp, Homo sapiens
aacctcgggcctgctg

SEQ ID NO: 4855533 - DNA, 18 bp, Homo sapiens
aacctctaagtgctgctg

SEQ ID NO: 4855534 - DNA, 19 bp, Homo sapiens
aacctctaagtgctgctgt

SEQ ID NO: 4855535 - DNA, 23 bp, Homo sapiens
aacctctaagtgctgctgtggag

SEQ ID NO: 4855536 - DNA, 15 bp, Homo sapiens
aacctgccaaggagc

SEQ ID NO: 4855537 - DNA, 19 bp, Homo sapiens
aacctgccaaggagcatcc

SEQ ID NO: 4855538 - DNA, 15 bp, Homo sapiens
aacctgggaaggcca

SEQ ID NO: 4855539 - DNA, 20 bp, Homo sapiens
aacctgggaaggccagcctt

SEQ ID NO: 4855540 - DNA, 21 bp, Homo sapiens
aacctttgagtagatccattt

SEQ ID NO: 4855541 - DNA, 16 bp, Homo sapiens
aacgaaatatcaaagt

SEQ ID NO: 4855542 - DNA, 15 bp, Homo sapiens
aactaaaatgttcta

SEQ ID NO: 4855543 - DNA, 14 bp, Homo sapiens
aactaaattttaaa

SEQ ID NO: 4855544 - DNA, 16 bp, Homo sapiens
aactaaattttaaagc

SEQ ID NO: 4855545 - DNA, 19 bp, Homo sapiens
aactactgaatgaagcagt

SEQ ID NO: 4855546 - DNA, 23 bp, Homo sapiens
aactactgaatgaagcagtattt

SEQ ID NO: 4855547 - DNA, 13 bp, Homo sapiens
aactcaaatacac

SEQ ID NO: 4855548 - DNA, 16 bp, Homo sapiens
aactcacacccctgcc

SEQ ID NO: 4855549 - DNA, 23 bp, Homo sapiens
aactcattttcatattgtaatct

SEQ ID NO: 4855550 - DNA, 13 bp, Homo sapiens
aactcccccagag

SEQ ID NO: 4855551 - DNA, 21 bp, Homo sapiens
aactcctataaagtgcctcgg

SEQ ID NO: 4855552 - DNA, 23 bp, Homo sapiens
aactctaaccaaggctgtgttta

SEQ ID NO: 4855553 - DNA, 18 bp, Homo sapiens
aactctacccctgctccc

SEQ ID NO: 4855554 - DNA, 15 bp, Homo sapiens
aactctgcatgtaga

SEQ ID NO: 4855555 - DNA, 15 bp, Homo sapiens
aactctgttccccca

SEQ ID NO: 4855556 - DNA, 13 bp, Homo sapiens
aactgtactgaat

SEQ ID NO: 4855557 - DNA, 18 bp, Homo sapiens
aactgtggatattgttac

SEQ ID NO: 4855558 - DNA, 15 bp, Homo sapiens
aactgtgtgattaaa

SEQ ID NO: 4855559 - DNA, 19 bp, Homo sapiens
aactgttggaatggatttt

SEQ ID NO: 4855560 - DNA, 13 bp, Homo sapiens
aactgtttagatg

SEQ ID NO: 4855561 - DNA, 17 bp, Homo sapiens
aacttattctttgagta

SEQ ID NO: 4855562 - DNA, 14 bp, Homo sapiens
aacttccaaagaaa

SEQ ID NO: 4855563 - DNA, 16 bp, Homo sapiens
aacttccaaagaaagt

SEQ ID NO: 4855564 - DNA, 17 bp, Homo sapiens
aacttccaaagaaagtt

SEQ ID NO: 4855565 - DNA, 23 bp, Homo sapiens
aacttccaaataaataattttca

SEQ ID NO: 4855566 - DNA, 17 bp, Homo sapiens
aacttcctgtggatgca

SEQ ID NO: 4855567 - DNA, 19 bp, Homo sapiens
aacttctgcaacaagcatg

SEQ ID NO: 4855568 - DNA, 18 bp, Homo sapiens
aactttgtaaaaatcttt

SEQ ID NO: 4855569 - DNA, 13 bp, Homo sapiens
aagaaaaaaagct

SEQ ID NO: 4855570 - DNA, 14 bp, Homo sapiens
aagaaaattgagtt

SEQ ID NO: 4855571 - DNA, 18 bp, Homo sapiens
aagaaaatttgccaatct

SEQ ID NO: 4855572 - DNA, 23 bp, Homo sapiens
aagaaaatttgccaatctttcct

SEQ ID NO: 4855573 - DNA, 14 bp, Homo sapiens
aagaaacaaagatg

SEQ ID NO: 4855574 - DNA, 17 bp, Homo sapiens
aagaaatactcatgtgc

SEQ ID NO: 4855575 - DNA, 13 bp, Homo sapiens
aagaaatggtgaa

SEQ ID NO: 4855576 - DNA, 12 bp, Homo sapiens
aagaacataaac

SEQ ID NO: 4855577 - DNA, 14 bp, Homo sapiens
aagaagaaggccag

SEQ ID NO: 4855578 - DNA, 18 bp, Homo sapiens
aaacctgggaaggccagc

SEQ ID NO: 4855579 - DNA, 14 bp, Homo sapiens
aaacgtcctcttta

SEQ ID NO: 4855580 - DNA, 13 bp, Homo sapiens
aaactaaatttca

SEQ ID NO: 4855581 - DNA, 15 bp, Homo sapiens
aaactccaggctgga

SEQ ID NO: 4855582 - DNA, 22 bp, Homo sapiens
aaactcgagaccataaagatat

SEQ ID NO: 4855583 - DNA, 16 bp, Homo sapiens
aaactgaggcccagag

SEQ ID NO: 4855584 - DNA, 22 bp, Homo sapiens
aaactgaggcccagagagggaa

SEQ ID NO: 4855585 - DNA, 15 bp, Homo sapiens
aaactgggatgtaag

SEQ ID NO: 4855586 - DNA, 19 bp, Homo sapiens
aaactgttggaatggattt

SEQ ID NO: 4855587 - DNA, 21 bp, Homo sapiens
aaacttcatgtaattttattt

SEQ ID NO: 4855588 - DNA, 22 bp, Homo sapiens
aaagaaaaaaaaaaaagccagc

SEQ ID NO: 4855589 - DNA, 19 bp, Homo sapiens
aaagaaaacaaaaaacgaa

SEQ ID NO: 4855590 - DNA, 16 bp, Homo sapiens
aaagaaaacccacccc

SEQ ID NO: 4855591 - DNA, 13 bp, Homo sapiens
aaagaaaatgaaa

SEQ ID NO: 4855592 - DNA, 17 bp, Homo sapiens
aaagaaggaaagatggt

SEQ ID NO: 4855593 - DNA, 17 bp, Homo sapiens
aaagacagctggcggag

SEQ ID NO: 4855594 - DNA, 22 bp, Homo sapiens
aaagaccctcctattctataaa

SEQ ID NO: 4855595 - DNA, 13 bp, Homo sapiens
aaagacttaaagg

SEQ ID NO: 4855596 - DNA, 15 bp, Homo sapiens
aaagagaaagagttt

SEQ ID NO: 4855597 - DNA, 12 bp, Homo sapiens
aaagagaatgag

SEQ ID NO: 4855598 - DNA, 13 bp, Homo sapiens
aaagatacttaca

SEQ ID NO: 4855599 - DNA, 20 bp, Homo sapiens
aaagatggttaaacattttc

SEQ ID NO: 4855600 - DNA, 23 bp, Homo sapiens
aaagatgtctctgcaaaccaaca

SEQ ID NO: 4855601 - DNA, 13 bp, Homo sapiens
aaagcataaagct

SEQ ID NO: 4855602 - DNA, 21 bp, Homo sapiens
aaagcataaagctcaaatgaa

SEQ ID NO: 4855603 - DNA, 18 bp, Homo sapiens
aaagcatggacatttaga

SEQ ID NO: 4855604 - DNA, 11 bp, Homo sapiens
aaagccacagc

SEQ ID NO: 4855605 - DNA, 23 bp, Homo sapiens
aaagccaggctcaggagaagcca

SEQ ID NO: 4855606 - DNA, 17 bp, Homo sapiens
aaagccattctgattat

SEQ ID NO: 4855607 - DNA, 17 bp, Homo sapiens
aaagcctgggtgacatt

SEQ ID NO: 4855608 - DNA, 21 bp, Homo sapiens
aaagctgatttttgtctttta

SEQ ID NO: 4855609 - DNA, 14 bp, Homo sapiens
aaagctgatttttt

SEQ ID NO: 4855610 - DNA, 14 bp, Homo sapiens
aaagctgtgtttat

SEQ ID NO: 4855611 - DNA, 16 bp, Homo sapiens
aaaggaaaatgtctgt

SEQ ID NO: 4855612 - DNA, 18 bp, Homo sapiens
aaaggaaagctgtgttta

SEQ ID NO: 4855613 - DNA, 14 bp, Homo sapiens
aaaggaactctaga

SEQ ID NO: 4855614 - DNA, 13 bp, Homo sapiens
aaaggaggtgaaa

SEQ ID NO: 4855615 - DNA, 13 bp, Homo sapiens
aaaggataaagaa

SEQ ID NO: 4855616 - DNA, 15 bp, Homo sapiens
aaaggcaggtgcttt

SEQ ID NO: 4855617 - DNA, 15 bp, Homo sapiens
aaaggcattagagtc

SEQ ID NO: 4855618 - DNA, 15 bp, Homo sapiens
aaaggccagcagctg

SEQ ID NO: 4855619 - DNA, 18 bp, Homo sapiens
aaaggcccttagagggaa

SEQ ID NO: 4855620 - DNA, 19 bp, Homo sapiens
aaaggcccttagagggaat

SEQ ID NO: 4855621 - DNA, 15 bp, Homo sapiens
aaaggtgcactccag

SEQ ID NO: 4855622 - DNA, 17 bp, Homo sapiens
aaaggtgcactccagac

SEQ ID NO: 4855623 - DNA, 17 bp, Homo sapiens
aaaggttgaataatata

SEQ ID NO: 4855624 - DNA, 19 bp, Homo sapiens
aaaggttgaataatatatg

SEQ ID NO: 4855625 - DNA, 14 bp, Homo sapiens
aaagtacagaattt

SEQ ID NO: 4855626 - DNA, 21 bp, Homo sapiens
aaagtacagaatttgaattat

SEQ ID NO: 4855627 - DNA, 21 bp, Homo sapiens
aaagtacttgactacctactg

SEQ ID NO: 4855628 - DNA, 18 bp, Homo sapiens
aaagtagtgttgtccagg

SEQ ID NO: 4855629 - DNA, 13 bp, Homo sapiens
aaagtataatgtt

SEQ ID NO: 4855630 - DNA, 16 bp, Homo sapiens
aaagtataatgtttat

SEQ ID NO: 4855631 - DNA, 23 bp, Homo sapiens
aaagtataatgtttattaaatgc

SEQ ID NO: 4855632 - DNA, 18 bp, Homo sapiens
aaagtatgcattattaaa

SEQ ID NO: 4855633 - DNA, 19 bp, Homo sapiens
aaagtatgcattattaaat

SEQ ID NO: 4855634 - DNA, 20 bp, Homo sapiens
aaagtatgcattattaaatt

SEQ ID NO: 4855635 - DNA, 14 bp, Homo sapiens
aaagtcagaatcag

SEQ ID NO: 4855636 - DNA, 21 bp, Homo sapiens
aaagtcgccagtcactgctgc

SEQ ID NO: 4855637 - DNA, 16 bp, Homo sapiens
aaagtgtgtatatatt

SEQ ID NO: 4855638 - DNA, 18 bp, Homo sapiens
aaagtgtgtatatatttt

SEQ ID NO: 4855639 - DNA, 19 bp, Homo sapiens
aaagtgtgtatatattttg

SEQ ID NO: 4855640 - DNA, 23 bp, Homo sapiens
aaagtgtgtatatattttgtgtg

SEQ ID NO: 4855641 - DNA, 13 bp, Homo sapiens
aaagtgttgtatc

SEQ ID NO: 4855642 - DNA, 17 bp, Homo sapiens
aaagttttatatgcttt

SEQ ID NO: 4855643 - DNA, 15 bp, Homo sapiens
aaataaaaactaatt

SEQ ID NO: 4855644 - DNA, 12 bp, Homo sapiens
aaataacagtat

SEQ ID NO: 4855645 - DNA, 18 bp, Homo sapiens
aaataactgaatttggag

SEQ ID NO: 4855646 - DNA, 16 bp, Homo sapiens
aaataagaaataatgc

SEQ ID NO: 4855647 - DNA, 14 bp, Homo sapiens
aaataataaaaaga

SEQ ID NO: 4855648 - DNA, 13 bp, Homo sapiens
aaataatgctaca

SEQ ID NO: 4855649 - DNA, 19 bp, Homo sapiens
aaataatgctacaatttta

SEQ ID NO: 4855650 - DNA, 14 bp, Homo sapiens
aaataatttgaact

SEQ ID NO: 4855651 - DNA, 19 bp, Homo sapiens
aaataatttgaactttgga

SEQ ID NO: 4855652 - DNA, 12 bp, Homo sapiens
aaatacacattt

SEQ ID NO: 4855653 - DNA, 13 bp, Homo sapiens
aaatacacatttg

SEQ ID NO: 4855654 - DNA, 14 bp, Homo sapiens
aaatacacatttgc

SEQ ID NO: 4855655 - DNA, 19 bp, Homo sapiens
aaatacatgcatataatga

SEQ ID NO: 4855656 - DNA, 12 bp, Homo sapiens
aaataccattta

SEQ ID NO: 4855657 - DNA, 22 bp, Homo sapiens
aaataccatttagtaagaatac

SEQ ID NO: 4855658 - DNA, 16 bp, Homo sapiens
aaatactattgcctca

SEQ ID NO: 4855659 - DNA, 18 bp, Homo sapiens
aaatagattcagagaaat

SEQ ID NO: 4855660 - DNA, 15 bp, Homo sapiens
aaatagtgtgaaata

SEQ ID NO: 4855661 - DNA, 13 bp, Homo sapiens
aaatataaaatta

SEQ ID NO: 4855662 - DNA, 14 bp, Homo sapiens
aaatataacacatt

SEQ ID NO: 4855663 - DNA, 17 bp, Homo sapiens
aaatatatcttataaag

SEQ ID NO: 4855664 - DNA, 14 bp, Homo sapiens
aaatatcaaagtca

SEQ ID NO: 4855665 - DNA, 22 bp, Homo sapiens
aaatatcaaagtcattaaagac

SEQ ID NO: 4855666 - DNA, 22 bp, Homo sapiens
aaatatcccttggacattttat

SEQ ID NO: 4855667 - DNA, 19 bp, Homo sapiens
aaatattcctttgcatatt

SEQ ID NO: 4855668 - DNA, 10 bp, Homo sapiens
aaatatttat

SEQ ID NO: 4855669 - DNA, 13 bp, Homo sapiens
aaatcataaagtc

SEQ ID NO: 4855670 - DNA, 14 bp, Homo sapiens
aaatcataaagtca

SEQ ID NO: 4855671 - DNA, 19 bp, Homo sapiens
aaatcattcttactaaaaa

SEQ ID NO: 4855672 - DNA, 17 bp, Homo sapiens
aaatcctgaagagcatt

SEQ ID NO: 4855673 - DNA, 17 bp, Homo sapiens
aaatccttttacctttt

SEQ ID NO: 4855674 - DNA, 13 bp, Homo sapiens
aaatcttcccatg

SEQ ID NO: 4855675 - DNA, 15 bp, Homo sapiens
aaatgaaagaaaatt

SEQ ID NO: 4855676 - DNA, 20 bp, Homo sapiens
aaatgaaagaaaattgagtt

SEQ ID NO: 4855677 - DNA, 12 bp, Homo sapiens
aaatgaaatgca

SEQ ID NO: 4855678 - DNA, 14 bp, Homo sapiens
aaatgaaatgcata

SEQ ID NO: 4855679 - DNA, 15 bp, Homo sapiens
aaatgaaatgcatat

SEQ ID NO: 4855680 - DNA, 13 bp, Homo sapiens
aaatgaactttgt

SEQ ID NO: 4855681 - DNA, 15 bp, Homo sapiens
aaatgagctctgaaa

SEQ ID NO: 4855682 - DNA, 19 bp, Homo sapiens
aaatgagctctgaaatctt

SEQ ID NO: 4855683 - DNA, 13 bp, Homo sapiens
aaatgaggatcca

SEQ ID NO: 4855684 - DNA, 15 bp, Homo sapiens
aaatgaggatccagg

SEQ ID NO: 4855685 - DNA, 12 bp, Homo sapiens
aaatgatgttat

SEQ ID NO: 4855686 - DNA, 15 bp, Homo sapiens
aaatgcagggagggg

SEQ ID NO: 4855687 - DNA, 15 bp, Homo sapiens
aaatgcctgactcag

SEQ ID NO: 4855688 - DNA, 23 bp, Homo sapiens
aaatgctcccacctgaatttgta

SEQ ID NO: 4855689 - DNA, 21 bp, Homo sapiens
aaatggaaagcagagttttca

SEQ ID NO: 4855690 - DNA, 22 bp, Homo sapiens
aaatggaggatctctaaagagc

SEQ ID NO: 4855691 - DNA, 14 bp, Homo sapiens
aaatgtaatttaaa

SEQ ID NO: 4855692 - DNA, 13 bp, Homo sapiens
aaatgtataaata

SEQ ID NO: 4855693 - DNA, 15 bp, Homo sapiens
aaatgtataaatata

SEQ ID NO: 4855694 - DNA, 16 bp, Homo sapiens
aaatgtataaatatac

SEQ ID NO: 4855695 - DNA, 17 bp, Homo sapiens
aaatgtataaatataca

SEQ ID NO: 4855696 - DNA, 22 bp, Homo sapiens
aaatgtccagccacccccaggc

SEQ ID NO: 4855697 - DNA, 18 bp, Homo sapiens
aaatgtctgtaataatag

SEQ ID NO: 4855698 - DNA, 24 bp, Homo sapiens
aaatgtgactcagcatcacccacc

SEQ ID NO: 4855699 - DNA, 12 bp, Homo sapiens
aagtcgccagtc

SEQ ID NO: 4855700 - DNA, 18 bp, Homo sapiens
aagtcgccagtcactgct

SEQ ID NO: 4855701 - DNA, 20 bp, Homo sapiens
aagtcgccagtcactgctgc

SEQ ID NO: 4855702 - DNA, 21 bp, Homo sapiens
aagtcgccagtcactgctgca

SEQ ID NO: 4855703 - DNA, 11 bp, Homo sapiens
aagtcttccta

SEQ ID NO: 4855704 - DNA, 13 bp, Homo sapiens
aagtcttctattt

SEQ ID NO: 4855705 - DNA, 16 bp, Homo sapiens
aagtgaattgaagttt

SEQ ID NO: 4855706 - DNA, 14 bp, Homo sapiens
aagtgcctgggctc

SEQ ID NO: 4855707 - DNA, 20 bp, Homo sapiens
aagtgcctgggctcagcctg

SEQ ID NO: 4855708 - DNA, 22 bp, Homo sapiens
aagtgcggggtaggggaagaag

SEQ ID NO: 4855709 - DNA, 17 bp, Homo sapiens
aagtgctgttgggatat

SEQ ID NO: 4855710 - DNA, 18 bp, Homo sapiens
aagtggacgttaggccag

SEQ ID NO: 4855711 - DNA, 19 bp, Homo sapiens
aagtggacgttaggccagg

SEQ ID NO: 4855712 - DNA, 16 bp, Homo sapiens
aagtggtgtttattgc

SEQ ID NO: 4855713 - DNA, 21 bp, Homo sapiens
aagtgtaccaacataagtgtt

SEQ ID NO: 4855714 - DNA, 17 bp, Homo sapiens
aagtgtgctgggcagag

SEQ ID NO: 4855715 - DNA, 17 bp, Homo sapiens
aagtgtgtatatatttt

SEQ ID NO: 4855716 - DNA, 12 bp, Homo sapiens
aagtgttgtatc

SEQ ID NO: 4855717 - DNA, 23 bp, Homo sapiens
aagttagtggaaatctgaacatt

SEQ ID NO: 4855718 - DNA, 13 bp, Homo sapiens
aagttatctttga

SEQ ID NO: 4855719 - DNA, 14 bp, Homo sapiens
aagttatctttgaa

SEQ ID NO: 4855720 - DNA, 15 bp, Homo sapiens
aagttatctttgaat

SEQ ID NO: 4855721 - DNA, 15 bp, Homo sapiens
aagttcatattccat

SEQ ID NO: 4855722 - DNA, 21 bp, Homo sapiens
aagttggaagggaccccagat

SEQ ID NO: 4855723 - DNA, 19 bp, Homo sapiens
aagtttcaagttttaaagt

SEQ ID NO: 4855724 - DNA, 20 bp, Homo sapiens
aagtttgctgtgctttggaa

SEQ ID NO: 4855725 - DNA, 13 bp, Homo sapiens
aagttttaaagtt

SEQ ID NO: 4855726 - DNA, 15 bp, Homo sapiens
aagtttttgtttgga

SEQ ID NO: 4855727 - DNA, 19 bp, Homo sapiens
aataaaaagaaagatactt

SEQ ID NO: 4855728 - DNA, 14 bp, Homo sapiens
aataaaaatatatt

SEQ ID NO: 4855729 - DNA, 15 bp, Homo sapiens
aataaaaatatattt

SEQ ID NO: 4855730 - DNA, 20 bp, Homo sapiens
aataaaaatatattttcaac

SEQ ID NO: 4855731 - DNA, 15 bp, Homo sapiens
aataaaatatatctt

SEQ ID NO: 4855732 - DNA, 12 bp, Homo sapiens
aataaaatttaa

SEQ ID NO: 4855733 - DNA, 15 bp, Homo sapiens
aataaacactacaga

SEQ ID NO: 4855734 - DNA, 18 bp, Homo sapiens
aataaaccaaaggaaaat

SEQ ID NO: 4855735 - DNA, 15 bp, Homo sapiens
aataaagtgatctgt

SEQ ID NO: 4855736 - DNA, 21 bp, Homo sapiens
aataaatcattcttactaaaa

SEQ ID NO: 4855737 - DNA, 12 bp, Homo sapiens
aataaatgtctt

SEQ ID NO: 4855738 - DNA, 14 bp, Homo sapiens
aataaatgtcttgc

SEQ ID NO: 4855739 - DNA, 18 bp, Homo sapiens
aataagagaatgttccta

SEQ ID NO: 4855740 - DNA, 15 bp, Homo sapiens
aataataaagtactt

SEQ ID NO: 4855741 - DNA, 19 bp, Homo sapiens
aataataaagtacttgact

SEQ ID NO: 4855742 - DNA, 14 bp, Homo sapiens
aataatagactgta

SEQ ID NO: 4855743 - DNA, 19 bp, Homo sapiens
aataattaaccaaccttgt

SEQ ID NO: 4855744 - DNA, 19 bp, Homo sapiens
aataatttccttcaggcag

SEQ ID NO: 4855745 - DNA, 20 bp, Homo sapiens
aataatttccttcaggcagc

SEQ ID NO: 4855746 - DNA, 15 bp, Homo sapiens
aataatttgaacttt

SEQ ID NO: 4855747 - DNA, 16 bp, Homo sapiens
aatacaaaatgtatta

SEQ ID NO: 4855748 - DNA, 18 bp, Homo sapiens
aataccatttagtaagaa

SEQ ID NO: 4855749 - DNA, 14 bp, Homo sapiens
aatacccgtcctct

SEQ ID NO: 4855750 - DNA, 12 bp, Homo sapiens
aatacctgctca

SEQ ID NO: 4855751 - DNA, 17 bp, Homo sapiens
aatacgtttgtgtttct

SEQ ID NO: 4855752 - DNA, 14 bp, Homo sapiens
aatactcatgtgca

SEQ ID NO: 4855753 - DNA, 17 bp, Homo sapiens
aatactgccaaaacatt

SEQ ID NO: 4855754 - DNA, 20 bp, Homo sapiens
aatactgccaaaacatttat

SEQ ID NO: 4855755 - DNA, 23 bp, Homo sapiens
aatactgccaaaacatttatgac

SEQ ID NO: 4855756 - DNA, 14 bp, Homo sapiens
aatacttccagaag

SEQ ID NO: 4855757 - DNA, 15 bp, Homo sapiens
aatacttccagaagt

SEQ ID NO: 4855758 - DNA, 14 bp, Homo sapiens
aatagaaggtgatg

SEQ ID NO: 4855759 - DNA, 18 bp, Homo sapiens
aatagatatgaaagctga

SEQ ID NO: 4855760 - DNA, 19 bp, Homo sapiens
aatagatatgaaagctgat

SEQ ID NO: 4855761 - DNA, 17 bp, Homo sapiens
aatagattcagagaaat

SEQ ID NO: 4855762 - DNA, 14 bp, Homo sapiens
aatagtatgaaaat

SEQ ID NO: 4855763 - DNA, 18 bp, Homo sapiens
aatagtatgaaaatggaa

SEQ ID NO: 4855764 - DNA, 20 bp, Homo sapiens
aatataaaaaatcatgccag

SEQ ID NO: 4855765 - DNA, 13 bp, Homo sapiens
aatataaaaataa

SEQ ID NO: 4855766 - DNA, 23 bp, Homo sapiens
aatatatgtattttttgaatcta

SEQ ID NO: 4855767 - DNA, 18 bp, Homo sapiens
aatatattacttaactgt

SEQ ID NO: 4855768 - DNA, 14 bp, Homo sapiens
aatatcaaagtcat

SEQ ID NO: 4855769 - DNA, 18 bp, Homo sapiens
aatatccctacatgtatt

SEQ ID NO: 4855770 - DNA, 19 bp, Homo sapiens
aatatccctacatgtattg

SEQ ID NO: 4855771 - DNA, 20 bp, Homo sapiens
aatatcccttggacatttta

SEQ ID NO: 4855772 - DNA, 20 bp, Homo sapiens
aatatgacaaacatcattgt

SEQ ID NO: 4855773 - DNA, 13 bp, Homo sapiens
aatattaaaaaac

SEQ ID NO: 4855774 - DNA, 20 bp, Homo sapiens
aatattcagggtaaatagga

SEQ ID NO: 4855775 - DNA, 15 bp, Homo sapiens
aatattgaaaattga

SEQ ID NO: 4855776 - DNA, 16 bp, Homo sapiens
aatattgaaaattgaa

SEQ ID NO: 4855777 - DNA, 14 bp, Homo sapiens
aatattgacttgta

SEQ ID NO: 4855778 - DNA, 20 bp, Homo sapiens
aatattgattgggaaaacat

SEQ ID NO: 4855779 - DNA, 21 bp, Homo sapiens
aatattgattgggaaaacatt

SEQ ID NO: 4855780 - DNA, 23 bp, Homo sapiens
aatattgattgggaaaacatttg

SEQ ID NO: 4855781 - DNA, 13 bp, Homo sapiens
aatatttatttat

SEQ ID NO: 4855782 - DNA, 20 bp, Homo sapiens
aatatttcaggttcttcaga

SEQ ID NO: 4855783 - DNA, 21 bp, Homo sapiens
aatattttaggtgtaaaataa

SEQ ID NO: 4855784 - DNA, 20 bp, Homo sapiens
aatcaaattctgtctgggga

SEQ ID NO: 4855785 - DNA, 12 bp, Homo sapiens
aatcaatagttg

SEQ ID NO: 4855786 - DNA, 22 bp, Homo sapiens
aatcacagctcaagcattctgt

SEQ ID NO: 4855787 - DNA, 21 bp, Homo sapiens
aatcacagggaatggccacaa

SEQ ID NO: 4855788 - DNA, 14 bp, Homo sapiens
aatcagacagcagg

SEQ ID NO: 4855789 - DNA, 15 bp, Homo sapiens
aatcagacagcagga

SEQ ID NO: 4855790 - DNA, 13 bp, Homo sapiens
aatcataaagtca

SEQ ID NO: 4855791 - DNA, 16 bp, Homo sapiens
aatcattcagaaatgt

SEQ ID NO: 4855792 - DNA, 23 bp, Homo sapiens
aatcattcagaaatgttgagtct

SEQ ID NO: 4855793 - DNA, 17 bp, Homo sapiens
aatcattcttactaaaa

SEQ ID NO: 4855794 - DNA, 18 bp, Homo sapiens
aatccatccatgtacttc

SEQ ID NO: 4855795 - DNA, 23 bp, Homo sapiens
aatccatcgtattaaaaaacaat

SEQ ID NO: 4855796 - DNA, 14 bp, Homo sapiens
aatcctagactgct

SEQ ID NO: 4855797 - DNA, 20 bp, Homo sapiens
aatctacaatctctttttgt

SEQ ID NO: 4855798 - DNA, 16 bp, Homo sapiens
aatctcaaataggcta

SEQ ID NO: 4855799 - DNA, 14 bp, Homo sapiens
aatctcaatgcaag

SEQ ID NO: 4855800 - DNA, 17 bp, Homo sapiens
aatctcattgcttacaa

SEQ ID NO: 4855801 - DNA, 19 bp, Homo sapiens
aatctggattcatatttaa

SEQ ID NO: 4855802 - DNA, 16 bp, Homo sapiens
aatctgtacaaaatgg

SEQ ID NO: 4855803 - DNA, 18 bp, Homo sapiens
aatctgtacaaaatggtc

SEQ ID NO: 4855804 - DNA, 10 bp, Homo sapiens
aatcttcctg

SEQ ID NO: 4855805 - DNA, 14 bp, Homo sapiens
aatcttgttttgaa

SEQ ID NO: 4855806 - DNA, 17 bp, Homo sapiens
aatcttgttttgaaaat

SEQ ID NO: 4855807 - DNA, 23 bp, Homo sapiens
aatcttgttttgaaaataaccta

SEQ ID NO: 4855808 - DNA, 18 bp, Homo sapiens
aatctttgtaccaaaatt

SEQ ID NO: 4855809 - DNA, 20 bp, Homo sapiens
aatctttgtaccaaaatttt

SEQ ID NO: 4855810 - DNA, 13 bp, Homo sapiens
aatcttttgaagc

SEQ ID NO: 4855811 - DNA, 21 bp, Homo sapiens
aatgaaacatgggctgtgatt

SEQ ID NO: 4855812 - DNA, 14 bp, Homo sapiens
aatgaagcagtatt

SEQ ID NO: 4855813 - DNA, 21 bp, Homo sapiens
aatgaataatggaaaatgcca

SEQ ID NO: 4855814 - DNA, 14 bp, Homo sapiens
aatgaatgggatat

SEQ ID NO: 4855815 - DNA, 21 bp, Homo sapiens
aatgaatgggatattttgaaa

SEQ ID NO: 4855816 - DNA, 15 bp, Homo sapiens
aatgacagccttgca

SEQ ID NO: 4855817 - DNA, 13 bp, Homo sapiens
aatgaccttgagt

SEQ ID NO: 4855818 - DNA, 18 bp, Homo sapiens
aatgagcttgattaaatc

SEQ ID NO: 4855819 - DNA, 14 bp, Homo sapiens
aatgatgttataca

SEQ ID NO: 4855820 - DNA, 18 bp, Homo sapiens
accccagatacctgtgag

SEQ ID NO: 4855821 - DNA, 21 bp, Homo sapiens
accccagatacctgtgaggac

SEQ ID NO: 4855822 - DNA, 23 bp, Homo sapiens
accccagatacctgtgaggactg

SEQ ID NO: 4855823 - DNA, 12 bp, Homo sapiens
accccattcctg

SEQ ID NO: 4855824 - DNA, 11 bp, Homo sapiens
acccctgcctg

SEQ ID NO: 4855825 - DNA, 14 bp, Homo sapiens
accctacagacagc

SEQ ID NO: 4855826 - DNA, 16 bp, Homo sapiens
accctcattgtgtttc

SEQ ID NO: 4855827 - DNA, 17 bp, Homo sapiens
accctcattgtgtttct

SEQ ID NO: 4855828 - DNA, 11 bp, Homo sapiens
accctccaagg

SEQ ID NO: 4855829 - DNA, 20 bp, Homo sapiens
accctccatgctcctcacct

SEQ ID NO: 4855830 - DNA, 15 bp, Homo sapiens
accctctgtccttcc

SEQ ID NO: 4855831 - DNA, 18 bp, Homo sapiens
acccttacagcctctgac

SEQ ID NO: 4855832 - DNA, 22 bp, Homo sapiens
acccttactggcttacctcctc

SEQ ID NO: 4855833 - DNA, 15 bp, Homo sapiens
acccttcctgctgct

SEQ ID NO: 4855834 - DNA, 23 bp, Homo sapiens
acccttcctgctgctgctactgc

SEQ ID NO: 4855835 - DNA, 19 bp, Homo sapiens
acccttctgggtccaggga

SEQ ID NO: 4855836 - DNA, 14 bp, Homo sapiens
acccttttaagcat

SEQ ID NO: 4855837 - DNA, 15 bp, Homo sapiens
accgcaggtgctcat

SEQ ID NO: 4855838 - DNA, 19 bp, Homo sapiens
accgcaggtgctcatgctg

SEQ ID NO: 4855839 - DNA, 22 bp, Homo sapiens
accgcaggtgctcatgctgctc

SEQ ID NO: 4855840 - DNA, 21 bp, Homo sapiens
accgcggccgaagcccaccac

SEQ ID NO: 4855841 - DNA, 17 bp, Homo sapiens
accgtaataattattat

SEQ ID NO: 4855842 - DNA, 21 bp, Homo sapiens
accgtggcagcttgctgggct

SEQ ID NO: 4855843 - DNA, 11 bp, Homo sapiens
acctacagttt

SEQ ID NO: 4855844 - DNA, 17 bp, Homo sapiens
acctacagttttaactg

SEQ ID NO: 4855845 - DNA, 23 bp, Homo sapiens
acctacattccaccctgttactt

SEQ ID NO: 4855846 - DNA, 17 bp, Homo sapiens
acctactggtgtaatct

SEQ ID NO: 4855847 - DNA, 22 bp, Homo sapiens
acctactggtgtaatctcaatg

SEQ ID NO: 4855848 - DNA, 13 bp, Homo sapiens
acctcaggctcct

SEQ ID NO: 4855849 - DNA, 16 bp, Homo sapiens
acctcatcactggact

SEQ ID NO: 4855850 - DNA, 13 bp, Homo sapiens
acctccagaagtc

SEQ ID NO: 4855851 - DNA, 17 bp, Homo sapiens
acctccagactcagcag

SEQ ID NO: 4855852 - DNA, 21 bp, Homo sapiens
acctccagactcagcagagtg

SEQ ID NO: 4855853 - DNA, 15 bp, Homo sapiens
acctccctgtctccc

SEQ ID NO: 4855854 - DNA, 20 bp, Homo sapiens
acctccttctgcagtcagac

SEQ ID NO: 4855855 - DNA, 21 bp, Homo sapiens
acctccttctgcagtcagact

SEQ ID NO: 4855856 - DNA, 14 bp, Homo sapiens
acctctaagtgctg

SEQ ID NO: 4855857 - DNA, 21 bp, Homo sapiens
acctcttaaagaaaacccacc

SEQ ID NO: 4855858 - DNA, 13 bp, Homo sapiens
acctcttctctcc

SEQ ID NO: 4855859 - DNA, 22 bp, Homo sapiens
acctcttttgcttgccaaagta

SEQ ID NO: 4855860 - DNA, 15 bp, Homo sapiens
acctgaaagagagga

SEQ ID NO: 4855861 - DNA, 18 bp, Homo sapiens
acctgaaagagaggactg

SEQ ID NO: 4855862 - DNA, 20 bp, Homo sapiens
acctgactaggttctgtaga

SEQ ID NO: 4855863 - DNA, 21 bp, Homo sapiens
acctgatgtcagctgctgttg

SEQ ID NO: 4855864 - DNA, 22 bp, Homo sapiens
acctgatgtcagctgctgttga

SEQ ID NO: 4855865 - DNA, 17 bp, Homo sapiens
acctgcactaacagagt

SEQ ID NO: 4855866 - DNA, 18 bp, Homo sapiens
acctgcactaacagagtg

SEQ ID NO: 4855867 - DNA, 12 bp, Homo sapiens
acctgccaagga

SEQ ID NO: 4855868 - DNA, 14 bp, Homo sapiens
acctgccaaggagc

SEQ ID NO: 4855869 - DNA, 18 bp, Homo sapiens
acctgccaaggagcatcc

SEQ ID NO: 4855870 - DNA, 23 bp, Homo sapiens
acctgccaaggagcatccttggc

SEQ ID NO: 4855871 - DNA, 22 bp, Homo sapiens
acctggattgtgcctaatgtgt

SEQ ID NO: 4855872 - DNA, 17 bp, Homo sapiens
acctggcagatgggggc

SEQ ID NO: 4855873 - DNA, 18 bp, Homo sapiens
acctggcagatgggggcc

SEQ ID NO: 4855874 - DNA, 20 bp, Homo sapiens
acctggcagatgggggcctc

SEQ ID NO: 4855875 - DNA, 15 bp, Homo sapiens
acctgggaaggccag

SEQ ID NO: 4855876 - DNA, 18 bp, Homo sapiens
acctgggacaggaaagag

SEQ ID NO: 4855877 - DNA, 14 bp, Homo sapiens
acctgggcacaaac

SEQ ID NO: 4855878 - DNA, 23 bp, Homo sapiens
acctgtctaggtctcctcagggt

SEQ ID NO: 4855879 - DNA, 10 bp, Homo sapiens
acctgtggat

SEQ ID NO: 4855880 - DNA, 12 bp, Homo sapiens
acctgtgggctg

SEQ ID NO: 4855881 - DNA, 22 bp, Homo sapiens
accttcaaggctcttcttcctc

SEQ ID NO: 4855882 - DNA, 19 bp, Homo sapiens
accttctagttgcccccat

SEQ ID NO: 4855883 - DNA, 22 bp, Homo sapiens
accttgaaaaaaaacagtggat

SEQ ID NO: 4855884 - DNA, 22 bp, Homo sapiens
accttgaccaaaatcagctttg

SEQ ID NO: 4855885 - DNA, 13 bp, Homo sapiens
accttgcttcctt

SEQ ID NO: 4855886 - DNA, 16 bp, Homo sapiens
accttgcttccttctc

SEQ ID NO: 4855887 - DNA, 13 bp, Homo sapiens
accttttcaggaa

SEQ ID NO: 4855888 - DNA, 16 bp, Homo sapiens
accttttcaggaaaat

SEQ ID NO: 4855889 - DNA, 20 bp, Homo sapiens
acgatgcatttaataaagat

SEQ ID NO: 4855890 - DNA, 15 bp, Homo sapiens
acgcaggaagcctac

SEQ ID NO: 4855891 - DNA, 17 bp, Homo sapiens
acgggatgacctccaga

SEQ ID NO: 4855892 - DNA, 18 bp, Homo sapiens
acgggatgacctccagaa

SEQ ID NO: 4855893 - DNA, 12 bp, Homo sapiens
acgtcatgtatt

SEQ ID NO: 4855894 - DNA, 11 bp, Homo sapiens
acgtttataaa

SEQ ID NO: 4855895 - DNA, 14 bp, Homo sapiens
acgtttataaacag

SEQ ID NO: 4855896 - DNA, 21 bp, Homo sapiens
acgtttataaacagaaatgga

SEQ ID NO: 4855897 - DNA, 16 bp, Homo sapiens
actaaaaaaaagatga

SEQ ID NO: 4855898 - DNA, 21 bp, Homo sapiens
actaaaaagtataaaatagta

SEQ ID NO: 4855899 - DNA, 18 bp, Homo sapiens
actaaaatgaggatccag

SEQ ID NO: 4855900 - DNA, 14 bp, Homo sapiens
actaaaatgttcta

SEQ ID NO: 4855901 - DNA, 13 bp, Homo sapiens
actaaattttaaa

SEQ ID NO: 4855902 - DNA, 22 bp, Homo sapiens
actaactcaaatacacatttgc

SEQ ID NO: 4855903 - DNA, 15 bp, Homo sapiens
actaaggagaaatga

SEQ ID NO: 4855904 - DNA, 13 bp, Homo sapiens
actacacacagta

SEQ ID NO: 4855905 - DNA, 16 bp, Homo sapiens
actactactgttatca

SEQ ID NO: 4855906 - DNA, 18 bp, Homo sapiens
actactagtgtgactcct

SEQ ID NO: 4855907 - DNA, 17 bp, Homo sapiens
actactgctcctgtggc

SEQ ID NO: 4855908 - DNA, 14 bp, Homo sapiens
actagataaaatgt

SEQ ID NO: 4855909 - DNA, 13 bp, Homo sapiens
actagattgacta

SEQ ID NO: 4855910 - DNA, 19 bp, Homo sapiens
actagccttcccagcttcc

SEQ ID NO: 4855911 - DNA, 15 bp, Homo sapiens
actaggaatcccaga

SEQ ID NO: 4855912 - DNA, 14 bp, Homo sapiens
actaggactcagaa

SEQ ID NO: 4855913 - DNA, 16 bp, Homo sapiens
actatatataatgtat

SEQ ID NO: 4855914 - DNA, 22 bp, Homo sapiens
actatatatataaatgtataaa

SEQ ID NO: 4855915 - DNA, 23 bp, Homo sapiens
actatgcgtggctggaaccacat

SEQ ID NO: 4855916 - DNA, 19 bp, Homo sapiens
actatttaaatccttggct

SEQ ID NO: 4855917 - DNA, 19 bp, Homo sapiens
actcaaatacacatttgct

SEQ ID NO: 4855918 - DNA, 23 bp, Homo sapiens
actcaaattttggcgaatctcaa

SEQ ID NO: 4855919 - DNA, 21 bp, Homo sapiens
actcaaggataccttcttatt

SEQ ID NO: 4855920 - DNA, 14 bp, Homo sapiens
actcagcagagtga

SEQ ID NO: 4855921 - DNA, 19 bp, Homo sapiens
actcagtgaccagtgcctg

SEQ ID NO: 4855922 - DNA, 24 bp, Homo sapiens
actcagtgaccagtgcctgtgagc

SEQ ID NO: 4855923 - DNA, 15 bp, Homo sapiens
actcattctgaatta

SEQ ID NO: 4855924 - DNA, 19 bp, Homo sapiens
actcattctgaattaatta

SEQ ID NO: 4855925 - DNA, 19 bp, Homo sapiens
actcattttcatattgtaa

SEQ ID NO: 4855926 - DNA, 22 bp, Homo sapiens
actcattttcatattgtaatct

SEQ ID NO: 4855927 - DNA, 11 bp, Homo sapiens
actccagctga

SEQ ID NO: 4855928 - DNA, 15 bp, Homo sapiens
actccaggcatgtgt

SEQ ID NO: 4855929 - DNA, 22 bp, Homo sapiens
actccaggcatgtgtctggccc

SEQ ID NO: 4855930 - DNA, 12 bp, Homo sapiens
actccagggtga

SEQ ID NO: 4855931 - DNA, 20 bp, Homo sapiens
actccagggtgacaaggcct

SEQ ID NO: 4855932 - DNA, 21 bp, Homo sapiens
actcccaagggacagcaagtg

SEQ ID NO: 4855933 - DNA, 13 bp, Homo sapiens
actcccagaacct

SEQ ID NO: 4855934 - DNA, 12 bp, Homo sapiens
actcccccagag

SEQ ID NO: 4855935 - DNA, 16 bp, Homo sapiens
actcccccagaggtgg

SEQ ID NO: 4855936 - DNA, 16 bp, Homo sapiens
actccccgcctcccca

SEQ ID NO: 4855937 - DNA, 21 bp, Homo sapiens
actcctataaagtgcctcgga

SEQ ID NO: 4855938 - DNA, 13 bp, Homo sapiens
actcctgcttaat

SEQ ID NO: 4855939 - DNA, 16 bp, Homo sapiens
actcctgtcttctttc

SEQ ID NO: 4855940 - DNA, 22 bp, Homo sapiens
agaaagcacaatttaaaacaat

SEQ ID NO: 4855941 - DNA, 18 bp, Homo sapiens
agaaagcctgggtgacat

SEQ ID NO: 4855942 - DNA, 19 bp, Homo sapiens
agaaagcctgggtgacatt

SEQ ID NO: 4855943 - DNA, 19 bp, Homo sapiens
agaaagcttccttcaacct

SEQ ID NO: 4855944 - DNA, 22 bp, Homo sapiens
agaaaggtgtgaggagagagga

SEQ ID NO: 4855945 - DNA, 22 bp, Homo sapiens
agaaagtaaggtgcttggagtt

SEQ ID NO: 4855946 - DNA, 13 bp, Homo sapiens
agaaataaaccaa

SEQ ID NO: 4855947 - DNA, 21 bp, Homo sapiens
agaaataataaaaagaaagat

SEQ ID NO: 4855948 - DNA, 16 bp, Homo sapiens
agaaatactcatgtgc

SEQ ID NO: 4855949 - DNA, 17 bp, Homo sapiens
agaaatagacaaaaagt

SEQ ID NO: 4855950 - DNA, 21 bp, Homo sapiens
agaaatagacaaaaagtatat

SEQ ID NO: 4855951 - DNA, 19 bp, Homo sapiens
agaaatataacacattttt

SEQ ID NO: 4855952 - DNA, 18 bp, Homo sapiens
agaaatcagtaatattta

SEQ ID NO: 4855953 - DNA, 22 bp, Homo sapiens
agaaatgttgagtctgtactaa

SEQ ID NO: 4855954 - DNA, 19 bp, Homo sapiens
agaaattacctgtggatat

SEQ ID NO: 4855955 - DNA, 20 bp, Homo sapiens
agaaattacctgtggatatt

SEQ ID NO: 4855956 - DNA, 20 bp, Homo sapiens
agaacatctgtataccctct

SEQ ID NO: 4855957 - DNA, 16 bp, Homo sapiens
agaaccacacttgaaa

SEQ ID NO: 4855958 - DNA, 21 bp, Homo sapiens
agaaccacacttgaaaccttt

SEQ ID NO: 4855959 - DNA, 23 bp, Homo sapiens
agaaccgcggccgaagcccacca

SEQ ID NO: 4855960 - DNA, 17 bp, Homo sapiens
agaactcctgtcttctt

SEQ ID NO: 4855961 - DNA, 18 bp, Homo sapiens
agaactcctgtcttcttt

SEQ ID NO: 4855962 - DNA, 21 bp, Homo sapiens
agaactcttcctcctcccaag

SEQ ID NO: 4855963 - DNA, 22 bp, Homo sapiens
agaacttagcctttacctgtga

SEQ ID NO: 4855964 - DNA, 16 bp, Homo sapiens
agaagaagttcatgtc

SEQ ID NO: 4855965 - DNA, 15 bp, Homo sapiens
agaagaatcttcctg

SEQ ID NO: 4855966 - DNA, 15 bp, Homo sapiens
agaagcctccccagc

SEQ ID NO: 4855967 - DNA, 11 bp, Homo sapiens
agaagctgctc

SEQ ID NO: 4855968 - DNA, 15 bp, Homo sapiens
agaaggaaagatggt

SEQ ID NO: 4855969 - DNA, 13 bp, Homo sapiens
agaaggcaaggct

SEQ ID NO: 4855970 - DNA, 20 bp, Homo sapiens
agaagtaagaggctacctct

SEQ ID NO: 4855971 - DNA, 17 bp, Homo sapiens
agaagtacagggcagaa

SEQ ID NO: 4855972 - DNA, 13 bp, Homo sapiens
agaagtatacata

SEQ ID NO: 4855973 - DNA, 13 bp, Homo sapiens
agaagtcccttca

SEQ ID NO: 4855974 - DNA, 19 bp, Homo sapiens
agaagtcccttcaatttct

SEQ ID NO: 4855975 - DNA, 18 bp, Homo sapiens
agaagtgagcagtgttgg

SEQ ID NO: 4855976 - DNA, 17 bp, Homo sapiens
agaagttcatgtccaaa

SEQ ID NO: 4855977 - DNA, 16 bp, Homo sapiens
agaataccacatcaaa

SEQ ID NO: 4855978 - DNA, 18 bp, Homo sapiens
agaataccacatcaaata

SEQ ID NO: 4855979 - DNA, 13 bp, Homo sapiens
agaatactgccaa

SEQ ID NO: 4855980 - DNA, 22 bp, Homo sapiens
agaatactgccaaaacatttat

SEQ ID NO: 4855981 - DNA, 13 bp, Homo sapiens
agaatcagacagc

SEQ ID NO: 4855982 - DNA, 18 bp, Homo sapiens
agaatcttcctggcacaa

SEQ ID NO: 4855983 - DNA, 19 bp, Homo sapiens
agaatcttcctggcacaat

SEQ ID NO: 4855984 - DNA, 16 bp, Homo sapiens
agaatgaaagctgttc

SEQ ID NO: 4855985 - DNA, 20 bp, Homo sapiens
agaatgagtccttgatttca

SEQ ID NO: 4855986 - DNA, 21 bp, Homo sapiens
agaatgagtccttgatttcaa

SEQ ID NO: 4855987 - DNA, 22 bp, Homo sapiens
agaatgagtccttgatttcaaa

SEQ ID NO: 4855988 - DNA, 19 bp, Homo sapiens
agaatgatcaaggatctgg

SEQ ID NO: 4855989 - DNA, 20 bp, Homo sapiens
agaatgatcaaggatctgga

SEQ ID NO: 4855990 - DNA, 14 bp, Homo sapiens
agaatggcatggca

SEQ ID NO: 4855991 - DNA, 17 bp, Homo sapiens
agaatggcatggcagga

SEQ ID NO: 4855992 - DNA, 19 bp, Homo sapiens
agaatggcatggcaggagt

SEQ ID NO: 4855993 - DNA, 14 bp, Homo sapiens
agaatggcctggag

SEQ ID NO: 4855994 - DNA, 22 bp, Homo sapiens
agaatggcctggagcaggccca

SEQ ID NO: 4855995 - DNA, 23 bp, Homo sapiens
agaatgtattttcatagatgtgt

SEQ ID NO: 4855996 - DNA, 15 bp, Homo sapiens
agaatgttagagtaa

SEQ ID NO: 4855997 - DNA, 18 bp, Homo sapiens
agaattctgattgatttg

SEQ ID NO: 4855998 - DNA, 16 bp, Homo sapiens
agaattgaggggaggt

SEQ ID NO: 4855999 - DNA, 13 bp, Homo sapiens
agaatttaatata

SEQ ID NO: 4856000 - DNA, 14 bp, Homo sapiens
agaatttgaattat

SEQ ID NO: 4856001 - DNA, 17 bp, Homo sapiens
agaattttccatttatt

SEQ ID NO: 4856002 - DNA, 15 bp, Homo sapiens
agaatttttaactgt

SEQ ID NO: 4856003 - DNA, 22 bp, Homo sapiens
agaatttttaactgtactgaat

SEQ ID NO: 4856004 - DNA, 14 bp, Homo sapiens
agacaaccttgtcc

SEQ ID NO: 4856005 - DNA, 15 bp, Homo sapiens
agacaagtaatttca

SEQ ID NO: 4856006 - DNA, 22 bp, Homo sapiens
agacaagtaatttcagtgtaaa

SEQ ID NO: 4856007 - DNA, 20 bp, Homo sapiens
agacactaacgaaatatcaa

SEQ ID NO: 4856008 - DNA, 17 bp, Homo sapiens
agacactgttgataaaa

SEQ ID NO: 4856009 - DNA, 17 bp, Homo sapiens
agacacttgctcccaac

SEQ ID NO: 4856010 - DNA, 15 bp, Homo sapiens
agacagagacaagta

SEQ ID NO: 4856011 - DNA, 16 bp, Homo sapiens
agacagctggcggagg

SEQ ID NO: 4856012 - DNA, 17 bp, Homo sapiens
agacagctggcggaggc

SEQ ID NO: 4856013 - DNA, 18 bp, Homo sapiens
agacagcttacaggagcc

SEQ ID NO: 4856014 - DNA, 14 bp, Homo sapiens
agacagtgaatttg

SEQ ID NO: 4856015 - DNA, 15 bp, Homo sapiens
agacatgtgacattt

SEQ ID NO: 4856016 - DNA, 19 bp, Homo sapiens
agaccataaagatattctt

SEQ ID NO: 4856017 - DNA, 14 bp, Homo sapiens
agaccataagagaa

SEQ ID NO: 4856018 - DNA, 18 bp, Homo sapiens
agacccttgacacctgct

SEQ ID NO: 4856019 - DNA, 20 bp, Homo sapiens
agacctgaaagagaggactg

SEQ ID NO: 4856020 - DNA, 13 bp, Homo sapiens
agacctggagctt

SEQ ID NO: 4856021 - DNA, 15 bp, Homo sapiens
agacctggagcttca

SEQ ID NO: 4856022 - DNA, 22 bp, Homo sapiens
agacctggagcttcagccaggt

SEQ ID NO: 4856023 - DNA, 13 bp, Homo sapiens
agacgtttataaa

SEQ ID NO: 4856024 - DNA, 14 bp, Homo sapiens
agactatggtgctg

SEQ ID NO: 4856025 - DNA, 19 bp, Homo sapiens
agactcaaagaagtactgt

SEQ ID NO: 4856026 - DNA, 22 bp, Homo sapiens
agactgaatagatatgaaagct

SEQ ID NO: 4856027 - DNA, 21 bp, Homo sapiens
agactgataacttggggaggc

SEQ ID NO: 4856028 - DNA, 11 bp, Homo sapiens
agactggccca

SEQ ID NO: 4856029 - DNA, 15 bp, Homo sapiens
agactggcccagtgc

SEQ ID NO: 4856030 - DNA, 20 bp, Homo sapiens
agactggcccagtgccagca

SEQ ID NO: 4856031 - DNA, 21 bp, Homo sapiens
agactgtaacttccaaataaa

SEQ ID NO: 4856032 - DNA, 22 bp, Homo sapiens
agactgtaacttccaaataaat

SEQ ID NO: 4856033 - DNA, 17 bp, Homo sapiens
agactgtagatatgtat

SEQ ID NO: 4856034 - DNA, 15 bp, Homo sapiens
agacttgaggggcta

SEQ ID NO: 4856035 - DNA, 21 bp, Homo sapiens
agacttgcagttagactcaaa

SEQ ID NO: 4856036 - DNA, 22 bp, Homo sapiens
agacttggagaatactgccaaa

SEQ ID NO: 4856037 - DNA, 18 bp, Homo sapiens
agactttgatactaccag

SEQ ID NO: 4856038 - DNA, 19 bp, Homo sapiens
agactttgatccatgtatg

SEQ ID NO: 4856039 - DNA, 22 bp, Homo sapiens
agagaaacactgaaaagaagga

SEQ ID NO: 4856040 - DNA, 14 bp, Homo sapiens
agagaaacctgcca

SEQ ID NO: 4856041 - DNA, 13 bp, Homo sapiens
agagaacctgtgg

SEQ ID NO: 4856042 - DNA, 23 bp, Homo sapiens
agagaagtacaggtcatctgctg

SEQ ID NO: 4856043 - DNA, 10 bp, Homo sapiens
agagaatgag

SEQ ID NO: 4856044 - DNA, 14 bp, Homo sapiens
agagaatgttccta

SEQ ID NO: 4856045 - DNA, 21 bp, Homo sapiens
agagaatgttcctactcacac

SEQ ID NO: 4856046 - DNA, 15 bp, Homo sapiens
agagacaagtaattt

SEQ ID NO: 4856047 - DNA, 19 bp, Homo sapiens
agagaccataagagaaacc

SEQ ID NO: 4856048 - DNA, 22 bp, Homo sapiens
agagactgggagccacttctcc

SEQ ID NO: 4856049 - DNA, 19 bp, Homo sapiens
agagacttgcagttagact

SEQ ID NO: 4856050 - DNA, 23 bp, Homo sapiens
agagacttgcagttagactcaaa

SEQ ID NO: 4856051 - DNA, 13 bp, Homo sapiens
agagagggaaaag

SEQ ID NO: 4856052 - DNA, 23 bp, Homo sapiens
agagagggaaaaggcaggtgctt

SEQ ID NO: 4856053 - DNA, 21 bp, Homo sapiens
agagagtagctgcagccttca

SEQ ID NO: 4856054 - DNA, 15 bp, Homo sapiens
agagatgtactgcaa

SEQ ID NO: 4856055 - DNA, 20 bp, Homo sapiens
agagcaagagataagtcttt

SEQ ID NO: 4856056 - DNA, 21 bp, Homo sapiens
agagcaggacctgggacagga

SEQ ID NO: 4856057 - DNA, 24 bp, Homo sapiens
agagcattgtcaccgcaggtgctc

SEQ ID NO: 4856058 - DNA, 13 bp, Homo sapiens
agagccatacata

SEQ ID NO: 4856059 - DNA, 13 bp, Homo sapiens
agctgtttggaaa

SEQ ID NO: 4856060 - DNA, 16 bp, Homo sapiens
agcttacaggagccag

SEQ ID NO: 4856061 - DNA, 17 bp, Homo sapiens
agcttacaggagccagc

SEQ ID NO: 4856062 - DNA, 19 bp, Homo sapiens
agcttacaggagccagcct

SEQ ID NO: 4856063 - DNA, 20 bp, Homo sapiens
agcttacaggagccagcctg

SEQ ID NO: 4856064 - DNA, 13 bp, Homo sapiens
agcttacctgggc

SEQ ID NO: 4856065 - DNA, 15 bp, Homo sapiens
agcttacctgggcac

SEQ ID NO: 4856066 - DNA, 12 bp, Homo sapiens
agcttcagccag

SEQ ID NO: 4856067 - DNA, 14 bp, Homo sapiens
agcttcagccaggc

SEQ ID NO: 4856068 - DNA, 20 bp, Homo sapiens
agcttcagccaggcaagaaa

SEQ ID NO: 4856069 - DNA, 14 bp, Homo sapiens
agcttcagccaggt

SEQ ID NO: 4856070 - DNA, 16 bp, Homo sapiens
agcttcagttgcttgt

SEQ ID NO: 4856071 - DNA, 20 bp, Homo sapiens
agcttccattttaattttaa

SEQ ID NO: 4856072 - DNA, 14 bp, Homo sapiens
agcttccttcaacc

SEQ ID NO: 4856073 - DNA, 15 bp, Homo sapiens
agcttgattaaatca

SEQ ID NO: 4856074 - DNA, 12 bp, Homo sapiens
agctttaaatta

SEQ ID NO: 4856075 - DNA, 17 bp, Homo sapiens
agctttaaattatgtga

SEQ ID NO: 4856076 - DNA, 18 bp, Homo sapiens
agctttagtgaattaaat

SEQ ID NO: 4856077 - DNA, 21 bp, Homo sapiens
agctttagtgaattaaattta

SEQ ID NO: 4856078 - DNA, 14 bp, Homo sapiens
agctttttggaatc

SEQ ID NO: 4856079 - DNA, 18 bp, Homo sapiens
aggaaaagtcttcctaat

SEQ ID NO: 4856080 - DNA, 20 bp, Homo sapiens
aggaaaatgtctgtaataat

SEQ ID NO: 4856081 - DNA, 23 bp, Homo sapiens
aggaaaatgtctgtaataataga

SEQ ID NO: 4856082 - DNA, 17 bp, Homo sapiens
aggaaagagaggaacca

SEQ ID NO: 4856083 - DNA, 12 bp, Homo sapiens
aggaactctaga

SEQ ID NO: 4856084 - DNA, 21 bp, Homo sapiens
aggaagccatagatgctggct

SEQ ID NO: 4856085 - DNA, 22 bp, Homo sapiens
aggaatcattcagaaatgttga

SEQ ID NO: 4856086 - DNA, 19 bp, Homo sapiens
aggacagttgatggagccc

SEQ ID NO: 4856087 - DNA, 20 bp, Homo sapiens
aggacagttgatggagcccc

SEQ ID NO: 4856088 - DNA, 13 bp, Homo sapiens
aggacatgcaata

SEQ ID NO: 4856089 - DNA, 16 bp, Homo sapiens
aggacatttgtgggca

SEQ ID NO: 4856090 - DNA, 23 bp, Homo sapiens
aggaccaatgcttgcatggagaa

SEQ ID NO: 4856091 - DNA, 16 bp, Homo sapiens
aggacccatccctgcc

SEQ ID NO: 4856092 - DNA, 18 bp, Homo sapiens
aggacccatccctgcctg

SEQ ID NO: 4856093 - DNA, 20 bp, Homo sapiens
aggacccatccctgcctgga

SEQ ID NO: 4856094 - DNA, 17 bp, Homo sapiens
aggaccctcgagagcct

SEQ ID NO: 4856095 - DNA, 16 bp, Homo sapiens
aggactcccagaacct

SEQ ID NO: 4856096 - DNA, 19 bp, Homo sapiens
aggactctctccaggaggg

SEQ ID NO: 4856097 - DNA, 21 bp, Homo sapiens
aggactctctccaggagggct

SEQ ID NO: 4856098 - DNA, 22 bp, Homo sapiens
aggactctctccaggagggctc

SEQ ID NO: 4856099 - DNA, 23 bp, Homo sapiens
aggactctctccaggagggctcg

SEQ ID NO: 4856100 - DNA, 21 bp, Homo sapiens
aggactggttctgaggccaga

SEQ ID NO: 4856101 - DNA, 20 bp, Homo sapiens
aggactggttgtctctcttc

SEQ ID NO: 4856102 - DNA, 14 bp, Homo sapiens
aggagaaggggctt

SEQ ID NO: 4856103 - DNA, 23 bp, Homo sapiens
aggagaagtcttctatttattta

SEQ ID NO: 4856104 - DNA, 20 bp, Homo sapiens
aggagaatggcatggcagga

SEQ ID NO: 4856105 - DNA, 13 bp, Homo sapiens
aggagagaggagg

SEQ ID NO: 4856106 - DNA, 15 bp, Homo sapiens
aggagagaggaggaa

SEQ ID NO: 4856107 - DNA, 12 bp, Homo sapiens
aggagcatcctt

SEQ ID NO: 4856108 - DNA, 19 bp, Homo sapiens
aggagcatccttggcagtg

SEQ ID NO: 4856109 - DNA, 13 bp, Homo sapiens
aggagccagcctg

SEQ ID NO: 4856110 - DNA, 18 bp, Homo sapiens
aggagcctggccaggcag

SEQ ID NO: 4856111 - DNA, 13 bp, Homo sapiens
aggaggaaaagtc

SEQ ID NO: 4856112 - DNA, 19 bp, Homo sapiens
aggaggaaaagtcttccta

SEQ ID NO: 4856113 - DNA, 22 bp, Homo sapiens
aggaggtgaaatccctgcctca

SEQ ID NO: 4856114 - DNA, 14 bp, Homo sapiens
aggagtaaaattca

SEQ ID NO: 4856115 - DNA, 16 bp, Homo sapiens
aggagtaaaattcagt

SEQ ID NO: 4856116 - DNA, 21 bp, Homo sapiens
aggagtaaaattcagtttttt

SEQ ID NO: 4856117 - DNA, 16 bp, Homo sapiens
aggagtctctgccagt

SEQ ID NO: 4856118 - DNA, 16 bp, Homo sapiens
aggataccttcttatt

SEQ ID NO: 4856119 - DNA, 19 bp, Homo sapiens
aggatccagggcagcaggc

SEQ ID NO: 4856120 - DNA, 20 bp, Homo sapiens
aggatccagggcagcaggcc

SEQ ID NO: 4856121 - DNA, 24 bp, Homo sapiens
aggatccagggcagcaggccagag

SEQ ID NO: 4856122 - DNA, 16 bp, Homo sapiens
aggatccccctctttg

SEQ ID NO: 4856123 - DNA, 16 bp, Homo sapiens
aggatcccgtcttcca

SEQ ID NO: 4856124 - DNA, 14 bp, Homo sapiens
aggatccggaaaga

SEQ ID NO: 4856125 - DNA, 16 bp, Homo sapiens
aggatccggaaagaag

SEQ ID NO: 4856126 - DNA, 14 bp, Homo sapiens
aggatcctggcctg

SEQ ID NO: 4856127 - DNA, 15 bp, Homo sapiens
aggatcctggcctga

SEQ ID NO: 4856128 - DNA, 16 bp, Homo sapiens
aggatgctaacatcta

SEQ ID NO: 4856129 - DNA, 19 bp, Homo sapiens
aggatgctaacatctaaaa

SEQ ID NO: 4856130 - DNA, 18 bp, Homo sapiens
aggatgtgatatataagt

SEQ ID NO: 4856131 - DNA, 17 bp, Homo sapiens
aggcaaagaaaatgaaa

SEQ ID NO: 4856132 - DNA, 18 bp, Homo sapiens
aggcaagaaagcttcctt

SEQ ID NO: 4856133 - DNA, 21 bp, Homo sapiens
aggcaagctgaaattttagaa

SEQ ID NO: 4856134 - DNA, 16 bp, Homo sapiens
aggcactgagcaggga

SEQ ID NO: 4856135 - DNA, 19 bp, Homo sapiens
aggcactgagcagggatct

SEQ ID NO: 4856136 - DNA, 21 bp, Homo sapiens
aggcagacaaccttgtcccaa

SEQ ID NO: 4856137 - DNA, 13 bp, Homo sapiens
aggcagagaaatc

SEQ ID NO: 4856138 - DNA, 16 bp, Homo sapiens
aggcagatagcactgg

SEQ ID NO: 4856139 - DNA, 15 bp, Homo sapiens
aggcagatgtttgcc

SEQ ID NO: 4856140 - DNA, 23 bp, Homo sapiens
aggcagcctagcctatgtctggc

SEQ ID NO: 4856141 - DNA, 15 bp, Homo sapiens
aggcagctgaaattc

SEQ ID NO: 4856142 - DNA, 18 bp, Homo sapiens
aggcaggacttctcacca

SEQ ID NO: 4856143 - DNA, 16 bp, Homo sapiens
aggcagggagagagta

SEQ ID NO: 4856144 - DNA, 19 bp, Homo sapiens
aggcatctgttagcagagt

SEQ ID NO: 4856145 - DNA, 23 bp, Homo sapiens
aggcatctgttagcagagtctgt

SEQ ID NO: 4856146 - DNA, 19 bp, Homo sapiens
aggcatgaaattcttccta

SEQ ID NO: 4856147 - DNA, 18 bp, Homo sapiens
aggcatgtgtctggccct

SEQ ID NO: 4856148 - DNA, 20 bp, Homo sapiens
aggcattctcccagctctag

SEQ ID NO: 4856149 - DNA, 23 bp, Homo sapiens
aggccacagaaggtgaactttgt

SEQ ID NO: 4856150 - DNA, 20 bp, Homo sapiens
aggccaccccctatcctctg

SEQ ID NO: 4856151 - DNA, 13 bp, Homo sapiens
aggccagaaaggt

SEQ ID NO: 4856152 - DNA, 14 bp, Homo sapiens
aggccagaaaggtg

SEQ ID NO: 4856153 - DNA, 12 bp, Homo sapiens
aggccagagaaa

SEQ ID NO: 4856154 - DNA, 17 bp, Homo sapiens
aggccagagaaagcaaa

SEQ ID NO: 4856155 - DNA, 20 bp, Homo sapiens
aggccagagaaagcaaaggt

SEQ ID NO: 4856156 - DNA, 15 bp, Homo sapiens
aggccagcagctgat

SEQ ID NO: 4856157 - DNA, 22 bp, Homo sapiens
aggccagccttgtacagtctgc

SEQ ID NO: 4856158 - DNA, 22 bp, Homo sapiens
aggccatggcatccctttttca

SEQ ID NO: 4856159 - DNA, 14 bp, Homo sapiens
aggccatttttggt

SEQ ID NO: 4856160 - DNA, 13 bp, Homo sapiens
aggcccagagagg

SEQ ID NO: 4856161 - DNA, 13 bp, Homo sapiens
aggccctgtgagc

SEQ ID NO: 4856162 - DNA, 17 bp, Homo sapiens
aggccctgtgagcacaa

SEQ ID NO: 4856163 - DNA, 16 bp, Homo sapiens
aggcccttagagggaa

SEQ ID NO: 4856164 - DNA, 20 bp, Homo sapiens
aggccgccagcgtgtggagc

SEQ ID NO: 4856165 - DNA, 15 bp, Homo sapiens
aggcctcccaagctg

SEQ ID NO: 4856166 - DNA, 21 bp, Homo sapiens
aggcctcccaagctgatggac

SEQ ID NO: 4856167 - DNA, 23 bp, Homo sapiens
aggcctctgggacccacagaact

SEQ ID NO: 4856168 - DNA, 23 bp, Homo sapiens
aggcctgcttgactttccagaat

SEQ ID NO: 4856169 - DNA, 17 bp, Homo sapiens
aggccttatctgaaagg

SEQ ID NO: 4856170 - DNA, 21 bp, Homo sapiens
aggccttatctgaaaggccag

SEQ ID NO: 4856171 - DNA, 22 bp, Homo sapiens
aggccttatctgaaaggccagc

SEQ ID NO: 4856172 - DNA, 20 bp, Homo sapiens
aggctactgtaatgctgcct

SEQ ID NO: 4856173 - DNA, 19 bp, Homo sapiens
aggctcagactgggcactg

SEQ ID NO: 4856174 - DNA, 13 bp, Homo sapiens
aggctcagagagg

SEQ ID NO: 4856175 - DNA, 14 bp, Homo sapiens
aggctcctccttgc

SEQ ID NO: 4856176 - DNA, 17 bp, Homo sapiens
aggctcctctaggccct

SEQ ID NO: 4856177 - DNA, 15 bp, Homo sapiens
aggctcttcttcctc

SEQ ID NO: 4856178 - DNA, 16 bp, Homo sapiens
aggctcttcttcctca

SEQ ID NO: 4856179 - DNA, 23 bp, Homo sapiens
agttttgttgtacttaaatggta

SEQ ID NO: 4856180 - DNA, 14 bp, Homo sapiens
agtttttgacattt

SEQ ID NO: 4856181 - DNA, 13 bp, Homo sapiens
agtttttgatagt

SEQ ID NO: 4856182 - DNA, 16 bp, Homo sapiens
agtttttggttgggaa

SEQ ID NO: 4856183 - DNA, 17 bp, Homo sapiens
agtttttggttgggaat

SEQ ID NO: 4856184 - DNA, 11 bp, Homo sapiens
ataaaactctg

SEQ ID NO: 4856185 - DNA, 18 bp, Homo sapiens
ataaaatagtatgaaaat

SEQ ID NO: 4856186 - DNA, 17 bp, Homo sapiens
ataaaatatatcttata

SEQ ID NO: 4856187 - DNA, 20 bp, Homo sapiens
ataaaatttaaaaaataaat

SEQ ID NO: 4856188 - DNA, 23 bp, Homo sapiens
ataaagaaggatgatgtcttttt

SEQ ID NO: 4856189 - DNA, 14 bp, Homo sapiens
ataaagatgagttg

SEQ ID NO: 4856190 - DNA, 15 bp, Homo sapiens
ataaagatgagttgg

SEQ ID NO: 4856191 - DNA, 14 bp, Homo sapiens
ataaaggataaaga

SEQ ID NO: 4856192 - DNA, 18 bp, Homo sapiens
ataaagtaaatacatgca

SEQ ID NO: 4856193 - DNA, 17 bp, Homo sapiens
ataaagtataatgttta

SEQ ID NO: 4856194 - DNA, 20 bp, Homo sapiens
ataaatgtataaatatacag

SEQ ID NO: 4856195 - DNA, 19 bp, Homo sapiens
ataaattatttgattattt

SEQ ID NO: 4856196 - DNA, 15 bp, Homo sapiens
ataaattcaactttg

SEQ ID NO: 4856197 - DNA, 21 bp, Homo sapiens
ataaatttaaacttacaaact

SEQ ID NO: 4856198 - DNA, 15 bp, Homo sapiens
ataaattttttataa

SEQ ID NO: 4856199 - DNA, 23 bp, Homo sapiens
ataacacatttttttgcatgcat

SEQ ID NO: 4856200 - DNA, 19 bp, Homo sapiens
ataactcacacccctgccc

SEQ ID NO: 4856201 - DNA, 18 bp, Homo sapiens
ataacttctcatgtatat

SEQ ID NO: 4856202 - DNA, 23 bp, Homo sapiens
ataagacaaatattcctttgcat

SEQ ID NO: 4856203 - DNA, 14 bp, Homo sapiens
ataagagaaacctg

SEQ ID NO: 4856204 - DNA, 16 bp, Homo sapiens
ataagagaaacctgcc

SEQ ID NO: 4856205 - DNA, 17 bp, Homo sapiens
ataagagaaacctgcca

SEQ ID NO: 4856206 - DNA, 15 bp, Homo sapiens
ataagataaaatgat

SEQ ID NO: 4856207 - DNA, 12 bp, Homo sapiens
ataaggaaattt

SEQ ID NO: 4856208 - DNA, 14 bp, Homo sapiens
ataagtgtacatat

SEQ ID NO: 4856209 - DNA, 17 bp, Homo sapiens
ataataaaaagaaagat

SEQ ID NO: 4856210 - DNA, 23 bp, Homo sapiens
ataataaaaagaaagatacttac

SEQ ID NO: 4856211 - DNA, 15 bp, Homo sapiens
ataataaaaatatat

SEQ ID NO: 4856212 - DNA, 20 bp, Homo sapiens
ataataagagaatgttccta

SEQ ID NO: 4856213 - DNA, 18 bp, Homo sapiens
ataatacagaatcttgtt

SEQ ID NO: 4856214 - DNA, 14 bp, Homo sapiens
ataatactactact

SEQ ID NO: 4856215 - DNA, 16 bp, Homo sapiens
ataatactactactgt

SEQ ID NO: 4856216 - DNA, 22 bp, Homo sapiens
ataatattgtttggtaaatgtt

SEQ ID NO: 4856217 - DNA, 20 bp, Homo sapiens
ataatctgtttttacgtatg

SEQ ID NO: 4856218 - DNA, 14 bp, Homo sapiens
ataatgaataaatc

SEQ ID NO: 4856219 - DNA, 20 bp, Homo sapiens
ataatgctacaattttaaga

SEQ ID NO: 4856220 - DNA, 14 bp, Homo sapiens
ataatgtaacatga

SEQ ID NO: 4856221 - DNA, 15 bp, Homo sapiens
ataatgtaacatgat

SEQ ID NO: 4856222 - DNA, 17 bp, Homo sapiens
ataatgtttattaaatg

SEQ ID NO: 4856223 - DNA, 13 bp, Homo sapiens
ataattgtacaaa

SEQ ID NO: 4856224 - DNA, 19 bp, Homo sapiens
ataattgtacaaaattaag

SEQ ID NO: 4856225 - DNA, 21 bp, Homo sapiens
ataattgtacaaaattaagca

SEQ ID NO: 4856226 - DNA, 19 bp, Homo sapiens
ataatttccttcaggcagc

SEQ ID NO: 4856227 - DNA, 20 bp, Homo sapiens
atacagaatcttgttttgaa

SEQ ID NO: 4856228 - DNA, 22 bp, Homo sapiens
atacagatctcagggctcggga

SEQ ID NO: 4856229 - DNA, 14 bp, Homo sapiens
atacataaaagaaa

SEQ ID NO: 4856230 - DNA, 16 bp, Homo sapiens
atacataaaagaaata

SEQ ID NO: 4856231 - DNA, 15 bp, Homo sapiens
atacatgcatataat

SEQ ID NO: 4856232 - DNA, 16 bp, Homo sapiens
atacatgtgatacatt

SEQ ID NO: 4856233 - DNA, 23 bp, Homo sapiens
ataccatatgaatgaaacatggg

SEQ ID NO: 4856234 - DNA, 20 bp, Homo sapiens
ataccattctattctccaga

SEQ ID NO: 4856235 - DNA, 22 bp, Homo sapiens
ataccattctattctccagaca

SEQ ID NO: 4856236 - DNA, 22 bp, Homo sapiens
ataccatttagtaagaatacca

SEQ ID NO: 4856237 - DNA, 15 bp, Homo sapiens
atactactactgtta

SEQ ID NO: 4856238 - DNA, 14 bp, Homo sapiens
atactattgcctca

SEQ ID NO: 4856239 - DNA, 18 bp, Homo sapiens
atactccttgcttcctga

SEQ ID NO: 4856240 - DNA, 18 bp, Homo sapiens
atactgccttgtttaatg

SEQ ID NO: 4856241 - DNA, 23 bp, Homo sapiens
atactgggacaccattaccaaaa

SEQ ID NO: 4856242 - DNA, 11 bp, Homo sapiens
atactgtggcc

SEQ ID NO: 4856243 - DNA, 19 bp, Homo sapiens
atactgtggcctgcaggag

SEQ ID NO: 4856244 - DNA, 17 bp, Homo sapiens
atacttgccttctgata

SEQ ID NO: 4856245 - DNA, 18 bp, Homo sapiens
atactttagtagacattt

SEQ ID NO: 4856246 - DNA, 15 bp, Homo sapiens
atagacaaaaagtat

SEQ ID NO: 4856247 - DNA, 13 bp, Homo sapiens
atagacatgaaag

SEQ ID NO: 4856248 - DNA, 19 bp, Homo sapiens
atagactgtaacttccaaa

SEQ ID NO: 4856249 - DNA, 19 bp, Homo sapiens
atagacttggagaatactg

SEQ ID NO: 4856250 - DNA, 20 bp, Homo sapiens
atagatgtgcagtttggaat

SEQ ID NO: 4856251 - DNA, 14 bp, Homo sapiens
atagcaccagggct

SEQ ID NO: 4856252 - DNA, 18 bp, Homo sapiens
atagcagtatatgttaat

SEQ ID NO: 4856253 - DNA, 18 bp, Homo sapiens
ataggaatcattcagaaa

SEQ ID NO: 4856254 - DNA, 21 bp, Homo sapiens
ataggaatcattcagaaatgt

SEQ ID NO: 4856255 - DNA, 18 bp, Homo sapiens
ataggctattaaaaaagt

SEQ ID NO: 4856256 - DNA, 17 bp, Homo sapiens
ataggctattttctaaa

SEQ ID NO: 4856257 - DNA, 20 bp, Homo sapiens
ataggctattttctaaagac

SEQ ID NO: 4856258 - DNA, 21 bp, Homo sapiens
ataggctattttctaaagact

SEQ ID NO: 4856259 - DNA, 22 bp, Homo sapiens
ataggctattttctaaagactt

SEQ ID NO: 4856260 - DNA, 12 bp, Homo sapiens
ataggctgggga

SEQ ID NO: 4856261 - DNA, 18 bp, Homo sapiens
atagggggaagacagata

SEQ ID NO: 4856262 - DNA, 20 bp, Homo sapiens
atagggtctaccaatacaaa

SEQ ID NO: 4856263 - DNA, 23 bp, Homo sapiens
atagggtctaccaatacaaaatg

SEQ ID NO: 4856264 - DNA, 16 bp, Homo sapiens
ataggtagctggggag

SEQ ID NO: 4856265 - DNA, 13 bp, Homo sapiens
atagtaagcatag

SEQ ID NO: 4856266 - DNA, 22 bp, Homo sapiens
atagtcttggaagctgtttgga

SEQ ID NO: 4856267 - DNA, 18 bp, Homo sapiens
atagtgcaacatctctga

SEQ ID NO: 4856268 - DNA, 19 bp, Homo sapiens
atagtgcaacatctctgaa

SEQ ID NO: 4856269 - DNA, 21 bp, Homo sapiens
atagtggggttccatgagtta

SEQ ID NO: 4856270 - DNA, 18 bp, Homo sapiens
atagttgcatagcagtat

SEQ ID NO: 4856271 - DNA, 20 bp, Homo sapiens
atagttgcatagcagtatat

SEQ ID NO: 4856272 - DNA, 12 bp, Homo sapiens
atataacacatt

SEQ ID NO: 4856273 - DNA, 13 bp, Homo sapiens
atataagacaaat

SEQ ID NO: 4856274 - DNA, 14 bp, Homo sapiens
atataagtgtacat

SEQ ID NO: 4856275 - DNA, 18 bp, Homo sapiens
atataagtgtacatatgt

SEQ ID NO: 4856276 - DNA, 19 bp, Homo sapiens
atataatgaataaatcatt

SEQ ID NO: 4856277 - DNA, 19 bp, Homo sapiens
atataccaaattaaaaaaa

SEQ ID NO: 4856278 - DNA, 16 bp, Homo sapiens
atatagacttggagaa

SEQ ID NO: 4856279 - DNA, 22 bp, Homo sapiens
atatagacttggagaatactgc

SEQ ID NO: 4856280 - DNA, 18 bp, Homo sapiens
atataggttcttttctct

SEQ ID NO: 4856281 - DNA, 12 bp, Homo sapiens
atatataaatgt

SEQ ID NO: 4856282 - DNA, 15 bp, Homo sapiens
atatataagtgtaca

SEQ ID NO: 4856283 - DNA, 16 bp, Homo sapiens
atatataagtgtacat

SEQ ID NO: 4856284 - DNA, 15 bp, Homo sapiens
atatatataaatgta

SEQ ID NO: 4856285 - DNA, 15 bp, Homo sapiens
atatatataggttct

SEQ ID NO: 4856286 - DNA, 15 bp, Homo sapiens
atatatcatgagtga

SEQ ID NO: 4856287 - DNA, 15 bp, Homo sapiens
atatatgtatttcta

SEQ ID NO: 4856288 - DNA, 13 bp, Homo sapiens
atatatttattga

SEQ ID NO: 4856289 - DNA, 16 bp, Homo sapiens
atatattttgtgtgaa

SEQ ID NO: 4856290 - DNA, 19 bp, Homo sapiens
atatattttgtgtgaaatt

SEQ ID NO: 4856291 - DNA, 20 bp, Homo sapiens
atatattttgtgtgaaattg

SEQ ID NO: 4856292 - DNA, 13 bp, Homo sapiens
atatcaaagtcat

SEQ ID NO: 4856293 - DNA, 15 bp, Homo sapiens
atatccctacatgta

SEQ ID NO: 4856294 - DNA, 16 bp, Homo sapiens
atatccctacatgtat

SEQ ID NO: 4856295 - DNA, 17 bp, Homo sapiens
atatccctacatgtatt

SEQ ID NO: 4856296 - DNA, 19 bp, Homo sapiens
atatcccttggacatttta

SEQ ID NO: 4856297 - DNA, 20 bp, Homo sapiens
atatcctccttctcctgttc

SEQ ID NO: 4856298 - DNA, 16 bp, Homo sapiens
atatctgcatgtgtca

SEQ ID NO: 4856299 - DNA, 17 bp, Homo sapiens
atgtaatttaaatgaaa

SEQ ID NO: 4856300 - DNA, 20 bp, Homo sapiens
atgtaatttaaatgaaagaa

SEQ ID NO: 4856301 - DNA, 23 bp, Homo sapiens
atgtaattttattttaaaatttc

SEQ ID NO: 4856302 - DNA, 14 bp, Homo sapiens
atgtacagattctt

SEQ ID NO: 4856303 - DNA, 19 bp, Homo sapiens
atgtactgatttcagtaag

SEQ ID NO: 4856304 - DNA, 19 bp, Homo sapiens
atgtacttccctcttgaaa

SEQ ID NO: 4856305 - DNA, 14 bp, Homo sapiens
atgtagccagctgt

SEQ ID NO: 4856306 - DNA, 16 bp, Homo sapiens
atgtagccagctgtgc

SEQ ID NO: 4856307 - DNA, 14 bp, Homo sapiens
atgtagtatctata

SEQ ID NO: 4856308 - DNA, 12 bp, Homo sapiens
atgtataaatat

SEQ ID NO: 4856309 - DNA, 17 bp, Homo sapiens
atgtataaatatacagt

SEQ ID NO: 4856310 - DNA, 14 bp, Homo sapiens
atgtatataaactg

SEQ ID NO: 4856311 - DNA, 18 bp, Homo sapiens
atgtatataaactgggat

SEQ ID NO: 4856312 - DNA, 16 bp, Homo sapiens
atgtatgagtgtatgt

SEQ ID NO: 4856313 - DNA, 22 bp, Homo sapiens
atgtattgcacattgtaaaaag

SEQ ID NO: 4856314 - DNA, 21 bp, Homo sapiens
atgtatttctatatagacttg

SEQ ID NO: 4856315 - DNA, 20 bp, Homo sapiens
atgtcagctgctgttgaact

SEQ ID NO: 4856316 - DNA, 21 bp, Homo sapiens
atgtcagctgctgttgaactt

SEQ ID NO: 4856317 - DNA, 14 bp, Homo sapiens
atgtccaaaattta

SEQ ID NO: 4856318 - DNA, 14 bp, Homo sapiens
atgtccagccaccc

SEQ ID NO: 4856319 - DNA, 23 bp, Homo sapiens
atgtctcaggtttgttttgtgaa

SEQ ID NO: 4856320 - DNA, 22 bp, Homo sapiens
atgtctggctcaaagcagcagg

SEQ ID NO: 4856321 - DNA, 22 bp, Homo sapiens
atgtctttttattaaaatattt

SEQ ID NO: 4856322 - DNA, 19 bp, Homo sapiens
atgtgacatttatatattg

SEQ ID NO: 4856323 - DNA, 15 bp, Homo sapiens
atgtgagctcttcct

SEQ ID NO: 4856324 - DNA, 14 bp, Homo sapiens
atgtgagtctggga

SEQ ID NO: 4856325 - DNA, 15 bp, Homo sapiens
atgtgatacattttt

SEQ ID NO: 4856326 - DNA, 21 bp, Homo sapiens
atgtgatacattttttaagct

SEQ ID NO: 4856327 - DNA, 13 bp, Homo sapiens
atgtgatatataa

SEQ ID NO: 4856328 - DNA, 15 bp, Homo sapiens
atgtgatatataagt

SEQ ID NO: 4856329 - DNA, 17 bp, Homo sapiens
atgtgatatataagtgt

SEQ ID NO: 4856330 - DNA, 14 bp, Homo sapiens
atgtgcagtttgga

SEQ ID NO: 4856331 - DNA, 16 bp, Homo sapiens
atgtgcagtttggaat

SEQ ID NO: 4856332 - DNA, 19 bp, Homo sapiens
atgtgctatacacacacac

SEQ ID NO: 4856333 - DNA, 22 bp, Homo sapiens
atgtgctggtgaacactgtgac

SEQ ID NO: 4856334 - DNA, 16 bp, Homo sapiens
atgtggcctttgaatt

SEQ ID NO: 4856335 - DNA, 17 bp, Homo sapiens
atgtgggatattgaatg

SEQ ID NO: 4856336 - DNA, 21 bp, Homo sapiens
atgtgtaataatgtaacatga

SEQ ID NO: 4856337 - DNA, 15 bp, Homo sapiens
atgtgtagagcccct

SEQ ID NO: 4856338 - DNA, 13 bp, Homo sapiens
atgtgttcttatt

SEQ ID NO: 4856339 - DNA, 17 bp, Homo sapiens
atgttaaagagaatgag

SEQ ID NO: 4856340 - DNA, 21 bp, Homo sapiens
atgttatacatcaatatgtat

SEQ ID NO: 4856341 - DNA, 20 bp, Homo sapiens
atgttctattttttgttttg

SEQ ID NO: 4856342 - DNA, 20 bp, Homo sapiens
atgttctccagtcattatgt

SEQ ID NO: 4856343 - DNA, 19 bp, Homo sapiens
atgttctttcacccatcct

SEQ ID NO: 4856344 - DNA, 12 bp, Homo sapiens
atgttctttctg

SEQ ID NO: 4856345 - DNA, 20 bp, Homo sapiens
atgttgactgacttatggca

SEQ ID NO: 4856346 - DNA, 16 bp, Homo sapiens
atgttggagcagcagg

SEQ ID NO: 4856347 - DNA, 19 bp, Homo sapiens
atgttggagcagcaggcct

SEQ ID NO: 4856348 - DNA, 17 bp, Homo sapiens
atgttgtttataataaa

SEQ ID NO: 4856349 - DNA, 20 bp, Homo sapiens
atgttgtttataataaaaat

SEQ ID NO: 4856350 - DNA, 21 bp, Homo sapiens
atgtttcttttgtttggtaaa

SEQ ID NO: 4856351 - DNA, 14 bp, Homo sapiens
atgtttggaaaata

SEQ ID NO: 4856352 - DNA, 20 bp, Homo sapiens
atgttttaccgtaataatta

SEQ ID NO: 4856353 - DNA, 12 bp, Homo sapiens
atgttttcaaat

SEQ ID NO: 4856354 - DNA, 15 bp, Homo sapiens
atgttttcaaatgtt

SEQ ID NO: 4856355 - DNA, 18 bp, Homo sapiens
atgttttcaaatgttctc

SEQ ID NO: 4856356 - DNA, 15 bp, Homo sapiens
attaaaaaaaaattg

SEQ ID NO: 4856357 - DNA, 20 bp, Homo sapiens
attaaaaaacaattaactgc

SEQ ID NO: 4856358 - DNA, 22 bp, Homo sapiens
attaaaaaacttcatgtaattt

SEQ ID NO: 4856359 - DNA, 13 bp, Homo sapiens
attaaaaaagtct

SEQ ID NO: 4856360 - DNA, 18 bp, Homo sapiens
attaaaaacgaaaacctg

SEQ ID NO: 4856361 - DNA, 23 bp, Homo sapiens
attaaaagatgtctctgcaaacc

SEQ ID NO: 4856362 - DNA, 22 bp, Homo sapiens
attaaagacaggagacaaaaga

SEQ ID NO: 4856363 - DNA, 16 bp, Homo sapiens
attaaagcatttccta

SEQ ID NO: 4856364 - DNA, 11 bp, Homo sapiens
attaaagtcag

SEQ ID NO: 4856365 - DNA, 14 bp, Homo sapiens
attaaataacatgt

SEQ ID NO: 4856366 - DNA, 22 bp, Homo sapiens
attaactgccctctgaaataat

SEQ ID NO: 4856367 - DNA, 16 bp, Homo sapiens
attaactgttgcactt

SEQ ID NO: 4856368 - DNA, 17 bp, Homo sapiens
attaagcaaatgttaaa

SEQ ID NO: 4856369 - DNA, 18 bp, Homo sapiens
attaaggggaagaatgaa

SEQ ID NO: 4856370 - DNA, 16 bp, Homo sapiens
attaattaatttggag

SEQ ID NO: 4856371 - DNA, 24 bp, Homo sapiens
attacaaagttaaaattgttatca

SEQ ID NO: 4856372 - DNA, 12 bp, Homo sapiens
attaccaaaata

SEQ ID NO: 4856373 - DNA, 13 bp, Homo sapiens
attacccaatgga

SEQ ID NO: 4856374 - DNA, 20 bp, Homo sapiens
attacctccatccatccttc

SEQ ID NO: 4856375 - DNA, 22 bp, Homo sapiens
attacctccatccatccttcca

SEQ ID NO: 4856376 - DNA, 19 bp, Homo sapiens
attacctggatgttctttt

SEQ ID NO: 4856377 - DNA, 13 bp, Homo sapiens
attactgacattt

SEQ ID NO: 4856378 - DNA, 13 bp, Homo sapiens
attactgcaatca

SEQ ID NO: 4856379 - DNA, 18 bp, Homo sapiens
attactgctttaatcaga

SEQ ID NO: 4856380 - DNA, 20 bp, Homo sapiens
attactgctttaatcagaaa

SEQ ID NO: 4856381 - DNA, 23 bp, Homo sapiens
attagaaacaaacaaaactctta

SEQ ID NO: 4856382 - DNA, 12 bp, Homo sapiens
attagacttgaa

SEQ ID NO: 4856383 - DNA, 16 bp, Homo sapiens
attagcaaggcagagc

SEQ ID NO: 4856384 - DNA, 19 bp, Homo sapiens
attaggtttcagcagagct

SEQ ID NO: 4856385 - DNA, 15 bp, Homo sapiens
attatacatgtgata

SEQ ID NO: 4856386 - DNA, 21 bp, Homo sapiens
attatacatgtgatacatttt

SEQ ID NO: 4856387 - DNA, 19 bp, Homo sapiens
attatatattgcaaggtgt

SEQ ID NO: 4856388 - DNA, 18 bp, Homo sapiens
attatcttgttcaggaaa

SEQ ID NO: 4856389 - DNA, 18 bp, Homo sapiens
attatgcaattcagtgtt

SEQ ID NO: 4856390 - DNA, 20 bp, Homo sapiens
attatgtgaccataatgtac

SEQ ID NO: 4856391 - DNA, 13 bp, Homo sapiens
attatgttaatat

SEQ ID NO: 4856392 - DNA, 14 bp, Homo sapiens
attatgttaatatt

SEQ ID NO: 4856393 - DNA, 15 bp, Homo sapiens
attattatatacata

SEQ ID NO: 4856394 - DNA, 17 bp, Homo sapiens
attattgatgttttcat

SEQ ID NO: 4856395 - DNA, 14 bp, Homo sapiens
attatttaagacta

SEQ ID NO: 4856396 - DNA, 18 bp, Homo sapiens
attatttgattatttaag

SEQ ID NO: 4856397 - DNA, 18 bp, Homo sapiens
attatttttataattgta

SEQ ID NO: 4856398 - DNA, 17 bp, Homo sapiens
attatttttttaaaatt

SEQ ID NO: 4856399 - DNA, 22 bp, Homo sapiens
attatttttttaaaattttgta

SEQ ID NO: 4856400 - DNA, 12 bp, Homo sapiens
attcagaaaaaa

SEQ ID NO: 4856401 - DNA, 18 bp, Homo sapiens
attcagggtaaataggaa

SEQ ID NO: 4856402 - DNA, 14 bp, Homo sapiens
attcaggtaacact

SEQ ID NO: 4856403 - DNA, 19 bp, Homo sapiens
attcagtttttttccagtt

SEQ ID NO: 4856404 - DNA, 15 bp, Homo sapiens
attcattctttttga

SEQ ID NO: 4856405 - DNA, 13 bp, Homo sapiens
attccaaaatatt

SEQ ID NO: 4856406 - DNA, 16 bp, Homo sapiens
attccaccctgttact

SEQ ID NO: 4856407 - DNA, 20 bp, Homo sapiens
attccagatctttcagaaat

SEQ ID NO: 4856408 - DNA, 13 bp, Homo sapiens
attccatatttat

SEQ ID NO: 4856409 - DNA, 12 bp, Homo sapiens
attcccagcctg

SEQ ID NO: 4856410 - DNA, 22 bp, Homo sapiens
attcccagcctgactagaactc

SEQ ID NO: 4856411 - DNA, 14 bp, Homo sapiens
attccccagtgact

SEQ ID NO: 4856412 - DNA, 20 bp, Homo sapiens
attccccagtgactccaggg

SEQ ID NO: 4856413 - DNA, 21 bp, Homo sapiens
attccccccattttgcctctg

SEQ ID NO: 4856414 - DNA, 23 bp, Homo sapiens
attcccttttcaccttttcagga

SEQ ID NO: 4856415 - DNA, 16 bp, Homo sapiens
attcctgatcccatgg

SEQ ID NO: 4856416 - DNA, 13 bp, Homo sapiens
attctataaaact

SEQ ID NO: 4856417 - DNA, 14 bp, Homo sapiens
attctataaaactc

SEQ ID NO: 4856418 - DNA, 24 bp, Homo sapiens
attctataaaactctgcatgtaga

SEQ ID NO: 4856419 - DNA, 13 bp, Homo sapiens
caagttttaaagt

SEQ ID NO: 4856420 - DNA, 14 bp, Homo sapiens
caataaaatttaaa

SEQ ID NO: 4856421 - DNA, 19 bp, Homo sapiens
caataaagtgatctgtgtt

SEQ ID NO: 4856422 - DNA, 21 bp, Homo sapiens
caataaccgcttggtttgcaa

SEQ ID NO: 4856423 - DNA, 14 bp, Homo sapiens
caatacaaaatgta

SEQ ID NO: 4856424 - DNA, 11 bp, Homo sapiens
caatactgctt

SEQ ID NO: 4856425 - DNA, 18 bp, Homo sapiens
caataggtagctggggag

SEQ ID NO: 4856426 - DNA, 23 bp, Homo sapiens
caatatgtatatatgtatttcta

SEQ ID NO: 4856427 - DNA, 19 bp, Homo sapiens
caatattccagatctttca

SEQ ID NO: 4856428 - DNA, 16 bp, Homo sapiens
caatattgattgggaa

SEQ ID NO: 4856429 - DNA, 17 bp, Homo sapiens
caatattgattgggaaa

SEQ ID NO: 4856430 - DNA, 21 bp, Homo sapiens
caatattgattgggaaaacat

SEQ ID NO: 4856431 - DNA, 22 bp, Homo sapiens
caatcacagggaatggccacaa

SEQ ID NO: 4856432 - DNA, 17 bp, Homo sapiens
caatctctttttgtttg

SEQ ID NO: 4856433 - DNA, 16 bp, Homo sapiens
caatctggattcatat

SEQ ID NO: 4856434 - DNA, 13 bp, Homo sapiens
caatgaattatta

SEQ ID NO: 4856435 - DNA, 15 bp, Homo sapiens
caatgactcaaagtc

SEQ ID NO: 4856436 - DNA, 16 bp, Homo sapiens
caatgcttgcatggag

SEQ ID NO: 4856437 - DNA, 22 bp, Homo sapiens
caatgcttgcatggagaatggg

SEQ ID NO: 4856438 - DNA, 21 bp, Homo sapiens
caatggtgtggtgaatgtgtg

SEQ ID NO: 4856439 - DNA, 18 bp, Homo sapiens
caatgtattttatcttat

SEQ ID NO: 4856440 - DNA, 13 bp, Homo sapiens
caatgttggagca

SEQ ID NO: 4856441 - DNA, 21 bp, Homo sapiens
caatgttggagcagcaggcct

SEQ ID NO: 4856442 - DNA, 21 bp, Homo sapiens
caattaaaaacgaaaacctga

SEQ ID NO: 4856443 - DNA, 14 bp, Homo sapiens
caattagacttgaa

SEQ ID NO: 4856444 - DNA, 13 bp, Homo sapiens
caattcagtgttc

SEQ ID NO: 4856445 - DNA, 14 bp, Homo sapiens
caatttaaaacaat

SEQ ID NO: 4856446 - DNA, 22 bp, Homo sapiens
caatttctagtacctgtgactc

SEQ ID NO: 4856447 - DNA, 14 bp, Homo sapiens
cacaaacctgcccg

SEQ ID NO: 4856448 - DNA, 17 bp, Homo sapiens
cacaactactagtgtga

SEQ ID NO: 4856449 - DNA, 14 bp, Homo sapiens
cacaagactggccc

SEQ ID NO: 4856450 - DNA, 16 bp, Homo sapiens
cacaatgttggagcag

SEQ ID NO: 4856451 - DNA, 13 bp, Homo sapiens
cacacacacacac

SEQ ID NO: 4856452 - DNA, 21 bp, Homo sapiens
cacacacgatgcatttaataa

SEQ ID NO: 4856453 - DNA, 10 bp, Homo sapiens
cacacgatgc

SEQ ID NO: 4856454 - DNA, 11 bp, Homo sapiens
cacacgatgca

SEQ ID NO: 4856455 - DNA, 19 bp, Homo sapiens
cacacgatgcatttaataa

SEQ ID NO: 4856456 - DNA, 21 bp, Homo sapiens
cacacgatgcatttaataaag

SEQ ID NO: 4856457 - DNA, 24 bp, Homo sapiens
cacacgatgcatttaataaagatg

SEQ ID NO: 4856458 - DNA, 21 bp, Homo sapiens
cacactcagaaaattccctgg

SEQ ID NO: 4856459 - DNA, 21 bp, Homo sapiens
cacactgcttggcccttcaag

SEQ ID NO: 4856460 - DNA, 12 bp, Homo sapiens
cacactggagga

SEQ ID NO: 4856461 - DNA, 22 bp, Homo sapiens
cacagaaggtgaactttgtgct

SEQ ID NO: 4856462 - DNA, 23 bp, Homo sapiens
cacagagcaagagataagtcttt

SEQ ID NO: 4856463 - DNA, 21 bp, Homo sapiens
cacagcatgaggcaaaaatgt

SEQ ID NO: 4856464 - DNA, 17 bp, Homo sapiens
cacaggatcctggcctg

SEQ ID NO: 4856465 - DNA, 21 bp, Homo sapiens
cacaggatcctggcctgagaa

SEQ ID NO: 4856466 - DNA, 20 bp, Homo sapiens
cacaggcacattaactgttg

SEQ ID NO: 4856467 - DNA, 20 bp, Homo sapiens
cacagggaatggccacaaac

SEQ ID NO: 4856468 - DNA, 21 bp, Homo sapiens
cacaggggccatgtcctctct

SEQ ID NO: 4856469 - DNA, 20 bp, Homo sapiens
cacatacacccaaacactta

SEQ ID NO: 4856470 - DNA, 14 bp, Homo sapiens
cacatagcataggc

SEQ ID NO: 4856471 - DNA, 18 bp, Homo sapiens
cacatcaaataagaaata

SEQ ID NO: 4856472 - DNA, 12 bp, Homo sapiens
cacatccatccc

SEQ ID NO: 4856473 - DNA, 21 bp, Homo sapiens
cacatggccatcttctttctt

SEQ ID NO: 4856474 - DNA, 15 bp, Homo sapiens
cacattaactgttgc

SEQ ID NO: 4856475 - DNA, 16 bp, Homo sapiens
cacattaactgttgca

SEQ ID NO: 4856476 - DNA, 23 bp, Homo sapiens
cacatttctttgcattccagctg

SEQ ID NO: 4856477 - DNA, 15 bp, Homo sapiens
caccaacctccagac

SEQ ID NO: 4856478 - DNA, 16 bp, Homo sapiens
caccagccccccgcgc

SEQ ID NO: 4856479 - DNA, 18 bp, Homo sapiens
caccatactccttgcttc

SEQ ID NO: 4856480 - DNA, 13 bp, Homo sapiens
caccattctacct

SEQ ID NO: 4856481 - DNA, 13 bp, Homo sapiens
cacccacaaactc

SEQ ID NO: 4856482 - DNA, 20 bp, Homo sapiens
caccccagggacagggccct

SEQ ID NO: 4856483 - DNA, 15 bp, Homo sapiens
cacccccaggcatct

SEQ ID NO: 4856484 - DNA, 13 bp, Homo sapiens
cacccccatccct

SEQ ID NO: 4856485 - DNA, 23 bp, Homo sapiens
caccccttaccccaaagagaaag

SEQ ID NO: 4856486 - DNA, 18 bp, Homo sapiens
caccctccatgctcctca

SEQ ID NO: 4856487 - DNA, 13 bp, Homo sapiens
caccctctgtcct

SEQ ID NO: 4856488 - DNA, 21 bp, Homo sapiens
caccctctgtccttcccccag

SEQ ID NO: 4856489 - DNA, 13 bp, Homo sapiens
caccgcaggtgct

SEQ ID NO: 4856490 - DNA, 22 bp, Homo sapiens
caccgtggcagcttgctgggct

SEQ ID NO: 4856491 - DNA, 16 bp, Homo sapiens
cacctcatcactggac

SEQ ID NO: 4856492 - DNA, 18 bp, Homo sapiens
cacctcatcactggactg

SEQ ID NO: 4856493 - DNA, 22 bp, Homo sapiens
cacctcttaaagaaaacccacc

SEQ ID NO: 4856494 - DNA, 17 bp, Homo sapiens
cacctgaatttgtatat

SEQ ID NO: 4856495 - DNA, 15 bp, Homo sapiens
cacctgcactaacag

SEQ ID NO: 4856496 - DNA, 16 bp, Homo sapiens
cacctgcactaacaga

SEQ ID NO: 4856497 - DNA, 20 bp, Homo sapiens
caccttcccctaaaccccaa

SEQ ID NO: 4856498 - DNA, 15 bp, Homo sapiens
cacgatgcatttaat

SEQ ID NO: 4856499 - DNA, 18 bp, Homo sapiens
cacgatgcatttaataaa

SEQ ID NO: 4856500 - DNA, 21 bp, Homo sapiens
cacgatgcatttaataaagat

SEQ ID NO: 4856501 - DNA, 12 bp, Homo sapiens
cacgcaggaagc

SEQ ID NO: 4856502 - DNA, 18 bp, Homo sapiens
cacgcctcaccagccccc

SEQ ID NO: 4856503 - DNA, 15 bp, Homo sapiens
cacgggggcagtgtg

SEQ ID NO: 4856504 - DNA, 21 bp, Homo sapiens
cacgtgggaacccccctccca

SEQ ID NO: 4856505 - DNA, 21 bp, Homo sapiens
cacgttggggtgatttaatcc

SEQ ID NO: 4856506 - DNA, 19 bp, Homo sapiens
cactaaaatgaggatccag

SEQ ID NO: 4856507 - DNA, 20 bp, Homo sapiens
cactaaaatgaggatccagg

SEQ ID NO: 4856508 - DNA, 16 bp, Homo sapiens
cactaacgaaatatca

SEQ ID NO: 4856509 - DNA, 14 bp, Homo sapiens
cactagccttccca

SEQ ID NO: 4856510 - DNA, 19 bp, Homo sapiens
cactagccttcccagcttc

SEQ ID NO: 4856511 - DNA, 14 bp, Homo sapiens
cactatttgtgact

SEQ ID NO: 4856512 - DNA, 12 bp, Homo sapiens
cactcacctcta

SEQ ID NO: 4856513 - DNA, 12 bp, Homo sapiens
cactcacctgca

SEQ ID NO: 4856514 - DNA, 16 bp, Homo sapiens
cactcagaaaattccc

SEQ ID NO: 4856515 - DNA, 18 bp, Homo sapiens
cactcagaaaattccctg

SEQ ID NO: 4856516 - DNA, 13 bp, Homo sapiens
cactccagctcct

SEQ ID NO: 4856517 - DNA, 23 bp, Homo sapiens
cactccagctgacagccacaccg

SEQ ID NO: 4856518 - DNA, 19 bp, Homo sapiens
cactcctgcttaatcttca

SEQ ID NO: 4856519 - DNA, 12 bp, Homo sapiens
cactcctgggac

SEQ ID NO: 4856520 - DNA, 12 bp, Homo sapiens
cactctcagagt

SEQ ID NO: 4856521 - DNA, 16 bp, Homo sapiens
cactctcccttgtaca

SEQ ID NO: 4856522 - DNA, 23 bp, Homo sapiens
cactgaaaaatctaagtgatata

SEQ ID NO: 4856523 - DNA, 14 bp, Homo sapiens
cactgaacagaatt

SEQ ID NO: 4856524 - DNA, 22 bp, Homo sapiens
cactgacttaggtttcaggaag

SEQ ID NO: 4856525 - DNA, 13 bp, Homo sapiens
cactgagcaggga

SEQ ID NO: 4856526 - DNA, 17 bp, Homo sapiens
cactgcagaaaccctga

SEQ ID NO: 4856527 - DNA, 12 bp, Homo sapiens
cactgccccctc

SEQ ID NO: 4856528 - DNA, 22 bp, Homo sapiens
cactgccccctccgtcccaccc

SEQ ID NO: 4856529 - DNA, 18 bp, Homo sapiens
cactgccttcgtttatat

SEQ ID NO: 4856530 - DNA, 19 bp, Homo sapiens
cactgccttcgtttatatt

SEQ ID NO: 4856531 - DNA, 22 bp, Homo sapiens
cactgccttcgtttatattttt

SEQ ID NO: 4856532 - DNA, 18 bp, Homo sapiens
cactggacccttgattca

SEQ ID NO: 4856533 - DNA, 19 bp, Homo sapiens
cactggccttgcctccagg

SEQ ID NO: 4856534 - DNA, 20 bp, Homo sapiens
cactggccttgcctccagga

SEQ ID NO: 4856535 - DNA, 13 bp, Homo sapiens
cactgtactgcat

SEQ ID NO: 4856536 - DNA, 14 bp, Homo sapiens
cactgttgataaaa

SEQ ID NO: 4856537 - DNA, 17 bp, Homo sapiens
cactgttgataaaaact

SEQ ID NO: 4856538 - DNA, 14 bp, Homo sapiens
cacttgaaaccttt

SEQ ID NO: 4856539 - DNA, 23 bp, Homo sapiens
cagcctgtatgtggtgtggggcg

SEQ ID NO: 4856540 - DNA, 22 bp, Homo sapiens
cagccttattttgttggtgctt

SEQ ID NO: 4856541 - DNA, 18 bp, Homo sapiens
cagccttgtacagtctgc

SEQ ID NO: 4856542 - DNA, 19 bp, Homo sapiens
cagccttgtacagtctgct

SEQ ID NO: 4856543 - DNA, 18 bp, Homo sapiens
cagcggattgctctggag

SEQ ID NO: 4856544 - DNA, 23 bp, Homo sapiens
cagcggattgctctggagcagcc

SEQ ID NO: 4856545 - DNA, 23 bp, Homo sapiens
cagcgggtacttatttctcagct

SEQ ID NO: 4856546 - DNA, 20 bp, Homo sapiens
cagcgtgtggagcagagctc

SEQ ID NO: 4856547 - DNA, 12 bp, Homo sapiens
cagctagtgcct

SEQ ID NO: 4856548 - DNA, 13 bp, Homo sapiens
cagctagtgcctt

SEQ ID NO: 4856549 - DNA, 17 bp, Homo sapiens
cagctctagcctctgga

SEQ ID NO: 4856550 - DNA, 21 bp, Homo sapiens
cagctctagcctctggactgg

SEQ ID NO: 4856551 - DNA, 20 bp, Homo sapiens
cagctctcctccagccctgg

SEQ ID NO: 4856552 - DNA, 14 bp, Homo sapiens
cagctctggagggg

SEQ ID NO: 4856553 - DNA, 20 bp, Homo sapiens
cagctgaaattcaccaagaa

SEQ ID NO: 4856554 - DNA, 13 bp, Homo sapiens
cagctgcagcctg

SEQ ID NO: 4856555 - DNA, 15 bp, Homo sapiens
cagctggcggaggct

SEQ ID NO: 4856556 - DNA, 16 bp, Homo sapiens
cagctggcggaggctg

SEQ ID NO: 4856557 - DNA, 19 bp, Homo sapiens
cagctggcggaggctgctc

SEQ ID NO: 4856558 - DNA, 12 bp, Homo sapiens
cagctgtgctcc

SEQ ID NO: 4856559 - DNA, 13 bp, Homo sapiens
cagcttacaggag

SEQ ID NO: 4856560 - DNA, 18 bp, Homo sapiens
cagcttacaggagccagc

SEQ ID NO: 4856561 - DNA, 21 bp, Homo sapiens
caggaaagactggccctctag

SEQ ID NO: 4856562 - DNA, 15 bp, Homo sapiens
caggaaagagctagg

SEQ ID NO: 4856563 - DNA, 21 bp, Homo sapiens
caggaaagagctaggaaccct

SEQ ID NO: 4856564 - DNA, 22 bp, Homo sapiens
caggaaagagctaggaaccctg

SEQ ID NO: 4856565 - DNA, 17 bp, Homo sapiens
caggacagttgatggag

SEQ ID NO: 4856566 - DNA, 15 bp, Homo sapiens
caggacatgcaataa

SEQ ID NO: 4856567 - DNA, 16 bp, Homo sapiens
caggacccatccctgc

SEQ ID NO: 4856568 - DNA, 24 bp, Homo sapiens
caggacccatccctgcctggaggc

SEQ ID NO: 4856569 - DNA, 16 bp, Homo sapiens
caggaccttgcttcct

SEQ ID NO: 4856570 - DNA, 14 bp, Homo sapiens
caggactcccagaa

SEQ ID NO: 4856571 - DNA, 19 bp, Homo sapiens
caggactcccagaacctct

SEQ ID NO: 4856572 - DNA, 15 bp, Homo sapiens
caggactctctccag

SEQ ID NO: 4856573 - DNA, 17 bp, Homo sapiens
caggactctctccagga

SEQ ID NO: 4856574 - DNA, 18 bp, Homo sapiens
caggactctctccaggag

SEQ ID NO: 4856575 - DNA, 19 bp, Homo sapiens
caggactctctccaggagg

SEQ ID NO: 4856576 - DNA, 23 bp, Homo sapiens
caggactctctccaggagggctc

SEQ ID NO: 4856577 - DNA, 13 bp, Homo sapiens
caggagacaaaag

SEQ ID NO: 4856578 - DNA, 14 bp, Homo sapiens
caggagagactggt

SEQ ID NO: 4856579 - DNA, 16 bp, Homo sapiens
caggagccagcctgct

SEQ ID NO: 4856580 - DNA, 13 bp, Homo sapiens
caggagcctggcc

SEQ ID NO: 4856581 - DNA, 16 bp, Homo sapiens
caggagcctggccagg

SEQ ID NO: 4856582 - DNA, 17 bp, Homo sapiens
caggagcctggccaggc

SEQ ID NO: 4856583 - DNA, 22 bp, Homo sapiens
caggagggctcggggtgtgtca

SEQ ID NO: 4856584 - DNA, 14 bp, Homo sapiens
caggcaagaaagct

SEQ ID NO: 4856585 - DNA, 19 bp, Homo sapiens
caggcagacaaccttgtcc

SEQ ID NO: 4856586 - DNA, 15 bp, Homo sapiens
caggcagctgaaatt

SEQ ID NO: 4856587 - DNA, 16 bp, Homo sapiens
caggcagggagagagt

SEQ ID NO: 4856588 - DNA, 19 bp, Homo sapiens
caggcatctgttagcagag

SEQ ID NO: 4856589 - DNA, 12 bp, Homo sapiens
caggcatgtgtc

SEQ ID NO: 4856590 - DNA, 16 bp, Homo sapiens
caggccaagggaccag

SEQ ID NO: 4856591 - DNA, 13 bp, Homo sapiens
caggccagagaaa

SEQ ID NO: 4856592 - DNA, 15 bp, Homo sapiens
caggccatttttggt

SEQ ID NO: 4856593 - DNA, 14 bp, Homo sapiens
caggcctcccaagc

SEQ ID NO: 4856594 - DNA, 17 bp, Homo sapiens
caggcctcccaagctga

SEQ ID NO: 4856595 - DNA, 12 bp, Homo sapiens
caggcctctggg

SEQ ID NO: 4856596 - DNA, 15 bp, Homo sapiens
caggcctctgggacc

SEQ ID NO: 4856597 - DNA, 22 bp, Homo sapiens
caggcctctgggacccacagaa

SEQ ID NO: 4856598 - DNA, 18 bp, Homo sapiens
caggccttatctgaaagg

SEQ ID NO: 4856599 - DNA, 22 bp, Homo sapiens
caggccttatctgaaaggccag

SEQ ID NO: 4856600 - DNA, 14 bp, Homo sapiens
caggctcaggagaa

SEQ ID NO: 4856601 - DNA, 16 bp, Homo sapiens
caggctcaggagaagc

SEQ ID NO: 4856602 - DNA, 23 bp, Homo sapiens
caggctcaggagaagccagtgtc

SEQ ID NO: 4856603 - DNA, 22 bp, Homo sapiens
caggctccgggcaccaggggcc

SEQ ID NO: 4856604 - DNA, 16 bp, Homo sapiens
cagggacagggccctg

SEQ ID NO: 4856605 - DNA, 20 bp, Homo sapiens
cagggacagggccctggagc

SEQ ID NO: 4856606 - DNA, 19 bp, Homo sapiens
cagggagagagtagctgca

SEQ ID NO: 4856607 - DNA, 14 bp, Homo sapiens
cagggaggggaggc

SEQ ID NO: 4856608 - DNA, 17 bp, Homo sapiens
cagggcagcaggccaga

SEQ ID NO: 4856609 - DNA, 20 bp, Homo sapiens
cagggccctgaaatggcctg

SEQ ID NO: 4856610 - DNA, 13 bp, Homo sapiens
cagggccctggag

SEQ ID NO: 4856611 - DNA, 18 bp, Homo sapiens
caggggagccagctgctt

SEQ ID NO: 4856612 - DNA, 18 bp, Homo sapiens
caggggccaacctcaggc

SEQ ID NO: 4856613 - DNA, 16 bp, Homo sapiens
caggggctctgtggca

SEQ ID NO: 4856614 - DNA, 21 bp, Homo sapiens
caggggctctgtggcaaaaag

SEQ ID NO: 4856615 - DNA, 13 bp, Homo sapiens
caggggggagaag

SEQ ID NO: 4856616 - DNA, 16 bp, Homo sapiens
caggggtcccccctca

SEQ ID NO: 4856617 - DNA, 22 bp, Homo sapiens
cagggtccttgtttctgccctg

SEQ ID NO: 4856618 - DNA, 22 bp, Homo sapiens
cagggtctctcagggatggagg

SEQ ID NO: 4856619 - DNA, 12 bp, Homo sapiens
cagggtgggggg

SEQ ID NO: 4856620 - DNA, 16 bp, Homo sapiens
cagggtggggggtgac

SEQ ID NO: 4856621 - DNA, 22 bp, Homo sapiens
cagggtgtgaacatgttctcca

SEQ ID NO: 4856622 - DNA, 19 bp, Homo sapiens
cagggtttacatgaagcag

SEQ ID NO: 4856623 - DNA, 17 bp, Homo sapiens
caggtctgactccaaag

SEQ ID NO: 4856624 - DNA, 18 bp, Homo sapiens
caggtgctcatgctgctc

SEQ ID NO: 4856625 - DNA, 16 bp, Homo sapiens
caggtgcttttggcag

SEQ ID NO: 4856626 - DNA, 17 bp, Homo sapiens
caggtgcttttggcaga

SEQ ID NO: 4856627 - DNA, 19 bp, Homo sapiens
caggtgcttttggcagaga

SEQ ID NO: 4856628 - DNA, 20 bp, Homo sapiens
caggtgcttttggcagagac

SEQ ID NO: 4856629 - DNA, 15 bp, Homo sapiens
caggttataacagtg

SEQ ID NO: 4856630 - DNA, 21 bp, Homo sapiens
caggttattgcaataaagtat

SEQ ID NO: 4856631 - DNA, 22 bp, Homo sapiens
cagtaagtctcataggttaaaa

SEQ ID NO: 4856632 - DNA, 20 bp, Homo sapiens
cagtaatatttatatattta

SEQ ID NO: 4856633 - DNA, 17 bp, Homo sapiens
cagtatttttaaaggca

SEQ ID NO: 4856634 - DNA, 20 bp, Homo sapiens
cagtcactgctgcaaggtgg

SEQ ID NO: 4856635 - DNA, 14 bp, Homo sapiens
cagtcagactgaaa

SEQ ID NO: 4856636 - DNA, 21 bp, Homo sapiens
cagtcccagacaattccattc

SEQ ID NO: 4856637 - DNA, 15 bp, Homo sapiens
cagtccgcagttgta

SEQ ID NO: 4856638 - DNA, 18 bp, Homo sapiens
cagtcgcccaagcagaca

SEQ ID NO: 4856639 - DNA, 20 bp, Homo sapiens
cagtcgtggggaacggagga

SEQ ID NO: 4856640 - DNA, 17 bp, Homo sapiens
cagtctgctcctcttgt

SEQ ID NO: 4856641 - DNA, 21 bp, Homo sapiens
cagtctttcttcactctggct

SEQ ID NO: 4856642 - DNA, 10 bp, Homo sapiens
cagtgactcc

SEQ ID NO: 4856643 - DNA, 13 bp, Homo sapiens
cagtgactccagg

SEQ ID NO: 4856644 - DNA, 23 bp, Homo sapiens
cagtgagtgacaaagcctctgaa

SEQ ID NO: 4856645 - DNA, 21 bp, Homo sapiens
cagtgcctgtgagcatggggc

SEQ ID NO: 4856646 - DNA, 12 bp, Homo sapiens
cagtgccttctc

SEQ ID NO: 4856647 - DNA, 15 bp, Homo sapiens
cagtggtggaggtgg

SEQ ID NO: 4856648 - DNA, 18 bp, Homo sapiens
cagtggtgtgtgaagttt

SEQ ID NO: 4856649 - DNA, 20 bp, Homo sapiens
cagtggtgtgtgaagtttgg

SEQ ID NO: 4856650 - DNA, 19 bp, Homo sapiens
cagtgtaatccaggggtgt

SEQ ID NO: 4856651 - DNA, 13 bp, Homo sapiens
cagtgtctaggca

SEQ ID NO: 4856652 - DNA, 22 bp, Homo sapiens
cagtgtctaggcactgagcagg

SEQ ID NO: 4856653 - DNA, 23 bp, Homo sapiens
cagtgtctgtgttttgaaagaat

SEQ ID NO: 4856654 - DNA, 18 bp, Homo sapiens
cagtgtgagatactgtgt

SEQ ID NO: 4856655 - DNA, 17 bp, Homo sapiens
cagtgtgtggtcaacat

SEQ ID NO: 4856656 - DNA, 16 bp, Homo sapiens
cagtgttacttgcagg

SEQ ID NO: 4856657 - DNA, 17 bp, Homo sapiens
cagtgttgcctcttgca

SEQ ID NO: 4856658 - DNA, 14 bp, Homo sapiens
cagttagactcaaa

SEQ ID NO: 4856659 - DNA, 22 bp, Homo sapiens
ccagaggtggatactggggggc

SEQ ID NO: 4856660 - DNA, 11 bp, Homo sapiens
ccagagtctct

SEQ ID NO: 4856661 - DNA, 19 bp, Homo sapiens
ccagagtgggctttggtgg

SEQ ID NO: 4856662 - DNA, 20 bp, Homo sapiens
ccagagtgggctttggtggc

SEQ ID NO: 4856663 - DNA, 13 bp, Homo sapiens
ccagatacctgtg

SEQ ID NO: 4856664 - DNA, 15 bp, Homo sapiens
ccagatacctgtgag

SEQ ID NO: 4856665 - DNA, 18 bp, Homo sapiens
ccagatacctgtgaggac

SEQ ID NO: 4856666 - DNA, 20 bp, Homo sapiens
ccagatagtgtagctgagga

SEQ ID NO: 4856667 - DNA, 18 bp, Homo sapiens
ccagattggccaattaaa

SEQ ID NO: 4856668 - DNA, 16 bp, Homo sapiens
ccagatttgtttcctt

SEQ ID NO: 4856669 - DNA, 23 bp, Homo sapiens
ccagcaagtccttaggctactgt

SEQ ID NO: 4856670 - DNA, 16 bp, Homo sapiens
ccagcagctgatgctg

SEQ ID NO: 4856671 - DNA, 18 bp, Homo sapiens
ccagccaaccatcatgtg

SEQ ID NO: 4856672 - DNA, 16 bp, Homo sapiens
ccagccacccccaggc

SEQ ID NO: 4856673 - DNA, 15 bp, Homo sapiens
ccagcccaaacctgg

SEQ ID NO: 4856674 - DNA, 16 bp, Homo sapiens
ccagcccaaacctggg

SEQ ID NO: 4856675 - DNA, 16 bp, Homo sapiens
ccagccccccgcgcgc

SEQ ID NO: 4856676 - DNA, 22 bp, Homo sapiens
ccagccccccgcgcgcccaccc

SEQ ID NO: 4856677 - DNA, 22 bp, Homo sapiens
ccagcccctggtggtgggggct

SEQ ID NO: 4856678 - DNA, 12 bp, Homo sapiens
ccagccctgggc

SEQ ID NO: 4856679 - DNA, 15 bp, Homo sapiens
ccagcctgcttccca

SEQ ID NO: 4856680 - DNA, 16 bp, Homo sapiens
ccagcctgcttcccac

SEQ ID NO: 4856681 - DNA, 23 bp, Homo sapiens
ccagccttgtacagtctgctcct

SEQ ID NO: 4856682 - DNA, 17 bp, Homo sapiens
ccagcgtgtggagcaga

SEQ ID NO: 4856683 - DNA, 18 bp, Homo sapiens
ccagcgtgtggagcagag

SEQ ID NO: 4856684 - DNA, 19 bp, Homo sapiens
ccagctcacccctggagga

SEQ ID NO: 4856685 - DNA, 17 bp, Homo sapiens
ccagctctagcctctgg

SEQ ID NO: 4856686 - DNA, 18 bp, Homo sapiens
ccagctctagcctctgga

SEQ ID NO: 4856687 - DNA, 20 bp, Homo sapiens
ccagctctagcctctggact

SEQ ID NO: 4856688 - DNA, 14 bp, Homo sapiens
ccagctgcagcctg

SEQ ID NO: 4856689 - DNA, 23 bp, Homo sapiens
ccagctgcagcctggttggcagc

SEQ ID NO: 4856690 - DNA, 23 bp, Homo sapiens
ccaggaccttgcttccttctcat

SEQ ID NO: 4856691 - DNA, 16 bp, Homo sapiens
ccaggactcccagaac

SEQ ID NO: 4856692 - DNA, 22 bp, Homo sapiens
ccaggagcaggacctactagga

SEQ ID NO: 4856693 - DNA, 19 bp, Homo sapiens
ccaggatgactagatcctg

SEQ ID NO: 4856694 - DNA, 20 bp, Homo sapiens
ccaggcaagaaagcttcctt

SEQ ID NO: 4856695 - DNA, 20 bp, Homo sapiens
ccaggcatgtgtctggccct

SEQ ID NO: 4856696 - DNA, 12 bp, Homo sapiens
ccaggctcagga

SEQ ID NO: 4856697 - DNA, 20 bp, Homo sapiens
ccaggctcaggagaagccag

SEQ ID NO: 4856698 - DNA, 21 bp, Homo sapiens
ccaggctcaggagaagccagt

SEQ ID NO: 4856699 - DNA, 18 bp, Homo sapiens
ccagggaggcagcctagc

SEQ ID NO: 4856700 - DNA, 13 bp, Homo sapiens
ccagggaggggtc

SEQ ID NO: 4856701 - DNA, 14 bp, Homo sapiens
ccagggcagcaggc

SEQ ID NO: 4856702 - DNA, 16 bp, Homo sapiens
ccagggcagcaggcca

SEQ ID NO: 4856703 - DNA, 20 bp, Homo sapiens
ccagggcagcaggccagaga

SEQ ID NO: 4856704 - DNA, 22 bp, Homo sapiens
ccagggcagcaggccagagaaa

SEQ ID NO: 4856705 - DNA, 12 bp, Homo sapiens
ccaggggagcca

SEQ ID NO: 4856706 - DNA, 16 bp, Homo sapiens
ccaggggagccagctg

SEQ ID NO: 4856707 - DNA, 18 bp, Homo sapiens
ccaggggagccagctgct

SEQ ID NO: 4856708 - DNA, 14 bp, Homo sapiens
ccaggggctctgtg

SEQ ID NO: 4856709 - DNA, 15 bp, Homo sapiens
ccagggtctctcagg

SEQ ID NO: 4856710 - DNA, 17 bp, Homo sapiens
ccaggtctgactccaaa

SEQ ID NO: 4856711 - DNA, 14 bp, Homo sapiens
ccagtatttttaaa

SEQ ID NO: 4856712 - DNA, 14 bp, Homo sapiens
ccagtcactgctgc

SEQ ID NO: 4856713 - DNA, 17 bp, Homo sapiens
ccagtcactgctgcaag

SEQ ID NO: 4856714 - DNA, 21 bp, Homo sapiens
ccagtcattatgttaatattt

SEQ ID NO: 4856715 - DNA, 22 bp, Homo sapiens
ccagtcattatgttaatatttc

SEQ ID NO: 4856716 - DNA, 19 bp, Homo sapiens
ccagtcccagacaattcca

SEQ ID NO: 4856717 - DNA, 10 bp, Homo sapiens
ccagtgactc

SEQ ID NO: 4856718 - DNA, 15 bp, Homo sapiens
ccagtgccagcaagt

SEQ ID NO: 4856719 - DNA, 22 bp, Homo sapiens
ccagtgtctaggcactgagcag

SEQ ID NO: 4856720 - DNA, 12 bp, Homo sapiens
ccagtgtgagat

SEQ ID NO: 4856721 - DNA, 22 bp, Homo sapiens
ccagtgtgagatactgtgtata

SEQ ID NO: 4856722 - DNA, 22 bp, Homo sapiens
ccagtgttatttattccccagt

SEQ ID NO: 4856723 - DNA, 14 bp, Homo sapiens
ccagttacttgggc

SEQ ID NO: 4856724 - DNA, 16 bp, Homo sapiens
ccagttcctcttttgt

SEQ ID NO: 4856725 - DNA, 14 bp, Homo sapiens
ccagttgctgctgc

SEQ ID NO: 4856726 - DNA, 20 bp, Homo sapiens
ccataagagaaacctgccaa

SEQ ID NO: 4856727 - DNA, 22 bp, Homo sapiens
ccataataagagaatgttccta

SEQ ID NO: 4856728 - DNA, 19 bp, Homo sapiens
ccatacataaaagaaataa

SEQ ID NO: 4856729 - DNA, 16 bp, Homo sapiens
ccatagacatgaaagg

SEQ ID NO: 4856730 - DNA, 13 bp, Homo sapiens
ccatatgaatgaa

SEQ ID NO: 4856731 - DNA, 14 bp, Homo sapiens
ccatccctgcctgg

SEQ ID NO: 4856732 - DNA, 15 bp, Homo sapiens
ccatccctgcctgga

SEQ ID NO: 4856733 - DNA, 19 bp, Homo sapiens
ccatccctgcctggaggct

SEQ ID NO: 4856734 - DNA, 17 bp, Homo sapiens
ccatcctaggaaccagc

SEQ ID NO: 4856735 - DNA, 21 bp, Homo sapiens
ccatcctaggaaccagccaac

SEQ ID NO: 4856736 - DNA, 19 bp, Homo sapiens
ccatctccacaggagagac

SEQ ID NO: 4856737 - DNA, 18 bp, Homo sapiens
ccatcttctttcttccac

SEQ ID NO: 4856738 - DNA, 15 bp, Homo sapiens
ccatgatttggggtg

SEQ ID NO: 4856739 - DNA, 12 bp, Homo sapiens
ccatggagccta

SEQ ID NO: 4856740 - DNA, 22 bp, Homo sapiens
ccatggctgaagctggagcagc

SEQ ID NO: 4856741 - DNA, 13 bp, Homo sapiens
ccatgtcatgtga

SEQ ID NO: 4856742 - DNA, 12 bp, Homo sapiens
ccatgttcccag

SEQ ID NO: 4856743 - DNA, 13 bp, Homo sapiens
ccatgttcccaga

SEQ ID NO: 4856744 - DNA, 19 bp, Homo sapiens
ccattaaagtcagaagttt

SEQ ID NO: 4856745 - DNA, 20 bp, Homo sapiens
ccattaaggggaagaatgaa

SEQ ID NO: 4856746 - DNA, 14 bp, Homo sapiens
ccattaccaaaata

SEQ ID NO: 4856747 - DNA, 20 bp, Homo sapiens
ccattcagagctatggtgct

SEQ ID NO: 4856748 - DNA, 15 bp, Homo sapiens
ccattcatccttcca

SEQ ID NO: 4856749 - DNA, 15 bp, Homo sapiens
ccattccaaaatatt

SEQ ID NO: 4856750 - DNA, 11 bp, Homo sapiens
ccattcccagc

SEQ ID NO: 4856751 - DNA, 13 bp, Homo sapiens
ccattcctccctc

SEQ ID NO: 4856752 - DNA, 18 bp, Homo sapiens
ccattctattctccagac

SEQ ID NO: 4856753 - DNA, 20 bp, Homo sapiens
ccattctattctccagacat

SEQ ID NO: 4856754 - DNA, 17 bp, Homo sapiens
ccattgcttattatgta

SEQ ID NO: 4856755 - DNA, 22 bp, Homo sapiens
ccattttgttattgactaacag

SEQ ID NO: 4856756 - DNA, 15 bp, Homo sapiens
cccaaaccagcccag

SEQ ID NO: 4856757 - DNA, 20 bp, Homo sapiens
cccaaacctgggaaggccag

SEQ ID NO: 4856758 - DNA, 21 bp, Homo sapiens
cccaaacctgggaaggccagc

SEQ ID NO: 4856759 - DNA, 17 bp, Homo sapiens
cccaacctacattccac

SEQ ID NO: 4856760 - DNA, 20 bp, Homo sapiens
cccaagccccctccttgtct

SEQ ID NO: 4856761 - DNA, 13 bp, Homo sapiens
cccaagcttccca

SEQ ID NO: 4856762 - DNA, 14 bp, Homo sapiens
cccaagcttcccaa

SEQ ID NO: 4856763 - DNA, 21 bp, Homo sapiens
cccaaggcattctcccagctc

SEQ ID NO: 4856764 - DNA, 18 bp, Homo sapiens
cccaagggggctgctgct

SEQ ID NO: 4856765 - DNA, 19 bp, Homo sapiens
cccaagggggctgctgctc

SEQ ID NO: 4856766 - DNA, 23 bp, Homo sapiens
cccaagggggctgctgctcctct

SEQ ID NO: 4856767 - DNA, 19 bp, Homo sapiens
cccaagggtgccctttggg

SEQ ID NO: 4856768 - DNA, 23 bp, Homo sapiens
cccaagttggaagggaccccaga

SEQ ID NO: 4856769 - DNA, 15 bp, Homo sapiens
cccaatccatcgtat

SEQ ID NO: 4856770 - DNA, 12 bp, Homo sapiens
cccaatgaatta

SEQ ID NO: 4856771 - DNA, 14 bp, Homo sapiens
cccacaaactccag

SEQ ID NO: 4856772 - DNA, 19 bp, Homo sapiens
cccacaacccaaaaggttt

SEQ ID NO: 4856773 - DNA, 20 bp, Homo sapiens
cccacaggcacattaactgt

SEQ ID NO: 4856774 - DNA, 14 bp, Homo sapiens
cccaccagttgctg

SEQ ID NO: 4856775 - DNA, 18 bp, Homo sapiens
cccaccctccatgctcct

SEQ ID NO: 4856776 - DNA, 13 bp, Homo sapiens
cccaccttgacca

SEQ ID NO: 4856777 - DNA, 12 bp, Homo sapiens
cccactccagct

SEQ ID NO: 4856778 - DNA, 19 bp, Homo sapiens
cccagaacctctaagtgct

SEQ ID NO: 4856779 - DNA, 24 bp, Homo sapiens
cctcttttgcttgccaaagtacag

SEQ ID NO: 4856780 - DNA, 14 bp, Homo sapiens
cctgaaagagagga

SEQ ID NO: 4856781 - DNA, 22 bp, Homo sapiens
cctgaaagagaggactggttct

SEQ ID NO: 4856782 - DNA, 16 bp, Homo sapiens
cctgacaactcatttt

SEQ ID NO: 4856783 - DNA, 12 bp, Homo sapiens
cctgacaggcct

SEQ ID NO: 4856784 - DNA, 22 bp, Homo sapiens
cctgacatcatcattcttgtgg

SEQ ID NO: 4856785 - DNA, 22 bp, Homo sapiens
cctgactagaactcctgtcttc

SEQ ID NO: 4856786 - DNA, 21 bp, Homo sapiens
cctgagaaacactatttgtga

SEQ ID NO: 4856787 - DNA, 23 bp, Homo sapiens
cctgagaattgaggggaggtggc

SEQ ID NO: 4856788 - DNA, 17 bp, Homo sapiens
cctgagccaaatttctt

SEQ ID NO: 4856789 - DNA, 16 bp, Homo sapiens
cctgaggcaaggagtt

SEQ ID NO: 4856790 - DNA, 21 bp, Homo sapiens
cctgaggccaggacgtctggg

SEQ ID NO: 4856791 - DNA, 21 bp, Homo sapiens
cctgagggccggttctaaggc

SEQ ID NO: 4856792 - DNA, 20 bp, Homo sapiens
cctgataccattctattctc

SEQ ID NO: 4856793 - DNA, 23 bp, Homo sapiens
cctgataccattctattctccag

SEQ ID NO: 4856794 - DNA, 16 bp, Homo sapiens
cctgatgcccctgaca

SEQ ID NO: 4856795 - DNA, 21 bp, Homo sapiens
cctgatggagtgtgcagacag

SEQ ID NO: 4856796 - DNA, 22 bp, Homo sapiens
cctgatggagtgtgcagacagc

SEQ ID NO: 4856797 - DNA, 15 bp, Homo sapiens
cctgatttcattcct

SEQ ID NO: 4856798 - DNA, 16 bp, Homo sapiens
cctgatttcattcctc

SEQ ID NO: 4856799 - DNA, 21 bp, Homo sapiens
cctgcaaaactccaggcagga

SEQ ID NO: 4856800 - DNA, 17 bp, Homo sapiens
cctgcaagtcagtccag

SEQ ID NO: 4856801 - DNA, 23 bp, Homo sapiens
cctgcatagccggtgggtgagga

SEQ ID NO: 4856802 - DNA, 20 bp, Homo sapiens
cctgccaaggagcatccttg

SEQ ID NO: 4856803 - DNA, 16 bp, Homo sapiens
cctgcccagttgcact

SEQ ID NO: 4856804 - DNA, 12 bp, Homo sapiens
cctgccctctgc

SEQ ID NO: 4856805 - DNA, 13 bp, Homo sapiens
cctgccctctgct

SEQ ID NO: 4856806 - DNA, 16 bp, Homo sapiens
cctgcccttcctcctg

SEQ ID NO: 4856807 - DNA, 13 bp, Homo sapiens
cctgcctggaggc

SEQ ID NO: 4856808 - DNA, 16 bp, Homo sapiens
cctgctaaggctcctc

SEQ ID NO: 4856809 - DNA, 19 bp, Homo sapiens
cctgctaaggctcctcctt

SEQ ID NO: 4856810 - DNA, 23 bp, Homo sapiens
cctgctcaactctacccctgctc

SEQ ID NO: 4856811 - DNA, 19 bp, Homo sapiens
cctgctcccattcctccct

SEQ ID NO: 4856812 - DNA, 20 bp, Homo sapiens
cctgctcccattcctccctc

SEQ ID NO: 4856813 - DNA, 16 bp, Homo sapiens
cctgctgggcgtgtgt

SEQ ID NO: 4856814 - DNA, 12 bp, Homo sapiens
cctggagcaggc

SEQ ID NO: 4856815 - DNA, 14 bp, Homo sapiens
cctggagcaggccc

SEQ ID NO: 4856816 - DNA, 15 bp, Homo sapiens
cctggagcaggccca

SEQ ID NO: 4856817 - DNA, 20 bp, Homo sapiens
cctggagcaggcccaatgct

SEQ ID NO: 4856818 - DNA, 19 bp, Homo sapiens
cctggagcttcagccaggt

SEQ ID NO: 4856819 - DNA, 19 bp, Homo sapiens
cctggaggctcctctaggc

SEQ ID NO: 4856820 - DNA, 23 bp, Homo sapiens
cctggagtgtcggatcctgtgag

SEQ ID NO: 4856821 - DNA, 15 bp, Homo sapiens
cctggcagatggggg

SEQ ID NO: 4856822 - DNA, 21 bp, Homo sapiens
cctggcagatgggggcctctc

SEQ ID NO: 4856823 - DNA, 14 bp, Homo sapiens
cctggccaggcagg

SEQ ID NO: 4856824 - DNA, 18 bp, Homo sapiens
cctggccaggcagggaga

SEQ ID NO: 4856825 - DNA, 15 bp, Homo sapiens
cctgggaaggccagc

SEQ ID NO: 4856826 - DNA, 21 bp, Homo sapiens
cctgggacctgtggtcatgtg

SEQ ID NO: 4856827 - DNA, 21 bp, Homo sapiens
cctgggcagggttctccaagg

SEQ ID NO: 4856828 - DNA, 21 bp, Homo sapiens
cctgggcattagcaaggcaga

SEQ ID NO: 4856829 - DNA, 14 bp, Homo sapiens
cctgggctcagcct

SEQ ID NO: 4856830 - DNA, 23 bp, Homo sapiens
cctgggctcagcctggtttctgg

SEQ ID NO: 4856831 - DNA, 10 bp, Homo sapiens
cctgggctgt

SEQ ID NO: 4856832 - DNA, 21 bp, Homo sapiens
cctggggcagggtggggggcc

SEQ ID NO: 4856833 - DNA, 22 bp, Homo sapiens
cctggggcctccagaagctgct

SEQ ID NO: 4856834 - DNA, 13 bp, Homo sapiens
cctgggtgacatt

SEQ ID NO: 4856835 - DNA, 15 bp, Homo sapiens
cctgggtgacatttg

SEQ ID NO: 4856836 - DNA, 19 bp, Homo sapiens
cctgggtttgggagccagg

SEQ ID NO: 4856837 - DNA, 20 bp, Homo sapiens
cctgggtttgggagccagga

SEQ ID NO: 4856838 - DNA, 21 bp, Homo sapiens
cctgggtttgggagccaggac

SEQ ID NO: 4856839 - DNA, 18 bp, Homo sapiens
cctggttggcagcatctg

SEQ ID NO: 4856840 - DNA, 15 bp, Homo sapiens
cctgtagcctataca

SEQ ID NO: 4856841 - DNA, 15 bp, Homo sapiens
cctgtatgtggtgtg

SEQ ID NO: 4856842 - DNA, 18 bp, Homo sapiens
cctgtatgtggtgtgggg

SEQ ID NO: 4856843 - DNA, 14 bp, Homo sapiens
cctgtcactgtcca

SEQ ID NO: 4856844 - DNA, 16 bp, Homo sapiens
cctgtcactgtccaga

SEQ ID NO: 4856845 - DNA, 13 bp, Homo sapiens
cctgtcccacatg

SEQ ID NO: 4856846 - DNA, 19 bp, Homo sapiens
cctgtctaacttggggaag

SEQ ID NO: 4856847 - DNA, 19 bp, Homo sapiens
cctgtctaggtctcctcag

SEQ ID NO: 4856848 - DNA, 21 bp, Homo sapiens
cctgtctaggtctcctcaggg

SEQ ID NO: 4856849 - DNA, 22 bp, Homo sapiens
cctgtctaggtctcctcagggt

SEQ ID NO: 4856850 - DNA, 14 bp, Homo sapiens
cctgtcttctttct

SEQ ID NO: 4856851 - DNA, 15 bp, Homo sapiens
cctgtcttctttctc

SEQ ID NO: 4856852 - DNA, 21 bp, Homo sapiens
cctgtgagcacaaagaagaaa

SEQ ID NO: 4856853 - DNA, 23 bp, Homo sapiens
cctgtgagtaggctgggcctccc

SEQ ID NO: 4856854 - DNA, 14 bp, Homo sapiens
cctgtggcaggagg

SEQ ID NO: 4856855 - DNA, 19 bp, Homo sapiens
cctgtggtcatgtgagtct

SEQ ID NO: 4856856 - DNA, 18 bp, Homo sapiens
cctgttacttatgtagaa

SEQ ID NO: 4856857 - DNA, 22 bp, Homo sapiens
cctgttcatgtttttgttttaa

SEQ ID NO: 4856858 - DNA, 20 bp, Homo sapiens
ccttaatttaactttccagt

SEQ ID NO: 4856859 - DNA, 18 bp, Homo sapiens
ccttacagcctctgactt

SEQ ID NO: 4856860 - DNA, 19 bp, Homo sapiens
ccttaccccaaagagaaag

SEQ ID NO: 4856861 - DNA, 18 bp, Homo sapiens
ccttacctttcctgatgc

SEQ ID NO: 4856862 - DNA, 13 bp, Homo sapiens
ccttagagctctt

SEQ ID NO: 4856863 - DNA, 14 bp, Homo sapiens
ccttagagctcttg

SEQ ID NO: 4856864 - DNA, 21 bp, Homo sapiens
ccttagagggaatctagccca

SEQ ID NO: 4856865 - DNA, 17 bp, Homo sapiens
ccttatagtctaagact

SEQ ID NO: 4856866 - DNA, 15 bp, Homo sapiens
ccttatctctttcca

SEQ ID NO: 4856867 - DNA, 18 bp, Homo sapiens
ccttatctgaaaggccag

SEQ ID NO: 4856868 - DNA, 19 bp, Homo sapiens
ccttatctgaaaggccagc

SEQ ID NO: 4856869 - DNA, 23 bp, Homo sapiens
ccttatctgaaaggccagcagct

SEQ ID NO: 4856870 - DNA, 20 bp, Homo sapiens
ccttcaaaactatagcttgc

SEQ ID NO: 4856871 - DNA, 17 bp, Homo sapiens
ccttcaaggctcttctt

SEQ ID NO: 4856872 - DNA, 21 bp, Homo sapiens
ccttcaaggctcttcttcctc

SEQ ID NO: 4856873 - DNA, 12 bp, Homo sapiens
ccttcaggagcc

SEQ ID NO: 4856874 - DNA, 16 bp, Homo sapiens
ccttcaggagcctggc

SEQ ID NO: 4856875 - DNA, 12 bp, Homo sapiens
ccttcaggcagc

SEQ ID NO: 4856876 - DNA, 18 bp, Homo sapiens
ccttcaggcagctgaaat

SEQ ID NO: 4856877 - DNA, 16 bp, Homo sapiens
ccttcatccatcctga

SEQ ID NO: 4856878 - DNA, 16 bp, Homo sapiens
ccttcccagcttcccg

SEQ ID NO: 4856879 - DNA, 12 bp, Homo sapiens
ccttccctgggt

SEQ ID NO: 4856880 - DNA, 13 bp, Homo sapiens
ccttcctcctctc

SEQ ID NO: 4856881 - DNA, 22 bp, Homo sapiens
ccttctctattgggcacagcct

SEQ ID NO: 4856882 - DNA, 15 bp, Homo sapiens
ccttctgcagtcaga

SEQ ID NO: 4856883 - DNA, 18 bp, Homo sapiens
ccttctgcagtcagactg

SEQ ID NO: 4856884 - DNA, 19 bp, Homo sapiens
ccttctgcagtcagactga

SEQ ID NO: 4856885 - DNA, 14 bp, Homo sapiens
ccttgacacctgct

SEQ ID NO: 4856886 - DNA, 12 bp, Homo sapiens
ccttgagtctct

SEQ ID NO: 4856887 - DNA, 13 bp, Homo sapiens
ccttgatttcaaa

SEQ ID NO: 4856888 - DNA, 21 bp, Homo sapiens
ccttgcaacccaaggtgaggt

SEQ ID NO: 4856889 - DNA, 18 bp, Homo sapiens
ccttgcagcggctcctgc

SEQ ID NO: 4856890 - DNA, 22 bp, Homo sapiens
ccttgcttccttctcatcttgc

SEQ ID NO: 4856891 - DNA, 21 bp, Homo sapiens
ccttggacattttatgtcttt

SEQ ID NO: 4856892 - DNA, 21 bp, Homo sapiens
ccttgggtgagtggcctgcta

SEQ ID NO: 4856893 - DNA, 16 bp, Homo sapiens
ccttgtacagtctgct

SEQ ID NO: 4856894 - DNA, 19 bp, Homo sapiens
ccttgtacagtctgctcct

SEQ ID NO: 4856895 - DNA, 16 bp, Homo sapiens
ccttgtgagagcccat

SEQ ID NO: 4856896 - DNA, 18 bp, Homo sapiens
cctttcctgatgcccctg

SEQ ID NO: 4856897 - DNA, 14 bp, Homo sapiens
cctttcctggcagt

SEQ ID NO: 4856898 - DNA, 15 bp, Homo sapiens
ctccgggactgccct

SEQ ID NO: 4856899 - DNA, 17 bp, Homo sapiens
ctcctatatcctccttc

SEQ ID NO: 4856900 - DNA, 13 bp, Homo sapiens
ctcctcagggtgg

SEQ ID NO: 4856901 - DNA, 15 bp, Homo sapiens
ctcctcagggtgggg

SEQ ID NO: 4856902 - DNA, 16 bp, Homo sapiens
ctcctcagggtggggg

SEQ ID NO: 4856903 - DNA, 20 bp, Homo sapiens
ctcctcatggcagcctactc

SEQ ID NO: 4856904 - DNA, 18 bp, Homo sapiens
ctcctccagccctgggca

SEQ ID NO: 4856905 - DNA, 13 bp, Homo sapiens
ctcctcccaaggc

SEQ ID NO: 4856906 - DNA, 15 bp, Homo sapiens
ctcctccccttcctc

SEQ ID NO: 4856907 - DNA, 17 bp, Homo sapiens
ctcctccccttcctctt

SEQ ID NO: 4856908 - DNA, 13 bp, Homo sapiens
ctcctccttgccc

SEQ ID NO: 4856909 - DNA, 15 bp, Homo sapiens
ctcctctaggccctg

SEQ ID NO: 4856910 - DNA, 20 bp, Homo sapiens
ctcctctaggccctgtgagc

SEQ ID NO: 4856911 - DNA, 15 bp, Homo sapiens
ctcctctcaaacctg

SEQ ID NO: 4856912 - DNA, 20 bp, Homo sapiens
ctcctctcaaacctggcaga

SEQ ID NO: 4856913 - DNA, 15 bp, Homo sapiens
ctcctcttgttcctg

SEQ ID NO: 4856914 - DNA, 20 bp, Homo sapiens
ctcctcttgttcctgaaatg

SEQ ID NO: 4856915 - DNA, 14 bp, Homo sapiens
ctcctgcaaagtct

SEQ ID NO: 4856916 - DNA, 20 bp, Homo sapiens
ctcctgccctctgctctgcc

SEQ ID NO: 4856917 - DNA, 23 bp, Homo sapiens
ctcctgccctctgctctgcctgg

SEQ ID NO: 4856918 - DNA, 19 bp, Homo sapiens
ctcctgggcattagcaagg

SEQ ID NO: 4856919 - DNA, 15 bp, Homo sapiens
ctcctgtcttctttc

SEQ ID NO: 4856920 - DNA, 22 bp, Homo sapiens
ctcctgtggaaggcagagaaat

SEQ ID NO: 4856921 - DNA, 23 bp, Homo sapiens
ctccttaagctgcagagatttct

SEQ ID NO: 4856922 - DNA, 22 bp, Homo sapiens
ctccttagccctgtctgctagg

SEQ ID NO: 4856923 - DNA, 20 bp, Homo sapiens
ctccttatagacacttgctc

SEQ ID NO: 4856924 - DNA, 19 bp, Homo sapiens
ctccttcatgacagcctcc

SEQ ID NO: 4856925 - DNA, 20 bp, Homo sapiens
ctccttctgcagtcagactg

SEQ ID NO: 4856926 - DNA, 19 bp, Homo sapiens
ctccttgagtgtatgagta

SEQ ID NO: 4856927 - DNA, 16 bp, Homo sapiens
ctcctttaccctcttg

SEQ ID NO: 4856928 - DNA, 17 bp, Homo sapiens
ctcctttgaagaaggca

SEQ ID NO: 4856929 - DNA, 22 bp, Homo sapiens
ctcgagaccataaagatattct

SEQ ID NO: 4856930 - DNA, 22 bp, Homo sapiens
ctcggctactggttacctggag

SEQ ID NO: 4856931 - DNA, 16 bp, Homo sapiens
ctcggctgccaggggc

SEQ ID NO: 4856932 - DNA, 14 bp, Homo sapiens
ctctaaagagcatc

SEQ ID NO: 4856933 - DNA, 13 bp, Homo sapiens
ctctaagtgctgc

SEQ ID NO: 4856934 - DNA, 14 bp, Homo sapiens
ctctaagtgctgct

SEQ ID NO: 4856935 - DNA, 17 bp, Homo sapiens
ctctaagtgctgctgtg

SEQ ID NO: 4856936 - DNA, 18 bp, Homo sapiens
ctctaagtgctgctgtgg

SEQ ID NO: 4856937 - DNA, 13 bp, Homo sapiens
ctctacccctgct

SEQ ID NO: 4856938 - DNA, 13 bp, Homo sapiens
ctctagcctctgg

SEQ ID NO: 4856939 - DNA, 19 bp, Homo sapiens
ctctagggcctcagtctgg

SEQ ID NO: 4856940 - DNA, 12 bp, Homo sapiens
ctctatactgtg

SEQ ID NO: 4856941 - DNA, 17 bp, Homo sapiens
ctctcaaacctggcaga

SEQ ID NO: 4856942 - DNA, 13 bp, Homo sapiens
ctctcacccccat

SEQ ID NO: 4856943 - DNA, 16 bp, Homo sapiens
ctctcacccccatccc

SEQ ID NO: 4856944 - DNA, 21 bp, Homo sapiens
ctctcagttctctcccttcct

SEQ ID NO: 4856945 - DNA, 23 bp, Homo sapiens
ctctcattttatttacagctgtg

SEQ ID NO: 4856946 - DNA, 12 bp, Homo sapiens
ctctcctccagc

SEQ ID NO: 4856947 - DNA, 13 bp, Homo sapiens
ctctcctccagcc

SEQ ID NO: 4856948 - DNA, 17 bp, Homo sapiens
ctctcctccagccctgg

SEQ ID NO: 4856949 - DNA, 21 bp, Homo sapiens
ctctcctgccctctgctctgc

SEQ ID NO: 4856950 - DNA, 19 bp, Homo sapiens
ctctcgactgtcagtgggg

SEQ ID NO: 4856951 - DNA, 13 bp, Homo sapiens
ctctctccaggag

SEQ ID NO: 4856952 - DNA, 15 bp, Homo sapiens
ctctctgggcccagg

SEQ ID NO: 4856953 - DNA, 18 bp, Homo sapiens
ctctcttcggtggccttg

SEQ ID NO: 4856954 - DNA, 13 bp, Homo sapiens
ctctgaaataatg

SEQ ID NO: 4856955 - DNA, 16 bp, Homo sapiens
ctctgcacccgcctcg

SEQ ID NO: 4856956 - DNA, 11 bp, Homo sapiens
ctctgcctgga

SEQ ID NO: 4856957 - DNA, 19 bp, Homo sapiens
ctctgctctgcctggagtg

SEQ ID NO: 4856958 - DNA, 18 bp, Homo sapiens
ctctggcttcaaaaagcc

SEQ ID NO: 4856959 - DNA, 15 bp, Homo sapiens
ctctgggacccacag

SEQ ID NO: 4856960 - DNA, 18 bp, Homo sapiens
ctctgggacccacagaac

SEQ ID NO: 4856961 - DNA, 22 bp, Homo sapiens
ctctgtccgtgccccttccctg

SEQ ID NO: 4856962 - DNA, 19 bp, Homo sapiens
ctctgtccttcccccagca

SEQ ID NO: 4856963 - DNA, 16 bp, Homo sapiens
ctctgtctgagacagg

SEQ ID NO: 4856964 - DNA, 19 bp, Homo sapiens
ctctgtgcttcgactactg

SEQ ID NO: 4856965 - DNA, 15 bp, Homo sapiens
ctctgtggcaaaaag

SEQ ID NO: 4856966 - DNA, 21 bp, Homo sapiens
ctctgttcccccaccctccat

SEQ ID NO: 4856967 - DNA, 21 bp, Homo sapiens
ctcttcaaccccgaggtccct

SEQ ID NO: 4856968 - DNA, 16 bp, Homo sapiens
ctcttcggtggccttg

SEQ ID NO: 4856969 - DNA, 23 bp, Homo sapiens
ctcttcggtggccttgagtctct

SEQ ID NO: 4856970 - DNA, 15 bp, Homo sapiens
ctcttgcagggtctt

SEQ ID NO: 4856971 - DNA, 18 bp, Homo sapiens
ctctttggggctcctttc

SEQ ID NO: 4856972 - DNA, 19 bp, Homo sapiens
ctgaaaaatctaagtgata

SEQ ID NO: 4856973 - DNA, 22 bp, Homo sapiens
ctgaaaaatctaagtgatataa

SEQ ID NO: 4856974 - DNA, 12 bp, Homo sapiens
ctgaaaagaagg

SEQ ID NO: 4856975 - DNA, 15 bp, Homo sapiens
ctgaaagatgcatca

SEQ ID NO: 4856976 - DNA, 15 bp, Homo sapiens
ctgaaaggccagcag

SEQ ID NO: 4856977 - DNA, 18 bp, Homo sapiens
ctgaaaggccagcagctg

SEQ ID NO: 4856978 - DNA, 19 bp, Homo sapiens
ctgaaaggccagcagctga

SEQ ID NO: 4856979 - DNA, 21 bp, Homo sapiens
ctgaaaggccagcagctgatg

SEQ ID NO: 4856980 - DNA, 13 bp, Homo sapiens
ctgaaatccttga

SEQ ID NO: 4856981 - DNA, 14 bp, Homo sapiens
ctgaaatggcctgt

SEQ ID NO: 4856982 - DNA, 18 bp, Homo sapiens
ctgaaatgtgtttccttt

SEQ ID NO: 4856983 - DNA, 20 bp, Homo sapiens
ctgaacaggaaagagctagg

SEQ ID NO: 4856984 - DNA, 23 bp, Homo sapiens
ctgaacaggaaagagctaggaac

SEQ ID NO: 4856985 - DNA, 15 bp, Homo sapiens
ctgaaccctccaaag

SEQ ID NO: 4856986 - DNA, 17 bp, Homo sapiens
ctgaagaagatgagcct

SEQ ID NO: 4856987 - DNA, 14 bp, Homo sapiens
ctgaagctggagca

SEQ ID NO: 4856988 - DNA, 16 bp, Homo sapiens
ctgaagtatgaagtct

SEQ ID NO: 4856989 - DNA, 21 bp, Homo sapiens
ctgaagtgtttcacgagagcc

SEQ ID NO: 4856990 - DNA, 15 bp, Homo sapiens
ctgaatctgctacca

SEQ ID NO: 4856991 - DNA, 14 bp, Homo sapiens
ctgaattaattaat

SEQ ID NO: 4856992 - DNA, 18 bp, Homo sapiens
ctgacaaccattaaagtc

SEQ ID NO: 4856993 - DNA, 21 bp, Homo sapiens
ctgacagccacaccgtggcag

SEQ ID NO: 4856994 - DNA, 23 bp, Homo sapiens
ctgacagccacaccgtggcagct

SEQ ID NO: 4856995 - DNA, 16 bp, Homo sapiens
ctgacaggccttcctc

SEQ ID NO: 4856996 - DNA, 23 bp, Homo sapiens
ctgaccccaagggggctgctgct

SEQ ID NO: 4856997 - DNA, 20 bp, Homo sapiens
ctgacctgaccccattcctg

SEQ ID NO: 4856998 - DNA, 21 bp, Homo sapiens
ctgactcagtgaccagtgcct

SEQ ID NO: 4856999 - DNA, 21 bp, Homo sapiens
ctgacttaggtttcaggaagt

SEQ ID NO: 4857000 - DNA, 21 bp, Homo sapiens
ctgagaaacactatttgtgac

SEQ ID NO: 4857001 - DNA, 18 bp, Homo sapiens
ctgagaaagctaaagttt

SEQ ID NO: 4857002 - DNA, 16 bp, Homo sapiens
ctgagaattgagggga

SEQ ID NO: 4857003 - DNA, 22 bp, Homo sapiens
ctgagacaggtgcctaacctgg

SEQ ID NO: 4857004 - DNA, 22 bp, Homo sapiens
ctgagcagcatccaccccaccc

SEQ ID NO: 4857005 - DNA, 13 bp, Homo sapiens
ctgagcagggatc

SEQ ID NO: 4857006 - DNA, 22 bp, Homo sapiens
ctgaggatattcagatgtatgt

SEQ ID NO: 4857007 - DNA, 13 bp, Homo sapiens
ctgaggccagaaa

SEQ ID NO: 4857008 - DNA, 14 bp, Homo sapiens
ctgaggccagaaag

SEQ ID NO: 4857009 - DNA, 15 bp, Homo sapiens
ctgaggccagaaagg

SEQ ID NO: 4857010 - DNA, 23 bp, Homo sapiens
ctgaggccagaaaggtgtgagga

SEQ ID NO: 4857011 - DNA, 16 bp, Homo sapiens
ctgaggctgagaaagc

SEQ ID NO: 4857012 - DNA, 17 bp, Homo sapiens
ctgataacttggggagg

SEQ ID NO: 4857013 - DNA, 20 bp, Homo sapiens
ctgatactttgacagtgttt

SEQ ID NO: 4857014 - DNA, 12 bp, Homo sapiens
ctgatcccatgg

SEQ ID NO: 4857015 - DNA, 21 bp, Homo sapiens
ctgatgagagaatgtggaaat

SEQ ID NO: 4857016 - DNA, 19 bp, Homo sapiens
ctgatgagtttcactgtac

SEQ ID NO: 4857017 - DNA, 14 bp, Homo sapiens
ctgatgcccctgac

SEQ ID NO: 4857018 - DNA, 20 bp, Homo sapiens
cttcaggagcctggccaggc

SEQ ID NO: 4857019 - DNA, 23 bp, Homo sapiens
cttcaggagcctggccaggcagg

SEQ ID NO: 4857020 - DNA, 14 bp, Homo sapiens
cttcagttgcttgt

SEQ ID NO: 4857021 - DNA, 19 bp, Homo sapiens
cttcatcagaactcttcct

SEQ ID NO: 4857022 - DNA, 14 bp, Homo sapiens
cttcatccatcctg

SEQ ID NO: 4857023 - DNA, 19 bp, Homo sapiens
cttcatccatcctgagcca

SEQ ID NO: 4857024 - DNA, 17 bp, Homo sapiens
cttcatgcctgatgaaa

SEQ ID NO: 4857025 - DNA, 19 bp, Homo sapiens
cttcatgcctgatgaaagc

SEQ ID NO: 4857026 - DNA, 16 bp, Homo sapiens
cttcatgtaattttat

SEQ ID NO: 4857027 - DNA, 12 bp, Homo sapiens
cttccaaagaaa

SEQ ID NO: 4857028 - DNA, 21 bp, Homo sapiens
cttccaacatatatttattga

SEQ ID NO: 4857029 - DNA, 22 bp, Homo sapiens
cttccatccatctttccatcca

SEQ ID NO: 4857030 - DNA, 16 bp, Homo sapiens
cttccattttaatttt

SEQ ID NO: 4857031 - DNA, 16 bp, Homo sapiens
cttcccactccagctg

SEQ ID NO: 4857032 - DNA, 18 bp, Homo sapiens
cttcccatgcattctggt

SEQ ID NO: 4857033 - DNA, 21 bp, Homo sapiens
cttccctgggtttgggagcca

SEQ ID NO: 4857034 - DNA, 23 bp, Homo sapiens
cttccctgggtttgggagccagg

SEQ ID NO: 4857035 - DNA, 22 bp, Homo sapiens
cttcctaattgtgcccctaaag

SEQ ID NO: 4857036 - DNA, 12 bp, Homo sapiens
cttcctgtggat

SEQ ID NO: 4857037 - DNA, 20 bp, Homo sapiens
cttcgactactgctcctgtg

SEQ ID NO: 4857038 - DNA, 22 bp, Homo sapiens
cttcggagatgaggagtaaaat

SEQ ID NO: 4857039 - DNA, 14 bp, Homo sapiens
cttcggtggccttg

SEQ ID NO: 4857040 - DNA, 15 bp, Homo sapiens
cttcggtggccttga

SEQ ID NO: 4857041 - DNA, 15 bp, Homo sapiens
cttcgtttatatttt

SEQ ID NO: 4857042 - DNA, 13 bp, Homo sapiens
cttctagttgccc

SEQ ID NO: 4857043 - DNA, 23 bp, Homo sapiens
cttctagttgcccccattcccag

SEQ ID NO: 4857044 - DNA, 16 bp, Homo sapiens
cttctatttatttatt

SEQ ID NO: 4857045 - DNA, 12 bp, Homo sapiens
cttctcacactg

SEQ ID NO: 4857046 - DNA, 14 bp, Homo sapiens
cttctcaccagcag

SEQ ID NO: 4857047 - DNA, 16 bp, Homo sapiens
cttctcatcttgcctc

SEQ ID NO: 4857048 - DNA, 15 bp, Homo sapiens
cttctcccctgccct

SEQ ID NO: 4857049 - DNA, 19 bp, Homo sapiens
cttctccctagctcctccc

SEQ ID NO: 4857050 - DNA, 15 bp, Homo sapiens
cttctgggggtcact

SEQ ID NO: 4857051 - DNA, 16 bp, Homo sapiens
cttctgggtccaggga

SEQ ID NO: 4857052 - DNA, 18 bp, Homo sapiens
cttctgggtccagggagg

SEQ ID NO: 4857053 - DNA, 15 bp, Homo sapiens
cttctggtactttct

SEQ ID NO: 4857054 - DNA, 15 bp, Homo sapiens
cttctgtatttcctt

SEQ ID NO: 4857055 - DNA, 11 bp, Homo sapiens
cttcttgggat

SEQ ID NO: 4857056 - DNA, 13 bp, Homo sapiens
cttctttcttcca

SEQ ID NO: 4857057 - DNA, 20 bp, Homo sapiens
cttctttggacttctgaaga

SEQ ID NO: 4857058 - DNA, 16 bp, Homo sapiens
cttgaaaaaaaacagt

SEQ ID NO: 4857059 - DNA, 17 bp, Homo sapiens
cttgaaacctgatgtca

SEQ ID NO: 4857060 - DNA, 16 bp, Homo sapiens
cttgaaactttgggaa

SEQ ID NO: 4857061 - DNA, 13 bp, Homo sapiens
cttgaaagaaatg

SEQ ID NO: 4857062 - DNA, 13 bp, Homo sapiens
cttgaatataaaa

SEQ ID NO: 4857063 - DNA, 13 bp, Homo sapiens
cttgacctagctc

SEQ ID NO: 4857064 - DNA, 18 bp, Homo sapiens
cttgacctagctctttgg

SEQ ID NO: 4857065 - DNA, 15 bp, Homo sapiens
cttgactacctactg

SEQ ID NO: 4857066 - DNA, 21 bp, Homo sapiens
cttgactacctactggtgtaa

SEQ ID NO: 4857067 - DNA, 22 bp, Homo sapiens
cttgagagttccggggagaaac

SEQ ID NO: 4857068 - DNA, 18 bp, Homo sapiens
cttgagggcctgagcagg

SEQ ID NO: 4857069 - DNA, 17 bp, Homo sapiens
cttgagttaacaggaca

SEQ ID NO: 4857070 - DNA, 22 bp, Homo sapiens
cttgagttaacaggacagttga

SEQ ID NO: 4857071 - DNA, 13 bp, Homo sapiens
cttgatggggtga

SEQ ID NO: 4857072 - DNA, 14 bp, Homo sapiens
cttgattcattctg

SEQ ID NO: 4857073 - DNA, 14 bp, Homo sapiens
cttgcaacccaagg

SEQ ID NO: 4857074 - DNA, 18 bp, Homo sapiens
cttgcagatatctgcatg

SEQ ID NO: 4857075 - DNA, 20 bp, Homo sapiens
cttgccaaagtacagaattt

SEQ ID NO: 4857076 - DNA, 21 bp, Homo sapiens
cttgccaaagtacagaatttg

SEQ ID NO: 4857077 - DNA, 17 bp, Homo sapiens
cttgccattccaaaata

SEQ ID NO: 4857078 - DNA, 14 bp, Homo sapiens
cttgcccacaccga

SEQ ID NO: 4857079 - DNA, 17 bp, Homo sapiens
cttgcccagactacagg

SEQ ID NO: 4857080 - DNA, 14 bp, Homo sapiens
cttgcctccaggac

SEQ ID NO: 4857081 - DNA, 17 bp, Homo sapiens
cttgcggcaaaaggaaa

SEQ ID NO: 4857082 - DNA, 16 bp, Homo sapiens
cttgctcccaacccat

SEQ ID NO: 4857083 - DNA, 20 bp, Homo sapiens
cttgctggtgcctgccacct

SEQ ID NO: 4857084 - DNA, 13 bp, Homo sapiens
cttgcttcctgat

SEQ ID NO: 4857085 - DNA, 18 bp, Homo sapiens
cttgcttggggaacttgt

SEQ ID NO: 4857086 - DNA, 19 bp, Homo sapiens
cttggaaattcctgtactg

SEQ ID NO: 4857087 - DNA, 19 bp, Homo sapiens
cttggaagctgtttggaaa

SEQ ID NO: 4857088 - DNA, 19 bp, Homo sapiens
cttggacattttatgtctt

SEQ ID NO: 4857089 - DNA, 17 bp, Homo sapiens
cttggagaatactgcca

SEQ ID NO: 4857090 - DNA, 14 bp, Homo sapiens
cttggagggaccaa

SEQ ID NO: 4857091 - DNA, 15 bp, Homo sapiens
cttggattttcctga

SEQ ID NO: 4857092 - DNA, 16 bp, Homo sapiens
cttggattttcctgaa

SEQ ID NO: 4857093 - DNA, 15 bp, Homo sapiens
cttggcagtgggaat

SEQ ID NO: 4857094 - DNA, 14 bp, Homo sapiens
cttggcccttcaag

SEQ ID NO: 4857095 - DNA, 22 bp, Homo sapiens
cttgggcttcaacagccaagct

SEQ ID NO: 4857096 - DNA, 17 bp, Homo sapiens
cttggggaaggggcctg

SEQ ID NO: 4857097 - DNA, 22 bp, Homo sapiens
cttggggaaggggcctgggctg

SEQ ID NO: 4857098 - DNA, 13 bp, Homo sapiens
cttgggggtcagg

SEQ ID NO: 4857099 - DNA, 16 bp, Homo sapiens
cttggggtgtggggtg

SEQ ID NO: 4857100 - DNA, 15 bp, Homo sapiens
cttgggtcacatgac

SEQ ID NO: 4857101 - DNA, 17 bp, Homo sapiens
cttggtcccatggctga

SEQ ID NO: 4857102 - DNA, 17 bp, Homo sapiens
cttggttgatgtttaaa

SEQ ID NO: 4857103 - DNA, 20 bp, Homo sapiens
cttgtacagtctgctcctct

SEQ ID NO: 4857104 - DNA, 23 bp, Homo sapiens
cttgtatattttaagaaataaca

SEQ ID NO: 4857105 - DNA, 20 bp, Homo sapiens
cttgtcagttccaaacagac

SEQ ID NO: 4857106 - DNA, 14 bp, Homo sapiens
cttgtctgatttct

SEQ ID NO: 4857107 - DNA, 18 bp, Homo sapiens
cttgtcttctggtacttt

SEQ ID NO: 4857108 - DNA, 21 bp, Homo sapiens
cttgtcttctggtactttctg

SEQ ID NO: 4857109 - DNA, 23 bp, Homo sapiens
cttgtgagagcccattcccacca

SEQ ID NO: 4857110 - DNA, 15 bp, Homo sapiens
cttgtgggagacagc

SEQ ID NO: 4857111 - DNA, 19 bp, Homo sapiens
cttgtgggagacagcagcc

SEQ ID NO: 4857112 - DNA, 23 bp, Homo sapiens
cttgtgggagacagcagcctgta

SEQ ID NO: 4857113 - DNA, 20 bp, Homo sapiens
cttgtgttcagaagaatctt

SEQ ID NO: 4857114 - DNA, 16 bp, Homo sapiens
cttgtttaatggtagt

SEQ ID NO: 4857115 - DNA, 13 bp, Homo sapiens
ctttaaattgtgt

SEQ ID NO: 4857116 - DNA, 23 bp, Homo sapiens
ctttaactgccgtaatttaactt

SEQ ID NO: 4857117 - DNA, 15 bp, Homo sapiens
ctttaagaactaaaa

SEQ ID NO: 4857118 - DNA, 18 bp, Homo sapiens
ctttaagtgtgctgggca

SEQ ID NO: 4857119 - DNA, 15 bp, Homo sapiens
ctttagcttacctgg

SEQ ID NO: 4857120 - DNA, 14 bp, Homo sapiens
ctttagtttttggt

SEQ ID NO: 4857121 - DNA, 23 bp, Homo sapiens
ctttagtttttggttgggaatga

SEQ ID NO: 4857122 - DNA, 13 bp, Homo sapiens
ctttataaatgta

SEQ ID NO: 4857123 - DNA, 14 bp, Homo sapiens
ctttatatttcaat

SEQ ID NO: 4857124 - DNA, 19 bp, Homo sapiens
ctttatatttcaataaatg

SEQ ID NO: 4857125 - DNA, 22 bp, Homo sapiens
ctttatatttcaataaatgata

SEQ ID NO: 4857126 - DNA, 21 bp, Homo sapiens
ctttatcatgaatgcttttag

SEQ ID NO: 4857127 - DNA, 16 bp, Homo sapiens
ctttattgcaatgcag

SEQ ID NO: 4857128 - DNA, 19 bp, Homo sapiens
ctttcaagaatcagacagc

SEQ ID NO: 4857129 - DNA, 22 bp, Homo sapiens
ctttcacccatcctaggaacca

SEQ ID NO: 4857130 - DNA, 21 bp, Homo sapiens
ctttcagaaatataacacatt

SEQ ID NO: 4857131 - DNA, 22 bp, Homo sapiens
ctttcagaaatataacacattt

SEQ ID NO: 4857132 - DNA, 17 bp, Homo sapiens
ctttcattaccctacag

SEQ ID NO: 4857133 - DNA, 19 bp, Homo sapiens
ctttcattaccctacagac

SEQ ID NO: 4857134 - DNA, 20 bp, Homo sapiens
ctttcattaccctacagaca

SEQ ID NO: 4857135 - DNA, 16 bp, Homo sapiens
ctttcctactttctat

SEQ ID NO: 4857136 - DNA, 17 bp, Homo sapiens
ctttcctgatgcccctg

SEQ ID NO: 4857137 - DNA, 13 bp, Homo sapiens
ctttcctggcagt

SEQ ID NO: 4857138 - DNA, 22 bp, Homo sapiens
gaccataagagaaacctgccaa

SEQ ID NO: 4857139 - DNA, 20 bp, Homo sapiens
gaccatttctctgcaggcca

SEQ ID NO: 4857140 - DNA, 21 bp, Homo sapiens
gacccagacgtggtgcttctc

SEQ ID NO: 4857141 - DNA, 16 bp, Homo sapiens
gacccatccctgcctg

SEQ ID NO: 4857142 - DNA, 20 bp, Homo sapiens
gacccatccctgcctggagg

SEQ ID NO: 4857143 - DNA, 21 bp, Homo sapiens
gaccccaagggggctgctgct

SEQ ID NO: 4857144 - DNA, 18 bp, Homo sapiens
gaccccagatacctgtga

SEQ ID NO: 4857145 - DNA, 13 bp, Homo sapiens
gacccctgcctgg

SEQ ID NO: 4857146 - DNA, 19 bp, Homo sapiens
gaccctcgagagccttact

SEQ ID NO: 4857147 - DNA, 22 bp, Homo sapiens
gaccctgaatccgtacttgggt

SEQ ID NO: 4857148 - DNA, 23 bp, Homo sapiens
gaccctgaatccgtacttgggtc

SEQ ID NO: 4857149 - DNA, 13 bp, Homo sapiens
gaccctgggcagt

SEQ ID NO: 4857150 - DNA, 20 bp, Homo sapiens
gacccttctgggtccaggga

SEQ ID NO: 4857151 - DNA, 14 bp, Homo sapiens
gacctagctctttg

SEQ ID NO: 4857152 - DNA, 19 bp, Homo sapiens
gacctccttagccctgtct

SEQ ID NO: 4857153 - DNA, 20 bp, Homo sapiens
gacctgaccccattcctgat

SEQ ID NO: 4857154 - DNA, 13 bp, Homo sapiens
gacctgcccacaa

SEQ ID NO: 4857155 - DNA, 20 bp, Homo sapiens
gacctggcatctaattctga

SEQ ID NO: 4857156 - DNA, 23 bp, Homo sapiens
gacctgttctttccatctttaga

SEQ ID NO: 4857157 - DNA, 21 bp, Homo sapiens
gaccttgagttaacaggacag

SEQ ID NO: 4857158 - DNA, 17 bp, Homo sapiens
gacgggatgacctccag

SEQ ID NO: 4857159 - DNA, 18 bp, Homo sapiens
gacgggatgacctccaga

SEQ ID NO: 4857160 - DNA, 19 bp, Homo sapiens
gacgggatgacctccagaa

SEQ ID NO: 4857161 - DNA, 18 bp, Homo sapiens
gacgttaggccaggcctt

SEQ ID NO: 4857162 - DNA, 19 bp, Homo sapiens
gacgtttataaacagaaat

SEQ ID NO: 4857163 - DNA, 13 bp, Homo sapiens
gactacagggctt

SEQ ID NO: 4857164 - DNA, 21 bp, Homo sapiens
gactacctactggtgtaatct

SEQ ID NO: 4857165 - DNA, 18 bp, Homo sapiens
gactactgctcctgtggc

SEQ ID NO: 4857166 - DNA, 21 bp, Homo sapiens
gactagaactcctgtcttctt

SEQ ID NO: 4857167 - DNA, 12 bp, Homo sapiens
gactatggtgct

SEQ ID NO: 4857168 - DNA, 23 bp, Homo sapiens
gactatggtgctgccttgcttct

SEQ ID NO: 4857169 - DNA, 13 bp, Homo sapiens
gactcagcagagt

SEQ ID NO: 4857170 - DNA, 15 bp, Homo sapiens
gactccaaagctgtt

SEQ ID NO: 4857171 - DNA, 15 bp, Homo sapiens
gactccaagccctgg

SEQ ID NO: 4857172 - DNA, 18 bp, Homo sapiens
gactccaagccctggggc

SEQ ID NO: 4857173 - DNA, 22 bp, Homo sapiens
gactccagggtgacaaggcctg

SEQ ID NO: 4857174 - DNA, 24 bp, Homo sapiens
gactccagggtgacaaggcctgct

SEQ ID NO: 4857175 - DNA, 13 bp, Homo sapiens
gactcccagaacc

SEQ ID NO: 4857176 - DNA, 15 bp, Homo sapiens
gactcccagaacctc

SEQ ID NO: 4857177 - DNA, 21 bp, Homo sapiens
gactctctccaggagggctcg

SEQ ID NO: 4857178 - DNA, 17 bp, Homo sapiens
gactctgacctcttggc

SEQ ID NO: 4857179 - DNA, 15 bp, Homo sapiens
gactctgcacccgcc

SEQ ID NO: 4857180 - DNA, 13 bp, Homo sapiens
gactgaagaagat

SEQ ID NO: 4857181 - DNA, 19 bp, Homo sapiens
gactgaagaagatgagcct

SEQ ID NO: 4857182 - DNA, 16 bp, Homo sapiens
gactgatttcagagtg

SEQ ID NO: 4857183 - DNA, 20 bp, Homo sapiens
gactgcatggggaggcagca

SEQ ID NO: 4857184 - DNA, 15 bp, Homo sapiens
gactgctcctgggca

SEQ ID NO: 4857185 - DNA, 16 bp, Homo sapiens
gactgctcctgggcat

SEQ ID NO: 4857186 - DNA, 19 bp, Homo sapiens
gactgggagccacttctcc

SEQ ID NO: 4857187 - DNA, 17 bp, Homo sapiens
gactgggcactggggcc

SEQ ID NO: 4857188 - DNA, 23 bp, Homo sapiens
gacttaaagggcccaatgaatta

SEQ ID NO: 4857189 - DNA, 15 bp, Homo sapiens
gacttctcaccagca

SEQ ID NO: 4857190 - DNA, 16 bp, Homo sapiens
gacttctcccctgccc

SEQ ID NO: 4857191 - DNA, 21 bp, Homo sapiens
gacttgaaatacgtttgtgtt

SEQ ID NO: 4857192 - DNA, 13 bp, Homo sapiens
gacttgaggggct

SEQ ID NO: 4857193 - DNA, 18 bp, Homo sapiens
gacttggagaatactgcc

SEQ ID NO: 4857194 - DNA, 22 bp, Homo sapiens
gacttgtatagcatgaaataaa

SEQ ID NO: 4857195 - DNA, 21 bp, Homo sapiens
gagaaacactatttgtgactt

SEQ ID NO: 4857196 - DNA, 13 bp, Homo sapiens
gagaaacccagag

SEQ ID NO: 4857197 - DNA, 22 bp, Homo sapiens
gagaaagcacaatttaaaacaa

SEQ ID NO: 4857198 - DNA, 23 bp, Homo sapiens
gagaaatgtgtagctgcaaaaat

SEQ ID NO: 4857199 - DNA, 16 bp, Homo sapiens
gagaacccagtttccc

SEQ ID NO: 4857200 - DNA, 20 bp, Homo sapiens
gagaatggcatggcaggagt

SEQ ID NO: 4857201 - DNA, 15 bp, Homo sapiens
gagaatggcctggag

SEQ ID NO: 4857202 - DNA, 16 bp, Homo sapiens
gagaatggcctggagc

SEQ ID NO: 4857203 - DNA, 18 bp, Homo sapiens
gagaattgaggggaggtg

SEQ ID NO: 4857204 - DNA, 20 bp, Homo sapiens
gagacactgttgataaaaac

SEQ ID NO: 4857205 - DNA, 15 bp, Homo sapiens
gagacagcagcctgt

SEQ ID NO: 4857206 - DNA, 18 bp, Homo sapiens
gagacagcagcctgtatg

SEQ ID NO: 4857207 - DNA, 19 bp, Homo sapiens
gagacagcagcctgtatgt

SEQ ID NO: 4857208 - DNA, 23 bp, Homo sapiens
gagacaggtgcctaacctgggac

SEQ ID NO: 4857209 - DNA, 13 bp, Homo sapiens
gagacagtgaatt

SEQ ID NO: 4857210 - DNA, 14 bp, Homo sapiens
gagacatgtgacat

SEQ ID NO: 4857211 - DNA, 20 bp, Homo sapiens
gagaccataagagaaacctg

SEQ ID NO: 4857212 - DNA, 23 bp, Homo sapiens
gagacgtttataaacagaaatgg

SEQ ID NO: 4857213 - DNA, 21 bp, Homo sapiens
gagacttgcagttagactcaa

SEQ ID NO: 4857214 - DNA, 19 bp, Homo sapiens
gagactttgatactaccag

SEQ ID NO: 4857215 - DNA, 14 bp, Homo sapiens
gagagaggaggaaa

SEQ ID NO: 4857216 - DNA, 21 bp, Homo sapiens
gagagcagagaagtacaggtc

SEQ ID NO: 4857217 - DNA, 16 bp, Homo sapiens
gagagcataatttaaa

SEQ ID NO: 4857218 - DNA, 18 bp, Homo sapiens
gagagggaaaaggcaggt

SEQ ID NO: 4857219 - DNA, 23 bp, Homo sapiens
gagagggaagatgacctgcccca

SEQ ID NO: 4857220 - DNA, 15 bp, Homo sapiens
gagagtagggccctg

SEQ ID NO: 4857221 - DNA, 18 bp, Homo sapiens
gagagttccggggagaaa

SEQ ID NO: 4857222 - DNA, 21 bp, Homo sapiens
gagagttctggatgtctggct

SEQ ID NO: 4857223 - DNA, 15 bp, Homo sapiens
gagatcaaagatgaa

SEQ ID NO: 4857224 - DNA, 20 bp, Homo sapiens
gagatcaaagatgaaaagta

SEQ ID NO: 4857225 - DNA, 17 bp, Homo sapiens
gagattggttttcctgt

SEQ ID NO: 4857226 - DNA, 15 bp, Homo sapiens
gagcaaactctgctg

SEQ ID NO: 4857227 - DNA, 22 bp, Homo sapiens
gagcaagcaccaacctccagac

SEQ ID NO: 4857228 - DNA, 24 bp, Homo sapiens
gagcacacatccaagagggactcc

SEQ ID NO: 4857229 - DNA, 11 bp, Homo sapiens
gagcagcaggc

SEQ ID NO: 4857230 - DNA, 12 bp, Homo sapiens
gagcagcaggcc

SEQ ID NO: 4857231 - DNA, 15 bp, Homo sapiens
gagcagcaggcctct

SEQ ID NO: 4857232 - DNA, 21 bp, Homo sapiens
gagcagcaggcctctgggacc

SEQ ID NO: 4857233 - DNA, 23 bp, Homo sapiens
gagcagcaggcctctgggaccca

SEQ ID NO: 4857234 - DNA, 22 bp, Homo sapiens
gagcagccaaggccgccagcgt

SEQ ID NO: 4857235 - DNA, 14 bp, Homo sapiens
gagcaggacctggg

SEQ ID NO: 4857236 - DNA, 20 bp, Homo sapiens
gagcataatttaaaaatata

SEQ ID NO: 4857237 - DNA, 14 bp, Homo sapiens
gagcattgcagcct

SEQ ID NO: 4857238 - DNA, 16 bp, Homo sapiens
gagccacttctcccca

SEQ ID NO: 4857239 - DNA, 19 bp, Homo sapiens
gagccacttctccccagaa

SEQ ID NO: 4857240 - DNA, 19 bp, Homo sapiens
gagccagcctgcttcccac

SEQ ID NO: 4857241 - DNA, 12 bp, Homo sapiens
gagccagctgct

SEQ ID NO: 4857242 - DNA, 16 bp, Homo sapiens
gagccaggactcccag

SEQ ID NO: 4857243 - DNA, 16 bp, Homo sapiens
gagcccctactgtggg

SEQ ID NO: 4857244 - DNA, 17 bp, Homo sapiens
gagcccctactgtgggc

SEQ ID NO: 4857245 - DNA, 22 bp, Homo sapiens
gagcccctactgtgggcaaagt

SEQ ID NO: 4857246 - DNA, 14 bp, Homo sapiens
gagcccgggagctg

SEQ ID NO: 4857247 - DNA, 22 bp, Homo sapiens
gagcctacctctgtctgagaca

SEQ ID NO: 4857248 - DNA, 21 bp, Homo sapiens
gagcctggccaggcagggaga

SEQ ID NO: 4857249 - DNA, 15 bp, Homo sapiens
gagcctggtcctggc

SEQ ID NO: 4857250 - DNA, 20 bp, Homo sapiens
gagcgacgtttatttcatct

SEQ ID NO: 4857251 - DNA, 23 bp, Homo sapiens
gagcgacgtttatttcatctctt

SEQ ID NO: 4857252 - DNA, 18 bp, Homo sapiens
gagcggggtcccctctgt

SEQ ID NO: 4857253 - DNA, 21 bp, Homo sapiens
gagctctcccctcctgctggg

SEQ ID NO: 4857254 - DNA, 16 bp, Homo sapiens
gagctctgaaatcttc

SEQ ID NO: 4857255 - DNA, 12 bp, Homo sapiens
gagctcttccta

SEQ ID NO: 4857256 - DNA, 13 bp, Homo sapiens
gagctgctgccct

SEQ ID NO: 4857257 - DNA, 19 bp, Homo sapiens
gatttcactaggactcaga

SEQ ID NO: 4857258 - DNA, 20 bp, Homo sapiens
gatttcactaggactcagaa

SEQ ID NO: 4857259 - DNA, 15 bp, Homo sapiens
gatttcatactgtaa

SEQ ID NO: 4857260 - DNA, 19 bp, Homo sapiens
gatttccagaaccacactt

SEQ ID NO: 4857261 - DNA, 22 bp, Homo sapiens
gatttccagaaccacacttgaa

SEQ ID NO: 4857262 - DNA, 21 bp, Homo sapiens
gatttccctccagagaaagca

SEQ ID NO: 4857263 - DNA, 22 bp, Homo sapiens
gatttctcattgacttttataa

SEQ ID NO: 4857264 - DNA, 15 bp, Homo sapiens
gatttgaaaaatata

SEQ ID NO: 4857265 - DNA, 15 bp, Homo sapiens
gatttttctttaact

SEQ ID NO: 4857266 - DNA, 16 bp, Homo sapiens
gcaaaaagagtcagac

SEQ ID NO: 4857267 - DNA, 11 bp, Homo sapiens
gcaaaaggaaa

SEQ ID NO: 4857268 - DNA, 13 bp, Homo sapiens
gcaaacagcaaga

SEQ ID NO: 4857269 - DNA, 16 bp, Homo sapiens
gcaaactgaggcagca

SEQ ID NO: 4857270 - DNA, 12 bp, Homo sapiens
gcaaagaaaatg

SEQ ID NO: 4857271 - DNA, 16 bp, Homo sapiens
gcaaaggtgcactcca

SEQ ID NO: 4857272 - DNA, 17 bp, Homo sapiens
gcaaagtcctcctttca

SEQ ID NO: 4857273 - DNA, 22 bp, Homo sapiens
gcaaagtcgccagtcactgctg

SEQ ID NO: 4857274 - DNA, 21 bp, Homo sapiens
gcaaagtctccagaagaaaat

SEQ ID NO: 4857275 - DNA, 20 bp, Homo sapiens
gcaaagtgacaaagcaattt

SEQ ID NO: 4857276 - DNA, 19 bp, Homo sapiens
gcaaatagattcagagaaa

SEQ ID NO: 4857277 - DNA, 20 bp, Homo sapiens
gcaaatagattcagagaaat

SEQ ID NO: 4857278 - DNA, 22 bp, Homo sapiens
gcaacccagtcacactgtggcc

SEQ ID NO: 4857279 - DNA, 19 bp, Homo sapiens
gcaagagactgggagccac

SEQ ID NO: 4857280 - DNA, 22 bp, Homo sapiens
gcaagcaccaacctccagactc

SEQ ID NO: 4857281 - DNA, 11 bp, Homo sapiens
gcaagcagatg

SEQ ID NO: 4857282 - DNA, 14 bp, Homo sapiens
gcaagcttcttgct

SEQ ID NO: 4857283 - DNA, 15 bp, Homo sapiens
gcaagcttcttgctg

SEQ ID NO: 4857284 - DNA, 16 bp, Homo sapiens
gcaagcttcttgctga

SEQ ID NO: 4857285 - DNA, 12 bp, Homo sapiens
gcaaggcagagc

SEQ ID NO: 4857286 - DNA, 15 bp, Homo sapiens
gcaaggggtgaggat

SEQ ID NO: 4857287 - DNA, 22 bp, Homo sapiens
gcaaggggtgaggataggacag

SEQ ID NO: 4857288 - DNA, 21 bp, Homo sapiens
gcaaggtggcctctgcctggg

SEQ ID NO: 4857289 - DNA, 17 bp, Homo sapiens
gcaaggtgtgatggtct

SEQ ID NO: 4857290 - DNA, 15 bp, Homo sapiens
gcaataaaatttaaa

SEQ ID NO: 4857291 - DNA, 13 bp, Homo sapiens
gcaataaagtata

SEQ ID NO: 4857292 - DNA, 23 bp, Homo sapiens
gcaataggtagctggggagccct

SEQ ID NO: 4857293 - DNA, 22 bp, Homo sapiens
gcaatagtgcaacatctctgaa

SEQ ID NO: 4857294 - DNA, 19 bp, Homo sapiens
gcacaaacagaattttcca

SEQ ID NO: 4857295 - DNA, 13 bp, Homo sapiens
gcacaaagaagaa

SEQ ID NO: 4857296 - DNA, 17 bp, Homo sapiens
gcacaaagcactggcct

SEQ ID NO: 4857297 - DNA, 16 bp, Homo sapiens
gcacaagactggccca

SEQ ID NO: 4857298 - DNA, 21 bp, Homo sapiens
gcacaagactggcccagtgcc

SEQ ID NO: 4857299 - DNA, 16 bp, Homo sapiens
gcacaatgttggagca

SEQ ID NO: 4857300 - DNA, 23 bp, Homo sapiens
gcacaatgttggagcagcaggcc

SEQ ID NO: 4857301 - DNA, 22 bp, Homo sapiens
gcacagtgtaatccaggggtgt

SEQ ID NO: 4857302 - DNA, 13 bp, Homo sapiens
gcacattaactgt

SEQ ID NO: 4857303 - DNA, 18 bp, Homo sapiens
gcaccaacctccagactc

SEQ ID NO: 4857304 - DNA, 19 bp, Homo sapiens
gcactaaaatgaggatcca

SEQ ID NO: 4857305 - DNA, 15 bp, Homo sapiens
gcactagccttccca

SEQ ID NO: 4857306 - DNA, 18 bp, Homo sapiens
gcactagccttcccagct

SEQ ID NO: 4857307 - DNA, 11 bp, Homo sapiens
gcactccagac

SEQ ID NO: 4857308 - DNA, 12 bp, Homo sapiens
gcactccagact

SEQ ID NO: 4857309 - DNA, 15 bp, Homo sapiens
gcactccagactctg

SEQ ID NO: 4857310 - DNA, 19 bp, Homo sapiens
gcactccagactctggggg

SEQ ID NO: 4857311 - DNA, 12 bp, Homo sapiens
gcactggccttg

SEQ ID NO: 4857312 - DNA, 13 bp, Homo sapiens
gcactggccttgc

SEQ ID NO: 4857313 - DNA, 20 bp, Homo sapiens
gcacttattgaatatatgat

SEQ ID NO: 4857314 - DNA, 19 bp, Homo sapiens
gcacttattgaccattttt

SEQ ID NO: 4857315 - DNA, 17 bp, Homo sapiens
gcagaagcaataataaa

SEQ ID NO: 4857316 - DNA, 14 bp, Homo sapiens
gcagacaaccttgt

SEQ ID NO: 4857317 - DNA, 23 bp, Homo sapiens
gcagacctggagcttcagccagg

SEQ ID NO: 4857318 - DNA, 14 bp, Homo sapiens
gcagacgtccatca

SEQ ID NO: 4857319 - DNA, 17 bp, Homo sapiens
gcagagaaatgccccag

SEQ ID NO: 4857320 - DNA, 23 bp, Homo sapiens
gcagagatttctcattgactttt

SEQ ID NO: 4857321 - DNA, 21 bp, Homo sapiens
gcagagcctttttacctggcc

SEQ ID NO: 4857322 - DNA, 21 bp, Homo sapiens
gcagagcggggtcccctctgt

SEQ ID NO: 4857323 - DNA, 19 bp, Homo sapiens
gcagagctctcccctcctg

SEQ ID NO: 4857324 - DNA, 15 bp, Homo sapiens
gcagaggtggggtgc

SEQ ID NO: 4857325 - DNA, 13 bp, Homo sapiens
gcagagttaaatc

SEQ ID NO: 4857326 - DNA, 12 bp, Homo sapiens
gcagagttttca

SEQ ID NO: 4857327 - DNA, 19 bp, Homo sapiens
gcagagttttcattaaatc

SEQ ID NO: 4857328 - DNA, 18 bp, Homo sapiens
gcagatatctgcatgtgt

SEQ ID NO: 4857329 - DNA, 14 bp, Homo sapiens
gcagatgagggctg

SEQ ID NO: 4857330 - DNA, 19 bp, Homo sapiens
gcagatgggggcctctctg

SEQ ID NO: 4857331 - DNA, 16 bp, Homo sapiens
gcagatgtttgcctca

SEQ ID NO: 4857332 - DNA, 17 bp, Homo sapiens
gcagcaggccagagaaa

SEQ ID NO: 4857333 - DNA, 23 bp, Homo sapiens
gcagcaggccagagaaagcaaag

SEQ ID NO: 4857334 - DNA, 14 bp, Homo sapiens
gcagcaggcctctg

SEQ ID NO: 4857335 - DNA, 18 bp, Homo sapiens
gcagcatccaccccaccc

SEQ ID NO: 4857336 - DNA, 15 bp, Homo sapiens
gcagccaaggccgcc

SEQ ID NO: 4857337 - DNA, 23 bp, Homo sapiens
gcagccaggatgactagatcctg

SEQ ID NO: 4857338 - DNA, 13 bp, Homo sapiens
gcagccagttcaa

SEQ ID NO: 4857339 - DNA, 19 bp, Homo sapiens
gcagcctaagaagaaggcc

SEQ ID NO: 4857340 - DNA, 20 bp, Homo sapiens
gcagcctctccgactctgca

SEQ ID NO: 4857341 - DNA, 17 bp, Homo sapiens
gcagcctggttggcagc

SEQ ID NO: 4857342 - DNA, 14 bp, Homo sapiens
gcagcctgtatgtg

SEQ ID NO: 4857343 - DNA, 21 bp, Homo sapiens
gcagcctgtatgtggtgtggg

SEQ ID NO: 4857344 - DNA, 21 bp, Homo sapiens
gcagcggattgctctggagca

SEQ ID NO: 4857345 - DNA, 14 bp, Homo sapiens
gcagcggctcctgc

SEQ ID NO: 4857346 - DNA, 16 bp, Homo sapiens
gcagcttgctgggctt

SEQ ID NO: 4857347 - DNA, 14 bp, Homo sapiens
gcaggagcccccct

SEQ ID NO: 4857348 - DNA, 20 bp, Homo sapiens
gcaggaggctttgggtggct

SEQ ID NO: 4857349 - DNA, 13 bp, Homo sapiens
gcaggagtctctg

SEQ ID NO: 4857350 - DNA, 16 bp, Homo sapiens
gcaggagtctctgcca

SEQ ID NO: 4857351 - DNA, 12 bp, Homo sapiens
gcaggccagaga

SEQ ID NO: 4857352 - DNA, 14 bp, Homo sapiens
gcaggcctcccaag

SEQ ID NO: 4857353 - DNA, 14 bp, Homo sapiens
gcaggcctctggga

SEQ ID NO: 4857354 - DNA, 19 bp, Homo sapiens
gcaggcctctgggacccac

SEQ ID NO: 4857355 - DNA, 22 bp, Homo sapiens
gcaggcctctgggacccacaga

SEQ ID NO: 4857356 - DNA, 14 bp, Homo sapiens
gcagggagagagta

SEQ ID NO: 4857357 - DNA, 21 bp, Homo sapiens
gcagggccctgaaatggcctg

SEQ ID NO: 4857358 - DNA, 12 bp, Homo sapiens
gcaggggtcccc

SEQ ID NO: 4857359 - DNA, 14 bp, Homo sapiens
gcagggtttctttt

SEQ ID NO: 4857360 - DNA, 19 bp, Homo sapiens
gcaggtgcttttggcagag

SEQ ID NO: 4857361 - DNA, 14 bp, Homo sapiens
gcagtcagactgaa

SEQ ID NO: 4857362 - DNA, 19 bp, Homo sapiens
gcagtcgcccaagcagaca

SEQ ID NO: 4857363 - DNA, 18 bp, Homo sapiens
gcagtgtctgtgttttga

SEQ ID NO: 4857364 - DNA, 13 bp, Homo sapiens
gcagtgtgaggac

SEQ ID NO: 4857365 - DNA, 17 bp, Homo sapiens
gcagttagactcaaaga

SEQ ID NO: 4857366 - DNA, 15 bp, Homo sapiens
gcagttcctgtccca

SEQ ID NO: 4857367 - DNA, 17 bp, Homo sapiens
gcagttcctgtcccaca

SEQ ID NO: 4857368 - DNA, 19 bp, Homo sapiens
gcagttcctgtcccacatg

SEQ ID NO: 4857369 - DNA, 17 bp, Homo sapiens
gcagttggactctcagg

SEQ ID NO: 4857370 - DNA, 22 bp, Homo sapiens
gcagtttccagtcctaacaaat

SEQ ID NO: 4857371 - DNA, 16 bp, Homo sapiens
gcataaagtaaataca

SEQ ID NO: 4857372 - DNA, 16 bp, Homo sapiens
gcataatttaaaaata

SEQ ID NO: 4857373 - DNA, 14 bp, Homo sapiens
gcatactttgtatt

SEQ ID NO: 4857374 - DNA, 20 bp, Homo sapiens
gcatagccggtgggtgagga

SEQ ID NO: 4857375 - DNA, 23 bp, Homo sapiens
gcatattataaaggataaagaag

SEQ ID NO: 4857376 - DNA, 14 bp, Homo sapiens
gcatcatctcttcc

SEQ ID NO: 4857377 - DNA, 16 bp, Homo sapiens
gctcctttcccctctc

SEQ ID NO: 4857378 - DNA, 18 bp, Homo sapiens
gctcctttcccctctcat

SEQ ID NO: 4857379 - DNA, 21 bp, Homo sapiens
gctcggctactggttacctgg

SEQ ID NO: 4857380 - DNA, 21 bp, Homo sapiens
gctcggggtgtgtcatttcta

SEQ ID NO: 4857381 - DNA, 14 bp, Homo sapiens
gctctaaaaggtaa

SEQ ID NO: 4857382 - DNA, 23 bp, Homo sapiens
gctctaaaaggtaatgtgtggat

SEQ ID NO: 4857383 - DNA, 14 bp, Homo sapiens
gctctatactgtgg

SEQ ID NO: 4857384 - DNA, 16 bp, Homo sapiens
gctctatactgtggcc

SEQ ID NO: 4857385 - DNA, 17 bp, Homo sapiens
gctctatactgtggcct

SEQ ID NO: 4857386 - DNA, 14 bp, Homo sapiens
gctctcacccccat

SEQ ID NO: 4857387 - DNA, 16 bp, Homo sapiens
gctctcacccccatcc

SEQ ID NO: 4857388 - DNA, 19 bp, Homo sapiens
gctctcccctcctgctggg

SEQ ID NO: 4857389 - DNA, 18 bp, Homo sapiens
gctctcctccagccctgg

SEQ ID NO: 4857390 - DNA, 13 bp, Homo sapiens
gctctgcctggag

SEQ ID NO: 4857391 - DNA, 17 bp, Homo sapiens
gctcttcccactccagc

SEQ ID NO: 4857392 - DNA, 19 bp, Homo sapiens
gctcttcccactccagctg

SEQ ID NO: 4857393 - DNA, 19 bp, Homo sapiens
gctcttcctatccctctcc

SEQ ID NO: 4857394 - DNA, 13 bp, Homo sapiens
gctcttcttcctc

SEQ ID NO: 4857395 - DNA, 19 bp, Homo sapiens
gctcttgtgttcagaagaa

SEQ ID NO: 4857396 - DNA, 16 bp, Homo sapiens
gctgaacaggaaagag

SEQ ID NO: 4857397 - DNA, 19 bp, Homo sapiens
gctgaacaggaaagagcta

SEQ ID NO: 4857398 - DNA, 19 bp, Homo sapiens
gctgacaaccattaaagtc

SEQ ID NO: 4857399 - DNA, 22 bp, Homo sapiens
gctgacaaccattaaagtcaga

SEQ ID NO: 4857400 - DNA, 21 bp, Homo sapiens
gctgacagccacaccgtggca

SEQ ID NO: 4857401 - DNA, 13 bp, Homo sapiens
gctgaggcagaag

SEQ ID NO: 4857402 - DNA, 16 bp, Homo sapiens
gctgatgggtgccctt

SEQ ID NO: 4857403 - DNA, 12 bp, Homo sapiens
gctgcaaaaatt

SEQ ID NO: 4857404 - DNA, 16 bp, Homo sapiens
gctgcaaaaattatat

SEQ ID NO: 4857405 - DNA, 19 bp, Homo sapiens
gctgcaaaaattatatatt

SEQ ID NO: 4857406 - DNA, 22 bp, Homo sapiens
gctgcaaggtggcctctgcctg

SEQ ID NO: 4857407 - DNA, 24 bp, Homo sapiens
gctgcaaggtggcctctgcctggg

SEQ ID NO: 4857408 - DNA, 18 bp, Homo sapiens
gctgcagagatttctcat

SEQ ID NO: 4857409 - DNA, 23 bp, Homo sapiens
gctgcagccttcatcagaactct

SEQ ID NO: 4857410 - DNA, 20 bp, Homo sapiens
gctgcatgatttttgccctg

SEQ ID NO: 4857411 - DNA, 19 bp, Homo sapiens
gctgccaggggctctgtgg

SEQ ID NO: 4857412 - DNA, 21 bp, Homo sapiens
gctgccaggggctctgtggca

SEQ ID NO: 4857413 - DNA, 15 bp, Homo sapiens
gctgccctgcggccc

SEQ ID NO: 4857414 - DNA, 14 bp, Homo sapiens
gctgccttgcttct

SEQ ID NO: 4857415 - DNA, 22 bp, Homo sapiens
gctgctaagtcattggcaaagt

SEQ ID NO: 4857416 - DNA, 14 bp, Homo sapiens
gctgctactgctgc

SEQ ID NO: 4857417 - DNA, 23 bp, Homo sapiens
gctgctcccctaaagccaggctc

SEQ ID NO: 4857418 - DNA, 20 bp, Homo sapiens
gctgctcctttaccctcttg

SEQ ID NO: 4857419 - DNA, 16 bp, Homo sapiens
gctgctcggctactgg

SEQ ID NO: 4857420 - DNA, 13 bp, Homo sapiens
gctgctgccctgc

SEQ ID NO: 4857421 - DNA, 14 bp, Homo sapiens
gctgctgccgccgc

SEQ ID NO: 4857422 - DNA, 16 bp, Homo sapiens
gctgctgtggagtgag

SEQ ID NO: 4857423 - DNA, 16 bp, Homo sapiens
gctgcttgacctagct

SEQ ID NO: 4857424 - DNA, 19 bp, Homo sapiens
gctgcttttgggggtcagc

SEQ ID NO: 4857425 - DNA, 21 bp, Homo sapiens
gctgcttttgggggtcagcat

SEQ ID NO: 4857426 - DNA, 23 bp, Homo sapiens
gctggaagaagtgagcagtgttg

SEQ ID NO: 4857427 - DNA, 24 bp, Homo sapiens
gctggagcagcggattgctctgga

SEQ ID NO: 4857428 - DNA, 16 bp, Homo sapiens
gctggcacaaaagaca

SEQ ID NO: 4857429 - DNA, 18 bp, Homo sapiens
gctggcacaaaagacagc

SEQ ID NO: 4857430 - DNA, 16 bp, Homo sapiens
gctggcggaggctgct

SEQ ID NO: 4857431 - DNA, 14 bp, Homo sapiens
gctgggaaagcata

SEQ ID NO: 4857432 - DNA, 14 bp, Homo sapiens
gctgggcagaggga

SEQ ID NO: 4857433 - DNA, 17 bp, Homo sapiens
gctgggcagagggaggt

SEQ ID NO: 4857434 - DNA, 20 bp, Homo sapiens
gctgggcctcccctgggcag

SEQ ID NO: 4857435 - DNA, 19 bp, Homo sapiens
gctgggcgtgtgtgacact

SEQ ID NO: 4857436 - DNA, 20 bp, Homo sapiens
gctggggacacaggatcctg

SEQ ID NO: 4857437 - DNA, 14 bp, Homo sapiens
gctggggagcccta

SEQ ID NO: 4857438 - DNA, 22 bp, Homo sapiens
gctggggagccctattgctgct

SEQ ID NO: 4857439 - DNA, 15 bp, Homo sapiens
gctggggctgcatga

SEQ ID NO: 4857440 - DNA, 22 bp, Homo sapiens
gctgggtgtttttttttaaaag

SEQ ID NO: 4857441 - DNA, 18 bp, Homo sapiens
gctggtggagatgtagga

SEQ ID NO: 4857442 - DNA, 18 bp, Homo sapiens
gctgtactaacccagtct

SEQ ID NO: 4857443 - DNA, 18 bp, Homo sapiens
gctgtacttcttgaatat

SEQ ID NO: 4857444 - DNA, 14 bp, Homo sapiens
gctgtatcactgcc

SEQ ID NO: 4857445 - DNA, 14 bp, Homo sapiens
gctgtgaggacagg

SEQ ID NO: 4857446 - DNA, 12 bp, Homo sapiens
gctgtgctttgg

SEQ ID NO: 4857447 - DNA, 21 bp, Homo sapiens
gctgtgtctgcccaatgaata

SEQ ID NO: 4857448 - DNA, 20 bp, Homo sapiens
gctgtgtgaatacctgctca

SEQ ID NO: 4857449 - DNA, 13 bp, Homo sapiens
gctgttgaacttt

SEQ ID NO: 4857450 - DNA, 14 bp, Homo sapiens
gcttaaattttaac

SEQ ID NO: 4857451 - DNA, 18 bp, Homo sapiens
gcttaatgctacatgtga

SEQ ID NO: 4857452 - DNA, 16 bp, Homo sapiens
gcttacaggagccagc

SEQ ID NO: 4857453 - DNA, 18 bp, Homo sapiens
gcttataacctagttaaa

SEQ ID NO: 4857454 - DNA, 17 bp, Homo sapiens
gcttatttaatatgctt

SEQ ID NO: 4857455 - DNA, 15 bp, Homo sapiens
gcttcaaaaagccac

SEQ ID NO: 4857456 - DNA, 17 bp, Homo sapiens
gcttcaaaaagccacag

SEQ ID NO: 4857457 - DNA, 20 bp, Homo sapiens
gcttcaaaaagccacagcag

SEQ ID NO: 4857458 - DNA, 21 bp, Homo sapiens
gcttcaaaaagccacagcaga

SEQ ID NO: 4857459 - DNA, 19 bp, Homo sapiens
gcttcaacagccaagctgg

SEQ ID NO: 4857460 - DNA, 12 bp, Homo sapiens
gcttcagccagg

SEQ ID NO: 4857461 - DNA, 13 bp, Homo sapiens
gcttcagccaggc

SEQ ID NO: 4857462 - DNA, 14 bp, Homo sapiens
gcttcagccaggca

SEQ ID NO: 4857463 - DNA, 19 bp, Homo sapiens
gcttcagccaggcaagaaa

SEQ ID NO: 4857464 - DNA, 13 bp, Homo sapiens
gcttcagccaggt

SEQ ID NO: 4857465 - DNA, 15 bp, Homo sapiens
gcttcagttgcttgt

SEQ ID NO: 4857466 - DNA, 14 bp, Homo sapiens
gcttcatccacagc

SEQ ID NO: 4857467 - DNA, 21 bp, Homo sapiens
gcttcccatctgaagagtgga

SEQ ID NO: 4857468 - DNA, 17 bp, Homo sapiens
gcttctctgctgagaag

SEQ ID NO: 4857469 - DNA, 11 bp, Homo sapiens
gcttgcagaac

SEQ ID NO: 4857470 - DNA, 17 bp, Homo sapiens
gcttgcatggagaatgg

SEQ ID NO: 4857471 - DNA, 14 bp, Homo sapiens
gcttgccaaagtac

SEQ ID NO: 4857472 - DNA, 21 bp, Homo sapiens
gcttggcccttcaagggtcag

SEQ ID NO: 4857473 - DNA, 22 bp, Homo sapiens
gcttgggtgaatttcaggggaa

SEQ ID NO: 4857474 - DNA, 14 bp, Homo sapiens
gcttggtttgcaac

SEQ ID NO: 4857475 - DNA, 18 bp, Homo sapiens
gcttgtggtggggcagga

SEQ ID NO: 4857476 - DNA, 20 bp, Homo sapiens
gcttgtggtggggcaggaac

SEQ ID NO: 4857477 - DNA, 16 bp, Homo sapiens
gcttgtttacctttct

SEQ ID NO: 4857478 - DNA, 14 bp, Homo sapiens
gctttaagccttca

SEQ ID NO: 4857479 - DNA, 23 bp, Homo sapiens
gctttgcattttgatattgctgt

SEQ ID NO: 4857480 - DNA, 22 bp, Homo sapiens
gctttgggtggctcactactga

SEQ ID NO: 4857481 - DNA, 20 bp, Homo sapiens
gctttgtcacttttcctttt

SEQ ID NO: 4857482 - DNA, 12 bp, Homo sapiens
gctttttggaaa

SEQ ID NO: 4857483 - DNA, 12 bp, Homo sapiens
gctttttggaat

SEQ ID NO: 4857484 - DNA, 13 bp, Homo sapiens
gctttttggaatc

SEQ ID NO: 4857485 - DNA, 20 bp, Homo sapiens
gcttttttccaaaacaaaaa

SEQ ID NO: 4857486 - DNA, 13 bp, Homo sapiens
ggaaaaataaaca

SEQ ID NO: 4857487 - DNA, 19 bp, Homo sapiens
ggaaaatgccatgaattac

SEQ ID NO: 4857488 - DNA, 21 bp, Homo sapiens
ggaaacaaataatttgaactt

SEQ ID NO: 4857489 - DNA, 13 bp, Homo sapiens
ggaaagagctagg

SEQ ID NO: 4857490 - DNA, 19 bp, Homo sapiens
ggaaagtgctgtcttaaac

SEQ ID NO: 4857491 - DNA, 17 bp, Homo sapiens
ggaaatagatgtgcagt

SEQ ID NO: 4857492 - DNA, 16 bp, Homo sapiens
ggaaattcctgtactg

SEQ ID NO: 4857493 - DNA, 23 bp, Homo sapiens
ggaaattttacaagggcataaag

SEQ ID NO: 4857494 - DNA, 18 bp, Homo sapiens
ggaacaatcacagggaat

SEQ ID NO: 4857495 - DNA, 23 bp, Homo sapiens
ggaacagaagaggaaagagagac

SEQ ID NO: 4857496 - DNA, 15 bp, Homo sapiens
ggaacccccctccca

SEQ ID NO: 4857497 - DNA, 18 bp, Homo sapiens
gggtgacagtgccttctc

SEQ ID NO: 4857498 - DNA, 18 bp, Homo sapiens
gggtgaggataggacaga

SEQ ID NO: 4857499 - DNA, 20 bp, Homo sapiens
gggtgccctttcctggcagt

SEQ ID NO: 4857500 - DNA, 22 bp, Homo sapiens
gggtggctcactactgaacaca

SEQ ID NO: 4857501 - DNA, 22 bp, Homo sapiens
gggtgtttgggaaaggcagggc

SEQ ID NO: 4857502 - DNA, 17 bp, Homo sapiens
gggtttctgattgcatc

SEQ ID NO: 4857503 - DNA, 15 bp, Homo sapiens
gggtttgggagccag

SEQ ID NO: 4857504 - DNA, 16 bp, Homo sapiens
gggtttgggagccagg

SEQ ID NO: 4857505 - DNA, 24 bp, Homo sapiens
gggtttgggagccaggactcccag

SEQ ID NO: 4857506 - DNA, 13 bp, Homo sapiens
ggtaaatgtttct

SEQ ID NO: 4857507 - DNA, 21 bp, Homo sapiens
ggtaaatgtttcttttaaaga

SEQ ID NO: 4857508 - DNA, 22 bp, Homo sapiens
ggtaacgtattggacctgccca

SEQ ID NO: 4857509 - DNA, 19 bp, Homo sapiens
ggtaagaatagtagatgtg

SEQ ID NO: 4857510 - DNA, 23 bp, Homo sapiens
ggtaatacccgtcctctcggctg

SEQ ID NO: 4857511 - DNA, 20 bp, Homo sapiens
ggtaattgggaactgaaatc

SEQ ID NO: 4857512 - DNA, 16 bp, Homo sapiens
ggtagctggggagccc

SEQ ID NO: 4857513 - DNA, 16 bp, Homo sapiens
ggtaggaccctcgaga

SEQ ID NO: 4857514 - DNA, 17 bp, Homo sapiens
ggtatgcagagcttgtg

SEQ ID NO: 4857515 - DNA, 19 bp, Homo sapiens
ggtattaaaactaaatttc

SEQ ID NO: 4857516 - DNA, 16 bp, Homo sapiens
ggtcacatccatccct

SEQ ID NO: 4857517 - DNA, 14 bp, Homo sapiens
ggtcagcatccagt

SEQ ID NO: 4857518 - DNA, 18 bp, Homo sapiens
ggtcatctgctgggatct

SEQ ID NO: 4857519 - DNA, 14 bp, Homo sapiens
ggtcccctctgtgc

SEQ ID NO: 4857520 - DNA, 12 bp, Homo sapiens
ggtcctctcagt

SEQ ID NO: 4857521 - DNA, 15 bp, Homo sapiens
ggtctaccaatacaa

SEQ ID NO: 4857522 - DNA, 13 bp, Homo sapiens
ggtctctcaggga

SEQ ID NO: 4857523 - DNA, 22 bp, Homo sapiens
ggtctctcagggatggagggaa

SEQ ID NO: 4857524 - DNA, 12 bp, Homo sapiens
ggtctgactcca

SEQ ID NO: 4857525 - DNA, 23 bp, Homo sapiens
ggtctgactccaaagctgttcca

SEQ ID NO: 4857526 - DNA, 12 bp, Homo sapiens
ggtctgtttgca

SEQ ID NO: 4857527 - DNA, 14 bp, Homo sapiens
ggtgaacactgtga

SEQ ID NO: 4857528 - DNA, 14 bp, Homo sapiens
ggtgaactccaggc

SEQ ID NO: 4857529 - DNA, 19 bp, Homo sapiens
ggtgacagttcccagagtg

SEQ ID NO: 4857530 - DNA, 18 bp, Homo sapiens
ggtgagaagtacagggca

SEQ ID NO: 4857531 - DNA, 23 bp, Homo sapiens
ggtgagacgtgatgggctaggcc

SEQ ID NO: 4857532 - DNA, 23 bp, Homo sapiens
ggtgagcaagcaccaacctccag

SEQ ID NO: 4857533 - DNA, 16 bp, Homo sapiens
ggtgaggtgaactcca

SEQ ID NO: 4857534 - DNA, 18 bp, Homo sapiens
ggtgaggtgaactccagg

SEQ ID NO: 4857535 - DNA, 21 bp, Homo sapiens
ggtgatttctcaccctctgtc

SEQ ID NO: 4857536 - DNA, 14 bp, Homo sapiens
ggtgcactccagac

SEQ ID NO: 4857537 - DNA, 15 bp, Homo sapiens
ggtgccctttcctgg

SEQ ID NO: 4857538 - DNA, 20 bp, Homo sapiens
ggtgcctaacctgggacctg

SEQ ID NO: 4857539 - DNA, 18 bp, Homo sapiens
ggtgctcatgctgctccc

SEQ ID NO: 4857540 - DNA, 14 bp, Homo sapiens
ggtgctggggctgc

SEQ ID NO: 4857541 - DNA, 15 bp, Homo sapiens
ggtgctggggctgca

SEQ ID NO: 4857542 - DNA, 18 bp, Homo sapiens
ggtgcttttggcagagac

SEQ ID NO: 4857543 - DNA, 13 bp, Homo sapiens
ggtggaggtgggt

SEQ ID NO: 4857544 - DNA, 15 bp, Homo sapiens
ggtggcactacccca

SEQ ID NO: 4857545 - DNA, 23 bp, Homo sapiens
ggtggccagcccgcagaggtggg

SEQ ID NO: 4857546 - DNA, 17 bp, Homo sapiens
ggtggcctctgcctggg

SEQ ID NO: 4857547 - DNA, 15 bp, Homo sapiens
ggtggccttgagtct

SEQ ID NO: 4857548 - DNA, 19 bp, Homo sapiens
ggtggccttgagtctctga

SEQ ID NO: 4857549 - DNA, 18 bp, Homo sapiens
ggtggctcactactgaac

SEQ ID NO: 4857550 - DNA, 13 bp, Homo sapiens
ggtggggtgctgg

SEQ ID NO: 4857551 - DNA, 20 bp, Homo sapiens
ggtggggtgctggggctgca

SEQ ID NO: 4857552 - DNA, 20 bp, Homo sapiens
ggtggtgaaggggctggtgg

SEQ ID NO: 4857553 - DNA, 15 bp, Homo sapiens
ggtggtggtgaaggg

SEQ ID NO: 4857554 - DNA, 20 bp, Homo sapiens
ggtgtgaatttgccagagga

SEQ ID NO: 4857555 - DNA, 15 bp, Homo sapiens
ggtgtggtgaatgtg

SEQ ID NO: 4857556 - DNA, 15 bp, Homo sapiens
ggtgttgcagccgca

SEQ ID NO: 4857557 - DNA, 18 bp, Homo sapiens
ggttaatgttgatttaaa

SEQ ID NO: 4857558 - DNA, 14 bp, Homo sapiens
ggttctgaggccag

SEQ ID NO: 4857559 - DNA, 13 bp, Homo sapiens
ggttgactaagaa

SEQ ID NO: 4857560 - DNA, 15 bp, Homo sapiens
ggttggcagcatctg

SEQ ID NO: 4857561 - DNA, 21 bp, Homo sapiens
ggttgtctctcttcggtggcc

SEQ ID NO: 4857562 - DNA, 17 bp, Homo sapiens
ggtttaagaaatagaat

SEQ ID NO: 4857563 - DNA, 12 bp, Homo sapiens
ggtttctgggtg

SEQ ID NO: 4857564 - DNA, 17 bp, Homo sapiens
ggtttgggagccaggac

SEQ ID NO: 4857565 - DNA, 22 bp, Homo sapiens
ggtttgggagccaggactccca

SEQ ID NO: 4857566 - DNA, 12 bp, Homo sapiens
gtaaaagtagtg

SEQ ID NO: 4857567 - DNA, 17 bp, Homo sapiens
gtaaagcagttcctgtc

SEQ ID NO: 4857568 - DNA, 21 bp, Homo sapiens
gtaaataggaatcattcagaa

SEQ ID NO: 4857569 - DNA, 20 bp, Homo sapiens
gtaacactagggccttggaa

SEQ ID NO: 4857570 - DNA, 12 bp, Homo sapiens
gtaagcagtgtt

SEQ ID NO: 4857571 - DNA, 19 bp, Homo sapiens
gtaaggatccggaaagaag

SEQ ID NO: 4857572 - DNA, 13 bp, Homo sapiens
gtaataagcactg

SEQ ID NO: 4857573 - DNA, 20 bp, Homo sapiens
gtaataagcactgtaaactt

SEQ ID NO: 4857574 - DNA, 16 bp, Homo sapiens
gtaatgctaaatgtgt

SEQ ID NO: 4857575 - DNA, 17 bp, Homo sapiens
gtaatgctaaatgtgta

SEQ ID NO: 4857576 - DNA, 22 bp, Homo sapiens
gtaatgctaaatgtgtaataat

SEQ ID NO: 4857577 - DNA, 12 bp, Homo sapiens
gtaatgctgcct

SEQ ID NO: 4857578 - DNA, 19 bp, Homo sapiens
gtaatgctgcctcaggacc

SEQ ID NO: 4857579 - DNA, 22 bp, Homo sapiens
gtaatgctgcctcaggacccat

SEQ ID NO: 4857580 - DNA, 19 bp, Homo sapiens
gtaattgggaactgaaatc

SEQ ID NO: 4857581 - DNA, 19 bp, Homo sapiens
gtaattttattttaaaatt

SEQ ID NO: 4857582 - DNA, 20 bp, Homo sapiens
gtaattttattttaaaattt

SEQ ID NO: 4857583 - DNA, 13 bp, Homo sapiens
gtacagggcagaa

SEQ ID NO: 4857584 - DNA, 19 bp, Homo sapiens
gtacaggtcatctgctggg

SEQ ID NO: 4857585 - DNA, 18 bp, Homo sapiens
gtacagtctgctcctctt

SEQ ID NO: 4857586 - DNA, 16 bp, Homo sapiens
gtacatatgtgctgga

SEQ ID NO: 4857587 - DNA, 13 bp, Homo sapiens
gtacatttaaatt

SEQ ID NO: 4857588 - DNA, 16 bp, Homo sapiens
gtaccaaaattttaaa

SEQ ID NO: 4857589 - DNA, 20 bp, Homo sapiens
gtactaacccagtctttctt

SEQ ID NO: 4857590 - DNA, 17 bp, Homo sapiens
gtactaaggagaaatga

SEQ ID NO: 4857591 - DNA, 23 bp, Homo sapiens
gtacttaaatggtaataagcact

SEQ ID NO: 4857592 - DNA, 20 bp, Homo sapiens
gtacttatttctcagctgtg

SEQ ID NO: 4857593 - DNA, 19 bp, Homo sapiens
gtacttggcccccttcagg

SEQ ID NO: 4857594 - DNA, 20 bp, Homo sapiens
gtacttgggtcacatgactc

SEQ ID NO: 4857595 - DNA, 15 bp, Homo sapiens
gtactttatcatgaa

SEQ ID NO: 4857596 - DNA, 21 bp, Homo sapiens
gtactttctgttatgggcttt

SEQ ID NO: 4857597 - DNA, 18 bp, Homo sapiens
gtagaaactgaggcccag

SEQ ID NO: 4857598 - DNA, 22 bp, Homo sapiens
gtagatccatttccattgctta

SEQ ID NO: 4857599 - DNA, 18 bp, Homo sapiens
gtagatggcgatgtgtta

SEQ ID NO: 4857600 - DNA, 19 bp, Homo sapiens
gtagatgggggaactgtga

SEQ ID NO: 4857601 - DNA, 14 bp, Homo sapiens
gtagcactctcaga

SEQ ID NO: 4857602 - DNA, 15 bp, Homo sapiens
gtagcactctcagag

SEQ ID NO: 4857603 - DNA, 13 bp, Homo sapiens
gtagcagaaacca

SEQ ID NO: 4857604 - DNA, 17 bp, Homo sapiens
gtagcagagttaaatct

SEQ ID NO: 4857605 - DNA, 15 bp, Homo sapiens
gtagcatctcagtgg

SEQ ID NO: 4857606 - DNA, 14 bp, Homo sapiens
gtagccagctgtgc

SEQ ID NO: 4857607 - DNA, 22 bp, Homo sapiens
gtagctgggaaagcataaagct

SEQ ID NO: 4857608 - DNA, 14 bp, Homo sapiens
gtagcttcagccag

SEQ ID NO: 4857609 - DNA, 16 bp, Homo sapiens
gtagcttcagccaggc

SEQ ID NO: 4857610 - DNA, 12 bp, Homo sapiens
gtagggccaggg

SEQ ID NO: 4857611 - DNA, 15 bp, Homo sapiens
gtagggccctgacag

SEQ ID NO: 4857612 - DNA, 17 bp, Homo sapiens
gtagggtagtggctggg

SEQ ID NO: 4857613 - DNA, 19 bp, Homo sapiens
gtagtatttgcctatttcc

SEQ ID NO: 4857614 - DNA, 21 bp, Homo sapiens
gtagtcccggaggccttccct

SEQ ID NO: 4857615 - DNA, 13 bp, Homo sapiens
gtataatattgaa

SEQ ID NO: 4857616 - DNA, 13 bp, Homo sapiens
gtataatgtttat

SEQ ID NO: 4857617 - DNA, 20 bp, Homo sapiens
gttctccagtcattatgtta

SEQ ID NO: 4857618 - DNA, 20 bp, Homo sapiens
gttctcctatatcctccttc

SEQ ID NO: 4857619 - DNA, 18 bp, Homo sapiens
gttctgaggccagaaagg

SEQ ID NO: 4857620 - DNA, 16 bp, Homo sapiens
gttctgtagagccaat

SEQ ID NO: 4857621 - DNA, 21 bp, Homo sapiens
gttctttcacccatcctagga

SEQ ID NO: 4857622 - DNA, 19 bp, Homo sapiens
gttctttccatctttagaa

SEQ ID NO: 4857623 - DNA, 14 bp, Homo sapiens
gttctttctgctct

SEQ ID NO: 4857624 - DNA, 19 bp, Homo sapiens
gttgaagagacagagacaa

SEQ ID NO: 4857625 - DNA, 22 bp, Homo sapiens
gttgaagagacagagacaagta

SEQ ID NO: 4857626 - DNA, 16 bp, Homo sapiens
gttgaagcgcggaccc

SEQ ID NO: 4857627 - DNA, 16 bp, Homo sapiens
gttgagaggaggactt

SEQ ID NO: 4857628 - DNA, 15 bp, Homo sapiens
gttgagtctgtacta

SEQ ID NO: 4857629 - DNA, 15 bp, Homo sapiens
gttgcacttttgaat

SEQ ID NO: 4857630 - DNA, 20 bp, Homo sapiens
gttgcacttttgaatgtcca

SEQ ID NO: 4857631 - DNA, 23 bp, Homo sapiens
gttgcatagcagtatatgttaat

SEQ ID NO: 4857632 - DNA, 14 bp, Homo sapiens
gttggactctcagg

SEQ ID NO: 4857633 - DNA, 16 bp, Homo sapiens
gttggactctcaggga

SEQ ID NO: 4857634 - DNA, 21 bp, Homo sapiens
gttggagcagcaggcctctgg

SEQ ID NO: 4857635 - DNA, 23 bp, Homo sapiens
gttgggaatgaggaaaattctta

SEQ ID NO: 4857636 - DNA, 18 bp, Homo sapiens
gttggggaagggcctgcc

SEQ ID NO: 4857637 - DNA, 16 bp, Homo sapiens
gttgtaagaattctga

SEQ ID NO: 4857638 - DNA, 23 bp, Homo sapiens
gttgtacctcttttgcttgccaa

SEQ ID NO: 4857639 - DNA, 18 bp, Homo sapiens
gttgtactttggaattct

SEQ ID NO: 4857640 - DNA, 14 bp, Homo sapiens
gttgtcttattgca

SEQ ID NO: 4857641 - DNA, 14 bp, Homo sapiens
gttgtgagaatggc

SEQ ID NO: 4857642 - DNA, 16 bp, Homo sapiens
gttgtttataataaaa

SEQ ID NO: 4857643 - DNA, 20 bp, Homo sapiens
gtttaaaatgtaatttaaat

SEQ ID NO: 4857644 - DNA, 17 bp, Homo sapiens
gtttaatggtagtttta

SEQ ID NO: 4857645 - DNA, 21 bp, Homo sapiens
gtttacatgaagcagaacctt

SEQ ID NO: 4857646 - DNA, 21 bp, Homo sapiens
gtttacctggcttatttaata

SEQ ID NO: 4857647 - DNA, 13 bp, Homo sapiens
gtttagattgtat

SEQ ID NO: 4857648 - DNA, 20 bp, Homo sapiens
gtttagattgtattaactat

SEQ ID NO: 4857649 - DNA, 15 bp, Homo sapiens
gtttataataaaaat

SEQ ID NO: 4857650 - DNA, 21 bp, Homo sapiens
gtttatatggaagaaagtaag

SEQ ID NO: 4857651 - DNA, 11 bp, Homo sapiens
gtttatatttt

SEQ ID NO: 4857652 - DNA, 20 bp, Homo sapiens
gtttatatttttttaactgt

SEQ ID NO: 4857653 - DNA, 22 bp, Homo sapiens
gtttatatttttttaactgtga

SEQ ID NO: 4857654 - DNA, 22 bp, Homo sapiens
gtttatgtaacttcctgtggat

SEQ ID NO: 4857655 - DNA, 14 bp, Homo sapiens
gtttattctttgca

SEQ ID NO: 4857656 - DNA, 22 bp, Homo sapiens
gtttcaaagtgatagaaaagtg

SEQ ID NO: 4857657 - DNA, 20 bp, Homo sapiens
gtttctcttctagatgattt

SEQ ID NO: 4857658 - DNA, 14 bp, Homo sapiens
gtttcttttaaaga

SEQ ID NO: 4857659 - DNA, 14 bp, Homo sapiens
gtttgaaggagaat

SEQ ID NO: 4857660 - DNA, 13 bp, Homo sapiens
gtttgctgtgctt

SEQ ID NO: 4857661 - DNA, 15 bp, Homo sapiens
gtttggaatattaaa

SEQ ID NO: 4857662 - DNA, 13 bp, Homo sapiens
gtttgggagccag

SEQ ID NO: 4857663 - DNA, 14 bp, Homo sapiens
gtttgggagccagg

SEQ ID NO: 4857664 - DNA, 19 bp, Homo sapiens
gttttaaaacgtgtaaatg

SEQ ID NO: 4857665 - DNA, 20 bp, Homo sapiens
gttttaaaacgtgtaaatga

SEQ ID NO: 4857666 - DNA, 21 bp, Homo sapiens
gttttaaaacgtgtaaatgaa

SEQ ID NO: 4857667 - DNA, 14 bp, Homo sapiens
gttttccaaaagta

SEQ ID NO: 4857668 - DNA, 20 bp, Homo sapiens
gttttgaagattctatgtta

SEQ ID NO: 4857669 - DNA, 19 bp, Homo sapiens
gttttgacaggttttccaa

SEQ ID NO: 4857670 - DNA, 22 bp, Homo sapiens
gtttttaaataaagaacaattg

SEQ ID NO: 4857671 - DNA, 15 bp, Homo sapiens
taaaaaaaagatgaa

SEQ ID NO: 4857672 - DNA, 17 bp, Homo sapiens
taaaaaacaattaactg

SEQ ID NO: 4857673 - DNA, 13 bp, Homo sapiens
taaaaaagagaca

SEQ ID NO: 4857674 - DNA, 18 bp, Homo sapiens
taaaaacgaaaacctgac

SEQ ID NO: 4857675 - DNA, 13 bp, Homo sapiens
taaaaagtataaa

SEQ ID NO: 4857676 - DNA, 19 bp, Homo sapiens
taaaaagtataaaatagta

SEQ ID NO: 4857677 - DNA, 18 bp, Homo sapiens
taaaaatcttttgaagca

SEQ ID NO: 4857678 - DNA, 23 bp, Homo sapiens
taaaacaaagccatgccaataaa

SEQ ID NO: 4857679 - DNA, 14 bp, Homo sapiens
taaaacacacaggt

SEQ ID NO: 4857680 - DNA, 21 bp, Homo sapiens
taaaacaggttataacagtgt

SEQ ID NO: 4857681 - DNA, 17 bp, Homo sapiens
taaaacgtgtaaatgaa

SEQ ID NO: 4857682 - DNA, 14 bp, Homo sapiens
taaaagaaataaac

SEQ ID NO: 4857683 - DNA, 15 bp, Homo sapiens
taaaagctttcatgt

SEQ ID NO: 4857684 - DNA, 15 bp, Homo sapiens
taaaaggtaatgtgt

SEQ ID NO: 4857685 - DNA, 20 bp, Homo sapiens
taaaaggtactggtactata

SEQ ID NO: 4857686 - DNA, 20 bp, Homo sapiens
taaaagtagtgttgtccagg

SEQ ID NO: 4857687 - DNA, 17 bp, Homo sapiens
taaaagttgcattttaa

SEQ ID NO: 4857688 - DNA, 12 bp, Homo sapiens
taaaatgaggat

SEQ ID NO: 4857689 - DNA, 22 bp, Homo sapiens
taaaattcagtttttttccagt

SEQ ID NO: 4857690 - DNA, 17 bp, Homo sapiens
taaaattccaaattcat

SEQ ID NO: 4857691 - DNA, 21 bp, Homo sapiens
taaaattctctagatttatta

SEQ ID NO: 4857692 - DNA, 11 bp, Homo sapiens
taaacactaca

SEQ ID NO: 4857693 - DNA, 12 bp, Homo sapiens
taaacagaaatg

SEQ ID NO: 4857694 - DNA, 22 bp, Homo sapiens
taaaccacttaaacgaagagtt

SEQ ID NO: 4857695 - DNA, 19 bp, Homo sapiens
taaaccccaagcttcccaa

SEQ ID NO: 4857696 - DNA, 22 bp, Homo sapiens
taaacgattagtgatgtcctta

SEQ ID NO: 4857697 - DNA, 21 bp, Homo sapiens
taaactccctggctgttctga

SEQ ID NO: 4857698 - DNA, 15 bp, Homo sapiens
taaacttccaaagaa

SEQ ID NO: 4857699 - DNA, 17 bp, Homo sapiens
taaacttccaaagaaag

SEQ ID NO: 4857700 - DNA, 22 bp, Homo sapiens
taaacttctgcaacaagcatgc

SEQ ID NO: 4857701 - DNA, 13 bp, Homo sapiens
taaagaaaggaaa

SEQ ID NO: 4857702 - DNA, 17 bp, Homo sapiens
taaagaaaggaaaagaa

SEQ ID NO: 4857703 - DNA, 23 bp, Homo sapiens
taaagaaaggaaaagaaaacaaa

SEQ ID NO: 4857704 - DNA, 16 bp, Homo sapiens
taaagaagtgcatgaa

SEQ ID NO: 4857705 - DNA, 15 bp, Homo sapiens
taaagaccagaaatt

SEQ ID NO: 4857706 - DNA, 16 bp, Homo sapiens
taaagaccagaaattc

SEQ ID NO: 4857707 - DNA, 13 bp, Homo sapiens
taaagagaatgag

SEQ ID NO: 4857708 - DNA, 20 bp, Homo sapiens
taaagagcatctgattcttg

SEQ ID NO: 4857709 - DNA, 22 bp, Homo sapiens
taaagccaggctcaggagaagc

SEQ ID NO: 4857710 - DNA, 17 bp, Homo sapiens
taaagccattctgatta

SEQ ID NO: 4857711 - DNA, 15 bp, Homo sapiens
taaagctcaaatgaa

SEQ ID NO: 4857712 - DNA, 17 bp, Homo sapiens
taaagctcaaatgaaat

SEQ ID NO: 4857713 - DNA, 20 bp, Homo sapiens
taaaggaaataggatctcca

SEQ ID NO: 4857714 - DNA, 22 bp, Homo sapiens
taaagggatatttttttctatt

SEQ ID NO: 4857715 - DNA, 21 bp, Homo sapiens
taaagggcccaatgaattatt

SEQ ID NO: 4857716 - DNA, 15 bp, Homo sapiens
taaagtacttgacta

SEQ ID NO: 4857717 - DNA, 13 bp, Homo sapiens
taaagtgtgtgat

SEQ ID NO: 4857718 - DNA, 16 bp, Homo sapiens
taaatacatgcatata

SEQ ID NO: 4857719 - DNA, 14 bp, Homo sapiens
taaatatgaatgaa

SEQ ID NO: 4857720 - DNA, 17 bp, Homo sapiens
taaatcataaagtcagt

SEQ ID NO: 4857721 - DNA, 16 bp, Homo sapiens
taaatcctgaagagca

SEQ ID NO: 4857722 - DNA, 18 bp, Homo sapiens
taaatcctgaagagcatt

SEQ ID NO: 4857723 - DNA, 15 bp, Homo sapiens
taaatgaagatcttt

SEQ ID NO: 4857724 - DNA, 18 bp, Homo sapiens
taaatggtaataagcact

SEQ ID NO: 4857725 - DNA, 19 bp, Homo sapiens
taaatgtataaatatacag

SEQ ID NO: 4857726 - DNA, 22 bp, Homo sapiens
taaatgtataaatatacagtat

SEQ ID NO: 4857727 - DNA, 22 bp, Homo sapiens
taaatgtgcaatagaaggtgat

SEQ ID NO: 4857728 - DNA, 14 bp, Homo sapiens
taaatgtgtaataa

SEQ ID NO: 4857729 - DNA, 22 bp, Homo sapiens
taaatgtgtaataatgtaacat

SEQ ID NO: 4857730 - DNA, 21 bp, Homo sapiens
taaatgtttcttttaaagacc

SEQ ID NO: 4857731 - DNA, 21 bp, Homo sapiens
taaattatgtgaccataatgt

SEQ ID NO: 4857732 - DNA, 10 bp, Homo sapiens
taaattattt

SEQ ID NO: 4857733 - DNA, 15 bp, Homo sapiens
taaattcaactttgt

SEQ ID NO: 4857734 - DNA, 19 bp, Homo sapiens
taaattcaactttgtaaaa

SEQ ID NO: 4857735 - DNA, 18 bp, Homo sapiens
taaattgcatcactgtat

SEQ ID NO: 4857736 - DNA, 12 bp, Homo sapiens
taaattttaaag

SEQ ID NO: 4857737 - DNA, 23 bp, Homo sapiens
tagcttacctgggcacaaacaga

SEQ ID NO: 4857738 - DNA, 23 bp, Homo sapiens
taggaaccagccaaccatcatgt

SEQ ID NO: 4857739 - DNA, 15 bp, Homo sapiens
taggaaccctggagg

SEQ ID NO: 4857740 - DNA, 17 bp, Homo sapiens
taggaatcattcagaaa

SEQ ID NO: 4857741 - DNA, 14 bp, Homo sapiens
taggaatcccagag

SEQ ID NO: 4857742 - DNA, 21 bp, Homo sapiens
taggaatcccagaggtgggat

SEQ ID NO: 4857743 - DNA, 23 bp, Homo sapiens
taggaccatttctctgcaggcca

SEQ ID NO: 4857744 - DNA, 18 bp, Homo sapiens
taggaccctcgagagcct

SEQ ID NO: 4857745 - DNA, 19 bp, Homo sapiens
taggaccctcgagagcctt

SEQ ID NO: 4857746 - DNA, 13 bp, Homo sapiens
taggactcagaaa

SEQ ID NO: 4857747 - DNA, 13 bp, Homo sapiens
taggccaggcctt

SEQ ID NO: 4857748 - DNA, 14 bp, Homo sapiens
taggccaggcctta

SEQ ID NO: 4857749 - DNA, 16 bp, Homo sapiens
taggctattaaaaaag

SEQ ID NO: 4857750 - DNA, 20 bp, Homo sapiens
taggctcttatgtgtgcctt

SEQ ID NO: 4857751 - DNA, 21 bp, Homo sapiens
taggctcttatgtgtgccttt

SEQ ID NO: 4857752 - DNA, 15 bp, Homo sapiens
tagggctctccaagc

SEQ ID NO: 4857753 - DNA, 19 bp, Homo sapiens
tagggctctccaagcacta

SEQ ID NO: 4857754 - DNA, 13 bp, Homo sapiens
tagggtctaccaa

SEQ ID NO: 4857755 - DNA, 20 bp, Homo sapiens
taggtctcctcagggtgggg

SEQ ID NO: 4857756 - DNA, 21 bp, Homo sapiens
taggtctcctcagggtggggg

SEQ ID NO: 4857757 - DNA, 20 bp, Homo sapiens
taggttaaaaaaaaaagtca

SEQ ID NO: 4857758 - DNA, 17 bp, Homo sapiens
taggttccccaatccat

SEQ ID NO: 4857759 - DNA, 21 bp, Homo sapiens
taggttctgtagagccaatta

SEQ ID NO: 4857760 - DNA, 11 bp, Homo sapiens
tagtaagcata

SEQ ID NO: 4857761 - DNA, 12 bp, Homo sapiens
tagtaagcatag

SEQ ID NO: 4857762 - DNA, 15 bp, Homo sapiens
tagtacctgtgactc

SEQ ID NO: 4857763 - DNA, 23 bp, Homo sapiens
tagtattatcttgttcaggaaaa

SEQ ID NO: 4857764 - DNA, 13 bp, Homo sapiens
tagtctaagacta

SEQ ID NO: 4857765 - DNA, 13 bp, Homo sapiens
tagtctctgccct

SEQ ID NO: 4857766 - DNA, 19 bp, Homo sapiens
tagtctctgccctcataga

SEQ ID NO: 4857767 - DNA, 11 bp, Homo sapiens
tagtgacattt

SEQ ID NO: 4857768 - DNA, 15 bp, Homo sapiens
tagtgacatttaatg

SEQ ID NO: 4857769 - DNA, 20 bp, Homo sapiens
tagtgaggaagacaagcatt

SEQ ID NO: 4857770 - DNA, 19 bp, Homo sapiens
tagtgcaacatctctgaat

SEQ ID NO: 4857771 - DNA, 19 bp, Homo sapiens
tagtgcaatagtgcaacat

SEQ ID NO: 4857772 - DNA, 13 bp, Homo sapiens
tagtgtgactcct

SEQ ID NO: 4857773 - DNA, 14 bp, Homo sapiens
tagtgttaaagaga

SEQ ID NO: 4857774 - DNA, 17 bp, Homo sapiens
tagttaaagaaaggaaa

SEQ ID NO: 4857775 - DNA, 23 bp, Homo sapiens
tagttcaatctggattcatattt

SEQ ID NO: 4857776 - DNA, 20 bp, Homo sapiens
tagttgtagacaaagtacat

SEQ ID NO: 4857777 - DNA, 22 bp, Homo sapiens
tataaaaaatcatgccagtatt

SEQ ID NO: 4857778 - DNA, 12 bp, Homo sapiens
tataaaattatg

SEQ ID NO: 4857779 - DNA, 16 bp, Homo sapiens
tataaactgggatgta

SEQ ID NO: 4857780 - DNA, 19 bp, Homo sapiens
tataaagtggaagtatgta

SEQ ID NO: 4857781 - DNA, 14 bp, Homo sapiens
tataaatatacagt

SEQ ID NO: 4857782 - DNA, 15 bp, Homo sapiens
tataaatatacagta

SEQ ID NO: 4857783 - DNA, 23 bp, Homo sapiens
tataacacatttttttgcatgca

SEQ ID NO: 4857784 - DNA, 19 bp, Homo sapiens
tataagcaaattgcttttt

SEQ ID NO: 4857785 - DNA, 13 bp, Homo sapiens
tataataaaaata

SEQ ID NO: 4857786 - DNA, 15 bp, Homo sapiens
tataatgaataaatc

SEQ ID NO: 4857787 - DNA, 16 bp, Homo sapiens
tataatgtatataaac

SEQ ID NO: 4857788 - DNA, 13 bp, Homo sapiens
tataattgtacaa

SEQ ID NO: 4857789 - DNA, 14 bp, Homo sapiens
tatacaaagtgtac

SEQ ID NO: 4857790 - DNA, 16 bp, Homo sapiens
tatacatcaatatgta

SEQ ID NO: 4857791 - DNA, 16 bp, Homo sapiens
tataccaaattaaaaa

SEQ ID NO: 4857792 - DNA, 19 bp, Homo sapiens
tatactgtggcctgcagga

SEQ ID NO: 4857793 - DNA, 16 bp, Homo sapiens
tatagtctaagactat

SEQ ID NO: 4857794 - DNA, 20 bp, Homo sapiens
tatagtctaagactatatat

SEQ ID NO: 4857795 - DNA, 12 bp, Homo sapiens
tatataaatgta

SEQ ID NO: 4857796 - DNA, 15 bp, Homo sapiens
tatataatgtatata

SEQ ID NO: 4857797 - DNA, 23 bp, Homo sapiens
tatataggctattttctaaagac

SEQ ID NO: 4857798 - DNA, 13 bp, Homo sapiens
tatatataaatgt

SEQ ID NO: 4857799 - DNA, 18 bp, Homo sapiens
tatatcctccttctcctg

SEQ ID NO: 4857800 - DNA, 19 bp, Homo sapiens
tatatgactgcatttgtgt

SEQ ID NO: 4857801 - DNA, 15 bp, Homo sapiens
tatatggaagaaagt

SEQ ID NO: 4857802 - DNA, 16 bp, Homo sapiens
tatatgtattttttga

SEQ ID NO: 4857803 - DNA, 18 bp, Homo sapiens
tatattaaaaaagagaca

SEQ ID NO: 4857804 - DNA, 22 bp, Homo sapiens
tatattagatcaaatagttgca

SEQ ID NO: 4857805 - DNA, 22 bp, Homo sapiens
tatattcaggacttgaaagaaa

SEQ ID NO: 4857806 - DNA, 14 bp, Homo sapiens
tatatttcaataaa

SEQ ID NO: 4857807 - DNA, 15 bp, Homo sapiens
tatatttcaataaat

SEQ ID NO: 4857808 - DNA, 15 bp, Homo sapiens
tatattttatattac

SEQ ID NO: 4857809 - DNA, 16 bp, Homo sapiens
tatattttgtgtgaaa

SEQ ID NO: 4857810 - DNA, 19 bp, Homo sapiens
tatattttgtgtgaaattg

SEQ ID NO: 4857811 - DNA, 21 bp, Homo sapiens
tatcagtaacccccttaaatt

SEQ ID NO: 4857812 - DNA, 11 bp, Homo sapiens
tatcatgaatg

SEQ ID NO: 4857813 - DNA, 12 bp, Homo sapiens
tatcatgaattt

SEQ ID NO: 4857814 - DNA, 19 bp, Homo sapiens
tatcatgaattttaaagta

SEQ ID NO: 4857815 - DNA, 16 bp, Homo sapiens
tatcatgagtgaataa

SEQ ID NO: 4857816 - DNA, 12 bp, Homo sapiens
tatcatgtatgg

SEQ ID NO: 4857817 - DNA, 20 bp, Homo sapiens
tatcattttcttttttaacc

SEQ ID NO: 4857818 - DNA, 16 bp, Homo sapiens
tatccacactgtcaaa

SEQ ID NO: 4857819 - DNA, 18 bp, Homo sapiens
tatccacactgtcaaaca

SEQ ID NO: 4857820 - DNA, 17 bp, Homo sapiens
tatcccttggacatttt

SEQ ID NO: 4857821 - DNA, 17 bp, Homo sapiens
tatcggcagatgatgct

SEQ ID NO: 4857822 - DNA, 18 bp, Homo sapiens
tatctagttctaacagtg

SEQ ID NO: 4857823 - DNA, 22 bp, Homo sapiens
tatctcaatgaaccataaattc

SEQ ID NO: 4857824 - DNA, 14 bp, Homo sapiens
tatctcttcctgtc

SEQ ID NO: 4857825 - DNA, 22 bp, Homo sapiens
tatctgaaaggccagcagctga

SEQ ID NO: 4857826 - DNA, 12 bp, Homo sapiens
tatctgcatgtg

SEQ ID NO: 4857827 - DNA, 17 bp, Homo sapiens
tatctgcatgtgtcatg

SEQ ID NO: 4857828 - DNA, 22 bp, Homo sapiens
tatctgcatgtgtcatgaagaa

SEQ ID NO: 4857829 - DNA, 14 bp, Homo sapiens
tatcttacaatatt

SEQ ID NO: 4857830 - DNA, 14 bp, Homo sapiens
tatcttctttggac

SEQ ID NO: 4857831 - DNA, 18 bp, Homo sapiens
tatcttttttagtgttaa

SEQ ID NO: 4857832 - DNA, 21 bp, Homo sapiens
tatgacaagctgtatcactgc

SEQ ID NO: 4857833 - DNA, 14 bp, Homo sapiens
tatgagattggttt

SEQ ID NO: 4857834 - DNA, 14 bp, Homo sapiens
tatgagtagccagg

SEQ ID NO: 4857835 - DNA, 20 bp, Homo sapiens
tatgcagaaatagacaaaaa

SEQ ID NO: 4857836 - DNA, 19 bp, Homo sapiens
tatgccattggggtagttg

SEQ ID NO: 4857837 - DNA, 14 bp, Homo sapiens
tatgccttgtataa

SEQ ID NO: 4857838 - DNA, 11 bp, Homo sapiens
tatgctcaggt

SEQ ID NO: 4857839 - DNA, 15 bp, Homo sapiens
tatggcatgactctt

SEQ ID NO: 4857840 - DNA, 15 bp, Homo sapiens
tatggtaggaccctc

SEQ ID NO: 4857841 - DNA, 21 bp, Homo sapiens
tatggtatttattttttcttt

SEQ ID NO: 4857842 - DNA, 20 bp, Homo sapiens
tatgtgcacatctgttttgt

SEQ ID NO: 4857843 - DNA, 19 bp, Homo sapiens
tatgtgctatacacacaca

SEQ ID NO: 4857844 - DNA, 19 bp, Homo sapiens
tatgtgggatattgaatgt

SEQ ID NO: 4857845 - DNA, 18 bp, Homo sapiens
tatgttgtttataataaa

SEQ ID NO: 4857846 - DNA, 22 bp, Homo sapiens
tattaaaaaacaattaactgcc

SEQ ID NO: 4857847 - DNA, 18 bp, Homo sapiens
tattaaaaaacttcatgt

SEQ ID NO: 4857848 - DNA, 17 bp, Homo sapiens
tattaaaatatttcagg

SEQ ID NO: 4857849 - DNA, 19 bp, Homo sapiens
tattaaacaaagtttcaga

SEQ ID NO: 4857850 - DNA, 23 bp, Homo sapiens
tattaaataacatgtttctctat

SEQ ID NO: 4857851 - DNA, 23 bp, Homo sapiens
tattaaatgcttcatttgtatgt

SEQ ID NO: 4857852 - DNA, 19 bp, Homo sapiens
tattaagctttttggaatc

SEQ ID NO: 4857853 - DNA, 17 bp, Homo sapiens
tattaatgttttcaaaa

SEQ ID NO: 4857854 - DNA, 18 bp, Homo sapiens
tattaatgttttcaaaag

SEQ ID NO: 4857855 - DNA, 17 bp, Homo sapiens
tattactgacatttctt

SEQ ID NO: 4857856 - DNA, 21 bp, Homo sapiens
tattatacatgtgatacattt

SEQ ID NO: 4857857 - DNA, 22 bp, Homo sapiens
tctatactgtggcctgcaggag

SEQ ID NO: 4857858 - DNA, 16 bp, Homo sapiens
tctatattcctccagc

SEQ ID NO: 4857859 - DNA, 18 bp, Homo sapiens
tctatattcctccagctg

SEQ ID NO: 4857860 - DNA, 12 bp, Homo sapiens
tctatgtttata

SEQ ID NO: 4857861 - DNA, 16 bp, Homo sapiens
tctattatttttataa

SEQ ID NO: 4857862 - DNA, 13 bp, Homo sapiens
tctatttatttat

SEQ ID NO: 4857863 - DNA, 14 bp, Homo sapiens
tctatttatttatt

SEQ ID NO: 4857864 - DNA, 22 bp, Homo sapiens
tctcaaataggctattaaaaaa

SEQ ID NO: 4857865 - DNA, 14 bp, Homo sapiens
tctcacaagccagc

SEQ ID NO: 4857866 - DNA, 12 bp, Homo sapiens
tctcaccctctg

SEQ ID NO: 4857867 - DNA, 19 bp, Homo sapiens
tctcagggatggagggaag

SEQ ID NO: 4857868 - DNA, 21 bp, Homo sapiens
tctcaggtttgttttgtgaat

SEQ ID NO: 4857869 - DNA, 13 bp, Homo sapiens
tctcagtgttggt

SEQ ID NO: 4857870 - DNA, 14 bp, Homo sapiens
tctcagtgttggta

SEQ ID NO: 4857871 - DNA, 14 bp, Homo sapiens
tctcatacataaaa

SEQ ID NO: 4857872 - DNA, 17 bp, Homo sapiens
tctcataggttaaaaaa

SEQ ID NO: 4857873 - DNA, 14 bp, Homo sapiens
tctcatcttgcctc

SEQ ID NO: 4857874 - DNA, 22 bp, Homo sapiens
tctcattgacttttataaagca

SEQ ID NO: 4857875 - DNA, 14 bp, Homo sapiens
tctccactggaccc

SEQ ID NO: 4857876 - DNA, 13 bp, Homo sapiens
tctccatggagcc

SEQ ID NO: 4857877 - DNA, 15 bp, Homo sapiens
tctccatggagccta

SEQ ID NO: 4857878 - DNA, 20 bp, Homo sapiens
tctccatggagcctacctct

SEQ ID NO: 4857879 - DNA, 12 bp, Homo sapiens
tctcccagctct

SEQ ID NO: 4857880 - DNA, 13 bp, Homo sapiens
tctcccctgccct

SEQ ID NO: 4857881 - DNA, 22 bp, Homo sapiens
tctcccctgcccttcctcctga

SEQ ID NO: 4857882 - DNA, 16 bp, Homo sapiens
tctccctagctcctcc

SEQ ID NO: 4857883 - DNA, 16 bp, Homo sapiens
tctcctcagggtgggg

SEQ ID NO: 4857884 - DNA, 17 bp, Homo sapiens
tctcctcagggtggggg

SEQ ID NO: 4857885 - DNA, 13 bp, Homo sapiens
tctcctgccctct

SEQ ID NO: 4857886 - DNA, 14 bp, Homo sapiens
tctcctgccctctg

SEQ ID NO: 4857887 - DNA, 20 bp, Homo sapiens
tctcctgccctctgctctgc

SEQ ID NO: 4857888 - DNA, 18 bp, Homo sapiens
tctcggctgccaggggct

SEQ ID NO: 4857889 - DNA, 23 bp, Homo sapiens
tctcggctgccaggggctctgtg

SEQ ID NO: 4857890 - DNA, 16 bp, Homo sapiens
tctctatagcaccagg

SEQ ID NO: 4857891 - DNA, 13 bp, Homo sapiens
tctctcagggatg

SEQ ID NO: 4857892 - DNA, 11 bp, Homo sapiens
tctctccagga

SEQ ID NO: 4857893 - DNA, 18 bp, Homo sapiens
tctctccaggagggctcg

SEQ ID NO: 4857894 - DNA, 15 bp, Homo sapiens
tctctctttcctcca

SEQ ID NO: 4857895 - DNA, 20 bp, Homo sapiens
tctctgcatttaaaaaaatc

SEQ ID NO: 4857896 - DNA, 22 bp, Homo sapiens
tctctgccagttacttgggctt

SEQ ID NO: 4857897 - DNA, 16 bp, Homo sapiens
tctcttcggtggcctt

SEQ ID NO: 4857898 - DNA, 23 bp, Homo sapiens
tctgaaaagtgtgtatatatttt

SEQ ID NO: 4857899 - DNA, 15 bp, Homo sapiens
tctgaaaggccagca

SEQ ID NO: 4857900 - DNA, 21 bp, Homo sapiens
tctgaaaggccagcagctgat

SEQ ID NO: 4857901 - DNA, 19 bp, Homo sapiens
tctgaagtatgaagtctga

SEQ ID NO: 4857902 - DNA, 13 bp, Homo sapiens
tctgaccccaagg

SEQ ID NO: 4857903 - DNA, 12 bp, Homo sapiens
tctgactccaaa

SEQ ID NO: 4857904 - DNA, 16 bp, Homo sapiens
tctgactccaaagctg

SEQ ID NO: 4857905 - DNA, 15 bp, Homo sapiens
tctgaggccagaaag

SEQ ID NO: 4857906 - DNA, 16 bp, Homo sapiens
tctgaggccagaaagg

SEQ ID NO: 4857907 - DNA, 14 bp, Homo sapiens
tctgatcggccagt

SEQ ID NO: 4857908 - DNA, 19 bp, Homo sapiens
tctgattctggctttaagc

SEQ ID NO: 4857909 - DNA, 23 bp, Homo sapiens
tctgattctggctttaagccttc

SEQ ID NO: 4857910 - DNA, 18 bp, Homo sapiens
tctgcacccgcctcgacc

SEQ ID NO: 4857911 - DNA, 16 bp, Homo sapiens
tctgcagtcagactga

SEQ ID NO: 4857912 - DNA, 19 bp, Homo sapiens
tctgccaaaggatgtgata

SEQ ID NO: 4857913 - DNA, 14 bp, Homo sapiens
tctgccaatctgta

SEQ ID NO: 4857914 - DNA, 18 bp, Homo sapiens
tctgccagttacttgggc

SEQ ID NO: 4857915 - DNA, 23 bp, Homo sapiens
tctgcctggggcctccagaagct

SEQ ID NO: 4857916 - DNA, 20 bp, Homo sapiens
tctgctaggcgctggggaga

SEQ ID NO: 4857917 - DNA, 20 bp, Homo sapiens
tctgctatttttaatttcct

SEQ ID NO: 4857918 - DNA, 13 bp, Homo sapiens
tctgctctgcctg

SEQ ID NO: 4857919 - DNA, 16 bp, Homo sapiens
tctggatgtctggctc

SEQ ID NO: 4857920 - DNA, 16 bp, Homo sapiens
tctggattcatattta

SEQ ID NO: 4857921 - DNA, 12 bp, Homo sapiens
tctggcagatga

SEQ ID NO: 4857922 - DNA, 18 bp, Homo sapiens
tctgggacccacagaact

SEQ ID NO: 4857923 - DNA, 19 bp, Homo sapiens
tctgggacccacagaactt

SEQ ID NO: 4857924 - DNA, 20 bp, Homo sapiens
tctgggggtggacatctgac

SEQ ID NO: 4857925 - DNA, 21 bp, Homo sapiens
tctggtaatattgacttgtat

SEQ ID NO: 4857926 - DNA, 20 bp, Homo sapiens
tctggtcaagggctgtcatt

SEQ ID NO: 4857927 - DNA, 21 bp, Homo sapiens
tctggttgctaatgacagcct

SEQ ID NO: 4857928 - DNA, 12 bp, Homo sapiens
tctgtaataata

SEQ ID NO: 4857929 - DNA, 15 bp, Homo sapiens
tctgtaataatagac

SEQ ID NO: 4857930 - DNA, 13 bp, Homo sapiens
tctgtatttcctt

SEQ ID NO: 4857931 - DNA, 16 bp, Homo sapiens
tctgtccgtgcccctt

SEQ ID NO: 4857932 - DNA, 17 bp, Homo sapiens
tctgtccttcccccagc

SEQ ID NO: 4857933 - DNA, 19 bp, Homo sapiens
tctgtccttcccccagcac

SEQ ID NO: 4857934 - DNA, 12 bp, Homo sapiens
tctgtctgggga

SEQ ID NO: 4857935 - DNA, 14 bp, Homo sapiens
tctgtgcctttcta

SEQ ID NO: 4857936 - DNA, 21 bp, Homo sapiens
tctgtgtaaccagctcagtgt

SEQ ID NO: 4857937 - DNA, 23 bp, Homo sapiens
tctgtgtaaccagctcagtgttt

SEQ ID NO: 4857938 - DNA, 20 bp, Homo sapiens
tctgttagcagagtctgtct

SEQ ID NO: 4857939 - DNA, 18 bp, Homo sapiens
tctgttcccccaccctcc

SEQ ID NO: 4857940 - DNA, 18 bp, Homo sapiens
tctgtttaattttcactt

SEQ ID NO: 4857941 - DNA, 15 bp, Homo sapiens
tcttaaaacaaagcc

SEQ ID NO: 4857942 - DNA, 12 bp, Homo sapiens
tcttaaactaaa

SEQ ID NO: 4857943 - DNA, 17 bp, Homo sapiens
tcttactaaaaagtata

SEQ ID NO: 4857944 - DNA, 16 bp, Homo sapiens
tcttcactcaaatttt

SEQ ID NO: 4857945 - DNA, 15 bp, Homo sapiens
tcttccacccacaaa

SEQ ID NO: 4857946 - DNA, 14 bp, Homo sapiens
tcttcccactccag

SEQ ID NO: 4857947 - DNA, 17 bp, Homo sapiens
tcttcccatgcattctg

SEQ ID NO: 4857948 - DNA, 20 bp, Homo sapiens
tcttcctaattgtgccccta

SEQ ID NO: 4857949 - DNA, 17 bp, Homo sapiens
tcttcctcctcccaagg

SEQ ID NO: 4857950 - DNA, 14 bp, Homo sapiens
tcttcctggcacaa

SEQ ID NO: 4857951 - DNA, 19 bp, Homo sapiens
tcttctagtgatgatggtt

SEQ ID NO: 4857952 - DNA, 12 bp, Homo sapiens
tcttctatttat

SEQ ID NO: 4857953 - DNA, 22 bp, Homo sapiens
tcttctatttatttatttattc

SEQ ID NO: 4857954 - DNA, 20 bp, Homo sapiens
tcttctctctcaattttatc

SEQ ID NO: 4857955 - DNA, 13 bp, Homo sapiens
tcttctgcctccc

SEQ ID NO: 4857956 - DNA, 17 bp, Homo sapiens
tcttctttctccatgga

SEQ ID NO: 4857957 - DNA, 14 bp, Homo sapiens
tcttctttcttcca

SEQ ID NO: 4857958 - DNA, 18 bp, Homo sapiens
tcttgaaacctgatgtca

SEQ ID NO: 4857959 - DNA, 14 bp, Homo sapiens
tcttgaatataaaa

SEQ ID NO: 4857960 - DNA, 20 bp, Homo sapiens
tcttggaagctgtttggaaa

SEQ ID NO: 4857961 - DNA, 14 bp, Homo sapiens
tcttgggggtcagg

SEQ ID NO: 4857962 - DNA, 21 bp, Homo sapiens
tcttgggggtcaggggggaga

SEQ ID NO: 4857963 - DNA, 15 bp, Homo sapiens
tcttgttcaggaaaa

SEQ ID NO: 4857964 - DNA, 23 bp, Homo sapiens
tcttgtttacgatttcactagga

SEQ ID NO: 4857965 - DNA, 20 bp, Homo sapiens
tctttaactgccgtaattta

SEQ ID NO: 4857966 - DNA, 22 bp, Homo sapiens
tctttaactgccgtaatttaac

SEQ ID NO: 4857967 - DNA, 16 bp, Homo sapiens
tctttagcttacctgg

SEQ ID NO: 4857968 - DNA, 22 bp, Homo sapiens
tctttagtttttggttgggaat

SEQ ID NO: 4857969 - DNA, 15 bp, Homo sapiens
tctttcacccatcct

SEQ ID NO: 4857970 - DNA, 24 bp, Homo sapiens
tctttctgctctatactgtggcct

SEQ ID NO: 4857971 - DNA, 16 bp, Homo sapiens
tctttgaatatgtagt

SEQ ID NO: 4857972 - DNA, 18 bp, Homo sapiens
tctttgcgtttccttttt

SEQ ID NO: 4857973 - DNA, 17 bp, Homo sapiens
tctttggacttctgaag

SEQ ID NO: 4857974 - DNA, 15 bp, Homo sapiens
tctttggattctaaa

SEQ ID NO: 4857975 - DNA, 16 bp, Homo sapiens
tctttggattctaaat

SEQ ID NO: 4857976 - DNA, 17 bp, Homo sapiens
tctttgtaccaaaattt

SEQ ID NO: 4857977 - DNA, 22 bp, Homo sapiens
tcttttaatccatttcaggact

SEQ ID NO: 4857978 - DNA, 13 bp, Homo sapiens
tgcccctaaagag

SEQ ID NO: 4857979 - DNA, 22 bp, Homo sapiens
tgcccctaaagagcatcctgat

SEQ ID NO: 4857980 - DNA, 13 bp, Homo sapiens
tgcccctgttcat

SEQ ID NO: 4857981 - DNA, 14 bp, Homo sapiens
tgccccttccctgg

SEQ ID NO: 4857982 - DNA, 21 bp, Homo sapiens
tgccctccgaagagagttctg

SEQ ID NO: 4857983 - DNA, 15 bp, Homo sapiens
tgccctctgctctgc

SEQ ID NO: 4857984 - DNA, 19 bp, Homo sapiens
tgccctctgctctgcctgg

SEQ ID NO: 4857985 - DNA, 21 bp, Homo sapiens
tgccctctgctctgcctggag

SEQ ID NO: 4857986 - DNA, 13 bp, Homo sapiens
tgccctgccagct

SEQ ID NO: 4857987 - DNA, 17 bp, Homo sapiens
tgccctgccagctgcag

SEQ ID NO: 4857988 - DNA, 19 bp, Homo sapiens
tgccctgcggccccgtctg

SEQ ID NO: 4857989 - DNA, 15 bp, Homo sapiens
tgcccttcctcctga

SEQ ID NO: 4857990 - DNA, 13 bp, Homo sapiens
tgccctttcctgg

SEQ ID NO: 4857991 - DNA, 14 bp, Homo sapiens
tgccctttcctggc

SEQ ID NO: 4857992 - DNA, 14 bp, Homo sapiens
tgccgtaatttaac

SEQ ID NO: 4857993 - DNA, 16 bp, Homo sapiens
tgcctaacctgggacc

SEQ ID NO: 4857994 - DNA, 20 bp, Homo sapiens
tgcctcattttgcttcccat

SEQ ID NO: 4857995 - DNA, 22 bp, Homo sapiens
tgcctcccaaggtcctctcagt

SEQ ID NO: 4857996 - DNA, 21 bp, Homo sapiens
tgcctctgccaaaggatgtga

SEQ ID NO: 4857997 - DNA, 17 bp, Homo sapiens
tgcctcttgcagggtct

SEQ ID NO: 4857998 - DNA, 16 bp, Homo sapiens
tgcctgatttcattcc

SEQ ID NO: 4857999 - DNA, 17 bp, Homo sapiens
tgcctgatttcattcct

SEQ ID NO: 4858000 - DNA, 15 bp, Homo sapiens
tgcctgccaccttca

SEQ ID NO: 4858001 - DNA, 15 bp, Homo sapiens
tgcctgctttttgga

SEQ ID NO: 4858002 - DNA, 17 bp, Homo sapiens
tgcctgctttttggaaa

SEQ ID NO: 4858003 - DNA, 15 bp, Homo sapiens
tgcctgggctcagcc

SEQ ID NO: 4858004 - DNA, 22 bp, Homo sapiens
tgcctggggcctccagaagctg

SEQ ID NO: 4858005 - DNA, 21 bp, Homo sapiens
tgcctgtgagcatggggccag

SEQ ID NO: 4858006 - DNA, 21 bp, Homo sapiens
tgcctttgcagttggactctc

SEQ ID NO: 4858007 - DNA, 23 bp, Homo sapiens
tgctaaaaatgagcttgattaaa

SEQ ID NO: 4858008 - DNA, 15 bp, Homo sapiens
tgctaaatgtgtaat

SEQ ID NO: 4858009 - DNA, 13 bp, Homo sapiens
tgctaacatctaa

SEQ ID NO: 4858010 - DNA, 16 bp, Homo sapiens
tgctaatgacagcctt

SEQ ID NO: 4858011 - DNA, 19 bp, Homo sapiens
tgctacttcccactgtatg

SEQ ID NO: 4858012 - DNA, 22 bp, Homo sapiens
tgctagatccagcccaaacctg

SEQ ID NO: 4858013 - DNA, 19 bp, Homo sapiens
tgctaggcgctggggagac

SEQ ID NO: 4858014 - DNA, 18 bp, Homo sapiens
tgctataatctgttttta

SEQ ID NO: 4858015 - DNA, 15 bp, Homo sapiens
tgctatacacacaca

SEQ ID NO: 4858016 - DNA, 17 bp, Homo sapiens
tgctatcggcagatgat

SEQ ID NO: 4858017 - DNA, 20 bp, Homo sapiens
tgctatcggcagatgatgct

SEQ ID NO: 4858018 - DNA, 23 bp, Homo sapiens
tgctatcggcagatgatgctttg

SEQ ID NO: 4858019 - DNA, 22 bp, Homo sapiens
tgctatcttttttagtgttaaa

SEQ ID NO: 4858020 - DNA, 20 bp, Homo sapiens
tgctcaactctacccctgct

SEQ ID NO: 4858021 - DNA, 21 bp, Homo sapiens
tgctcactcccaagggacagc

SEQ ID NO: 4858022 - DNA, 17 bp, Homo sapiens
tgctccaatgactgagc

SEQ ID NO: 4858023 - DNA, 18 bp, Homo sapiens
tgctccaatgactgagca

SEQ ID NO: 4858024 - DNA, 18 bp, Homo sapiens
tgctcccattcctccctc

SEQ ID NO: 4858025 - DNA, 19 bp, Homo sapiens
tgctcccattcctccctcc

SEQ ID NO: 4858026 - DNA, 12 bp, Homo sapiens
tgctcccctaaa

SEQ ID NO: 4858027 - DNA, 20 bp, Homo sapiens
tgctcccctaaagccaggct

SEQ ID NO: 4858028 - DNA, 14 bp, Homo sapiens
tgctcctctcttgg

SEQ ID NO: 4858029 - DNA, 19 bp, Homo sapiens
tgctcctcttgttcctgaa

SEQ ID NO: 4858030 - DNA, 12 bp, Homo sapiens
tgctcctgggca

SEQ ID NO: 4858031 - DNA, 22 bp, Homo sapiens
tgctcctgggcattagcaaggc

SEQ ID NO: 4858032 - DNA, 21 bp, Homo sapiens
tgctctatactgtggcctgca

SEQ ID NO: 4858033 - DNA, 22 bp, Homo sapiens
tgctctatactgtggcctgcag

SEQ ID NO: 4858034 - DNA, 14 bp, Homo sapiens
tgctctgcctggag

SEQ ID NO: 4858035 - DNA, 17 bp, Homo sapiens
tgctctgcctggagtgt

SEQ ID NO: 4858036 - DNA, 12 bp, Homo sapiens
tgctctggagca

SEQ ID NO: 4858037 - DNA, 13 bp, Homo sapiens
tgctctggagcag

SEQ ID NO: 4858038 - DNA, 14 bp, Homo sapiens
tgctctggagcagc

SEQ ID NO: 4858039 - DNA, 15 bp, Homo sapiens
tgctcttcccactcc

SEQ ID NO: 4858040 - DNA, 17 bp, Homo sapiens
tgctcttcccactccag

SEQ ID NO: 4858041 - DNA, 18 bp, Homo sapiens
tgctgaacaggaaagagc

SEQ ID NO: 4858042 - DNA, 19 bp, Homo sapiens
tgctgaacaggaaagagct

SEQ ID NO: 4858043 - DNA, 22 bp, Homo sapiens
tgctgaacataacttctcatgt

SEQ ID NO: 4858044 - DNA, 17 bp, Homo sapiens
tgctgagggtttgaata

SEQ ID NO: 4858045 - DNA, 20 bp, Homo sapiens
tgctgataccatatgaatga

SEQ ID NO: 4858046 - DNA, 12 bp, Homo sapiens
tgctgcaaccca

SEQ ID NO: 4858047 - DNA, 18 bp, Homo sapiens
tgctgcaaggtggcctct

SEQ ID NO: 4858048 - DNA, 13 bp, Homo sapiens
tgctgccctgcgg

SEQ ID NO: 4858049 - DNA, 22 bp, Homo sapiens
tgctgcctcaggacccatccct

SEQ ID NO: 4858050 - DNA, 23 bp, Homo sapiens
tgctgcctcaggacccatccctg

SEQ ID NO: 4858051 - DNA, 21 bp, Homo sapiens
tgctgctcccctaaagccagg

SEQ ID NO: 4858052 - DNA, 11 bp, Homo sapiens
tgctgctcctc

SEQ ID NO: 4858053 - DNA, 13 bp, Homo sapiens
tgctgctcctctc

SEQ ID NO: 4858054 - DNA, 18 bp, Homo sapiens
tgctgctcctctcttggg

SEQ ID NO: 4858055 - DNA, 13 bp, Homo sapiens
tgctgctgtggag

SEQ ID NO: 4858056 - DNA, 22 bp, Homo sapiens
tgctgcttttgggggtcagcat

SEQ ID NO: 4858057 - DNA, 13 bp, Homo sapiens
tgctgggctttgg

SEQ ID NO: 4858058 - DNA, 13 bp, Homo sapiens
tgctggtgaacac

SEQ ID NO: 4858059 - DNA, 18 bp, Homo sapiens
tgctggtgaacactgtga

SEQ ID NO: 4858060 - DNA, 19 bp, Homo sapiens
tgctggtgaacactgtgac

SEQ ID NO: 4858061 - DNA, 17 bp, Homo sapiens
tgctgtctaacctgtga

SEQ ID NO: 4858062 - DNA, 13 bp, Homo sapiens
tgctgtcttaaac

SEQ ID NO: 4858063 - DNA, 14 bp, Homo sapiens
tgctgtcttaaact

SEQ ID NO: 4858064 - DNA, 16 bp, Homo sapiens
tgctgtgctttggaac

SEQ ID NO: 4858065 - DNA, 15 bp, Homo sapiens
tgctgtggagtgagg

SEQ ID NO: 4858066 - DNA, 18 bp, Homo sapiens
tgctgttgaactttttaa

SEQ ID NO: 4858067 - DNA, 14 bp, Homo sapiens
tgcttaaaccactt

SEQ ID NO: 4858068 - DNA, 14 bp, Homo sapiens
tgcttaatcttcaa

SEQ ID NO: 4858069 - DNA, 16 bp, Homo sapiens
tgcttaatcttcaaag

SEQ ID NO: 4858070 - DNA, 20 bp, Homo sapiens
tgcttaatcttcaaagcctt

SEQ ID NO: 4858071 - DNA, 23 bp, Homo sapiens
tgcttataacctagttaaagaaa

SEQ ID NO: 4858072 - DNA, 19 bp, Homo sapiens
tgcttcccatctgaagagt

SEQ ID NO: 4858073 - DNA, 14 bp, Homo sapiens
tgcttcctgatgct

SEQ ID NO: 4858074 - DNA, 13 bp, Homo sapiens
tgcttccttctca

SEQ ID NO: 4858075 - DNA, 16 bp, Homo sapiens
tgcttctgtatttcct

SEQ ID NO: 4858076 - DNA, 20 bp, Homo sapiens
tgcttctgtatttccttgga

SEQ ID NO: 4858077 - DNA, 14 bp, Homo sapiens
tgcttgactttcca

SEQ ID NO: 4858078 - DNA, 15 bp, Homo sapiens
tgcttgactttccag

SEQ ID NO: 4858079 - DNA, 19 bp, Homo sapiens
tgcttgcatggagaatggg

SEQ ID NO: 4858080 - DNA, 15 bp, Homo sapiens
tgcttgccaaagtac

SEQ ID NO: 4858081 - DNA, 18 bp, Homo sapiens
tgcttgcggcaaaaggaa

SEQ ID NO: 4858082 - DNA, 12 bp, Homo sapiens
tgcttggccctt

SEQ ID NO: 4858083 - DNA, 15 bp, Homo sapiens
tgctttcctgcagca

SEQ ID NO: 4858084 - DNA, 15 bp, Homo sapiens
tgctttgcattttga

SEQ ID NO: 4858085 - DNA, 19 bp, Homo sapiens
tgctttggaacaatcacag

SEQ ID NO: 4858086 - DNA, 19 bp, Homo sapiens
tgcttttgggggtcagcat

SEQ ID NO: 4858087 - DNA, 19 bp, Homo sapiens
tgcttttttccaaaacaaa

SEQ ID NO: 4858088 - DNA, 12 bp, Homo sapiens
tggaaagtcaga

SEQ ID NO: 4858089 - DNA, 13 bp, Homo sapiens
tggaaagtcagaa

SEQ ID NO: 4858090 - DNA, 17 bp, Homo sapiens
tggaaataaactgtgca

SEQ ID NO: 4858091 - DNA, 13 bp, Homo sapiens
tggaaattcctgt

SEQ ID NO: 4858092 - DNA, 14 bp, Homo sapiens
tggaaattcctgta

SEQ ID NO: 4858093 - DNA, 18 bp, Homo sapiens
tggaagctgtttggaaaa

SEQ ID NO: 4858094 - DNA, 15 bp, Homo sapiens
tggaaggcagagaaa

SEQ ID NO: 4858095 - DNA, 18 bp, Homo sapiens
tggaaggcagagaaatct

SEQ ID NO: 4858096 - DNA, 23 bp, Homo sapiens
tggaagtacttggcccccttcag

SEQ ID NO: 4858097 - DNA, 22 bp, Homo sapiens
tggaagtatgtatattaaaaaa

SEQ ID NO: 4858098 - DNA, 19 bp, Homo sapiens
tggaagtgtgtgccaagag

SEQ ID NO: 4858099 - DNA, 16 bp, Homo sapiens
tgtccaaaatttatat

SEQ ID NO: 4858100 - DNA, 21 bp, Homo sapiens
tgtccaaacgtcctctttagt

SEQ ID NO: 4858101 - DNA, 12 bp, Homo sapiens
tgtccaggaagt

SEQ ID NO: 4858102 - DNA, 17 bp, Homo sapiens
tgtcccacatggccatc

SEQ ID NO: 4858103 - DNA, 16 bp, Homo sapiens
tgtcccaccttgacca

SEQ ID NO: 4858104 - DNA, 18 bp, Homo sapiens
tgtccctagggctctcca

SEQ ID NO: 4858105 - DNA, 13 bp, Homo sapiens
tgtccgtgcccct

SEQ ID NO: 4858106 - DNA, 14 bp, Homo sapiens
tgtccgtgcccctt

SEQ ID NO: 4858107 - DNA, 15 bp, Homo sapiens
tgtcctattatattc

SEQ ID NO: 4858108 - DNA, 12 bp, Homo sapiens
tgtccttccccc

SEQ ID NO: 4858109 - DNA, 15 bp, Homo sapiens
tgtccttcccccagc

SEQ ID NO: 4858110 - DNA, 16 bp, Homo sapiens
tgtccttcccccagca

SEQ ID NO: 4858111 - DNA, 23 bp, Homo sapiens
tgtctaggcactgagcagggatc

SEQ ID NO: 4858112 - DNA, 19 bp, Homo sapiens
tgtctaggtctcctcaggg

SEQ ID NO: 4858113 - DNA, 19 bp, Homo sapiens
tgtctagtgaggaagacaa

SEQ ID NO: 4858114 - DNA, 17 bp, Homo sapiens
tgtctccttaagctgca

SEQ ID NO: 4858115 - DNA, 23 bp, Homo sapiens
tgtctctcttcggtggccttgag

SEQ ID NO: 4858116 - DNA, 13 bp, Homo sapiens
tgtctgagacagg

SEQ ID NO: 4858117 - DNA, 18 bp, Homo sapiens
tgtctgagacaggtgcct

SEQ ID NO: 4858118 - DNA, 14 bp, Homo sapiens
tgtctggcagatga

SEQ ID NO: 4858119 - DNA, 20 bp, Homo sapiens
tgtctgtgttttgaaagaat

SEQ ID NO: 4858120 - DNA, 18 bp, Homo sapiens
tgtcttaaactaaatgtg

SEQ ID NO: 4858121 - DNA, 20 bp, Homo sapiens
tgtcttaaactaaatgtgca

SEQ ID NO: 4858122 - DNA, 12 bp, Homo sapiens
tgtcttattgca

SEQ ID NO: 4858123 - DNA, 15 bp, Homo sapiens
tgtcttctttctcca

SEQ ID NO: 4858124 - DNA, 21 bp, Homo sapiens
tgtctttttattaaaatattt

SEQ ID NO: 4858125 - DNA, 13 bp, Homo sapiens
tgtgaaattgcat

SEQ ID NO: 4858126 - DNA, 20 bp, Homo sapiens
tgtgaagcaaactctaaaat

SEQ ID NO: 4858127 - DNA, 15 bp, Homo sapiens
tgtgaagtttggaga

SEQ ID NO: 4858128 - DNA, 21 bp, Homo sapiens
tgtgaatacctgctcacgtca

SEQ ID NO: 4858129 - DNA, 17 bp, Homo sapiens
tgtgaatttgccagagg

SEQ ID NO: 4858130 - DNA, 21 bp, Homo sapiens
tgtgaatttgccagaggacca

SEQ ID NO: 4858131 - DNA, 22 bp, Homo sapiens
tgtgaccagaaagcttcatcca

SEQ ID NO: 4858132 - DNA, 15 bp, Homo sapiens
tgtgaccctgggcag

SEQ ID NO: 4858133 - DNA, 21 bp, Homo sapiens
tgtgactgaagaagatgagcc

SEQ ID NO: 4858134 - DNA, 20 bp, Homo sapiens
tgtgacttctcccctgccct

SEQ ID NO: 4858135 - DNA, 11 bp, Homo sapiens
tgtgagaatgg

SEQ ID NO: 4858136 - DNA, 19 bp, Homo sapiens
tgtgagaatggcctggagc

SEQ ID NO: 4858137 - DNA, 14 bp, Homo sapiens
tgtgagatactgtg

SEQ ID NO: 4858138 - DNA, 19 bp, Homo sapiens
tgtgagcacaaagaagaaa

SEQ ID NO: 4858139 - DNA, 14 bp, Homo sapiens
tgtgagccttgcat

SEQ ID NO: 4858140 - DNA, 15 bp, Homo sapiens
tgtgagctcttccta

SEQ ID NO: 4858141 - DNA, 16 bp, Homo sapiens
tgtgagtctgggatat

SEQ ID NO: 4858142 - DNA, 15 bp, Homo sapiens
tgtgattactgcaat

SEQ ID NO: 4858143 - DNA, 13 bp, Homo sapiens
tgtgcaatagaag

SEQ ID NO: 4858144 - DNA, 13 bp, Homo sapiens
tgtgcagacagcc

SEQ ID NO: 4858145 - DNA, 16 bp, Homo sapiens
tgtgcagacagccatg

SEQ ID NO: 4858146 - DNA, 17 bp, Homo sapiens
tgtgcctaatgtgtttg

SEQ ID NO: 4858147 - DNA, 18 bp, Homo sapiens
tgtgcctaatgtgtttga

SEQ ID NO: 4858148 - DNA, 15 bp, Homo sapiens
tgtgccttccctttc

SEQ ID NO: 4858149 - DNA, 17 bp, Homo sapiens
tgtgctatacacacaca

SEQ ID NO: 4858150 - DNA, 15 bp, Homo sapiens
tgtgctcagagacac

SEQ ID NO: 4858151 - DNA, 20 bp, Homo sapiens
tgtgctccacactcagaaaa

SEQ ID NO: 4858152 - DNA, 19 bp, Homo sapiens
tgtgctgaacataacttct

SEQ ID NO: 4858153 - DNA, 16 bp, Homo sapiens
tgtgctggtgaacact

SEQ ID NO: 4858154 - DNA, 14 bp, Homo sapiens
tgtggattctttaa

SEQ ID NO: 4858155 - DNA, 23 bp, Homo sapiens
tgtggcaaaaagagtcagacatt

SEQ ID NO: 4858156 - DNA, 14 bp, Homo sapiens
tgtggcctgcagga

SEQ ID NO: 4858157 - DNA, 17 bp, Homo sapiens
tgtgggatattgaatgt

SEQ ID NO: 4858158 - DNA, 23 bp, Homo sapiens
tgtgggcaagcagatgacagagg

SEQ ID NO: 4858159 - DNA, 22 bp, Homo sapiens
tgtggtcaacatttctcatgtt

SEQ ID NO: 4858160 - DNA, 20 bp, Homo sapiens
tgtggtcatgtgagtctggg

SEQ ID NO: 4858161 - DNA, 13 bp, Homo sapiens
tgtggtttggaat

SEQ ID NO: 4858162 - DNA, 19 bp, Homo sapiens
tgtgtaataatgtaacatg

SEQ ID NO: 4858163 - DNA, 21 bp, Homo sapiens
tgtgtaataatgtaacatgat

SEQ ID NO: 4858164 - DNA, 22 bp, Homo sapiens
tgtgtcatgaagaatgtttctg

SEQ ID NO: 4858165 - DNA, 18 bp, Homo sapiens
tgtgtcatttctatattc

SEQ ID NO: 4858166 - DNA, 16 bp, Homo sapiens
tgtgtgccaagagcta

SEQ ID NO: 4858167 - DNA, 12 bp, Homo sapiens
tgtgtggaattt

SEQ ID NO: 4858168 - DNA, 12 bp, Homo sapiens
tgtgtttatatg

SEQ ID NO: 4858169 - DNA, 16 bp, Homo sapiens
tgtgtttatgtaactt

SEQ ID NO: 4858170 - DNA, 16 bp, Homo sapiens
tgttaaagagaatgag

SEQ ID NO: 4858171 - DNA, 17 bp, Homo sapiens
tgttagcagagtctgtc

SEQ ID NO: 4858172 - DNA, 18 bp, Homo sapiens
tgttagcagagtctgtct

SEQ ID NO: 4858173 - DNA, 17 bp, Homo sapiens
tgttatttattgaaatg

SEQ ID NO: 4858174 - DNA, 19 bp, Homo sapiens
tgttatttattgaaatgat

SEQ ID NO: 4858175 - DNA, 15 bp, Homo sapiens
tgttcccaaaacaat

SEQ ID NO: 4858176 - DNA, 16 bp, Homo sapiens
tgttcccaaggcccca

SEQ ID NO: 4858177 - DNA, 19 bp, Homo sapiens
tgttcctactcacacttca

SEQ ID NO: 4858178 - DNA, 13 bp, Homo sapiens
tgttcctgaaatg

SEQ ID NO: 4858179 - DNA, 19 bp, Homo sapiens
tgttctccattttcaagct

SEQ ID NO: 4858180 - DNA, 24 bp, Homo sapiens
tgttctttcacccatcctaggaac

SEQ ID NO: 4858181 - DNA, 13 bp, Homo sapiens
tgttgagttatga

SEQ ID NO: 4858182 - DNA, 16 bp, Homo sapiens
tgttgagttatgataa

SEQ ID NO: 4858183 - DNA, 20 bp, Homo sapiens
tgttgcactaaaatgaggat

SEQ ID NO: 4858184 - DNA, 11 bp, Homo sapiens
tgttgcacttt

SEQ ID NO: 4858185 - DNA, 24 bp, Homo sapiens
tgttgcacttttgaatgtccaaaa

SEQ ID NO: 4858186 - DNA, 20 bp, Homo sapiens
tgttgcagccgcagagaaat

SEQ ID NO: 4858187 - DNA, 15 bp, Homo sapiens
tgttgcctcttgcaa

SEQ ID NO: 4858188 - DNA, 22 bp, Homo sapiens
tgttggagcagcaggcctctgg

SEQ ID NO: 4858189 - DNA, 14 bp, Homo sapiens
tgttggagtgagga

SEQ ID NO: 4858190 - DNA, 14 bp, Homo sapiens
tgttgtgagaatgg

SEQ ID NO: 4858191 - DNA, 13 bp, Homo sapiens
tgtttaaaatgta

SEQ ID NO: 4858192 - DNA, 20 bp, Homo sapiens
tgtttaaaatgtaatttaaa

SEQ ID NO: 4858193 - DNA, 15 bp, Homo sapiens
tgtttacctttctct

SEQ ID NO: 4858194 - DNA, 16 bp, Homo sapiens
tgtttacgatttcact

SEQ ID NO: 4858195 - DNA, 20 bp, Homo sapiens
tgtttacgatttcactagga

SEQ ID NO: 4858196 - DNA, 22 bp, Homo sapiens
tgtttacgatttcactaggact

SEQ ID NO: 4858197 - DNA, 20 bp, Homo sapiens
tgtttagatgaatgtcagtt

SEQ ID NO: 4858198 - DNA, 15 bp, Homo sapiens
tgtttattaaatgct

SEQ ID NO: 4858199 - DNA, 20 bp, Homo sapiens
tgtttccctttcactggcat

SEQ ID NO: 4858200 - DNA, 15 bp, Homo sapiens
tgtttcttttgtttg

SEQ ID NO: 4858201 - DNA, 21 bp, Homo sapiens
tgtttcttttgtttggtaaat

SEQ ID NO: 4858202 - DNA, 16 bp, Homo sapiens
tgtttggaaaagacag

SEQ ID NO: 4858203 - DNA, 23 bp, Homo sapiens
tgtttgggaaaggcagggccctg

SEQ ID NO: 4858204 - DNA, 19 bp, Homo sapiens
tgttttaaaacgtgtaaat

SEQ ID NO: 4858205 - DNA, 20 bp, Homo sapiens
tgttttaaaacgtgtaaatg

SEQ ID NO: 4858206 - DNA, 22 bp, Homo sapiens
tgttttaaaacgtgtaaatgaa

SEQ ID NO: 4858207 - DNA, 19 bp, Homo sapiens
tgttttttaagatggcaat

SEQ ID NO: 4858208 - DNA, 16 bp, Homo sapiens
ttaaaaaaaaaagtca

SEQ ID NO: 4858209 - DNA, 21 bp, Homo sapiens
ttaaaaaaaaaagtcaccaaa

SEQ ID NO: 4858210 - DNA, 13 bp, Homo sapiens
ttaaaaaagagac

SEQ ID NO: 4858211 - DNA, 18 bp, Homo sapiens
ttaaaacgtgtaaatgaa

SEQ ID NO: 4858212 - DNA, 17 bp, Homo sapiens
ttaaaatgtaatttaaa

SEQ ID NO: 4858213 - DNA, 20 bp, Homo sapiens
ttaaaattttgtatgttaaa

SEQ ID NO: 4858214 - DNA, 15 bp, Homo sapiens
ttaaacgattagtga

SEQ ID NO: 4858215 - DNA, 22 bp, Homo sapiens
ttaaacgattagtgatgtcctt

SEQ ID NO: 4858216 - DNA, 20 bp, Homo sapiens
ttaaagaccctcctattcta

SEQ ID NO: 4858217 - DNA, 20 bp, Homo sapiens
ttaaagtatgcattattaaa

SEQ ID NO: 4858218 - DNA, 14 bp, Homo sapiens
ttaaagttcattgc

SEQ ID NO: 4858219 - DNA, 16 bp, Homo sapiens
ttgaaggtagaatgtt

SEQ ID NO: 4858220 - DNA, 17 bp, Homo sapiens
ttgaatataaaaaatca

SEQ ID NO: 4858221 - DNA, 23 bp, Homo sapiens
ttgaattaatatccctacatgta

SEQ ID NO: 4858222 - DNA, 20 bp, Homo sapiens
ttgaattatcagcaaagaaa

SEQ ID NO: 4858223 - DNA, 24 bp, Homo sapiens
ttgacatttatattaaataacatg

SEQ ID NO: 4858224 - DNA, 20 bp, Homo sapiens
ttgaccagtttaagccgcag

SEQ ID NO: 4858225 - DNA, 20 bp, Homo sapiens
ttgactaactcaaatacaca

SEQ ID NO: 4858226 - DNA, 22 bp, Homo sapiens
ttgactaactcaaatacacatt

SEQ ID NO: 4858227 - DNA, 18 bp, Homo sapiens
ttgactcttatttataga

SEQ ID NO: 4858228 - DNA, 18 bp, Homo sapiens
ttgacttttataaagcat

SEQ ID NO: 4858229 - DNA, 14 bp, Homo sapiens
ttgaggggaggtgg

SEQ ID NO: 4858230 - DNA, 22 bp, Homo sapiens
ttgaggggaggtggccagcccg

SEQ ID NO: 4858231 - DNA, 13 bp, Homo sapiens
ttgagtaatgtga

SEQ ID NO: 4858232 - DNA, 19 bp, Homo sapiens
ttgagtacctactgtgtgc

SEQ ID NO: 4858233 - DNA, 21 bp, Homo sapiens
ttgagtacctactgtgtgcca

SEQ ID NO: 4858234 - DNA, 16 bp, Homo sapiens
ttgagtctctgaattt

SEQ ID NO: 4858235 - DNA, 18 bp, Homo sapiens
ttgagttaacaggacagt

SEQ ID NO: 4858236 - DNA, 22 bp, Homo sapiens
ttgagttaacaggacagttgat

SEQ ID NO: 4858237 - DNA, 13 bp, Homo sapiens
ttgatactaccag

SEQ ID NO: 4858238 - DNA, 22 bp, Homo sapiens
ttgatactaccagggtctctca

SEQ ID NO: 4858239 - DNA, 23 bp, Homo sapiens
ttgatagggtctaccaatacaaa

SEQ ID NO: 4858240 - DNA, 13 bp, Homo sapiens
ttgatataccaaa

SEQ ID NO: 4858241 - DNA, 13 bp, Homo sapiens
ttgatatcccaag

SEQ ID NO: 4858242 - DNA, 19 bp, Homo sapiens
ttgatgaggacccagagct

SEQ ID NO: 4858243 - DNA, 12 bp, Homo sapiens
ttgatggagccc

SEQ ID NO: 4858244 - DNA, 22 bp, Homo sapiens
ttgattgggaaaacatttgctg

SEQ ID NO: 4858245 - DNA, 19 bp, Homo sapiens
ttgcaattaaacttccaaa

SEQ ID NO: 4858246 - DNA, 14 bp, Homo sapiens
ttgcactaaaatga

SEQ ID NO: 4858247 - DNA, 17 bp, Homo sapiens
ttgcactaaaatgagga

SEQ ID NO: 4858248 - DNA, 22 bp, Homo sapiens
ttgcactaaaatgaggatccag

SEQ ID NO: 4858249 - DNA, 14 bp, Homo sapiens
ttgcacttttgaat

SEQ ID NO: 4858250 - DNA, 16 bp, Homo sapiens
ttgcacttttgaatgt

SEQ ID NO: 4858251 - DNA, 17 bp, Homo sapiens
ttgcagccgcagagaaa

SEQ ID NO: 4858252 - DNA, 19 bp, Homo sapiens
ttgcagccgcagagaaatg

SEQ ID NO: 4858253 - DNA, 20 bp, Homo sapiens
ttgcagccgcagagaaatgc

SEQ ID NO: 4858254 - DNA, 14 bp, Homo sapiens
ttgcagttagactc

SEQ ID NO: 4858255 - DNA, 16 bp, Homo sapiens
ttgcatactttgtatt

SEQ ID NO: 4858256 - DNA, 17 bp, Homo sapiens
ttgcatactttgtattt

SEQ ID NO: 4858257 - DNA, 15 bp, Homo sapiens
ttgcatgcatgcaaa

SEQ ID NO: 4858258 - DNA, 15 bp, Homo sapiens
ttgcatggagaatgg

SEQ ID NO: 4858259 - DNA, 15 bp, Homo sapiens
ttgcattttgatatt

SEQ ID NO: 4858260 - DNA, 17 bp, Homo sapiens
ttgccaggacatgcaat

SEQ ID NO: 4858261 - DNA, 20 bp, Homo sapiens
ttgcccagtacatttaaatt

SEQ ID NO: 4858262 - DNA, 19 bp, Homo sapiens
ttgccctgcgtcccttctc

SEQ ID NO: 4858263 - DNA, 17 bp, Homo sapiens
ttgcctcatattgtcct

SEQ ID NO: 4858264 - DNA, 18 bp, Homo sapiens
ttgcctcattttgcttcc

SEQ ID NO: 4858265 - DNA, 23 bp, Homo sapiens
ttgcctccaggaccttgcttcct

SEQ ID NO: 4858266 - DNA, 20 bp, Homo sapiens
ttgcctctgtccgtgcccct

SEQ ID NO: 4858267 - DNA, 19 bp, Homo sapiens
ttgctactgttgtaagaat

SEQ ID NO: 4858268 - DNA, 14 bp, Homo sapiens
ttgctcccaaccca

SEQ ID NO: 4858269 - DNA, 17 bp, Homo sapiens
ttgctcccaacccattc

SEQ ID NO: 4858270 - DNA, 23 bp, Homo sapiens
ttgctgaacaggaaagagctagg

SEQ ID NO: 4858271 - DNA, 16 bp, Homo sapiens
ttgctgggctttggga

SEQ ID NO: 4858272 - DNA, 18 bp, Homo sapiens
ttgcttaaaccacttaaa

SEQ ID NO: 4858273 - DNA, 14 bp, Homo sapiens
ttgcttcccatctg

SEQ ID NO: 4858274 - DNA, 14 bp, Homo sapiens
ttgcttccttctca

SEQ ID NO: 4858275 - DNA, 14 bp, Homo sapiens
ttgcttgtcttctg

SEQ ID NO: 4858276 - DNA, 21 bp, Homo sapiens
ttggacgggatgacctccaga

SEQ ID NO: 4858277 - DNA, 15 bp, Homo sapiens
ttggacttctgaaga

SEQ ID NO: 4858278 - DNA, 18 bp, Homo sapiens
ttggagaatactgccaaa

SEQ ID NO: 4858279 - DNA, 21 bp, Homo sapiens
ttggagcacaaaattcaaagc

SEQ ID NO: 4858280 - DNA, 12 bp, Homo sapiens
ttggagcagcag

SEQ ID NO: 4858281 - DNA, 15 bp, Homo sapiens
ttggagcagcaggcc

SEQ ID NO: 4858282 - DNA, 23 bp, Homo sapiens
ttggagtgctcttcccactccag

SEQ ID NO: 4858283 - DNA, 13 bp, Homo sapiens
ttggagttaaaat

SEQ ID NO: 4858284 - DNA, 19 bp, Homo sapiens
ttggatttaaaagcctgct

SEQ ID NO: 4858285 - DNA, 21 bp, Homo sapiens
ttggatttaaaagcctgctca

SEQ ID NO: 4858286 - DNA, 18 bp, Homo sapiens
ttggcacttattgaatat

SEQ ID NO: 4858287 - DNA, 18 bp, Homo sapiens
ttggcccccttcaggagc

SEQ ID NO: 4858288 - DNA, 16 bp, Homo sapiens
ttggcctcctgcaaag

SEQ ID NO: 4858289 - DNA, 18 bp, Homo sapiens
ttggcctcctgcaaagtc

SEQ ID NO: 4858290 - DNA, 18 bp, Homo sapiens
ttggcgaatctcaaaatt

SEQ ID NO: 4858291 - DNA, 15 bp, Homo sapiens
ttgggaactgaaatc

SEQ ID NO: 4858292 - DNA, 14 bp, Homo sapiens
ttgggagacatgtg

SEQ ID NO: 4858293 - DNA, 13 bp, Homo sapiens
ttgggagccagga

SEQ ID NO: 4858294 - DNA, 15 bp, Homo sapiens
ttgggagccaggact

SEQ ID NO: 4858295 - DNA, 16 bp, Homo sapiens
ttgggagccaggactc

SEQ ID NO: 4858296 - DNA, 22 bp, Homo sapiens
ttgggagccaggactcccagaa

SEQ ID NO: 4858297 - DNA, 14 bp, Homo sapiens
ttgggcctctcctg

SEQ ID NO: 4858298 - DNA, 18 bp, Homo sapiens
ttgggcctctcctgccct

SEQ ID NO: 4858299 - DNA, 19 bp, Homo sapiens
ttgggcttcaacagccaag

SEQ ID NO: 4858300 - DNA, 18 bp, Homo sapiens
ttggggaagggcctgccc

SEQ ID NO: 4858301 - DNA, 21 bp, Homo sapiens
ttggggaaggggcctgggctg

SEQ ID NO: 4858302 - DNA, 17 bp, Homo sapiens
ttgggggtcagcatcca

SEQ ID NO: 4858303 - DNA, 15 bp, Homo sapiens
ttgggtgaatttcag

SEQ ID NO: 4858304 - DNA, 19 bp, Homo sapiens
ttgggtggctcactactga

SEQ ID NO: 4858305 - DNA, 13 bp, Homo sapiens
ttggtggccaggg

SEQ ID NO: 4858306 - DNA, 21 bp, Homo sapiens
ttggtgggtctatgttcccca

SEQ ID NO: 4858307 - DNA, 20 bp, Homo sapiens
ttggtgtgaatttgccagag

SEQ ID NO: 4858308 - DNA, 23 bp, Homo sapiens
ttggtgtgaatttgccagaggac

SEQ ID NO: 4858309 - DNA, 18 bp, Homo sapiens
ttggttctgattaggtaa

SEQ ID NO: 4858310 - DNA, 15 bp, Homo sapiens
ttggttctgtgaaca

SEQ ID NO: 4858311 - DNA, 18 bp, Homo sapiens
ttgtacaaaattaagcaa

SEQ ID NO: 4858312 - DNA, 20 bp, Homo sapiens
ttgtacaaaattaagcaaat

SEQ ID NO: 4858313 - DNA, 14 bp, Homo sapiens
ttgtacagccttat

SEQ ID NO: 4858314 - DNA, 15 bp, Homo sapiens
ttgtactttatcatg

SEQ ID NO: 4858315 - DNA, 16 bp, Homo sapiens
ttgtataatattgaaa

SEQ ID NO: 4858316 - DNA, 14 bp, Homo sapiens
ttgtatatgactgc

SEQ ID NO: 4858317 - DNA, 18 bp, Homo sapiens
ttgtatatgactgcattt

SEQ ID NO: 4858318 - DNA, 16 bp, Homo sapiens
ttgtattttcatgaaa

SEQ ID NO: 4858319 - DNA, 17 bp, Homo sapiens
ttgtccaggaagtcaga

SEQ ID NO: 4858320 - DNA, 20 bp, Homo sapiens
ttgtctaagtagggccaggg

SEQ ID NO: 4858321 - DNA, 16 bp, Homo sapiens
ttgtctgatttcttag

SEQ ID NO: 4858322 - DNA, 23 bp, Homo sapiens
ttgtcttagcatggtacctgctg

SEQ ID NO: 4858323 - DNA, 21 bp, Homo sapiens
ttgtcttttaatccatttcag

SEQ ID NO: 4858324 - DNA, 20 bp, Homo sapiens
ttgtgagaatggcctggagc

SEQ ID NO: 4858325 - DNA, 22 bp, Homo sapiens
ttgtgagtttaccttgtatact

SEQ ID NO: 4858326 - DNA, 23 bp, Homo sapiens
ttgtgcccctaaagagcatcctg

SEQ ID NO: 4858327 - DNA, 18 bp, Homo sapiens
ttgtgcctaatgtgtttg

SEQ ID NO: 4858328 - DNA, 16 bp, Homo sapiens
ttgtgctcagagacac

SEQ ID NO: 4858329 - DNA, 16 bp, Homo sapiens
ttgtgtccctaatgtg

SEQ ID NO: 4858330 - DNA, 12 bp, Homo sapiens
ttgtgtgaaatt

SEQ ID NO: 4858331 - DNA, 14 bp, Homo sapiens
ttgtgtgaaattgc

SEQ ID NO: 4858332 - DNA, 16 bp, Homo sapiens
ttgtgtgaaattgcat

SEQ ID NO: 4858333 - DNA, 16 bp, Homo sapiens
ttgtgtggattcttta

SEQ ID NO: 4858334 - DNA, 21 bp, Homo sapiens
ttgtgtttctagaatcacagc

SEQ ID NO: 4858335 - DNA, 15 bp, Homo sapiens
ttgttaaaaatgtca

SEQ ID NO: 4858336 - DNA, 16 bp, Homo sapiens
ttgttacgtagcctaa

SEQ ID NO: 4858337 - DNA, 13 bp, Homo sapiens
ttgttcctgaaat

SEQ ID NO: 4858338 - DNA, 15 bp, Homo sapiens
ttgttgtgagaatgg

SEQ ID NO: 4858339 - DNA, 12 bp, Homo sapiens
aaaaaaaacagt

SEQ ID NO: 4858340 - DNA, 12 bp, Homo sapiens
aaaaaagagaca

SEQ ID NO: 4858341 - DNA, 16 bp, Homo sapiens
aaaaacaattaactgc

SEQ ID NO: 4858342 - DNA, 15 bp, Homo sapiens
aaaaagagacatcca

SEQ ID NO: 4858343 - DNA, 20 bp, Homo sapiens
aaaaagctgcaaaaattata

SEQ ID NO: 4858344 - DNA, 21 bp, Homo sapiens
aaaaagctgcaaaaattatat

SEQ ID NO: 4858345 - DNA, 16 bp, Homo sapiens
aaaaagttttagtttt

SEQ ID NO: 4858346 - DNA, 11 bp, Homo sapiens
aaaaatatatt

SEQ ID NO: 4858347 - DNA, 20 bp, Homo sapiens
aaaaatcatgccagtatttt

SEQ ID NO: 4858348 - DNA, 18 bp, Homo sapiens
aaaaatgtccagccaccc

SEQ ID NO: 4858349 - DNA, 22 bp, Homo sapiens
aaaacaatggtgtggtgaatgt

SEQ ID NO: 4858350 - DNA, 13 bp, Homo sapiens
aaaacacacaggt

SEQ ID NO: 4858351 - DNA, 13 bp, Homo sapiens
aaaacatttatga

SEQ ID NO: 4858352 - DNA, 18 bp, Homo sapiens
aaaactcaggcaaagaaa

SEQ ID NO: 4858353 - DNA, 17 bp, Homo sapiens
aaaacttcatgtaattt

SEQ ID NO: 4858354 - DNA, 17 bp, Homo sapiens
aaaactttgactttgcc

SEQ ID NO: 4858355 - DNA, 21 bp, Homo sapiens
aaaagaaatcaatagttgaat

SEQ ID NO: 4858356 - DNA, 21 bp, Homo sapiens
aaaagactggatttgcagaag

SEQ ID NO: 4858357 - DNA, 15 bp, Homo sapiens
aaaagcactcctgct

SEQ ID NO: 4858358 - DNA, 11 bp, Homo sapiens
aaaagccacag

SEQ ID NO: 4858359 - DNA, 13 bp, Homo sapiens
aaaaggaaagctg

SEQ ID NO: 4858360 - DNA, 11 bp, Homo sapiens
aaaaggcaggt

SEQ ID NO: 4858361 - DNA, 23 bp, Homo sapiens
aaaaggcaggtgcttttggcaga

SEQ ID NO: 4858362 - DNA, 22 bp, Homo sapiens
aaaagtagtgttgtccaggaag

SEQ ID NO: 4858363 - DNA, 13 bp, Homo sapiens
aaaagtcttccta

SEQ ID NO: 4858364 - DNA, 17 bp, Homo sapiens
aaaagttgcattttaac

SEQ ID NO: 4858365 - DNA, 13 bp, Homo sapiens
aaaataacagtat

SEQ ID NO: 4858366 - DNA, 17 bp, Homo sapiens
aaaataacctaattaat

SEQ ID NO: 4858367 - DNA, 18 bp, Homo sapiens
aaaataacctaattaata

SEQ ID NO: 4858368 - DNA, 14 bp, Homo sapiens
aaaatactattgcc

SEQ ID NO: 4858369 - DNA, 14 bp, Homo sapiens
aaaatataaaatta

SEQ ID NO: 4858370 - DNA, 18 bp, Homo sapiens
aaaatcatgccagtattt

SEQ ID NO: 4858371 - DNA, 16 bp, Homo sapiens
aaaatgaaatgcatat

SEQ ID NO: 4858372 - DNA, 13 bp, Homo sapiens
aaaatgatgttat

SEQ ID NO: 4858373 - DNA, 13 bp, Homo sapiens
aaaatggaaattt

SEQ ID NO: 4858374 - DNA, 23 bp, Homo sapiens
aaaatggtcctatttttgtgaag

SEQ ID NO: 4858375 - DNA, 24 bp, Homo sapiens
aaaatggtcctatttttgtgaaga

SEQ ID NO: 4858376 - DNA, 19 bp, Homo sapiens
aaaatgtaatttaaatgaa

SEQ ID NO: 4858377 - DNA, 22 bp, Homo sapiens
aaaatgtggtctgccaatctgt

SEQ ID NO: 4858378 - DNA, 16 bp, Homo sapiens
aaaattaaggaaatgt

SEQ ID NO: 4858379 - DNA, 15 bp, Homo sapiens
aaaattcaaagcatg

SEQ ID NO: 4858380 - DNA, 20 bp, Homo sapiens
aaaattgagttgcacttatt

SEQ ID NO: 4858381 - DNA, 20 bp, Homo sapiens
aaaatttgccaatctttcct

SEQ ID NO: 4858382 - DNA, 21 bp, Homo sapiens
aaaattttgtatgttaaagag

SEQ ID NO: 4858383 - DNA, 18 bp, Homo sapiens
aaacaacatttatatgta

SEQ ID NO: 4858384 - DNA, 22 bp, Homo sapiens
aaacaatggtgtggtgaatgtg

SEQ ID NO: 4858385 - DNA, 15 bp, Homo sapiens
aaacactatttgtga

SEQ ID NO: 4858386 - DNA, 19 bp, Homo sapiens
aaacactatttgtgacttt

SEQ ID NO: 4858387 - DNA, 23 bp, Homo sapiens
aaacactatttgtgactttttaa

SEQ ID NO: 4858388 - DNA, 16 bp, Homo sapiens
aaacactgaaaagaag

SEQ ID NO: 4858389 - DNA, 14 bp, Homo sapiens
aaacagacaaaaca

SEQ ID NO: 4858390 - DNA, 20 bp, Homo sapiens
aaacagacaaaacagataaa

SEQ ID NO: 4858391 - DNA, 22 bp, Homo sapiens
aaacatttatgacaagctgtat

SEQ ID NO: 4858392 - DNA, 12 bp, Homo sapiens
aaacatttgctg

SEQ ID NO: 4858393 - DNA, 23 bp, Homo sapiens
aaaccactttattgcaatgcaga

SEQ ID NO: 4858394 - DNA, 23 bp, Homo sapiens
aaacctgatgtcagctgctgttg

SEQ ID NO: 4858395 - DNA, 11 bp, Homo sapiens
aaacctgccaa

SEQ ID NO: 4858396 - DNA, 15 bp, Homo sapiens
aagaatctttagaga

SEQ ID NO: 4858397 - DNA, 20 bp, Homo sapiens
aagaatgttagagtaatgaa

SEQ ID NO: 4858398 - DNA, 21 bp, Homo sapiens
aagaatgttagagtaatgaaa

SEQ ID NO: 4858399 - DNA, 15 bp, Homo sapiens
aagaatgtttctgga

SEQ ID NO: 4858400 - DNA, 15 bp, Homo sapiens
aagaattgaaaagtt

SEQ ID NO: 4858401 - DNA, 18 bp, Homo sapiens
aagaattgaaaagttttt

SEQ ID NO: 4858402 - DNA, 20 bp, Homo sapiens
aagaattgaaaagtttttgt

SEQ ID NO: 4858403 - DNA, 14 bp, Homo sapiens
aagaccagaaattc

SEQ ID NO: 4858404 - DNA, 12 bp, Homo sapiens
aagactaaaagt

SEQ ID NO: 4858405 - DNA, 20 bp, Homo sapiens
aagactatatatataaatgt

SEQ ID NO: 4858406 - DNA, 16 bp, Homo sapiens
aagactgtagatatgt

SEQ ID NO: 4858407 - DNA, 17 bp, Homo sapiens
aagactttgatccatgt

SEQ ID NO: 4858408 - DNA, 22 bp, Homo sapiens
aagagaaacctgccaaggagca

SEQ ID NO: 4858409 - DNA, 18 bp, Homo sapiens
aagagaaagagtttgaaa

SEQ ID NO: 4858410 - DNA, 22 bp, Homo sapiens
aagagacagagacaagtaattt

SEQ ID NO: 4858411 - DNA, 24 bp, Homo sapiens
aagagaggactggttctgaggcca

SEQ ID NO: 4858412 - DNA, 15 bp, Homo sapiens
aagagataagtcttt

SEQ ID NO: 4858413 - DNA, 14 bp, Homo sapiens
aagagcatctgatt

SEQ ID NO: 4858414 - DNA, 23 bp, Homo sapiens
aagagcgagagatcaaagatgaa

SEQ ID NO: 4858415 - DNA, 16 bp, Homo sapiens
aagagttcccttgaaa

SEQ ID NO: 4858416 - DNA, 19 bp, Homo sapiens
aagagttggggacagaact

SEQ ID NO: 4858417 - DNA, 19 bp, Homo sapiens
aagagtttcagtttgttgg

SEQ ID NO: 4858418 - DNA, 20 bp, Homo sapiens
aagataaaatgatgttatac

SEQ ID NO: 4858419 - DNA, 16 bp, Homo sapiens
aagatacttacatgtt

SEQ ID NO: 4858420 - DNA, 17 bp, Homo sapiens
aagatacttacatgttc

SEQ ID NO: 4858421 - DNA, 13 bp, Homo sapiens
aagatctttatat

SEQ ID NO: 4858422 - DNA, 16 bp, Homo sapiens
aagatgacctgcccca

SEQ ID NO: 4858423 - DNA, 14 bp, Homo sapiens
aagatgcagaagca

SEQ ID NO: 4858424 - DNA, 16 bp, Homo sapiens
aagatgcagaagcaat

SEQ ID NO: 4858425 - DNA, 22 bp, Homo sapiens
aagatgctacttcccactgtat

SEQ ID NO: 4858426 - DNA, 17 bp, Homo sapiens
aagatgtgttcttattt

SEQ ID NO: 4858427 - DNA, 16 bp, Homo sapiens
aagatgttatggtgtt

SEQ ID NO: 4858428 - DNA, 21 bp, Homo sapiens
aagcaaaggtgcactccagac

SEQ ID NO: 4858429 - DNA, 23 bp, Homo sapiens
aagcaagaggcaagctgaaattt

SEQ ID NO: 4858430 - DNA, 21 bp, Homo sapiens
aagcaatttactgatgagaga

SEQ ID NO: 4858431 - DNA, 18 bp, Homo sapiens
aagcacaagactggccca

SEQ ID NO: 4858432 - DNA, 20 bp, Homo sapiens
aagcaccaacctccagactc

SEQ ID NO: 4858433 - DNA, 17 bp, Homo sapiens
aagcagacagccctggc

SEQ ID NO: 4858434 - DNA, 15 bp, Homo sapiens
aagcagagttttcat

SEQ ID NO: 4858435 - DNA, 14 bp, Homo sapiens
aagcagatgacaga

SEQ ID NO: 4858436 - DNA, 21 bp, Homo sapiens
aagcaggcttgcccagtacat

SEQ ID NO: 4858437 - DNA, 20 bp, Homo sapiens
aagcagtatattagtattat

SEQ ID NO: 4858438 - DNA, 12 bp, Homo sapiens
aagcagtatttt

SEQ ID NO: 4858439 - DNA, 14 bp, Homo sapiens
aagcataaagctca

SEQ ID NO: 4858440 - DNA, 19 bp, Homo sapiens
aagcatggacatttagaag

SEQ ID NO: 4858441 - DNA, 19 bp, Homo sapiens
aagccaatctacaatctct

SEQ ID NO: 4858442 - DNA, 13 bp, Homo sapiens
aagccacagcaga

SEQ ID NO: 4858443 - DNA, 20 bp, Homo sapiens
aagccagccaagctttaaat

SEQ ID NO: 4858444 - DNA, 13 bp, Homo sapiens
aagccaggctcag

SEQ ID NO: 4858445 - DNA, 15 bp, Homo sapiens
aagccaggctcagga

SEQ ID NO: 4858446 - DNA, 22 bp, Homo sapiens
aagccaggctcaggagaagcca

SEQ ID NO: 4858447 - DNA, 17 bp, Homo sapiens
aagccagtgtctaggca

SEQ ID NO: 4858448 - DNA, 15 bp, Homo sapiens
aagccatgccaataa

SEQ ID NO: 4858449 - DNA, 14 bp, Homo sapiens
aagccccaactttc

SEQ ID NO: 4858450 - DNA, 17 bp, Homo sapiens
aagccgcagacctggag

SEQ ID NO: 4858451 - DNA, 14 bp, Homo sapiens
aagcctaagaatct

SEQ ID NO: 4858452 - DNA, 14 bp, Homo sapiens
aagcctccccagct

SEQ ID NO: 4858453 - DNA, 18 bp, Homo sapiens
aagctcaaatgaaatgta

SEQ ID NO: 4858454 - DNA, 13 bp, Homo sapiens
aagctgaaatttt

SEQ ID NO: 4858455 - DNA, 12 bp, Homo sapiens
aagctgatggac

SEQ ID NO: 4858456 - DNA, 17 bp, Homo sapiens
aagctgatggacatgag

SEQ ID NO: 4858457 - DNA, 18 bp, Homo sapiens
aagctgattttttttaat

SEQ ID NO: 4858458 - DNA, 21 bp, Homo sapiens
aagctgcaaaaattatatatt

SEQ ID NO: 4858459 - DNA, 15 bp, Homo sapiens
aagctgcagagattt

SEQ ID NO: 4858460 - DNA, 16 bp, Homo sapiens
aagctggagcagcgga

SEQ ID NO: 4858461 - DNA, 21 bp, Homo sapiens
aagctggagcagcggattgct

SEQ ID NO: 4858462 - DNA, 17 bp, Homo sapiens
aagctgtatcactgcct

SEQ ID NO: 4858463 - DNA, 18 bp, Homo sapiens
aagctgtatcactgcctt

SEQ ID NO: 4858464 - DNA, 21 bp, Homo sapiens
aagctgtgtctgcccaatgaa

SEQ ID NO: 4858465 - DNA, 14 bp, Homo sapiens
aagctgtttggaaa

SEQ ID NO: 4858466 - DNA, 17 bp, Homo sapiens
aagctgtttggaaaaga

SEQ ID NO: 4858467 - DNA, 16 bp, Homo sapiens
aagcttggttctgtga

SEQ ID NO: 4858468 - DNA, 17 bp, Homo sapiens
aagctttaaattatgtg

SEQ ID NO: 4858469 - DNA, 20 bp, Homo sapiens
aagctttgactctataagca

SEQ ID NO: 4858470 - DNA, 12 bp, Homo sapiens
aaggaaagctgt

SEQ ID NO: 4858471 - DNA, 18 bp, Homo sapiens
aaggaaagctgtgtttat

SEQ ID NO: 4858472 - DNA, 15 bp, Homo sapiens
aaggacccttttaag

SEQ ID NO: 4858473 - DNA, 17 bp, Homo sapiens
aaggacccttttaagca

SEQ ID NO: 4858474 - DNA, 14 bp, Homo sapiens
aaggatagtaagca

SEQ ID NO: 4858475 - DNA, 20 bp, Homo sapiens
aaggatagtaagcatagaaa

SEQ ID NO: 4858476 - DNA, 16 bp, Homo sapiens
aaggatccggaaagaa

SEQ ID NO: 4858477 - DNA, 22 bp, Homo sapiens
aaggcagagaaatctaagctgt

SEQ ID NO: 4858478 - DNA, 13 bp, Homo sapiens
aaggcagggccct

SEQ ID NO: 4858479 - DNA, 15 bp, Homo sapiens
aaggcagggccctga

SEQ ID NO: 4858480 - DNA, 20 bp, Homo sapiens
aaggcagggccctgaaatgg

SEQ ID NO: 4858481 - DNA, 20 bp, Homo sapiens
aaggcatgtacaaaaattat

SEQ ID NO: 4858482 - DNA, 13 bp, Homo sapiens
aaggccagcagct

SEQ ID NO: 4858483 - DNA, 17 bp, Homo sapiens
aaggcccttagagggaa

SEQ ID NO: 4858484 - DNA, 18 bp, Homo sapiens
aaggctcagactgggcac

SEQ ID NO: 4858485 - DNA, 13 bp, Homo sapiens
aaggctctcaccc

SEQ ID NO: 4858486 - DNA, 14 bp, Homo sapiens
aaggctctcacccc

SEQ ID NO: 4858487 - DNA, 21 bp, Homo sapiens
aaggctgtgtttagattgtat

SEQ ID NO: 4858488 - DNA, 23 bp, Homo sapiens
aaggctgtgtttagattgtatta

SEQ ID NO: 4858489 - DNA, 14 bp, Homo sapiens
aagggaccccagat

SEQ ID NO: 4858490 - DNA, 23 bp, Homo sapiens
aagggaccccagatacctgtgag

SEQ ID NO: 4858491 - DNA, 23 bp, Homo sapiens
aagggcctgcccagttgcactca

SEQ ID NO: 4858492 - DNA, 21 bp, Homo sapiens
aaggggcctgggctgtgagga

SEQ ID NO: 4858493 - DNA, 18 bp, Homo sapiens
aaggtagcattctttgga

SEQ ID NO: 4858494 - DNA, 20 bp, Homo sapiens
aaggtagcattctttggagt

SEQ ID NO: 4858495 - DNA, 14 bp, Homo sapiens
aaggtgaactttgt

SEQ ID NO: 4858496 - DNA, 13 bp, Homo sapiens
aaggtgatgttgt

SEQ ID NO: 4858497 - DNA, 16 bp, Homo sapiens
aaggtgcactccagac

SEQ ID NO: 4858498 - DNA, 18 bp, Homo sapiens
aaggtgcactccagactc

SEQ ID NO: 4858499 - DNA, 22 bp, Homo sapiens
aaggtgcactccagactctggg

SEQ ID NO: 4858500 - DNA, 16 bp, Homo sapiens
aaggtgcttggagttt

SEQ ID NO: 4858501 - DNA, 16 bp, Homo sapiens
aaggtggcctctgcct

SEQ ID NO: 4858502 - DNA, 19 bp, Homo sapiens
aaggtggcctctgcctggg

SEQ ID NO: 4858503 - DNA, 16 bp, Homo sapiens
aagtaaaagtagtgtt

SEQ ID NO: 4858504 - DNA, 13 bp, Homo sapiens
aagtaatttcagt

SEQ ID NO: 4858505 - DNA, 14 bp, Homo sapiens
aagtacagaatttg

SEQ ID NO: 4858506 - DNA, 19 bp, Homo sapiens
aagtacttgactacctact

SEQ ID NO: 4858507 - DNA, 22 bp, Homo sapiens
aagtacttggcccccttcagga

SEQ ID NO: 4858508 - DNA, 17 bp, Homo sapiens
aagtagtgttgtccagg

SEQ ID NO: 4858509 - DNA, 20 bp, Homo sapiens
aagtatgcattattaaattg

SEQ ID NO: 4858510 - DNA, 22 bp, Homo sapiens
aagtatgcattattaaattgta

SEQ ID NO: 4858511 - DNA, 20 bp, Homo sapiens
aagtatgtatattaaaaaag

SEQ ID NO: 4858512 - DNA, 22 bp, Homo sapiens
aagtatgtatattaaaaaagag

SEQ ID NO: 4858513 - DNA, 13 bp, Homo sapiens
aagtcagaagttt

SEQ ID NO: 4858514 - DNA, 23 bp, Homo sapiens
aagtcagtccaggatgctaacat

SEQ ID NO: 4858515 - DNA, 22 bp, Homo sapiens
aagtcagttgctcaaaaagaaa

SEQ ID NO: 4858516 - DNA, 14 bp, Homo sapiens
acacttgctcccaa

SEQ ID NO: 4858517 - DNA, 16 bp, Homo sapiens
acacttgctcccaacc

SEQ ID NO: 4858518 - DNA, 17 bp, Homo sapiens
acagaaatggaaagcag

SEQ ID NO: 4858519 - DNA, 20 bp, Homo sapiens
acagaacttcagcattgtaa

SEQ ID NO: 4858520 - DNA, 13 bp, Homo sapiens
acagaacttgtgg

SEQ ID NO: 4858521 - DNA, 22 bp, Homo sapiens
acagacactaacgaaatatcaa

SEQ ID NO: 4858522 - DNA, 13 bp, Homo sapiens
acagacagcttac

SEQ ID NO: 4858523 - DNA, 18 bp, Homo sapiens
acagacagcttacaggag

SEQ ID NO: 4858524 - DNA, 22 bp, Homo sapiens
acagacagcttacaggagccag

SEQ ID NO: 4858525 - DNA, 18 bp, Homo sapiens
acagagacaagtaatttc

SEQ ID NO: 4858526 - DNA, 20 bp, Homo sapiens
acagagactgaatagatatg

SEQ ID NO: 4858527 - DNA, 14 bp, Homo sapiens
acagagtggccgtc

SEQ ID NO: 4858528 - DNA, 13 bp, Homo sapiens
acagataaacaaa

SEQ ID NO: 4858529 - DNA, 19 bp, Homo sapiens
acagcagccccaggagaag

SEQ ID NO: 4858530 - DNA, 14 bp, Homo sapiens
acagcagcctgtat

SEQ ID NO: 4858531 - DNA, 17 bp, Homo sapiens
acagcagcctgtatgtg

SEQ ID NO: 4858532 - DNA, 13 bp, Homo sapiens
acagccaagctgg

SEQ ID NO: 4858533 - DNA, 15 bp, Homo sapiens
acagcctgcaagtca

SEQ ID NO: 4858534 - DNA, 20 bp, Homo sapiens
acagccttctaaattcccaa

SEQ ID NO: 4858535 - DNA, 17 bp, Homo sapiens
acagccttgcagcggct

SEQ ID NO: 4858536 - DNA, 15 bp, Homo sapiens
acagcgaacagcctt

SEQ ID NO: 4858537 - DNA, 22 bp, Homo sapiens
acagcgggtacttatttctcag

SEQ ID NO: 4858538 - DNA, 18 bp, Homo sapiens
acagctcaagcattctgt

SEQ ID NO: 4858539 - DNA, 15 bp, Homo sapiens
acagctctcctccag

SEQ ID NO: 4858540 - DNA, 11 bp, Homo sapiens
acagctgtgct

SEQ ID NO: 4858541 - DNA, 17 bp, Homo sapiens
acagctgtgctccacac

SEQ ID NO: 4858542 - DNA, 18 bp, Homo sapiens
acagctgtgctccacact

SEQ ID NO: 4858543 - DNA, 21 bp, Homo sapiens
acagctgtgctccacactcag

SEQ ID NO: 4858544 - DNA, 23 bp, Homo sapiens
acagctgtgctccacactcagaa

SEQ ID NO: 4858545 - DNA, 16 bp, Homo sapiens
acagcttacaggagcc

SEQ ID NO: 4858546 - DNA, 22 bp, Homo sapiens
acagcttacaggagccagcctg

SEQ ID NO: 4858547 - DNA, 21 bp, Homo sapiens
acaggacagttgatggagccc

SEQ ID NO: 4858548 - DNA, 15 bp, Homo sapiens
acaggagacaaaaga

SEQ ID NO: 4858549 - DNA, 18 bp, Homo sapiens
acaggagacaaaagagca

SEQ ID NO: 4858550 - DNA, 17 bp, Homo sapiens
acaggatcctggcctga

SEQ ID NO: 4858551 - DNA, 17 bp, Homo sapiens
acaggccttcctcctct

SEQ ID NO: 4858552 - DNA, 17 bp, Homo sapiens
acagggaatggccacaa

SEQ ID NO: 4858553 - DNA, 19 bp, Homo sapiens
acagggccctggagctcag

SEQ ID NO: 4858554 - DNA, 19 bp, Homo sapiens
acaggtgcctaacctggga

SEQ ID NO: 4858555 - DNA, 15 bp, Homo sapiens
acaggttataacagt

SEQ ID NO: 4858556 - DNA, 23 bp, Homo sapiens
acagtccgcagttgtagcagaaa

SEQ ID NO: 4858557 - DNA, 14 bp, Homo sapiens
acagtgccttctct

SEQ ID NO: 4858558 - DNA, 22 bp, Homo sapiens
acagtgtgtggtcaacatttct

SEQ ID NO: 4858559 - DNA, 16 bp, Homo sapiens
acagttgatggagccc

SEQ ID NO: 4858560 - DNA, 17 bp, Homo sapiens
acagttttaactgtgga

SEQ ID NO: 4858561 - DNA, 20 bp, Homo sapiens
acagtttttgacatttatat

SEQ ID NO: 4858562 - DNA, 17 bp, Homo sapiens
acataagcttccatttt

SEQ ID NO: 4858563 - DNA, 14 bp, Homo sapiens
acatatatttattg

SEQ ID NO: 4858564 - DNA, 13 bp, Homo sapiens
acatcaaaccttt

SEQ ID NO: 4858565 - DNA, 14 bp, Homo sapiens
acatcaaataagaa

SEQ ID NO: 4858566 - DNA, 16 bp, Homo sapiens
acatctttattgaaat

SEQ ID NO: 4858567 - DNA, 22 bp, Homo sapiens
acatctttattgaaattctatt

SEQ ID NO: 4858568 - DNA, 14 bp, Homo sapiens
acatgaagcagaac

SEQ ID NO: 4858569 - DNA, 13 bp, Homo sapiens
acatgactctcat

SEQ ID NO: 4858570 - DNA, 13 bp, Homo sapiens
acatgcaataaaa

SEQ ID NO: 4858571 - DNA, 18 bp, Homo sapiens
acatgcaataaaatttaa

SEQ ID NO: 4858572 - DNA, 19 bp, Homo sapiens
acatgcaataaaatttaaa

SEQ ID NO: 4858573 - DNA, 23 bp, Homo sapiens
acatgggctgtgattactgcaat

SEQ ID NO: 4858574 - DNA, 17 bp, Homo sapiens
acatggtctgtcaatga

SEQ ID NO: 4858575 - DNA, 21 bp, Homo sapiens
acatgtattgcacattgtaaa

SEQ ID NO: 4858576 - DNA, 14 bp, Homo sapiens
acatgtgacattta

SEQ ID NO: 4858577 - DNA, 15 bp, Homo sapiens
acatgtgatacattt

SEQ ID NO: 4858578 - DNA, 20 bp, Homo sapiens
acatgtgtatgatactaaag

SEQ ID NO: 4858579 - DNA, 12 bp, Homo sapiens
acatgttctcca

SEQ ID NO: 4858580 - DNA, 16 bp, Homo sapiens
acatgtttctctataa

SEQ ID NO: 4858581 - DNA, 22 bp, Homo sapiens
acatgtttctctataaagtatg

SEQ ID NO: 4858582 - DNA, 11 bp, Homo sapiens
acattaactgt

SEQ ID NO: 4858583 - DNA, 23 bp, Homo sapiens
acattctggggaaacaacattta

SEQ ID NO: 4858584 - DNA, 13 bp, Homo sapiens
acatttagaaaag

SEQ ID NO: 4858585 - DNA, 20 bp, Homo sapiens
acatttagaaaagtgaattg

SEQ ID NO: 4858586 - DNA, 22 bp, Homo sapiens
acatttagaaaagtgaattgaa

SEQ ID NO: 4858587 - DNA, 20 bp, Homo sapiens
acatttatgacaagctgtat

SEQ ID NO: 4858588 - DNA, 22 bp, Homo sapiens
acatttatgacaagctgtatca

SEQ ID NO: 4858589 - DNA, 17 bp, Homo sapiens
acatttgctactgttgt

SEQ ID NO: 4858590 - DNA, 19 bp, Homo sapiens
acatttgctactgttgtaa

SEQ ID NO: 4858591 - DNA, 21 bp, Homo sapiens
acatttgggagacatgtgaca

SEQ ID NO: 4858592 - DNA, 17 bp, Homo sapiens
acattttttaagcttca

SEQ ID NO: 4858593 - DNA, 18 bp, Homo sapiens
acatttttttgcatgcat

SEQ ID NO: 4858594 - DNA, 23 bp, Homo sapiens
acatttttttgcatgcatgcaaa

SEQ ID NO: 4858595 - DNA, 16 bp, Homo sapiens
accaaaacagttaatc

SEQ ID NO: 4858596 - DNA, 16 bp, Homo sapiens
accaaatagtgtgaaa

SEQ ID NO: 4858597 - DNA, 18 bp, Homo sapiens
accaacaagaaccactcc

SEQ ID NO: 4858598 - DNA, 18 bp, Homo sapiens
accaacctccagactcag

SEQ ID NO: 4858599 - DNA, 21 bp, Homo sapiens
accaacctccagactcagcag

SEQ ID NO: 4858600 - DNA, 20 bp, Homo sapiens
accaacttgtatccaggcct

SEQ ID NO: 4858601 - DNA, 21 bp, Homo sapiens
accaaggctgagacagtgaat

SEQ ID NO: 4858602 - DNA, 16 bp, Homo sapiens
accaaggctgtgttta

SEQ ID NO: 4858603 - DNA, 13 bp, Homo sapiens
accacacttgaaa

SEQ ID NO: 4858604 - DNA, 23 bp, Homo sapiens
accacagccttctaaattcccaa

SEQ ID NO: 4858605 - DNA, 18 bp, Homo sapiens
accactttattgcaatgc

SEQ ID NO: 4858606 - DNA, 15 bp, Homo sapiens
accagagctgtctga

SEQ ID NO: 4858607 - DNA, 12 bp, Homo sapiens
accaggggccaa

SEQ ID NO: 4858608 - DNA, 18 bp, Homo sapiens
accagggtctctcaggga

SEQ ID NO: 4858609 - DNA, 14 bp, Homo sapiens
accagttgctgctg

SEQ ID NO: 4858610 - DNA, 23 bp, Homo sapiens
accagtttaagccgcagacctgg

SEQ ID NO: 4858611 - DNA, 14 bp, Homo sapiens
accataaattcaac

SEQ ID NO: 4858612 - DNA, 16 bp, Homo sapiens
accataagagaaacct

SEQ ID NO: 4858613 - DNA, 22 bp, Homo sapiens
accataatgtactgatttcagt

SEQ ID NO: 4858614 - DNA, 18 bp, Homo sapiens
accatactccttgcttcc

SEQ ID NO: 4858615 - DNA, 15 bp, Homo sapiens
accattaaagtcaga

SEQ ID NO: 4858616 - DNA, 17 bp, Homo sapiens
accattctattctccag

SEQ ID NO: 4858617 - DNA, 23 bp, Homo sapiens
acccaaggtgaggtgaactccag

SEQ ID NO: 4858618 - DNA, 24 bp, Homo sapiens
acccaagtggacgttaggccaggc

SEQ ID NO: 4858619 - DNA, 15 bp, Homo sapiens
acccacaaactccag

SEQ ID NO: 4858620 - DNA, 22 bp, Homo sapiens
acccagacgtggtgcttctcac

SEQ ID NO: 4858621 - DNA, 15 bp, Homo sapiens
acccagagatgcctg

SEQ ID NO: 4858622 - DNA, 17 bp, Homo sapiens
acccagagatgcctgat

SEQ ID NO: 4858623 - DNA, 14 bp, Homo sapiens
acccagtctttctt

SEQ ID NO: 4858624 - DNA, 18 bp, Homo sapiens
acccagtctttcttcact

SEQ ID NO: 4858625 - DNA, 21 bp, Homo sapiens
acccagtctttcttcactctg

SEQ ID NO: 4858626 - DNA, 24 bp, Homo sapiens
acccataataagagaatgttccta

SEQ ID NO: 4858627 - DNA, 17 bp, Homo sapiens
acccatccctgcctgga

SEQ ID NO: 4858628 - DNA, 18 bp, Homo sapiens
acccatccctgcctggag

SEQ ID NO: 4858629 - DNA, 19 bp, Homo sapiens
acccatccctgcctggagg

SEQ ID NO: 4858630 - DNA, 16 bp, Homo sapiens
acccattcactacagg

SEQ ID NO: 4858631 - DNA, 18 bp, Homo sapiens
acccattcactacaggtg

SEQ ID NO: 4858632 - DNA, 17 bp, Homo sapiens
accccaaagagaaagag

SEQ ID NO: 4858633 - DNA, 11 bp, Homo sapiens
accccaagctt

SEQ ID NO: 4858634 - DNA, 19 bp, Homo sapiens
accccaagggggctgctgc

SEQ ID NO: 4858635 - DNA, 19 bp, Homo sapiens
accccaatatatgtatttt

SEQ ID NO: 4858636 - DNA, 18 bp, Homo sapiens
agagccatacataaaaga

SEQ ID NO: 4858637 - DNA, 13 bp, Homo sapiens
agagcccctactg

SEQ ID NO: 4858638 - DNA, 21 bp, Homo sapiens
agagcggggtcccctctgtgc

SEQ ID NO: 4858639 - DNA, 21 bp, Homo sapiens
agagctaaaaaggcccttaga

SEQ ID NO: 4858640 - DNA, 22 bp, Homo sapiens
agagctaaaaaggcccttagag

SEQ ID NO: 4858641 - DNA, 20 bp, Homo sapiens
agagctaggaaccctggagg

SEQ ID NO: 4858642 - DNA, 23 bp, Homo sapiens
agagctctcccctcctgctgggc

SEQ ID NO: 4858643 - DNA, 16 bp, Homo sapiens
agagctgctgcacaca

SEQ ID NO: 4858644 - DNA, 23 bp, Homo sapiens
agaggaccaatgcttgcatggag

SEQ ID NO: 4858645 - DNA, 19 bp, Homo sapiens
agaggactggttctgaggc

SEQ ID NO: 4858646 - DNA, 20 bp, Homo sapiens
agaggactggttctgaggcc

SEQ ID NO: 4858647 - DNA, 21 bp, Homo sapiens
agaggactggttctgaggcca

SEQ ID NO: 4858648 - DNA, 22 bp, Homo sapiens
agaggactggttctgaggccag

SEQ ID NO: 4858649 - DNA, 16 bp, Homo sapiens
agagggaaaaggcagg

SEQ ID NO: 4858650 - DNA, 16 bp, Homo sapiens
agagggaatctagccc

SEQ ID NO: 4858651 - DNA, 21 bp, Homo sapiens
agagggcgagggatgatgagg

SEQ ID NO: 4858652 - DNA, 18 bp, Homo sapiens
agaggtagcactctcaga

SEQ ID NO: 4858653 - DNA, 16 bp, Homo sapiens
agaggtattaaaacta

SEQ ID NO: 4858654 - DNA, 14 bp, Homo sapiens
agaggttaggagta

SEQ ID NO: 4858655 - DNA, 18 bp, Homo sapiens
agaggtttgaaggagaat

SEQ ID NO: 4858656 - DNA, 16 bp, Homo sapiens
agagtagctgcagcct

SEQ ID NO: 4858657 - DNA, 22 bp, Homo sapiens
agagtagctgcagccttcatca

SEQ ID NO: 4858658 - DNA, 16 bp, Homo sapiens
agagtagggccctgac

SEQ ID NO: 4858659 - DNA, 18 bp, Homo sapiens
agagtagggccctgacag

SEQ ID NO: 4858660 - DNA, 14 bp, Homo sapiens
agagtctgtctctt

SEQ ID NO: 4858661 - DNA, 20 bp, Homo sapiens
agagtgttttgaccagttta

SEQ ID NO: 4858662 - DNA, 20 bp, Homo sapiens
agagttcccttgaaactttg

SEQ ID NO: 4858663 - DNA, 20 bp, Homo sapiens
agagttccggggagaaaccc

SEQ ID NO: 4858664 - DNA, 18 bp, Homo sapiens
agagttctggatgtctgg

SEQ ID NO: 4858665 - DNA, 22 bp, Homo sapiens
agagttctggatgtctggctca

SEQ ID NO: 4858666 - DNA, 12 bp, Homo sapiens
agataaaatgta

SEQ ID NO: 4858667 - DNA, 17 bp, Homo sapiens
agataaagaccagaaat

SEQ ID NO: 4858668 - DNA, 15 bp, Homo sapiens
agatacctgtgagga

SEQ ID NO: 4858669 - DNA, 19 bp, Homo sapiens
agataccttatcttacaat

SEQ ID NO: 4858670 - DNA, 22 bp, Homo sapiens
agataccttatcttacaatatt

SEQ ID NO: 4858671 - DNA, 21 bp, Homo sapiens
agatagtcttggaagctgttt

SEQ ID NO: 4858672 - DNA, 15 bp, Homo sapiens
agatatgaaagctga

SEQ ID NO: 4858673 - DNA, 22 bp, Homo sapiens
agatatgggtgtttttaataaa

SEQ ID NO: 4858674 - DNA, 15 bp, Homo sapiens
agatatgtattcttt

SEQ ID NO: 4858675 - DNA, 13 bp, Homo sapiens
agatcaaagatga

SEQ ID NO: 4858676 - DNA, 13 bp, Homo sapiens
agatccagcccaa

SEQ ID NO: 4858677 - DNA, 21 bp, Homo sapiens
agatccagcccaaacctggga

SEQ ID NO: 4858678 - DNA, 18 bp, Homo sapiens
agatccatttccattgct

SEQ ID NO: 4858679 - DNA, 15 bp, Homo sapiens
agatcgcccccacct

SEQ ID NO: 4858680 - DNA, 13 bp, Homo sapiens
agatctttatatt

SEQ ID NO: 4858681 - DNA, 17 bp, Homo sapiens
agatctttcagaaatat

SEQ ID NO: 4858682 - DNA, 21 bp, Homo sapiens
agatctttcagaaatataaca

SEQ ID NO: 4858683 - DNA, 15 bp, Homo sapiens
agatgacctgcccca

SEQ ID NO: 4858684 - DNA, 16 bp, Homo sapiens
agatgacctgccccaa

SEQ ID NO: 4858685 - DNA, 18 bp, Homo sapiens
agatgaggagtaaaattc

SEQ ID NO: 4858686 - DNA, 15 bp, Homo sapiens
agatgaggctcagag

SEQ ID NO: 4858687 - DNA, 17 bp, Homo sapiens
agatgagggctggctgc

SEQ ID NO: 4858688 - DNA, 18 bp, Homo sapiens
agatgaggtcagttgtgt

SEQ ID NO: 4858689 - DNA, 15 bp, Homo sapiens
agatgattttttgaa

SEQ ID NO: 4858690 - DNA, 17 bp, Homo sapiens
agatgattttttgaaag

SEQ ID NO: 4858691 - DNA, 22 bp, Homo sapiens
agatgctacttcccactgtatg

SEQ ID NO: 4858692 - DNA, 22 bp, Homo sapiens
agatgcttgcggcaaaaggaaa

SEQ ID NO: 4858693 - DNA, 22 bp, Homo sapiens
agatggagcccataggccaccc

SEQ ID NO: 4858694 - DNA, 16 bp, Homo sapiens
agatggcgatgtgtta

SEQ ID NO: 4858695 - DNA, 13 bp, Homo sapiens
agatgtactgcaa

SEQ ID NO: 4858696 - DNA, 14 bp, Homo sapiens
agatgtgcagtttg

SEQ ID NO: 4858697 - DNA, 17 bp, Homo sapiens
agattgactaactcaaa

SEQ ID NO: 4858698 - DNA, 12 bp, Homo sapiens
agattgagaaat

SEQ ID NO: 4858699 - DNA, 16 bp, Homo sapiens
agattgagaaatgtgt

SEQ ID NO: 4858700 - DNA, 17 bp, Homo sapiens
agattgagaaatgtgta

SEQ ID NO: 4858701 - DNA, 17 bp, Homo sapiens
agattgtattaactatc

SEQ ID NO: 4858702 - DNA, 16 bp, Homo sapiens
agatttctcattgact

SEQ ID NO: 4858703 - DNA, 18 bp, Homo sapiens
agatttgggtcatttaga

SEQ ID NO: 4858704 - DNA, 14 bp, Homo sapiens
agcaaattccagat

SEQ ID NO: 4858705 - DNA, 16 bp, Homo sapiens
agcaaattccagattt

SEQ ID NO: 4858706 - DNA, 19 bp, Homo sapiens
agcaacccttcctgctgct

SEQ ID NO: 4858707 - DNA, 15 bp, Homo sapiens
agcaagcaccaacct

SEQ ID NO: 4858708 - DNA, 21 bp, Homo sapiens
agcaagcaccaacctccagac

SEQ ID NO: 4858709 - DNA, 15 bp, Homo sapiens
agcaaggcagagcct

SEQ ID NO: 4858710 - DNA, 12 bp, Homo sapiens
agcaagtgagca

SEQ ID NO: 4858711 - DNA, 16 bp, Homo sapiens
agcaagtgagcagaga

SEQ ID NO: 4858712 - DNA, 19 bp, Homo sapiens
agcaagtgtgcactccagc

SEQ ID NO: 4858713 - DNA, 23 bp, Homo sapiens
agcaataggtagctggggagccc

SEQ ID NO: 4858714 - DNA, 22 bp, Homo sapiens
agcaattgcgaccttaatttaa

SEQ ID NO: 4858715 - DNA, 13 bp, Homo sapiens
agcaatttactga

SEQ ID NO: 4858716 - DNA, 22 bp, Homo sapiens
agcaatttactgatgagagaat

SEQ ID NO: 4858717 - DNA, 20 bp, Homo sapiens
agcacaaaattcaaagcatg

SEQ ID NO: 4858718 - DNA, 22 bp, Homo sapiens
agcacaaaattcaaagcatgga

SEQ ID NO: 4858719 - DNA, 13 bp, Homo sapiens
agcacaaagaaga

SEQ ID NO: 4858720 - DNA, 18 bp, Homo sapiens
agcacaaagaagaaagct

SEQ ID NO: 4858721 - DNA, 14 bp, Homo sapiens
agcacaaagcactg

SEQ ID NO: 4858722 - DNA, 17 bp, Homo sapiens
agcacaagactggccca

SEQ ID NO: 4858723 - DNA, 15 bp, Homo sapiens
agcaccaacctccag

SEQ ID NO: 4858724 - DNA, 16 bp, Homo sapiens
agcaccaacctccaga

SEQ ID NO: 4858725 - DNA, 17 bp, Homo sapiens
agcactagccttcccag

SEQ ID NO: 4858726 - DNA, 16 bp, Homo sapiens
agcactcctgcttaat

SEQ ID NO: 4858727 - DNA, 14 bp, Homo sapiens
agcactggccttgc

SEQ ID NO: 4858728 - DNA, 16 bp, Homo sapiens
agcactggccttgcct

SEQ ID NO: 4858729 - DNA, 21 bp, Homo sapiens
agcactggccttgcctccagg

SEQ ID NO: 4858730 - DNA, 22 bp, Homo sapiens
agcagaaaccaacaagaaccac

SEQ ID NO: 4858731 - DNA, 22 bp, Homo sapiens
agcagaaccttctttggttcca

SEQ ID NO: 4858732 - DNA, 22 bp, Homo sapiens
agcagagcggggtcccctctgt

SEQ ID NO: 4858733 - DNA, 14 bp, Homo sapiens
agcagagttaaatc

SEQ ID NO: 4858734 - DNA, 13 bp, Homo sapiens
agcagagttttca

SEQ ID NO: 4858735 - DNA, 15 bp, Homo sapiens
agcagagttttcatt

SEQ ID NO: 4858736 - DNA, 23 bp, Homo sapiens
agcagagttttcattaaatcctt

SEQ ID NO: 4858737 - DNA, 18 bp, Homo sapiens
agcagatctgttttgtgg

SEQ ID NO: 4858738 - DNA, 12 bp, Homo sapiens
agcagcaggcct

SEQ ID NO: 4858739 - DNA, 14 bp, Homo sapiens
agcagccccaggag

SEQ ID NO: 4858740 - DNA, 16 bp, Homo sapiens
agcagccccaggagaa

SEQ ID NO: 4858741 - DNA, 19 bp, Homo sapiens
agcagcggattgctctgga

SEQ ID NO: 4858742 - DNA, 15 bp, Homo sapiens
agcaggccagagaaa

SEQ ID NO: 4858743 - DNA, 16 bp, Homo sapiens
agcaggcctctgggac

SEQ ID NO: 4858744 - DNA, 20 bp, Homo sapiens
agcaggcctctgggacccac

SEQ ID NO: 4858745 - DNA, 21 bp, Homo sapiens
agcaggcctctgggacccaca

SEQ ID NO: 4858746 - DNA, 16 bp, Homo sapiens
agcagtatattagtat

SEQ ID NO: 4858747 - DNA, 11 bp, Homo sapiens
agcagtatttt

SEQ ID NO: 4858748 - DNA, 19 bp, Homo sapiens
agcagtgttacttgcaggt

SEQ ID NO: 4858749 - DNA, 20 bp, Homo sapiens
agcagtgttacttgcaggta

SEQ ID NO: 4858750 - DNA, 23 bp, Homo sapiens
agcagttcctgtcccacatggcc

SEQ ID NO: 4858751 - DNA, 13 bp, Homo sapiens
agcataaagctca

SEQ ID NO: 4858752 - DNA, 17 bp, Homo sapiens
agcatagagaacaaagt

SEQ ID NO: 4858753 - DNA, 16 bp, Homo sapiens
agcataggctggggac

SEQ ID NO: 4858754 - DNA, 17 bp, Homo sapiens
agcataggctggggaca

SEQ ID NO: 4858755 - DNA, 16 bp, Homo sapiens
agcatccaccccaccc

SEQ ID NO: 4858756 - DNA, 18 bp, Homo sapiens
agtataatgtttattaaa

SEQ ID NO: 4858757 - DNA, 22 bp, Homo sapiens
agtatattgttgaagagacaga

SEQ ID NO: 4858758 - DNA, 20 bp, Homo sapiens
agtatgtatattaaaaaaga

SEQ ID NO: 4858759 - DNA, 22 bp, Homo sapiens
agtatgtgctatacacacacac

SEQ ID NO: 4858760 - DNA, 22 bp, Homo sapiens
agtattcctttatacacagtgg

SEQ ID NO: 4858761 - DNA, 14 bp, Homo sapiens
agtattgtttaaaa

SEQ ID NO: 4858762 - DNA, 15 bp, Homo sapiens
agtcacactgtggcc

SEQ ID NO: 4858763 - DNA, 17 bp, Homo sapiens
agtcactgctgcaaggt

SEQ ID NO: 4858764 - DNA, 19 bp, Homo sapiens
agtcagaatttttaactgt

SEQ ID NO: 4858765 - DNA, 15 bp, Homo sapiens
agtcagacatttctt

SEQ ID NO: 4858766 - DNA, 13 bp, Homo sapiens
agtcagactgaaa

SEQ ID NO: 4858767 - DNA, 14 bp, Homo sapiens
agtcagatgaggca

SEQ ID NO: 4858768 - DNA, 16 bp, Homo sapiens
agtcaggctgcagagg

SEQ ID NO: 4858769 - DNA, 14 bp, Homo sapiens
agtcattaaagaca

SEQ ID NO: 4858770 - DNA, 22 bp, Homo sapiens
agtcattggcaaagtgacaaag

SEQ ID NO: 4858771 - DNA, 14 bp, Homo sapiens
agtccactcccagt

SEQ ID NO: 4858772 - DNA, 20 bp, Homo sapiens
agtccgcagttgtagcagaa

SEQ ID NO: 4858773 - DNA, 13 bp, Homo sapiens
agtcctaacaaat

SEQ ID NO: 4858774 - DNA, 17 bp, Homo sapiens
agtcgcagaccagagct

SEQ ID NO: 4858775 - DNA, 22 bp, Homo sapiens
agtcgcagaccagagctgtctg

SEQ ID NO: 4858776 - DNA, 18 bp, Homo sapiens
agtcgccagtcactgctg

SEQ ID NO: 4858777 - DNA, 19 bp, Homo sapiens
agtctcataggttaaaaaa

SEQ ID NO: 4858778 - DNA, 15 bp, Homo sapiens
agtctctgaatttgt

SEQ ID NO: 4858779 - DNA, 20 bp, Homo sapiens
agtctctgccagttacttgg

SEQ ID NO: 4858780 - DNA, 19 bp, Homo sapiens
agtctggagtgggatagga

SEQ ID NO: 4858781 - DNA, 19 bp, Homo sapiens
agtctgtctcttggctttg

SEQ ID NO: 4858782 - DNA, 10 bp, Homo sapiens
agtcttccta

SEQ ID NO: 4858783 - DNA, 16 bp, Homo sapiens
agtcttggaagctgtt

SEQ ID NO: 4858784 - DNA, 17 bp, Homo sapiens
agtctttcatggctgct

SEQ ID NO: 4858785 - DNA, 21 bp, Homo sapiens
agtctttcttcactctggctt

SEQ ID NO: 4858786 - DNA, 23 bp, Homo sapiens
agtctttcttcactctggcttca

SEQ ID NO: 4858787 - DNA, 13 bp, Homo sapiens
agtgaataaatgt

SEQ ID NO: 4858788 - DNA, 12 bp, Homo sapiens
agtgaattgaag

SEQ ID NO: 4858789 - DNA, 15 bp, Homo sapiens
agtgacaaagcaatt

SEQ ID NO: 4858790 - DNA, 17 bp, Homo sapiens
agtgacaaagcctctga

SEQ ID NO: 4858791 - DNA, 23 bp, Homo sapiens
agtgacaaagcctctgaaagatg

SEQ ID NO: 4858792 - DNA, 16 bp, Homo sapiens
agtgacatttaatgcc

SEQ ID NO: 4858793 - DNA, 15 bp, Homo sapiens
agtgaccagtgcctg

SEQ ID NO: 4858794 - DNA, 16 bp, Homo sapiens
agtgaccagtgcctgt

SEQ ID NO: 4858795 - DNA, 12 bp, Homo sapiens
agtgactccagg

SEQ ID NO: 4858796 - DNA, 16 bp, Homo sapiens
agtgagcagagatgta

SEQ ID NO: 4858797 - DNA, 21 bp, Homo sapiens
agtgatgtccttaaaatgtgg

SEQ ID NO: 4858798 - DNA, 17 bp, Homo sapiens
agtgcaacatctctgaa

SEQ ID NO: 4858799 - DNA, 18 bp, Homo sapiens
agtgcaacatctctgaat

SEQ ID NO: 4858800 - DNA, 22 bp, Homo sapiens
agtgcatagttgtagacaaagt

SEQ ID NO: 4858801 - DNA, 16 bp, Homo sapiens
agtgcatgaaaaacca

SEQ ID NO: 4858802 - DNA, 17 bp, Homo sapiens
agtgccactgttgtttt

SEQ ID NO: 4858803 - DNA, 13 bp, Homo sapiens
agtgcctgggctc

SEQ ID NO: 4858804 - DNA, 19 bp, Homo sapiens
agtgcctgtgagcatgggg

SEQ ID NO: 4858805 - DNA, 23 bp, Homo sapiens
agtgcctgtgagcatggggccag

SEQ ID NO: 4858806 - DNA, 19 bp, Homo sapiens
agtgcggtttactcactgc

SEQ ID NO: 4858807 - DNA, 14 bp, Homo sapiens
agtgctcttcccac

SEQ ID NO: 4858808 - DNA, 12 bp, Homo sapiens
agtgctgctgtg

SEQ ID NO: 4858809 - DNA, 15 bp, Homo sapiens
agtgctgctgtggag

SEQ ID NO: 4858810 - DNA, 22 bp, Homo sapiens
agtggaagtatgtatattaaaa

SEQ ID NO: 4858811 - DNA, 21 bp, Homo sapiens
agtggacgttaggccaggcct

SEQ ID NO: 4858812 - DNA, 16 bp, Homo sapiens
agtggatcacaaagtg

SEQ ID NO: 4858813 - DNA, 23 bp, Homo sapiens
agtgggaagggagcattgcagcc

SEQ ID NO: 4858814 - DNA, 20 bp, Homo sapiens
agtgggaatgttctttctgc

SEQ ID NO: 4858815 - DNA, 16 bp, Homo sapiens
agtgggctttggtggc

SEQ ID NO: 4858816 - DNA, 17 bp, Homo sapiens
agtggtatggggctgag

SEQ ID NO: 4858817 - DNA, 15 bp, Homo sapiens
agtggtgagcaagca

SEQ ID NO: 4858818 - DNA, 22 bp, Homo sapiens
agtggtgatttgaaaaatataa

SEQ ID NO: 4858819 - DNA, 16 bp, Homo sapiens
agtggtgtttattgca

SEQ ID NO: 4858820 - DNA, 15 bp, Homo sapiens
agtgtagctgtgaaa

SEQ ID NO: 4858821 - DNA, 16 bp, Homo sapiens
agtgtagtcccggagg

SEQ ID NO: 4858822 - DNA, 17 bp, Homo sapiens
agtgtcggatcctgtga

SEQ ID NO: 4858823 - DNA, 19 bp, Homo sapiens
agtgtcggatcctgtgagt

SEQ ID NO: 4858824 - DNA, 21 bp, Homo sapiens
agtgtctaggcactgagcagg

SEQ ID NO: 4858825 - DNA, 22 bp, Homo sapiens
agtgtctgtgttttgaaagaat

SEQ ID NO: 4858826 - DNA, 16 bp, Homo sapiens
agtgtgaaatatatta

SEQ ID NO: 4858827 - DNA, 12 bp, Homo sapiens
agtgtgactcct

SEQ ID NO: 4858828 - DNA, 17 bp, Homo sapiens
agtgtgagatactgtgt

SEQ ID NO: 4858829 - DNA, 17 bp, Homo sapiens
agtgtgcagacagccat

SEQ ID NO: 4858830 - DNA, 14 bp, Homo sapiens
agtgtgctaaaaat

SEQ ID NO: 4858831 - DNA, 23 bp, Homo sapiens
agtgtgtatatattttgtgtgaa

SEQ ID NO: 4858832 - DNA, 19 bp, Homo sapiens
agtgtgtggtcaacatttc

SEQ ID NO: 4858833 - DNA, 18 bp, Homo sapiens
agtgttatttattcccca

SEQ ID NO: 4858834 - DNA, 23 bp, Homo sapiens
agtgttatttattccccagtgac

SEQ ID NO: 4858835 - DNA, 21 bp, Homo sapiens
agtgttggtatattttatatt

SEQ ID NO: 4858836 - DNA, 11 bp, Homo sapiens
agtgttgtcca

SEQ ID NO: 4858837 - DNA, 14 bp, Homo sapiens
agttaaatctcaaa

SEQ ID NO: 4858838 - DNA, 14 bp, Homo sapiens
agttagtggaaatc

SEQ ID NO: 4858839 - DNA, 17 bp, Homo sapiens
agttagtggaaatctga

SEQ ID NO: 4858840 - DNA, 12 bp, Homo sapiens
agttataagaag

SEQ ID NO: 4858841 - DNA, 14 bp, Homo sapiens
agttataagaagaa

SEQ ID NO: 4858842 - DNA, 13 bp, Homo sapiens
agttcccagagtg

SEQ ID NO: 4858843 - DNA, 14 bp, Homo sapiens
agttcccagagtgg

SEQ ID NO: 4858844 - DNA, 18 bp, Homo sapiens
agttcccagagtgggctt

SEQ ID NO: 4858845 - DNA, 17 bp, Homo sapiens
agttcccttgaaacttt

SEQ ID NO: 4858846 - DNA, 14 bp, Homo sapiens
agttccggggagaa

SEQ ID NO: 4858847 - DNA, 15 bp, Homo sapiens
agttccggggagaaa

SEQ ID NO: 4858848 - DNA, 18 bp, Homo sapiens
agttccggggagaaaccc

SEQ ID NO: 4858849 - DNA, 19 bp, Homo sapiens
agttctcaaatgtgtgtgg

SEQ ID NO: 4858850 - DNA, 15 bp, Homo sapiens
agttctggatgtctg

SEQ ID NO: 4858851 - DNA, 19 bp, Homo sapiens
agttctggatgtctggctc

SEQ ID NO: 4858852 - DNA, 22 bp, Homo sapiens
agttctttggattctaaataca

SEQ ID NO: 4858853 - DNA, 19 bp, Homo sapiens
agttgaagttagtggaaat

SEQ ID NO: 4858854 - DNA, 22 bp, Homo sapiens
agttgaagttagtggaaatctg

SEQ ID NO: 4858855 - DNA, 23 bp, Homo sapiens
agttgcacttattgaccattttt

SEQ ID NO: 4858856 - DNA, 14 bp, Homo sapiens
agttgcattttaac

SEQ ID NO: 4858857 - DNA, 23 bp, Homo sapiens
agttgcattttaaccctatttta

SEQ ID NO: 4858858 - DNA, 23 bp, Homo sapiens
agttgcccccattcccagcctga

SEQ ID NO: 4858859 - DNA, 14 bp, Homo sapiens
agttggactctcag

SEQ ID NO: 4858860 - DNA, 15 bp, Homo sapiens
agttggactctcagg

SEQ ID NO: 4858861 - DNA, 16 bp, Homo sapiens
agttgtagacaaagta

SEQ ID NO: 4858862 - DNA, 18 bp, Homo sapiens
agttgtagacaaagtaca

SEQ ID NO: 4858863 - DNA, 17 bp, Homo sapiens
agttgtagcagaaacca

SEQ ID NO: 4858864 - DNA, 17 bp, Homo sapiens
agttgtgttttttaaga

SEQ ID NO: 4858865 - DNA, 17 bp, Homo sapiens
agttgttatttattgaa

SEQ ID NO: 4858866 - DNA, 23 bp, Homo sapiens
agtttcagcggtgccaacctctt

SEQ ID NO: 4858867 - DNA, 13 bp, Homo sapiens
agtttcttgcttg

SEQ ID NO: 4858868 - DNA, 20 bp, Homo sapiens
agtttgctgtgctttggaac

SEQ ID NO: 4858869 - DNA, 15 bp, Homo sapiens
agttttacagtgttt

SEQ ID NO: 4858870 - DNA, 23 bp, Homo sapiens
agttttactgtctattaatattc

SEQ ID NO: 4858871 - DNA, 15 bp, Homo sapiens
agttttatatgcttt

SEQ ID NO: 4858872 - DNA, 15 bp, Homo sapiens
agttttcattaaatc

SEQ ID NO: 4858873 - DNA, 22 bp, Homo sapiens
agttttcggaaacactgactta

SEQ ID NO: 4858874 - DNA, 13 bp, Homo sapiens
agttttgttgtac

SEQ ID NO: 4858875 - DNA, 18 bp, Homo sapiens
agttttgttgtacttaaa

SEQ ID NO: 4858876 - DNA, 20 bp, Homo sapiens
atctttgtaccaaaatttta

SEQ ID NO: 4858877 - DNA, 13 bp, Homo sapiens
atcttttcttatt

SEQ ID NO: 4858878 - DNA, 21 bp, Homo sapiens
atcttttttagtgttaaagag

SEQ ID NO: 4858879 - DNA, 22 bp, Homo sapiens
atgaaaataactgaatttggag

SEQ ID NO: 4858880 - DNA, 12 bp, Homo sapiens
atgaaaatggaa

SEQ ID NO: 4858881 - DNA, 15 bp, Homo sapiens
atgaaacttctcagt

SEQ ID NO: 4858882 - DNA, 16 bp, Homo sapiens
atgaaataaaatatat

SEQ ID NO: 4858883 - DNA, 15 bp, Homo sapiens
atgaaccataaattc

SEQ ID NO: 4858884 - DNA, 15 bp, Homo sapiens
atgaacctgaaaagg

SEQ ID NO: 4858885 - DNA, 13 bp, Homo sapiens
atgaactttgtca

SEQ ID NO: 4858886 - DNA, 20 bp, Homo sapiens
atgaactttgtcagtgttgc

SEQ ID NO: 4858887 - DNA, 15 bp, Homo sapiens
atgaagcagaacctt

SEQ ID NO: 4858888 - DNA, 13 bp, Homo sapiens
atgaagcagtatt

SEQ ID NO: 4858889 - DNA, 13 bp, Homo sapiens
atgaataatggaa

SEQ ID NO: 4858890 - DNA, 16 bp, Homo sapiens
atgaatgcttttagtg

SEQ ID NO: 4858891 - DNA, 14 bp, Homo sapiens
atgacaagctgtat

SEQ ID NO: 4858892 - DNA, 16 bp, Homo sapiens
atgacaagctgtatca

SEQ ID NO: 4858893 - DNA, 19 bp, Homo sapiens
atgacaagctgtatcactg

SEQ ID NO: 4858894 - DNA, 17 bp, Homo sapiens
atgacagtgttccccga

SEQ ID NO: 4858895 - DNA, 11 bp, Homo sapiens
atgacctccag

SEQ ID NO: 4858896 - DNA, 16 bp, Homo sapiens
atgacctccagaagtc

SEQ ID NO: 4858897 - DNA, 11 bp, Homo sapiens
atgacctgccc

SEQ ID NO: 4858898 - DNA, 22 bp, Homo sapiens
atgactatgcgtggctggaacc

SEQ ID NO: 4858899 - DNA, 14 bp, Homo sapiens
atgactcaaagtct

SEQ ID NO: 4858900 - DNA, 18 bp, Homo sapiens
atgagagaatgtggaaat

SEQ ID NO: 4858901 - DNA, 17 bp, Homo sapiens
atgagagtagggccctg

SEQ ID NO: 4858902 - DNA, 18 bp, Homo sapiens
atgagagtagggccctga

SEQ ID NO: 4858903 - DNA, 19 bp, Homo sapiens
atgagctctgaaatcttcc

SEQ ID NO: 4858904 - DNA, 21 bp, Homo sapiens
atgaggaaaattcttaaaagg

SEQ ID NO: 4858905 - DNA, 17 bp, Homo sapiens
atgaggacccagagctg

SEQ ID NO: 4858906 - DNA, 23 bp, Homo sapiens
atgaggatccagggcagcaggcc

SEQ ID NO: 4858907 - DNA, 14 bp, Homo sapiens
atgaggcaaacagc

SEQ ID NO: 4858908 - DNA, 15 bp, Homo sapiens
atgaggcaaacagca

SEQ ID NO: 4858909 - DNA, 13 bp, Homo sapiens
atgaggctcagag

SEQ ID NO: 4858910 - DNA, 15 bp, Homo sapiens
atgagggaagcaata

SEQ ID NO: 4858911 - DNA, 11 bp, Homo sapiens
atgagggccac

SEQ ID NO: 4858912 - DNA, 15 bp, Homo sapiens
atgagtgaataaatg

SEQ ID NO: 4858913 - DNA, 16 bp, Homo sapiens
atgagtttcactgtac

SEQ ID NO: 4858914 - DNA, 14 bp, Homo sapiens
atgataaaggaaat

SEQ ID NO: 4858915 - DNA, 15 bp, Homo sapiens
atgataaaggaaata

SEQ ID NO: 4858916 - DNA, 16 bp, Homo sapiens
atgatcagcaaaaaga

SEQ ID NO: 4858917 - DNA, 13 bp, Homo sapiens
atgatgagggaag

SEQ ID NO: 4858918 - DNA, 16 bp, Homo sapiens
atgatgctttggaaga

SEQ ID NO: 4858919 - DNA, 19 bp, Homo sapiens
atgatttccctccagagaa

SEQ ID NO: 4858920 - DNA, 22 bp, Homo sapiens
atgatttccctccagagaaagc

SEQ ID NO: 4858921 - DNA, 14 bp, Homo sapiens
atgatttggggtga

SEQ ID NO: 4858922 - DNA, 17 bp, Homo sapiens
atgattttttgaaagtt

SEQ ID NO: 4858923 - DNA, 23 bp, Homo sapiens
atgcaaatagattcagagaaatt

SEQ ID NO: 4858924 - DNA, 14 bp, Homo sapiens
atgcaaatgagctc

SEQ ID NO: 4858925 - DNA, 20 bp, Homo sapiens
atgcaaatgagctctgaaat

SEQ ID NO: 4858926 - DNA, 11 bp, Homo sapiens
atgcagaaata

SEQ ID NO: 4858927 - DNA, 20 bp, Homo sapiens
atgcagaaatagacaaaaag

SEQ ID NO: 4858928 - DNA, 22 bp, Homo sapiens
atgcagaaatagacaaaaagta

SEQ ID NO: 4858929 - DNA, 13 bp, Homo sapiens
atgcagaagcaat

SEQ ID NO: 4858930 - DNA, 14 bp, Homo sapiens
atgcagctttgcaa

SEQ ID NO: 4858931 - DNA, 19 bp, Homo sapiens
atgcagttagctgaagaat

SEQ ID NO: 4858932 - DNA, 19 bp, Homo sapiens
atgcatataatgaataaat

SEQ ID NO: 4858933 - DNA, 21 bp, Homo sapiens
atgcatataatgaataaatca

SEQ ID NO: 4858934 - DNA, 21 bp, Homo sapiens
atgcatatttgcaaagtgtat

SEQ ID NO: 4858935 - DNA, 17 bp, Homo sapiens
atgcatttaataaagat

SEQ ID NO: 4858936 - DNA, 18 bp, Homo sapiens
atgccaataaagtgatct

SEQ ID NO: 4858937 - DNA, 13 bp, Homo sapiens
atgccagtatttt

SEQ ID NO: 4858938 - DNA, 20 bp, Homo sapiens
atgccagtatttttaaaggc

SEQ ID NO: 4858939 - DNA, 20 bp, Homo sapiens
atgcccagcccctggtggtg

SEQ ID NO: 4858940 - DNA, 21 bp, Homo sapiens
atgcctatggtggatccaaac

SEQ ID NO: 4858941 - DNA, 18 bp, Homo sapiens
atgcctgctttttggaaa

SEQ ID NO: 4858942 - DNA, 23 bp, Homo sapiens
atgcctgctttttggaaagtcag

SEQ ID NO: 4858943 - DNA, 15 bp, Homo sapiens
atgctaaatgtgtaa

SEQ ID NO: 4858944 - DNA, 16 bp, Homo sapiens
atgctaaatgtgtaat

SEQ ID NO: 4858945 - DNA, 14 bp, Homo sapiens
atgctaacatctaa

SEQ ID NO: 4858946 - DNA, 17 bp, Homo sapiens
atgctaacatctaaaaa

SEQ ID NO: 4858947 - DNA, 18 bp, Homo sapiens
atgctacttcccactgta

SEQ ID NO: 4858948 - DNA, 19 bp, Homo sapiens
atgctacttcccactgtat

SEQ ID NO: 4858949 - DNA, 20 bp, Homo sapiens
atgctcccacctgaatttgt

SEQ ID NO: 4858950 - DNA, 13 bp, Homo sapiens
atgctcctcacct

SEQ ID NO: 4858951 - DNA, 20 bp, Homo sapiens
atgctcctcacctgtctagg

SEQ ID NO: 4858952 - DNA, 14 bp, Homo sapiens
atgctgcctcagga

SEQ ID NO: 4858953 - DNA, 22 bp, Homo sapiens
atgctgcctcaggacccatccc

SEQ ID NO: 4858954 - DNA, 22 bp, Homo sapiens
atgctgctcccctaaagccagg

SEQ ID NO: 4858955 - DNA, 23 bp, Homo sapiens
atgctgctcccctaaagccaggc

SEQ ID NO: 4858956 - DNA, 12 bp, Homo sapiens
atgctggctggg

SEQ ID NO: 4858957 - DNA, 13 bp, Homo sapiens
atgcttaaatttt

SEQ ID NO: 4858958 - DNA, 16 bp, Homo sapiens
atgcttcatttgtatg

SEQ ID NO: 4858959 - DNA, 20 bp, Homo sapiens
atgcttgcatggagaatggg

SEQ ID NO: 4858960 - DNA, 18 bp, Homo sapiens
atgcttgcggcaaaagga

SEQ ID NO: 4858961 - DNA, 20 bp, Homo sapiens
atgcttgcggcaaaaggaaa

SEQ ID NO: 4858962 - DNA, 19 bp, Homo sapiens
atgctttattaatgttttc

SEQ ID NO: 4858963 - DNA, 20 bp, Homo sapiens
atggaaaatgccatgaatta

SEQ ID NO: 4858964 - DNA, 12 bp, Homo sapiens
atggaagaaagt

SEQ ID NO: 4858965 - DNA, 14 bp, Homo sapiens
atggaagaaagtaa

SEQ ID NO: 4858966 - DNA, 17 bp, Homo sapiens
atggacatttagaagaa

SEQ ID NO: 4858967 - DNA, 18 bp, Homo sapiens
atggacatttagaagaaa

SEQ ID NO: 4858968 - DNA, 21 bp, Homo sapiens
atggagcccataggccacccc

SEQ ID NO: 4858969 - DNA, 16 bp, Homo sapiens
atggagggaagacctg

SEQ ID NO: 4858970 - DNA, 22 bp, Homo sapiens
atggaggggatgataaaggaaa

SEQ ID NO: 4858971 - DNA, 22 bp, Homo sapiens
atggcatccctttttcataaat

SEQ ID NO: 4858972 - DNA, 15 bp, Homo sapiens
atggcatggcaggag

SEQ ID NO: 4858973 - DNA, 12 bp, Homo sapiens
atggcctggagc

SEQ ID NO: 4858974 - DNA, 13 bp, Homo sapiens
atggcctggagca

SEQ ID NO: 4858975 - DNA, 15 bp, Homo sapiens
atggcctggagcagg

SEQ ID NO: 4858976 - DNA, 18 bp, Homo sapiens
atggcctggagcaggccc

SEQ ID NO: 4858977 - DNA, 15 bp, Homo sapiens
atggctgaagctgga

SEQ ID NO: 4858978 - DNA, 17 bp, Homo sapiens
atgggagacccttgaca

SEQ ID NO: 4858979 - DNA, 17 bp, Homo sapiens
atgggattagaaacaaa

SEQ ID NO: 4858980 - DNA, 13 bp, Homo sapiens
atgggctgtgatt

SEQ ID NO: 4858981 - DNA, 22 bp, Homo sapiens
atgggcttttggggagccagaa

SEQ ID NO: 4858982 - DNA, 16 bp, Homo sapiens
atggggaggcagcaga

SEQ ID NO: 4858983 - DNA, 18 bp, Homo sapiens
atgggggagattgaactt

SEQ ID NO: 4858984 - DNA, 19 bp, Homo sapiens
atgggggagattgaacttt

SEQ ID NO: 4858985 - DNA, 23 bp, Homo sapiens
atggggtgagaagtacagggcag

SEQ ID NO: 4858986 - DNA, 23 bp, Homo sapiens
atgggtgccctttcctggcagtc

SEQ ID NO: 4858987 - DNA, 13 bp, Homo sapiens
atggtaagagaaa

SEQ ID NO: 4858988 - DNA, 21 bp, Homo sapiens
atggtagttttacagtgtttc

SEQ ID NO: 4858989 - DNA, 23 bp, Homo sapiens
atggtcctatttttgtgaagagg

SEQ ID NO: 4858990 - DNA, 18 bp, Homo sapiens
atggtgtggtgaatgtgt

SEQ ID NO: 4858991 - DNA, 19 bp, Homo sapiens
atggtgtggtgaatgtgtg

SEQ ID NO: 4858992 - DNA, 21 bp, Homo sapiens
atggttaatttttcctgcatg

SEQ ID NO: 4858993 - DNA, 19 bp, Homo sapiens
atggtttattctttgcaaa

SEQ ID NO: 4858994 - DNA, 12 bp, Homo sapiens
atgtaacatgat

SEQ ID NO: 4858995 - DNA, 13 bp, Homo sapiens
atgtaatttaaat

SEQ ID NO: 4858996 - DNA, 16 bp, Homo sapiens
atgtaatttaaatgaa

SEQ ID NO: 4858997 - DNA, 18 bp, Homo sapiens
atttttttaactgtgata

SEQ ID NO: 4858998 - DNA, 15 bp, Homo sapiens
atttttttagattga

SEQ ID NO: 4858999 - DNA, 23 bp, Homo sapiens
atttttttgcatgcatgcaaatg

SEQ ID NO: 4859000 - DNA, 11 bp, Homo sapiens
caaaaagccac

SEQ ID NO: 4859001 - DNA, 14 bp, Homo sapiens
caaaaagccacagc

SEQ ID NO: 4859002 - DNA, 16 bp, Homo sapiens
caaaacaaaaagatgt

SEQ ID NO: 4859003 - DNA, 14 bp, Homo sapiens
caaaacaatggtgt

SEQ ID NO: 4859004 - DNA, 17 bp, Homo sapiens
caaaactccaggcagga

SEQ ID NO: 4859005 - DNA, 14 bp, Homo sapiens
caaaagacactgca

SEQ ID NO: 4859006 - DNA, 20 bp, Homo sapiens
caaaaggaaagctgtgttta

SEQ ID NO: 4859007 - DNA, 15 bp, Homo sapiens
caaaaggaggtgaaa

SEQ ID NO: 4859008 - DNA, 14 bp, Homo sapiens
caaaataataaaaa

SEQ ID NO: 4859009 - DNA, 20 bp, Homo sapiens
caaaatatattttgtttaca

SEQ ID NO: 4859010 - DNA, 21 bp, Homo sapiens
caaaattagatcctaagatgt

SEQ ID NO: 4859011 - DNA, 16 bp, Homo sapiens
caaaattttaaaaaag

SEQ ID NO: 4859012 - DNA, 19 bp, Homo sapiens
caaacaagccccctgccct

SEQ ID NO: 4859013 - DNA, 22 bp, Homo sapiens
caaacagaattttccatttatt

SEQ ID NO: 4859014 - DNA, 17 bp, Homo sapiens
caaacctgggaaggcca

SEQ ID NO: 4859015 - DNA, 14 bp, Homo sapiens
caaacctttgagta

SEQ ID NO: 4859016 - DNA, 18 bp, Homo sapiens
caaagaaaatgaaatgca

SEQ ID NO: 4859017 - DNA, 15 bp, Homo sapiens
caaagaagaaagctg

SEQ ID NO: 4859018 - DNA, 13 bp, Homo sapiens
caaagaatagact

SEQ ID NO: 4859019 - DNA, 22 bp, Homo sapiens
caaagagaaagagtttgaaact

SEQ ID NO: 4859020 - DNA, 17 bp, Homo sapiens
caaagcaaatgttggga

SEQ ID NO: 4859021 - DNA, 15 bp, Homo sapiens
caaagcactggcctt

SEQ ID NO: 4859022 - DNA, 13 bp, Homo sapiens
caaagcagcagga

SEQ ID NO: 4859023 - DNA, 24 bp, Homo sapiens
caaagcatggacatttagaagaaa

SEQ ID NO: 4859024 - DNA, 16 bp, Homo sapiens
caaagccggcctgaga

SEQ ID NO: 4859025 - DNA, 19 bp, Homo sapiens
caaagccggcctgagaaac

SEQ ID NO: 4859026 - DNA, 13 bp, Homo sapiens
caaagctgttcca

SEQ ID NO: 4859027 - DNA, 14 bp, Homo sapiens
caaaggtgcactcc

SEQ ID NO: 4859028 - DNA, 17 bp, Homo sapiens
caaaggtgcactccaga

SEQ ID NO: 4859029 - DNA, 18 bp, Homo sapiens
caaagtaaaagtagtgtt

SEQ ID NO: 4859030 - DNA, 17 bp, Homo sapiens
caaagtcattaaagaca

SEQ ID NO: 4859031 - DNA, 16 bp, Homo sapiens
caaagtcctcctttca

SEQ ID NO: 4859032 - DNA, 20 bp, Homo sapiens
caaagtcgccagtcactgct

SEQ ID NO: 4859033 - DNA, 21 bp, Homo sapiens
caaagtgatagaaaagtgtgg

SEQ ID NO: 4859034 - DNA, 22 bp, Homo sapiens
caaagtgcctgggctcagcctg

SEQ ID NO: 4859035 - DNA, 17 bp, Homo sapiens
caaagttaaaattgtta

SEQ ID NO: 4859036 - DNA, 16 bp, Homo sapiens
caaagtttcagagtat

SEQ ID NO: 4859037 - DNA, 18 bp, Homo sapiens
caaagtttcagagtatat

SEQ ID NO: 4859038 - DNA, 20 bp, Homo sapiens
caaagtttcagagtatattg

SEQ ID NO: 4859039 - DNA, 22 bp, Homo sapiens
caaagttttgttgtacttaaat

SEQ ID NO: 4859040 - DNA, 17 bp, Homo sapiens
caaataatttgaacttt

SEQ ID NO: 4859041 - DNA, 18 bp, Homo sapiens
caaataatttgaactttg

SEQ ID NO: 4859042 - DNA, 13 bp, Homo sapiens
caaatacacattt

SEQ ID NO: 4859043 - DNA, 14 bp, Homo sapiens
caaatacacatttg

SEQ ID NO: 4859044 - DNA, 17 bp, Homo sapiens
caaatacacatttgcta

SEQ ID NO: 4859045 - DNA, 19 bp, Homo sapiens
caaatagattcagagaaat

SEQ ID NO: 4859046 - DNA, 23 bp, Homo sapiens
caaatcctagactgctcctgggc

SEQ ID NO: 4859047 - DNA, 15 bp, Homo sapiens
caaatgcagggaggg

SEQ ID NO: 4859048 - DNA, 15 bp, Homo sapiens
caaatgcctgactca

SEQ ID NO: 4859049 - DNA, 13 bp, Homo sapiens
caaatgtttttca

SEQ ID NO: 4859050 - DNA, 20 bp, Homo sapiens
caaattgactcttatttata

SEQ ID NO: 4859051 - DNA, 17 bp, Homo sapiens
caaatttcttttgctga

SEQ ID NO: 4859052 - DNA, 22 bp, Homo sapiens
caacagaacatatgttgcaaga

SEQ ID NO: 4859053 - DNA, 17 bp, Homo sapiens
caacagactgttgagtt

SEQ ID NO: 4859054 - DNA, 20 bp, Homo sapiens
caacagagactgaatagata

SEQ ID NO: 4859055 - DNA, 23 bp, Homo sapiens
caacagccaagctggcacaaaag

SEQ ID NO: 4859056 - DNA, 13 bp, Homo sapiens
caacatctctgaa

SEQ ID NO: 4859057 - DNA, 14 bp, Homo sapiens
caacatctctgaat

SEQ ID NO: 4859058 - DNA, 23 bp, Homo sapiens
caacatgccagccactgtgatag

SEQ ID NO: 4859059 - DNA, 22 bp, Homo sapiens
caacatttctcatgttgaaact

SEQ ID NO: 4859060 - DNA, 14 bp, Homo sapiens
caaccaagtgtgct

SEQ ID NO: 4859061 - DNA, 15 bp, Homo sapiens
caaccacactgcttg

SEQ ID NO: 4859062 - DNA, 14 bp, Homo sapiens
caaccatcatgtgt

SEQ ID NO: 4859063 - DNA, 21 bp, Homo sapiens
caacccagtcacactgtggcc

SEQ ID NO: 4859064 - DNA, 18 bp, Homo sapiens
caacccattcactacagg

SEQ ID NO: 4859065 - DNA, 18 bp, Homo sapiens
caacccttcctgctgctg

SEQ ID NO: 4859066 - DNA, 19 bp, Homo sapiens
caacccttcctgctgctgc

SEQ ID NO: 4859067 - DNA, 20 bp, Homo sapiens
caacctctttgcgtttcctt

SEQ ID NO: 4859068 - DNA, 21 bp, Homo sapiens
caacctctttgcgtttccttt

SEQ ID NO: 4859069 - DNA, 15 bp, Homo sapiens
caacctctttgctca

SEQ ID NO: 4859070 - DNA, 20 bp, Homo sapiens
caacggaaagtgctgtctta

SEQ ID NO: 4859071 - DNA, 20 bp, Homo sapiens
caactactagtgtgactcct

SEQ ID NO: 4859072 - DNA, 15 bp, Homo sapiens
caactcccttgcacg

SEQ ID NO: 4859073 - DNA, 21 bp, Homo sapiens
caactgaggttcttgggatac

SEQ ID NO: 4859074 - DNA, 12 bp, Homo sapiens
caactgtgtgat

SEQ ID NO: 4859075 - DNA, 17 bp, Homo sapiens
caagaaccactccttca

SEQ ID NO: 4859076 - DNA, 16 bp, Homo sapiens
caagaccctcccatgg

SEQ ID NO: 4859077 - DNA, 17 bp, Homo sapiens
caagactggcccagtgc

SEQ ID NO: 4859078 - DNA, 19 bp, Homo sapiens
caagactggcccagtgcca

SEQ ID NO: 4859079 - DNA, 15 bp, Homo sapiens
caagaggcaagctga

SEQ ID NO: 4859080 - DNA, 17 bp, Homo sapiens
caagcaccaacctccag

SEQ ID NO: 4859081 - DNA, 20 bp, Homo sapiens
caagcaccaacctccagact

SEQ ID NO: 4859082 - DNA, 15 bp, Homo sapiens
caagcagacagccct

SEQ ID NO: 4859083 - DNA, 15 bp, Homo sapiens
caagccccctgccct

SEQ ID NO: 4859084 - DNA, 11 bp, Homo sapiens
caagccctggg

SEQ ID NO: 4859085 - DNA, 14 bp, Homo sapiens
caagccctggggca

SEQ ID NO: 4859086 - DNA, 15 bp, Homo sapiens
caagccctggggcag

SEQ ID NO: 4859087 - DNA, 16 bp, Homo sapiens
caagccctggggcagg

SEQ ID NO: 4859088 - DNA, 17 bp, Homo sapiens
caagccctggggcaggg

SEQ ID NO: 4859089 - DNA, 13 bp, Homo sapiens
caagctgaaattt

SEQ ID NO: 4859090 - DNA, 13 bp, Homo sapiens
caagcttcccaac

SEQ ID NO: 4859091 - DNA, 17 bp, Homo sapiens
caaggagcatccttggc

SEQ ID NO: 4859092 - DNA, 24 bp, Homo sapiens
caaggagtttgagaccagcttagc

SEQ ID NO: 4859093 - DNA, 13 bp, Homo sapiens
caaggcagagcct

SEQ ID NO: 4859094 - DNA, 20 bp, Homo sapiens
caaggcattctcccagctct

SEQ ID NO: 4859095 - DNA, 13 bp, Homo sapiens
caaggcctgcttg

SEQ ID NO: 4859096 - DNA, 22 bp, Homo sapiens
caaggcctgcttgactttccag

SEQ ID NO: 4859097 - DNA, 15 bp, Homo sapiens
caaggctcttcttcc

SEQ ID NO: 4859098 - DNA, 17 bp, Homo sapiens
caaggctcttcttcctc

SEQ ID NO: 4859099 - DNA, 23 bp, Homo sapiens
caaggctgataatatgacaaaca

SEQ ID NO: 4859100 - DNA, 22 bp, Homo sapiens
caaggctgtgtttagattgtat

SEQ ID NO: 4859101 - DNA, 22 bp, Homo sapiens
caagggaccaggtttgcaggag

SEQ ID NO: 4859102 - DNA, 11 bp, Homo sapiens
caagggtcagg

SEQ ID NO: 4859103 - DNA, 10 bp, Homo sapiens
caaggtcctg

SEQ ID NO: 4859104 - DNA, 19 bp, Homo sapiens
caaggtgaggtgaactcca

SEQ ID NO: 4859105 - DNA, 20 bp, Homo sapiens
caaggtgaggtgaactccag

SEQ ID NO: 4859106 - DNA, 23 bp, Homo sapiens
caaggtgaggtgaactccaggca

SEQ ID NO: 4859107 - DNA, 16 bp, Homo sapiens
caaggtggcctctgcc

SEQ ID NO: 4859108 - DNA, 18 bp, Homo sapiens
caaggtggcctctgcctg

SEQ ID NO: 4859109 - DNA, 19 bp, Homo sapiens
caaggtggcctctgcctgg

SEQ ID NO: 4859110 - DNA, 15 bp, Homo sapiens
caaggtgtgatggtc

SEQ ID NO: 4859111 - DNA, 20 bp, Homo sapiens
caagtcaccaaaagacactg

SEQ ID NO: 4859112 - DNA, 20 bp, Homo sapiens
caagtcataggttaatattt

SEQ ID NO: 4859113 - DNA, 14 bp, Homo sapiens
caagtgagcagaga

SEQ ID NO: 4859114 - DNA, 19 bp, Homo sapiens
caagtgtgctaaaaatgag

SEQ ID NO: 4859115 - DNA, 22 bp, Homo sapiens
caagttggaagggaccccagat

SEQ ID NO: 4859116 - DNA, 12 bp, Homo sapiens
caagtttgctgc

SEQ ID NO: 4859117 - DNA, 18 bp, Homo sapiens
cagttcctgtcccacatg

SEQ ID NO: 4859118 - DNA, 21 bp, Homo sapiens
cagttcctgtcccacatggcc

SEQ ID NO: 4859119 - DNA, 14 bp, Homo sapiens
cagttctcaaatgt

SEQ ID NO: 4859120 - DNA, 18 bp, Homo sapiens
cagttctcaaatgtgtgt

SEQ ID NO: 4859121 - DNA, 23 bp, Homo sapiens
cagttctctcccttcctctctcc

SEQ ID NO: 4859122 - DNA, 19 bp, Homo sapiens
cagttgctcaaaaagaaat

SEQ ID NO: 4859123 - DNA, 15 bp, Homo sapiens
cagttgtagcagaaa

SEQ ID NO: 4859124 - DNA, 16 bp, Homo sapiens
cagtttaagccgcaga

SEQ ID NO: 4859125 - DNA, 15 bp, Homo sapiens
cagtttgttggaaag

SEQ ID NO: 4859126 - DNA, 16 bp, Homo sapiens
cagttttcggaaacac

SEQ ID NO: 4859127 - DNA, 18 bp, Homo sapiens
cagttttcggaaacactg

SEQ ID NO: 4859128 - DNA, 19 bp, Homo sapiens
cagttttcggaaacactga

SEQ ID NO: 4859129 - DNA, 14 bp, Homo sapiens
cagtttttgacatt

SEQ ID NO: 4859130 - DNA, 17 bp, Homo sapiens
cataaattatttgatta

SEQ ID NO: 4859131 - DNA, 19 bp, Homo sapiens
cataaattcaactttgtaa

SEQ ID NO: 4859132 - DNA, 19 bp, Homo sapiens
cataactcacacccctgcc

SEQ ID NO: 4859133 - DNA, 23 bp, Homo sapiens
cataactcacacccctgccccca

SEQ ID NO: 4859134 - DNA, 16 bp, Homo sapiens
cataacttctcatgta

SEQ ID NO: 4859135 - DNA, 22 bp, Homo sapiens
cataagataaaatgatgttata

SEQ ID NO: 4859136 - DNA, 21 bp, Homo sapiens
cataataagagaatgttccta

SEQ ID NO: 4859137 - DNA, 21 bp, Homo sapiens
cataatgtttctggatttcat

SEQ ID NO: 4859138 - DNA, 23 bp, Homo sapiens
cataatgtttctggatttcatac

SEQ ID NO: 4859139 - DNA, 18 bp, Homo sapiens
cataattcagcacttaac

SEQ ID NO: 4859140 - DNA, 18 bp, Homo sapiens
cataatttaaaaatatat

SEQ ID NO: 4859141 - DNA, 15 bp, Homo sapiens
catacataaaagaaa

SEQ ID NO: 4859142 - DNA, 20 bp, Homo sapiens
catacataaaagaaataaac

SEQ ID NO: 4859143 - DNA, 16 bp, Homo sapiens
catactttgtattttg

SEQ ID NO: 4859144 - DNA, 13 bp, Homo sapiens
catagacatgaaa

SEQ ID NO: 4859145 - DNA, 17 bp, Homo sapiens
catagagaacaaagtaa

SEQ ID NO: 4859146 - DNA, 19 bp, Homo sapiens
catagataatattgtttgg

SEQ ID NO: 4859147 - DNA, 16 bp, Homo sapiens
catagcataggctggg

SEQ ID NO: 4859148 - DNA, 17 bp, Homo sapiens
catagcataggctgggg

SEQ ID NO: 4859149 - DNA, 13 bp, Homo sapiens
cataggctgggga

SEQ ID NO: 4859150 - DNA, 20 bp, Homo sapiens
catataagacaaatattcct

SEQ ID NO: 4859151 - DNA, 12 bp, Homo sapiens
catatatttatt

SEQ ID NO: 4859152 - DNA, 17 bp, Homo sapiens
catatggtaggaccctc

SEQ ID NO: 4859153 - DNA, 21 bp, Homo sapiens
catattataaaggataaagaa

SEQ ID NO: 4859154 - DNA, 17 bp, Homo sapiens
catattccatatttatt

SEQ ID NO: 4859155 - DNA, 13 bp, Homo sapiens
catattgtaatct

SEQ ID NO: 4859156 - DNA, 18 bp, Homo sapiens
catattgtaatctatgtt

SEQ ID NO: 4859157 - DNA, 22 bp, Homo sapiens
catattgtaatctatgtttata

SEQ ID NO: 4859158 - DNA, 18 bp, Homo sapiens
catcaaacctttgagtag

SEQ ID NO: 4859159 - DNA, 15 bp, Homo sapiens
catcaatatgtatat

SEQ ID NO: 4859160 - DNA, 21 bp, Homo sapiens
catcaatatgtatatatgtat

SEQ ID NO: 4859161 - DNA, 17 bp, Homo sapiens
catcactggactgcatg

SEQ ID NO: 4859162 - DNA, 19 bp, Homo sapiens
catcactggactgcatggg

SEQ ID NO: 4859163 - DNA, 15 bp, Homo sapiens
catcaggtgaggtgt

SEQ ID NO: 4859164 - DNA, 15 bp, Homo sapiens
catcattcttgtggg

SEQ ID NO: 4859165 - DNA, 21 bp, Homo sapiens
catcattcttgtgggagacag

SEQ ID NO: 4859166 - DNA, 23 bp, Homo sapiens
catcattgtttagatgaggctca

SEQ ID NO: 4859167 - DNA, 17 bp, Homo sapiens
catccacctcatcactg

SEQ ID NO: 4859168 - DNA, 17 bp, Homo sapiens
catccatccctccattc

SEQ ID NO: 4859169 - DNA, 16 bp, Homo sapiens
catccatcctgagcca

SEQ ID NO: 4859170 - DNA, 20 bp, Homo sapiens
catccctccattcatccttc

SEQ ID NO: 4859171 - DNA, 16 bp, Homo sapiens
catccttccaacatat

SEQ ID NO: 4859172 - DNA, 16 bp, Homo sapiens
catccttccatccatc

SEQ ID NO: 4859173 - DNA, 17 bp, Homo sapiens
catccttgagattctga

SEQ ID NO: 4859174 - DNA, 23 bp, Homo sapiens
catcgtattaaaaaacaattaac

SEQ ID NO: 4859175 - DNA, 16 bp, Homo sapiens
catctatccacactgt

SEQ ID NO: 4859176 - DNA, 13 bp, Homo sapiens
catctatctagtt

SEQ ID NO: 4859177 - DNA, 21 bp, Homo sapiens
catctccatggggaggcctca

SEQ ID NO: 4859178 - DNA, 11 bp, Homo sapiens
catctgaagag

SEQ ID NO: 4859179 - DNA, 19 bp, Homo sapiens
catctgttagcagagtctg

SEQ ID NO: 4859180 - DNA, 12 bp, Homo sapiens
catcttctttct

SEQ ID NO: 4859181 - DNA, 16 bp, Homo sapiens
catcttggagggacca

SEQ ID NO: 4859182 - DNA, 21 bp, Homo sapiens
catctttccatccattacctc

SEQ ID NO: 4859183 - DNA, 17 bp, Homo sapiens
catcttttgttctccta

SEQ ID NO: 4859184 - DNA, 24 bp, Homo sapiens
catgaaaataccatttagtaagaa

SEQ ID NO: 4859185 - DNA, 13 bp, Homo sapiens
catgaaataaaat

SEQ ID NO: 4859186 - DNA, 18 bp, Homo sapiens
catgaaataaaatatatc

SEQ ID NO: 4859187 - DNA, 19 bp, Homo sapiens
catgaaattcttcctaatg

SEQ ID NO: 4859188 - DNA, 12 bp, Homo sapiens
catgaagaatgt

SEQ ID NO: 4859189 - DNA, 14 bp, Homo sapiens
catgaagcagaacc

SEQ ID NO: 4859190 - DNA, 15 bp, Homo sapiens
catgaagcagaacct

SEQ ID NO: 4859191 - DNA, 21 bp, Homo sapiens
catgaagcagaaccttctttg

SEQ ID NO: 4859192 - DNA, 14 bp, Homo sapiens
catgaattttaaag

SEQ ID NO: 4859193 - DNA, 14 bp, Homo sapiens
catgacagcctcca

SEQ ID NO: 4859194 - DNA, 23 bp, Homo sapiens
catgagagtagggccctgacagg

SEQ ID NO: 4859195 - DNA, 21 bp, Homo sapiens
catgatttccctccagagaaa

SEQ ID NO: 4859196 - DNA, 15 bp, Homo sapiens
catgatttttgccct

SEQ ID NO: 4859197 - DNA, 17 bp, Homo sapiens
catgatttttgccctgc

SEQ ID NO: 4859198 - DNA, 20 bp, Homo sapiens
catgcaaatgagctctgaaa

SEQ ID NO: 4859199 - DNA, 12 bp, Homo sapiens
catgcatataat

SEQ ID NO: 4859200 - DNA, 14 bp, Homo sapiens
catgcatgcaaatg

SEQ ID NO: 4859201 - DNA, 14 bp, Homo sapiens
catgccagtatttt

SEQ ID NO: 4859202 - DNA, 19 bp, Homo sapiens
catgccagtatttttaaag

SEQ ID NO: 4859203 - DNA, 22 bp, Homo sapiens
catgctgctcccctaaagccag

SEQ ID NO: 4859204 - DNA, 13 bp, Homo sapiens
catgcttaaattt

SEQ ID NO: 4859205 - DNA, 21 bp, Homo sapiens
catggagcctacctctgtctg

SEQ ID NO: 4859206 - DNA, 12 bp, Homo sapiens
catggcaggagt

SEQ ID NO: 4859207 - DNA, 20 bp, Homo sapiens
catggcaggagtctctgcca

SEQ ID NO: 4859208 - DNA, 22 bp, Homo sapiens
catggcaggagtctctgccagt

SEQ ID NO: 4859209 - DNA, 23 bp, Homo sapiens
catggcatccctttttcataaat

SEQ ID NO: 4859210 - DNA, 15 bp, Homo sapiens
catggccatcttctt

SEQ ID NO: 4859211 - DNA, 15 bp, Homo sapiens
catggctgaagctgg

SEQ ID NO: 4859212 - DNA, 20 bp, Homo sapiens
catggctgaagctggagcag

SEQ ID NO: 4859213 - DNA, 18 bp, Homo sapiens
catggctgctgttgctta

SEQ ID NO: 4859214 - DNA, 14 bp, Homo sapiens
catggtgctagtgg

SEQ ID NO: 4859215 - DNA, 19 bp, Homo sapiens
catggtggctcatgcctgt

SEQ ID NO: 4859216 - DNA, 21 bp, Homo sapiens
catgtattgcacattgtaaaa

SEQ ID NO: 4859217 - DNA, 14 bp, Homo sapiens
catgtatttgagca

SEQ ID NO: 4859218 - DNA, 15 bp, Homo sapiens
catgtatttgagcat

SEQ ID NO: 4859219 - DNA, 19 bp, Homo sapiens
catgtccaaacgtcctctt

SEQ ID NO: 4859220 - DNA, 11 bp, Homo sapiens
catgtcctctc

SEQ ID NO: 4859221 - DNA, 23 bp, Homo sapiens
catgtcttctcacaagccagcca

SEQ ID NO: 4859222 - DNA, 13 bp, Homo sapiens
catgtgacattta

SEQ ID NO: 4859223 - DNA, 14 bp, Homo sapiens
catgtgacatttat

SEQ ID NO: 4859224 - DNA, 18 bp, Homo sapiens
catgtgacttctcccctg

SEQ ID NO: 4859225 - DNA, 14 bp, Homo sapiens
catgtgagctcttc

SEQ ID NO: 4859226 - DNA, 21 bp, Homo sapiens
catgtgatgttgtcttagcat

SEQ ID NO: 4859227 - DNA, 24 bp, Homo sapiens
catgtgtcatgaagaatgtttctg

SEQ ID NO: 4859228 - DNA, 16 bp, Homo sapiens
catgttcccaaggccc

SEQ ID NO: 4859229 - DNA, 13 bp, Homo sapiens
catgttcccagaa

SEQ ID NO: 4859230 - DNA, 14 bp, Homo sapiens
catgttcccagaac

SEQ ID NO: 4859231 - DNA, 20 bp, Homo sapiens
catgtttaatgggtatgctc

SEQ ID NO: 4859232 - DNA, 16 bp, Homo sapiens
catgtttttgttttaa

SEQ ID NO: 4859233 - DNA, 17 bp, Homo sapiens
cattaaagtcagaagtt

SEQ ID NO: 4859234 - DNA, 23 bp, Homo sapiens
cattaactgttgcacttttgaat

SEQ ID NO: 4859235 - DNA, 19 bp, Homo sapiens
cattaatgcctgctttttg

SEQ ID NO: 4859236 - DNA, 21 bp, Homo sapiens
cattaatgcctgctttttgga

SEQ ID NO: 4859237 - DNA, 19 bp, Homo sapiens
ccgcagagaaatgccccag

SEQ ID NO: 4859238 - DNA, 13 bp, Homo sapiens
ccgcagaggtggg

SEQ ID NO: 4859239 - DNA, 12 bp, Homo sapiens
ccgcaggtgctc

SEQ ID NO: 4859240 - DNA, 21 bp, Homo sapiens
ccgcaggtgctcatgctgctc

SEQ ID NO: 4859241 - DNA, 16 bp, Homo sapiens
ccgcagttgtagcaga

SEQ ID NO: 4859242 - DNA, 12 bp, Homo sapiens
ccgccagcgtgt

SEQ ID NO: 4859243 - DNA, 14 bp, Homo sapiens
ccgccgccgccgcc

SEQ ID NO: 4859244 - DNA, 14 bp, Homo sapiens
ccgccgccgccgct

SEQ ID NO: 4859245 - DNA, 20 bp, Homo sapiens
ccgcctcgacctccccaccc

SEQ ID NO: 4859246 - DNA, 23 bp, Homo sapiens
ccgcctcgacctccccacccgct

SEQ ID NO: 4859247 - DNA, 17 bp, Homo sapiens
ccgcgcgcccaccctcc

SEQ ID NO: 4859248 - DNA, 18 bp, Homo sapiens
ccggagcaaactctgctg

SEQ ID NO: 4859249 - DNA, 18 bp, Homo sapiens
ccggcgggtgacagctcc

SEQ ID NO: 4859250 - DNA, 19 bp, Homo sapiens
ccggcgggtgacagctccg

SEQ ID NO: 4859251 - DNA, 16 bp, Homo sapiens
ccgggcaccaggggcc

SEQ ID NO: 4859252 - DNA, 15 bp, Homo sapiens
ccgggggaggggcgc

SEQ ID NO: 4859253 - DNA, 16 bp, Homo sapiens
ccgggggaggggcgcg

SEQ ID NO: 4859254 - DNA, 17 bp, Homo sapiens
ccggttcagacccctgc

SEQ ID NO: 4859255 - DNA, 17 bp, Homo sapiens
ccgtaataattattatt

SEQ ID NO: 4859256 - DNA, 13 bp, Homo sapiens
ccgtaatttaact

SEQ ID NO: 4859257 - DNA, 20 bp, Homo sapiens
ccgtacttgggtcacatgac

SEQ ID NO: 4859258 - DNA, 16 bp, Homo sapiens
ccgtagcttcagccag

SEQ ID NO: 4859259 - DNA, 18 bp, Homo sapiens
ccgtagcttcagccaggc

SEQ ID NO: 4859260 - DNA, 13 bp, Homo sapiens
ccgtattcctctc

SEQ ID NO: 4859261 - DNA, 12 bp, Homo sapiens
ccgtcacagcct

SEQ ID NO: 4859262 - DNA, 12 bp, Homo sapiens
ccgtctcctccc

SEQ ID NO: 4859263 - DNA, 17 bp, Homo sapiens
ccgtctcctccctcagc

SEQ ID NO: 4859264 - DNA, 17 bp, Homo sapiens
ccgtgccccttccctgg

SEQ ID NO: 4859265 - DNA, 20 bp, Homo sapiens
ccgtgccccttccctgggtt

SEQ ID NO: 4859266 - DNA, 18 bp, Homo sapiens
ccgtggcagcttgctggg

SEQ ID NO: 4859267 - DNA, 22 bp, Homo sapiens
ccgtggcagcttgctgggcttt

SEQ ID NO: 4859268 - DNA, 23 bp, Homo sapiens
cctaaaataacagtatgtgggat

SEQ ID NO: 4859269 - DNA, 13 bp, Homo sapiens
cctaaagagcatc

SEQ ID NO: 4859270 - DNA, 13 bp, Homo sapiens
cctaaagccaggc

SEQ ID NO: 4859271 - DNA, 21 bp, Homo sapiens
cctaaagccaggctcaggaga

SEQ ID NO: 4859272 - DNA, 18 bp, Homo sapiens
cctaacctcgggcctgct

SEQ ID NO: 4859273 - DNA, 17 bp, Homo sapiens
cctaagaagaaggccag

SEQ ID NO: 4859274 - DNA, 18 bp, Homo sapiens
cctaagaagaaggccaga

SEQ ID NO: 4859275 - DNA, 20 bp, Homo sapiens
cctaagaagaaggccagaga

SEQ ID NO: 4859276 - DNA, 23 bp, Homo sapiens
cctacagacagcttacaggagcc

SEQ ID NO: 4859277 - DNA, 20 bp, Homo sapiens
cctacagttttaactgtgga

SEQ ID NO: 4859278 - DNA, 22 bp, Homo sapiens
cctacagttttaactgtggata

SEQ ID NO: 4859279 - DNA, 13 bp, Homo sapiens
cctacctctgtct

SEQ ID NO: 4859280 - DNA, 13 bp, Homo sapiens
cctactatttaaa

SEQ ID NO: 4859281 - DNA, 18 bp, Homo sapiens
cctactcacacttcagct

SEQ ID NO: 4859282 - DNA, 21 bp, Homo sapiens
cctactggtgtaatctcaatg

SEQ ID NO: 4859283 - DNA, 17 bp, Homo sapiens
cctactttctattttta

SEQ ID NO: 4859284 - DNA, 15 bp, Homo sapiens
cctagaaagggcaag

SEQ ID NO: 4859285 - DNA, 15 bp, Homo sapiens
cctagactgctcctg

SEQ ID NO: 4859286 - DNA, 16 bp, Homo sapiens
cctagactgctcctgg

SEQ ID NO: 4859287 - DNA, 17 bp, Homo sapiens
cctagcctatgtctggc

SEQ ID NO: 4859288 - DNA, 15 bp, Homo sapiens
cctagctaattattt

SEQ ID NO: 4859289 - DNA, 12 bp, Homo sapiens
cctagggctctc

SEQ ID NO: 4859290 - DNA, 16 bp, Homo sapiens
cctagggctctccaag

SEQ ID NO: 4859291 - DNA, 17 bp, Homo sapiens
cctagggctctccaagc

SEQ ID NO: 4859292 - DNA, 12 bp, Homo sapiens
cctatgtctggc

SEQ ID NO: 4859293 - DNA, 23 bp, Homo sapiens
cctatttttgacatggaaatgaa

SEQ ID NO: 4859294 - DNA, 14 bp, Homo sapiens
cctcaccacagcct

SEQ ID NO: 4859295 - DNA, 15 bp, Homo sapiens
cctcaccacagcctt

SEQ ID NO: 4859296 - DNA, 12 bp, Homo sapiens
cctcaccgagca

SEQ ID NO: 4859297 - DNA, 13 bp, Homo sapiens
cctcagcctgctt

SEQ ID NO: 4859298 - DNA, 23 bp, Homo sapiens
cctcagcctgctttcctgcagca

SEQ ID NO: 4859299 - DNA, 23 bp, Homo sapiens
cctcaggacccatccctgcctgg

SEQ ID NO: 4859300 - DNA, 12 bp, Homo sapiens
cctcaggctcct

SEQ ID NO: 4859301 - DNA, 13 bp, Homo sapiens
cctcaggctccta

SEQ ID NO: 4859302 - DNA, 13 bp, Homo sapiens
cctcagggtgggg

SEQ ID NO: 4859303 - DNA, 21 bp, Homo sapiens
cctcagtctggagtgggatag

SEQ ID NO: 4859304 - DNA, 20 bp, Homo sapiens
cctcagttctcaaatgtgtg

SEQ ID NO: 4859305 - DNA, 13 bp, Homo sapiens
cctcatcactgga

SEQ ID NO: 4859306 - DNA, 21 bp, Homo sapiens
cctcatcactggactgcatgg

SEQ ID NO: 4859307 - DNA, 16 bp, Homo sapiens
cctcattttgcttccc

SEQ ID NO: 4859308 - DNA, 18 bp, Homo sapiens
cctcattttgcttcccat

SEQ ID NO: 4859309 - DNA, 20 bp, Homo sapiens
cctcattttgcttcccatct

SEQ ID NO: 4859310 - DNA, 21 bp, Homo sapiens
cctcattttgcttcccatctg

SEQ ID NO: 4859311 - DNA, 23 bp, Homo sapiens
cctcattttgcttcccatctgaa

SEQ ID NO: 4859312 - DNA, 16 bp, Homo sapiens
cctccaagcctgcctc

SEQ ID NO: 4859313 - DNA, 13 bp, Homo sapiens
cctccagaagctg

SEQ ID NO: 4859314 - DNA, 13 bp, Homo sapiens
cctccagactcag

SEQ ID NO: 4859315 - DNA, 17 bp, Homo sapiens
cctccagactcagcaga

SEQ ID NO: 4859316 - DNA, 13 bp, Homo sapiens
cctccagagaaag

SEQ ID NO: 4859317 - DNA, 14 bp, Homo sapiens
cctccagagaaagc

SEQ ID NO: 4859318 - DNA, 13 bp, Homo sapiens
cctccagccctgg

SEQ ID NO: 4859319 - DNA, 16 bp, Homo sapiens
cctccagccctgggca

SEQ ID NO: 4859320 - DNA, 20 bp, Homo sapiens
cctccaggaccttgcttcct

SEQ ID NO: 4859321 - DNA, 23 bp, Homo sapiens
cctccaggaccttgcttccttct

SEQ ID NO: 4859322 - DNA, 16 bp, Homo sapiens
cctccatccatccttc

SEQ ID NO: 4859323 - DNA, 14 bp, Homo sapiens
cctccatgctcctc

SEQ ID NO: 4859324 - DNA, 19 bp, Homo sapiens
cctccatgctcctcacctg

SEQ ID NO: 4859325 - DNA, 16 bp, Homo sapiens
cctccattcatccttc

SEQ ID NO: 4859326 - DNA, 11 bp, Homo sapiens
cctcccaagct

SEQ ID NO: 4859327 - DNA, 12 bp, Homo sapiens
cctcccaagctg

SEQ ID NO: 4859328 - DNA, 21 bp, Homo sapiens
cctcccaaggcattctcccag

SEQ ID NO: 4859329 - DNA, 15 bp, Homo sapiens
cctcccaaggtcctc

SEQ ID NO: 4859330 - DNA, 13 bp, Homo sapiens
cctcccacccacc

SEQ ID NO: 4859331 - DNA, 16 bp, Homo sapiens
cctcccacccaccgcc

SEQ ID NO: 4859332 - DNA, 15 bp, Homo sapiens
cctccccacccgctc

SEQ ID NO: 4859333 - DNA, 18 bp, Homo sapiens
cctccggcgggtgacagc

SEQ ID NO: 4859334 - DNA, 15 bp, Homo sapiens
cctcctcccaaggca

SEQ ID NO: 4859335 - DNA, 19 bp, Homo sapiens
cctcctctcaaacctggca

SEQ ID NO: 4859336 - DNA, 21 bp, Homo sapiens
cctcctctcaaacctggcaga

SEQ ID NO: 4859337 - DNA, 17 bp, Homo sapiens
cctccttgcccagacta

SEQ ID NO: 4859338 - DNA, 22 bp, Homo sapiens
cctcctttcattaccctacaga

SEQ ID NO: 4859339 - DNA, 20 bp, Homo sapiens
cctctaagtgctgctgtgga

SEQ ID NO: 4859340 - DNA, 13 bp, Homo sapiens
cctctcaaacctg

SEQ ID NO: 4859341 - DNA, 17 bp, Homo sapiens
cctctcaaacctggcag

SEQ ID NO: 4859342 - DNA, 15 bp, Homo sapiens
cctctcaccttgtcc

SEQ ID NO: 4859343 - DNA, 18 bp, Homo sapiens
cctctctctttcctccac

SEQ ID NO: 4859344 - DNA, 22 bp, Homo sapiens
cctctctctttcctccacccat

SEQ ID NO: 4859345 - DNA, 18 bp, Homo sapiens
cctctgaaaagtgtgtat

SEQ ID NO: 4859346 - DNA, 20 bp, Homo sapiens
cctctgccaaaggatgtgat

SEQ ID NO: 4859347 - DNA, 14 bp, Homo sapiens
cctctgcctggggc

SEQ ID NO: 4859348 - DNA, 14 bp, Homo sapiens
cctctgctctgcct

SEQ ID NO: 4859349 - DNA, 17 bp, Homo sapiens
cctctggactggaaagc

SEQ ID NO: 4859350 - DNA, 18 bp, Homo sapiens
cctctgtctgagacaggt

SEQ ID NO: 4859351 - DNA, 22 bp, Homo sapiens
cctctgtctgagacaggtgcct

SEQ ID NO: 4859352 - DNA, 22 bp, Homo sapiens
cctctgtgcttcgactactgct

SEQ ID NO: 4859353 - DNA, 20 bp, Homo sapiens
cctcttaaagaaaacccacc

SEQ ID NO: 4859354 - DNA, 21 bp, Homo sapiens
cctcttaaagaaaacccaccc

SEQ ID NO: 4859355 - DNA, 18 bp, Homo sapiens
cctcttgttcctgaaatg

SEQ ID NO: 4859356 - DNA, 14 bp, Homo sapiens
cctctttgcacagc

SEQ ID NO: 4859357 - DNA, 11 bp, Homo sapiens
cctctttgctc

SEQ ID NO: 4859358 - DNA, 18 bp, Homo sapiens
ctagactgctcctgggca

SEQ ID NO: 4859359 - DNA, 14 bp, Homo sapiens
ctagagagaaccaa

SEQ ID NO: 4859360 - DNA, 15 bp, Homo sapiens
ctagagggcgaggga

SEQ ID NO: 4859361 - DNA, 14 bp, Homo sapiens
ctagatccagccca

SEQ ID NO: 4859362 - DNA, 18 bp, Homo sapiens
ctagcctatgtctggcag

SEQ ID NO: 4859363 - DNA, 17 bp, Homo sapiens
ctagcctctggactgga

SEQ ID NO: 4859364 - DNA, 16 bp, Homo sapiens
ctagctaattatttaa

SEQ ID NO: 4859365 - DNA, 15 bp, Homo sapiens
ctaggagaggggggc

SEQ ID NO: 4859366 - DNA, 19 bp, Homo sapiens
ctaggatagcgctcccctt

SEQ ID NO: 4859367 - DNA, 14 bp, Homo sapiens
ctaggccctgtgag

SEQ ID NO: 4859368 - DNA, 22 bp, Homo sapiens
ctaggcctccgttgtctggttg

SEQ ID NO: 4859369 - DNA, 16 bp, Homo sapiens
ctagggtcttgggggt

SEQ ID NO: 4859370 - DNA, 14 bp, Homo sapiens
ctaggttctgtaga

SEQ ID NO: 4859371 - DNA, 22 bp, Homo sapiens
ctaggttctgtagagccaatta

SEQ ID NO: 4859372 - DNA, 12 bp, Homo sapiens
ctagtgtgactc

SEQ ID NO: 4859373 - DNA, 14 bp, Homo sapiens
ctagtgtgactcct

SEQ ID NO: 4859374 - DNA, 23 bp, Homo sapiens
ctagttatacttatttgtatatg

SEQ ID NO: 4859375 - DNA, 13 bp, Homo sapiens
ctataaaactctg

SEQ ID NO: 4859376 - DNA, 13 bp, Homo sapiens
ctataaagtgcct

SEQ ID NO: 4859377 - DNA, 20 bp, Homo sapiens
ctataaagtgcctcggacag

SEQ ID NO: 4859378 - DNA, 21 bp, Homo sapiens
ctataagcaaattgctttttt

SEQ ID NO: 4859379 - DNA, 14 bp, Homo sapiens
ctatacacacacac

SEQ ID NO: 4859380 - DNA, 19 bp, Homo sapiens
ctatactgtggcctgcagg

SEQ ID NO: 4859381 - DNA, 14 bp, Homo sapiens
ctatatagacttgg

SEQ ID NO: 4859382 - DNA, 18 bp, Homo sapiens
ctatatatataaatgtat

SEQ ID NO: 4859383 - DNA, 21 bp, Homo sapiens
ctatattcctccagctgggat

SEQ ID NO: 4859384 - DNA, 15 bp, Homo sapiens
ctatcttttttagtg

SEQ ID NO: 4859385 - DNA, 22 bp, Homo sapiens
ctatgtctggcagatgagggct

SEQ ID NO: 4859386 - DNA, 21 bp, Homo sapiens
ctatgttaatattttaggtgt

SEQ ID NO: 4859387 - DNA, 13 bp, Homo sapiens
ctattaaaaaagt

SEQ ID NO: 4859388 - DNA, 19 bp, Homo sapiens
ctattatttttataattgt

SEQ ID NO: 4859389 - DNA, 14 bp, Homo sapiens
ctattctccagaca

SEQ ID NO: 4859390 - DNA, 20 bp, Homo sapiens
ctattgggcacagcctaggg

SEQ ID NO: 4859391 - DNA, 17 bp, Homo sapiens
ctattgtttgttgcact

SEQ ID NO: 4859392 - DNA, 16 bp, Homo sapiens
ctatttttatgatgac

SEQ ID NO: 4859393 - DNA, 17 bp, Homo sapiens
ctatttttatgatgaca

SEQ ID NO: 4859394 - DNA, 13 bp, Homo sapiens
ctatttttttaga

SEQ ID NO: 4859395 - DNA, 22 bp, Homo sapiens
ctatttttttagattgagaaat

SEQ ID NO: 4859396 - DNA, 13 bp, Homo sapiens
ctcaaaattagat

SEQ ID NO: 4859397 - DNA, 15 bp, Homo sapiens
ctcaaacctggcaga

SEQ ID NO: 4859398 - DNA, 18 bp, Homo sapiens
ctcaaacctggcagatgg

SEQ ID NO: 4859399 - DNA, 15 bp, Homo sapiens
ctcaaatacacattt

SEQ ID NO: 4859400 - DNA, 22 bp, Homo sapiens
ctcaatgcagttagctgaagaa

SEQ ID NO: 4859401 - DNA, 13 bp, Homo sapiens
ctcacaagccagc

SEQ ID NO: 4859402 - DNA, 13 bp, Homo sapiens
ctcaccacagcct

SEQ ID NO: 4859403 - DNA, 20 bp, Homo sapiens
ctcaccagccccccgcgcgc

SEQ ID NO: 4859404 - DNA, 12 bp, Homo sapiens
ctcaccctctgt

SEQ ID NO: 4859405 - DNA, 23 bp, Homo sapiens
ctcaccctctgtccttcccccag

SEQ ID NO: 4859406 - DNA, 20 bp, Homo sapiens
ctcacctgcactaacagagt

SEQ ID NO: 4859407 - DNA, 22 bp, Homo sapiens
ctcacctgtctaggtctcctca

SEQ ID NO: 4859408 - DNA, 11 bp, Homo sapiens
ctcactactga

SEQ ID NO: 4859409 - DNA, 20 bp, Homo sapiens
ctcactcccaagggacagca

SEQ ID NO: 4859410 - DNA, 14 bp, Homo sapiens
ctcacttagtcctt

SEQ ID NO: 4859411 - DNA, 17 bp, Homo sapiens
ctcagaaaattccctgg

SEQ ID NO: 4859412 - DNA, 22 bp, Homo sapiens
ctcagagacactgttgataaaa

SEQ ID NO: 4859413 - DNA, 19 bp, Homo sapiens
ctcagagaggtagcactct

SEQ ID NO: 4859414 - DNA, 20 bp, Homo sapiens
ctcagcctgctttcctgcag

SEQ ID NO: 4859415 - DNA, 14 bp, Homo sapiens
ctcagctcaatgca

SEQ ID NO: 4859416 - DNA, 14 bp, Homo sapiens
ctcagctctctggg

SEQ ID NO: 4859417 - DNA, 13 bp, Homo sapiens
ctcagctgtgcct

SEQ ID NO: 4859418 - DNA, 20 bp, Homo sapiens
ctcaggacccatccctgcct

SEQ ID NO: 4859419 - DNA, 22 bp, Homo sapiens
ctcaggacccatccctgcctgg

SEQ ID NO: 4859420 - DNA, 13 bp, Homo sapiens
ctcaggagaagcc

SEQ ID NO: 4859421 - DNA, 15 bp, Homo sapiens
ctcaggagaagccag

SEQ ID NO: 4859422 - DNA, 20 bp, Homo sapiens
ctcaggagaagccagtgtct

SEQ ID NO: 4859423 - DNA, 16 bp, Homo sapiens
ctcaggccaagggacc

SEQ ID NO: 4859424 - DNA, 18 bp, Homo sapiens
ctcaggccaagggaccag

SEQ ID NO: 4859425 - DNA, 19 bp, Homo sapiens
ctcaggccaagggaccagg

SEQ ID NO: 4859426 - DNA, 10 bp, Homo sapiens
ctcaggctcc

SEQ ID NO: 4859427 - DNA, 11 bp, Homo sapiens
ctcaggctccg

SEQ ID NO: 4859428 - DNA, 12 bp, Homo sapiens
ctcaggctcttg

SEQ ID NO: 4859429 - DNA, 15 bp, Homo sapiens
ctcaggtttgttttg

SEQ ID NO: 4859430 - DNA, 14 bp, Homo sapiens
ctcagtgaccagtg

SEQ ID NO: 4859431 - DNA, 22 bp, Homo sapiens
ctcagtgttggtatattttata

SEQ ID NO: 4859432 - DNA, 17 bp, Homo sapiens
ctcagttctcaaatgtg

SEQ ID NO: 4859433 - DNA, 15 bp, Homo sapiens
ctcagttctctccct

SEQ ID NO: 4859434 - DNA, 12 bp, Homo sapiens
ctcatcactgga

SEQ ID NO: 4859435 - DNA, 20 bp, Homo sapiens
ctcatcactggactgcatgg

SEQ ID NO: 4859436 - DNA, 13 bp, Homo sapiens
ctcatcttgcctc

SEQ ID NO: 4859437 - DNA, 20 bp, Homo sapiens
ctcatgctgctcccctaaag

SEQ ID NO: 4859438 - DNA, 23 bp, Homo sapiens
ctcatgtatattacccaatggaa

SEQ ID NO: 4859439 - DNA, 22 bp, Homo sapiens
ctcattgacttttataaagcat

SEQ ID NO: 4859440 - DNA, 19 bp, Homo sapiens
ctccaaaggaactctagag

SEQ ID NO: 4859441 - DNA, 20 bp, Homo sapiens
ctccaagccctggggcaggg

SEQ ID NO: 4859442 - DNA, 15 bp, Homo sapiens
ctccacactcagaaa

SEQ ID NO: 4859443 - DNA, 20 bp, Homo sapiens
ctccagaaccgcagaagcct

SEQ ID NO: 4859444 - DNA, 13 bp, Homo sapiens
ctccagaagctgc

SEQ ID NO: 4859445 - DNA, 15 bp, Homo sapiens
ctccagactcagcag

SEQ ID NO: 4859446 - DNA, 17 bp, Homo sapiens
ctccagactctgggggt

SEQ ID NO: 4859447 - DNA, 13 bp, Homo sapiens
ctccagagaaagc

SEQ ID NO: 4859448 - DNA, 19 bp, Homo sapiens
ctccagctgacagccacac

SEQ ID NO: 4859449 - DNA, 23 bp, Homo sapiens
ctccaggaccttgcttccttctc

SEQ ID NO: 4859450 - DNA, 12 bp, Homo sapiens
ctccaggcagga

SEQ ID NO: 4859451 - DNA, 17 bp, Homo sapiens
ctccaggcatgtgtctg

SEQ ID NO: 4859452 - DNA, 12 bp, Homo sapiens
ctccaggctgga

SEQ ID NO: 4859453 - DNA, 14 bp, Homo sapiens
ctccaggctggaag

SEQ ID NO: 4859454 - DNA, 18 bp, Homo sapiens
ctccagggtgacaaggcc

SEQ ID NO: 4859455 - DNA, 20 bp, Homo sapiens
ctccagggtgacaaggcctg

SEQ ID NO: 4859456 - DNA, 16 bp, Homo sapiens
ctccatccatccttcc

SEQ ID NO: 4859457 - DNA, 13 bp, Homo sapiens
ctccatggagcct

SEQ ID NO: 4859458 - DNA, 14 bp, Homo sapiens
ctccatggagccta

SEQ ID NO: 4859459 - DNA, 15 bp, Homo sapiens
ctccatggagcctac

SEQ ID NO: 4859460 - DNA, 18 bp, Homo sapiens
ctccatggagcctacctc

SEQ ID NO: 4859461 - DNA, 16 bp, Homo sapiens
ctccattcatccttcc

SEQ ID NO: 4859462 - DNA, 15 bp, Homo sapiens
ctcccaacccattca

SEQ ID NO: 4859463 - DNA, 18 bp, Homo sapiens
ctcccaagctgatggaca

SEQ ID NO: 4859464 - DNA, 21 bp, Homo sapiens
ctcccaaggcattctcccagc

SEQ ID NO: 4859465 - DNA, 21 bp, Homo sapiens
ctcccaagggtgccctttggg

SEQ ID NO: 4859466 - DNA, 13 bp, Homo sapiens
ctcccacacccct

SEQ ID NO: 4859467 - DNA, 17 bp, Homo sapiens
ctcccagaacctctaag

SEQ ID NO: 4859468 - DNA, 16 bp, Homo sapiens
ctcccaggggagccag

SEQ ID NO: 4859469 - DNA, 20 bp, Homo sapiens
ctcccctaaagccaggctca

SEQ ID NO: 4859470 - DNA, 22 bp, Homo sapiens
ctcccctaaagccaggctcagg

SEQ ID NO: 4859471 - DNA, 14 bp, Homo sapiens
ctcccgccccgccc

SEQ ID NO: 4859472 - DNA, 14 bp, Homo sapiens
ctccctcatggctc

SEQ ID NO: 4859473 - DNA, 19 bp, Homo sapiens
ctccctcatggctctggca

SEQ ID NO: 4859474 - DNA, 22 bp, Homo sapiens
ctccctgtggcactcagggagc

SEQ ID NO: 4859475 - DNA, 19 bp, Homo sapiens
ctcccttcctctctcctta

SEQ ID NO: 4859476 - DNA, 15 bp, Homo sapiens
ctccctttcactaaa

SEQ ID NO: 4859477 - DNA, 21 bp, Homo sapiens
ctccgactctgcacccgcctc

SEQ ID NO: 4859478 - DNA, 19 bp, Homo sapiens
ctccggccatactgccttt

SEQ ID NO: 4859479 - DNA, 13 bp, Homo sapiens
ctggggcagggtg

SEQ ID NO: 4859480 - DNA, 19 bp, Homo sapiens
ctggggcctccagaagctg

SEQ ID NO: 4859481 - DNA, 21 bp, Homo sapiens
ctggggcctccagaagctgct

SEQ ID NO: 4859482 - DNA, 22 bp, Homo sapiens
ctggggcctccagaagctgctc

SEQ ID NO: 4859483 - DNA, 13 bp, Homo sapiens
ctggggggcaggc

SEQ ID NO: 4859484 - DNA, 16 bp, Homo sapiens
ctggggggcaggcctc

SEQ ID NO: 4859485 - DNA, 18 bp, Homo sapiens
ctggggggcaggcctccc

SEQ ID NO: 4859486 - DNA, 21 bp, Homo sapiens
ctggggggcaggcctcccaag

SEQ ID NO: 4859487 - DNA, 21 bp, Homo sapiens
ctgggggtggacatctgaccc

SEQ ID NO: 4859488 - DNA, 22 bp, Homo sapiens
ctgggggtggacatctgacccc

SEQ ID NO: 4859489 - DNA, 17 bp, Homo sapiens
ctgggtgctagatccag

SEQ ID NO: 4859490 - DNA, 20 bp, Homo sapiens
ctgggtttgggagccaggac

SEQ ID NO: 4859491 - DNA, 22 bp, Homo sapiens
ctggtaataaatgtgactcagc

SEQ ID NO: 4859492 - DNA, 15 bp, Homo sapiens
ctggtaatattgact

SEQ ID NO: 4859493 - DNA, 15 bp, Homo sapiens
ctggtgaacactgtg

SEQ ID NO: 4859494 - DNA, 16 bp, Homo sapiens
ctggtgaacactgtga

SEQ ID NO: 4859495 - DNA, 18 bp, Homo sapiens
ctggtgggacagtggtga

SEQ ID NO: 4859496 - DNA, 16 bp, Homo sapiens
ctggtgtaatctcaat

SEQ ID NO: 4859497 - DNA, 16 bp, Homo sapiens
ctggttacctggagaa

SEQ ID NO: 4859498 - DNA, 17 bp, Homo sapiens
ctggttacctggagaag

SEQ ID NO: 4859499 - DNA, 14 bp, Homo sapiens
ctggttctgaggcc

SEQ ID NO: 4859500 - DNA, 16 bp, Homo sapiens
ctggttctgaggccag

SEQ ID NO: 4859501 - DNA, 19 bp, Homo sapiens
ctggttctgaggccagaaa

SEQ ID NO: 4859502 - DNA, 16 bp, Homo sapiens
ctgtaaagatgtttat

SEQ ID NO: 4859503 - DNA, 20 bp, Homo sapiens
ctgtaatgctgcctcaggac

SEQ ID NO: 4859504 - DNA, 22 bp, Homo sapiens
ctgtaatgctgcctcaggaccc

SEQ ID NO: 4859505 - DNA, 12 bp, Homo sapiens
ctgtaattgtgt

SEQ ID NO: 4859506 - DNA, 14 bp, Homo sapiens
ctgtactgcatgtg

SEQ ID NO: 4859507 - DNA, 17 bp, Homo sapiens
ctgtactgtgtctcatg

SEQ ID NO: 4859508 - DNA, 16 bp, Homo sapiens
ctgtacttcttgaata

SEQ ID NO: 4859509 - DNA, 17 bp, Homo sapiens
ctgtacttcttgaatat

SEQ ID NO: 4859510 - DNA, 13 bp, Homo sapiens
ctgtactttccca

SEQ ID NO: 4859511 - DNA, 14 bp, Homo sapiens
ctgtagatatgtat

SEQ ID NO: 4859512 - DNA, 18 bp, Homo sapiens
ctgtagatatgtattctt

SEQ ID NO: 4859513 - DNA, 14 bp, Homo sapiens
ctgtagctgccatg

SEQ ID NO: 4859514 - DNA, 22 bp, Homo sapiens
ctgtcaatgagagcataattta

SEQ ID NO: 4859515 - DNA, 16 bp, Homo sapiens
ctgtcattcagaaaaa

SEQ ID NO: 4859516 - DNA, 16 bp, Homo sapiens
ctgtccagagtctctt

SEQ ID NO: 4859517 - DNA, 14 bp, Homo sapiens
ctgtctcttggctt

SEQ ID NO: 4859518 - DNA, 14 bp, Homo sapiens
ctgtctgagacagg

SEQ ID NO: 4859519 - DNA, 21 bp, Homo sapiens
ctgtcttaaactaaatgtgca

SEQ ID NO: 4859520 - DNA, 20 bp, Homo sapiens
ctgtgaacaagcttcagtaa

SEQ ID NO: 4859521 - DNA, 13 bp, Homo sapiens
ctgtgaagtgtta

SEQ ID NO: 4859522 - DNA, 15 bp, Homo sapiens
ctgtgaatacttgaa

SEQ ID NO: 4859523 - DNA, 23 bp, Homo sapiens
ctgtgaccagtctgacccttaca

SEQ ID NO: 4859524 - DNA, 22 bp, Homo sapiens
ctgtgactcttagccctcacca

SEQ ID NO: 4859525 - DNA, 23 bp, Homo sapiens
ctgtgactgaagaagatgagcct

SEQ ID NO: 4859526 - DNA, 17 bp, Homo sapiens
ctgtgagcatggggcca

SEQ ID NO: 4859527 - DNA, 18 bp, Homo sapiens
ctgtgagcatggggccag

SEQ ID NO: 4859528 - DNA, 19 bp, Homo sapiens
ctgtgaggacagggccccc

SEQ ID NO: 4859529 - DNA, 23 bp, Homo sapiens
ctgtgaggacagggcccccacag

SEQ ID NO: 4859530 - DNA, 18 bp, Homo sapiens
ctgtgaggatagagactt

SEQ ID NO: 4859531 - DNA, 15 bp, Homo sapiens
ctgtgattactgcaa

SEQ ID NO: 4859532 - DNA, 23 bp, Homo sapiens
ctgtgattactgcaatcactgtg

SEQ ID NO: 4859533 - DNA, 13 bp, Homo sapiens
ctgtgctccacac

SEQ ID NO: 4859534 - DNA, 17 bp, Homo sapiens
ctgtgctccacactcag

SEQ ID NO: 4859535 - DNA, 22 bp, Homo sapiens
ctgtgctccacactcagaaaat

SEQ ID NO: 4859536 - DNA, 22 bp, Homo sapiens
ctgtgcttcgactactgctcct

SEQ ID NO: 4859537 - DNA, 19 bp, Homo sapiens
ctgtggccgtctcctccct

SEQ ID NO: 4859538 - DNA, 14 bp, Homo sapiens
ctgtggcctgcagg

SEQ ID NO: 4859539 - DNA, 17 bp, Homo sapiens
ctgtggcctgcaggagg

SEQ ID NO: 4859540 - DNA, 18 bp, Homo sapiens
ctgtggcctgcaggaggg

SEQ ID NO: 4859541 - DNA, 22 bp, Homo sapiens
ctgtggtcatgtgagtctggga

SEQ ID NO: 4859542 - DNA, 21 bp, Homo sapiens
ctgtgtaaccagctcagtgtt

SEQ ID NO: 4859543 - DNA, 23 bp, Homo sapiens
ctgtgtaaccagctcagtgtttt

SEQ ID NO: 4859544 - DNA, 22 bp, Homo sapiens
ctgtgtctgcccaatgaataat

SEQ ID NO: 4859545 - DNA, 19 bp, Homo sapiens
ctgtgtttagattgtatta

SEQ ID NO: 4859546 - DNA, 22 bp, Homo sapiens
ctgtgttttgaaagaatagaac

SEQ ID NO: 4859547 - DNA, 19 bp, Homo sapiens
ctgttccattacaccacag

SEQ ID NO: 4859548 - DNA, 22 bp, Homo sapiens
ctgttctgatcggccagttttc

SEQ ID NO: 4859549 - DNA, 15 bp, Homo sapiens
ctgttgcacttttga

SEQ ID NO: 4859550 - DNA, 23 bp, Homo sapiens
ctgttggaatggatttttcttta

SEQ ID NO: 4859551 - DNA, 21 bp, Homo sapiens
ctgttgtaagaattctgattg

SEQ ID NO: 4859552 - DNA, 16 bp, Homo sapiens
ctgtttcctagctgtg

SEQ ID NO: 4859553 - DNA, 23 bp, Homo sapiens
ctgtttgatataccaaattaaaa

SEQ ID NO: 4859554 - DNA, 18 bp, Homo sapiens
ctgtttgcatttgataca

SEQ ID NO: 4859555 - DNA, 19 bp, Homo sapiens
ctgttttgtggtttggaat

SEQ ID NO: 4859556 - DNA, 20 bp, Homo sapiens
cttaaaaggtactggtacta

SEQ ID NO: 4859557 - DNA, 18 bp, Homo sapiens
cttaaagaaaacccaccc

SEQ ID NO: 4859558 - DNA, 12 bp, Homo sapiens
cttaactatgag

SEQ ID NO: 4859559 - DNA, 20 bp, Homo sapiens
cttaaggggtatcatgtatg

SEQ ID NO: 4859560 - DNA, 18 bp, Homo sapiens
cttaatggagttcttgtg

SEQ ID NO: 4859561 - DNA, 10 bp, Homo sapiens
cttaattatt

SEQ ID NO: 4859562 - DNA, 15 bp, Homo sapiens
cttacaatattgatt

SEQ ID NO: 4859563 - DNA, 21 bp, Homo sapiens
cttacaatattgattgggaaa

SEQ ID NO: 4859564 - DNA, 13 bp, Homo sapiens
cttacaggagcca

SEQ ID NO: 4859565 - DNA, 16 bp, Homo sapiens
cttacaggagccagcc

SEQ ID NO: 4859566 - DNA, 18 bp, Homo sapiens
cttacaggagccagcctg

SEQ ID NO: 4859567 - DNA, 23 bp, Homo sapiens
cttacaggagccagcctgcttcc

SEQ ID NO: 4859568 - DNA, 21 bp, Homo sapiens
cttacatgttcccaaaacaat

SEQ ID NO: 4859569 - DNA, 14 bp, Homo sapiens
cttacctgggcaca

SEQ ID NO: 4859570 - DNA, 18 bp, Homo sapiens
cttacctttcctgatgcc

SEQ ID NO: 4859571 - DNA, 22 bp, Homo sapiens
cttacctttcctgatgcccctg

SEQ ID NO: 4859572 - DNA, 21 bp, Homo sapiens
cttacttcaaagtgcctgggc

SEQ ID NO: 4859573 - DNA, 12 bp, Homo sapiens
cttagcatggta

SEQ ID NO: 4859574 - DNA, 17 bp, Homo sapiens
cttagccctcaccacag

SEQ ID NO: 4859575 - DNA, 19 bp, Homo sapiens
cttagccctcaccacagcc

SEQ ID NO: 4859576 - DNA, 20 bp, Homo sapiens
cttagccctcaccacagcct

SEQ ID NO: 4859577 - DNA, 21 bp, Homo sapiens
cttataacctagttaaagaaa

SEQ ID NO: 4859578 - DNA, 14 bp, Homo sapiens
cttatccaactttt

SEQ ID NO: 4859579 - DNA, 17 bp, Homo sapiens
cttatctgaaaggccag

SEQ ID NO: 4859580 - DNA, 22 bp, Homo sapiens
cttatctgaaaggccagcagct

SEQ ID NO: 4859581 - DNA, 22 bp, Homo sapiens
cttatttaatcttttcttattt

SEQ ID NO: 4859582 - DNA, 17 bp, Homo sapiens
cttatttctcagctgtg

SEQ ID NO: 4859583 - DNA, 16 bp, Homo sapiens
cttatttgtatatggt

SEQ ID NO: 4859584 - DNA, 20 bp, Homo sapiens
cttattttgttggtgctttg

SEQ ID NO: 4859585 - DNA, 23 bp, Homo sapiens
cttatttttataacatctttatt

SEQ ID NO: 4859586 - DNA, 14 bp, Homo sapiens
cttcaaaaagccac

SEQ ID NO: 4859587 - DNA, 22 bp, Homo sapiens
cttcaaagtgcctgggctcagc

SEQ ID NO: 4859588 - DNA, 21 bp, Homo sapiens
cttcaaccccgaggtccctgt

SEQ ID NO: 4859589 - DNA, 23 bp, Homo sapiens
cttcaaggctcttcttcctcacc

SEQ ID NO: 4859590 - DNA, 19 bp, Homo sapiens
cttcaagggtcagggtgag

SEQ ID NO: 4859591 - DNA, 17 bp, Homo sapiens
cttcacctccttctgca

SEQ ID NO: 4859592 - DNA, 15 bp, Homo sapiens
cttcactctggcttc

SEQ ID NO: 4859593 - DNA, 21 bp, Homo sapiens
cttcactctggcttcaaaaag

SEQ ID NO: 4859594 - DNA, 11 bp, Homo sapiens
cttcagccagg

SEQ ID NO: 4859595 - DNA, 13 bp, Homo sapiens
cttcagccaggca

SEQ ID NO: 4859596 - DNA, 14 bp, Homo sapiens
cttcaggagcctgg

SEQ ID NO: 4859597 - DNA, 17 bp, Homo sapiens
cttcaggagcctggcca

SEQ ID NO: 4859598 - DNA, 21 bp, Homo sapiens
gaagatcagcaccctaagaga

SEQ ID NO: 4859599 - DNA, 18 bp, Homo sapiens
gaagatgacctgccccaa

SEQ ID NO: 4859600 - DNA, 13 bp, Homo sapiens
gaagcagaacctt

SEQ ID NO: 4859601 - DNA, 21 bp, Homo sapiens
gaagccagtgtctaggcactg

SEQ ID NO: 4859602 - DNA, 19 bp, Homo sapiens
gaagccatagatgctggct

SEQ ID NO: 4859603 - DNA, 22 bp, Homo sapiens
gaagcctccaagcctgcctccc

SEQ ID NO: 4859604 - DNA, 16 bp, Homo sapiens
gaagcctccccagctc

SEQ ID NO: 4859605 - DNA, 18 bp, Homo sapiens
gaagctgccgtagcttca

SEQ ID NO: 4859606 - DNA, 19 bp, Homo sapiens
gaagctgccgtagcttcag

SEQ ID NO: 4859607 - DNA, 20 bp, Homo sapiens
gaagctgccgtagcttcagc

SEQ ID NO: 4859608 - DNA, 23 bp, Homo sapiens
gaagctgccgtagcttcagccag

SEQ ID NO: 4859609 - DNA, 14 bp, Homo sapiens
gaagctggagcagc

SEQ ID NO: 4859610 - DNA, 15 bp, Homo sapiens
gaagctgtttggaaa

SEQ ID NO: 4859611 - DNA, 18 bp, Homo sapiens
gaagctgtttggaaaaga

SEQ ID NO: 4859612 - DNA, 24 bp, Homo sapiens
gaaggagaatggcatggcaggagt

SEQ ID NO: 4859613 - DNA, 20 bp, Homo sapiens
gaaggcaaactgaggcagca

SEQ ID NO: 4859614 - DNA, 14 bp, Homo sapiens
gaaggcagagaaat

SEQ ID NO: 4859615 - DNA, 18 bp, Homo sapiens
gaaggcagagaaatctaa

SEQ ID NO: 4859616 - DNA, 16 bp, Homo sapiens
gaaggccagagaggga

SEQ ID NO: 4859617 - DNA, 17 bp, Homo sapiens
gaaggccagagagggaa

SEQ ID NO: 4859618 - DNA, 15 bp, Homo sapiens
gaagggaccccagat

SEQ ID NO: 4859619 - DNA, 22 bp, Homo sapiens
gaagggcctgcccagttgcact

SEQ ID NO: 4859620 - DNA, 13 bp, Homo sapiens
gaaggggcctggg

SEQ ID NO: 4859621 - DNA, 21 bp, Homo sapiens
gaaggggcctgggctgtgagg

SEQ ID NO: 4859622 - DNA, 11 bp, Homo sapiens
gaaggggctgg

SEQ ID NO: 4859623 - DNA, 19 bp, Homo sapiens
gaaggtagcattctttgga

SEQ ID NO: 4859624 - DNA, 13 bp, Homo sapiens
gaaggtgaacttt

SEQ ID NO: 4859625 - DNA, 19 bp, Homo sapiens
gaaggtgatgttgccatcc

SEQ ID NO: 4859626 - DNA, 14 bp, Homo sapiens
gaagtacagggcag

SEQ ID NO: 4859627 - DNA, 21 bp, Homo sapiens
gaagtacttggcccccttcag

SEQ ID NO: 4859628 - DNA, 17 bp, Homo sapiens
gaagtcagaatttttaa

SEQ ID NO: 4859629 - DNA, 13 bp, Homo sapiens
gaagtcttctatt

SEQ ID NO: 4859630 - DNA, 18 bp, Homo sapiens
gaagtctttgccttctct

SEQ ID NO: 4859631 - DNA, 22 bp, Homo sapiens
gaagtgcggggtaggggaagaa

SEQ ID NO: 4859632 - DNA, 17 bp, Homo sapiens
gaagtgtgtgccaagag

SEQ ID NO: 4859633 - DNA, 18 bp, Homo sapiens
gaagtgtgtgccaagagc

SEQ ID NO: 4859634 - DNA, 16 bp, Homo sapiens
gaagtgtttatgttgt

SEQ ID NO: 4859635 - DNA, 21 bp, Homo sapiens
gaagtgtttcacgagagcccg

SEQ ID NO: 4859636 - DNA, 22 bp, Homo sapiens
gaagtgtttcacgagagcccgg

SEQ ID NO: 4859637 - DNA, 15 bp, Homo sapiens
gaagttagtggaaat

SEQ ID NO: 4859638 - DNA, 22 bp, Homo sapiens
gaagttgccatgggaaacaaat

SEQ ID NO: 4859639 - DNA, 22 bp, Homo sapiens
gaagtttcaagttttaaagttc

SEQ ID NO: 4859640 - DNA, 17 bp, Homo sapiens
gaataatttccttcagg

SEQ ID NO: 4859641 - DNA, 21 bp, Homo sapiens
gaatactgccaaaacatttat

SEQ ID NO: 4859642 - DNA, 13 bp, Homo sapiens
gaatataaaaaat

SEQ ID NO: 4859643 - DNA, 23 bp, Homo sapiens
gaatatgtagtatctatatgact

SEQ ID NO: 4859644 - DNA, 14 bp, Homo sapiens
gaatattaaaaaac

SEQ ID NO: 4859645 - DNA, 23 bp, Homo sapiens
gaatcacagctcaagcattctgt

SEQ ID NO: 4859646 - DNA, 18 bp, Homo sapiens
gaatcattcagaaatgtt

SEQ ID NO: 4859647 - DNA, 15 bp, Homo sapiens
gaatccaagattggt

SEQ ID NO: 4859648 - DNA, 13 bp, Homo sapiens
gaatctagcccaa

SEQ ID NO: 4859649 - DNA, 16 bp, Homo sapiens
gaatctagcccaacct

SEQ ID NO: 4859650 - DNA, 17 bp, Homo sapiens
gaatcttcctggcacaa

SEQ ID NO: 4859651 - DNA, 20 bp, Homo sapiens
gaatcttgttttgaaaataa

SEQ ID NO: 4859652 - DNA, 22 bp, Homo sapiens
gaatctttagagaagtatacat

SEQ ID NO: 4859653 - DNA, 23 bp, Homo sapiens
gaatctttagagaagtatacata

SEQ ID NO: 4859654 - DNA, 12 bp, Homo sapiens
gaatgaaaataa

SEQ ID NO: 4859655 - DNA, 21 bp, Homo sapiens
gaatgaatgggatattttgaa

SEQ ID NO: 4859656 - DNA, 23 bp, Homo sapiens
gaatgaggaaaattcttaaaagg

SEQ ID NO: 4859657 - DNA, 19 bp, Homo sapiens
gaatgccatctatctagtt

SEQ ID NO: 4859658 - DNA, 16 bp, Homo sapiens
gaatggcatggcagga

SEQ ID NO: 4859659 - DNA, 13 bp, Homo sapiens
gaatggccacaaa

SEQ ID NO: 4859660 - DNA, 14 bp, Homo sapiens
gaatggcctggagc

SEQ ID NO: 4859661 - DNA, 17 bp, Homo sapiens
gaatgtcagttgttatt

SEQ ID NO: 4859662 - DNA, 22 bp, Homo sapiens
gaatgtcagttgttatttattg

SEQ ID NO: 4859663 - DNA, 15 bp, Homo sapiens
gaatgtccaaaattt

SEQ ID NO: 4859664 - DNA, 20 bp, Homo sapiens
gaatgtccaaaatttatatt

SEQ ID NO: 4859665 - DNA, 22 bp, Homo sapiens
gaatgtccaaaatttatatttt

SEQ ID NO: 4859666 - DNA, 13 bp, Homo sapiens
gaatgttctttct

SEQ ID NO: 4859667 - DNA, 18 bp, Homo sapiens
gaatgttctttctgctct

SEQ ID NO: 4859668 - DNA, 17 bp, Homo sapiens
gaattaattaatttgga

SEQ ID NO: 4859669 - DNA, 18 bp, Homo sapiens
gaattaattaatttggag

SEQ ID NO: 4859670 - DNA, 14 bp, Homo sapiens
gaattataactgta

SEQ ID NO: 4859671 - DNA, 15 bp, Homo sapiens
gaattatcagcaaag

SEQ ID NO: 4859672 - DNA, 17 bp, Homo sapiens
gaattatcagcaaagaa

SEQ ID NO: 4859673 - DNA, 18 bp, Homo sapiens
gaattatcagcaaagaaa

SEQ ID NO: 4859674 - DNA, 20 bp, Homo sapiens
gaattatcagcaaagaaaaa

SEQ ID NO: 4859675 - DNA, 19 bp, Homo sapiens
gaattctgtttaattttca

SEQ ID NO: 4859676 - DNA, 14 bp, Homo sapiens
gaattgaaaagttt

SEQ ID NO: 4859677 - DNA, 22 bp, Homo sapiens
gaattgaaaagtttttgtttgg

SEQ ID NO: 4859678 - DNA, 12 bp, Homo sapiens
gaatttaatata

SEQ ID NO: 4859679 - DNA, 14 bp, Homo sapiens
gaatttgaggtcta

SEQ ID NO: 4859680 - DNA, 13 bp, Homo sapiens
gaatttgccagag

SEQ ID NO: 4859681 - DNA, 12 bp, Homo sapiens
gaattttaaagt

SEQ ID NO: 4859682 - DNA, 15 bp, Homo sapiens
gaattttaaagtatg

SEQ ID NO: 4859683 - DNA, 15 bp, Homo sapiens
gaattttctaaaagc

SEQ ID NO: 4859684 - DNA, 15 bp, Homo sapiens
gacaaagcaatttac

SEQ ID NO: 4859685 - DNA, 19 bp, Homo sapiens
gacacaggatcctggcctg

SEQ ID NO: 4859686 - DNA, 19 bp, Homo sapiens
gacagaacttcagcattgt

SEQ ID NO: 4859687 - DNA, 21 bp, Homo sapiens
gacagaggtttgaaggagaat

SEQ ID NO: 4859688 - DNA, 13 bp, Homo sapiens
gacagcagcctgt

SEQ ID NO: 4859689 - DNA, 15 bp, Homo sapiens
gacagcagcctgtat

SEQ ID NO: 4859690 - DNA, 18 bp, Homo sapiens
gacagcagcctgtatgtg

SEQ ID NO: 4859691 - DNA, 16 bp, Homo sapiens
gacagccttgcaaccc

SEQ ID NO: 4859692 - DNA, 23 bp, Homo sapiens
gacagcttacaggagccagcctg

SEQ ID NO: 4859693 - DNA, 13 bp, Homo sapiens
gacagtgccttct

SEQ ID NO: 4859694 - DNA, 15 bp, Homo sapiens
gacagtgccttctct

SEQ ID NO: 4859695 - DNA, 21 bp, Homo sapiens
gacagtgttccccgataccat

SEQ ID NO: 4859696 - DNA, 16 bp, Homo sapiens
gacagttcccagagtg

SEQ ID NO: 4859697 - DNA, 20 bp, Homo sapiens
gacagttcccagagtgggct

SEQ ID NO: 4859698 - DNA, 15 bp, Homo sapiens
gacagttgatggagc

SEQ ID NO: 4859699 - DNA, 17 bp, Homo sapiens
gacagttgatggagccc

SEQ ID NO: 4859700 - DNA, 18 bp, Homo sapiens
gacagttgatggagcccc

SEQ ID NO: 4859701 - DNA, 22 bp, Homo sapiens
gacagttgatggagccccaggg

SEQ ID NO: 4859702 - DNA, 15 bp, Homo sapiens
gacagtttttgacat

SEQ ID NO: 4859703 - DNA, 15 bp, Homo sapiens
gacataagataaaat

SEQ ID NO: 4859704 - DNA, 20 bp, Homo sapiens
gacatacatattatctcatt

SEQ ID NO: 4859705 - DNA, 19 bp, Homo sapiens
gacatcatcattcttgtgg

SEQ ID NO: 4859706 - DNA, 17 bp, Homo sapiens
gacatctgaccccaagg

SEQ ID NO: 4859707 - DNA, 16 bp, Homo sapiens
gacatgagagtagggc

SEQ ID NO: 4859708 - DNA, 12 bp, Homo sapiens
gacatgtgacat

SEQ ID NO: 4859709 - DNA, 20 bp, Homo sapiens
gacatgtgacatttatatat

SEQ ID NO: 4859710 - DNA, 14 bp, Homo sapiens
gacatttagaagaa

SEQ ID NO: 4859711 - DNA, 15 bp, Homo sapiens
gacatttagaagaaa

SEQ ID NO: 4859712 - DNA, 21 bp, Homo sapiens
gaccaggcttttgtagatggc

SEQ ID NO: 4859713 - DNA, 18 bp, Homo sapiens
gaccaggtttgcaggagc

SEQ ID NO: 4859714 - DNA, 15 bp, Homo sapiens
gaccagtctgaccct

SEQ ID NO: 4859715 - DNA, 18 bp, Homo sapiens
gaccagtttaagccgcag

SEQ ID NO: 4859716 - DNA, 13 bp, Homo sapiens
gaccataagagaa

SEQ ID NO: 4859717 - DNA, 15 bp, Homo sapiens
gaccataagagaaac

SEQ ID NO: 4859718 - DNA, 16 bp, Homo sapiens
gcatcatctcttcctc

SEQ ID NO: 4859719 - DNA, 22 bp, Homo sapiens
gcatctcagtggtgtgtgaagt

SEQ ID NO: 4859720 - DNA, 23 bp, Homo sapiens
gcatctgttagcagagtctgtct

SEQ ID NO: 4859721 - DNA, 18 bp, Homo sapiens
gcatgaaataaaatatat

SEQ ID NO: 4859722 - DNA, 11 bp, Homo sapiens
gcatgcttccc

SEQ ID NO: 4859723 - DNA, 14 bp, Homo sapiens
gcatggagaatggg

SEQ ID NO: 4859724 - DNA, 16 bp, Homo sapiens
gcatggggaggcagca

SEQ ID NO: 4859725 - DNA, 17 bp, Homo sapiens
gcatggggaggcagcag

SEQ ID NO: 4859726 - DNA, 13 bp, Homo sapiens
gcatggggccagg

SEQ ID NO: 4859727 - DNA, 14 bp, Homo sapiens
gcatggggccagga

SEQ ID NO: 4859728 - DNA, 18 bp, Homo sapiens
gcatgtacaaaaattatg

SEQ ID NO: 4859729 - DNA, 23 bp, Homo sapiens
gcatgtgacttctcccctgccct

SEQ ID NO: 4859730 - DNA, 16 bp, Homo sapiens
gcatgtgtctggccct

SEQ ID NO: 4859731 - DNA, 13 bp, Homo sapiens
gcattagcaaggc

SEQ ID NO: 4859732 - DNA, 17 bp, Homo sapiens
gcattagcaaggcagag

SEQ ID NO: 4859733 - DNA, 20 bp, Homo sapiens
gcattagcaaggcagagcct

SEQ ID NO: 4859734 - DNA, 22 bp, Homo sapiens
gcattagcaaggcagagccttt

SEQ ID NO: 4859735 - DNA, 14 bp, Homo sapiens
gcattattaaattg

SEQ ID NO: 4859736 - DNA, 18 bp, Homo sapiens
gcattattaaattgtaaa

SEQ ID NO: 4859737 - DNA, 22 bp, Homo sapiens
gcattccagctgtcactctgtg

SEQ ID NO: 4859738 - DNA, 10 bp, Homo sapiens
gcattgagta

SEQ ID NO: 4859739 - DNA, 13 bp, Homo sapiens
gcattgcagccta

SEQ ID NO: 4859740 - DNA, 16 bp, Homo sapiens
gcattgcagcctaaga

SEQ ID NO: 4859741 - DNA, 12 bp, Homo sapiens
gcattggatatt

SEQ ID NO: 4859742 - DNA, 13 bp, Homo sapiens
gcatttaataaag

SEQ ID NO: 4859743 - DNA, 18 bp, Homo sapiens
gcatttaatggcagctag

SEQ ID NO: 4859744 - DNA, 18 bp, Homo sapiens
gcatttttattaaagcat

SEQ ID NO: 4859745 - DNA, 14 bp, Homo sapiens
gccaaaacatttat

SEQ ID NO: 4859746 - DNA, 16 bp, Homo sapiens
gccaacctcaggctcc

SEQ ID NO: 4859747 - DNA, 20 bp, Homo sapiens
gccaagctgaggaggtgctg

SEQ ID NO: 4859748 - DNA, 14 bp, Homo sapiens
gccaagctggcaca

SEQ ID NO: 4859749 - DNA, 16 bp, Homo sapiens
gccaagctttaaatta

SEQ ID NO: 4859750 - DNA, 16 bp, Homo sapiens
gccaaggagcatcctt

SEQ ID NO: 4859751 - DNA, 21 bp, Homo sapiens
gccaatctttcctactttcta

SEQ ID NO: 4859752 - DNA, 22 bp, Homo sapiens
gccaatctttcctactttctat

SEQ ID NO: 4859753 - DNA, 14 bp, Homo sapiens
gccaattagacttg

SEQ ID NO: 4859754 - DNA, 13 bp, Homo sapiens
gccacgggggcag

SEQ ID NO: 4859755 - DNA, 22 bp, Homo sapiens
gccacgggtctgtgttcgactc

SEQ ID NO: 4859756 - DNA, 13 bp, Homo sapiens
gccacttctcccc

SEQ ID NO: 4859757 - DNA, 15 bp, Homo sapiens
gccacttctccccag

SEQ ID NO: 4859758 - DNA, 22 bp, Homo sapiens
gccagagagggaaaaggcaggt

SEQ ID NO: 4859759 - DNA, 12 bp, Homo sapiens
gccagaggacca

SEQ ID NO: 4859760 - DNA, 19 bp, Homo sapiens
gccagaggaccaatgcttg

SEQ ID NO: 4859761 - DNA, 16 bp, Homo sapiens
gccagattggccaatt

SEQ ID NO: 4859762 - DNA, 12 bp, Homo sapiens
gccagcagctga

SEQ ID NO: 4859763 - DNA, 13 bp, Homo sapiens
gccagcagctgat

SEQ ID NO: 4859764 - DNA, 16 bp, Homo sapiens
gccagcagctgatgct

SEQ ID NO: 4859765 - DNA, 17 bp, Homo sapiens
gccagcagctgatgctg

SEQ ID NO: 4859766 - DNA, 21 bp, Homo sapiens
gccagccttgtacagtctgct

SEQ ID NO: 4859767 - DNA, 16 bp, Homo sapiens
gccagcgtgtggagca

SEQ ID NO: 4859768 - DNA, 18 bp, Homo sapiens
gccagcgtgtggagcaga

SEQ ID NO: 4859769 - DNA, 16 bp, Homo sapiens
gccagctgcagcctgg

SEQ ID NO: 4859770 - DNA, 12 bp, Homo sapiens
gccagctgtgca

SEQ ID NO: 4859771 - DNA, 14 bp, Homo sapiens
gccagctgtgcact

SEQ ID NO: 4859772 - DNA, 14 bp, Homo sapiens
gccaggactcccag

SEQ ID NO: 4859773 - DNA, 15 bp, Homo sapiens
gccaggactcccaga

SEQ ID NO: 4859774 - DNA, 19 bp, Homo sapiens
gccaggatccccctctttg

SEQ ID NO: 4859775 - DNA, 15 bp, Homo sapiens
gccaggcagggagag

SEQ ID NO: 4859776 - DNA, 15 bp, Homo sapiens
gccaggggctctgtg

SEQ ID NO: 4859777 - DNA, 18 bp, Homo sapiens
gccaggggctctgtggca

SEQ ID NO: 4859778 - DNA, 16 bp, Homo sapiens
gccaggtccttgccct

SEQ ID NO: 4859779 - DNA, 16 bp, Homo sapiens
gccaggtctgactcca

SEQ ID NO: 4859780 - DNA, 18 bp, Homo sapiens
gccaggtctgactccaaa

SEQ ID NO: 4859781 - DNA, 19 bp, Homo sapiens
gccaggtctgactccaaag

SEQ ID NO: 4859782 - DNA, 22 bp, Homo sapiens
gccaggtctgactccaaagctg

SEQ ID NO: 4859783 - DNA, 17 bp, Homo sapiens
gccagtatttttaaagg

SEQ ID NO: 4859784 - DNA, 12 bp, Homo sapiens
gccagtcactgc

SEQ ID NO: 4859785 - DNA, 16 bp, Homo sapiens
gccagtcactgctgca

SEQ ID NO: 4859786 - DNA, 14 bp, Homo sapiens
gccagtgtctaggc

SEQ ID NO: 4859787 - DNA, 18 bp, Homo sapiens
gccagtgtctaggcactg

SEQ ID NO: 4859788 - DNA, 20 bp, Homo sapiens
gccatgccaataaagtgatc

SEQ ID NO: 4859789 - DNA, 15 bp, Homo sapiens
gccatgttcccagaa

SEQ ID NO: 4859790 - DNA, 21 bp, Homo sapiens
gcccaaacctgggaaggccag

SEQ ID NO: 4859791 - DNA, 14 bp, Homo sapiens
gcccaatgaattat

SEQ ID NO: 4859792 - DNA, 18 bp, Homo sapiens
gcccaatgctgcttttgg

SEQ ID NO: 4859793 - DNA, 12 bp, Homo sapiens
gcccactcctgg

SEQ ID NO: 4859794 - DNA, 16 bp, Homo sapiens
gcccagagcagggtct

SEQ ID NO: 4859795 - DNA, 18 bp, Homo sapiens
gcccagcccctggtggtg

SEQ ID NO: 4859796 - DNA, 22 bp, Homo sapiens
gcccagtacatttaaatttttt

SEQ ID NO: 4859797 - DNA, 14 bp, Homo sapiens
gcccagtgccagca

SEQ ID NO: 4859798 - DNA, 17 bp, Homo sapiens
gcccattcagagctatg

SEQ ID NO: 4859799 - DNA, 16 bp, Homo sapiens
gccccactacaggccc

SEQ ID NO: 4859800 - DNA, 11 bp, Homo sapiens
gccccaggaga

SEQ ID NO: 4859801 - DNA, 12 bp, Homo sapiens
gccccaggagaa

SEQ ID NO: 4859802 - DNA, 22 bp, Homo sapiens
gccccagtgttatttattcccc

SEQ ID NO: 4859803 - DNA, 14 bp, Homo sapiens
gcccccacctccac

SEQ ID NO: 4859804 - DNA, 18 bp, Homo sapiens
gcccccacctccaccctc

SEQ ID NO: 4859805 - DNA, 19 bp, Homo sapiens
gcccccattcccagcctga

SEQ ID NO: 4859806 - DNA, 18 bp, Homo sapiens
gccccccctatctcttcc

SEQ ID NO: 4859807 - DNA, 22 bp, Homo sapiens
gccccccctatctcttcctgtc

SEQ ID NO: 4859808 - DNA, 19 bp, Homo sapiens
gccccccgcgcgcccaccc

SEQ ID NO: 4859809 - DNA, 12 bp, Homo sapiens
gcccccttcagg

SEQ ID NO: 4859810 - DNA, 19 bp, Homo sapiens
gcccccttcaggagcctgg

SEQ ID NO: 4859811 - DNA, 23 bp, Homo sapiens
gcccccttcaggagcctggccag

SEQ ID NO: 4859812 - DNA, 12 bp, Homo sapiens
gccccgcccctc

SEQ ID NO: 4859813 - DNA, 13 bp, Homo sapiens
gccccgcccctcc

SEQ ID NO: 4859814 - DNA, 19 bp, Homo sapiens
gccccgtgtcctgcctgtc

SEQ ID NO: 4859815 - DNA, 15 bp, Homo sapiens
gcccctaaagagcat

SEQ ID NO: 4859816 - DNA, 15 bp, Homo sapiens
gcccctactgtgggc

SEQ ID NO: 4859817 - DNA, 13 bp, Homo sapiens
gcccctcccacgc

SEQ ID NO: 4859818 - DNA, 13 bp, Homo sapiens
gcccctgacatca

SEQ ID NO: 4859819 - DNA, 14 bp, Homo sapiens
gcccgggagctgct

SEQ ID NO: 4859820 - DNA, 13 bp, Homo sapiens
gccctaactccta

SEQ ID NO: 4859821 - DNA, 14 bp, Homo sapiens
gccctattgctgct

SEQ ID NO: 4859822 - DNA, 14 bp, Homo sapiens
gccctctagcttct

SEQ ID NO: 4859823 - DNA, 15 bp, Homo sapiens
gccctctctctgggc

SEQ ID NO: 4859824 - DNA, 18 bp, Homo sapiens
gccctctgctctgcctgg

SEQ ID NO: 4859825 - DNA, 19 bp, Homo sapiens
gccctctgctctgcctgga

SEQ ID NO: 4859826 - DNA, 20 bp, Homo sapiens
gccctctgctctgcctggag

SEQ ID NO: 4859827 - DNA, 22 bp, Homo sapiens
gccctctgctctgcctggagtg

SEQ ID NO: 4859828 - DNA, 15 bp, Homo sapiens
gccctgacaggcctt

SEQ ID NO: 4859829 - DNA, 18 bp, Homo sapiens
gccctgacaggccttcct

SEQ ID NO: 4859830 - DNA, 16 bp, Homo sapiens
gccctggagctcaggg

SEQ ID NO: 4859831 - DNA, 18 bp, Homo sapiens
gccctgtgagcacaaaga

SEQ ID NO: 4859832 - DNA, 22 bp, Homo sapiens
gccctgtgagcacaaagaagaa

SEQ ID NO: 4859833 - DNA, 20 bp, Homo sapiens
gccctgttcagctactccca

SEQ ID NO: 4859834 - DNA, 20 bp, Homo sapiens
gcccttacctttcctgatgc

SEQ ID NO: 4859835 - DNA, 13 bp, Homo sapiens
gcccttagaggga

SEQ ID NO: 4859836 - DNA, 14 bp, Homo sapiens
gcccttcctcctga

SEQ ID NO: 4859837 - DNA, 12 bp, Homo sapiens
gccctttcctgg

SEQ ID NO: 4859838 - DNA, 21 bp, Homo sapiens
gccgcagacctggagcttcag

SEQ ID NO: 4859839 - DNA, 20 bp, Homo sapiens
gccgcagagaaatgccccag

SEQ ID NO: 4859840 - DNA, 23 bp, Homo sapiens
ggaactaggctcttatgtgtgcc

SEQ ID NO: 4859841 - DNA, 17 bp, Homo sapiens
ggaactcccccagaggt

SEQ ID NO: 4859842 - DNA, 20 bp, Homo sapiens
ggaactcccccagaggtgga

SEQ ID NO: 4859843 - DNA, 12 bp, Homo sapiens
ggaactgaaatc

SEQ ID NO: 4859844 - DNA, 15 bp, Homo sapiens
ggaagagggaggggc

SEQ ID NO: 4859845 - DNA, 23 bp, Homo sapiens
ggaagccatagatgctggctggg

SEQ ID NO: 4859846 - DNA, 17 bp, Homo sapiens
ggaaggacctgctccca

SEQ ID NO: 4859847 - DNA, 18 bp, Homo sapiens
ggaaggggcctgggctgt

SEQ ID NO: 4859848 - DNA, 23 bp, Homo sapiens
ggaaggggcctgggctgtgagga

SEQ ID NO: 4859849 - DNA, 24 bp, Homo sapiens
ggaagtacttggcccccttcagga

SEQ ID NO: 4859850 - DNA, 20 bp, Homo sapiens
ggaagtcagaatttttaact

SEQ ID NO: 4859851 - DNA, 19 bp, Homo sapiens
ggaataatttccttcaggc

SEQ ID NO: 4859852 - DNA, 22 bp, Homo sapiens
ggaataatttccttcaggcagc

SEQ ID NO: 4859853 - DNA, 18 bp, Homo sapiens
ggaatctagcccaaccta

SEQ ID NO: 4859854 - DNA, 19 bp, Homo sapiens
ggaatggatttttctttaa

SEQ ID NO: 4859855 - DNA, 20 bp, Homo sapiens
ggacacaggatcctggcctg

SEQ ID NO: 4859856 - DNA, 21 bp, Homo sapiens
ggacagggcccccacagggga

SEQ ID NO: 4859857 - DNA, 21 bp, Homo sapiens
ggacagttgatggagccccag

SEQ ID NO: 4859858 - DNA, 22 bp, Homo sapiens
ggacagttgatggagccccagg

SEQ ID NO: 4859859 - DNA, 22 bp, Homo sapiens
ggacataagataaaatgatgtt

SEQ ID NO: 4859860 - DNA, 15 bp, Homo sapiens
ggacatctgacccca

SEQ ID NO: 4859861 - DNA, 15 bp, Homo sapiens
ggacatgagagtagg

SEQ ID NO: 4859862 - DNA, 21 bp, Homo sapiens
ggacatgagagtagggccctg

SEQ ID NO: 4859863 - DNA, 23 bp, Homo sapiens
ggacatgagagtagggccctgac

SEQ ID NO: 4859864 - DNA, 16 bp, Homo sapiens
ggacatgcaataaaat

SEQ ID NO: 4859865 - DNA, 18 bp, Homo sapiens
ggacatgcaataaaattt

SEQ ID NO: 4859866 - DNA, 19 bp, Homo sapiens
ggaccaggtttgcaggagc

SEQ ID NO: 4859867 - DNA, 13 bp, Homo sapiens
ggacccagagctg

SEQ ID NO: 4859868 - DNA, 21 bp, Homo sapiens
ggaccccagatacctgtgagg

SEQ ID NO: 4859869 - DNA, 16 bp, Homo sapiens
ggaccctcgagagcct

SEQ ID NO: 4859870 - DNA, 18 bp, Homo sapiens
ggaccctcgagagcctta

SEQ ID NO: 4859871 - DNA, 21 bp, Homo sapiens
ggacctccttagccctgtctg

SEQ ID NO: 4859872 - DNA, 18 bp, Homo sapiens
ggacctgtggtcatgtga

SEQ ID NO: 4859873 - DNA, 14 bp, Homo sapiens
ggaccttgcttcct

SEQ ID NO: 4859874 - DNA, 18 bp, Homo sapiens
ggacgggatgacctccag

SEQ ID NO: 4859875 - DNA, 20 bp, Homo sapiens
ggacgggatgacctccagaa

SEQ ID NO: 4859876 - DNA, 17 bp, Homo sapiens
ggacgttaggccaggcc

SEQ ID NO: 4859877 - DNA, 14 bp, Homo sapiens
ggacgttgttttgg

SEQ ID NO: 4859878 - DNA, 15 bp, Homo sapiens
ggactcacttgccca

SEQ ID NO: 4859879 - DNA, 15 bp, Homo sapiens
ggactctcagggatt

SEQ ID NO: 4859880 - DNA, 16 bp, Homo sapiens
ggactgtgggaaagag

SEQ ID NO: 4859881 - DNA, 12 bp, Homo sapiens
ggagaagccagt

SEQ ID NO: 4859882 - DNA, 19 bp, Homo sapiens
ggagaatggcatggcagga

SEQ ID NO: 4859883 - DNA, 19 bp, Homo sapiens
ggagacatgtgacatttat

SEQ ID NO: 4859884 - DNA, 13 bp, Homo sapiens
ggagattgaactt

SEQ ID NO: 4859885 - DNA, 14 bp, Homo sapiens
ggagattgaacttt

SEQ ID NO: 4859886 - DNA, 21 bp, Homo sapiens
ggagcacacatccaagaggga

SEQ ID NO: 4859887 - DNA, 12 bp, Homo sapiens
ggagcagcaggc

SEQ ID NO: 4859888 - DNA, 14 bp, Homo sapiens
ggagcagcaggcct

SEQ ID NO: 4859889 - DNA, 15 bp, Homo sapiens
ggagcaggcccaatg

SEQ ID NO: 4859890 - DNA, 20 bp, Homo sapiens
ggagcatttaatggcagcta

SEQ ID NO: 4859891 - DNA, 24 bp, Homo sapiens
ggagcatttaatggcagctagtgc

SEQ ID NO: 4859892 - DNA, 14 bp, Homo sapiens
ggagccagctgctt

SEQ ID NO: 4859893 - DNA, 23 bp, Homo sapiens
ggagccagctgcttgacctagct

SEQ ID NO: 4859894 - DNA, 23 bp, Homo sapiens
ggagccaggactcccagaacctc

SEQ ID NO: 4859895 - DNA, 23 bp, Homo sapiens
ggagcctacctctgtctgagaca

SEQ ID NO: 4859896 - DNA, 13 bp, Homo sapiens
ggagcgttctaaa

SEQ ID NO: 4859897 - DNA, 16 bp, Homo sapiens
ggagcttcagccaggt

SEQ ID NO: 4859898 - DNA, 20 bp, Homo sapiens
ggaggctgctcggctactgg

SEQ ID NO: 4859899 - DNA, 19 bp, Homo sapiens
ggagggcccctgcgtgggg

SEQ ID NO: 4859900 - DNA, 13 bp, Homo sapiens
ggaggggaggcag

SEQ ID NO: 4859901 - DNA, 14 bp, Homo sapiens
ggagtcagtgccag

SEQ ID NO: 4859902 - DNA, 23 bp, Homo sapiens
ggagtgctcttcccactccagct

SEQ ID NO: 4859903 - DNA, 13 bp, Homo sapiens
ggagtgtgcagac

SEQ ID NO: 4859904 - DNA, 16 bp, Homo sapiens
ggagtgtgcagacagc

SEQ ID NO: 4859905 - DNA, 16 bp, Homo sapiens
ggatagcgctcccctt

SEQ ID NO: 4859906 - DNA, 16 bp, Homo sapiens
ggataggacagaggga

SEQ ID NO: 4859907 - DNA, 21 bp, Homo sapiens
ggatattttgaaatgaacttt

SEQ ID NO: 4859908 - DNA, 19 bp, Homo sapiens
ggatccagggcagcaggcc

SEQ ID NO: 4859909 - DNA, 21 bp, Homo sapiens
ggatccagggcagcaggccag

SEQ ID NO: 4859910 - DNA, 12 bp, Homo sapiens
ggatcctccctc

SEQ ID NO: 4859911 - DNA, 13 bp, Homo sapiens
ggatcctggcctg

SEQ ID NO: 4859912 - DNA, 16 bp, Homo sapiens
ggatcctggcctgaga

SEQ ID NO: 4859913 - DNA, 17 bp, Homo sapiens
ggatcctggcctgagaa

SEQ ID NO: 4859914 - DNA, 20 bp, Homo sapiens
ggatcgagtgtagctgtgaa

SEQ ID NO: 4859915 - DNA, 21 bp, Homo sapiens
ggatcgagtgtagctgtgaaa

SEQ ID NO: 4859916 - DNA, 15 bp, Homo sapiens
ggatgacctccagaa

SEQ ID NO: 4859917 - DNA, 18 bp, Homo sapiens
ggatggagggaagacctg

SEQ ID NO: 4859918 - DNA, 14 bp, Homo sapiens
ggatggcttgtcta

SEQ ID NO: 4859919 - DNA, 16 bp, Homo sapiens
ggatggtggtgcatcc

SEQ ID NO: 4859920 - DNA, 15 bp, Homo sapiens
ggattgcctctgaaa

SEQ ID NO: 4859921 - DNA, 23 bp, Homo sapiens
ggattgtgcctaatgtgtttgag

SEQ ID NO: 4859922 - DNA, 16 bp, Homo sapiens
ggatttaaaagcctgc

SEQ ID NO: 4859923 - DNA, 18 bp, Homo sapiens
ggatttaaaagcctgctc

SEQ ID NO: 4859924 - DNA, 19 bp, Homo sapiens
ggatttaaaagcctgctca

SEQ ID NO: 4859925 - DNA, 18 bp, Homo sapiens
ggcaaagtgacaaagcaa

SEQ ID NO: 4859926 - DNA, 19 bp, Homo sapiens
ggcaagaaagcttccttca

SEQ ID NO: 4859927 - DNA, 19 bp, Homo sapiens
ggcacaaaagacagctggc

SEQ ID NO: 4859928 - DNA, 13 bp, Homo sapiens
ggcacagccttct

SEQ ID NO: 4859929 - DNA, 15 bp, Homo sapiens
ggcacatagcatagg

SEQ ID NO: 4859930 - DNA, 15 bp, Homo sapiens
ggcaccaggggccaa

SEQ ID NO: 4859931 - DNA, 16 bp, Homo sapiens
ggcactagccaaagcg

SEQ ID NO: 4859932 - DNA, 13 bp, Homo sapiens
ggcactgagcagg

SEQ ID NO: 4859933 - DNA, 15 bp, Homo sapiens
ggcagacaaccttgt

SEQ ID NO: 4859934 - DNA, 16 bp, Homo sapiens
ggcagacaaccttgtc

SEQ ID NO: 4859935 - DNA, 21 bp, Homo sapiens
ggcagagaccataagagaaac

SEQ ID NO: 4859936 - DNA, 23 bp, Homo sapiens
ggcagagcctttttacctggcct

SEQ ID NO: 4859937 - DNA, 12 bp, Homo sapiens
ggcagcaggcca

SEQ ID NO: 4859938 - DNA, 16 bp, Homo sapiens
ggcagcctagcctatg

SEQ ID NO: 4859939 - DNA, 23 bp, Homo sapiens
ggcagcctagcctatgtctggca

SEQ ID NO: 4859940 - DNA, 14 bp, Homo sapiens
ggcagctagtgcct

SEQ ID NO: 4859941 - DNA, 13 bp, Homo sapiens
ggcagcttgctgg

SEQ ID NO: 4859942 - DNA, 17 bp, Homo sapiens
ggcagcttgctgggctt

SEQ ID NO: 4859943 - DNA, 14 bp, Homo sapiens
ggcaggcctcccaa

SEQ ID NO: 4859944 - DNA, 17 bp, Homo sapiens
ggcaggcctcccaagct

SEQ ID NO: 4859945 - DNA, 22 bp, Homo sapiens
ggcaggcctcccaagctgatgg

SEQ ID NO: 4859946 - DNA, 11 bp, Homo sapiens
ggcagggccct

SEQ ID NO: 4859947 - DNA, 12 bp, Homo sapiens
ggcataaagtaa

SEQ ID NO: 4859948 - DNA, 14 bp, Homo sapiens
ggcatggcaggagt

SEQ ID NO: 4859949 - DNA, 16 bp, Homo sapiens
ggcatgtgtctggccc

SEQ ID NO: 4859950 - DNA, 22 bp, Homo sapiens
ggcattagcaaggcagagcctt

SEQ ID NO: 4859951 - DNA, 16 bp, Homo sapiens
ggccaaagagtctcca

SEQ ID NO: 4859952 - DNA, 14 bp, Homo sapiens
ggccaagctgagga

SEQ ID NO: 4859953 - DNA, 23 bp, Homo sapiens
ggccaagctgaggaggtgctgca

SEQ ID NO: 4859954 - DNA, 16 bp, Homo sapiens
ggccaaggtcctgctc

SEQ ID NO: 4859955 - DNA, 19 bp, Homo sapiens
ggccaccccctatcctctg

SEQ ID NO: 4859956 - DNA, 16 bp, Homo sapiens
ggccacgggggcagtg

SEQ ID NO: 4859957 - DNA, 21 bp, Homo sapiens
ggccacgggggcagtgtgagg

SEQ ID NO: 4859958 - DNA, 14 bp, Homo sapiens
ggccagagaaagca

SEQ ID NO: 4859959 - DNA, 16 bp, Homo sapiens
ggccagagaaagcaaa

SEQ ID NO: 4859960 - DNA, 15 bp, Homo sapiens
gtataatgtttatta

SEQ ID NO: 4859961 - DNA, 15 bp, Homo sapiens
gtatactgtaggcac

SEQ ID NO: 4859962 - DNA, 13 bp, Homo sapiens
gtatatattttgt

SEQ ID NO: 4859963 - DNA, 19 bp, Homo sapiens
gtatatgactgcatttgtg

SEQ ID NO: 4859964 - DNA, 13 bp, Homo sapiens
gtatattaaaaaa

SEQ ID NO: 4859965 - DNA, 19 bp, Homo sapiens
gtatattaaaaaagagaca

SEQ ID NO: 4859966 - DNA, 21 bp, Homo sapiens
gtatcactgccttcgtttata

SEQ ID NO: 4859967 - DNA, 17 bp, Homo sapiens
gtatgcattattaaatt

SEQ ID NO: 4859968 - DNA, 13 bp, Homo sapiens
gtatgtcaaagct

SEQ ID NO: 4859969 - DNA, 15 bp, Homo sapiens
gtatgtgggatattg

SEQ ID NO: 4859970 - DNA, 20 bp, Homo sapiens
gtatgtgggatattgaatgt

SEQ ID NO: 4859971 - DNA, 21 bp, Homo sapiens
gtattaaaaaacaattaactg

SEQ ID NO: 4859972 - DNA, 23 bp, Homo sapiens
gtattaaaaaacaattaactgcc

SEQ ID NO: 4859973 - DNA, 20 bp, Homo sapiens
gtattatcttgttcaggaaa

SEQ ID NO: 4859974 - DNA, 21 bp, Homo sapiens
gtattcccaaaaattactttg

SEQ ID NO: 4859975 - DNA, 13 bp, Homo sapiens
gtattgcacattg

SEQ ID NO: 4859976 - DNA, 18 bp, Homo sapiens
gtattggtgttgcagccg

SEQ ID NO: 4859977 - DNA, 19 bp, Homo sapiens
gtatttattttttcttttc

SEQ ID NO: 4859978 - DNA, 10 bp, Homo sapiens
gtatttcctt

SEQ ID NO: 4859979 - DNA, 16 bp, Homo sapiens
gtattttcatgaaaat

SEQ ID NO: 4859980 - DNA, 22 bp, Homo sapiens
gtcaaatgcatacaagtttcat

SEQ ID NO: 4859981 - DNA, 13 bp, Homo sapiens
gtcaacatttctc

SEQ ID NO: 4859982 - DNA, 17 bp, Homo sapiens
gtcaacatttctcatgt

SEQ ID NO: 4859983 - DNA, 19 bp, Homo sapiens
gtcacacattacaaagtta

SEQ ID NO: 4859984 - DNA, 12 bp, Homo sapiens
gtcacagcctca

SEQ ID NO: 4859985 - DNA, 14 bp, Homo sapiens
gtcacatccatccc

SEQ ID NO: 4859986 - DNA, 19 bp, Homo sapiens
gtcacatccatccctccat

SEQ ID NO: 4859987 - DNA, 16 bp, Homo sapiens
gtcacatgactctcat

SEQ ID NO: 4859988 - DNA, 19 bp, Homo sapiens
gtcacatgactctcatttt

SEQ ID NO: 4859989 - DNA, 19 bp, Homo sapiens
gtcaccaaaagacactgca

SEQ ID NO: 4859990 - DNA, 15 bp, Homo sapiens
gtcaccgcaggtgct

SEQ ID NO: 4859991 - DNA, 18 bp, Homo sapiens
gtcactcccaagccccct

SEQ ID NO: 4859992 - DNA, 13 bp, Homo sapiens
gtcacttttcctt

SEQ ID NO: 4859993 - DNA, 15 bp, Homo sapiens
gtcagatgaggcaaa

SEQ ID NO: 4859994 - DNA, 19 bp, Homo sapiens
gtcagctgggatgtgaagt

SEQ ID NO: 4859995 - DNA, 14 bp, Homo sapiens
gtcaggggggagaa

SEQ ID NO: 4859996 - DNA, 21 bp, Homo sapiens
gtcagttgttatttattgaaa

SEQ ID NO: 4859997 - DNA, 19 bp, Homo sapiens
gtcatgaagaatgtttctg

SEQ ID NO: 4859998 - DNA, 12 bp, Homo sapiens
gtcatgtgagtc

SEQ ID NO: 4859999 - DNA, 18 bp, Homo sapiens
gtcatgtgagtctgggat

SEQ ID NO: 4860000 - DNA, 17 bp, Homo sapiens
gtcattatgttaatatt

SEQ ID NO: 4860001 - DNA, 14 bp, Homo sapiens
gtcattcagaaaaa

SEQ ID NO: 4860002 - DNA, 22 bp, Homo sapiens
gtcatttctatattcctccagc

SEQ ID NO: 4860003 - DNA, 23 bp, Homo sapiens
gtcatttctatattcctccagct

SEQ ID NO: 4860004 - DNA, 17 bp, Homo sapiens
gtccaaacgtcctcttt

SEQ ID NO: 4860005 - DNA, 12 bp, Homo sapiens
gtccactcccag

SEQ ID NO: 4860006 - DNA, 15 bp, Homo sapiens
gtccactcccagtgc

SEQ ID NO: 4860007 - DNA, 15 bp, Homo sapiens
gtccagcagtttcca

SEQ ID NO: 4860008 - DNA, 17 bp, Homo sapiens
gtccagcagtttccagt

SEQ ID NO: 4860009 - DNA, 21 bp, Homo sapiens
gtccagccacccccaggcatc

SEQ ID NO: 4860010 - DNA, 21 bp, Homo sapiens
gtccagggaggggtccctgca

SEQ ID NO: 4860011 - DNA, 23 bp, Homo sapiens
gtcccaccttgaccaaaatcagc

SEQ ID NO: 4860012 - DNA, 18 bp, Homo sapiens
gtcccatggctgaagctg

SEQ ID NO: 4860013 - DNA, 22 bp, Homo sapiens
gtcccggttcagacccctgcct

SEQ ID NO: 4860014 - DNA, 23 bp, Homo sapiens
gtcccggttcagacccctgcctg

SEQ ID NO: 4860015 - DNA, 23 bp, Homo sapiens
gtccctaagcatgtgtcccagga

SEQ ID NO: 4860016 - DNA, 17 bp, Homo sapiens
gtccctagggctctcca

SEQ ID NO: 4860017 - DNA, 21 bp, Homo sapiens
gtcccttctctttggggctcc

SEQ ID NO: 4860018 - DNA, 20 bp, Homo sapiens
gtcctaagtgctaagtgctt

SEQ ID NO: 4860019 - DNA, 19 bp, Homo sapiens
gtcctattatattcattct

SEQ ID NO: 4860020 - DNA, 20 bp, Homo sapiens
gtcctctcagttctctccct

SEQ ID NO: 4860021 - DNA, 17 bp, Homo sapiens
gtcctctttagtttttg

SEQ ID NO: 4860022 - DNA, 13 bp, Homo sapiens
gtccttaaaatgt

SEQ ID NO: 4860023 - DNA, 14 bp, Homo sapiens
gtccttaaaatgtg

SEQ ID NO: 4860024 - DNA, 15 bp, Homo sapiens
gtccttaggctactg

SEQ ID NO: 4860025 - DNA, 18 bp, Homo sapiens
gtcgccagtcactgctgc

SEQ ID NO: 4860026 - DNA, 15 bp, Homo sapiens
gtctaagtagggcca

SEQ ID NO: 4860027 - DNA, 18 bp, Homo sapiens
gtctaccaatacaaaatg

SEQ ID NO: 4860028 - DNA, 14 bp, Homo sapiens
gtctagagagaacc

SEQ ID NO: 4860029 - DNA, 15 bp, Homo sapiens
gtctaggtctcctca

SEQ ID NO: 4860030 - DNA, 20 bp, Homo sapiens
gtctcaggtttgttttgtga

SEQ ID NO: 4860031 - DNA, 18 bp, Homo sapiens
gtctcataggttaaaaaa

SEQ ID NO: 4860032 - DNA, 13 bp, Homo sapiens
gtctcctcagggt

SEQ ID NO: 4860033 - DNA, 15 bp, Homo sapiens
gtctcctccctcagc

SEQ ID NO: 4860034 - DNA, 20 bp, Homo sapiens
gtctctcttcggtggccttg

SEQ ID NO: 4860035 - DNA, 12 bp, Homo sapiens
gtctctgcaaac

SEQ ID NO: 4860036 - DNA, 20 bp, Homo sapiens
gtctctgccagttacttggg

SEQ ID NO: 4860037 - DNA, 22 bp, Homo sapiens
gtctctgccagttacttgggct

SEQ ID NO: 4860038 - DNA, 20 bp, Homo sapiens
gtctcttggctttgtcactt

SEQ ID NO: 4860039 - DNA, 12 bp, Homo sapiens
gtctgactccaa

SEQ ID NO: 4860040 - DNA, 16 bp, Homo sapiens
gtctgactccaaagct

SEQ ID NO: 4860041 - DNA, 13 bp, Homo sapiens
gtctgatttctta

SEQ ID NO: 4860042 - DNA, 15 bp, Homo sapiens
gtctgccaatctgta

SEQ ID NO: 4860043 - DNA, 22 bp, Homo sapiens
gtctgctcctcttgttcctgaa

SEQ ID NO: 4860044 - DNA, 18 bp, Homo sapiens
gtctggcagatgagggct

SEQ ID NO: 4860045 - DNA, 21 bp, Homo sapiens
gtctggcagatgagggctggc

SEQ ID NO: 4860046 - DNA, 22 bp, Homo sapiens
gtctggccctaactcctataaa

SEQ ID NO: 4860047 - DNA, 15 bp, Homo sapiens
gtctgtctcttggct

SEQ ID NO: 4860048 - DNA, 17 bp, Homo sapiens
gtcttaaactaaatgtg

SEQ ID NO: 4860049 - DNA, 23 bp, Homo sapiens
gtcttagctgaggctgagaaagc

SEQ ID NO: 4860050 - DNA, 12 bp, Homo sapiens
gtcttctttctc

SEQ ID NO: 4860051 - DNA, 18 bp, Homo sapiens
gtcttctttctccatgga

SEQ ID NO: 4860052 - DNA, 13 bp, Homo sapiens
gtctttcatggct

SEQ ID NO: 4860053 - DNA, 20 bp, Homo sapiens
gtgaaattgcatactttgta

SEQ ID NO: 4860054 - DNA, 12 bp, Homo sapiens
gtgaactccagg

SEQ ID NO: 4860055 - DNA, 15 bp, Homo sapiens
gtgaactccaggcat

SEQ ID NO: 4860056 - DNA, 18 bp, Homo sapiens
gtgaagagggacataaga

SEQ ID NO: 4860057 - DNA, 11 bp, Homo sapiens
gtgaaggggct

SEQ ID NO: 4860058 - DNA, 12 bp, Homo sapiens
gtgaaggggctg

SEQ ID NO: 4860059 - DNA, 20 bp, Homo sapiens
gtgaatttgccagaggacca

SEQ ID NO: 4860060 - DNA, 21 bp, Homo sapiens
gtgacactgatgagtttcact

SEQ ID NO: 4860061 - DNA, 22 bp, Homo sapiens
gtgacatttgggagacatgtga

SEQ ID NO: 4860062 - DNA, 20 bp, Homo sapiens
gtgaccaggcttttgtagat

SEQ ID NO: 4860063 - DNA, 12 bp, Homo sapiens
gtgactccaggg

SEQ ID NO: 4860064 - DNA, 13 bp, Homo sapiens
gtgactccagggt

SEQ ID NO: 4860065 - DNA, 14 bp, Homo sapiens
gtgactccagggtg

SEQ ID NO: 4860066 - DNA, 18 bp, Homo sapiens
gtgactccttatctcttt

SEQ ID NO: 4860067 - DNA, 16 bp, Homo sapiens
gtgagaagtacagggc

SEQ ID NO: 4860068 - DNA, 15 bp, Homo sapiens
gtgagaatggcctgg

SEQ ID NO: 4860069 - DNA, 23 bp, Homo sapiens
gtgagaatggcctggagcaggcc

SEQ ID NO: 4860070 - DNA, 13 bp, Homo sapiens
gtgagcacaaaga

SEQ ID NO: 4860071 - DNA, 13 bp, Homo sapiens
gtgaggacagggc

SEQ ID NO: 4860072 - DNA, 20 bp, Homo sapiens
gtgaggacctgtaaggcagg

SEQ ID NO: 4860073 - DNA, 15 bp, Homo sapiens
gtgaggataggacag

SEQ ID NO: 4860074 - DNA, 17 bp, Homo sapiens
gtgaggtgaactccagg

SEQ ID NO: 4860075 - DNA, 13 bp, Homo sapiens
gtgagtctgggat

SEQ ID NO: 4860076 - DNA, 14 bp, Homo sapiens
gtgagtctgggata

SEQ ID NO: 4860077 - DNA, 19 bp, Homo sapiens
gtgagtgacaaagcctctg

SEQ ID NO: 4860078 - DNA, 21 bp, Homo sapiens
gtgataagggaaaagataaag

SEQ ID NO: 4860079 - DNA, 15 bp, Homo sapiens
gtgatacatttttta

SEQ ID NO: 4860080 - DNA, 16 bp, Homo sapiens
taaattttaaagccat

SEQ ID NO: 4860081 - DNA, 17 bp, Homo sapiens
taaattttcatgaatgt

SEQ ID NO: 4860082 - DNA, 21 bp, Homo sapiens
taaattttcatgaatgtgctg

SEQ ID NO: 4860083 - DNA, 21 bp, Homo sapiens
taacacagcattgtatatgtg

SEQ ID NO: 4860084 - DNA, 21 bp, Homo sapiens
taacagtatgtgggatattga

SEQ ID NO: 4860085 - DNA, 14 bp, Homo sapiens
taacagtgtttaaa

SEQ ID NO: 4860086 - DNA, 14 bp, Homo sapiens
taacatctaaaaat

SEQ ID NO: 4860087 - DNA, 21 bp, Homo sapiens
taacatctttattgaaattct

SEQ ID NO: 4860088 - DNA, 20 bp, Homo sapiens
taacatgatttccctccaga

SEQ ID NO: 4860089 - DNA, 17 bp, Homo sapiens
taaccaaggctgtgttt

SEQ ID NO: 4860090 - DNA, 20 bp, Homo sapiens
taaccagctcagtgttttgg

SEQ ID NO: 4860091 - DNA, 19 bp, Homo sapiens
taaccaggccatttttggt

SEQ ID NO: 4860092 - DNA, 16 bp, Homo sapiens
taacccagtctttctt

SEQ ID NO: 4860093 - DNA, 21 bp, Homo sapiens
taacctaattaatatattaaa

SEQ ID NO: 4860094 - DNA, 12 bp, Homo sapiens
taacctgggacc

SEQ ID NO: 4860095 - DNA, 14 bp, Homo sapiens
taacctgggacctg

SEQ ID NO: 4860096 - DNA, 19 bp, Homo sapiens
taactaaattttaaagcca

SEQ ID NO: 4860097 - DNA, 21 bp, Homo sapiens
taactcaaatacacatttgct

SEQ ID NO: 4860098 - DNA, 21 bp, Homo sapiens
taactgccctctgaaataatg

SEQ ID NO: 4860099 - DNA, 23 bp, Homo sapiens
taactgttgcacttttgaatgtc

SEQ ID NO: 4860100 - DNA, 17 bp, Homo sapiens
taacttctcatgtatat

SEQ ID NO: 4860101 - DNA, 14 bp, Homo sapiens
taacttggggaggc

SEQ ID NO: 4860102 - DNA, 13 bp, Homo sapiens
taactttccagtc

SEQ ID NO: 4860103 - DNA, 13 bp, Homo sapiens
taactttctgggt

SEQ ID NO: 4860104 - DNA, 21 bp, Homo sapiens
taagaaaaaaagctgcaaaaa

SEQ ID NO: 4860105 - DNA, 15 bp, Homo sapiens
taagaaatactcatg

SEQ ID NO: 4860106 - DNA, 16 bp, Homo sapiens
taagaactaaaatgtt

SEQ ID NO: 4860107 - DNA, 19 bp, Homo sapiens
taagaagaaggccagagag

SEQ ID NO: 4860108 - DNA, 22 bp, Homo sapiens
taagaataccacatcaaataag

SEQ ID NO: 4860109 - DNA, 14 bp, Homo sapiens
taagaatctttaga

SEQ ID NO: 4860110 - DNA, 18 bp, Homo sapiens
taagaattctgattgatt

SEQ ID NO: 4860111 - DNA, 19 bp, Homo sapiens
taagaattctgattgattt

SEQ ID NO: 4860112 - DNA, 19 bp, Homo sapiens
taagactatatatataaat

SEQ ID NO: 4860113 - DNA, 20 bp, Homo sapiens
taagactatatatataaatg

SEQ ID NO: 4860114 - DNA, 23 bp, Homo sapiens
taagactatatatataaatgtat

SEQ ID NO: 4860115 - DNA, 18 bp, Homo sapiens
taagagaaaagagagaaa

SEQ ID NO: 4860116 - DNA, 21 bp, Homo sapiens
taagagaaacctgccaaggag

SEQ ID NO: 4860117 - DNA, 17 bp, Homo sapiens
taagatgtgttcttatt

SEQ ID NO: 4860118 - DNA, 18 bp, Homo sapiens
taagcagtgtctgtgttt

SEQ ID NO: 4860119 - DNA, 17 bp, Homo sapiens
taagcagtgttacttgc

SEQ ID NO: 4860120 - DNA, 21 bp, Homo sapiens
taagccgcagacctggagctt

SEQ ID NO: 4860121 - DNA, 22 bp, Homo sapiens
taagcgaagtctttgccttctc

SEQ ID NO: 4860122 - DNA, 13 bp, Homo sapiens
taagctgtgtctg

SEQ ID NO: 4860123 - DNA, 17 bp, Homo sapiens
taagcttcagttgcttg

SEQ ID NO: 4860124 - DNA, 16 bp, Homo sapiens
taagcttccattttaa

SEQ ID NO: 4860125 - DNA, 23 bp, Homo sapiens
taagcttccattttaattttaaa

SEQ ID NO: 4860126 - DNA, 13 bp, Homo sapiens
taagctttttgga

SEQ ID NO: 4860127 - DNA, 17 bp, Homo sapiens
taaggacccttttaagc

SEQ ID NO: 4860128 - DNA, 15 bp, Homo sapiens
taaggataaatcata

SEQ ID NO: 4860129 - DNA, 18 bp, Homo sapiens
taaggatccggaaagaag

SEQ ID NO: 4860130 - DNA, 14 bp, Homo sapiens
taagtaggtgatga

SEQ ID NO: 4860131 - DNA, 14 bp, Homo sapiens
taagtgtacatatg

SEQ ID NO: 4860132 - DNA, 15 bp, Homo sapiens
taatactactactgt

SEQ ID NO: 4860133 - DNA, 15 bp, Homo sapiens
taatatattaaaatt

SEQ ID NO: 4860134 - DNA, 21 bp, Homo sapiens
taatatattaaaattccaaat

SEQ ID NO: 4860135 - DNA, 17 bp, Homo sapiens
taatatccctacatgta

SEQ ID NO: 4860136 - DNA, 20 bp, Homo sapiens
taatattcagggtaaatagg

SEQ ID NO: 4860137 - DNA, 20 bp, Homo sapiens
taatattgaaaattgaaaag

SEQ ID NO: 4860138 - DNA, 16 bp, Homo sapiens
taatattgacttgtat

SEQ ID NO: 4860139 - DNA, 18 bp, Homo sapiens
taatattgacttgtatat

SEQ ID NO: 4860140 - DNA, 17 bp, Homo sapiens
taatcaaattctgtctg

SEQ ID NO: 4860141 - DNA, 21 bp, Homo sapiens
taatcaaattctgtctgggga

SEQ ID NO: 4860142 - DNA, 15 bp, Homo sapiens
taatccatttcagga

SEQ ID NO: 4860143 - DNA, 19 bp, Homo sapiens
taatccatttcaggactct

SEQ ID NO: 4860144 - DNA, 19 bp, Homo sapiens
taatcccctaaaataacag

SEQ ID NO: 4860145 - DNA, 15 bp, Homo sapiens
taatctcaatgcaag

SEQ ID NO: 4860146 - DNA, 16 bp, Homo sapiens
taatcttcaaagcctt

SEQ ID NO: 4860147 - DNA, 15 bp, Homo sapiens
taatgaaatggagga

SEQ ID NO: 4860148 - DNA, 13 bp, Homo sapiens
taatgacagcctt

SEQ ID NO: 4860149 - DNA, 20 bp, Homo sapiens
taatgctgcctcaggaccca

SEQ ID NO: 4860150 - DNA, 21 bp, Homo sapiens
taatggaaaatgccatgaatt

SEQ ID NO: 4860151 - DNA, 16 bp, Homo sapiens
taatggtagttttaca

SEQ ID NO: 4860152 - DNA, 18 bp, Homo sapiens
taatggtagttttacagt

SEQ ID NO: 4860153 - DNA, 16 bp, Homo sapiens
taatggtttattcttt

SEQ ID NO: 4860154 - DNA, 17 bp, Homo sapiens
taatggtttattctttg

SEQ ID NO: 4860155 - DNA, 15 bp, Homo sapiens
taatgtcagaacaga

SEQ ID NO: 4860156 - DNA, 15 bp, Homo sapiens
taatgtgtggattgc

SEQ ID NO: 4860157 - DNA, 13 bp, Homo sapiens
taattatgtaaat

SEQ ID NO: 4860158 - DNA, 16 bp, Homo sapiens
taattattgatgtttt

SEQ ID NO: 4860159 - DNA, 18 bp, Homo sapiens
taattattgatgttttca

SEQ ID NO: 4860160 - DNA, 16 bp, Homo sapiens
taattgggaactgaaa

SEQ ID NO: 4860161 - DNA, 18 bp, Homo sapiens
taattgggaactgaaatc

SEQ ID NO: 4860162 - DNA, 13 bp, Homo sapiens
taattgtgcccct

SEQ ID NO: 4860163 - DNA, 14 bp, Homo sapiens
taatttaaaaatat

SEQ ID NO: 4860164 - DNA, 12 bp, Homo sapiens
taatttaaatga

SEQ ID NO: 4860165 - DNA, 17 bp, Homo sapiens
taatttaactttccagt

SEQ ID NO: 4860166 - DNA, 20 bp, Homo sapiens
taatttacttgttttggatg

SEQ ID NO: 4860167 - DNA, 15 bp, Homo sapiens
taatttcagtgtaaa

SEQ ID NO: 4860168 - DNA, 14 bp, Homo sapiens
taatttcctgtgag

SEQ ID NO: 4860169 - DNA, 16 bp, Homo sapiens
taatttcctgtgagga

SEQ ID NO: 4860170 - DNA, 15 bp, Homo sapiens
taatttccttcaggc

SEQ ID NO: 4860171 - DNA, 12 bp, Homo sapiens
taatttgaactt

SEQ ID NO: 4860172 - DNA, 13 bp, Homo sapiens
taatttgaacttt

SEQ ID NO: 4860173 - DNA, 20 bp, Homo sapiens
taatttgaaggtagaatgtt

SEQ ID NO: 4860174 - DNA, 21 bp, Homo sapiens
taatttggagcacaaaattca

SEQ ID NO: 4860175 - DNA, 17 bp, Homo sapiens
taatttgttttggatat

SEQ ID NO: 4860176 - DNA, 12 bp, Homo sapiens
taattttaaagt

SEQ ID NO: 4860177 - DNA, 18 bp, Homo sapiens
taattttattttaaaatt

SEQ ID NO: 4860178 - DNA, 16 bp, Homo sapiens
taatttttcctgcatg

SEQ ID NO: 4860179 - DNA, 17 bp, Homo sapiens
taatttttcctgcatgt

SEQ ID NO: 4860180 - DNA, 18 bp, Homo sapiens
taatttttcctgcatgtt

SEQ ID NO: 4860181 - DNA, 21 bp, Homo sapiens
taatttttcctgcatgttctg

SEQ ID NO: 4860182 - DNA, 15 bp, Homo sapiens
tacaaaattaagcaa

SEQ ID NO: 4860183 - DNA, 17 bp, Homo sapiens
tacaaagttaaaattgt

SEQ ID NO: 4860184 - DNA, 19 bp, Homo sapiens
tacaaatgtttttcatcca

SEQ ID NO: 4860185 - DNA, 18 bp, Homo sapiens
tacaagggcataaagtaa

SEQ ID NO: 4860186 - DNA, 20 bp, Homo sapiens
tacagaacactttgctagga

SEQ ID NO: 4860187 - DNA, 18 bp, Homo sapiens
tacagaatcttgttttga

SEQ ID NO: 4860188 - DNA, 17 bp, Homo sapiens
tacagaatttgaattat

SEQ ID NO: 4860189 - DNA, 23 bp, Homo sapiens
tacagccttattttgttggtgct

SEQ ID NO: 4860190 - DNA, 17 bp, Homo sapiens
tacagctctcctccagc

SEQ ID NO: 4860191 - DNA, 18 bp, Homo sapiens
tacagctctcctccagcc

SEQ ID NO: 4860192 - DNA, 15 bp, Homo sapiens
tacagctgtgctcca

SEQ ID NO: 4860193 - DNA, 16 bp, Homo sapiens
tacagctgtgctccac

SEQ ID NO: 4860194 - DNA, 12 bp, Homo sapiens
tacaggagccag

SEQ ID NO: 4860195 - DNA, 13 bp, Homo sapiens
tacaggagccagc

SEQ ID NO: 4860196 - DNA, 14 bp, Homo sapiens
tacaggagccagcc

SEQ ID NO: 4860197 - DNA, 15 bp, Homo sapiens
tacagtatagatttt

SEQ ID NO: 4860198 - DNA, 15 bp, Homo sapiens
tacagttttaactgt

SEQ ID NO: 4860199 - DNA, 19 bp, Homo sapiens
tacagttttaactgtggat

SEQ ID NO: 4860200 - DNA, 13 bp, Homo sapiens
tattatattcatt

SEQ ID NO: 4860201 - DNA, 12 bp, Homo sapiens
tattatgagcca

SEQ ID NO: 4860202 - DNA, 20 bp, Homo sapiens
tattatttttataattgtac

SEQ ID NO: 4860203 - DNA, 15 bp, Homo sapiens
tattcagatgtatgt

SEQ ID NO: 4860204 - DNA, 23 bp, Homo sapiens
tattcattactagataaaatgta

SEQ ID NO: 4860205 - DNA, 15 bp, Homo sapiens
tattccatatttatt

SEQ ID NO: 4860206 - DNA, 18 bp, Homo sapiens
tattccccagtgactcca

SEQ ID NO: 4860207 - DNA, 19 bp, Homo sapiens
tattctataaaactctgca

SEQ ID NO: 4860208 - DNA, 16 bp, Homo sapiens
tattctccagacatgg

SEQ ID NO: 4860209 - DNA, 20 bp, Homo sapiens
tattctttagcttacctggg

SEQ ID NO: 4860210 - DNA, 14 bp, Homo sapiens
tattgaaaattgaa

SEQ ID NO: 4860211 - DNA, 22 bp, Homo sapiens
tattgactaacaggccaaagag

SEQ ID NO: 4860212 - DNA, 14 bp, Homo sapiens
tattgacttgtata

SEQ ID NO: 4860213 - DNA, 19 bp, Homo sapiens
tattgagttccagttgaag

SEQ ID NO: 4860214 - DNA, 14 bp, Homo sapiens
tattgatgttttca

SEQ ID NO: 4860215 - DNA, 14 bp, Homo sapiens
tattgattgggaaa

SEQ ID NO: 4860216 - DNA, 15 bp, Homo sapiens
tattgattgggaaaa

SEQ ID NO: 4860217 - DNA, 21 bp, Homo sapiens
tattgcaaggtgtgatggtct

SEQ ID NO: 4860218 - DNA, 18 bp, Homo sapiens
tattgcaataaagtataa

SEQ ID NO: 4860219 - DNA, 11 bp, Homo sapiens
tattgcaatgc

SEQ ID NO: 4860220 - DNA, 12 bp, Homo sapiens
tattgcaatgca

SEQ ID NO: 4860221 - DNA, 13 bp, Homo sapiens
tattgcaatgcag

SEQ ID NO: 4860222 - DNA, 13 bp, Homo sapiens
tattgcacattgt

SEQ ID NO: 4860223 - DNA, 11 bp, Homo sapiens
tattgctgcta

SEQ ID NO: 4860224 - DNA, 16 bp, Homo sapiens
tattggacctgcccac

SEQ ID NO: 4860225 - DNA, 20 bp, Homo sapiens
tattgggcacagcctagggt

SEQ ID NO: 4860226 - DNA, 19 bp, Homo sapiens
tattgtaatctatgtttat

SEQ ID NO: 4860227 - DNA, 17 bp, Homo sapiens
tattgtgctcagagaca

SEQ ID NO: 4860228 - DNA, 22 bp, Homo sapiens
tattgttacgtagcctaaggct

SEQ ID NO: 4860229 - DNA, 15 bp, Homo sapiens
tattgtttggtaaat

SEQ ID NO: 4860230 - DNA, 14 bp, Homo sapiens
tatttaagactaaa

SEQ ID NO: 4860231 - DNA, 16 bp, Homo sapiens
tatttaatttgaaggt

SEQ ID NO: 4860232 - DNA, 22 bp, Homo sapiens
tatttactttttcggtttcaaa

SEQ ID NO: 4860233 - DNA, 16 bp, Homo sapiens
tatttataatacagaa

SEQ ID NO: 4860234 - DNA, 20 bp, Homo sapiens
tatttataatacagaatctt

SEQ ID NO: 4860235 - DNA, 17 bp, Homo sapiens
tatttatagaatttaat

SEQ ID NO: 4860236 - DNA, 14 bp, Homo sapiens
tatttattccccag

SEQ ID NO: 4860237 - DNA, 21 bp, Homo sapiens
tatttattccccagtgactcc

SEQ ID NO: 4860238 - DNA, 15 bp, Homo sapiens
tatttcccccttcat

SEQ ID NO: 4860239 - DNA, 22 bp, Homo sapiens
tatttccttggattttcctgaa

SEQ ID NO: 4860240 - DNA, 14 bp, Homo sapiens
tatttctgaaggta

SEQ ID NO: 4860241 - DNA, 23 bp, Homo sapiens
tatttctgaggagcctgcaacat

SEQ ID NO: 4860242 - DNA, 11 bp, Homo sapiens
tatttgtgact

SEQ ID NO: 4860243 - DNA, 15 bp, Homo sapiens
tatttttaaaggcat

SEQ ID NO: 4860244 - DNA, 18 bp, Homo sapiens
tatttttgacatggaaat

SEQ ID NO: 4860245 - DNA, 12 bp, Homo sapiens
tattttttaaga

SEQ ID NO: 4860246 - DNA, 16 bp, Homo sapiens
tatttttttaactgtg

SEQ ID NO: 4860247 - DNA, 19 bp, Homo sapiens
tatttttttagattgagaa

SEQ ID NO: 4860248 - DNA, 17 bp, Homo sapiens
tcaaaaagaaatcaata

SEQ ID NO: 4860249 - DNA, 23 bp, Homo sapiens
tcaaaaagccacagcagagcatt

SEQ ID NO: 4860250 - DNA, 21 bp, Homo sapiens
tcaaaaggtattatacatgtg

SEQ ID NO: 4860251 - DNA, 22 bp, Homo sapiens
tcaaagcagcaggactgtggga

SEQ ID NO: 4860252 - DNA, 17 bp, Homo sapiens
tcaaagtcattaaagac

SEQ ID NO: 4860253 - DNA, 16 bp, Homo sapiens
tcaaagtgcctgggct

SEQ ID NO: 4860254 - DNA, 17 bp, Homo sapiens
tcaaagtgcctgggctc

SEQ ID NO: 4860255 - DNA, 12 bp, Homo sapiens
tcaaataagaaa

SEQ ID NO: 4860256 - DNA, 16 bp, Homo sapiens
tcaaatacacatttgc

SEQ ID NO: 4860257 - DNA, 15 bp, Homo sapiens
tcaaatagttgcata

SEQ ID NO: 4860258 - DNA, 15 bp, Homo sapiens
tcaaatgaaatgtat

SEQ ID NO: 4860259 - DNA, 17 bp, Homo sapiens
tcaaatgtgtgtggcag

SEQ ID NO: 4860260 - DNA, 17 bp, Homo sapiens
tcaaattctgtctgggg

SEQ ID NO: 4860261 - DNA, 16 bp, Homo sapiens
tcaacagagactgaat

SEQ ID NO: 4860262 - DNA, 22 bp, Homo sapiens
tcaaccaggtccagatgtgcta

SEQ ID NO: 4860263 - DNA, 21 bp, Homo sapiens
tcaacggaaagtgctgtctta

SEQ ID NO: 4860264 - DNA, 16 bp, Homo sapiens
tcaactctacccctgc

SEQ ID NO: 4860265 - DNA, 17 bp, Homo sapiens
tcaactctacccctgct

SEQ ID NO: 4860266 - DNA, 23 bp, Homo sapiens
tcaactgacctgaccccattcct

SEQ ID NO: 4860267 - DNA, 14 bp, Homo sapiens
tcaactttgtaaaa

SEQ ID NO: 4860268 - DNA, 16 bp, Homo sapiens
tcaactttgtaaaaat

SEQ ID NO: 4860269 - DNA, 20 bp, Homo sapiens
tcaagaatcagacagcagga

SEQ ID NO: 4860270 - DNA, 19 bp, Homo sapiens
tcaaggataccttcttatt

SEQ ID NO: 4860271 - DNA, 18 bp, Homo sapiens
tcaaggctcttcttcctc

SEQ ID NO: 4860272 - DNA, 13 bp, Homo sapiens
tcaatatgtatat

SEQ ID NO: 4860273 - DNA, 17 bp, Homo sapiens
tcaatatgtatatatgt

SEQ ID NO: 4860274 - DNA, 19 bp, Homo sapiens
tcaatatgtatatatgtat

SEQ ID NO: 4860275 - DNA, 13 bp, Homo sapiens
tcaatgagagcat

SEQ ID NO: 4860276 - DNA, 17 bp, Homo sapiens
tcacaaagtggaacgaa

SEQ ID NO: 4860277 - DNA, 13 bp, Homo sapiens
tcacacccctgcc

SEQ ID NO: 4860278 - DNA, 20 bp, Homo sapiens
tcacagcctcaagtcactcc

SEQ ID NO: 4860279 - DNA, 13 bp, Homo sapiens
tcacatccatccc

SEQ ID NO: 4860280 - DNA, 18 bp, Homo sapiens
tcaccaaaagacactgca

SEQ ID NO: 4860281 - DNA, 17 bp, Homo sapiens
tcaccaaatagtgtgaa

SEQ ID NO: 4860282 - DNA, 18 bp, Homo sapiens
tcaccaagaacagcgggt

SEQ ID NO: 4860283 - DNA, 20 bp, Homo sapiens
tcacccattccgggttcact

SEQ ID NO: 4860284 - DNA, 16 bp, Homo sapiens
tcaccctctgtccttc

SEQ ID NO: 4860285 - DNA, 20 bp, Homo sapiens
tcaccctctgtccttccccc

SEQ ID NO: 4860286 - DNA, 14 bp, Homo sapiens
tcaccgcaggtgct

SEQ ID NO: 4860287 - DNA, 16 bp, Homo sapiens
tcacctccttctgcag

SEQ ID NO: 4860288 - DNA, 17 bp, Homo sapiens
tcacctcttaaagaaaa

SEQ ID NO: 4860289 - DNA, 20 bp, Homo sapiens
tcacgttggggtgatttaat

SEQ ID NO: 4860290 - DNA, 17 bp, Homo sapiens
tcactcccaagggacag

SEQ ID NO: 4860291 - DNA, 15 bp, Homo sapiens
tcactccccgcctcc

SEQ ID NO: 4860292 - DNA, 12 bp, Homo sapiens
tcactctggctt

SEQ ID NO: 4860293 - DNA, 22 bp, Homo sapiens
tcactctggcttcaaaaagcca

SEQ ID NO: 4860294 - DNA, 18 bp, Homo sapiens
tcactgccttcgtttata

SEQ ID NO: 4860295 - DNA, 13 bp, Homo sapiens
tcactggactgca

SEQ ID NO: 4860296 - DNA, 17 bp, Homo sapiens
tcactggactgcatggg

SEQ ID NO: 4860297 - DNA, 16 bp, Homo sapiens
tcactgggatgcctct

SEQ ID NO: 4860298 - DNA, 12 bp, Homo sapiens
tcactgtactgc

SEQ ID NO: 4860299 - DNA, 13 bp, Homo sapiens
tcactgtactgca

SEQ ID NO: 4860300 - DNA, 12 bp, Homo sapiens
tcacttagtcct

SEQ ID NO: 4860301 - DNA, 19 bp, Homo sapiens
tcagaaaattccctggggt

SEQ ID NO: 4860302 - DNA, 24 bp, Homo sapiens
tcagaaacgagatcgggaagcaga

SEQ ID NO: 4860303 - DNA, 18 bp, Homo sapiens
tcagaactcttcctcctc

SEQ ID NO: 4860304 - DNA, 18 bp, Homo sapiens
tcagaagaatcttcctgg

SEQ ID NO: 4860305 - DNA, 15 bp, Homo sapiens
tcagaatcagaagat

SEQ ID NO: 4860306 - DNA, 13 bp, Homo sapiens
tcagacatttctt

SEQ ID NO: 4860307 - DNA, 19 bp, Homo sapiens
tcagacatttctttggaaa

SEQ ID NO: 4860308 - DNA, 14 bp, Homo sapiens
tcagacccctgcct

SEQ ID NO: 4860309 - DNA, 23 bp, Homo sapiens
tcagagaggtagcactctcagag

SEQ ID NO: 4860310 - DNA, 22 bp, Homo sapiens
tcagagtatattgttgaagaga

SEQ ID NO: 4860311 - DNA, 18 bp, Homo sapiens
tcagatgaggcaaacagc

SEQ ID NO: 4860312 - DNA, 19 bp, Homo sapiens
tcagatgcttgcggcaaaa

SEQ ID NO: 4860313 - DNA, 22 bp, Homo sapiens
tcagatgcttgcggcaaaagga

SEQ ID NO: 4860314 - DNA, 14 bp, Homo sapiens
tcagcaaaaagact

SEQ ID NO: 4860315 - DNA, 13 bp, Homo sapiens
tcagcaaagaaaa

SEQ ID NO: 4860316 - DNA, 15 bp, Homo sapiens
tcagcaaattccaga

SEQ ID NO: 4860317 - DNA, 23 bp, Homo sapiens
tcagcactttgggaggctgaggc

SEQ ID NO: 4860318 - DNA, 14 bp, Homo sapiens
tcagcagagtgagg

SEQ ID NO: 4860319 - DNA, 18 bp, Homo sapiens
tcagcagagtgagggggt

SEQ ID NO: 4860320 - DNA, 18 bp, Homo sapiens
tcagcagtcctagcccca

SEQ ID NO: 4860321 - DNA, 10 bp, Homo sapiens
tcagcatcca

SEQ ID NO: 4860322 - DNA, 22 bp, Homo sapiens
tcagccaggcaagaaagcttcc

SEQ ID NO: 4860323 - DNA, 14 bp, Homo sapiens
tcagccaggtctga

SEQ ID NO: 4860324 - DNA, 18 bp, Homo sapiens
tcagcctgctttcctgca

SEQ ID NO: 4860325 - DNA, 21 bp, Homo sapiens
tcagcctgctttcctgcagca

SEQ ID NO: 4860326 - DNA, 22 bp, Homo sapiens
tcagctctctgggacctcctta

SEQ ID NO: 4860327 - DNA, 15 bp, Homo sapiens
tcagctgctgttgaa

SEQ ID NO: 4860328 - DNA, 19 bp, Homo sapiens
tcagctgctgttgaacttt

SEQ ID NO: 4860329 - DNA, 12 bp, Homo sapiens
tcagctgtgcct

SEQ ID NO: 4860330 - DNA, 20 bp, Homo sapiens
tcaggacccatccctgcctg

SEQ ID NO: 4860331 - DNA, 23 bp, Homo sapiens
tcaggacccatccctgcctggag

SEQ ID NO: 4860332 - DNA, 18 bp, Homo sapiens
tcaggactctctccagga

SEQ ID NO: 4860333 - DNA, 19 bp, Homo sapiens
tcaggactctctccaggag

SEQ ID NO: 4860334 - DNA, 20 bp, Homo sapiens
tcaggactctctccaggagg

SEQ ID NO: 4860335 - DNA, 12 bp, Homo sapiens
tcaggagcctgg

SEQ ID NO: 4860336 - DNA, 21 bp, Homo sapiens
tcaggagcctggccaggcagg

SEQ ID NO: 4860337 - DNA, 23 bp, Homo sapiens
tcagggtgagacgtgatgggcta

SEQ ID NO: 4860338 - DNA, 14 bp, Homo sapiens
tcaggtttgttttg

SEQ ID NO: 4860339 - DNA, 15 bp, Homo sapiens
tcaggtttgttttgt

SEQ ID NO: 4860340 - DNA, 23 bp, Homo sapiens
tcagtaagttatctttgaatatg

SEQ ID NO: 4860341 - DNA, 19 bp, Homo sapiens
tcagtaatgctaaatgtgt

SEQ ID NO: 4860342 - DNA, 20 bp, Homo sapiens
tcagtccagcagtttccagt

SEQ ID NO: 4860343 - DNA, 21 bp, Homo sapiens
tcagtccagcagtttccagtc

SEQ ID NO: 4860344 - DNA, 17 bp, Homo sapiens
tcagtggggcagcctct

SEQ ID NO: 4860345 - DNA, 21 bp, Homo sapiens
tcagtgtcccaccttgaccaa

SEQ ID NO: 4860346 - DNA, 14 bp, Homo sapiens
tcagttctcaaatg

SEQ ID NO: 4860347 - DNA, 18 bp, Homo sapiens
tcagttgctcaaaaagaa

SEQ ID NO: 4860348 - DNA, 15 bp, Homo sapiens
tcagttgttatttat

SEQ ID NO: 4860349 - DNA, 12 bp, Homo sapiens
tcatataagaca

SEQ ID NO: 4860350 - DNA, 23 bp, Homo sapiens
tcatatggtaggaccctcgagag

SEQ ID NO: 4860351 - DNA, 14 bp, Homo sapiens
tcatcactggactg

SEQ ID NO: 4860352 - DNA, 22 bp, Homo sapiens
tcatcagatgcttgcggcaaaa

SEQ ID NO: 4860353 - DNA, 17 bp, Homo sapiens
tcatcattcttgtggga

SEQ ID NO: 4860354 - DNA, 22 bp, Homo sapiens
tcatcattcttgtgggagacag

SEQ ID NO: 4860355 - DNA, 16 bp, Homo sapiens
tcatccatcctgagcc

SEQ ID NO: 4860356 - DNA, 21 bp, Homo sapiens
tcatgaatgtgctggtgaaca

SEQ ID NO: 4860357 - DNA, 22 bp, Homo sapiens
tcatgaatgtgctggtgaacac

SEQ ID NO: 4860358 - DNA, 18 bp, Homo sapiens
tcatgagtgaataaatgt

SEQ ID NO: 4860359 - DNA, 21 bp, Homo sapiens
tcatgcctgatgaaagctttg

SEQ ID NO: 4860360 - DNA, 23 bp, Homo sapiens
tcatgtatattacccaatggaaa

SEQ ID NO: 4860361 - DNA, 22 bp, Homo sapiens
tcatgtttggaaaataatttct

SEQ ID NO: 4860362 - DNA, 15 bp, Homo sapiens
tcattaaagacagga

SEQ ID NO: 4860363 - DNA, 18 bp, Homo sapiens
tcattaccctacagacag

SEQ ID NO: 4860364 - DNA, 13 bp, Homo sapiens
tcattatgtcaac

SEQ ID NO: 4860365 - DNA, 16 bp, Homo sapiens
tcattatgttaatatt

SEQ ID NO: 4860366 - DNA, 20 bp, Homo sapiens
tcattctgaaccctccaaag

SEQ ID NO: 4860367 - DNA, 14 bp, Homo sapiens
tcattcttgtggga

SEQ ID NO: 4860368 - DNA, 16 bp, Homo sapiens
tcattcttgtgggaga

SEQ ID NO: 4860369 - DNA, 19 bp, Homo sapiens
tcattcttgtgggagacag

SEQ ID NO: 4860370 - DNA, 21 bp, Homo sapiens
tcattgacttttataaagcat

SEQ ID NO: 4860371 - DNA, 13 bp, Homo sapiens
tcattggcaaagt

SEQ ID NO: 4860372 - DNA, 19 bp, Homo sapiens
tcatttctatattcctcca

SEQ ID NO: 4860373 - DNA, 20 bp, Homo sapiens
tcatttctatattcctccag

SEQ ID NO: 4860374 - DNA, 17 bp, Homo sapiens
tcatttgtatgtcaaag

SEQ ID NO: 4860375 - DNA, 20 bp, Homo sapiens
tcattttatttacagctgtg

SEQ ID NO: 4860376 - DNA, 16 bp, Homo sapiens
tcattttcttttttaa

SEQ ID NO: 4860377 - DNA, 14 bp, Homo sapiens
tcattttgcttccc

SEQ ID NO: 4860378 - DNA, 15 bp, Homo sapiens
tcattttgcttccca

SEQ ID NO: 4860379 - DNA, 16 bp, Homo sapiens
tccaaaagtaaagatg

SEQ ID NO: 4860380 - DNA, 13 bp, Homo sapiens
tccaaagaaagtt

SEQ ID NO: 4860381 - DNA, 12 bp, Homo sapiens
tccaagagggac

SEQ ID NO: 4860382 - DNA, 16 bp, Homo sapiens
tccaagagggactcca

SEQ ID NO: 4860383 - DNA, 22 bp, Homo sapiens
tccaagcactagccttcccagc

SEQ ID NO: 4860384 - DNA, 12 bp, Homo sapiens
tccaagccctgg

SEQ ID NO: 4860385 - DNA, 16 bp, Homo sapiens
tccaagccctggggca

SEQ ID NO: 4860386 - DNA, 22 bp, Homo sapiens
tccaagggcccggtttcccggc

SEQ ID NO: 4860387 - DNA, 16 bp, Homo sapiens
tccaaggtgatgttgt

SEQ ID NO: 4860388 - DNA, 21 bp, Homo sapiens
tccaatgactgagcagcatcc

SEQ ID NO: 4860389 - DNA, 16 bp, Homo sapiens
tccacactcagaaaat

SEQ ID NO: 4860390 - DNA, 23 bp, Homo sapiens
tccacactcagaaaattccctgg

SEQ ID NO: 4860391 - DNA, 14 bp, Homo sapiens
tccacactgtcaaa

SEQ ID NO: 4860392 - DNA, 18 bp, Homo sapiens
tccacagcctgcaagtca

SEQ ID NO: 4860393 - DNA, 20 bp, Homo sapiens
tccacagccttgcagcggct

SEQ ID NO: 4860394 - DNA, 18 bp, Homo sapiens
tccacccacaaactccag

SEQ ID NO: 4860395 - DNA, 22 bp, Homo sapiens
tccacccacaaactccaggctg

SEQ ID NO: 4860396 - DNA, 20 bp, Homo sapiens
tccacccataataagagaat

SEQ ID NO: 4860397 - DNA, 19 bp, Homo sapiens
tccacctcatcactggact

SEQ ID NO: 4860398 - DNA, 15 bp, Homo sapiens
tccactcccagtgct

SEQ ID NO: 4860399 - DNA, 16 bp, Homo sapiens
tccagaagaaaatttg

SEQ ID NO: 4860400 - DNA, 12 bp, Homo sapiens
tccagaagctgc

SEQ ID NO: 4860401 - DNA, 17 bp, Homo sapiens
tccagaatgaccttgag

SEQ ID NO: 4860402 - DNA, 14 bp, Homo sapiens
tccagactctgggg

SEQ ID NO: 4860403 - DNA, 22 bp, Homo sapiens
tccagagaaagcacaatttaaa

SEQ ID NO: 4860404 - DNA, 13 bp, Homo sapiens
tccagagaacctg

SEQ ID NO: 4860405 - DNA, 14 bp, Homo sapiens
tccagcccaaacct

SEQ ID NO: 4860406 - DNA, 17 bp, Homo sapiens
tccagccctgggcacat

SEQ ID NO: 4860407 - DNA, 19 bp, Homo sapiens
tccaggatgctaacatcta

SEQ ID NO: 4860408 - DNA, 21 bp, Homo sapiens
tccaggcatgtgtctggccct

SEQ ID NO: 4860409 - DNA, 22 bp, Homo sapiens
tccaggcatgtgtctggcccta

SEQ ID NO: 4860410 - DNA, 17 bp, Homo sapiens
tccaggttatggggaga

SEQ ID NO: 4860411 - DNA, 14 bp, Homo sapiens
tccagtcattatgt

SEQ ID NO: 4860412 - DNA, 21 bp, Homo sapiens
tccagtcattatgttaatatt

SEQ ID NO: 4860413 - DNA, 23 bp, Homo sapiens
tccagtcattatgttaatatttc

SEQ ID NO: 4860414 - DNA, 19 bp, Homo sapiens
tccagtgtgagatactgtg

SEQ ID NO: 4860415 - DNA, 22 bp, Homo sapiens
tccagtgtgagatactgtgtat

SEQ ID NO: 4860416 - DNA, 15 bp, Homo sapiens
tccagttataagaag

SEQ ID NO: 4860417 - DNA, 17 bp, Homo sapiens
tccagtttgtcttggat

SEQ ID NO: 4860418 - DNA, 17 bp, Homo sapiens
tccatatatatgaaatg

SEQ ID NO: 4860419 - DNA, 19 bp, Homo sapiens
tccatcacgttagctgtcc

SEQ ID NO: 4860420 - DNA, 21 bp, Homo sapiens
tccatccacctcatcactgga

SEQ ID NO: 4860421 - DNA, 14 bp, Homo sapiens
tccatccatccttc

SEQ ID NO: 4860422 - DNA, 13 bp, Homo sapiens
tccatccctccat

SEQ ID NO: 4860423 - DNA, 13 bp, Homo sapiens
tccatggagccta

SEQ ID NO: 4860424 - DNA, 15 bp, Homo sapiens
tccattacaccacag

SEQ ID NO: 4860425 - DNA, 20 bp, Homo sapiens
tccattcatccttccatcca

SEQ ID NO: 4860426 - DNA, 13 bp, Homo sapiens
tcccaccttgacc

SEQ ID NO: 4860427 - DNA, 12 bp, Homo sapiens
tcccactccagc

SEQ ID NO: 4860428 - DNA, 13 bp, Homo sapiens
tcccactccagct

SEQ ID NO: 4860429 - DNA, 11 bp, Homo sapiens
tcccagagtgg

SEQ ID NO: 4860430 - DNA, 22 bp, Homo sapiens
tcccagctctagcctctggact

SEQ ID NO: 4860431 - DNA, 16 bp, Homo sapiens
tcccaggggagccagc

SEQ ID NO: 4860432 - DNA, 23 bp, Homo sapiens
tcccaggggagccagctgcttga

SEQ ID NO: 4860433 - DNA, 13 bp, Homo sapiens
tcccatctgaaga

SEQ ID NO: 4860434 - DNA, 16 bp, Homo sapiens
tcccatctgaagagtg

SEQ ID NO: 4860435 - DNA, 18 bp, Homo sapiens
tcccatggctgaagctgg

SEQ ID NO: 4860436 - DNA, 21 bp, Homo sapiens
tcccatggctgaagctggagc

SEQ ID NO: 4860437 - DNA, 24 bp, Homo sapiens
tcccatggctgaagctggagcagc

SEQ ID NO: 4860438 - DNA, 21 bp, Homo sapiens
tcccatgggggcacttgagtt

SEQ ID NO: 4860439 - DNA, 15 bp, Homo sapiens
tcccattcctccctc

SEQ ID NO: 4860440 - DNA, 14 bp, Homo sapiens
tgaggctgagaaag

SEQ ID NO: 4860441 - DNA, 21 bp, Homo sapiens
tgagggaagcaataggtagct

SEQ ID NO: 4860442 - DNA, 19 bp, Homo sapiens
tgaggggaggtggccagcc

SEQ ID NO: 4860443 - DNA, 15 bp, Homo sapiens
tgaggtgaactccag

SEQ ID NO: 4860444 - DNA, 20 bp, Homo sapiens
tgagtaatgtgactaaagga

SEQ ID NO: 4860445 - DNA, 19 bp, Homo sapiens
tgagtagatccatttccat

SEQ ID NO: 4860446 - DNA, 21 bp, Homo sapiens
tgagtagatccatttccattg

SEQ ID NO: 4860447 - DNA, 13 bp, Homo sapiens
tgagtaggctggg

SEQ ID NO: 4860448 - DNA, 12 bp, Homo sapiens
tgagtattgttt

SEQ ID NO: 4860449 - DNA, 21 bp, Homo sapiens
tgagtattgtttaaaatgtaa

SEQ ID NO: 4860450 - DNA, 23 bp, Homo sapiens
tgagtattgtttaaaatgtaatt

SEQ ID NO: 4860451 - DNA, 18 bp, Homo sapiens
tgagtctgggatattctt

SEQ ID NO: 4860452 - DNA, 21 bp, Homo sapiens
tgagtctgtactaaacagtaa

SEQ ID NO: 4860453 - DNA, 15 bp, Homo sapiens
tgagtgaataaatgt

SEQ ID NO: 4860454 - DNA, 20 bp, Homo sapiens
tgagtgacaaagcctctgaa

SEQ ID NO: 4860455 - DNA, 14 bp, Homo sapiens
tgagtgtatgagta

SEQ ID NO: 4860456 - DNA, 16 bp, Homo sapiens
tgagttatcatgaatt

SEQ ID NO: 4860457 - DNA, 20 bp, Homo sapiens
tgagttatcatgaattttaa

SEQ ID NO: 4860458 - DNA, 19 bp, Homo sapiens
tgagttccagttgaagtta

SEQ ID NO: 4860459 - DNA, 15 bp, Homo sapiens
tgagtttcactgtac

SEQ ID NO: 4860460 - DNA, 20 bp, Homo sapiens
tgagtttcactgtactgcat

SEQ ID NO: 4860461 - DNA, 22 bp, Homo sapiens
tgagtttcactgtactgcatgt

SEQ ID NO: 4860462 - DNA, 14 bp, Homo sapiens
tgataaaaactcag

SEQ ID NO: 4860463 - DNA, 12 bp, Homo sapiens
tgataaaggaaa

SEQ ID NO: 4860464 - DNA, 15 bp, Homo sapiens
tgataacttggggag

SEQ ID NO: 4860465 - DNA, 19 bp, Homo sapiens
tgataagggaaaagataaa

SEQ ID NO: 4860466 - DNA, 14 bp, Homo sapiens
tgatatacaaagtg

SEQ ID NO: 4860467 - DNA, 16 bp, Homo sapiens
tgatataccaaattaa

SEQ ID NO: 4860468 - DNA, 22 bp, Homo sapiens
tgatatataagtgtacatatgt

SEQ ID NO: 4860469 - DNA, 15 bp, Homo sapiens
tgatcagcaaaaaga

SEQ ID NO: 4860470 - DNA, 17 bp, Homo sapiens
tgatcccttgagatatg

SEQ ID NO: 4860471 - DNA, 20 bp, Homo sapiens
tgatcggccagttttcggaa

SEQ ID NO: 4860472 - DNA, 18 bp, Homo sapiens
tgatcgtttcttccagtt

SEQ ID NO: 4860473 - DNA, 18 bp, Homo sapiens
tgatctacttctgtaatt

SEQ ID NO: 4860474 - DNA, 19 bp, Homo sapiens
tgatgagagaatgtggaaa

SEQ ID NO: 4860475 - DNA, 13 bp, Homo sapiens
tgatgaggaccca

SEQ ID NO: 4860476 - DNA, 19 bp, Homo sapiens
tgatgctttggaagatgca

SEQ ID NO: 4860477 - DNA, 23 bp, Homo sapiens
tgatgctttggaagatgcagaag

SEQ ID NO: 4860478 - DNA, 20 bp, Homo sapiens
tgatggagtgtgcagacagc

SEQ ID NO: 4860479 - DNA, 16 bp, Homo sapiens
tgatgggtgccctttc

SEQ ID NO: 4860480 - DNA, 23 bp, Homo sapiens
tgatgttatacatcaatatgtat

SEQ ID NO: 4860481 - DNA, 11 bp, Homo sapiens
tgatgtttaaa

SEQ ID NO: 4860482 - DNA, 17 bp, Homo sapiens
tgattactgcaatcact

SEQ ID NO: 4860483 - DNA, 21 bp, Homo sapiens
tgattattttttttttcttct

SEQ ID NO: 4860484 - DNA, 17 bp, Homo sapiens
tgattctggctttaagc

SEQ ID NO: 4860485 - DNA, 20 bp, Homo sapiens
tgattgggaaaacatttgct

SEQ ID NO: 4860486 - DNA, 17 bp, Homo sapiens
tgattgtctagtgagga

SEQ ID NO: 4860487 - DNA, 14 bp, Homo sapiens
tgatttcacagtgt

SEQ ID NO: 4860488 - DNA, 16 bp, Homo sapiens
tgatttgaaaaatata

SEQ ID NO: 4860489 - DNA, 18 bp, Homo sapiens
tgattttttgaaagttaa

SEQ ID NO: 4860490 - DNA, 16 bp, Homo sapiens
tgcaaaaattatatat

SEQ ID NO: 4860491 - DNA, 17 bp, Homo sapiens
tgcaaaaattatatatt

SEQ ID NO: 4860492 - DNA, 15 bp, Homo sapiens
tgcaaagtctccaga

SEQ ID NO: 4860493 - DNA, 21 bp, Homo sapiens
tgcaaagtctccagaagaaaa

SEQ ID NO: 4860494 - DNA, 15 bp, Homo sapiens
tgcaacaagcatgca

SEQ ID NO: 4860495 - DNA, 16 bp, Homo sapiens
tgcaacagacttgaat

SEQ ID NO: 4860496 - DNA, 17 bp, Homo sapiens
tgcaagaccctcccatg

SEQ ID NO: 4860497 - DNA, 20 bp, Homo sapiens
tgcaagccccaactttctta

SEQ ID NO: 4860498 - DNA, 21 bp, Homo sapiens
tgcaagccccaactttcttat

SEQ ID NO: 4860499 - DNA, 19 bp, Homo sapiens
tgcaaggtggcctctgcct

SEQ ID NO: 4860500 - DNA, 20 bp, Homo sapiens
tgcaaggtggcctctgcctg

SEQ ID NO: 4860501 - DNA, 21 bp, Homo sapiens
tgcaaggtggcctctgcctgg

SEQ ID NO: 4860502 - DNA, 22 bp, Homo sapiens
tgcaaggtggcctctgcctggg

SEQ ID NO: 4860503 - DNA, 23 bp, Homo sapiens
tgcaagtcagtccaggatgctaa

SEQ ID NO: 4860504 - DNA, 14 bp, Homo sapiens
tgcaataaagtata

SEQ ID NO: 4860505 - DNA, 23 bp, Homo sapiens
tgcaattaaacttccaaagaaag

SEQ ID NO: 4860506 - DNA, 14 bp, Homo sapiens
tgcaattcagtgtt

SEQ ID NO: 4860507 - DNA, 15 bp, Homo sapiens
tgcaattcagtgttc

SEQ ID NO: 4860508 - DNA, 21 bp, Homo sapiens
tgcacataagcttccatttta

SEQ ID NO: 4860509 - DNA, 17 bp, Homo sapiens
tgcacatctgttttgta

SEQ ID NO: 4860510 - DNA, 21 bp, Homo sapiens
tgcactaaaatgaggatccag

SEQ ID NO: 4860511 - DNA, 22 bp, Homo sapiens
tgcactaaaatgaggatccagg

SEQ ID NO: 4860512 - DNA, 23 bp, Homo sapiens
tgcactaaaatgaggatccaggg

SEQ ID NO: 4860513 - DNA, 18 bp, Homo sapiens
tgcactccagactctggg

SEQ ID NO: 4860514 - DNA, 20 bp, Homo sapiens
tgcactccagactctggggg

SEQ ID NO: 4860515 - DNA, 18 bp, Homo sapiens
tgcactgaacagaattaa

SEQ ID NO: 4860516 - DNA, 19 bp, Homo sapiens
tgcagaaatagacaaaaag

SEQ ID NO: 4860517 - DNA, 13 bp, Homo sapiens
tgcagacagccat

SEQ ID NO: 4860518 - DNA, 16 bp, Homo sapiens
tgcagacagccatgcg

SEQ ID NO: 4860519 - DNA, 16 bp, Homo sapiens
tgcagatatctgcatg

SEQ ID NO: 4860520 - DNA, 18 bp, Homo sapiens
tgcagatatctgcatgtg

SEQ ID NO: 4860521 - DNA, 23 bp, Homo sapiens
tgcagcagtcgcccaagcagaca

SEQ ID NO: 4860522 - DNA, 22 bp, Homo sapiens
tgcaggagggttggagtgctct

SEQ ID NO: 4860523 - DNA, 18 bp, Homo sapiens
tgcaggggtcccccctca

SEQ ID NO: 4860524 - DNA, 14 bp, Homo sapiens
tgcagtcagactga

SEQ ID NO: 4860525 - DNA, 18 bp, Homo sapiens
tgcagttggactctcagg

SEQ ID NO: 4860526 - DNA, 20 bp, Homo sapiens
tgcatactttgtattttgat

SEQ ID NO: 4860527 - DNA, 18 bp, Homo sapiens
tgcatagttgtagacaaa

SEQ ID NO: 4860528 - DNA, 13 bp, Homo sapiens
tgcatattataaa

SEQ ID NO: 4860529 - DNA, 19 bp, Homo sapiens
tgcatatttgcaaagtgta

SEQ ID NO: 4860530 - DNA, 15 bp, Homo sapiens
tgcatgaaaaaccat

SEQ ID NO: 4860531 - DNA, 20 bp, Homo sapiens
tgcatgatttttgccctgcg

SEQ ID NO: 4860532 - DNA, 14 bp, Homo sapiens
tgcatggagaatgg

SEQ ID NO: 4860533 - DNA, 15 bp, Homo sapiens
tgcatggggaggcag

SEQ ID NO: 4860534 - DNA, 23 bp, Homo sapiens
tgcatgtgacttctcccctgccc

SEQ ID NO: 4860535 - DNA, 18 bp, Homo sapiens
tgcattccagctgtcact

SEQ ID NO: 4860536 - DNA, 12 bp, Homo sapiens
tgcatttaataa

SEQ ID NO: 4860537 - DNA, 15 bp, Homo sapiens
tgcatttaataaaga

SEQ ID NO: 4860538 - DNA, 22 bp, Homo sapiens
tgcatttaataaagatgagttg

SEQ ID NO: 4860539 - DNA, 23 bp, Homo sapiens
tgcatttaataaagatgagttgg

SEQ ID NO: 4860540 - DNA, 19 bp, Homo sapiens
tgcatttttattaaagcat

SEQ ID NO: 4860541 - DNA, 19 bp, Homo sapiens
tgccaaaacatttatgaca

SEQ ID NO: 4860542 - DNA, 22 bp, Homo sapiens
tgccaaagtacagaatttgaat

SEQ ID NO: 4860543 - DNA, 12 bp, Homo sapiens
tgccaaggagca

SEQ ID NO: 4860544 - DNA, 17 bp, Homo sapiens
tgccaataaagtgatct

SEQ ID NO: 4860545 - DNA, 16 bp, Homo sapiens
tgccaatctgtacaaa

SEQ ID NO: 4860546 - DNA, 13 bp, Homo sapiens
tgccagaggacca

SEQ ID NO: 4860547 - DNA, 20 bp, Homo sapiens
tgccaggacatgcaataaaa

SEQ ID NO: 4860548 - DNA, 15 bp, Homo sapiens
tgccaggggctctgt

SEQ ID NO: 4860549 - DNA, 22 bp, Homo sapiens
tgccaggggctctgtggcaaaa

SEQ ID NO: 4860550 - DNA, 13 bp, Homo sapiens
tgccagtggtgga

SEQ ID NO: 4860551 - DNA, 18 bp, Homo sapiens
tgccagtggtggaggtgg

SEQ ID NO: 4860552 - DNA, 17 bp, Homo sapiens
tgccagttacttgggct

SEQ ID NO: 4860553 - DNA, 18 bp, Homo sapiens
tgccagttacttgggctt

SEQ ID NO: 4860554 - DNA, 15 bp, Homo sapiens
tgccatgggaaacaa

SEQ ID NO: 4860555 - DNA, 22 bp, Homo sapiens
tgccattacagaggtattaaaa

SEQ ID NO: 4860556 - DNA, 21 bp, Homo sapiens
tgcccagacatcagcctcctt

SEQ ID NO: 4860557 - DNA, 14 bp, Homo sapiens
tgccccaagtggtg

SEQ ID NO: 4860558 - DNA, 17 bp, Homo sapiens
tgcccccattcccagcc

SEQ ID NO: 4860559 - DNA, 14 bp, Homo sapiens
tggggaggcagcag

SEQ ID NO: 4860560 - DNA, 16 bp, Homo sapiens
tggggaggcagcagag

SEQ ID NO: 4860561 - DNA, 13 bp, Homo sapiens
tggggcagcctct

SEQ ID NO: 4860562 - DNA, 16 bp, Homo sapiens
tggggcagggtggggg

SEQ ID NO: 4860563 - DNA, 16 bp, Homo sapiens
tggggcctcagcctgc

SEQ ID NO: 4860564 - DNA, 14 bp, Homo sapiens
tggggcctcaggct

SEQ ID NO: 4860565 - DNA, 20 bp, Homo sapiens
tggggcctccagaagctgct

SEQ ID NO: 4860566 - DNA, 21 bp, Homo sapiens
tggggcctccagaagctgctc

SEQ ID NO: 4860567 - DNA, 22 bp, Homo sapiens
tggggcctccagaagctgctcc

SEQ ID NO: 4860568 - DNA, 16 bp, Homo sapiens
tggggctcctttcccc

SEQ ID NO: 4860569 - DNA, 15 bp, Homo sapiens
tggggctgagccctc

SEQ ID NO: 4860570 - DNA, 20 bp, Homo sapiens
tggggggatggtaagagaaa

SEQ ID NO: 4860571 - DNA, 22 bp, Homo sapiens
tggggggccatgttcccagaac

SEQ ID NO: 4860572 - DNA, 14 bp, Homo sapiens
tggggtgctggggc

SEQ ID NO: 4860573 - DNA, 16 bp, Homo sapiens
tggggtgctggggctg

SEQ ID NO: 4860574 - DNA, 17 bp, Homo sapiens
tggggtggagtgggaag

SEQ ID NO: 4860575 - DNA, 22 bp, Homo sapiens
tggggtggggggatggtaagag

SEQ ID NO: 4860576 - DNA, 18 bp, Homo sapiens
tggggtgtggggtggggt

SEQ ID NO: 4860577 - DNA, 19 bp, Homo sapiens
tgggtctgagtcatggccg

SEQ ID NO: 4860578 - DNA, 20 bp, Homo sapiens
tgggtgctagatccagccca

SEQ ID NO: 4860579 - DNA, 21 bp, Homo sapiens
tgggtgctagatccagcccaa

SEQ ID NO: 4860580 - DNA, 20 bp, Homo sapiens
tgggtggggggcattgagta

SEQ ID NO: 4860581 - DNA, 22 bp, Homo sapiens
tgggtgtgagaatgatcaagga

SEQ ID NO: 4860582 - DNA, 18 bp, Homo sapiens
tgggttgtgcacatttct

SEQ ID NO: 4860583 - DNA, 14 bp, Homo sapiens
tgggtttgggagcc

SEQ ID NO: 4860584 - DNA, 15 bp, Homo sapiens
tgggtttgggagcca

SEQ ID NO: 4860585 - DNA, 14 bp, Homo sapiens
tggtaaatgtttct

SEQ ID NO: 4860586 - DNA, 15 bp, Homo sapiens
tggtaaatgtttctt

SEQ ID NO: 4860587 - DNA, 14 bp, Homo sapiens
tggtaagagaaaag

SEQ ID NO: 4860588 - DNA, 16 bp, Homo sapiens
tggtaataagcactgt

SEQ ID NO: 4860589 - DNA, 14 bp, Homo sapiens
tggtaatattgact

SEQ ID NO: 4860590 - DNA, 21 bp, Homo sapiens
tggtaatcccctaaaataaca

SEQ ID NO: 4860591 - DNA, 12 bp, Homo sapiens
tggtaggaccct

SEQ ID NO: 4860592 - DNA, 19 bp, Homo sapiens
tggtaggaccctcgagagc

SEQ ID NO: 4860593 - DNA, 15 bp, Homo sapiens
tggtagttttacagt

SEQ ID NO: 4860594 - DNA, 18 bp, Homo sapiens
tggtctggttcctgtgtg

SEQ ID NO: 4860595 - DNA, 13 bp, Homo sapiens
tggtgaaggggct

SEQ ID NO: 4860596 - DNA, 16 bp, Homo sapiens
tggtgaaggggctggt

SEQ ID NO: 4860597 - DNA, 19 bp, Homo sapiens
tggtgaaggggctggtgga

SEQ ID NO: 4860598 - DNA, 13 bp, Homo sapiens
tggtgagcaagca

SEQ ID NO: 4860599 - DNA, 21 bp, Homo sapiens
tggtgatttgaaaaatataaa

SEQ ID NO: 4860600 - DNA, 22 bp, Homo sapiens
tggtgatttgaaaaatataaaa

SEQ ID NO: 4860601 - DNA, 14 bp, Homo sapiens
tggtgcctgccacc

SEQ ID NO: 4860602 - DNA, 18 bp, Homo sapiens
tggtggaaaaaacatttt

SEQ ID NO: 4860603 - DNA, 17 bp, Homo sapiens
tggtggcagagtcctgg

SEQ ID NO: 4860604 - DNA, 16 bp, Homo sapiens
tggtggctcatgcctg

SEQ ID NO: 4860605 - DNA, 16 bp, Homo sapiens
tggtgtaatctcaatg

SEQ ID NO: 4860606 - DNA, 15 bp, Homo sapiens
tggtgtgaatttgcc

SEQ ID NO: 4860607 - DNA, 19 bp, Homo sapiens
tggtgtgaatttgccagag

SEQ ID NO: 4860608 - DNA, 20 bp, Homo sapiens
tggtgttgcagccgcagaga

SEQ ID NO: 4860609 - DNA, 22 bp, Homo sapiens
tggttcctgtgtgaccctgggc

SEQ ID NO: 4860610 - DNA, 23 bp, Homo sapiens
tggttgtctctcttcggtggcct

SEQ ID NO: 4860611 - DNA, 23 bp, Homo sapiens
tggtttgcaacctctttgctcaa

SEQ ID NO: 4860612 - DNA, 11 bp, Homo sapiens
tggtttggaat

SEQ ID NO: 4860613 - DNA, 17 bp, Homo sapiens
tggtttggaatattaaa

SEQ ID NO: 4860614 - DNA, 13 bp, Homo sapiens
tggttttcctgtg

SEQ ID NO: 4860615 - DNA, 23 bp, Homo sapiens
tgtaaaaatcttttgaagcatag

SEQ ID NO: 4860616 - DNA, 13 bp, Homo sapiens
tgtaaataactct

SEQ ID NO: 4860617 - DNA, 17 bp, Homo sapiens
tgtaacttccaaataaa

SEQ ID NO: 4860618 - DNA, 13 bp, Homo sapiens
tgtaacttcctgt

SEQ ID NO: 4860619 - DNA, 15 bp, Homo sapiens
tgtaacttcctgtgg

SEQ ID NO: 4860620 - DNA, 17 bp, Homo sapiens
tgtaacttcctgtggat

SEQ ID NO: 4860621 - DNA, 19 bp, Homo sapiens
tgtaaggatccggaaagaa

SEQ ID NO: 4860622 - DNA, 13 bp, Homo sapiens
tgtaagtttgtgt

SEQ ID NO: 4860623 - DNA, 13 bp, Homo sapiens
tgtaatctcaatg

SEQ ID NO: 4860624 - DNA, 17 bp, Homo sapiens
tgtaatctcaatgcaag

SEQ ID NO: 4860625 - DNA, 15 bp, Homo sapiens
tgtaatgctgcctca

SEQ ID NO: 4860626 - DNA, 15 bp, Homo sapiens
tgtaattatgtaaat

SEQ ID NO: 4860627 - DNA, 16 bp, Homo sapiens
tgtaattatgtaaata

SEQ ID NO: 4860628 - DNA, 19 bp, Homo sapiens
tgtaattatgtaaataact

SEQ ID NO: 4860629 - DNA, 15 bp, Homo sapiens
tgtacaaaagcaatg

SEQ ID NO: 4860630 - DNA, 16 bp, Homo sapiens
tgtacaaaattaagca

SEQ ID NO: 4860631 - DNA, 19 bp, Homo sapiens
tgtacaaaattaagcaaat

SEQ ID NO: 4860632 - DNA, 18 bp, Homo sapiens
tgtacagattctttcagt

SEQ ID NO: 4860633 - DNA, 17 bp, Homo sapiens
tgtaccaaaattttaaa

SEQ ID NO: 4860634 - DNA, 20 bp, Homo sapiens
tgtactaaacagtaagatat

SEQ ID NO: 4860635 - DNA, 16 bp, Homo sapiens
tgtactaacccagtct

SEQ ID NO: 4860636 - DNA, 17 bp, Homo sapiens
tgtactaacccagtctt

SEQ ID NO: 4860637 - DNA, 21 bp, Homo sapiens
tgtactaacccagtctttctt

SEQ ID NO: 4860638 - DNA, 16 bp, Homo sapiens
tgtactaactagcatt

SEQ ID NO: 4860639 - DNA, 12 bp, Homo sapiens
tgtactgcaaag

SEQ ID NO: 4860640 - DNA, 18 bp, Homo sapiens
tgtactgcatgtgacttc

SEQ ID NO: 4860641 - DNA, 15 bp, Homo sapiens
tgtacttaaatggta

SEQ ID NO: 4860642 - DNA, 22 bp, Homo sapiens
tgtacttaaatggtaataagca

SEQ ID NO: 4860643 - DNA, 22 bp, Homo sapiens
tgtacttccctcttgaaacctg

SEQ ID NO: 4860644 - DNA, 14 bp, Homo sapiens
tgtactttcccagg

SEQ ID NO: 4860645 - DNA, 15 bp, Homo sapiens
tgtactttcccaggt

SEQ ID NO: 4860646 - DNA, 14 bp, Homo sapiens
tgtagaaactgagg

SEQ ID NO: 4860647 - DNA, 14 bp, Homo sapiens
tgtagcagaaacca

SEQ ID NO: 4860648 - DNA, 15 bp, Homo sapiens
tgtagccagctgtgc

SEQ ID NO: 4860649 - DNA, 13 bp, Homo sapiens
tgtagctgtgaaa

SEQ ID NO: 4860650 - DNA, 15 bp, Homo sapiens
tgtaggtaagactgt

SEQ ID NO: 4860651 - DNA, 18 bp, Homo sapiens
tgtataaaagtgtgaaat

SEQ ID NO: 4860652 - DNA, 21 bp, Homo sapiens
tgtataaaagtgtgaaataaa

SEQ ID NO: 4860653 - DNA, 12 bp, Homo sapiens
tgtataaatata

SEQ ID NO: 4860654 - DNA, 14 bp, Homo sapiens
tgtataaatataca

SEQ ID NO: 4860655 - DNA, 19 bp, Homo sapiens
tgtataaatatacagtata

SEQ ID NO: 4860656 - DNA, 14 bp, Homo sapiens
tgtataatattgaa

SEQ ID NO: 4860657 - DNA, 21 bp, Homo sapiens
tgtataatattgaaaattgaa

SEQ ID NO: 4860658 - DNA, 13 bp, Homo sapiens
tgtatagcatgaa

SEQ ID NO: 4860659 - DNA, 19 bp, Homo sapiens
tgtatagcatgaaataaaa

SEQ ID NO: 4860660 - DNA, 15 bp, Homo sapiens
tgtatatatgtattt

SEQ ID NO: 4860661 - DNA, 19 bp, Homo sapiens
tgtatattacccaatggaa

SEQ ID NO: 4860662 - DNA, 20 bp, Homo sapiens
tgtatattacccaatggaaa

SEQ ID NO: 4860663 - DNA, 16 bp, Homo sapiens
tgtatgagtagccagg

SEQ ID NO: 4860664 - DNA, 17 bp, Homo sapiens
tgtatgagtagccaggg

SEQ ID NO: 4860665 - DNA, 21 bp, Homo sapiens
tgtatgggggagattgaactt

SEQ ID NO: 4860666 - DNA, 23 bp, Homo sapiens
tgtatgggggagattgaactttc

SEQ ID NO: 4860667 - DNA, 16 bp, Homo sapiens
tgtattcttttctcag

SEQ ID NO: 4860668 - DNA, 19 bp, Homo sapiens
tgtattcttttctcagtgt

SEQ ID NO: 4860669 - DNA, 21 bp, Homo sapiens
tgtattggtgttgcagccgca

SEQ ID NO: 4860670 - DNA, 14 bp, Homo sapiens
tgtatttctatata

SEQ ID NO: 4860671 - DNA, 16 bp, Homo sapiens
tgtattttcatgaaaa

SEQ ID NO: 4860672 - DNA, 18 bp, Homo sapiens
tgtatttttctaaactcc

SEQ ID NO: 4860673 - DNA, 20 bp, Homo sapiens
tgtcaaccccaagttagttc

SEQ ID NO: 4860674 - DNA, 16 bp, Homo sapiens
tgtcaccgcaggtgct

SEQ ID NO: 4860675 - DNA, 19 bp, Homo sapiens
tgtcactgtccagagtctc

SEQ ID NO: 4860676 - DNA, 22 bp, Homo sapiens
tgtcacttttccttttcttaaa

SEQ ID NO: 4860677 - DNA, 15 bp, Homo sapiens
tgtcagaagcctcca

SEQ ID NO: 4860678 - DNA, 21 bp, Homo sapiens
tgtcattgcacataagcttcc

SEQ ID NO: 4860679 - DNA, 14 bp, Homo sapiens
ttcaggagcctggc

SEQ ID NO: 4860680 - DNA, 20 bp, Homo sapiens
ttcaggagcctggccaggca

SEQ ID NO: 4860681 - DNA, 16 bp, Homo sapiens
ttcaggcagctgaaat

SEQ ID NO: 4860682 - DNA, 18 bp, Homo sapiens
ttcaggcagctgaaattc

SEQ ID NO: 4860683 - DNA, 23 bp, Homo sapiens
ttcagggtaaataggaatcattc

SEQ ID NO: 4860684 - DNA, 18 bp, Homo sapiens
ttcagtgtcccaccttga

SEQ ID NO: 4860685 - DNA, 17 bp, Homo sapiens
ttcagttgcttgtcttc

SEQ ID NO: 4860686 - DNA, 19 bp, Homo sapiens
ttcagttgcttgtcttctg

SEQ ID NO: 4860687 - DNA, 11 bp, Homo sapiens
ttcatagagaa

SEQ ID NO: 4860688 - DNA, 23 bp, Homo sapiens
ttcatagtaagtgcgaagactga

SEQ ID NO: 4860689 - DNA, 14 bp, Homo sapiens
ttcatccatcctga

SEQ ID NO: 4860690 - DNA, 15 bp, Homo sapiens
ttcatccatcctgag

SEQ ID NO: 4860691 - DNA, 21 bp, Homo sapiens
ttcatccatcctgagccaaat

SEQ ID NO: 4860692 - DNA, 17 bp, Homo sapiens
ttcatccttccatccat

SEQ ID NO: 4860693 - DNA, 17 bp, Homo sapiens
ttcatgaaaataccatt

SEQ ID NO: 4860694 - DNA, 15 bp, Homo sapiens
ttcatgaatgtgctg

SEQ ID NO: 4860695 - DNA, 15 bp, Homo sapiens
ttcatgattagaaat

SEQ ID NO: 4860696 - DNA, 15 bp, Homo sapiens
ttcatgcctgatgaa

SEQ ID NO: 4860697 - DNA, 18 bp, Homo sapiens
ttcattctccctttcact

SEQ ID NO: 4860698 - DNA, 14 bp, Homo sapiens
ttccaaaacaaaaa

SEQ ID NO: 4860699 - DNA, 14 bp, Homo sapiens
ttccaaaatattat

SEQ ID NO: 4860700 - DNA, 12 bp, Homo sapiens
ttccaaagaaag

SEQ ID NO: 4860701 - DNA, 19 bp, Homo sapiens
ttccaccataccttagaga

SEQ ID NO: 4860702 - DNA, 21 bp, Homo sapiens
ttccacccacaaactccaggc

SEQ ID NO: 4860703 - DNA, 16 bp, Homo sapiens
ttccagatctttcaga

SEQ ID NO: 4860704 - DNA, 21 bp, Homo sapiens
ttccatgagttatcatgaatt

SEQ ID NO: 4860705 - DNA, 13 bp, Homo sapiens
ttccattacacca

SEQ ID NO: 4860706 - DNA, 17 bp, Homo sapiens
ttcccaaaacaatggtg

SEQ ID NO: 4860707 - DNA, 22 bp, Homo sapiens
ttcccaaatcctagactgctcc

SEQ ID NO: 4860708 - DNA, 13 bp, Homo sapiens
ttcccactccagc

SEQ ID NO: 4860709 - DNA, 14 bp, Homo sapiens
ttcccactccagct

SEQ ID NO: 4860710 - DNA, 16 bp, Homo sapiens
ttcccactccagctga

SEQ ID NO: 4860711 - DNA, 23 bp, Homo sapiens
ttcccagaaccttgatggggtga

SEQ ID NO: 4860712 - DNA, 12 bp, Homo sapiens
ttcccagagtgg

SEQ ID NO: 4860713 - DNA, 21 bp, Homo sapiens
ttcccccagcacaaagcactg

SEQ ID NO: 4860714 - DNA, 24 bp, Homo sapiens
ttccctccagagaaagcacaattt

SEQ ID NO: 4860715 - DNA, 20 bp, Homo sapiens
ttccctgggtttgggagcca

SEQ ID NO: 4860716 - DNA, 18 bp, Homo sapiens
ttccctttacagctctcc

SEQ ID NO: 4860717 - DNA, 17 bp, Homo sapiens
ttcctaattgtgcccct

SEQ ID NO: 4860718 - DNA, 13 bp, Homo sapiens
ttcctccagctgg

SEQ ID NO: 4860719 - DNA, 18 bp, Homo sapiens
ttcctcctcccaaggcat

SEQ ID NO: 4860720 - DNA, 23 bp, Homo sapiens
ttcctcctcccaaggcattctcc

SEQ ID NO: 4860721 - DNA, 15 bp, Homo sapiens
ttcctcttgtctgat

SEQ ID NO: 4860722 - DNA, 21 bp, Homo sapiens
ttcctcttttgtgctgcttct

SEQ ID NO: 4860723 - DNA, 11 bp, Homo sapiens
ttcctgcatgt

SEQ ID NO: 4860724 - DNA, 17 bp, Homo sapiens
ttcctgctgctgctact

SEQ ID NO: 4860725 - DNA, 12 bp, Homo sapiens
ttcctggcacaa

SEQ ID NO: 4860726 - DNA, 22 bp, Homo sapiens
ttcctggcacaatgttggagca

SEQ ID NO: 4860727 - DNA, 11 bp, Homo sapiens
ttcctggcagt

SEQ ID NO: 4860728 - DNA, 17 bp, Homo sapiens
ttcctggcagtctcagt

SEQ ID NO: 4860729 - DNA, 15 bp, Homo sapiens
ttcctgtcccacatg

SEQ ID NO: 4860730 - DNA, 13 bp, Homo sapiens
ttcctgtgaggat

SEQ ID NO: 4860731 - DNA, 21 bp, Homo sapiens
ttcctgtgtgaccctgggcag

SEQ ID NO: 4860732 - DNA, 11 bp, Homo sapiens
ttccttcaggc

SEQ ID NO: 4860733 - DNA, 14 bp, Homo sapiens
ttccttcaggcagc

SEQ ID NO: 4860734 - DNA, 21 bp, Homo sapiens
ttccttcaggcagctgaaatt

SEQ ID NO: 4860735 - DNA, 19 bp, Homo sapiens
ttccttctcatcttgcctc

SEQ ID NO: 4860736 - DNA, 21 bp, Homo sapiens
ttccttctcatcttgcctcat

SEQ ID NO: 4860737 - DNA, 15 bp, Homo sapiens
ttccttttcaggaga

SEQ ID NO: 4860738 - DNA, 21 bp, Homo sapiens
ttccttttcaggagatgggga

SEQ ID NO: 4860739 - DNA, 15 bp, Homo sapiens
ttccttttcttaaaa

SEQ ID NO: 4860740 - DNA, 23 bp, Homo sapiens
ttcgaggggttccttccacttct

SEQ ID NO: 4860741 - DNA, 11 bp, Homo sapiens
ttcggaaacac

SEQ ID NO: 4860742 - DNA, 20 bp, Homo sapiens
ttcggctctagggcctcagt

SEQ ID NO: 4860743 - DNA, 19 bp, Homo sapiens
ttcggtggccttgagtctc

SEQ ID NO: 4860744 - DNA, 17 bp, Homo sapiens
ttctaaaagctttcatg

SEQ ID NO: 4860745 - DNA, 14 bp, Homo sapiens
ttctaagtgggaga

SEQ ID NO: 4860746 - DNA, 19 bp, Homo sapiens
ttctagtacctgtgactct

SEQ ID NO: 4860747 - DNA, 20 bp, Homo sapiens
ttctagttgcccccattccc

SEQ ID NO: 4860748 - DNA, 21 bp, Homo sapiens
ttctataaaactctgcatgta

SEQ ID NO: 4860749 - DNA, 19 bp, Homo sapiens
ttctatattcctccagctg

SEQ ID NO: 4860750 - DNA, 13 bp, Homo sapiens
ttctattctccag

SEQ ID NO: 4860751 - DNA, 17 bp, Homo sapiens
ttctattctccagacat

SEQ ID NO: 4860752 - DNA, 21 bp, Homo sapiens
ttctatttatttatttattca

SEQ ID NO: 4860753 - DNA, 21 bp, Homo sapiens
ttctatttttatgatgacaat

SEQ ID NO: 4860754 - DNA, 23 bp, Homo sapiens
ttctattttttgttttgtttcct

SEQ ID NO: 4860755 - DNA, 13 bp, Homo sapiens
ttctcaaatgtgt

SEQ ID NO: 4860756 - DNA, 14 bp, Homo sapiens
ttctcaaatgtgtg

SEQ ID NO: 4860757 - DNA, 15 bp, Homo sapiens
ttctcaaatgtgtgt

SEQ ID NO: 4860758 - DNA, 20 bp, Homo sapiens
ttctcagctgtgccttccct

SEQ ID NO: 4860759 - DNA, 21 bp, Homo sapiens
ttctcagtccagcagtttcca

SEQ ID NO: 4860760 - DNA, 20 bp, Homo sapiens
ttctcattgacttttataaa

SEQ ID NO: 4860761 - DNA, 17 bp, Homo sapiens
ttctccagtcattatgt

SEQ ID NO: 4860762 - DNA, 14 bp, Homo sapiens
ttctccatggagcc

SEQ ID NO: 4860763 - DNA, 19 bp, Homo sapiens
ttctccatggagcctacct

SEQ ID NO: 4860764 - DNA, 19 bp, Homo sapiens
ttctctggtaatattgact

SEQ ID NO: 4860765 - DNA, 17 bp, Homo sapiens
ttctctttggggctcct

SEQ ID NO: 4860766 - DNA, 21 bp, Homo sapiens
ttctgaaccctccaaaggaac

SEQ ID NO: 4860767 - DNA, 17 bp, Homo sapiens
ttctgcaacaagcatgc

SEQ ID NO: 4860768 - DNA, 18 bp, Homo sapiens
ttctggctttaagccttc

SEQ ID NO: 4860769 - DNA, 19 bp, Homo sapiens
ttctgggcttggggtgtgg

SEQ ID NO: 4860770 - DNA, 14 bp, Homo sapiens
ttctgtatttcctt

SEQ ID NO: 4860771 - DNA, 13 bp, Homo sapiens
ttctgtctgggga

SEQ ID NO: 4860772 - DNA, 19 bp, Homo sapiens
ttctgtctggggacgaagg

SEQ ID NO: 4860773 - DNA, 20 bp, Homo sapiens
ttcttactaaaaagtataaa

SEQ ID NO: 4860774 - DNA, 17 bp, Homo sapiens
ttcttatttttgtactt

SEQ ID NO: 4860775 - DNA, 16 bp, Homo sapiens
ttcttgaatataaaaa

SEQ ID NO: 4860776 - DNA, 17 bp, Homo sapiens
ttcttgaatataaaaaa

SEQ ID NO: 4860777 - DNA, 18 bp, Homo sapiens
ttcttgtgggagacagca

SEQ ID NO: 4860778 - DNA, 19 bp, Homo sapiens
ttctttctagttcagctgc

SEQ ID NO: 4860779 - DNA, 12 bp, Homo sapiens
ttctttcttcca

SEQ ID NO: 4860780 - DNA, 21 bp, Homo sapiens
ttctttgacctcttctctcct

SEQ ID NO: 4860781 - DNA, 17 bp, Homo sapiens
ttctttgcaatactgct

SEQ ID NO: 4860782 - DNA, 18 bp, Homo sapiens
ttctttggacttctgaag

SEQ ID NO: 4860783 - DNA, 16 bp, Homo sapiens
ttctttggagttaaaa

SEQ ID NO: 4860784 - DNA, 20 bp, Homo sapiens
ttctttggagttaaaatgca

SEQ ID NO: 4860785 - DNA, 14 bp, Homo sapiens
ttcttttaaagacc

SEQ ID NO: 4860786 - DNA, 14 bp, Homo sapiens
ttcttttctcagtg

SEQ ID NO: 4860787 - DNA, 14 bp, Homo sapiens
ttcttttgtttggt

SEQ ID NO: 4860788 - DNA, 14 bp, Homo sapiens
ttctttttgaaatg

SEQ ID NO: 4860789 - DNA, 20 bp, Homo sapiens
ttgaaactttgggaaaacat

SEQ ID NO: 4860790 - DNA, 22 bp, Homo sapiens
ttgaaatacgtttgtgtttcta

SEQ ID NO: 4860791 - DNA, 14 bp, Homo sapiens
ttgaaatgaacttt

SEQ ID NO: 4860792 - DNA, 16 bp, Homo sapiens
ttgaaatgaactttgt

SEQ ID NO: 4860793 - DNA, 23 bp, Homo sapiens
ttgaactctgttcccccaccctc

SEQ ID NO: 4860794 - DNA, 13 bp, Homo sapiens
ttgaactttggaa

SEQ ID NO: 4860795 - DNA, 13 bp, Homo sapiens
ttgaactttttaa

SEQ ID NO: 4860796 - DNA, 23 bp, Homo sapiens
ttgaagcatagataatattgttt

SEQ ID NO: 4860797 - DNA, 22 bp, Homo sapiens
ttgaaggagaatggcatggcag

SEQ ID NO: 4860798 - DNA, 15 bp, Homo sapiens
ttgaaggtagaatgt

SEQ ID NO: 4860799 - DNA, 15 bp, Homo sapiens
tttgttgcactaaaa

SEQ ID NO: 4860800 - DNA, 21 bp, Homo sapiens
ttttaaaaaagggagtttttg

SEQ ID NO: 4860801 - DNA, 19 bp, Homo sapiens
ttttaaaaattgttattta

SEQ ID NO: 4860802 - DNA, 14 bp, Homo sapiens
ttttaaaacgtgta

SEQ ID NO: 4860803 - DNA, 15 bp, Homo sapiens
ttttaaaatttcata

SEQ ID NO: 4860804 - DNA, 19 bp, Homo sapiens
ttttaaaggcattagagtc

SEQ ID NO: 4860805 - DNA, 22 bp, Homo sapiens
ttttaaccggtaagagtttcag

SEQ ID NO: 4860806 - DNA, 20 bp, Homo sapiens
ttttaactaaattttaaagc

SEQ ID NO: 4860807 - DNA, 12 bp, Homo sapiens
ttttaactgtga

SEQ ID NO: 4860808 - DNA, 14 bp, Homo sapiens
ttttaactgtggat

SEQ ID NO: 4860809 - DNA, 23 bp, Homo sapiens
ttttaaggataaatcataaagtc

SEQ ID NO: 4860810 - DNA, 22 bp, Homo sapiens
ttttaatccatttcaggactct

SEQ ID NO: 4860811 - DNA, 17 bp, Homo sapiens
ttttagaaatattcaca

SEQ ID NO: 4860812 - DNA, 22 bp, Homo sapiens
ttttagtgttaaagagataaag

SEQ ID NO: 4860813 - DNA, 12 bp, Homo sapiens
ttttataaagca

SEQ ID NO: 4860814 - DNA, 21 bp, Homo sapiens
ttttataacatctttattgaa

SEQ ID NO: 4860815 - DNA, 16 bp, Homo sapiens
ttttataattgtacaa

SEQ ID NO: 4860816 - DNA, 17 bp, Homo sapiens
ttttatccctcacctgt

SEQ ID NO: 4860817 - DNA, 15 bp, Homo sapiens
ttttcaaatgttctc

SEQ ID NO: 4860818 - DNA, 20 bp, Homo sapiens
ttttcaccttttcaggaaaa

SEQ ID NO: 4860819 - DNA, 16 bp, Homo sapiens
ttttccaaaagtaaag

SEQ ID NO: 4860820 - DNA, 17 bp, Homo sapiens
ttttccaaaagtaaaga

SEQ ID NO: 4860821 - DNA, 18 bp, Homo sapiens
ttttccttttcttaaaac

SEQ ID NO: 4860822 - DNA, 16 bp, Homo sapiens
ttttcggaaacactga

SEQ ID NO: 4860823 - DNA, 16 bp, Homo sapiens
ttttctcaatctcctc

SEQ ID NO: 4860824 - DNA, 20 bp, Homo sapiens
ttttctctgcatttaaaaaa

SEQ ID NO: 4860825 - DNA, 16 bp, Homo sapiens
ttttctctggtaatat

SEQ ID NO: 4860826 - DNA, 17 bp, Homo sapiens
ttttcttcactcaaatt

SEQ ID NO: 4860827 - DNA, 12 bp, Homo sapiens
ttttgaaagaat

SEQ ID NO: 4860828 - DNA, 13 bp, Homo sapiens
ttttgaaatgtca

SEQ ID NO: 4860829 - DNA, 21 bp, Homo sapiens
ttttgagataaatgagtgatt

SEQ ID NO: 4860830 - DNA, 19 bp, Homo sapiens
ttttgcatgcatgcaaatg

SEQ ID NO: 4860831 - DNA, 21 bp, Homo sapiens
ttttgcatgcatgcaaatgag

SEQ ID NO: 4860832 - DNA, 14 bp, Homo sapiens
ttttggaaagtcag

SEQ ID NO: 4860833 - DNA, 17 bp, Homo sapiens
ttttggaaagtcagaat

SEQ ID NO: 4860834 - DNA, 22 bp, Homo sapiens
ttttggcacttgccattccaaa

SEQ ID NO: 4860835 - DNA, 15 bp, Homo sapiens
ttttggggagccaga

SEQ ID NO: 4860836 - DNA, 16 bp, Homo sapiens
ttttggggagccagaa

SEQ ID NO: 4860837 - DNA, 19 bp, Homo sapiens
ttttgggggtcagcatcca

SEQ ID NO: 4860838 - DNA, 14 bp, Homo sapiens
ttttgtatgttaaa

SEQ ID NO: 4860839 - DNA, 15 bp, Homo sapiens
ttttgtgctgcttct

SEQ ID NO: 4860840 - DNA, 19 bp, Homo sapiens
ttttgttgtacttaaatgg

SEQ ID NO: 4860841 - DNA, 15 bp, Homo sapiens
ttttgtttgccagga

SEQ ID NO: 4860842 - DNA, 18 bp, Homo sapiens
ttttgtttggagacgttt

SEQ ID NO: 4860843 - DNA, 16 bp, Homo sapiens
tttttaatttacttgt

SEQ ID NO: 4860844 - DNA, 14 bp, Homo sapiens
tttttagtgttaaa

SEQ ID NO: 4860845 - DNA, 23 bp, Homo sapiens
tttttataacatctttattgaaa

SEQ ID NO: 4860846 - DNA, 23 bp, Homo sapiens
tttttataattgtacaaaattaa

SEQ ID NO: 4860847 - DNA, 18 bp, Homo sapiens
tttttcctgcatgttctg

SEQ ID NO: 4860848 - DNA, 17 bp, Homo sapiens
tttttcggtttcaaagt

SEQ ID NO: 4860849 - DNA, 16 bp, Homo sapiens
tttttgagtcaaagac

SEQ ID NO: 4860850 - DNA, 15 bp, Homo sapiens
tttttggaaagtcag

SEQ ID NO: 4860851 - DNA, 13 bp, Homo sapiens
tttttttaactgt

SEQ ID NO: 4860852 - DNA, 22 bp, Homo sapiens
aaacctgactaggttctgtaga

SEQ ID NO: 4860853 - DNA, 15 bp, Homo sapiens
aaactatatataatg

SEQ ID NO: 4860854 - DNA, 19 bp, Homo sapiens
aatttcagtgtaaagtgtg

SEQ ID NO: 4860855 - DNA, 18 bp, Homo sapiens
aatttcatagctgtactt

SEQ ID NO: 4860856 - DNA, 20 bp, Homo sapiens
aatttcatagctgtacttct

SEQ ID NO: 4860857 - DNA, 11 bp, Homo sapiens
aatttcctgtg

SEQ ID NO: 4860858 - DNA, 12 bp, Homo sapiens
aatttgaacttt

SEQ ID NO: 4860859 - DNA, 16 bp, Homo sapiens
aatttgaactttggaa

SEQ ID NO: 4860860 - DNA, 23 bp, Homo sapiens
aatttggatttaaaagcctgctc

SEQ ID NO: 4860861 - DNA, 14 bp, Homo sapiens
aatttgtatatgac

SEQ ID NO: 4860862 - DNA, 17 bp, Homo sapiens
aatttgtatatgactgc

SEQ ID NO: 4860863 - DNA, 14 bp, Homo sapiens
aatttgtgtgtttt

SEQ ID NO: 4860864 - DNA, 12 bp, Homo sapiens
aattttaaaaaa

SEQ ID NO: 4860865 - DNA, 12 bp, Homo sapiens
aattttaaagcc

SEQ ID NO: 4860866 - DNA, 12 bp, Homo sapiens
aattttaaagta

SEQ ID NO: 4860867 - DNA, 13 bp, Homo sapiens
aattttaaagtat

SEQ ID NO: 4860868 - DNA, 16 bp, Homo sapiens
aattttaaagtatgca

SEQ ID NO: 4860869 - DNA, 18 bp, Homo sapiens
aattttaaagtatgcatt

SEQ ID NO: 4860870 - DNA, 17 bp, Homo sapiens
aattttagaaatattca

SEQ ID NO: 4860871 - DNA, 19 bp, Homo sapiens
aattttatgagggccacgg

SEQ ID NO: 4860872 - DNA, 19 bp, Homo sapiens
aattttattttaaaatttc

SEQ ID NO: 4860873 - DNA, 22 bp, Homo sapiens
aattttattttaaaatttcata

SEQ ID NO: 4860874 - DNA, 18 bp, Homo sapiens
aattttcacttttggcaa

SEQ ID NO: 4860875 - DNA, 21 bp, Homo sapiens
aattttcacttttggcaatga

SEQ ID NO: 4860876 - DNA, 20 bp, Homo sapiens
aattttgtatgttaaagaga

SEQ ID NO: 4860877 - DNA, 17 bp, Homo sapiens
acaaaaaacgaatgaaa

SEQ ID NO: 4860878 - DNA, 16 bp, Homo sapiens
acaaaaagatgtctca

SEQ ID NO: 4860879 - DNA, 15 bp, Homo sapiens
acaaacaaaactctt

SEQ ID NO: 4860880 - DNA, 12 bp, Homo sapiens
acaaactccagg

SEQ ID NO: 4860881 - DNA, 18 bp, Homo sapiens
acaaagaaacaaagatgt

SEQ ID NO: 4860882 - DNA, 15 bp, Homo sapiens
acaaagaagaaagct

SEQ ID NO: 4860883 - DNA, 14 bp, Homo sapiens
acaaagtttcagag

SEQ ID NO: 4860884 - DNA, 19 bp, Homo sapiens
acaaattgactcttattta

SEQ ID NO: 4860885 - DNA, 17 bp, Homo sapiens
acaacatttatatgtag

SEQ ID NO: 4860886 - DNA, 18 bp, Homo sapiens
acaaccattaaagtcaga

SEQ ID NO: 4860887 - DNA, 16 bp, Homo sapiens
acaactcattttcata

SEQ ID NO: 4860888 - DNA, 15 bp, Homo sapiens
acaagactggcccag

SEQ ID NO: 4860889 - DNA, 13 bp, Homo sapiens
acaagctgtatca

SEQ ID NO: 4860890 - DNA, 19 bp, Homo sapiens
acaagcttcagtaagttat

SEQ ID NO: 4860891 - DNA, 16 bp, Homo sapiens
acaagtaatttcagtg

SEQ ID NO: 4860892 - DNA, 17 bp, Homo sapiens
acaagtggtgtttattg

SEQ ID NO: 4860893 - DNA, 23 bp, Homo sapiens
acaataggagtggtgatttgaaa

SEQ ID NO: 4860894 - DNA, 18 bp, Homo sapiens
acaatattgattgggaaa

SEQ ID NO: 4860895 - DNA, 21 bp, Homo sapiens
acaattaactgccctctgaaa

SEQ ID NO: 4860896 - DNA, 13 bp, Homo sapiens
acaatttaaaaca

SEQ ID NO: 4860897 - DNA, 22 bp, Homo sapiens
acaatttaaaacaatccttact

SEQ ID NO: 4860898 - DNA, 14 bp, Homo sapiens
acacacacacacac

SEQ ID NO: 4860899 - DNA, 14 bp, Homo sapiens
acacacacgatgca

SEQ ID NO: 4860900 - DNA, 15 bp, Homo sapiens
acacacacgatgcat

SEQ ID NO: 4860901 - DNA, 16 bp, Homo sapiens
acacacacgatgcatt

SEQ ID NO: 4860902 - DNA, 12 bp, Homo sapiens
acacacagtacg

SEQ ID NO: 4860903 - DNA, 14 bp, Homo sapiens
acacacgatgcatt

SEQ ID NO: 4860904 - DNA, 21 bp, Homo sapiens
acacagacactaacgaaatat

SEQ ID NO: 4860905 - DNA, 14 bp, Homo sapiens
acacattacaaagt

SEQ ID NO: 4860906 - DNA, 19 bp, Homo sapiens
acacatttgctactgttgt

SEQ ID NO: 4860907 - DNA, 13 bp, Homo sapiens
acacatttttttg

SEQ ID NO: 4860908 - DNA, 15 bp, Homo sapiens
acaccattaccaaaa

SEQ ID NO: 4860909 - DNA, 15 bp, Homo sapiens
acaccgagggcgacc

SEQ ID NO: 4860910 - DNA, 15 bp, Homo sapiens
acacgatgcatttaa

SEQ ID NO: 4860911 - DNA, 17 bp, Homo sapiens
acactaacgaaatatca

SEQ ID NO: 4860912 - DNA, 21 bp, Homo sapiens
acactaacgaaatatcaaagt

SEQ ID NO: 4860913 - DNA, 13 bp, Homo sapiens
acactcagaaaat

SEQ ID NO: 4860914 - DNA, 18 bp, Homo sapiens
acactcagaaaattccct

SEQ ID NO: 4860915 - DNA, 11 bp, Homo sapiens
acactgcttgg

SEQ ID NO: 4860916 - DNA, 16 bp, Homo sapiens
acactgtcaaacaggt

SEQ ID NO: 4860917 - DNA, 18 bp, Homo sapiens
acactgtcctattatatt

SEQ ID NO: 4860918 - DNA, 17 bp, Homo sapiens
acactgttgataaaaac

SEQ ID NO: 4860919 - DNA, 19 bp, Homo sapiens
acactgttgataaaaactc

SEQ ID NO: 4860920 - DNA, 16 bp, Homo sapiens
acacttcacctccttc

SEQ ID NO: 4860921 - DNA, 17 bp, Homo sapiens
acacttcacctccttct

SEQ ID NO: 4860922 - DNA, 20 bp, Homo sapiens
acacttcacctccttctgca

SEQ ID NO: 4860923 - DNA, 15 bp, Homo sapiens
acagaacactttgct

SEQ ID NO: 4860924 - DNA, 16 bp, Homo sapiens
acagaaggtgaacttt

SEQ ID NO: 4860925 - DNA, 19 bp, Homo sapiens
acagaatcttgttttgaaa

SEQ ID NO: 4860926 - DNA, 23 bp, Homo sapiens
acagaatttgaattatcagcaaa

SEQ ID NO: 4860927 - DNA, 14 bp, Homo sapiens
acagacacaattta

SEQ ID NO: 4860928 - DNA, 19 bp, Homo sapiens
acagaggtattaaaactaa

SEQ ID NO: 4860929 - DNA, 23 bp, Homo sapiens
acagatatgggtgtttttaataa

SEQ ID NO: 4860930 - DNA, 20 bp, Homo sapiens
acagatctcagggctcggga

SEQ ID NO: 4860931 - DNA, 21 bp, Homo sapiens
acagattctttcagttctttg

SEQ ID NO: 4860932 - DNA, 15 bp, Homo sapiens
acagcaaacaggtgc

SEQ ID NO: 4860933 - DNA, 21 bp, Homo sapiens
acagcaagagtaagcagtgtt

SEQ ID NO: 4860934 - DNA, 16 bp, Homo sapiens
acagcaagtgagcaga

SEQ ID NO: 4860935 - DNA, 17 bp, Homo sapiens
acagcagccccaggaga

SEQ ID NO: 4860936 - DNA, 17 bp, Homo sapiens
acagcattgtgtggaat

SEQ ID NO: 4860937 - DNA, 18 bp, Homo sapiens
acagccacaccgtggcag

SEQ ID NO: 4860938 - DNA, 20 bp, Homo sapiens
acagccctggcaaatgcctg

SEQ ID NO: 4860939 - DNA, 13 bp, Homo sapiens
acagcctctgact

SEQ ID NO: 4860940 - DNA, 19 bp, Homo sapiens
acagccttagagctcttgt

SEQ ID NO: 4860941 - DNA, 22 bp, Homo sapiens
acagccttgcaacccaaggtga

SEQ ID NO: 4860942 - DNA, 21 bp, Homo sapiens
acagctcaagcattctgttta

SEQ ID NO: 4860943 - DNA, 20 bp, Homo sapiens
acagctctcctccagccctg

SEQ ID NO: 4860944 - DNA, 21 bp, Homo sapiens
acagctggcggaggctgctcg

SEQ ID NO: 4860945 - DNA, 12 bp, Homo sapiens
acagctgtgctc

SEQ ID NO: 4860946 - DNA, 16 bp, Homo sapiens
acaggaaagagctagg

SEQ ID NO: 4860947 - DNA, 21 bp, Homo sapiens
acaggaaagagctaggaaccc

SEQ ID NO: 4860948 - DNA, 22 bp, Homo sapiens
acaggacagttgatggagcccc

SEQ ID NO: 4860949 - DNA, 15 bp, Homo sapiens
acaggagccagcctg

SEQ ID NO: 4860950 - DNA, 18 bp, Homo sapiens
acaggatcctggcctgag

SEQ ID NO: 4860951 - DNA, 19 bp, Homo sapiens
acaggccttcctcctctca

SEQ ID NO: 4860952 - DNA, 20 bp, Homo sapiens
acaggccttcctcctctcaa

SEQ ID NO: 4860953 - DNA, 16 bp, Homo sapiens
acagggaatggccaca

SEQ ID NO: 4860954 - DNA, 22 bp, Homo sapiens
acagggaatggccacaaacctg

SEQ ID NO: 4860955 - DNA, 13 bp, Homo sapiens
actgtaaagatgt

SEQ ID NO: 4860956 - DNA, 15 bp, Homo sapiens
actgtaacattcagg

SEQ ID NO: 4860957 - DNA, 17 bp, Homo sapiens
actgtaatgctgcctca

SEQ ID NO: 4860958 - DNA, 19 bp, Homo sapiens
actgtaatgctgcctcagg

SEQ ID NO: 4860959 - DNA, 13 bp, Homo sapiens
actgtactgcatg

SEQ ID NO: 4860960 - DNA, 14 bp, Homo sapiens
actgtactgcatgt

SEQ ID NO: 4860961 - DNA, 16 bp, Homo sapiens
actgtactgcatgtga

SEQ ID NO: 4860962 - DNA, 18 bp, Homo sapiens
actgtactttcccaggtt

SEQ ID NO: 4860963 - DNA, 15 bp, Homo sapiens
actgtagatatgtat

SEQ ID NO: 4860964 - DNA, 16 bp, Homo sapiens
actgtatcattttctt

SEQ ID NO: 4860965 - DNA, 22 bp, Homo sapiens
actgtatgggggagattgaact

SEQ ID NO: 4860966 - DNA, 23 bp, Homo sapiens
actgtcagtggggcagcctctcc

SEQ ID NO: 4860967 - DNA, 18 bp, Homo sapiens
actgtcctattatattca

SEQ ID NO: 4860968 - DNA, 17 bp, Homo sapiens
actgtgagaacccagtt

SEQ ID NO: 4860969 - DNA, 13 bp, Homo sapiens
actgtgggaaaga

SEQ ID NO: 4860970 - DNA, 14 bp, Homo sapiens
actgtgggcaaagt

SEQ ID NO: 4860971 - DNA, 23 bp, Homo sapiens
actgttaaggacccttttaagca

SEQ ID NO: 4860972 - DNA, 21 bp, Homo sapiens
actgttatcagtaatgctaaa

SEQ ID NO: 4860973 - DNA, 12 bp, Homo sapiens
actgttggaatg

SEQ ID NO: 4860974 - DNA, 14 bp, Homo sapiens
actgtttagatgaa

SEQ ID NO: 4860975 - DNA, 23 bp, Homo sapiens
actgtttgatataccaaattaaa

SEQ ID NO: 4860976 - DNA, 19 bp, Homo sapiens
acttaaagggcccaatgaa

SEQ ID NO: 4860977 - DNA, 19 bp, Homo sapiens
acttaaatggtaataagca

SEQ ID NO: 4860978 - DNA, 21 bp, Homo sapiens
acttacatgttcccaaaacaa

SEQ ID NO: 4860979 - DNA, 17 bp, Homo sapiens
acttagcctttacctgt

SEQ ID NO: 4860980 - DNA, 19 bp, Homo sapiens
acttaggtttcaggaagtt

SEQ ID NO: 4860981 - DNA, 15 bp, Homo sapiens
acttatgtagaaact

SEQ ID NO: 4860982 - DNA, 17 bp, Homo sapiens
ataaattatttgattat

SEQ ID NO: 4860983 - DNA, 20 bp, Homo sapiens
ataaattcaactttgtaaaa

SEQ ID NO: 4860984 - DNA, 12 bp, Homo sapiens
ataacacatttt

SEQ ID NO: 4860985 - DNA, 14 bp, Homo sapiens
ataacatctttatt

SEQ ID NO: 4860986 - DNA, 14 bp, Homo sapiens
ataacctaattaat

SEQ ID NO: 4860987 - DNA, 17 bp, Homo sapiens
ataacctagttaaagaa

SEQ ID NO: 4860988 - DNA, 20 bp, Homo sapiens
ataacctagttaaagaaagg

SEQ ID NO: 4860989 - DNA, 17 bp, Homo sapiens
ataacttctcatgtata

SEQ ID NO: 4860990 - DNA, 21 bp, Homo sapiens
ataagaaataatgctacaatt

SEQ ID NO: 4860991 - DNA, 17 bp, Homo sapiens
ataagagaatgttccta

SEQ ID NO: 4860992 - DNA, 16 bp, Homo sapiens
ataagataaaatgatg

SEQ ID NO: 4860993 - DNA, 13 bp, Homo sapiens
ataagggaaaaga

SEQ ID NO: 4860994 - DNA, 19 bp, Homo sapiens
ataataaaaatatattttc

SEQ ID NO: 4860995 - DNA, 16 bp, Homo sapiens
ataataaagtacttga

SEQ ID NO: 4860996 - DNA, 19 bp, Homo sapiens
ataatactactactgttat

SEQ ID NO: 4860997 - DNA, 13 bp, Homo sapiens
ataatagactgta

SEQ ID NO: 4860998 - DNA, 16 bp, Homo sapiens
ataatattgaaaattg

SEQ ID NO: 4860999 - DNA, 21 bp, Homo sapiens
ataatattgaaaattgaaaag

SEQ ID NO: 4861000 - DNA, 14 bp, Homo sapiens
ataatattgtttgg

SEQ ID NO: 4861001 - DNA, 16 bp, Homo sapiens
ataatattgtttggta

SEQ ID NO: 4861002 - DNA, 21 bp, Homo sapiens
ataatattgtttggtaaatgt

SEQ ID NO: 4861003 - DNA, 22 bp, Homo sapiens
ataatgatcagcaaaaagactg

SEQ ID NO: 4861004 - DNA, 22 bp, Homo sapiens
ataatggaaaatgccatgaatt

SEQ ID NO: 4861005 - DNA, 18 bp, Homo sapiens
ataatgggattagaaaca

SEQ ID NO: 4861006 - DNA, 19 bp, Homo sapiens
ataatgggattagaaacaa

SEQ ID NO: 4861007 - DNA, 23 bp, Homo sapiens
ataatgggattagaaacaaacaa

SEQ ID NO: 4861008 - DNA, 21 bp, Homo sapiens
ataatgggattttcttttctt

SEQ ID NO: 4861009 - DNA, 20 bp, Homo sapiens
ataatgtactgatttcagta

SEQ ID NO: 4861010 - DNA, 16 bp, Homo sapiens
ataatgtttattaaat

SEQ ID NO: 4861011 - DNA, 22 bp, Homo sapiens
ataattaaccaaccttgtttaa

SEQ ID NO: 4861012 - DNA, 17 bp, Homo sapiens
ataatttaaaaatatat

SEQ ID NO: 4861013 - DNA, 19 bp, Homo sapiens
ataatttaaaaatatattt

SEQ ID NO: 4861014 - DNA, 13 bp, Homo sapiens
ataatttaaagtt

SEQ ID NO: 4861015 - DNA, 14 bp, Homo sapiens
ataatttccttcag

SEQ ID NO: 4861016 - DNA, 23 bp, Homo sapiens
ataatttccttcaggcagctgaa

SEQ ID NO: 4861017 - DNA, 17 bp, Homo sapiens
ataatttgaactttgga

SEQ ID NO: 4861018 - DNA, 11 bp, Homo sapiens
atacaaaatgt

SEQ ID NO: 4861019 - DNA, 21 bp, Homo sapiens
atacatgccacatcaaacctt

SEQ ID NO: 4861020 - DNA, 16 bp, Homo sapiens
atacattttttaagct

SEQ ID NO: 4861021 - DNA, 17 bp, Homo sapiens
ataccaaattaaaaaaa

SEQ ID NO: 4861022 - DNA, 12 bp, Homo sapiens
atactaccaggg

SEQ ID NO: 4861023 - DNA, 12 bp, Homo sapiens
atactccttccc

SEQ ID NO: 4861024 - DNA, 23 bp, Homo sapiens
atactgccaaaacatttatgaca

SEQ ID NO: 4861025 - DNA, 18 bp, Homo sapiens
atactgcttaattgctga

SEQ ID NO: 4861026 - DNA, 18 bp, Homo sapiens
atactggggggcaggcct

SEQ ID NO: 4861027 - DNA, 18 bp, Homo sapiens
atactgtggcctgcagga

SEQ ID NO: 4861028 - DNA, 13 bp, Homo sapiens
atactttgtattt

SEQ ID NO: 4861029 - DNA, 22 bp, Homo sapiens
atagacttggagaatactgcca

SEQ ID NO: 4861030 - DNA, 14 bp, Homo sapiens
atagagaacaaagt

SEQ ID NO: 4861031 - DNA, 16 bp, Homo sapiens
atagagttgattgtct

SEQ ID NO: 4861032 - DNA, 16 bp, Homo sapiens
atagataatattgttt

SEQ ID NO: 4861033 - DNA, 14 bp, Homo sapiens
atagattcagagaa

SEQ ID NO: 4861034 - DNA, 15 bp, Homo sapiens
atagattcagagaaa

SEQ ID NO: 4861035 - DNA, 22 bp, Homo sapiens
atagcagtatatgttaatttgt

SEQ ID NO: 4861036 - DNA, 13 bp, Homo sapiens
atagcatgaaata

SEQ ID NO: 4861037 - DNA, 15 bp, Homo sapiens
atagctgtacttctt

SEQ ID NO: 4861038 - DNA, 17 bp, Homo sapiens
atagcttgcagaactgt

SEQ ID NO: 4861039 - DNA, 20 bp, Homo sapiens
ataggaatcattcagaaatg

SEQ ID NO: 4861040 - DNA, 15 bp, Homo sapiens
ataggacagagggat

SEQ ID NO: 4861041 - DNA, 22 bp, Homo sapiens
ataggccacagaaggtgaactt

SEQ ID NO: 4861042 - DNA, 22 bp, Homo sapiens
atagggtctaccaatacaaaat

SEQ ID NO: 4861043 - DNA, 22 bp, Homo sapiens
atagtagatgtggcctttgaat

SEQ ID NO: 4861044 - DNA, 15 bp, Homo sapiens
atagtcgtaagtgga

SEQ ID NO: 4861045 - DNA, 18 bp, Homo sapiens
atagtctaagactatata

SEQ ID NO: 4861046 - DNA, 12 bp, Homo sapiens
atagttgaatta

SEQ ID NO: 4861047 - DNA, 21 bp, Homo sapiens
atagttgaattagtgagtata

SEQ ID NO: 4861048 - DNA, 21 bp, Homo sapiens
atagttgcatagcagtatatg

SEQ ID NO: 4861049 - DNA, 19 bp, Homo sapiens
atagttgtagacaaagtac

SEQ ID NO: 4861050 - DNA, 16 bp, Homo sapiens
atataaaaaatcatgc

SEQ ID NO: 4861051 - DNA, 17 bp, Homo sapiens
atatacagtatagattt

SEQ ID NO: 4861052 - DNA, 14 bp, Homo sapiens
atatataaatgtat

SEQ ID NO: 4861053 - DNA, 15 bp, Homo sapiens
atatataaatgtata

SEQ ID NO: 4861054 - DNA, 15 bp, Homo sapiens
atatataatgtatat

SEQ ID NO: 4861055 - DNA, 20 bp, Homo sapiens
atgtagaaactgaggcccag

SEQ ID NO: 4861056 - DNA, 19 bp, Homo sapiens
atgtagtatctatatgact

SEQ ID NO: 4861057 - DNA, 16 bp, Homo sapiens
atgtataaatatacag

SEQ ID NO: 4861058 - DNA, 19 bp, Homo sapiens
atgtatataaactgggatg

SEQ ID NO: 4861059 - DNA, 14 bp, Homo sapiens
atgtatatatgtat

SEQ ID NO: 4861060 - DNA, 15 bp, Homo sapiens
atgtattatgagcca

SEQ ID NO: 4861061 - DNA, 16 bp, Homo sapiens
atgtattgcacattgt

SEQ ID NO: 4861062 - DNA, 17 bp, Homo sapiens
atgtattgcacattgta

SEQ ID NO: 4861063 - DNA, 16 bp, Homo sapiens
atgtcagaacagagtg

SEQ ID NO: 4861064 - DNA, 18 bp, Homo sapiens
atgtcagctgctgttgaa

SEQ ID NO: 4861065 - DNA, 15 bp, Homo sapiens
atgtccaaaatttat

SEQ ID NO: 4861066 - DNA, 14 bp, Homo sapiens
atgtctctgcaaac

SEQ ID NO: 4861067 - DNA, 18 bp, Homo sapiens
atgtctggcagatgaggg

SEQ ID NO: 4861068 - DNA, 14 bp, Homo sapiens
atgtgacatttata

SEQ ID NO: 4861069 - DNA, 14 bp, Homo sapiens
atgtgactaaagga

SEQ ID NO: 4861070 - DNA, 18 bp, Homo sapiens
atgtgactcagcatcacc

SEQ ID NO: 4861071 - DNA, 14 bp, Homo sapiens
atgtgacttctccc

SEQ ID NO: 4861072 - DNA, 15 bp, Homo sapiens
atgtgagtctgggat

SEQ ID NO: 4861073 - DNA, 19 bp, Homo sapiens
atgtgcacatctgttttgt

SEQ ID NO: 4861074 - DNA, 15 bp, Homo sapiens
atgtgcagtttggaa

SEQ ID NO: 4861075 - DNA, 16 bp, Homo sapiens
atgtgctatacacaca

SEQ ID NO: 4861076 - DNA, 17 bp, Homo sapiens
atgtgctatacacacac

SEQ ID NO: 4861077 - DNA, 18 bp, Homo sapiens
atgtgctatacacacaca

SEQ ID NO: 4861078 - DNA, 17 bp, Homo sapiens
atgtggtgtggggcgtg

SEQ ID NO: 4861079 - DNA, 18 bp, Homo sapiens
atgtgtaataatgtaaca

SEQ ID NO: 4861080 - DNA, 20 bp, Homo sapiens
atgtgtagagcccctactgt

SEQ ID NO: 4861081 - DNA, 21 bp, Homo sapiens
atgtgttatagacggtgctca

SEQ ID NO: 4861082 - DNA, 20 bp, Homo sapiens
atgtgtttccttttcaggag

SEQ ID NO: 4861083 - DNA, 22 bp, Homo sapiens
atgtgtttccttttcaggagat

SEQ ID NO: 4861084 - DNA, 16 bp, Homo sapiens
atgttaaagagaatga

SEQ ID NO: 4861085 - DNA, 22 bp, Homo sapiens
atgttaaagagaatgagtcctt

SEQ ID NO: 4861086 - DNA, 14 bp, Homo sapiens
atgttagagtaatg

SEQ ID NO: 4861087 - DNA, 16 bp, Homo sapiens
atgttcccaaaacaat

SEQ ID NO: 4861088 - DNA, 13 bp, Homo sapiens
atgttctccattt

SEQ ID NO: 4861089 - DNA, 20 bp, Homo sapiens
atgttctttcacccatccta

SEQ ID NO: 4861090 - DNA, 17 bp, Homo sapiens
atgttggagcagcaggc

SEQ ID NO: 4861091 - DNA, 18 bp, Homo sapiens
atgttggagcagcaggcc

SEQ ID NO: 4861092 - DNA, 21 bp, Homo sapiens
atgttggagcagcaggcctct

SEQ ID NO: 4861093 - DNA, 12 bp, Homo sapiens
atgttgggaaag

SEQ ID NO: 4861094 - DNA, 15 bp, Homo sapiens
atgttgggaaagtat

SEQ ID NO: 4861095 - DNA, 16 bp, Homo sapiens
atgttgtttataataa

SEQ ID NO: 4861096 - DNA, 18 bp, Homo sapiens
atgttgtttataataaaa

SEQ ID NO: 4861097 - DNA, 15 bp, Homo sapiens
atgtttaaagagaag

SEQ ID NO: 4861098 - DNA, 13 bp, Homo sapiens
atgtttattaaat

SEQ ID NO: 4861099 - DNA, 17 bp, Homo sapiens
atgtttattaaatgctt

SEQ ID NO: 4861100 - DNA, 16 bp, Homo sapiens
atgtttgcctcataat

SEQ ID NO: 4861101 - DNA, 19 bp, Homo sapiens
atgtttttcatccattcct

SEQ ID NO: 4861102 - DNA, 20 bp, Homo sapiens
atgtttttcatccattccta

SEQ ID NO: 4861103 - DNA, 17 bp, Homo sapiens
attaaaaaaaaattgta

SEQ ID NO: 4861104 - DNA, 12 bp, Homo sapiens
attaaaaaacaa

SEQ ID NO: 4861105 - DNA, 19 bp, Homo sapiens
attaaaaaacaattaactg

SEQ ID NO: 4861106 - DNA, 16 bp, Homo sapiens
attaaaaaagagacat

SEQ ID NO: 4861107 - DNA, 21 bp, Homo sapiens
attaaaaacgaaaacctgact

SEQ ID NO: 4861108 - DNA, 12 bp, Homo sapiens
attaaaatattt

SEQ ID NO: 4861109 - DNA, 21 bp, Homo sapiens
attaaacttccaaagaaagtt

SEQ ID NO: 4861110 - DNA, 22 bp, Homo sapiens
agccttcatcagaactcttcct

SEQ ID NO: 4861111 - DNA, 18 bp, Homo sapiens
agccttctaaattcccaa

SEQ ID NO: 4861112 - DNA, 19 bp, Homo sapiens
agccttctaaattcccaaa

SEQ ID NO: 4861113 - DNA, 18 bp, Homo sapiens
agccttgcagcggctcct

SEQ ID NO: 4861114 - DNA, 19 bp, Homo sapiens
agccttgcagcggctcctg

SEQ ID NO: 4861115 - DNA, 20 bp, Homo sapiens
agccttgcagcggctcctgc

SEQ ID NO: 4861116 - DNA, 18 bp, Homo sapiens
agccttgtacagtctgct

SEQ ID NO: 4861117 - DNA, 15 bp, Homo sapiens
agcctttttacctgg

SEQ ID NO: 4861118 - DNA, 19 bp, Homo sapiens
agcgaagtctttgccttct

SEQ ID NO: 4861119 - DNA, 21 bp, Homo sapiens
agcgcggacccttctgggtcc

SEQ ID NO: 4861120 - DNA, 18 bp, Homo sapiens
agcgggggcctaaaaaaa

SEQ ID NO: 4861121 - DNA, 15 bp, Homo sapiens
agcgttctaaatatg

SEQ ID NO: 4861122 - DNA, 21 bp, Homo sapiens
agcgttctaaatatgaatgaa

SEQ ID NO: 4861123 - DNA, 18 bp, Homo sapiens
agctacagtgcatagttg

SEQ ID NO: 4861124 - DNA, 18 bp, Homo sapiens
agctaggaaccctggagg

SEQ ID NO: 4861125 - DNA, 21 bp, Homo sapiens
agctagtgcctttagagggta

SEQ ID NO: 4861126 - DNA, 17 bp, Homo sapiens
agctcaaatgaaatgta

SEQ ID NO: 4861127 - DNA, 17 bp, Homo sapiens
agctcaagcattctgtt

SEQ ID NO: 4861128 - DNA, 19 bp, Homo sapiens
agctcaagcattctgttta

SEQ ID NO: 4861129 - DNA, 13 bp, Homo sapiens
agctcaatgcagt

SEQ ID NO: 4861130 - DNA, 19 bp, Homo sapiens
agctcctccccttcctctt

SEQ ID NO: 4861131 - DNA, 14 bp, Homo sapiens
agctctagcctctg

SEQ ID NO: 4861132 - DNA, 15 bp, Homo sapiens
agctctagcctctgg

SEQ ID NO: 4861133 - DNA, 18 bp, Homo sapiens
agctctagcctctggact

SEQ ID NO: 4861134 - DNA, 21 bp, Homo sapiens
agctctcaggaccgtgccctc

SEQ ID NO: 4861135 - DNA, 22 bp, Homo sapiens
agctctcccctcctgctgggcg

SEQ ID NO: 4861136 - DNA, 19 bp, Homo sapiens
agctctcctccagccctgg

SEQ ID NO: 4861137 - DNA, 21 bp, Homo sapiens
agctctcctccagccctgggc

SEQ ID NO: 4861138 - DNA, 23 bp, Homo sapiens
agctctcctccagccctgggcac

SEQ ID NO: 4861139 - DNA, 18 bp, Homo sapiens
agctctctgggacctcct

SEQ ID NO: 4861140 - DNA, 19 bp, Homo sapiens
agctcttcctatccctctc

SEQ ID NO: 4861141 - DNA, 21 bp, Homo sapiens
agctctttgggcctctcctgc

SEQ ID NO: 4861142 - DNA, 17 bp, Homo sapiens
agctgaaattcaccaag

SEQ ID NO: 4861143 - DNA, 19 bp, Homo sapiens
agctgaaattcaccaagaa

SEQ ID NO: 4861144 - DNA, 14 bp, Homo sapiens
agctgacagccaca

SEQ ID NO: 4861145 - DNA, 17 bp, Homo sapiens
agctgacagccacaccg

SEQ ID NO: 4861146 - DNA, 18 bp, Homo sapiens
agctgatttttgtctttt

SEQ ID NO: 4861147 - DNA, 16 bp, Homo sapiens
agctgcaaaaataatc

SEQ ID NO: 4861148 - DNA, 22 bp, Homo sapiens
agctgcagcctggttggcagca

SEQ ID NO: 4861149 - DNA, 22 bp, Homo sapiens
agctgccgtagcttcagccagg

SEQ ID NO: 4861150 - DNA, 15 bp, Homo sapiens
agctgctgttgaact

SEQ ID NO: 4861151 - DNA, 16 bp, Homo sapiens
agctgcttgacctagc

SEQ ID NO: 4861152 - DNA, 13 bp, Homo sapiens
agctggcacaaaa

SEQ ID NO: 4861153 - DNA, 15 bp, Homo sapiens
agctgggaaagcata

SEQ ID NO: 4861154 - DNA, 14 bp, Homo sapiens
agctggggagccct

SEQ ID NO: 4861155 - DNA, 15 bp, Homo sapiens
agctggtggcagagt

SEQ ID NO: 4861156 - DNA, 16 bp, Homo sapiens
agctgtgccttccctt

SEQ ID NO: 4861157 - DNA, 21 bp, Homo sapiens
agctgtgctccacactcagaa

SEQ ID NO: 4861158 - DNA, 22 bp, Homo sapiens
agctgtgctccacactcagaaa

SEQ ID NO: 4861159 - DNA, 11 bp, Homo sapiens
agctgtgttta

SEQ ID NO: 4861160 - DNA, 20 bp, Homo sapiens
agctgttccttggtcctagt

SEQ ID NO: 4861161 - DNA, 21 bp, Homo sapiens
agcttacaggagccagcctgc

SEQ ID NO: 4861162 - DNA, 15 bp, Homo sapiens
agcttcagccaggca

SEQ ID NO: 4861163 - DNA, 19 bp, Homo sapiens
agcttcagccaggcaagaa

SEQ ID NO: 4861164 - DNA, 21 bp, Homo sapiens
agcttcagccaggtctgactc

SEQ ID NO: 4861165 - DNA, 21 bp, Homo sapiens
agcttcagtaagttatctttg

SEQ ID NO: 4861166 - DNA, 22 bp, Homo sapiens
agcttcagtaagttatctttga

SEQ ID NO: 4861167 - DNA, 15 bp, Homo sapiens
agcttcagttgcttg

SEQ ID NO: 4861168 - DNA, 19 bp, Homo sapiens
agcttcagttgcttgtctt

SEQ ID NO: 4861169 - DNA, 20 bp, Homo sapiens
agcttcggagggcccctgcg

SEQ ID NO: 4861170 - DNA, 22 bp, Homo sapiens
agcttctgggagatttttttga

SEQ ID NO: 4861171 - DNA, 14 bp, Homo sapiens
agcttgctgggctt

SEQ ID NO: 4861172 - DNA, 15 bp, Homo sapiens
agcttgctgggcttt

SEQ ID NO: 4861173 - DNA, 20 bp, Homo sapiens
agcttgctgggctttgggaa

SEQ ID NO: 4861174 - DNA, 16 bp, Homo sapiens
agcttgtggtggggca

SEQ ID NO: 4861175 - DNA, 21 bp, Homo sapiens
agctttgcaaacccattaagg

SEQ ID NO: 4861176 - DNA, 23 bp, Homo sapiens
aggaaagagctaggaaccctgga

SEQ ID NO: 4861177 - DNA, 15 bp, Homo sapiens
aggaaccctggaggt

SEQ ID NO: 4861178 - DNA, 20 bp, Homo sapiens
aggaagccatagatgctggc

SEQ ID NO: 4861179 - DNA, 23 bp, Homo sapiens
aggaatcattcagaaatgttgag

SEQ ID NO: 4861180 - DNA, 22 bp, Homo sapiens
aggaatggctgcaagagcccag

SEQ ID NO: 4861181 - DNA, 21 bp, Homo sapiens
aggacatgcaataaaatttaa

SEQ ID NO: 4861182 - DNA, 22 bp, Homo sapiens
aggacatttgtgggcaagcaga

SEQ ID NO: 4861183 - DNA, 13 bp, Homo sapiens
aggaccaatgctt

SEQ ID NO: 4861184 - DNA, 14 bp, Homo sapiens
aggacccagagctg

SEQ ID NO: 4861185 - DNA, 17 bp, Homo sapiens
aggacccttttaagcat

SEQ ID NO: 4861186 - DNA, 13 bp, Homo sapiens
aggacggccggct

SEQ ID NO: 4861187 - DNA, 12 bp, Homo sapiens
aggactcccaga

SEQ ID NO: 4861188 - DNA, 17 bp, Homo sapiens
aggactcccagaacctc

SEQ ID NO: 4861189 - DNA, 15 bp, Homo sapiens
aggactctctccagg

SEQ ID NO: 4861190 - DNA, 19 bp, Homo sapiens
aggactggttctgaggcca

SEQ ID NO: 4861191 - DNA, 22 bp, Homo sapiens
aggactggttctgaggccagaa

SEQ ID NO: 4861192 - DNA, 15 bp, Homo sapiens
agttcattgcaatta

SEQ ID NO: 4861193 - DNA, 22 bp, Homo sapiens
agttcccttgaaactttgggaa

SEQ ID NO: 4861194 - DNA, 22 bp, Homo sapiens
agttccggggagaaacccagag

SEQ ID NO: 4861195 - DNA, 23 bp, Homo sapiens
agttccggggagaaacccagaga

SEQ ID NO: 4861196 - DNA, 14 bp, Homo sapiens
agttcctcctactt

SEQ ID NO: 4861197 - DNA, 18 bp, Homo sapiens
agttcctcctacttacaa

SEQ ID NO: 4861198 - DNA, 19 bp, Homo sapiens
agttctaacagtgaagttt

SEQ ID NO: 4861199 - DNA, 18 bp, Homo sapiens
agttctcaaatgtgtgtg

SEQ ID NO: 4861200 - DNA, 22 bp, Homo sapiens
agttctctcccttcctctctcc

SEQ ID NO: 4861201 - DNA, 18 bp, Homo sapiens
agttctggatgtctggct

SEQ ID NO: 4861202 - DNA, 15 bp, Homo sapiens
agttgatggagcccc

SEQ ID NO: 4861203 - DNA, 18 bp, Homo sapiens
agttgatggagccccagg

SEQ ID NO: 4861204 - DNA, 20 bp, Homo sapiens
agttgccatgggaaacaaat

SEQ ID NO: 4861205 - DNA, 19 bp, Homo sapiens
agttgcttgtcttctggta

SEQ ID NO: 4861206 - DNA, 16 bp, Homo sapiens
agttggactctcaggg

SEQ ID NO: 4861207 - DNA, 23 bp, Homo sapiens
agttgtagacaaagtacattctg

SEQ ID NO: 4861208 - DNA, 23 bp, Homo sapiens
agtttaagccgcagacctggagc

SEQ ID NO: 4861209 - DNA, 20 bp, Homo sapiens
agtttaccttgtatactgta

SEQ ID NO: 4861210 - DNA, 22 bp, Homo sapiens
agtttcaagttttaaagttcat

SEQ ID NO: 4861211 - DNA, 18 bp, Homo sapiens
agtttcactgtactgcat

SEQ ID NO: 4861212 - DNA, 20 bp, Homo sapiens
agtttcactgtactgcatgt

SEQ ID NO: 4861213 - DNA, 19 bp, Homo sapiens
agtttgacagtttttgaca

SEQ ID NO: 4861214 - DNA, 14 bp, Homo sapiens
agtttgctgtgctt

SEQ ID NO: 4861215 - DNA, 16 bp, Homo sapiens
agtttggttttgacag

SEQ ID NO: 4861216 - DNA, 13 bp, Homo sapiens
agttttaactgtg

SEQ ID NO: 4861217 - DNA, 14 bp, Homo sapiens
agttttatatgctt

SEQ ID NO: 4861218 - DNA, 17 bp, Homo sapiens
agttttatatgctttat

SEQ ID NO: 4861219 - DNA, 17 bp, Homo sapiens
agttttgaagattctat

SEQ ID NO: 4861220 - DNA, 18 bp, Homo sapiens
agttttgaagattctatg

SEQ ID NO: 4861221 - DNA, 16 bp, Homo sapiens
agtttttgacatttat

SEQ ID NO: 4861222 - DNA, 13 bp, Homo sapiens
ataaaaaatcatg

SEQ ID NO: 4861223 - DNA, 21 bp, Homo sapiens
ataaaaactcaggcaaagaaa

SEQ ID NO: 4861224 - DNA, 12 bp, Homo sapiens
ataaaaatatat

SEQ ID NO: 4861225 - DNA, 13 bp, Homo sapiens
ataaaagaaataa

SEQ ID NO: 4861226 - DNA, 23 bp, Homo sapiens
ataaaataatgggattttctttt

SEQ ID NO: 4861227 - DNA, 16 bp, Homo sapiens
ataaaatgatgttata

SEQ ID NO: 4861228 - DNA, 12 bp, Homo sapiens
ataaaatttaaa

SEQ ID NO: 4861229 - DNA, 13 bp, Homo sapiens
ataaacagaaatg

SEQ ID NO: 4861230 - DNA, 14 bp, Homo sapiens
ataaaccctccaag

SEQ ID NO: 4861231 - DNA, 18 bp, Homo sapiens
ataaagatcgcccccacc

SEQ ID NO: 4861232 - DNA, 12 bp, Homo sapiens
ataaagatgagt

SEQ ID NO: 4861233 - DNA, 16 bp, Homo sapiens
ataaagtaaatacatg

SEQ ID NO: 4861234 - DNA, 15 bp, Homo sapiens
ataaagtacttgact

SEQ ID NO: 4861235 - DNA, 17 bp, Homo sapiens
ataaagtgatctgtgtt

SEQ ID NO: 4861236 - DNA, 21 bp, Homo sapiens
ataaatctaataattattcat

SEQ ID NO: 4861237 - DNA, 22 bp, Homo sapiens
aacattttaagttttactgata

SEQ ID NO: 4861238 - DNA, 16 bp, Homo sapiens
aaccaaaggaaaatgt

SEQ ID NO: 4861239 - DNA, 20 bp, Homo sapiens
aaccaacaagaaccactcct

SEQ ID NO: 4861240 - DNA, 19 bp, Homo sapiens
aaccaaggctgtgtttaga

SEQ ID NO: 4861241 - DNA, 22 bp, Homo sapiens
aaccacattgaagaatgttaga

SEQ ID NO: 4861242 - DNA, 22 bp, Homo sapiens
aaccacgcaggaagcctactat

SEQ ID NO: 4861243 - DNA, 17 bp, Homo sapiens
aaccagagtctgtattt

SEQ ID NO: 4861244 - DNA, 12 bp, Homo sapiens
aaccatttttga

SEQ ID NO: 4861245 - DNA, 15 bp, Homo sapiens
aaccatttttgaacc

SEQ ID NO: 4861246 - DNA, 14 bp, Homo sapiens
aacccaaggtgagg

SEQ ID NO: 4861247 - DNA, 16 bp, Homo sapiens
aacccaaggtgaggtg

SEQ ID NO: 4861248 - DNA, 14 bp, Homo sapiens
aacccagtctttct

SEQ ID NO: 4861249 - DNA, 15 bp, Homo sapiens
aacccagtctttctt

SEQ ID NO: 4861250 - DNA, 21 bp, Homo sapiens
aaccctccaaaggaactctag

SEQ ID NO: 4861251 - DNA, 17 bp, Homo sapiens
aacctacattccaccct

SEQ ID NO: 4861252 - DNA, 21 bp, Homo sapiens
aacctacattccaccctgtta

SEQ ID NO: 4861253 - DNA, 20 bp, Homo sapiens
aacctagttaaagaaaggaa

SEQ ID NO: 4861254 - DNA, 18 bp, Homo sapiens
aacctccagactcagcag

SEQ ID NO: 4861255 - DNA, 19 bp, Homo sapiens
aacctctttgcgtttcctt

SEQ ID NO: 4861256 - DNA, 17 bp, Homo sapiens
aaccttaaaaggtactg

SEQ ID NO: 4861257 - DNA, 17 bp, Homo sapiens
aaccttgaaaaaaaaca

SEQ ID NO: 4861258 - DNA, 20 bp, Homo sapiens
aaccttgaaaaaaaacagtg

SEQ ID NO: 4861259 - DNA, 19 bp, Homo sapiens
aacgtattggacctgccca

SEQ ID NO: 4861260 - DNA, 21 bp, Homo sapiens
aactaaatgtgcaatagaagg

SEQ ID NO: 4861261 - DNA, 22 bp, Homo sapiens
aactattgtgctcagagacact

SEQ ID NO: 4861262 - DNA, 24 bp, Homo sapiens
aactattgtgctcagagacactgt

SEQ ID NO: 4861263 - DNA, 18 bp, Homo sapiens
aactcaggcaaagaaaat

SEQ ID NO: 4861264 - DNA, 19 bp, Homo sapiens
aactccaggcatgtgtctg

SEQ ID NO: 4861265 - DNA, 13 bp, Homo sapiens
aactccaggctgg

SEQ ID NO: 4861266 - DNA, 19 bp, Homo sapiens
aactcctgtcttctttctc

SEQ ID NO: 4861267 - DNA, 21 bp, Homo sapiens
aactctaaccaaggctgtgtt

SEQ ID NO: 4861268 - DNA, 18 bp, Homo sapiens
aactctgttcccccaccc

SEQ ID NO: 4861269 - DNA, 22 bp, Homo sapiens
aactgacctgaccccattcctg

SEQ ID NO: 4861270 - DNA, 17 bp, Homo sapiens
aactgaggcccagagag

SEQ ID NO: 4861271 - DNA, 21 bp, Homo sapiens
aactgatccagtataagacta

SEQ ID NO: 4861272 - DNA, 17 bp, Homo sapiens
aactgccgtaatttaac

SEQ ID NO: 4861273 - DNA, 22 bp, Homo sapiens
aactgcttcccttactttgctg

SEQ ID NO: 4861274 - DNA, 21 bp, Homo sapiens
aactgtgaatacttgaactct

SEQ ID NO: 4861275 - DNA, 14 bp, Homo sapiens
aactgtggatattg

SEQ ID NO: 4861276 - DNA, 18 bp, Homo sapiens
aactgttgcacttttgaa

SEQ ID NO: 4861277 - DNA, 19 bp, Homo sapiens
aactgttgcacttttgaat

SEQ ID NO: 4861278 - DNA, 22 bp, Homo sapiens
aactgttgcacttttgaatgtc

SEQ ID NO: 4861279 - DNA, 13 bp, Homo sapiens
aacttccaaagaa

SEQ ID NO: 4861280 - DNA, 15 bp, Homo sapiens
aacttccaaagaaag

SEQ ID NO: 4861281 - DNA, 13 bp, Homo sapiens
aacttcctgtgga

SEQ ID NO: 4861282 - DNA, 21 bp, Homo sapiens
aacttgatagggtctaccaat

SEQ ID NO: 4861283 - DNA, 16 bp, Homo sapiens
aacttggggaaggggc

SEQ ID NO: 4861284 - DNA, 19 bp, Homo sapiens
aacttgtgtccctaatgtg

SEQ ID NO: 4861285 - DNA, 21 bp, Homo sapiens
aactttaagaactaaaatgtt

SEQ ID NO: 4861286 - DNA, 14 bp, Homo sapiens
aactttccagtctt

SEQ ID NO: 4861287 - DNA, 16 bp, Homo sapiens
aactttggaacagggt

SEQ ID NO: 4861288 - DNA, 12 bp, Homo sapiens
aactttgggaaa

SEQ ID NO: 4861289 - DNA, 16 bp, Homo sapiens
aactttgggaaaacat

SEQ ID NO: 4861290 - DNA, 14 bp, Homo sapiens
aactttgtaaaaat

SEQ ID NO: 4861291 - DNA, 16 bp, Homo sapiens
aagaaaatgaaatgca

SEQ ID NO: 4861292 - DNA, 16 bp, Homo sapiens
aagaaaggaaaagaaa

SEQ ID NO: 4861293 - DNA, 16 bp, Homo sapiens
aagaaagttctacagt

SEQ ID NO: 4861294 - DNA, 12 bp, Homo sapiens
aagaaatagaat

SEQ ID NO: 4861295 - DNA, 15 bp, Homo sapiens
aagaagagctatcag

SEQ ID NO: 4861296 - DNA, 14 bp, Homo sapiens
aagaaggaaagatg

SEQ ID NO: 4861297 - DNA, 18 bp, Homo sapiens
aagaaggaaagatggtta

SEQ ID NO: 4861298 - DNA, 13 bp, Homo sapiens
aagaaggcaaggc

SEQ ID NO: 4861299 - DNA, 12 bp, Homo sapiens
aagaaggccaga

SEQ ID NO: 4861300 - DNA, 14 bp, Homo sapiens
aagaaggccagaga

SEQ ID NO: 4861301 - DNA, 15 bp, Homo sapiens
aagaatgttagagta

SEQ ID NO: 4861302 - DNA, 19 bp, Homo sapiens
aagaattgaaaagtttttg

SEQ ID NO: 4861303 - DNA, 13 bp, Homo sapiens
aagacaaatattc

SEQ ID NO: 4861304 - DNA, 22 bp, Homo sapiens
aagacagctggcggaggctgct

SEQ ID NO: 4861305 - DNA, 13 bp, Homo sapiens
aagaccctgaatc

SEQ ID NO: 4861306 - DNA, 12 bp, Homo sapiens
aagacctgaaag

SEQ ID NO: 4861307 - DNA, 20 bp, Homo sapiens
aagacctgaaagagaggact

SEQ ID NO: 4861308 - DNA, 21 bp, Homo sapiens
aagacctgaaagagaggactg

SEQ ID NO: 4861309 - DNA, 19 bp, Homo sapiens
aagactgagccagattggc

SEQ ID NO: 4861310 - DNA, 21 bp, Homo sapiens
aagactgagccagattggcca

SEQ ID NO: 4861311 - DNA, 18 bp, Homo sapiens
aagactggcccagtgcca

SEQ ID NO: 4861312 - DNA, 17 bp, Homo sapiens
aagactgtagatatgta

SEQ ID NO: 4861313 - DNA, 22 bp, Homo sapiens
aagacttaaagggcccaatgaa

SEQ ID NO: 4861314 - DNA, 24 bp, Homo sapiens
aagacttaaagggcccaatgaatt

SEQ ID NO: 4861315 - DNA, 19 bp, Homo sapiens
aagactttgatccatgtat

SEQ ID NO: 4861316 - DNA, 15 bp, Homo sapiens
aagagaaaagagaga

SEQ ID NO: 4861317 - DNA, 11 bp, Homo sapiens
aagagaaagag

SEQ ID NO: 4861318 - DNA, 15 bp, Homo sapiens
aagagaatgttccta

SEQ ID NO: 4861319 - DNA, 18 bp, Homo sapiens
aagagcagtggtaagaat

SEQ ID NO: 4861320 - DNA, 18 bp, Homo sapiens
aagagcgagagatcaaag

SEQ ID NO: 4861321 - DNA, 15 bp, Homo sapiens
aagagtggaaatggg

SEQ ID NO: 4861322 - DNA, 20 bp, Homo sapiens
aagagttcccttgaaacttt

SEQ ID NO: 4861323 - DNA, 14 bp, Homo sapiens
aagataaaatgatg

SEQ ID NO: 4861324 - DNA, 15 bp, Homo sapiens
aagataaaatgatgt

SEQ ID NO: 4861325 - DNA, 20 bp, Homo sapiens
aagatactaaggacgttgtt

SEQ ID NO: 4861326 - DNA, 16 bp, Homo sapiens
aagatagtcttggaag

SEQ ID NO: 4861327 - DNA, 16 bp, Homo sapiens
aagatcgcccccacct

SEQ ID NO: 4861328 - DNA, 22 bp, Homo sapiens
aagatctttatatttcaataaa

SEQ ID NO: 4861329 - DNA, 14 bp, Homo sapiens
aagatgacctgccc

SEQ ID NO: 4861330 - DNA, 17 bp, Homo sapiens
aagatgacctgccccaa

SEQ ID NO: 4861331 - DNA, 19 bp, Homo sapiens
aagatgagccttgcagata

SEQ ID NO: 4861332 - DNA, 12 bp, Homo sapiens
aagatgagttgg

SEQ ID NO: 4861333 - DNA, 21 bp, Homo sapiens
aagatgcatcatctcttcctc

SEQ ID NO: 4861334 - DNA, 15 bp, Homo sapiens
aagatgtgttcttat

SEQ ID NO: 4861335 - DNA, 19 bp, Homo sapiens
aagattctatgttaatatt

SEQ ID NO: 4861336 - DNA, 22 bp, Homo sapiens
aagcaaaggtgcactccagact

SEQ ID NO: 4861337 - DNA, 17 bp, Homo sapiens
aagcaaatgttaaaagt

SEQ ID NO: 4861338 - DNA, 19 bp, Homo sapiens
aagcaaatgttaaaagttt

SEQ ID NO: 4861339 - DNA, 18 bp, Homo sapiens
aagcaaccacactgcttg

SEQ ID NO: 4861340 - DNA, 15 bp, Homo sapiens
aagcacaagactggc

SEQ ID NO: 4861341 - DNA, 17 bp, Homo sapiens
aagcaccaacctccaga

SEQ ID NO: 4861342 - DNA, 17 bp, Homo sapiens
aagcactagccttccca

SEQ ID NO: 4861343 - DNA, 14 bp, Homo sapiens
aagcactggccttg

SEQ ID NO: 4861344 - DNA, 13 bp, Homo sapiens
aagcagaaccttc

SEQ ID NO: 4861345 - DNA, 21 bp, Homo sapiens
aagcatagataatattgtttg

SEQ ID NO: 4861346 - DNA, 15 bp, Homo sapiens
aagcattctgtttat

SEQ ID NO: 4861347 - DNA, 12 bp, Homo sapiens
aagcatttccta

SEQ ID NO: 4861348 - DNA, 13 bp, Homo sapiens
aagccccctgccc

SEQ ID NO: 4861349 - DNA, 21 bp, Homo sapiens
aataggctattaaaaaagtct

SEQ ID NO: 4861350 - DNA, 13 bp, Homo sapiens
aatagtagatgtg

SEQ ID NO: 4861351 - DNA, 20 bp, Homo sapiens
aatagtgcaacatctctgaa

SEQ ID NO: 4861352 - DNA, 21 bp, Homo sapiens
aatagtgcaacatctctgaat

SEQ ID NO: 4861353 - DNA, 15 bp, Homo sapiens
aatagtgtgaaatat

SEQ ID NO: 4861354 - DNA, 16 bp, Homo sapiens
aatagtgtgaaatata

SEQ ID NO: 4861355 - DNA, 17 bp, Homo sapiens
aatagtgtgaaatatat

SEQ ID NO: 4861356 - DNA, 12 bp, Homo sapiens
aatagttgaatt

SEQ ID NO: 4861357 - DNA, 15 bp, Homo sapiens
aatagttgaattagt

SEQ ID NO: 4861358 - DNA, 14 bp, Homo sapiens
aatataacacattt

SEQ ID NO: 4861359 - DNA, 15 bp, Homo sapiens
aatataacacatttt

SEQ ID NO: 4861360 - DNA, 16 bp, Homo sapiens
aatatatatatatata

SEQ ID NO: 4861361 - DNA, 21 bp, Homo sapiens
aatatatcttataaagtggaa

SEQ ID NO: 4861362 - DNA, 20 bp, Homo sapiens
aatatatgccttgtataata

SEQ ID NO: 4861363 - DNA, 21 bp, Homo sapiens
aatatatgccttgtataatat

SEQ ID NO: 4861364 - DNA, 11 bp, Homo sapiens
aatatatgtat

SEQ ID NO: 4861365 - DNA, 19 bp, Homo sapiens
aatatattttgtttacaaa

SEQ ID NO: 4861366 - DNA, 21 bp, Homo sapiens
aatatcaaagtcattaaagac

SEQ ID NO: 4861367 - DNA, 16 bp, Homo sapiens
aatatccctacatgta

SEQ ID NO: 4861368 - DNA, 21 bp, Homo sapiens
aatatcccttggacattttat

SEQ ID NO: 4861369 - DNA, 17 bp, Homo sapiens
aatatgcttataaccta

SEQ ID NO: 4861370 - DNA, 16 bp, Homo sapiens
aatatgtagtatctat

SEQ ID NO: 4861371 - DNA, 21 bp, Homo sapiens
aatattaaaaaacttcatgta

SEQ ID NO: 4861372 - DNA, 18 bp, Homo sapiens
aatattccagatctttca

SEQ ID NO: 4861373 - DNA, 23 bp, Homo sapiens
aatattccagatctttcagaaat

SEQ ID NO: 4861374 - DNA, 14 bp, Homo sapiens
aatattgaaaattg

SEQ ID NO: 4861375 - DNA, 21 bp, Homo sapiens
aatattgtttggtaaatgttt

SEQ ID NO: 4861376 - DNA, 23 bp, Homo sapiens
aatattgtttggtaaatgtttct

SEQ ID NO: 4861377 - DNA, 20 bp, Homo sapiens
aatcaaccacctatttttga

SEQ ID NO: 4861378 - DNA, 21 bp, Homo sapiens
aatcagtaatatttatatatt

SEQ ID NO: 4861379 - DNA, 14 bp, Homo sapiens
aatcataaagtcag

SEQ ID NO: 4861380 - DNA, 13 bp, Homo sapiens
aatcattcagaaa

SEQ ID NO: 4861381 - DNA, 19 bp, Homo sapiens
aatcattcagaaatgttga

SEQ ID NO: 4861382 - DNA, 19 bp, Homo sapiens
aatccagttataagaagaa

SEQ ID NO: 4861383 - DNA, 17 bp, Homo sapiens
aatccatttcaggactc

SEQ ID NO: 4861384 - DNA, 18 bp, Homo sapiens
aatccatttcaggactct

SEQ ID NO: 4861385 - DNA, 15 bp, Homo sapiens
aatccgtacttgggt

SEQ ID NO: 4861386 - DNA, 21 bp, Homo sapiens
aatcctagactgctcctgggc

SEQ ID NO: 4861387 - DNA, 20 bp, Homo sapiens
aatccttactaagtaggtga

SEQ ID NO: 4861388 - DNA, 12 bp, Homo sapiens
aatctcaaaatt

SEQ ID NO: 4861389 - DNA, 13 bp, Homo sapiens
aatctcaaaatta

SEQ ID NO: 4861390 - DNA, 17 bp, Homo sapiens
aatctctttttgtttgc

SEQ ID NO: 4861391 - DNA, 19 bp, Homo sapiens
aatctgctaccaaaacagt

SEQ ID NO: 4861392 - DNA, 21 bp, Homo sapiens
aatctggatgcctcattatgt

SEQ ID NO: 4861393 - DNA, 19 bp, Homo sapiens
aatctgtttttacgtatgt

SEQ ID NO: 4861394 - DNA, 21 bp, Homo sapiens
aatctttagagaagtatacat

SEQ ID NO: 4861395 - DNA, 22 bp, Homo sapiens
aatctttagagaagtatacata

SEQ ID NO: 4861396 - DNA, 18 bp, Homo sapiens
aatctttcctactttcta

SEQ ID NO: 4861397 - DNA, 13 bp, Homo sapiens
aatgaaacatggg

SEQ ID NO: 4861398 - DNA, 13 bp, Homo sapiens
aatgaaagaaaat

SEQ ID NO: 4861399 - DNA, 19 bp, Homo sapiens
aatgaaagaaaattgagtt

SEQ ID NO: 4861400 - DNA, 16 bp, Homo sapiens
aatgaaagctgttcct

SEQ ID NO: 4861401 - DNA, 14 bp, Homo sapiens
aatgaaatgtatgc

SEQ ID NO: 4861402 - DNA, 11 bp, Homo sapiens
aatgaactttg

SEQ ID NO: 4861403 - DNA, 15 bp, Homo sapiens
aatgaataatggaaa

SEQ ID NO: 4861404 - DNA, 12 bp, Homo sapiens
aatgacaatatt

SEQ ID NO: 4861405 - DNA, 16 bp, Homo sapiens
aatgactcaaagtctg

SEQ ID NO: 4861406 - DNA, 19 bp, Homo sapiens
aatgaggaaaattcttaaa

SEQ ID NO: 4861407 - DNA, 12 bp, Homo sapiens
aatgaggatcca

SEQ ID NO: 4861408 - DNA, 21 bp, Homo sapiens
aatgatatataatttaaagtt

SEQ ID NO: 4861409 - DNA, 19 bp, Homo sapiens
aatgatcagcaaaaagact

SEQ ID NO: 4861410 - DNA, 17 bp, Homo sapiens
aatgcatatttgcaaag

SEQ ID NO: 4861411 - DNA, 18 bp, Homo sapiens
aatgcatatttgcaaagt

SEQ ID NO: 4861412 - DNA, 19 bp, Homo sapiens
aatgcctgctttttggaaa

SEQ ID NO: 4861413 - DNA, 20 bp, Homo sapiens
aatgcctgctttttggaaag

SEQ ID NO: 4861414 - DNA, 14 bp, Homo sapiens
aatgctaaatgtgt

SEQ ID NO: 4861415 - DNA, 15 bp, Homo sapiens
aatgctaaatgtgta

SEQ ID NO: 4861416 - DNA, 11 bp, Homo sapiens
aatgctgcctc

SEQ ID NO: 4861417 - DNA, 17 bp, Homo sapiens
aatgctgcctcaggacc

SEQ ID NO: 4861418 - DNA, 16 bp, Homo sapiens
aatgcttttagtgtgt

SEQ ID NO: 4861419 - DNA, 13 bp, Homo sapiens
aatggcagctagt

SEQ ID NO: 4861420 - DNA, 16 bp, Homo sapiens
aatggcagctagtgcc

SEQ ID NO: 4861421 - DNA, 22 bp, Homo sapiens
aatggcatggcaggagtctctg

SEQ ID NO: 4861422 - DNA, 13 bp, Homo sapiens
aatggcctggagc

SEQ ID NO: 4861423 - DNA, 21 bp, Homo sapiens
aatggcctgtccctagggctc

SEQ ID NO: 4861424 - DNA, 17 bp, Homo sapiens
aatgggatattttgaaa

SEQ ID NO: 4861425 - DNA, 19 bp, Homo sapiens
aatgggatattttgaaatg

SEQ ID NO: 4861426 - DNA, 14 bp, Homo sapiens
aatggtagttttac

SEQ ID NO: 4861427 - DNA, 18 bp, Homo sapiens
aatggtgtggtgaatgtg

SEQ ID NO: 4861428 - DNA, 16 bp, Homo sapiens
aatgtaatttaaatga

SEQ ID NO: 4861429 - DNA, 17 bp, Homo sapiens
aatgtactgatttcagt

SEQ ID NO: 4861430 - DNA, 16 bp, Homo sapiens
aatgtattatgagcca

SEQ ID NO: 4861431 - DNA, 12 bp, Homo sapiens
aatgtcagaaca

SEQ ID NO: 4861432 - DNA, 20 bp, Homo sapiens
aatgtcagttgttatttatt

SEQ ID NO: 4861433 - DNA, 22 bp, Homo sapiens
aatgtcagttgttatttattga

SEQ ID NO: 4861434 - DNA, 16 bp, Homo sapiens
aatgtctgtaataata

SEQ ID NO: 4861435 - DNA, 23 bp, Homo sapiens
aatgtctgtaataatagactgta

SEQ ID NO: 4861436 - DNA, 17 bp, Homo sapiens
aatgtgcaatagaaggt

SEQ ID NO: 4861437 - DNA, 21 bp, Homo sapiens
aatgtgctggtgaacactgtg

SEQ ID NO: 4861438 - DNA, 23 bp, Homo sapiens
aatgtggtctgccaatctgtaca

SEQ ID NO: 4861439 - DNA, 12 bp, Homo sapiens
aatgtgtgagaa

SEQ ID NO: 4861440 - DNA, 15 bp, Homo sapiens
aatgtgtgagaaaaa

SEQ ID NO: 4861441 - DNA, 23 bp, Homo sapiens
aatgtgtggattgcctctgaaaa

SEQ ID NO: 4861442 - DNA, 14 bp, Homo sapiens
aatgtgtttccttt

SEQ ID NO: 4861443 - DNA, 23 bp, Homo sapiens
aatgtgtttccttttcaggagat

SEQ ID NO: 4861444 - DNA, 18 bp, Homo sapiens
aatgttaaagggatattt

SEQ ID NO: 4861445 - DNA, 17 bp, Homo sapiens
aatgtttcttttgtttg

SEQ ID NO: 4861446 - DNA, 21 bp, Homo sapiens
aatgtttcttttgtttggtaa

SEQ ID NO: 4861447 - DNA, 16 bp, Homo sapiens
aatgttttcaaaaggt

SEQ ID NO: 4861448 - DNA, 21 bp, Homo sapiens
aatgtttttcatccattccta

SEQ ID NO: 4861449 - DNA, 17 bp, Homo sapiens
aattaaaaaaaaattgt

SEQ ID NO: 4861450 - DNA, 18 bp, Homo sapiens
aattaaaaaaaaattgta

SEQ ID NO: 4861451 - DNA, 16 bp, Homo sapiens
aattaaacttccaaag

SEQ ID NO: 4861452 - DNA, 21 bp, Homo sapiens
aattaaacttccaaagaaagt

SEQ ID NO: 4861453 - DNA, 13 bp, Homo sapiens
aattaagcaaatg

SEQ ID NO: 4861454 - DNA, 15 bp, Homo sapiens
aattaagcaaatgtt

SEQ ID NO: 4861455 - DNA, 18 bp, Homo sapiens
aattaagcaaatgttaaa

SEQ ID NO: 4861456 - DNA, 23 bp, Homo sapiens
aattaagcaaatgttaaaagttt

SEQ ID NO: 4861457 - DNA, 19 bp, Homo sapiens
aattaatatccctacatgt

SEQ ID NO: 4861458 - DNA, 21 bp, Homo sapiens
aattaccatgcttcacaatgt

SEQ ID NO: 4861459 - DNA, 22 bp, Homo sapiens
aattactttggggctaatttaa

SEQ ID NO: 4861460 - DNA, 14 bp, Homo sapiens
aattactttggtag

SEQ ID NO: 4861461 - DNA, 17 bp, Homo sapiens
aattagacttgaaatac

SEQ ID NO: 4861462 - DNA, 20 bp, Homo sapiens
aattataactgtaaagatgt

SEQ ID NO: 4861463 - DNA, 17 bp, Homo sapiens
aattatatattgcaagg

SEQ ID NO: 4861464 - DNA, 16 bp, Homo sapiens
aattatcagcaaagaa

SEQ ID NO: 4861465 - DNA, 19 bp, Homo sapiens
aattatcagcaaagaaaaa

SEQ ID NO: 4861466 - DNA, 21 bp, Homo sapiens
aattatgcaattcagtgttcc

SEQ ID NO: 4861467 - DNA, 16 bp, Homo sapiens
aattatgtaaataact

SEQ ID NO: 4861468 - DNA, 18 bp, Homo sapiens
aattatgttggtgtgaat

SEQ ID NO: 4861469 - DNA, 19 bp, Homo sapiens
ggggagagagcagagaagt

SEQ ID NO: 4861470 - DNA, 12 bp, Homo sapiens
ggggagccagct

SEQ ID NO: 4861471 - DNA, 16 bp, Homo sapiens
ggggagccagctgctt

SEQ ID NO: 4861472 - DNA, 14 bp, Homo sapiens
ggggaggcagcaga

SEQ ID NO: 4861473 - DNA, 20 bp, Homo sapiens
ggggcaggcctcccaagctg

SEQ ID NO: 4861474 - DNA, 11 bp, Homo sapiens
ggggcagggtg

SEQ ID NO: 4861475 - DNA, 17 bp, Homo sapiens
ggggccaacctcaggct

SEQ ID NO: 4861476 - DNA, 19 bp, Homo sapiens
ggggcctccagaagctgct

SEQ ID NO: 4861477 - DNA, 18 bp, Homo sapiens
ggggctgagccctcctga

SEQ ID NO: 4861478 - DNA, 23 bp, Homo sapiens
ggggctgctgctcctctcttggg

SEQ ID NO: 4861479 - DNA, 15 bp, Homo sapiens
gggggccgggggagg

SEQ ID NO: 4861480 - DNA, 23 bp, Homo sapiens
gggggtaaagcagttcctgtccc

SEQ ID NO: 4861481 - DNA, 16 bp, Homo sapiens
gggtcacatccatccc

SEQ ID NO: 4861482 - DNA, 19 bp, Homo sapiens
gggtcactgggatgcctct

SEQ ID NO: 4861483 - DNA, 15 bp, Homo sapiens
gggtcagcatccagt

SEQ ID NO: 4861484 - DNA, 14 bp, Homo sapiens
gggtccagggaggg

SEQ ID NO: 4861485 - DNA, 13 bp, Homo sapiens
gggtcccctctgt

SEQ ID NO: 4861486 - DNA, 23 bp, Homo sapiens
gggtctaccaatacaaaatgtat

SEQ ID NO: 4861487 - DNA, 12 bp, Homo sapiens
gggtctctcagg

SEQ ID NO: 4861488 - DNA, 15 bp, Homo sapiens
gggtgacaaggcctg

SEQ ID NO: 4861489 - DNA, 12 bp, Homo sapiens
gggtggggtgga

SEQ ID NO: 4861490 - DNA, 17 bp, Homo sapiens
gggtgtgaacatgttct

SEQ ID NO: 4861491 - DNA, 23 bp, Homo sapiens
gggttggacgggatgacctccag

SEQ ID NO: 4861492 - DNA, 17 bp, Homo sapiens
ggtaataaatgtgactc

SEQ ID NO: 4861493 - DNA, 15 bp, Homo sapiens
ggtagcactctcaga

SEQ ID NO: 4861494 - DNA, 13 bp, Homo sapiens
ggtagctggggag

SEQ ID NO: 4861495 - DNA, 12 bp, Homo sapiens
ggtaggaccctc

SEQ ID NO: 4861496 - DNA, 20 bp, Homo sapiens
ggtaggaccctcgagagcct

SEQ ID NO: 4861497 - DNA, 14 bp, Homo sapiens
ggtatgcagagctt

SEQ ID NO: 4861498 - DNA, 19 bp, Homo sapiens
ggtcactgggatgcctctt

SEQ ID NO: 4861499 - DNA, 17 bp, Homo sapiens
ggtcatgtgagtctggg

SEQ ID NO: 4861500 - DNA, 20 bp, Homo sapiens
ggtcatgtgagtctgggata

SEQ ID NO: 4861501 - DNA, 24 bp, Homo sapiens
ggtcccggttcagacccctgcctg

SEQ ID NO: 4861502 - DNA, 20 bp, Homo sapiens
ggtcccgtctggctccagcc

SEQ ID NO: 4861503 - DNA, 16 bp, Homo sapiens
ggtcctatttttgtga

SEQ ID NO: 4861504 - DNA, 21 bp, Homo sapiens
ggtcctctcagttctctccct

SEQ ID NO: 4861505 - DNA, 16 bp, Homo sapiens
ggtctatgttccccag

SEQ ID NO: 4861506 - DNA, 21 bp, Homo sapiens
ggtctcctcagggtggggggt

SEQ ID NO: 4861507 - DNA, 20 bp, Homo sapiens
ggtctgagtcatggccgggt

SEQ ID NO: 4861508 - DNA, 15 bp, Homo sapiens
ggtctggttcctgtg

SEQ ID NO: 4861509 - DNA, 16 bp, Homo sapiens
ggtgaaggctctcacc

SEQ ID NO: 4861510 - DNA, 12 bp, Homo sapiens
ggtgaaggggct

SEQ ID NO: 4861511 - DNA, 13 bp, Homo sapiens
ggtgaaggggctg

SEQ ID NO: 4861512 - DNA, 14 bp, Homo sapiens
ggtgacaaggcctg

SEQ ID NO: 4861513 - DNA, 19 bp, Homo sapiens
ggtgagaagtacagggcag

SEQ ID NO: 4861514 - DNA, 14 bp, Homo sapiens
ggtgaggataggac

SEQ ID NO: 4861515 - DNA, 15 bp, Homo sapiens
ggtgataagggaaaa

SEQ ID NO: 4861516 - DNA, 13 bp, Homo sapiens
ggtgcactccaga

SEQ ID NO: 4861517 - DNA, 15 bp, Homo sapiens
ggtgcactccagact

SEQ ID NO: 4861518 - DNA, 16 bp, Homo sapiens
ggtgcactccagactc

SEQ ID NO: 4861519 - DNA, 16 bp, Homo sapiens
ggtgccctttcctggc

SEQ ID NO: 4861520 - DNA, 19 bp, Homo sapiens
ggtgccctttcctggcagt

SEQ ID NO: 4861521 - DNA, 17 bp, Homo sapiens
ggtgcctaacctgggac

SEQ ID NO: 4861522 - DNA, 14 bp, Homo sapiens
ggtgctagatccag

SEQ ID NO: 4861523 - DNA, 18 bp, Homo sapiens
ggtgctagatccagccca

SEQ ID NO: 4861524 - DNA, 23 bp, Homo sapiens
ggtgctagtgggccctctctctg

SEQ ID NO: 4861525 - DNA, 24 bp, Homo sapiens
ggtgctagtgggccctctctctgg

SEQ ID NO: 4861526 - DNA, 17 bp, Homo sapiens
ggtgctggggctgcatg

SEQ ID NO: 4861527 - DNA, 17 bp, Homo sapiens
ggtgcttttggcagaga

SEQ ID NO: 4861528 - DNA, 16 bp, Homo sapiens
ggtggacatctgaccc

SEQ ID NO: 4861529 - DNA, 20 bp, Homo sapiens
ggtggatactggggggcagg

SEQ ID NO: 4861530 - DNA, 14 bp, Homo sapiens
ggtggccagcccgc

SEQ ID NO: 4861531 - DNA, 14 bp, Homo sapiens
ggtggcctctgcct

SEQ ID NO: 4861532 - DNA, 12 bp, Homo sapiens
ggtggccttgag

SEQ ID NO: 4861533 - DNA, 21 bp, Homo sapiens
ggtggccttgagtctctgaat

SEQ ID NO: 4861534 - DNA, 21 bp, Homo sapiens
ggtgggctttgttgtgagaat

SEQ ID NO: 4861535 - DNA, 22 bp, Homo sapiens
ggtgggtctatgttccccagga

SEQ ID NO: 4861536 - DNA, 14 bp, Homo sapiens
ggtgtaatctcaat

SEQ ID NO: 4861537 - DNA, 17 bp, Homo sapiens
ggtgtaatctcaatgca

SEQ ID NO: 4861538 - DNA, 21 bp, Homo sapiens
ggtgtgagaatgatcaaggat

SEQ ID NO: 4861539 - DNA, 15 bp, Homo sapiens
ggtgtgaggagagag

SEQ ID NO: 4861540 - DNA, 13 bp, Homo sapiens
ggtgtgatggtct

SEQ ID NO: 4861541 - DNA, 13 bp, Homo sapiens
ggtgttgcagccg

SEQ ID NO: 4861542 - DNA, 21 bp, Homo sapiens
ggtgttgcagccgcagagaaa

SEQ ID NO: 4861543 - DNA, 12 bp, Homo sapiens
ggtgtttattgc

SEQ ID NO: 4861544 - DNA, 13 bp, Homo sapiens
ggtgtttattgca

SEQ ID NO: 4861545 - DNA, 15 bp, Homo sapiens
ggttaatttttcctg

SEQ ID NO: 4861546 - DNA, 17 bp, Homo sapiens
ggttaatttttcctgca

SEQ ID NO: 4861547 - DNA, 21 bp, Homo sapiens
ggttaatttttcctgcatgtt

SEQ ID NO: 4861548 - DNA, 13 bp, Homo sapiens
ggttacctggaga

SEQ ID NO: 4861549 - DNA, 19 bp, Homo sapiens
ggttatttattttttaaga

SEQ ID NO: 4861550 - DNA, 21 bp, Homo sapiens
ggttcactccccgcctcccca

SEQ ID NO: 4861551 - DNA, 16 bp, Homo sapiens
ggttctaagtgggaga

SEQ ID NO: 4861552 - DNA, 18 bp, Homo sapiens
ggttctgaggccagaaag

SEQ ID NO: 4861553 - DNA, 20 bp, Homo sapiens
ggttctgaggccagaaaggt

SEQ ID NO: 4861554 - DNA, 20 bp, Homo sapiens
ggttggagtgctcttcccac

SEQ ID NO: 4861555 - DNA, 18 bp, Homo sapiens
ggtttactcactgctgca

SEQ ID NO: 4861556 - DNA, 13 bp, Homo sapiens
ggtttcaggaagt

SEQ ID NO: 4861557 - DNA, 16 bp, Homo sapiens
ggtttggaatattaaa

SEQ ID NO: 4861558 - DNA, 18 bp, Homo sapiens
ggtttgggagccaggact

SEQ ID NO: 4861559 - DNA, 21 bp, Homo sapiens
gtaaacaaagactttgatcca

SEQ ID NO: 4861560 - DNA, 11 bp, Homo sapiens
gtgactccagg

SEQ ID NO: 4861561 - DNA, 19 bp, Homo sapiens
gtgactccttatctctttc

SEQ ID NO: 4861562 - DNA, 21 bp, Homo sapiens
gtgactccttatctctttcca

SEQ ID NO: 4861563 - DNA, 15 bp, Homo sapiens
gtgactgaagaagat

SEQ ID NO: 4861564 - DNA, 19 bp, Homo sapiens
gtgagaagtacagggcaga

SEQ ID NO: 4861565 - DNA, 20 bp, Homo sapiens
gtgagaagtacagggcagaa

SEQ ID NO: 4861566 - DNA, 21 bp, Homo sapiens
gtgagaagtacagggcagaac

SEQ ID NO: 4861567 - DNA, 23 bp, Homo sapiens
gtgagaatgatcaaggatctgga

SEQ ID NO: 4861568 - DNA, 18 bp, Homo sapiens
gtgagaatggcctggagc

SEQ ID NO: 4861569 - DNA, 12 bp, Homo sapiens
gtgagagcccat

SEQ ID NO: 4861570 - DNA, 18 bp, Homo sapiens
gtgagcatggggccagga

SEQ ID NO: 4861571 - DNA, 23 bp, Homo sapiens
gtgagccttgcatgacatcatga

SEQ ID NO: 4861572 - DNA, 23 bp, Homo sapiens
gtgagctcttcctatccctctcc

SEQ ID NO: 4861573 - DNA, 20 bp, Homo sapiens
gtgaggatagagacttgcag

SEQ ID NO: 4861574 - DNA, 20 bp, Homo sapiens
gtgagtctgggatattcttt

SEQ ID NO: 4861575 - DNA, 19 bp, Homo sapiens
gtgataagggaaaagataa

SEQ ID NO: 4861576 - DNA, 18 bp, Homo sapiens
gtgatatacaaagtgtac

SEQ ID NO: 4861577 - DNA, 20 bp, Homo sapiens
gtgatgtccttaaaatgtgg

SEQ ID NO: 4861578 - DNA, 16 bp, Homo sapiens
gtgattactgcaatca

SEQ ID NO: 4861579 - DNA, 17 bp, Homo sapiens
gtgatttgaaaaatata

SEQ ID NO: 4861580 - DNA, 17 bp, Homo sapiens
gtgcacatctgttttgt

SEQ ID NO: 4861581 - DNA, 13 bp, Homo sapiens
gtgcactccagct

SEQ ID NO: 4861582 - DNA, 22 bp, Homo sapiens
gtgcatagttgtagacaaagta

SEQ ID NO: 4861583 - DNA, 20 bp, Homo sapiens
gtgcatccgggggcagctct

SEQ ID NO: 4861584 - DNA, 13 bp, Homo sapiens
gtgccaacctctt

SEQ ID NO: 4861585 - DNA, 21 bp, Homo sapiens
gtgccagcaagtccttaggct

SEQ ID NO: 4861586 - DNA, 16 bp, Homo sapiens
gtgccaggtccttgcc

SEQ ID NO: 4861587 - DNA, 22 bp, Homo sapiens
gtgcccctaaagagcatcctga

SEQ ID NO: 4861588 - DNA, 23 bp, Homo sapiens
gtgcccctaaagagcatcctgat

SEQ ID NO: 4861589 - DNA, 17 bp, Homo sapiens
gtgccctttcctggcag

SEQ ID NO: 4861590 - DNA, 18 bp, Homo sapiens
gtgccctttcctggcagt

SEQ ID NO: 4861591 - DNA, 16 bp, Homo sapiens
gtgcctaacctgggac

SEQ ID NO: 4861592 - DNA, 13 bp, Homo sapiens
gtgctaagtgctt

SEQ ID NO: 4861593 - DNA, 18 bp, Homo sapiens
gtgctagatccagcccaa

SEQ ID NO: 4861594 - DNA, 14 bp, Homo sapiens
gtgctcatgctgct

SEQ ID NO: 4861595 - DNA, 20 bp, Homo sapiens
gtgctcttcccactccagct

SEQ ID NO: 4861596 - DNA, 18 bp, Homo sapiens
gtgctggaattctaacaa

SEQ ID NO: 4861597 - DNA, 16 bp, Homo sapiens
gtgcttcgactactgc

SEQ ID NO: 4861598 - DNA, 15 bp, Homo sapiens
gtgcttctcacactg

SEQ ID NO: 4861599 - DNA, 12 bp, Homo sapiens
gtgctttggaac

SEQ ID NO: 4861600 - DNA, 13 bp, Homo sapiens
gtggaaaaaacat

SEQ ID NO: 4861601 - DNA, 17 bp, Homo sapiens
gtggaaaaaacatttta

SEQ ID NO: 4861602 - DNA, 20 bp, Homo sapiens
gtggatactggggggcaggc

SEQ ID NO: 4861603 - DNA, 14 bp, Homo sapiens
gtggatattgttac

SEQ ID NO: 4861604 - DNA, 15 bp, Homo sapiens
gtggatgcaaataga

SEQ ID NO: 4861605 - DNA, 21 bp, Homo sapiens
gtggcaaaaagagtcagacat

SEQ ID NO: 4861606 - DNA, 22 bp, Homo sapiens
gtggccacgggggcagtgtgag

SEQ ID NO: 4861607 - DNA, 15 bp, Homo sapiens
gtggccagcccgcag

SEQ ID NO: 4861608 - DNA, 19 bp, Homo sapiens
gtggccagcccgcagaggt

SEQ ID NO: 4861609 - DNA, 21 bp, Homo sapiens
gtggccagcccgcagaggtgg

SEQ ID NO: 4861610 - DNA, 16 bp, Homo sapiens
gtggccttgagtctct

SEQ ID NO: 4861611 - DNA, 14 bp, Homo sapiens
gtggctcactactg

SEQ ID NO: 4861612 - DNA, 15 bp, Homo sapiens
gtggctcactactga

SEQ ID NO: 4861613 - DNA, 24 bp, Homo sapiens
gtggctggaaccacattgaagaat

SEQ ID NO: 4861614 - DNA, 14 bp, Homo sapiens
gtgggagacagcag

SEQ ID NO: 4861615 - DNA, 14 bp, Homo sapiens
gtgggatcctccct

SEQ ID NO: 4861616 - DNA, 15 bp, Homo sapiens
gtgggatcctccctc

SEQ ID NO: 4861617 - DNA, 18 bp, Homo sapiens
gtgggcaaagtcctcctt

SEQ ID NO: 4861618 - DNA, 22 bp, Homo sapiens
gtggggcctcaggctccgggca

SEQ ID NO: 4861619 - DNA, 15 bp, Homo sapiens
gtggggtgctggggc

SEQ ID NO: 4861620 - DNA, 23 bp, Homo sapiens
gtggggtggagtcgcagaccaga

SEQ ID NO: 4861621 - DNA, 12 bp, Homo sapiens
gtggggtggggt

SEQ ID NO: 4861622 - DNA, 19 bp, Homo sapiens
gtggtctgccaatctgtac

SEQ ID NO: 4861623 - DNA, 21 bp, Homo sapiens
gtggtctgccaatctgtacaa

SEQ ID NO: 4861624 - DNA, 19 bp, Homo sapiens
gtggtgaatgtgtgagaaa

SEQ ID NO: 4861625 - DNA, 16 bp, Homo sapiens
gtggtggtggtgaagg

SEQ ID NO: 4861626 - DNA, 15 bp, Homo sapiens
gtggtgtttattgca

SEQ ID NO: 4861627 - DNA, 17 bp, Homo sapiens
gtgtaaatgaagatctt

SEQ ID NO: 4861628 - DNA, 18 bp, Homo sapiens
gtgtaaatgaagatcttt

SEQ ID NO: 4861629 - DNA, 16 bp, Homo sapiens
gtgtaaccagctcagt

SEQ ID NO: 4861630 - DNA, 19 bp, Homo sapiens
gtgtaatccaggggtgtag

SEQ ID NO: 4861631 - DNA, 16 bp, Homo sapiens
gtgtagctgtgaaatc

SEQ ID NO: 4861632 - DNA, 16 bp, Homo sapiens
gtgtcatgaagaatgt

SEQ ID NO: 4861633 - DNA, 23 bp, Homo sapiens
gtgtcatttctatattcctccag

SEQ ID NO: 4861634 - DNA, 22 bp, Homo sapiens
gtgtctccttaagctgcagaga

SEQ ID NO: 4861635 - DNA, 17 bp, Homo sapiens
gtgtgaatttgccagag

SEQ ID NO: 4861636 - DNA, 15 bp, Homo sapiens
gtgtgaccctgggca

SEQ ID NO: 4861637 - DNA, 16 bp, Homo sapiens
gtgtgaccctgggcag

SEQ ID NO: 4861638 - DNA, 15 bp, Homo sapiens
gtgtgactccttatc

SEQ ID NO: 4861639 - DNA, 14 bp, Homo sapiens
gtgtgcactccagc

SEQ ID NO: 4861640 - DNA, 13 bp, Homo sapiens
gtgtgcagacagc

SEQ ID NO: 4861641 - DNA, 23 bp, Homo sapiens
gtgtgcagacagccatgcgtggc

SEQ ID NO: 4861642 - DNA, 15 bp, Homo sapiens
gtgtgctaaaaatga

SEQ ID NO: 4861643 - DNA, 20 bp, Homo sapiens
gtgtgctgggcagagggagg

SEQ ID NO: 4861644 - DNA, 11 bp, Homo sapiens
gtgtggagcag

SEQ ID NO: 4861645 - DNA, 20 bp, Homo sapiens
gtgtggcagccaggatgact

SEQ ID NO: 4861646 - DNA, 16 bp, Homo sapiens
gtgtgtgacactgatg

SEQ ID NO: 4861647 - DNA, 23 bp, Homo sapiens
gtgtgtggtcaacatttctcatg

SEQ ID NO: 4861648 - DNA, 14 bp, Homo sapiens
gtgttcattgtttc

SEQ ID NO: 4861649 - DNA, 20 bp, Homo sapiens
gtgttccaagtctctgtgta

SEQ ID NO: 4861650 - DNA, 13 bp, Homo sapiens
gtgtttattgcaa

SEQ ID NO: 4861651 - DNA, 15 bp, Homo sapiens
gtgtttctagaatca

SEQ ID NO: 4861652 - DNA, 16 bp, Homo sapiens
gtgttttaattgtaaa

SEQ ID NO: 4861653 - DNA, 15 bp, Homo sapiens
gtgttttgaaagaat

SEQ ID NO: 4861654 - DNA, 15 bp, Homo sapiens
gtgttttttaagatg

SEQ ID NO: 4861655 - DNA, 22 bp, Homo sapiens
gttaaggacccttttaagcatg

SEQ ID NO: 4861656 - DNA, 23 bp, Homo sapiens
gttaaggacccttttaagcatgt

SEQ ID NO: 4861657 - DNA, 16 bp, Homo sapiens
gttaatttttcctgca

SEQ ID NO: 4861658 - DNA, 18 bp, Homo sapiens
gttacgtagcctaaggct

SEQ ID NO: 4861659 - DNA, 15 bp, Homo sapiens
gttagcagagtctgt

SEQ ID NO: 4861660 - DNA, 16 bp, Homo sapiens
gttagcagagtctgtc

SEQ ID NO: 4861661 - DNA, 20 bp, Homo sapiens
gttagcagagtctgtctctt

SEQ ID NO: 4861662 - DNA, 20 bp, Homo sapiens
gttatacatcaatatgtata

SEQ ID NO: 4861663 - DNA, 21 bp, Homo sapiens
gttatcagtaatgctaaatgt

SEQ ID NO: 4861664 - DNA, 19 bp, Homo sapiens
gttatcatgaattttaaag

SEQ ID NO: 4861665 - DNA, 23 bp, Homo sapiens
gttatgataacaccagtgggaat

SEQ ID NO: 4861666 - DNA, 18 bp, Homo sapiens
gttattgcaataaagtat

SEQ ID NO: 4861667 - DNA, 16 bp, Homo sapiens
gttatttattccccag

SEQ ID NO: 4861668 - DNA, 13 bp, Homo sapiens
gttcaacaaagaa

SEQ ID NO: 4861669 - DNA, 18 bp, Homo sapiens
gttcagaagaatcttcct

SEQ ID NO: 4861670 - DNA, 15 bp, Homo sapiens
gttcagctgccccac

SEQ ID NO: 4861671 - DNA, 18 bp, Homo sapiens
gttcattgcaattaaact

SEQ ID NO: 4861672 - DNA, 18 bp, Homo sapiens
gttccaaacagacaaaac

SEQ ID NO: 4861673 - DNA, 14 bp, Homo sapiens
gttccggggagaaa

SEQ ID NO: 4861674 - DNA, 11 bp, Homo sapiens
gttcctgaaat

SEQ ID NO: 4861675 - DNA, 20 bp, Homo sapiens
gttcctgtgtgaccctgggc

SEQ ID NO: 4861676 - DNA, 16 bp, Homo sapiens
gttcgactcagcctca

SEQ ID NO: 4861677 - DNA, 21 bp, Homo sapiens
gttcggctctagggcctcagt

SEQ ID NO: 4861678 - DNA, 19 bp, Homo sapiens
gttctgaggccagaaaggt

SEQ ID NO: 4861679 - DNA, 17 bp, Homo sapiens
gttctggacctgggcat

SEQ ID NO: 4861680 - DNA, 20 bp, Homo sapiens
gctgcaaggtggcctctgcc

SEQ ID NO: 4861681 - DNA, 22 bp, Homo sapiens
gctgcatgatttttgccctgcg

SEQ ID NO: 4861682 - DNA, 18 bp, Homo sapiens
gctgccaggggctctgtg

SEQ ID NO: 4861683 - DNA, 20 bp, Homo sapiens
gctgccaggggctctgtggc

SEQ ID NO: 4861684 - DNA, 19 bp, Homo sapiens
gctgccccactacaggccc

SEQ ID NO: 4861685 - DNA, 16 bp, Homo sapiens
gctgccgtagcttcag

SEQ ID NO: 4861686 - DNA, 16 bp, Homo sapiens
gctgccgttttctggg

SEQ ID NO: 4861687 - DNA, 16 bp, Homo sapiens
gctgcctcaggaccca

SEQ ID NO: 4861688 - DNA, 21 bp, Homo sapiens
gctgctaagtcattggcaaag

SEQ ID NO: 4861689 - DNA, 20 bp, Homo sapiens
gctgctcccctaaagccagg

SEQ ID NO: 4861690 - DNA, 22 bp, Homo sapiens
gctgctcccctaaagccaggct

SEQ ID NO: 4861691 - DNA, 15 bp, Homo sapiens
gctgctgctactgct

SEQ ID NO: 4861692 - DNA, 20 bp, Homo sapiens
gctgctgctcctctcttggg

SEQ ID NO: 4861693 - DNA, 15 bp, Homo sapiens
gctgctgttgaactt

SEQ ID NO: 4861694 - DNA, 17 bp, Homo sapiens
gctggaagtacttggcc

SEQ ID NO: 4861695 - DNA, 15 bp, Homo sapiens
gctggagtaatcaga

SEQ ID NO: 4861696 - DNA, 22 bp, Homo sapiens
gctggcacaaaagacagctggc

SEQ ID NO: 4861697 - DNA, 19 bp, Homo sapiens
gctgggcctcccctgggca

SEQ ID NO: 4861698 - DNA, 22 bp, Homo sapiens
gctgggctttgggaagtttgct

SEQ ID NO: 4861699 - DNA, 16 bp, Homo sapiens
gctggtgaacactgtg

SEQ ID NO: 4861700 - DNA, 19 bp, Homo sapiens
gctggtggagatgtaggaa

SEQ ID NO: 4861701 - DNA, 23 bp, Homo sapiens
gctgtaaggatccggaaagaaga

SEQ ID NO: 4861702 - DNA, 17 bp, Homo sapiens
gctgtacttcttgaata

SEQ ID NO: 4861703 - DNA, 17 bp, Homo sapiens
gctgtgagccttgcatg

SEQ ID NO: 4861704 - DNA, 15 bp, Homo sapiens
gctgtgccttccctt

SEQ ID NO: 4861705 - DNA, 19 bp, Homo sapiens
gctgtgctccacactcaga

SEQ ID NO: 4861706 - DNA, 14 bp, Homo sapiens
gctgtgctttggaa

SEQ ID NO: 4861707 - DNA, 18 bp, Homo sapiens
gctgtggagtgaggtgta

SEQ ID NO: 4861708 - DNA, 20 bp, Homo sapiens
gctgtggccgtctcctccct

SEQ ID NO: 4861709 - DNA, 23 bp, Homo sapiens
gctgttccattacaccacagcat

SEQ ID NO: 4861710 - DNA, 14 bp, Homo sapiens
gctgtttggaaaag

SEQ ID NO: 4861711 - DNA, 22 bp, Homo sapiens
gcttaattattgatgttttcat

SEQ ID NO: 4861712 - DNA, 17 bp, Homo sapiens
gcttacaggagccagcc

SEQ ID NO: 4861713 - DNA, 13 bp, Homo sapiens
gcttacctcctca

SEQ ID NO: 4861714 - DNA, 21 bp, Homo sapiens
gcttacctgggcacaaacaga

SEQ ID NO: 4861715 - DNA, 21 bp, Homo sapiens
gcttaggagaagtcttctatt

SEQ ID NO: 4861716 - DNA, 16 bp, Homo sapiens
gcttcaaaaagccaca

SEQ ID NO: 4861717 - DNA, 18 bp, Homo sapiens
gcttcaacagccaagctg

SEQ ID NO: 4861718 - DNA, 23 bp, Homo sapiens
gcttcaacagccaagctggcaca

SEQ ID NO: 4861719 - DNA, 16 bp, Homo sapiens
gcttcactgccccctc

SEQ ID NO: 4861720 - DNA, 23 bp, Homo sapiens
gcttcactgccccctccgtccca

SEQ ID NO: 4861721 - DNA, 21 bp, Homo sapiens
gcttcagccaggtctgactcc

SEQ ID NO: 4861722 - DNA, 22 bp, Homo sapiens
gcttcaggttagtgacatttaa

SEQ ID NO: 4861723 - DNA, 21 bp, Homo sapiens
gcttcccaacagatcatatgg

SEQ ID NO: 4861724 - DNA, 16 bp, Homo sapiens
gcttcccatctgaaga

SEQ ID NO: 4861725 - DNA, 19 bp, Homo sapiens
gcttcggagggcccctgcg

SEQ ID NO: 4861726 - DNA, 13 bp, Homo sapiens
gcttctcacactg

SEQ ID NO: 4861727 - DNA, 15 bp, Homo sapiens
gcttctcacactgga

SEQ ID NO: 4861728 - DNA, 16 bp, Homo sapiens
gcttctgtatttcctt

SEQ ID NO: 4861729 - DNA, 18 bp, Homo sapiens
gcttgactttccagaatg

SEQ ID NO: 4861730 - DNA, 16 bp, Homo sapiens
gcttgatatcccaagt

SEQ ID NO: 4861731 - DNA, 13 bp, Homo sapiens
gcttgattaaatc

SEQ ID NO: 4861732 - DNA, 15 bp, Homo sapiens
gcttgcatggagaat

SEQ ID NO: 4861733 - DNA, 15 bp, Homo sapiens
gcttgctgggctttg

SEQ ID NO: 4861734 - DNA, 19 bp, Homo sapiens
gcttgctgggctttgggaa

SEQ ID NO: 4861735 - DNA, 20 bp, Homo sapiens
gcttgtctatactccttccc

SEQ ID NO: 4861736 - DNA, 19 bp, Homo sapiens
gctttaagtgtgctgggca

SEQ ID NO: 4861737 - DNA, 20 bp, Homo sapiens
gctttaagtgtgctgggcag

SEQ ID NO: 4861738 - DNA, 16 bp, Homo sapiens
gctttattaatgtttt

SEQ ID NO: 4861739 - DNA, 15 bp, Homo sapiens
gctttcagcctctgg

SEQ ID NO: 4861740 - DNA, 22 bp, Homo sapiens
gctttcctgcagcagtcgccca

SEQ ID NO: 4861741 - DNA, 19 bp, Homo sapiens
gctttgactctataagcaa

SEQ ID NO: 4861742 - DNA, 23 bp, Homo sapiens
gctttggcgaccccaatatatgt

SEQ ID NO: 4861743 - DNA, 18 bp, Homo sapiens
gctttgggaagtttgctg

SEQ ID NO: 4861744 - DNA, 23 bp, Homo sapiens
gctttgggtggctcactactgaa

SEQ ID NO: 4861745 - DNA, 15 bp, Homo sapiens
gctttgtaggtgtct

SEQ ID NO: 4861746 - DNA, 21 bp, Homo sapiens
gctttgtgaccagaaagcttc

SEQ ID NO: 4861747 - DNA, 15 bp, Homo sapiens
gctttgttgtgagaa

SEQ ID NO: 4861748 - DNA, 16 bp, Homo sapiens
gctttgttgtgagaat

SEQ ID NO: 4861749 - DNA, 23 bp, Homo sapiens
gctttgttgtgagaatggcctgg

SEQ ID NO: 4861750 - DNA, 18 bp, Homo sapiens
gcttttggggagccagaa

SEQ ID NO: 4861751 - DNA, 17 bp, Homo sapiens
gcttttttccaaaacaa

SEQ ID NO: 4861752 - DNA, 14 bp, Homo sapiens
ggaaaacatttgct

SEQ ID NO: 4861753 - DNA, 18 bp, Homo sapiens
ggaaaagataaagaccag

SEQ ID NO: 4861754 - DNA, 22 bp, Homo sapiens
ggaaaagataaagaccagaaat

SEQ ID NO: 4861755 - DNA, 15 bp, Homo sapiens
ggaaaaggttgaata

SEQ ID NO: 4861756 - DNA, 20 bp, Homo sapiens
ggaaaaggttgaataatata

SEQ ID NO: 4861757 - DNA, 15 bp, Homo sapiens
ggaaaagtcttccta

SEQ ID NO: 4861758 - DNA, 15 bp, Homo sapiens
ggaaacaacatttat

SEQ ID NO: 4861759 - DNA, 22 bp, Homo sapiens
ggaaagcacaagactggcccag

SEQ ID NO: 4861760 - DNA, 13 bp, Homo sapiens
ggaaaggcagggc

SEQ ID NO: 4861761 - DNA, 18 bp, Homo sapiens
ggaaagtcagaatcagaa

SEQ ID NO: 4861762 - DNA, 19 bp, Homo sapiens
ggaacaatcacagggaatg

SEQ ID NO: 4861763 - DNA, 15 bp, Homo sapiens
ggaacggaggaggac

SEQ ID NO: 4861764 - DNA, 16 bp, Homo sapiens
ggaactcccccagagg

SEQ ID NO: 4861765 - DNA, 18 bp, Homo sapiens
ggaactcccccagaggtg

SEQ ID NO: 4861766 - DNA, 19 bp, Homo sapiens
ggaactgaaatccttgaga

SEQ ID NO: 4861767 - DNA, 11 bp, Homo sapiens
ggaagaatgaa

SEQ ID NO: 4861768 - DNA, 13 bp, Homo sapiens
ggaagaatgaaag

SEQ ID NO: 4861769 - DNA, 21 bp, Homo sapiens
ggaagcaataggtagctgggg

SEQ ID NO: 4861770 - DNA, 20 bp, Homo sapiens
ggaagctgccgtagcttcag

SEQ ID NO: 4861771 - DNA, 14 bp, Homo sapiens
ggaaggggcctggg

SEQ ID NO: 4861772 - DNA, 16 bp, Homo sapiens
ggaaggggcctgggct

SEQ ID NO: 4861773 - DNA, 12 bp, Homo sapiens
ggaagtacttgg

SEQ ID NO: 4861774 - DNA, 23 bp, Homo sapiens
ggaagtacttggcccccttcagg

SEQ ID NO: 4861775 - DNA, 18 bp, Homo sapiens
ggaagtgtgtgccaagag

SEQ ID NO: 4861776 - DNA, 16 bp, Homo sapiens
ggaagtttgctgtgct

SEQ ID NO: 4861777 - DNA, 18 bp, Homo sapiens
ggaataatttccttcagg

SEQ ID NO: 4861778 - DNA, 15 bp, Homo sapiens
ggaatattaaaaaac

SEQ ID NO: 4861779 - DNA, 16 bp, Homo sapiens
ggcatctgttagcaga

SEQ ID NO: 4861780 - DNA, 21 bp, Homo sapiens
ggcatctgttagcagagtctg

SEQ ID NO: 4861781 - DNA, 17 bp, Homo sapiens
ggcatgtgtctggccct

SEQ ID NO: 4861782 - DNA, 17 bp, Homo sapiens
ggcattctcccagctct

SEQ ID NO: 4861783 - DNA, 20 bp, Homo sapiens
ggcattctttgcaatactgc

SEQ ID NO: 4861784 - DNA, 15 bp, Homo sapiens
ggccaacctcaggct

SEQ ID NO: 4861785 - DNA, 13 bp, Homo sapiens
ggccaagggacca

SEQ ID NO: 4861786 - DNA, 15 bp, Homo sapiens
ggccaaggtcctgct

SEQ ID NO: 4861787 - DNA, 20 bp, Homo sapiens
ggccacgggggcagtgtgag

SEQ ID NO: 4861788 - DNA, 21 bp, Homo sapiens
ggccagaaaggtgtgaggaga

SEQ ID NO: 4861789 - DNA, 18 bp, Homo sapiens
ggccagagaaagcaaagg

SEQ ID NO: 4861790 - DNA, 18 bp, Homo sapiens
ggccagagagggaaaagg

SEQ ID NO: 4861791 - DNA, 17 bp, Homo sapiens
ggccagcagctgatgct

SEQ ID NO: 4861792 - DNA, 18 bp, Homo sapiens
ggccagcagctgatgctg

SEQ ID NO: 4861793 - DNA, 22 bp, Homo sapiens
ggccagccttgtacagtctgct

SEQ ID NO: 4861794 - DNA, 21 bp, Homo sapiens
ggccaggatccccctctttgc

SEQ ID NO: 4861795 - DNA, 22 bp, Homo sapiens
ggccaggatccccctctttgca

SEQ ID NO: 4861796 - DNA, 14 bp, Homo sapiens
ggccatactgcctt

SEQ ID NO: 4861797 - DNA, 16 bp, Homo sapiens
ggccatgttcccagaa

SEQ ID NO: 4861798 - DNA, 14 bp, Homo sapiens
ggcccaatgctgct

SEQ ID NO: 4861799 - DNA, 20 bp, Homo sapiens
ggcccagagagggaagatga

SEQ ID NO: 4861800 - DNA, 22 bp, Homo sapiens
ggcccaggcagacaaccttgtc

SEQ ID NO: 4861801 - DNA, 15 bp, Homo sapiens
ggcccagtgccagca

SEQ ID NO: 4861802 - DNA, 16 bp, Homo sapiens
ggcccccttcaggagc

SEQ ID NO: 4861803 - DNA, 17 bp, Homo sapiens
ggcccccttcaggagcc

SEQ ID NO: 4861804 - DNA, 19 bp, Homo sapiens
ggcccccttcaggagcctg

SEQ ID NO: 4861805 - DNA, 17 bp, Homo sapiens
ggccctgaaatggcctg

SEQ ID NO: 4861806 - DNA, 18 bp, Homo sapiens
ggccctgacaggccttcc

SEQ ID NO: 4861807 - DNA, 15 bp, Homo sapiens
ggccctggagctcag

SEQ ID NO: 4861808 - DNA, 18 bp, Homo sapiens
ggccctgtcactgtccag

SEQ ID NO: 4861809 - DNA, 19 bp, Homo sapiens
ggccgccagcgtgtggagc

SEQ ID NO: 4861810 - DNA, 13 bp, Homo sapiens
ggccgggggaggg

SEQ ID NO: 4861811 - DNA, 15 bp, Homo sapiens
ggccgggggaggggc

SEQ ID NO: 4861812 - DNA, 17 bp, Homo sapiens
ggccgtctcctccctca

SEQ ID NO: 4861813 - DNA, 13 bp, Homo sapiens
ggcctagaaaggg

SEQ ID NO: 4861814 - DNA, 18 bp, Homo sapiens
ggcctagaaagggcaagg

SEQ ID NO: 4861815 - DNA, 22 bp, Homo sapiens
ggcctccagaagctgctccttt

SEQ ID NO: 4861816 - DNA, 15 bp, Homo sapiens
ggcctctctggaaga

SEQ ID NO: 4861817 - DNA, 16 bp, Homo sapiens
ggcctctgcctggggc

SEQ ID NO: 4861818 - DNA, 16 bp, Homo sapiens
ggcctctgggacccac

SEQ ID NO: 4861819 - DNA, 21 bp, Homo sapiens
ggcctgagaattgaggggagg

SEQ ID NO: 4861820 - DNA, 14 bp, Homo sapiens
ggcctgcaggaggg

SEQ ID NO: 4861821 - DNA, 15 bp, Homo sapiens
ggcctgcccagttgc

SEQ ID NO: 4861822 - DNA, 20 bp, Homo sapiens
ggcctgcttgactttccaga

SEQ ID NO: 4861823 - DNA, 11 bp, Homo sapiens
ggcctggagca

SEQ ID NO: 4861824 - DNA, 13 bp, Homo sapiens
ggcctggagcagg

SEQ ID NO: 4861825 - DNA, 14 bp, Homo sapiens
ggcctggagcaggc

SEQ ID NO: 4861826 - DNA, 19 bp, Homo sapiens
ggcctgtccctagggctct

SEQ ID NO: 4861827 - DNA, 12 bp, Homo sapiens
ggcctgttcctt

SEQ ID NO: 4861828 - DNA, 22 bp, Homo sapiens
ggccttcctcctctcaaacctg

SEQ ID NO: 4861829 - DNA, 15 bp, Homo sapiens
ggccttgagtctctg

SEQ ID NO: 4861830 - DNA, 20 bp, Homo sapiens
ggcgaccccgtcacagcctc

SEQ ID NO: 4861831 - DNA, 14 bp, Homo sapiens
ggcgtgtgtgacac

SEQ ID NO: 4861832 - DNA, 12 bp, Homo sapiens
ggctaatttaac

SEQ ID NO: 4861833 - DNA, 13 bp, Homo sapiens
ggctaatttaaca

SEQ ID NO: 4861834 - DNA, 16 bp, Homo sapiens
ggctactgtaatgctg

SEQ ID NO: 4861835 - DNA, 13 bp, Homo sapiens
ggctcactactga

SEQ ID NO: 4861836 - DNA, 12 bp, Homo sapiens
ggctcaggagaa

SEQ ID NO: 4861837 - DNA, 18 bp, Homo sapiens
ggctcccctcccagggga

SEQ ID NO: 4861838 - DNA, 12 bp, Homo sapiens
ggctcctccttg

SEQ ID NO: 4861839 - DNA, 22 bp, Homo sapiens
ggctcctctaggccctgtgagc

SEQ ID NO: 4861840 - DNA, 15 bp, Homo sapiens
ggctcctgttttgca

SEQ ID NO: 4861841 - DNA, 13 bp, Homo sapiens
ggctcctttcccc

SEQ ID NO: 4861842 - DNA, 19 bp, Homo sapiens
ggctctgctggccggagca

SEQ ID NO: 4861843 - DNA, 15 bp, Homo sapiens
ggctctgtggcaaaa

SEQ ID NO: 4861844 - DNA, 12 bp, Homo sapiens
ggctgaagctgg

SEQ ID NO: 4861845 - DNA, 18 bp, Homo sapiens
ggctgaagctggagcagc

SEQ ID NO: 4861846 - DNA, 16 bp, Homo sapiens
ggctgagccctcctga

SEQ ID NO: 4861847 - DNA, 14 bp, Homo sapiens
ggctgaggcagaag

SEQ ID NO: 4861848 - DNA, 22 bp, Homo sapiens
ggctgcatgatttttgccctgc

SEQ ID NO: 4861849 - DNA, 14 bp, Homo sapiens
ggctgccaggggct

SEQ ID NO: 4861850 - DNA, 17 bp, Homo sapiens
ggctgccaggggctctg

SEQ ID NO: 4861851 - DNA, 19 bp, Homo sapiens
ggctgccaggggctctgtg

SEQ ID NO: 4861852 - DNA, 21 bp, Homo sapiens
ggctgccaggggctctgtggc

SEQ ID NO: 4861853 - DNA, 22 bp, Homo sapiens
ggctgccaggggctctgtggca

SEQ ID NO: 4861854 - DNA, 17 bp, Homo sapiens
ggctgccgttttctggg

SEQ ID NO: 4861855 - DNA, 20 bp, Homo sapiens
ggctggaaggacctgctccc

SEQ ID NO: 4861856 - DNA, 23 bp, Homo sapiens
ggctggaaggacctgctcccaca

SEQ ID NO: 4861857 - DNA, 17 bp, Homo sapiens
ggctggagtaatcagat

SEQ ID NO: 4861858 - DNA, 17 bp, Homo sapiens
ggctgtgaggacagggc

SEQ ID NO: 4861859 - DNA, 19 bp, Homo sapiens
ggcttcaacagccaagctg

SEQ ID NO: 4861860 - DNA, 22 bp, Homo sapiens
ggcttctctgctgagaaggcaa

SEQ ID NO: 4861861 - DNA, 12 bp, Homo sapiens
ggctttgggaag

SEQ ID NO: 4861862 - DNA, 21 bp, Homo sapiens
ggctttgggaagtttgctgtg

SEQ ID NO: 4861863 - DNA, 22 bp, Homo sapiens
ggctttgggaagtttgctgtgc

SEQ ID NO: 4861864 - DNA, 19 bp, Homo sapiens
ggctttgttgtgagaatgg

SEQ ID NO: 4861865 - DNA, 17 bp, Homo sapiens
gggaactcccccagagg

SEQ ID NO: 4861866 - DNA, 20 bp, Homo sapiens
gggaactcccccagaggtgg

SEQ ID NO: 4861867 - DNA, 15 bp, Homo sapiens
gggaagacctgaaag

SEQ ID NO: 4861868 - DNA, 20 bp, Homo sapiens
gggaagctgccgtagcttca

SEQ ID NO: 4861869 - DNA, 13 bp, Homo sapiens
gggaaggggcctg

SEQ ID NO: 4861870 - DNA, 21 bp, Homo sapiens
gggaaggggcctgggctgtga

SEQ ID NO: 4861871 - DNA, 23 bp, Homo sapiens
gggaataatttccttcaggcagc

SEQ ID NO: 4861872 - DNA, 22 bp, Homo sapiens
gggaatctagcccaacctacat

SEQ ID NO: 4861873 - DNA, 16 bp, Homo sapiens
gggacccacagaactt

SEQ ID NO: 4861874 - DNA, 22 bp, Homo sapiens
gggaccccagatacctgtgagg

SEQ ID NO: 4861875 - DNA, 18 bp, Homo sapiens
gggactaggacctgagcc

SEQ ID NO: 4861876 - DNA, 16 bp, Homo sapiens
gggagaagaaatacag

SEQ ID NO: 4861877 - DNA, 12 bp, Homo sapiens
gggagacagcag

SEQ ID NO: 4861878 - DNA, 15 bp, Homo sapiens
gggagattgaacttt

SEQ ID NO: 4861879 - DNA, 11 bp, Homo sapiens
gggagccagct

SEQ ID NO: 4861880 - DNA, 13 bp, Homo sapiens
gggagccaggact

SEQ ID NO: 4861881 - DNA, 19 bp, Homo sapiens
gggagccaggactcccaga

SEQ ID NO: 4861882 - DNA, 14 bp, Homo sapiens
gggaggcagcagag

SEQ ID NO: 4861883 - DNA, 21 bp, Homo sapiens
gggaggggcgcgggagggggc

SEQ ID NO: 4861884 - DNA, 12 bp, Homo sapiens
gggaggtggcca

SEQ ID NO: 4861885 - DNA, 18 bp, Homo sapiens
gggaggtggccagcccgc

SEQ ID NO: 4861886 - DNA, 19 bp, Homo sapiens
gggaggtggccagcccgca

SEQ ID NO: 4861887 - DNA, 16 bp, Homo sapiens
gggaggttgtggggcc

SEQ ID NO: 4861888 - DNA, 23 bp, Homo sapiens
gggaggttgtggggcctcaggct

SEQ ID NO: 4861889 - DNA, 14 bp, Homo sapiens
gggatattttgaaa

SEQ ID NO: 4861890 - DNA, 16 bp, Homo sapiens
gggatattttgaaatg

SEQ ID NO: 4861891 - DNA, 13 bp, Homo sapiens
gggatctgccccc

SEQ ID NO: 4861892 - DNA, 16 bp, Homo sapiens
gggatgacctccagaa

SEQ ID NO: 4861893 - DNA, 13 bp, Homo sapiens
gggcacaaacaga

SEQ ID NO: 4861894 - DNA, 22 bp, Homo sapiens
gggcagcaggccagagaaagca

SEQ ID NO: 4861895 - DNA, 23 bp, Homo sapiens
gggcaggaacggtggaggcagag

SEQ ID NO: 4861896 - DNA, 11 bp, Homo sapiens
gggcagggtgg

SEQ ID NO: 4861897 - DNA, 21 bp, Homo sapiens
gggcagtgtgaggacctccct

SEQ ID NO: 4861898 - DNA, 23 bp, Homo sapiens
gggcagtgtgaggacctccctgt

SEQ ID NO: 4861899 - DNA, 21 bp, Homo sapiens
gccctgccagctgcagcctgg

SEQ ID NO: 4861900 - DNA, 17 bp, Homo sapiens
gccctgcgtcccttctc

SEQ ID NO: 4861901 - DNA, 18 bp, Homo sapiens
gccctgcgtcccttctct

SEQ ID NO: 4861902 - DNA, 17 bp, Homo sapiens
gccctgggccacactga

SEQ ID NO: 4861903 - DNA, 17 bp, Homo sapiens
gccctgtgagcacaaag

SEQ ID NO: 4861904 - DNA, 13 bp, Homo sapiens
gccctttcctggc

SEQ ID NO: 4861905 - DNA, 15 bp, Homo sapiens
gccctttcctggcag

SEQ ID NO: 4861906 - DNA, 12 bp, Homo sapiens
gccgcagagaaa

SEQ ID NO: 4861907 - DNA, 15 bp, Homo sapiens
gccgcagagaaatgc

SEQ ID NO: 4861908 - DNA, 20 bp, Homo sapiens
gccgccagcgtgtggagcag

SEQ ID NO: 4861909 - DNA, 21 bp, Homo sapiens
gccgccagcgtgtggagcaga

SEQ ID NO: 4861910 - DNA, 15 bp, Homo sapiens
gccgccgccgctgcc

SEQ ID NO: 4861911 - DNA, 15 bp, Homo sapiens
gccggagtcagtgcc

SEQ ID NO: 4861912 - DNA, 16 bp, Homo sapiens
gccggagtccactccc

SEQ ID NO: 4861913 - DNA, 19 bp, Homo sapiens
gccggagtccactcccagt

SEQ ID NO: 4861914 - DNA, 15 bp, Homo sapiens
gccggcctgagaaac

SEQ ID NO: 4861915 - DNA, 23 bp, Homo sapiens
gccgggggaggggcgcgggaggg

SEQ ID NO: 4861916 - DNA, 15 bp, Homo sapiens
gccggtgggtgagga

SEQ ID NO: 4861917 - DNA, 14 bp, Homo sapiens
gccgtaatttaact

SEQ ID NO: 4861918 - DNA, 13 bp, Homo sapiens
gccgtagcttcag

SEQ ID NO: 4861919 - DNA, 14 bp, Homo sapiens
gcctaagaagaagg

SEQ ID NO: 4861920 - DNA, 22 bp, Homo sapiens
gcctaagaagaaggccagagag

SEQ ID NO: 4861921 - DNA, 15 bp, Homo sapiens
gcctacctctgtctg

SEQ ID NO: 4861922 - DNA, 17 bp, Homo sapiens
gcctagcctatgtctgg

SEQ ID NO: 4861923 - DNA, 21 bp, Homo sapiens
gcctagcctatgtctggcaga

SEQ ID NO: 4861924 - DNA, 12 bp, Homo sapiens
gcctatgtctgg

SEQ ID NO: 4861925 - DNA, 15 bp, Homo sapiens
gcctatgtctggcag

SEQ ID NO: 4861926 - DNA, 18 bp, Homo sapiens
gcctatttcccccttcat

SEQ ID NO: 4861927 - DNA, 23 bp, Homo sapiens
gcctatttttttagattgagaaa

SEQ ID NO: 4861928 - DNA, 16 bp, Homo sapiens
gcctcaccagcccccc

SEQ ID NO: 4861929 - DNA, 24 bp, Homo sapiens
gcctcaccagccccccgcgcgccc

SEQ ID NO: 4861930 - DNA, 17 bp, Homo sapiens
gcctcaggctccgggca

SEQ ID NO: 4861931 - DNA, 22 bp, Homo sapiens
gcctcattttgcttcccatctg

SEQ ID NO: 4861932 - DNA, 16 bp, Homo sapiens
gcctccagaagctgct

SEQ ID NO: 4861933 - DNA, 17 bp, Homo sapiens
gcctccagaagctgctc

SEQ ID NO: 4861934 - DNA, 18 bp, Homo sapiens
gcctccagaagctgctcc

SEQ ID NO: 4861935 - DNA, 12 bp, Homo sapiens
gcctcccaagct

SEQ ID NO: 4861936 - DNA, 13 bp, Homo sapiens
gcctcccaagctg

SEQ ID NO: 4861937 - DNA, 19 bp, Homo sapiens
gcctcccaagctgatggac

SEQ ID NO: 4861938 - DNA, 21 bp, Homo sapiens
gcctctgggacccacagaact

SEQ ID NO: 4861939 - DNA, 18 bp, Homo sapiens
gcctctgtccgtgcccct

SEQ ID NO: 4861940 - DNA, 19 bp, Homo sapiens
gcctctgtccgtgcccctt

SEQ ID NO: 4861941 - DNA, 14 bp, Homo sapiens
gcctgactagaact

SEQ ID NO: 4861942 - DNA, 12 bp, Homo sapiens
gcctgagaaaca

SEQ ID NO: 4861943 - DNA, 19 bp, Homo sapiens
gcctgcccagttgcactca

SEQ ID NO: 4861944 - DNA, 13 bp, Homo sapiens
gcctgcctcccaa

SEQ ID NO: 4861945 - DNA, 18 bp, Homo sapiens
gcctgcctcccaaggtcc

SEQ ID NO: 4861946 - DNA, 17 bp, Homo sapiens
gcctgcttcccacaact

SEQ ID NO: 4861947 - DNA, 18 bp, Homo sapiens
gcctgcttgactttccag

SEQ ID NO: 4861948 - DNA, 21 bp, Homo sapiens
gcctgctttttggaaagtcag

SEQ ID NO: 4861949 - DNA, 23 bp, Homo sapiens
gcctggagtgtcggatcctgtga

SEQ ID NO: 4861950 - DNA, 17 bp, Homo sapiens
gcctgggctgtgaggac

SEQ ID NO: 4861951 - DNA, 13 bp, Homo sapiens
gcctggtttctgg

SEQ ID NO: 4861952 - DNA, 18 bp, Homo sapiens
gcctggtttctgggtgct

SEQ ID NO: 4861953 - DNA, 14 bp, Homo sapiens
gcctgtccctaggg

SEQ ID NO: 4861954 - DNA, 21 bp, Homo sapiens
gcctgtccctagggctctcca

SEQ ID NO: 4861955 - DNA, 16 bp, Homo sapiens
gccttgagtctctgaa

SEQ ID NO: 4861956 - DNA, 22 bp, Homo sapiens
gccttgcagatatctgcatgtg

SEQ ID NO: 4861957 - DNA, 17 bp, Homo sapiens
gccttgcagcggctcct

SEQ ID NO: 4861958 - DNA, 20 bp, Homo sapiens
gccttgcagcggctcctgca

SEQ ID NO: 4861959 - DNA, 13 bp, Homo sapiens
gccttggaaattc

SEQ ID NO: 4861960 - DNA, 20 bp, Homo sapiens
gccttgtacagtctgctcct

SEQ ID NO: 4861961 - DNA, 19 bp, Homo sapiens
gccttgtataatattgaaa

SEQ ID NO: 4861962 - DNA, 22 bp, Homo sapiens
gcctttctacaactgattgcaa

SEQ ID NO: 4861963 - DNA, 14 bp, Homo sapiens
gcctttttacctgg

SEQ ID NO: 4861964 - DNA, 20 bp, Homo sapiens
gcgagggatgatgagggaag

SEQ ID NO: 4861965 - DNA, 20 bp, Homo sapiens
gcgcatcaatgtattttatc

SEQ ID NO: 4861966 - DNA, 15 bp, Homo sapiens
gcgcgggagggggcg

SEQ ID NO: 4861967 - DNA, 13 bp, Homo sapiens
gcgctggggagac

SEQ ID NO: 4861968 - DNA, 20 bp, Homo sapiens
gcggattgctctggagcagc

SEQ ID NO: 4861969 - DNA, 21 bp, Homo sapiens
gcggattgctctggagcagcc

SEQ ID NO: 4861970 - DNA, 12 bp, Homo sapiens
gcggcacagcct

SEQ ID NO: 4861971 - DNA, 20 bp, Homo sapiens
gcggtttactcactgctgca

SEQ ID NO: 4861972 - DNA, 17 bp, Homo sapiens
gcgtggccacgggggca

SEQ ID NO: 4861973 - DNA, 18 bp, Homo sapiens
gctaaaaaggcccttaga

SEQ ID NO: 4861974 - DNA, 19 bp, Homo sapiens
gctaaggctcctccttgcc

SEQ ID NO: 4861975 - DNA, 14 bp, Homo sapiens
gctaagtgcttatt

SEQ ID NO: 4861976 - DNA, 14 bp, Homo sapiens
gctactcccacagc

SEQ ID NO: 4861977 - DNA, 18 bp, Homo sapiens
gctactggttacctggag

SEQ ID NO: 4861978 - DNA, 20 bp, Homo sapiens
gctactggttacctggagaa

SEQ ID NO: 4861979 - DNA, 17 bp, Homo sapiens
gctacttcccactgtat

SEQ ID NO: 4861980 - DNA, 12 bp, Homo sapiens
gctagatccagc

SEQ ID NO: 4861981 - DNA, 11 bp, Homo sapiens
gctaggaaccc

SEQ ID NO: 4861982 - DNA, 15 bp, Homo sapiens
gctaggaaccctgga

SEQ ID NO: 4861983 - DNA, 17 bp, Homo sapiens
gctaggaaccctggagg

SEQ ID NO: 4861984 - DNA, 22 bp, Homo sapiens
gctaggcctccgttgtctggtt

SEQ ID NO: 4861985 - DNA, 11 bp, Homo sapiens
gctagtgcctt

SEQ ID NO: 4861986 - DNA, 19 bp, Homo sapiens
gctagtgggccctctctct

SEQ ID NO: 4861987 - DNA, 22 bp, Homo sapiens
gctagtgggccctctctctggg

SEQ ID NO: 4861988 - DNA, 22 bp, Homo sapiens
gctagttatacttatttgtata

SEQ ID NO: 4861989 - DNA, 20 bp, Homo sapiens
gctatcttttttagtgttaa

SEQ ID NO: 4861990 - DNA, 12 bp, Homo sapiens
gctattaaaaaa

SEQ ID NO: 4861991 - DNA, 17 bp, Homo sapiens
gctattttctaaagact

SEQ ID NO: 4861992 - DNA, 23 bp, Homo sapiens
gctatttttaatttcctgtgagg

SEQ ID NO: 4861993 - DNA, 18 bp, Homo sapiens
gctcaaagcagcaggact

SEQ ID NO: 4861994 - DNA, 20 bp, Homo sapiens
gctcactcccaagggacagc

SEQ ID NO: 4861995 - DNA, 23 bp, Homo sapiens
gctcagcctggtttctgggtgct

SEQ ID NO: 4861996 - DNA, 14 bp, Homo sapiens
gctcaggagaagcc

SEQ ID NO: 4861997 - DNA, 15 bp, Homo sapiens
gctcaggagaagcca

SEQ ID NO: 4861998 - DNA, 23 bp, Homo sapiens
gctccaatgactgagcagcatcc

SEQ ID NO: 4861999 - DNA, 13 bp, Homo sapiens
gctccacactcag

SEQ ID NO: 4862000 - DNA, 16 bp, Homo sapiens
gctccacactcagaaa

SEQ ID NO: 4862001 - DNA, 17 bp, Homo sapiens
gctcccattcctccctc

SEQ ID NO: 4862002 - DNA, 16 bp, Homo sapiens
gctcccctaaagccag

SEQ ID NO: 4862003 - DNA, 15 bp, Homo sapiens
gctcccctcccaggg

SEQ ID NO: 4862004 - DNA, 16 bp, Homo sapiens
gctcctcacctgtcta

SEQ ID NO: 4862005 - DNA, 15 bp, Homo sapiens
gctcctccccttcct

SEQ ID NO: 4862006 - DNA, 15 bp, Homo sapiens
gctcctctcttgggt

SEQ ID NO: 4862007 - DNA, 15 bp, Homo sapiens
gctcctgtggcagga

SEQ ID NO: 4862008 - DNA, 15 bp, Homo sapiens
gctcctttaccctct

SEQ ID NO: 4862009 - DNA, 13 bp, Homo sapiens
gctcctttcccct

SEQ ID NO: 4862010 - DNA, 20 bp, Homo sapiens
gctctaaaaggtaatgtgtg

SEQ ID NO: 4862011 - DNA, 12 bp, Homo sapiens
gctctagcctct

SEQ ID NO: 4862012 - DNA, 16 bp, Homo sapiens
gctctagcctctggac

SEQ ID NO: 4862013 - DNA, 15 bp, Homo sapiens
gctctagggcctcag

SEQ ID NO: 4862014 - DNA, 19 bp, Homo sapiens
gctctaggtacgatgacag

SEQ ID NO: 4862015 - DNA, 15 bp, Homo sapiens
gctctatactgtggc

SEQ ID NO: 4862016 - DNA, 17 bp, Homo sapiens
gctctcacccccatccc

SEQ ID NO: 4862017 - DNA, 18 bp, Homo sapiens
gctctcacccccatccct

SEQ ID NO: 4862018 - DNA, 14 bp, Homo sapiens
gctctcccctcctg

SEQ ID NO: 4862019 - DNA, 17 bp, Homo sapiens
gctctcccctcctgctg

SEQ ID NO: 4862020 - DNA, 18 bp, Homo sapiens
ctgtttgatataccaaat

SEQ ID NO: 4862021 - DNA, 21 bp, Homo sapiens
ctgtttgatataccaaattaa

SEQ ID NO: 4862022 - DNA, 22 bp, Homo sapiens
ctgtttgcatttgatacatttt

SEQ ID NO: 4862023 - DNA, 20 bp, Homo sapiens
ctgttttgtggtttggaata

SEQ ID NO: 4862024 - DNA, 15 bp, Homo sapiens
cttaaactaaatgtg

SEQ ID NO: 4862025 - DNA, 16 bp, Homo sapiens
cttaaatttaatacca

SEQ ID NO: 4862026 - DNA, 13 bp, Homo sapiens
cttaaattttaac

SEQ ID NO: 4862027 - DNA, 23 bp, Homo sapiens
cttaaattttaactaaattttaa

SEQ ID NO: 4862028 - DNA, 17 bp, Homo sapiens
cttaagtcctaaaagtt

SEQ ID NO: 4862029 - DNA, 22 bp, Homo sapiens
cttaagtcctaaaagttctcaa

SEQ ID NO: 4862030 - DNA, 16 bp, Homo sapiens
cttaattattgatgtt

SEQ ID NO: 4862031 - DNA, 18 bp, Homo sapiens
cttaatttaactttccag

SEQ ID NO: 4862032 - DNA, 11 bp, Homo sapiens
cttacaaactt

SEQ ID NO: 4862033 - DNA, 20 bp, Homo sapiens
cttacaatattgattgggaa

SEQ ID NO: 4862034 - DNA, 15 bp, Homo sapiens
cttacagcctctgac

SEQ ID NO: 4862035 - DNA, 14 bp, Homo sapiens
cttacaggagccag

SEQ ID NO: 4862036 - DNA, 20 bp, Homo sapiens
cttacaggagccagcctgct

SEQ ID NO: 4862037 - DNA, 18 bp, Homo sapiens
cttaccccaaagagaaag

SEQ ID NO: 4862038 - DNA, 15 bp, Homo sapiens
cttacctaacatctg

SEQ ID NO: 4862039 - DNA, 12 bp, Homo sapiens
cttacctgggca

SEQ ID NO: 4862040 - DNA, 13 bp, Homo sapiens
cttacctgggcac

SEQ ID NO: 4862041 - DNA, 17 bp, Homo sapiens
cttacctttcctgatgc

SEQ ID NO: 4862042 - DNA, 13 bp, Homo sapiens
cttactaaaaagt

SEQ ID NO: 4862043 - DNA, 15 bp, Homo sapiens
cttactaaaaagtat

SEQ ID NO: 4862044 - DNA, 17 bp, Homo sapiens
cttactaaaaagtataa

SEQ ID NO: 4862045 - DNA, 17 bp, Homo sapiens
cttacttcaaagtgcct

SEQ ID NO: 4862046 - DNA, 20 bp, Homo sapiens
cttacttcaaagtgcctggg

SEQ ID NO: 4862047 - DNA, 22 bp, Homo sapiens
cttacttcaaagtgcctgggct

SEQ ID NO: 4862048 - DNA, 13 bp, Homo sapiens
cttactttgctga

SEQ ID NO: 4862049 - DNA, 21 bp, Homo sapiens
cttagactctagtatttatgg

SEQ ID NO: 4862050 - DNA, 14 bp, Homo sapiens
cttagagctcttgt

SEQ ID NO: 4862051 - DNA, 22 bp, Homo sapiens
cttagctgaggctgagaaagct

SEQ ID NO: 4862052 - DNA, 13 bp, Homo sapiens
cttaggctactgt

SEQ ID NO: 4862053 - DNA, 15 bp, Homo sapiens
cttaggggaaggaga

SEQ ID NO: 4862054 - DNA, 22 bp, Homo sapiens
cttataacctagttaaagaaag

SEQ ID NO: 4862055 - DNA, 20 bp, Homo sapiens
cttatctgaaaggccagcag

SEQ ID NO: 4862056 - DNA, 16 bp, Homo sapiens
cttattacattttatt

SEQ ID NO: 4862057 - DNA, 20 bp, Homo sapiens
cttattatgtaggtaagact

SEQ ID NO: 4862058 - DNA, 16 bp, Homo sapiens
cttattctttgagtaa

SEQ ID NO: 4862059 - DNA, 14 bp, Homo sapiens
cttattgaccattt

SEQ ID NO: 4862060 - DNA, 15 bp, Homo sapiens
cttatttaatctttt

SEQ ID NO: 4862061 - DNA, 21 bp, Homo sapiens
cttatttatagaatttaatat

SEQ ID NO: 4862062 - DNA, 16 bp, Homo sapiens
cttcaaaaagccacag

SEQ ID NO: 4862063 - DNA, 18 bp, Homo sapiens
cttcaaaaagccacagca

SEQ ID NO: 4862064 - DNA, 17 bp, Homo sapiens
cttcaaagtgcctgggc

SEQ ID NO: 4862065 - DNA, 19 bp, Homo sapiens
cttcaaagtgcctgggctc

SEQ ID NO: 4862066 - DNA, 22 bp, Homo sapiens
cttcaacagccaagctggcaca

SEQ ID NO: 4862067 - DNA, 19 bp, Homo sapiens
cttcaaggctcttcttcct

SEQ ID NO: 4862068 - DNA, 14 bp, Homo sapiens
cttcacacagacac

SEQ ID NO: 4862069 - DNA, 13 bp, Homo sapiens
cttcacctccttc

SEQ ID NO: 4862070 - DNA, 13 bp, Homo sapiens
cttcactctggct

SEQ ID NO: 4862071 - DNA, 14 bp, Homo sapiens
cttcactctggctt

SEQ ID NO: 4862072 - DNA, 16 bp, Homo sapiens
cttcactctggcttca

SEQ ID NO: 4862073 - DNA, 15 bp, Homo sapiens
cttcactgccccctc

SEQ ID NO: 4862074 - DNA, 18 bp, Homo sapiens
cttcagccaggtctgact

SEQ ID NO: 4862075 - DNA, 21 bp, Homo sapiens
cttcagccaggtctgactcca

SEQ ID NO: 4862076 - DNA, 11 bp, Homo sapiens
cttcaggagcc

SEQ ID NO: 4862077 - DNA, 12 bp, Homo sapiens
cttcaggagcct

SEQ ID NO: 4862078 - DNA, 19 bp, Homo sapiens
cttcaggagcctggccagg

SEQ ID NO: 4862079 - DNA, 19 bp, Homo sapiens
cttcagtgtcccaccttga

SEQ ID NO: 4862080 - DNA, 16 bp, Homo sapiens
cttcatgacagcctcc

SEQ ID NO: 4862081 - DNA, 14 bp, Homo sapiens
cttcatgcctgatg

SEQ ID NO: 4862082 - DNA, 15 bp, Homo sapiens
cttcatgtttggaaa

SEQ ID NO: 4862083 - DNA, 20 bp, Homo sapiens
cttccaacatatatttattg

SEQ ID NO: 4862084 - DNA, 22 bp, Homo sapiens
cttccacccacaaactccaggc

SEQ ID NO: 4862085 - DNA, 23 bp, Homo sapiens
cttccacccacaaactccaggct

SEQ ID NO: 4862086 - DNA, 13 bp, Homo sapiens
cttccacttctgg

SEQ ID NO: 4862087 - DNA, 17 bp, Homo sapiens
cttccatccatctttcc

SEQ ID NO: 4862088 - DNA, 12 bp, Homo sapiens
cttcccactcca

SEQ ID NO: 4862089 - DNA, 12 bp, Homo sapiens
cttcccctaaac

SEQ ID NO: 4862090 - DNA, 12 bp, Homo sapiens
cttccctgggtt

SEQ ID NO: 4862091 - DNA, 13 bp, Homo sapiens
cttcctcctccca

SEQ ID NO: 4862092 - DNA, 14 bp, Homo sapiens
cttcctcctctcaa

SEQ ID NO: 4862093 - DNA, 11 bp, Homo sapiens
cttcctcctga

SEQ ID NO: 4862094 - DNA, 12 bp, Homo sapiens
cttcctcctgat

SEQ ID NO: 4862095 - DNA, 21 bp, Homo sapiens
cttcctcctgatggagtgtgc

SEQ ID NO: 4862096 - DNA, 14 bp, Homo sapiens
cttcctcttgtctg

SEQ ID NO: 4862097 - DNA, 17 bp, Homo sapiens
cttcctgctgctgctac

SEQ ID NO: 4862098 - DNA, 22 bp, Homo sapiens
cttcctgctgctgctactgctg

SEQ ID NO: 4862099 - DNA, 11 bp, Homo sapiens
cttccttcaac

SEQ ID NO: 4862100 - DNA, 13 bp, Homo sapiens
cttcgactactgc

SEQ ID NO: 4862101 - DNA, 19 bp, Homo sapiens
cttcgactactgctcctgt

SEQ ID NO: 4862102 - DNA, 22 bp, Homo sapiens
cttcgactactgctcctgtggc

SEQ ID NO: 4862103 - DNA, 12 bp, Homo sapiens
cttcggtggcct

SEQ ID NO: 4862104 - DNA, 16 bp, Homo sapiens
cttcggtggccttgag

SEQ ID NO: 4862105 - DNA, 18 bp, Homo sapiens
cttctagtgatgatggtt

SEQ ID NO: 4862106 - DNA, 23 bp, Homo sapiens
cttctcagtccagcagtttccag

SEQ ID NO: 4862107 - DNA, 17 bp, Homo sapiens
cttctcccctgcccttc

SEQ ID NO: 4862108 - DNA, 13 bp, Homo sapiens
cttcttgaatata

SEQ ID NO: 4862109 - DNA, 15 bp, Homo sapiens
cttctttctccatgg

SEQ ID NO: 4862110 - DNA, 20 bp, Homo sapiens
cttgaaaaaaaacagtggat

SEQ ID NO: 4862111 - DNA, 18 bp, Homo sapiens
cttgaaactttgggaaaa

SEQ ID NO: 4862112 - DNA, 19 bp, Homo sapiens
cttgaactctgttccccca

SEQ ID NO: 4862113 - DNA, 15 bp, Homo sapiens
cttgaatataaaaaa

SEQ ID NO: 4862114 - DNA, 22 bp, Homo sapiens
cttgacacctgctgagaaaaca

SEQ ID NO: 4862115 - DNA, 13 bp, Homo sapiens
cttgactttccag

SEQ ID NO: 4862116 - DNA, 21 bp, Homo sapiens
cttgactttccagaatgacct

SEQ ID NO: 4862117 - DNA, 19 bp, Homo sapiens
cttgagagttccggggaga

SEQ ID NO: 4862118 - DNA, 19 bp, Homo sapiens
cttgagttaacaggacagt

SEQ ID NO: 4862119 - DNA, 14 bp, Homo sapiens
cttgatatcccaag

SEQ ID NO: 4862120 - DNA, 15 bp, Homo sapiens
cttgatatcccaagt

SEQ ID NO: 4862121 - DNA, 18 bp, Homo sapiens
cttgatggggtgagaagt

SEQ ID NO: 4862122 - DNA, 14 bp, Homo sapiens
cttgattaaatcaa

SEQ ID NO: 4862123 - DNA, 18 bp, Homo sapiens
cttgcaacccaaggtgag

SEQ ID NO: 4862124 - DNA, 16 bp, Homo sapiens
cttgcagcggctcctg

SEQ ID NO: 4862125 - DNA, 19 bp, Homo sapiens
cttgcagcggctcctgcaa

SEQ ID NO: 4862126 - DNA, 21 bp, Homo sapiens
cttgcaggggtcccccctcaa

SEQ ID NO: 4862127 - DNA, 23 bp, Homo sapiens
cttgcaggggtcccccctcaaga

SEQ ID NO: 4862128 - DNA, 12 bp, Homo sapiens
cttgcctccagg

SEQ ID NO: 4862129 - DNA, 16 bp, Homo sapiens
cttgcctccaggacct

SEQ ID NO: 4862130 - DNA, 13 bp, Homo sapiens
cttgctgggcttt

SEQ ID NO: 4862131 - DNA, 16 bp, Homo sapiens
cttgctgggctttggg

SEQ ID NO: 4862132 - DNA, 13 bp, Homo sapiens
cttgctggtgcct

SEQ ID NO: 4862133 - DNA, 19 bp, Homo sapiens
cttgcttctgtatttcctt

SEQ ID NO: 4862134 - DNA, 19 bp, Homo sapiens
cttgctttctttgacctct

SEQ ID NO: 4862135 - DNA, 16 bp, Homo sapiens
cttggaaattcctgta

SEQ ID NO: 4862136 - DNA, 16 bp, Homo sapiens
cttggacattttatgt

SEQ ID NO: 4862137 - DNA, 17 bp, Homo sapiens
cttggacattttatgtc

SEQ ID NO: 4862138 - DNA, 22 bp, Homo sapiens
cttggatatataggctattttc

SEQ ID NO: 4862139 - DNA, 20 bp, Homo sapiens
cttggcacttattgaatata

SEQ ID NO: 4862140 - DNA, 23 bp, Homo sapiens
cttggcccccttcaggagcctgg

SEQ ID NO: 4862141 - DNA, 19 bp, Homo sapiens
gatgcatttaataaagatg

SEQ ID NO: 4862142 - DNA, 21 bp, Homo sapiens
gatgcatttaataaagatgag

SEQ ID NO: 4862143 - DNA, 13 bp, Homo sapiens
gatgctggctggg

SEQ ID NO: 4862144 - DNA, 19 bp, Homo sapiens
gatgctgggcaatgaggca

SEQ ID NO: 4862145 - DNA, 21 bp, Homo sapiens
gatgctgggcaatgaggcaga

SEQ ID NO: 4862146 - DNA, 20 bp, Homo sapiens
gatgcttgcggcaaaaggaa

SEQ ID NO: 4862147 - DNA, 12 bp, Homo sapiens
gatggagggaag

SEQ ID NO: 4862148 - DNA, 14 bp, Homo sapiens
gatggagtgtgcag

SEQ ID NO: 4862149 - DNA, 19 bp, Homo sapiens
gatggagtgtgcagacagc

SEQ ID NO: 4862150 - DNA, 13 bp, Homo sapiens
gatggggtgagaa

SEQ ID NO: 4862151 - DNA, 23 bp, Homo sapiens
gatgggtgccctttcctggcagt

SEQ ID NO: 4862152 - DNA, 14 bp, Homo sapiens
gatggtaagagaaa

SEQ ID NO: 4862153 - DNA, 23 bp, Homo sapiens
gatgtcagctgctgttgaacttt

SEQ ID NO: 4862154 - DNA, 19 bp, Homo sapiens
gatgtccttaaaatgtggt

SEQ ID NO: 4862155 - DNA, 19 bp, Homo sapiens
gatgtctttttattaaaat

SEQ ID NO: 4862156 - DNA, 17 bp, Homo sapiens
gatgtgcagtttggaat

SEQ ID NO: 4862157 - DNA, 22 bp, Homo sapiens
gatgttatacatcaatatgtat

SEQ ID NO: 4862158 - DNA, 22 bp, Homo sapiens
gatgttctattttttgttttgt

SEQ ID NO: 4862159 - DNA, 15 bp, Homo sapiens
gattagtgatgtcct

SEQ ID NO: 4862160 - DNA, 17 bp, Homo sapiens
gattatttaagactaaa

SEQ ID NO: 4862161 - DNA, 23 bp, Homo sapiens
gattgactaactcaaatacacat

SEQ ID NO: 4862162 - DNA, 22 bp, Homo sapiens
gattgcatttttattaaagcat

SEQ ID NO: 4862163 - DNA, 13 bp, Homo sapiens
gattgcctctgaa

SEQ ID NO: 4862164 - DNA, 16 bp, Homo sapiens
gattgctctggagcag

SEQ ID NO: 4862165 - DNA, 23 bp, Homo sapiens
gattgctctggagcagccaaggc

SEQ ID NO: 4862166 - DNA, 19 bp, Homo sapiens
gattggggggtgggctttg

SEQ ID NO: 4862167 - DNA, 16 bp, Homo sapiens
gatttaaaagcctgct

SEQ ID NO: 4862168 - DNA, 14 bp, Homo sapiens
gatttcactaggac

SEQ ID NO: 4862169 - DNA, 23 bp, Homo sapiens
gatttccctccagagaaagcaca

SEQ ID NO: 4862170 - DNA, 15 bp, Homo sapiens
gatttctcattgact

SEQ ID NO: 4862171 - DNA, 16 bp, Homo sapiens
gatttctcattgactt

SEQ ID NO: 4862172 - DNA, 16 bp, Homo sapiens
gatttgaaaaatataa

SEQ ID NO: 4862173 - DNA, 21 bp, Homo sapiens
gatttgaaaaatataaaatta

SEQ ID NO: 4862174 - DNA, 19 bp, Homo sapiens
gatttggcactagccaaag

SEQ ID NO: 4862175 - DNA, 22 bp, Homo sapiens
gatttttgccctgcgtcccttc

SEQ ID NO: 4862176 - DNA, 13 bp, Homo sapiens
gcaaaaataatca

SEQ ID NO: 4862177 - DNA, 16 bp, Homo sapiens
gcaaacccattaaggg

SEQ ID NO: 4862178 - DNA, 13 bp, Homo sapiens
gcaaactctgctg

SEQ ID NO: 4862179 - DNA, 14 bp, Homo sapiens
gcaaactctgctgt

SEQ ID NO: 4862180 - DNA, 18 bp, Homo sapiens
gcaaaggtgcactccaga

SEQ ID NO: 4862181 - DNA, 19 bp, Homo sapiens
gcaaaggtgcactccagac

SEQ ID NO: 4862182 - DNA, 14 bp, Homo sapiens
gcaaagtcgccagt

SEQ ID NO: 4862183 - DNA, 18 bp, Homo sapiens
gcaaagtcgccagtcact

SEQ ID NO: 4862184 - DNA, 23 bp, Homo sapiens
gcaaagtcgccagtcactgctgc

SEQ ID NO: 4862185 - DNA, 18 bp, Homo sapiens
gcaaatagattcagagaa

SEQ ID NO: 4862186 - DNA, 12 bp, Homo sapiens
gcaaatgttaaa

SEQ ID NO: 4862187 - DNA, 19 bp, Homo sapiens
gcaaatgttgggaaagtat

SEQ ID NO: 4862188 - DNA, 20 bp, Homo sapiens
gcaaatgttgggaaagtatt

SEQ ID NO: 4862189 - DNA, 15 bp, Homo sapiens
gcaacatctctgaat

SEQ ID NO: 4862190 - DNA, 15 bp, Homo sapiens
gcaagaaagcttcct

SEQ ID NO: 4862191 - DNA, 17 bp, Homo sapiens
gcaagaaagcttccttc

SEQ ID NO: 4862192 - DNA, 17 bp, Homo sapiens
gcaagaccctcccatgg

SEQ ID NO: 4862193 - DNA, 18 bp, Homo sapiens
gcaagaggcaagctgaaa

SEQ ID NO: 4862194 - DNA, 17 bp, Homo sapiens
gcaagagtaagcagtgt

SEQ ID NO: 4862195 - DNA, 20 bp, Homo sapiens
gcaagcaccaacctccagac

SEQ ID NO: 4862196 - DNA, 16 bp, Homo sapiens
gcaaggcagagccttt

SEQ ID NO: 4862197 - DNA, 20 bp, Homo sapiens
gcaaggtggcctctgcctgg

SEQ ID NO: 4862198 - DNA, 13 bp, Homo sapiens
gcaagtgagcaga

SEQ ID NO: 4862199 - DNA, 15 bp, Homo sapiens
gcaagtgagcagaga

SEQ ID NO: 4862200 - DNA, 22 bp, Homo sapiens
gcaagtgagcagagatgtactg

SEQ ID NO: 4862201 - DNA, 16 bp, Homo sapiens
gcaagtgtgcactcca

SEQ ID NO: 4862202 - DNA, 14 bp, Homo sapiens
gcaataaaatttaa

SEQ ID NO: 4862203 - DNA, 14 bp, Homo sapiens
gcaatactgcttaa

SEQ ID NO: 4862204 - DNA, 21 bp, Homo sapiens
gcaattgcgaccttaatttaa

SEQ ID NO: 4862205 - DNA, 16 bp, Homo sapiens
gcacaaaagacagctg

SEQ ID NO: 4862206 - DNA, 18 bp, Homo sapiens
gcacaaagaagaaagctg

SEQ ID NO: 4862207 - DNA, 15 bp, Homo sapiens
gcacatctgttttgt

SEQ ID NO: 4862208 - DNA, 21 bp, Homo sapiens
gcacattaactgttgcacttt

SEQ ID NO: 4862209 - DNA, 15 bp, Homo sapiens
gcaccaacctccaga

SEQ ID NO: 4862210 - DNA, 16 bp, Homo sapiens
gcaccaacctccagac

SEQ ID NO: 4862211 - DNA, 20 bp, Homo sapiens
gcaccaacctccagactcag

SEQ ID NO: 4862212 - DNA, 21 bp, Homo sapiens
gcaccaacctccagactcagc

SEQ ID NO: 4862213 - DNA, 21 bp, Homo sapiens
gcaccaggggccaacctcagg

SEQ ID NO: 4862214 - DNA, 20 bp, Homo sapiens
gcaccatactccttgcttcc

SEQ ID NO: 4862215 - DNA, 23 bp, Homo sapiens
gcaccatactccttgcttcctga

SEQ ID NO: 4862216 - DNA, 12 bp, Homo sapiens
gcactagccttc

SEQ ID NO: 4862217 - DNA, 13 bp, Homo sapiens
gcactccagactc

SEQ ID NO: 4862218 - DNA, 18 bp, Homo sapiens
gcactccagactctgggg

SEQ ID NO: 4862219 - DNA, 15 bp, Homo sapiens
gcactgaacagaatt

SEQ ID NO: 4862220 - DNA, 18 bp, Homo sapiens
gcacttattgaccatttt

SEQ ID NO: 4862221 - DNA, 12 bp, Homo sapiens
gcacttgagttt

SEQ ID NO: 4862222 - DNA, 16 bp, Homo sapiens
gcagaaccttctttgg

SEQ ID NO: 4862223 - DNA, 22 bp, Homo sapiens
gcagaagaatgggaatatttta

SEQ ID NO: 4862224 - DNA, 12 bp, Homo sapiens
gcagacctggag

SEQ ID NO: 4862225 - DNA, 14 bp, Homo sapiens
gcagacctggagct

SEQ ID NO: 4862226 - DNA, 19 bp, Homo sapiens
gcagagaaatgccccagtg

SEQ ID NO: 4862227 - DNA, 20 bp, Homo sapiens
gcagagaccataagagaaac

SEQ ID NO: 4862228 - DNA, 22 bp, Homo sapiens
gcagagaccataagagaaacct

SEQ ID NO: 4862229 - DNA, 15 bp, Homo sapiens
gcagagatgtactgc

SEQ ID NO: 4862230 - DNA, 23 bp, Homo sapiens
gcagagcaggacctgggacagga

SEQ ID NO: 4862231 - DNA, 20 bp, Homo sapiens
gcagagcctttttacctggc

SEQ ID NO: 4862232 - DNA, 22 bp, Homo sapiens
gcagagcggggtcccctctgtg

SEQ ID NO: 4862233 - DNA, 20 bp, Homo sapiens
gcagagctctcccctcctgc

SEQ ID NO: 4862234 - DNA, 23 bp, Homo sapiens
gcagagctctcccctcctgctgg

SEQ ID NO: 4862235 - DNA, 20 bp, Homo sapiens
gcagagcttgtggtggggca

SEQ ID NO: 4862236 - DNA, 20 bp, Homo sapiens
gcagaggtggggtgctgggg

SEQ ID NO: 4862237 - DNA, 14 bp, Homo sapiens
gcagagtctgtctc

SEQ ID NO: 4862238 - DNA, 15 bp, Homo sapiens
gcagatgacagaggt

SEQ ID NO: 4862239 - DNA, 15 bp, Homo sapiens
gcagcaggccagaga

SEQ ID NO: 4862240 - DNA, 13 bp, Homo sapiens
gcagcaggcctct

SEQ ID NO: 4862241 - DNA, 15 bp, Homo sapiens
gcagcaggcctctgg

SEQ ID NO: 4862242 - DNA, 17 bp, Homo sapiens
gcagcaggcctctggga

SEQ ID NO: 4862243 - DNA, 19 bp, Homo sapiens
gcagcagtcgcccaagcag

SEQ ID NO: 4862244 - DNA, 22 bp, Homo sapiens
gcagccaaggccgccagcgtgt

SEQ ID NO: 4862245 - DNA, 14 bp, Homo sapiens
gcagccccaggaga

SEQ ID NO: 4862246 - DNA, 15 bp, Homo sapiens
gcagccccaggagaa

SEQ ID NO: 4862247 - DNA, 16 bp, Homo sapiens
gcagccccaggagaag

SEQ ID NO: 4862248 - DNA, 18 bp, Homo sapiens
gcagcctaagaagaaggc

SEQ ID NO: 4862249 - DNA, 23 bp, Homo sapiens
gcagcctagcctatgtctggcag

SEQ ID NO: 4862250 - DNA, 17 bp, Homo sapiens
gcagcggattgctctgg

SEQ ID NO: 4862251 - DNA, 13 bp, Homo sapiens
gcagcggctcctg

SEQ ID NO: 4862252 - DNA, 15 bp, Homo sapiens
gcagctagtgccttt

SEQ ID NO: 4862253 - DNA, 12 bp, Homo sapiens
gcagctgaaatt

SEQ ID NO: 4862254 - DNA, 15 bp, Homo sapiens
gcagcttgctgggct

SEQ ID NO: 4862255 - DNA, 17 bp, Homo sapiens
gcaggaaagactggccc

SEQ ID NO: 4862256 - DNA, 22 bp, Homo sapiens
gcaggaacggtggaggcagagg

SEQ ID NO: 4862257 - DNA, 17 bp, Homo sapiens
gcaggagtctctgccag

SEQ ID NO: 4862258 - DNA, 21 bp, Homo sapiens
gcaggagtctctgccagttac

SEQ ID NO: 4862259 - DNA, 12 bp, Homo sapiens
gcaggcctctgg

SEQ ID NO: 4862260 - DNA, 21 bp, Homo sapiens
gcaggcctctgggacccacag

SEQ ID NO: 4862261 - DNA, 22 bp, Homo sapiens
ctcccacagcagccccaggaga

SEQ ID NO: 4862262 - DNA, 14 bp, Homo sapiens
ctcccacccaccgc

SEQ ID NO: 4862263 - DNA, 23 bp, Homo sapiens
ctcccagaacctctaagtgctgc

SEQ ID NO: 4862264 - DNA, 21 bp, Homo sapiens
ctcccagctctagcctctgga

SEQ ID NO: 4862265 - DNA, 23 bp, Homo sapiens
ctcccaggggagccagctgcttg

SEQ ID NO: 4862266 - DNA, 13 bp, Homo sapiens
ctccccacccgct

SEQ ID NO: 4862267 - DNA, 12 bp, Homo sapiens
ctccccagctca

SEQ ID NO: 4862268 - DNA, 15 bp, Homo sapiens
ctcccccagaggtgg

SEQ ID NO: 4862269 - DNA, 18 bp, Homo sapiens
ctcccctaaagccaggct

SEQ ID NO: 4862270 - DNA, 21 bp, Homo sapiens
ctcccctcacacacaaattga

SEQ ID NO: 4862271 - DNA, 22 bp, Homo sapiens
ctcccctcccaggggagccagc

SEQ ID NO: 4862272 - DNA, 23 bp, Homo sapiens
ctcccctcccaggggagccagct

SEQ ID NO: 4862273 - DNA, 17 bp, Homo sapiens
ctccctcagctctctgg

SEQ ID NO: 4862274 - DNA, 19 bp, Homo sapiens
ctcctatatcctccttctc

SEQ ID NO: 4862275 - DNA, 15 bp, Homo sapiens
ctcctattctataaa

SEQ ID NO: 4862276 - DNA, 16 bp, Homo sapiens
ctcctattctataaaa

SEQ ID NO: 4862277 - DNA, 15 bp, Homo sapiens
ctcctcacctgtcta

SEQ ID NO: 4862278 - DNA, 14 bp, Homo sapiens
ctcctcagggtggg

SEQ ID NO: 4862279 - DNA, 19 bp, Homo sapiens
ctggaggtaaacaaagact

SEQ ID NO: 4862280 - DNA, 20 bp, Homo sapiens
ctggatggaaagacaaactg

SEQ ID NO: 4862281 - DNA, 16 bp, Homo sapiens
ctggatggtggtgcat

SEQ ID NO: 4862282 - DNA, 17 bp, Homo sapiens
ctggatggtggtgcatc

SEQ ID NO: 4862283 - DNA, 12 bp, Homo sapiens
ctggatgtctgg

SEQ ID NO: 4862284 - DNA, 14 bp, Homo sapiens
ctggatgtctggct

SEQ ID NO: 4862285 - DNA, 17 bp, Homo sapiens
ctggatttgcagaagtt

SEQ ID NO: 4862286 - DNA, 22 bp, Homo sapiens
ctggcacaaaagacagctggcg

SEQ ID NO: 4862287 - DNA, 22 bp, Homo sapiens
ctggcacaatgttggagcagca

SEQ ID NO: 4862288 - DNA, 16 bp, Homo sapiens
ctggcagatgagggct

SEQ ID NO: 4862289 - DNA, 21 bp, Homo sapiens
ctggcagatgggggcctctct

SEQ ID NO: 4862290 - DNA, 17 bp, Homo sapiens
ctggccaggcagggaga

SEQ ID NO: 4862291 - DNA, 22 bp, Homo sapiens
ctggccggagcaaactctgctg

SEQ ID NO: 4862292 - DNA, 19 bp, Homo sapiens
ctggcctgagaattgaggg

SEQ ID NO: 4862293 - DNA, 21 bp, Homo sapiens
ctggcctgagaattgagggga

SEQ ID NO: 4862294 - DNA, 13 bp, Homo sapiens
ctggccttgcctc

SEQ ID NO: 4862295 - DNA, 19 bp, Homo sapiens
ctggcgccatcgccgggac

SEQ ID NO: 4862296 - DNA, 14 bp, Homo sapiens
ctggctgttctgat

SEQ ID NO: 4862297 - DNA, 21 bp, Homo sapiens
ctggcttcaaaaagccacagc

SEQ ID NO: 4862298 - DNA, 14 bp, Homo sapiens
ctgggacccacaga

SEQ ID NO: 4862299 - DNA, 18 bp, Homo sapiens
ctgggacccacagaactt

SEQ ID NO: 4862300 - DNA, 17 bp, Homo sapiens
ctgggcaatgaggcaga

SEQ ID NO: 4862301 - DNA, 12 bp, Homo sapiens
ctgggcacaaac

SEQ ID NO: 4862302 - DNA, 15 bp, Homo sapiens
ctgggcacaaacaga

SEQ ID NO: 4862303 - DNA, 19 bp, Homo sapiens
ctgggcactggggcctcag

SEQ ID NO: 4862304 - DNA, 16 bp, Homo sapiens
ctgggcattagcaagg

SEQ ID NO: 4862305 - DNA, 13 bp, Homo sapiens
ctgggcccagggg

SEQ ID NO: 4862306 - DNA, 18 bp, Homo sapiens
ctgggcctcccctgggca

SEQ ID NO: 4862307 - DNA, 15 bp, Homo sapiens
ctgggctcagcctgg

SEQ ID NO: 4862308 - DNA, 18 bp, Homo sapiens
ctgggctcagcctggttt

SEQ ID NO: 4862309 - DNA, 16 bp, Homo sapiens
ctgggctgtgaggaca

SEQ ID NO: 4862310 - DNA, 17 bp, Homo sapiens
ctgggcttggggtgtgg

SEQ ID NO: 4862311 - DNA, 20 bp, Homo sapiens
ctggggagccctattgctgc

SEQ ID NO: 4862312 - DNA, 21 bp, Homo sapiens
ctggggagccctattgctgct

SEQ ID NO: 4862313 - DNA, 14 bp, Homo sapiens
ctggggcagggtgg

SEQ ID NO: 4862314 - DNA, 19 bp, Homo sapiens
ctgggggccttgggtgagt

SEQ ID NO: 4862315 - DNA, 12 bp, Homo sapiens
ctggggggcagg

SEQ ID NO: 4862316 - DNA, 17 bp, Homo sapiens
ctgggtcacatccatcc

SEQ ID NO: 4862317 - DNA, 17 bp, Homo sapiens
ctgggttgcctttattt

SEQ ID NO: 4862318 - DNA, 17 bp, Homo sapiens
ctgggtttgggagccag

SEQ ID NO: 4862319 - DNA, 21 bp, Homo sapiens
ctggtgaacactgtgaccagg

SEQ ID NO: 4862320 - DNA, 17 bp, Homo sapiens
ctggtgggacagtggtg

SEQ ID NO: 4862321 - DNA, 17 bp, Homo sapiens
ctggtgtaatctcaatg

SEQ ID NO: 4862322 - DNA, 20 bp, Homo sapiens
ctggtgtaatctcaatgcaa

SEQ ID NO: 4862323 - DNA, 20 bp, Homo sapiens
ctggttcggctctagggcct

SEQ ID NO: 4862324 - DNA, 12 bp, Homo sapiens
ctgtaaagatgt

SEQ ID NO: 4862325 - DNA, 15 bp, Homo sapiens
ctgtaacattcagga

SEQ ID NO: 4862326 - DNA, 16 bp, Homo sapiens
ctgtaacttccaaata

SEQ ID NO: 4862327 - DNA, 20 bp, Homo sapiens
ctgtaacttccaaataaata

SEQ ID NO: 4862328 - DNA, 12 bp, Homo sapiens
ctgtaataatag

SEQ ID NO: 4862329 - DNA, 15 bp, Homo sapiens
ctgtactaacccagt

SEQ ID NO: 4862330 - DNA, 18 bp, Homo sapiens
ctgtactaacccagtctt

SEQ ID NO: 4862331 - DNA, 21 bp, Homo sapiens
ctgtactaacccagtctttct

SEQ ID NO: 4862332 - DNA, 22 bp, Homo sapiens
ctgtactaacccagtctttctt

SEQ ID NO: 4862333 - DNA, 15 bp, Homo sapiens
ctgtactgaataggt

SEQ ID NO: 4862334 - DNA, 13 bp, Homo sapiens
ctgtactgcatgt

SEQ ID NO: 4862335 - DNA, 14 bp, Homo sapiens
ctgtactttcccag

SEQ ID NO: 4862336 - DNA, 15 bp, Homo sapiens
ctgtactttcccagg

SEQ ID NO: 4862337 - DNA, 18 bp, Homo sapiens
ctgtactttcccaggttg

SEQ ID NO: 4862338 - DNA, 19 bp, Homo sapiens
ctgtactttcccaggttga

SEQ ID NO: 4862339 - DNA, 17 bp, Homo sapiens
ctgtagagccaattaga

SEQ ID NO: 4862340 - DNA, 20 bp, Homo sapiens
ctgtagatatgtattctttt

SEQ ID NO: 4862341 - DNA, 14 bp, Homo sapiens
ctgtatattcagga

SEQ ID NO: 4862342 - DNA, 14 bp, Homo sapiens
ctgtatcactgcct

SEQ ID NO: 4862343 - DNA, 23 bp, Homo sapiens
ctgtatgggggagattgaacttt

SEQ ID NO: 4862344 - DNA, 16 bp, Homo sapiens
ctgtatgtggtgtggg

SEQ ID NO: 4862345 - DNA, 20 bp, Homo sapiens
ctgtattccgatacaaagtg

SEQ ID NO: 4862346 - DNA, 15 bp, Homo sapiens
ctgtatttttctaaa

SEQ ID NO: 4862347 - DNA, 11 bp, Homo sapiens
ctgtcactgtc

SEQ ID NO: 4862348 - DNA, 15 bp, Homo sapiens
ctgtcattgcacata

SEQ ID NO: 4862349 - DNA, 16 bp, Homo sapiens
ctgtccctagggctct

SEQ ID NO: 4862350 - DNA, 21 bp, Homo sapiens
ctgtccctagggctctccaag

SEQ ID NO: 4862351 - DNA, 22 bp, Homo sapiens
ctgtccgtgccccttccctggg

SEQ ID NO: 4862352 - DNA, 16 bp, Homo sapiens
ctgtctaacttgggga

SEQ ID NO: 4862353 - DNA, 20 bp, Homo sapiens
ctgtctaacttggggaaggg

SEQ ID NO: 4862354 - DNA, 19 bp, Homo sapiens
ctgtctcccggctcccctc

SEQ ID NO: 4862355 - DNA, 16 bp, Homo sapiens
ctgtctgaagccaatg

SEQ ID NO: 4862356 - DNA, 17 bp, Homo sapiens
ctgtctgagacaggtgc

SEQ ID NO: 4862357 - DNA, 19 bp, Homo sapiens
ctgtcttaaactaaatgtg

SEQ ID NO: 4862358 - DNA, 14 bp, Homo sapiens
ctgtcttctttctc

SEQ ID NO: 4862359 - DNA, 21 bp, Homo sapiens
ctgtgaacaagcttcagtaag

SEQ ID NO: 4862360 - DNA, 17 bp, Homo sapiens
ctgtgactgaagaagat

SEQ ID NO: 4862361 - DNA, 12 bp, Homo sapiens
ctgtgagcacaa

SEQ ID NO: 4862362 - DNA, 16 bp, Homo sapiens
ctgtgagcacaaagaa

SEQ ID NO: 4862363 - DNA, 18 bp, Homo sapiens
ctgtgagcacaaagaaga

SEQ ID NO: 4862364 - DNA, 21 bp, Homo sapiens
ctgtgagcacaaagaagaaag

SEQ ID NO: 4862365 - DNA, 16 bp, Homo sapiens
ctgtgaggacagggcc

SEQ ID NO: 4862366 - DNA, 13 bp, Homo sapiens
ctgtgaggactgg

SEQ ID NO: 4862367 - DNA, 23 bp, Homo sapiens
ctgtgaggatagagacttgcagt

SEQ ID NO: 4862368 - DNA, 19 bp, Homo sapiens
ctgtgagtaggctgggcct

SEQ ID NO: 4862369 - DNA, 14 bp, Homo sapiens
ctgtgctccacact

SEQ ID NO: 4862370 - DNA, 18 bp, Homo sapiens
ctgtgctccacactcaga

SEQ ID NO: 4862371 - DNA, 17 bp, Homo sapiens
ctgtgcttcgactactg

SEQ ID NO: 4862372 - DNA, 12 bp, Homo sapiens
ctgtgctttgga

SEQ ID NO: 4862373 - DNA, 15 bp, Homo sapiens
ctgtgctttggaaca

SEQ ID NO: 4862374 - DNA, 19 bp, Homo sapiens
ctgtggaaggcagagaaat

SEQ ID NO: 4862375 - DNA, 20 bp, Homo sapiens
ctgtggcaaaaagagtcaga

SEQ ID NO: 4862376 - DNA, 17 bp, Homo sapiens
ctgtggcataaattgca

SEQ ID NO: 4862377 - DNA, 17 bp, Homo sapiens
ctgtggccgtctcctcc

SEQ ID NO: 4862378 - DNA, 18 bp, Homo sapiens
ctgtggccgtctcctccc

SEQ ID NO: 4862379 - DNA, 20 bp, Homo sapiens
ctgtggccgtctcctccctc

SEQ ID NO: 4862380 - DNA, 14 bp, Homo sapiens
ctgtgggaaagagc

SEQ ID NO: 4862381 - DNA, 13 bp, Homo sapiens
ctgtgggcaaagt

SEQ ID NO: 4862382 - DNA, 19 bp, Homo sapiens
ctgtgggcaaagtcctcct

SEQ ID NO: 4862383 - DNA, 14 bp, Homo sapiens
ctgtgtgattaaaa

SEQ ID NO: 4862384 - DNA, 20 bp, Homo sapiens
ctgtgttcgactcagcctca

SEQ ID NO: 4862385 - DNA, 21 bp, Homo sapiens
ctgtgttcgactcagcctcag

SEQ ID NO: 4862386 - DNA, 22 bp, Homo sapiens
ctgtgttcgactcagcctcagg

SEQ ID NO: 4862387 - DNA, 17 bp, Homo sapiens
ctgtgttttgaaagaat

SEQ ID NO: 4862388 - DNA, 23 bp, Homo sapiens
ctgttaaggacccttttaagcat

SEQ ID NO: 4862389 - DNA, 20 bp, Homo sapiens
ctgttacttatgtagaaact

SEQ ID NO: 4862390 - DNA, 23 bp, Homo sapiens
ctgttacttatgtagaaactgag

SEQ ID NO: 4862391 - DNA, 22 bp, Homo sapiens
ccatttcaggactctctccagg

SEQ ID NO: 4862392 - DNA, 23 bp, Homo sapiens
ccatttcaggactctctccagga

SEQ ID NO: 4862393 - DNA, 21 bp, Homo sapiens
ccattttaattttaaagtgca

SEQ ID NO: 4862394 - DNA, 14 bp, Homo sapiens
ccattttgcctctg

SEQ ID NO: 4862395 - DNA, 18 bp, Homo sapiens
ccattttttaatttactt

SEQ ID NO: 4862396 - DNA, 13 bp, Homo sapiens
cccaaacctggga

SEQ ID NO: 4862397 - DNA, 15 bp, Homo sapiens
cccaagggggctgct

SEQ ID NO: 4862398 - DNA, 14 bp, Homo sapiens
cccaaggtcctctc

SEQ ID NO: 4862399 - DNA, 22 bp, Homo sapiens
cccaaggtgaggtgaactccag

SEQ ID NO: 4862400 - DNA, 13 bp, Homo sapiens
cccaatgctgctt

SEQ ID NO: 4862401 - DNA, 17 bp, Homo sapiens
cccacaaactccaggct

SEQ ID NO: 4862402 - DNA, 20 bp, Homo sapiens
cccacaaactccaggctgga

SEQ ID NO: 4862403 - DNA, 11 bp, Homo sapiens
cccacagaact

SEQ ID NO: 4862404 - DNA, 22 bp, Homo sapiens
cccacaggggccatgtcctctc

SEQ ID NO: 4862405 - DNA, 18 bp, Homo sapiens
cccaccagttgctgctgc

SEQ ID NO: 4862406 - DNA, 17 bp, Homo sapiens
cccaccattctacctga

SEQ ID NO: 4862407 - DNA, 15 bp, Homo sapiens
cccaccctccatgct

SEQ ID NO: 4862408 - DNA, 21 bp, Homo sapiens
cccaccctccggcgggtgaca

SEQ ID NO: 4862409 - DNA, 23 bp, Homo sapiens
cccaccctccggcgggtgacagc

SEQ ID NO: 4862410 - DNA, 11 bp, Homo sapiens
cccacctccac

SEQ ID NO: 4862411 - DNA, 22 bp, Homo sapiens
cccagaacctctaagtgctgct

SEQ ID NO: 4862412 - DNA, 18 bp, Homo sapiens
cccagaaccttgatgggg

SEQ ID NO: 4862413 - DNA, 10 bp, Homo sapiens
cccagagctg

SEQ ID NO: 4862414 - DNA, 20 bp, Homo sapiens
cccagaggtggatactgggg

SEQ ID NO: 4862415 - DNA, 22 bp, Homo sapiens
cccagaggtggatactgggggg

SEQ ID NO: 4862416 - DNA, 21 bp, Homo sapiens
cccagaggtgggatcctccct

SEQ ID NO: 4862417 - DNA, 16 bp, Homo sapiens
cccagcacaaagcact

SEQ ID NO: 4862418 - DNA, 22 bp, Homo sapiens
cccagcacaaagcactggcctt

SEQ ID NO: 4862419 - DNA, 18 bp, Homo sapiens
cccagctctagcctctgg

SEQ ID NO: 4862420 - DNA, 20 bp, Homo sapiens
cccagctctagcctctggac

SEQ ID NO: 4862421 - DNA, 21 bp, Homo sapiens
cccagctctagcctctggact

SEQ ID NO: 4862422 - DNA, 22 bp, Homo sapiens
cccagctctagcctctggactg

SEQ ID NO: 4862423 - DNA, 18 bp, Homo sapiens
cccaggcagacaaccttg

SEQ ID NO: 4862424 - DNA, 19 bp, Homo sapiens
cccaggcagacaaccttgt

SEQ ID NO: 4862425 - DNA, 21 bp, Homo sapiens
cccaggcatctgttagcagag

SEQ ID NO: 4862426 - DNA, 18 bp, Homo sapiens
cccaggggagccagctgc

SEQ ID NO: 4862427 - DNA, 15 bp, Homo sapiens
cccagtctttcttca

SEQ ID NO: 4862428 - DNA, 13 bp, Homo sapiens
cccagtgccagca

SEQ ID NO: 4862429 - DNA, 15 bp, Homo sapiens
cccagtgccagcaag

SEQ ID NO: 4862430 - DNA, 18 bp, Homo sapiens
cccagtgttatttattcc

SEQ ID NO: 4862431 - DNA, 21 bp, Homo sapiens
cccagtgttatttattcccca

SEQ ID NO: 4862432 - DNA, 17 bp, Homo sapiens
cccataggccaccccct

SEQ ID NO: 4862433 - DNA, 18 bp, Homo sapiens
cccataggccacccccta

SEQ ID NO: 4862434 - DNA, 18 bp, Homo sapiens
cccatcctaggaaccagc

SEQ ID NO: 4862435 - DNA, 21 bp, Homo sapiens
cccatctttgctgccagctct

SEQ ID NO: 4862436 - DNA, 15 bp, Homo sapiens
cccattcccagcctg

SEQ ID NO: 4862437 - DNA, 18 bp, Homo sapiens
cccattcccagcctgact

SEQ ID NO: 4862438 - DNA, 13 bp, Homo sapiens
cccattcctccct

SEQ ID NO: 4862439 - DNA, 19 bp, Homo sapiens
cccattcctgatcccatgg

SEQ ID NO: 4862440 - DNA, 20 bp, Homo sapiens
ccccacaggcacattaactg

SEQ ID NO: 4862441 - DNA, 13 bp, Homo sapiens
ccccaccctccat

SEQ ID NO: 4862442 - DNA, 21 bp, Homo sapiens
ccccagaggtggatactgggg

SEQ ID NO: 4862443 - DNA, 19 bp, Homo sapiens
ccccagatacctgtgagga

SEQ ID NO: 4862444 - DNA, 13 bp, Homo sapiens
ccccagtgactcc

SEQ ID NO: 4862445 - DNA, 14 bp, Homo sapiens
ccccagtgactcca

SEQ ID NO: 4862446 - DNA, 16 bp, Homo sapiens
ccccagtgactccagg

SEQ ID NO: 4862447 - DNA, 13 bp, Homo sapiens
ccccattcccagc

SEQ ID NO: 4862448 - DNA, 19 bp, Homo sapiens
ccccattcctgatcccatg

SEQ ID NO: 4862449 - DNA, 13 bp, Homo sapiens
cccccaccctcca

SEQ ID NO: 4862450 - DNA, 16 bp, Homo sapiens
cccccttaaatttaat

SEQ ID NO: 4862451 - DNA, 11 bp, Homo sapiens
cccccttcagg

SEQ ID NO: 4862452 - DNA, 12 bp, Homo sapiens
cccccttcagga

SEQ ID NO: 4862453 - DNA, 16 bp, Homo sapiens
cccccttcaggagcct

SEQ ID NO: 4862454 - DNA, 16 bp, Homo sapiens
ccccgcccctcccacg

SEQ ID NO: 4862455 - DNA, 18 bp, Homo sapiens
cccctaaagagcatcctg

SEQ ID NO: 4862456 - DNA, 18 bp, Homo sapiens
cccctaaagccaggctca

SEQ ID NO: 4862457 - DNA, 12 bp, Homo sapiens
cccctatcctct

SEQ ID NO: 4862458 - DNA, 15 bp, Homo sapiens
cccctatcctctgag

SEQ ID NO: 4862459 - DNA, 15 bp, Homo sapiens
cccctcctgctgggc

SEQ ID NO: 4862460 - DNA, 15 bp, Homo sapiens
cccctgctcccattc

SEQ ID NO: 4862461 - DNA, 15 bp, Homo sapiens
ccccttcaggagcct

SEQ ID NO: 4862462 - DNA, 13 bp, Homo sapiens
ccccttccctggg

SEQ ID NO: 4862463 - DNA, 15 bp, Homo sapiens
cccgcccctcccacg

SEQ ID NO: 4862464 - DNA, 17 bp, Homo sapiens
cccgctcccacacccct

SEQ ID NO: 4862465 - DNA, 19 bp, Homo sapiens
cccgggagctgctgccctg

SEQ ID NO: 4862466 - DNA, 21 bp, Homo sapiens
cccgtttgtcaaagaggatgg

SEQ ID NO: 4862467 - DNA, 17 bp, Homo sapiens
ccctaaagagcatcctg

SEQ ID NO: 4862468 - DNA, 14 bp, Homo sapiens
ccctaaagccaggc

SEQ ID NO: 4862469 - DNA, 21 bp, Homo sapiens
ccctaaagccaggctcaggag

SEQ ID NO: 4862470 - DNA, 13 bp, Homo sapiens
ccctaactcctat

SEQ ID NO: 4862471 - DNA, 14 bp, Homo sapiens
ccctacatgtattg

SEQ ID NO: 4862472 - DNA, 20 bp, Homo sapiens
ccctaggatcccgtcttcca

SEQ ID NO: 4862473 - DNA, 13 bp, Homo sapiens
ccctagggctctc

SEQ ID NO: 4862474 - DNA, 12 bp, Homo sapiens
ccctagttcagg

SEQ ID NO: 4862475 - DNA, 17 bp, Homo sapiens
ccctatctcttcctgtc

SEQ ID NO: 4862476 - DNA, 13 bp, Homo sapiens
ccctattgctgct

SEQ ID NO: 4862477 - DNA, 12 bp, Homo sapiens
ccctcaccacag

SEQ ID NO: 4862478 - DNA, 14 bp, Homo sapiens
ccctcaccacagcc

SEQ ID NO: 4862479 - DNA, 18 bp, Homo sapiens
cccttctgggtccaggga

SEQ ID NO: 4862480 - DNA, 18 bp, Homo sapiens
cccttgaaactttgggaa

SEQ ID NO: 4862481 - DNA, 15 bp, Homo sapiens
cccttgacacctgct

SEQ ID NO: 4862482 - DNA, 17 bp, Homo sapiens
cccttgattcattctga

SEQ ID NO: 4862483 - DNA, 14 bp, Homo sapiens
cccttgcaggggtc

SEQ ID NO: 4862484 - DNA, 15 bp, Homo sapiens
ccctttcctggcagt

SEQ ID NO: 4862485 - DNA, 14 bp, Homo sapiens
ccctttctaagcaa

SEQ ID NO: 4862486 - DNA, 18 bp, Homo sapiens
ccgactctgcacccgcct

SEQ ID NO: 4862487 - DNA, 21 bp, Homo sapiens
ccgagtctccgggactgccct

SEQ ID NO: 4862488 - DNA, 12 bp, Homo sapiens
ccgcagagaaat

SEQ ID NO: 4862489 - DNA, 20 bp, Homo sapiens
ccgcaggtgctcatgctgct

SEQ ID NO: 4862490 - DNA, 16 bp, Homo sapiens
ccgccagcgtgtggag

SEQ ID NO: 4862491 - DNA, 17 bp, Homo sapiens
ccgccagcgtgtggagc

SEQ ID NO: 4862492 - DNA, 22 bp, Homo sapiens
ccgccagcgtgtggagcagagc

SEQ ID NO: 4862493 - DNA, 16 bp, Homo sapiens
ccgccgccgccgctgc

SEQ ID NO: 4862494 - DNA, 14 bp, Homo sapiens
ccgcgcgcccaccc

SEQ ID NO: 4862495 - DNA, 15 bp, Homo sapiens
ccgggagctgctgcc

SEQ ID NO: 4862496 - DNA, 19 bp, Homo sapiens
ccggggagaaacccagaga

SEQ ID NO: 4862497 - DNA, 20 bp, Homo sapiens
ccgggggaggggcgcgggag

SEQ ID NO: 4862498 - DNA, 20 bp, Homo sapiens
ccgggtgggcggcacagcct

SEQ ID NO: 4862499 - DNA, 12 bp, Homo sapiens
ccgtaatttaac

SEQ ID NO: 4862500 - DNA, 13 bp, Homo sapiens
ccgtcacagcctc

SEQ ID NO: 4862501 - DNA, 15 bp, Homo sapiens
ccgtcctctcggctg

SEQ ID NO: 4862502 - DNA, 16 bp, Homo sapiens
ccgtcttttcctgttt

SEQ ID NO: 4862503 - DNA, 20 bp, Homo sapiens
ccgtggcagcttgctgggct

SEQ ID NO: 4862504 - DNA, 19 bp, Homo sapiens
cctaaagccaggctcagga

SEQ ID NO: 4862505 - DNA, 23 bp, Homo sapiens
cctaaagccaggctcaggagaag

SEQ ID NO: 4862506 - DNA, 12 bp, Homo sapiens
cctaagaagaag

SEQ ID NO: 4862507 - DNA, 14 bp, Homo sapiens
cctaagaagaaggc

SEQ ID NO: 4862508 - DNA, 16 bp, Homo sapiens
cctaagaagaaggcca

SEQ ID NO: 4862509 - DNA, 17 bp, Homo sapiens
cctaagaatctttagag

SEQ ID NO: 4862510 - DNA, 15 bp, Homo sapiens
cctaagaccctgaat

SEQ ID NO: 4862511 - DNA, 16 bp, Homo sapiens
cctaagaccctgaatc

SEQ ID NO: 4862512 - DNA, 18 bp, Homo sapiens
cctaatcaaattctgtct

SEQ ID NO: 4862513 - DNA, 20 bp, Homo sapiens
cctaatcaaattctgtctgg

SEQ ID NO: 4862514 - DNA, 14 bp, Homo sapiens
cctaattcaatcct

SEQ ID NO: 4862515 - DNA, 19 bp, Homo sapiens
cctacagttttaactgtgg

SEQ ID NO: 4862516 - DNA, 21 bp, Homo sapiens
cctacagttttaactgtggat

SEQ ID NO: 4862517 - DNA, 23 bp, Homo sapiens
cctagaaagggcaaggggtgagg

SEQ ID NO: 4862518 - DNA, 14 bp, Homo sapiens
cctagactgctcct

SEQ ID NO: 4862519 - DNA, 17 bp, Homo sapiens
cctagactgctcctggg

SEQ ID NO: 4862520 - DNA, 13 bp, Homo sapiens
cctaggaaccagc

SEQ ID NO: 4862521 - DNA, 20 bp, Homo sapiens
cctaggatcccgtcttccag

SEQ ID NO: 4862522 - DNA, 21 bp, Homo sapiens
cctaggatcccgtcttccaga

SEQ ID NO: 4862523 - DNA, 14 bp, Homo sapiens
cctatccctctcct

SEQ ID NO: 4862524 - DNA, 18 bp, Homo sapiens
cctatctcttcctgtcta

SEQ ID NO: 4862525 - DNA, 16 bp, Homo sapiens
cctattctataaaact

SEQ ID NO: 4862526 - DNA, 13 bp, Homo sapiens
cctattgctgcta

SEQ ID NO: 4862527 - DNA, 20 bp, Homo sapiens
cctatttttgacatggaaat

SEQ ID NO: 4862528 - DNA, 16 bp, Homo sapiens
cctcagctctctggga

SEQ ID NO: 4862529 - DNA, 21 bp, Homo sapiens
cctcagcttcttcacaggcac

SEQ ID NO: 4862530 - DNA, 19 bp, Homo sapiens
cctcaggccaagggaccag

SEQ ID NO: 4862531 - DNA, 16 bp, Homo sapiens
cctcaggctcctaaag

SEQ ID NO: 4862532 - DNA, 14 bp, Homo sapiens
cctcagttctcaaa

SEQ ID NO: 4862533 - DNA, 20 bp, Homo sapiens
cctcatcactggactgcatg

SEQ ID NO: 4862534 - DNA, 18 bp, Homo sapiens
cctccaaacatgttccca

SEQ ID NO: 4862535 - DNA, 14 bp, Homo sapiens
cctccagaagctgc

SEQ ID NO: 4862536 - DNA, 12 bp, Homo sapiens
cctccagactca

SEQ ID NO: 4862537 - DNA, 17 bp, Homo sapiens
cctccatccatccttcc

SEQ ID NO: 4862538 - DNA, 18 bp, Homo sapiens
cctccatgctcctcacct

SEQ ID NO: 4862539 - DNA, 20 bp, Homo sapiens
cctccatgctcctcacctgt

SEQ ID NO: 4862540 - DNA, 17 bp, Homo sapiens
cctccattcatccttcc

SEQ ID NO: 4862541 - DNA, 18 bp, Homo sapiens
cctcccaaggtcctctca

SEQ ID NO: 4862542 - DNA, 13 bp, Homo sapiens
cctcccaggggag

SEQ ID NO: 4862543 - DNA, 17 bp, Homo sapiens
cctcccaggggagccag

SEQ ID NO: 4862544 - DNA, 18 bp, Homo sapiens
cctcccaggggagccagc

SEQ ID NO: 4862545 - DNA, 19 bp, Homo sapiens
cctcccaggggagccagct

SEQ ID NO: 4862546 - DNA, 20 bp, Homo sapiens
cctcccaggggagccagctg

SEQ ID NO: 4862547 - DNA, 14 bp, Homo sapiens
cctccccacccgct

SEQ ID NO: 4862548 - DNA, 15 bp, Homo sapiens
cctcccctgggcagg

SEQ ID NO: 4862549 - DNA, 14 bp, Homo sapiens
cctcccgccccgcc

SEQ ID NO: 4862550 - DNA, 16 bp, Homo sapiens
cctcccgccccgcccc

SEQ ID NO: 4862551 - DNA, 19 bp, Homo sapiens
cctcccgccccgcccctcc

SEQ ID NO: 4862552 - DNA, 22 bp, Homo sapiens
cctccctcagctctctgggacc

SEQ ID NO: 4862553 - DNA, 18 bp, Homo sapiens
cctccggccatactgcct

SEQ ID NO: 4862554 - DNA, 20 bp, Homo sapiens
cctccggcgggtgacagctc

SEQ ID NO: 4862555 - DNA, 15 bp, Homo sapiens
cctccgtcccacccc

SEQ ID NO: 4862556 - DNA, 12 bp, Homo sapiens
cctcctgctggg

SEQ ID NO: 4862557 - DNA, 22 bp, Homo sapiens
cctccttagccctgtctgctag

SEQ ID NO: 4862558 - DNA, 13 bp, Homo sapiens
cctccttctcctg

SEQ ID NO: 4862559 - DNA, 13 bp, Homo sapiens
cctcgggcctgct

SEQ ID NO: 4862560 - DNA, 15 bp, Homo sapiens
cctctaagtgctgct

SEQ ID NO: 4862561 - DNA, 15 bp, Homo sapiens
cctctaggccctgtg

SEQ ID NO: 4862562 - DNA, 18 bp, Homo sapiens
cctctcaaacctggcaga

SEQ ID NO: 4862563 - DNA, 17 bp, Homo sapiens
cctctcagttctctccc

SEQ ID NO: 4862564 - DNA, 13 bp, Homo sapiens
cctctcctgccct

SEQ ID NO: 4862565 - DNA, 15 bp, Homo sapiens
cctctcctgccctct

SEQ ID NO: 4862566 - DNA, 12 bp, Homo sapiens
cctctcggctgc

SEQ ID NO: 4862567 - DNA, 12 bp, Homo sapiens
cctctctctggg

SEQ ID NO: 4862568 - DNA, 13 bp, Homo sapiens
cctctctggaaga

SEQ ID NO: 4862569 - DNA, 22 bp, Homo sapiens
cctctgccaaaggatgtgatat

SEQ ID NO: 4862570 - DNA, 12 bp, Homo sapiens
cctctgcctggg

SEQ ID NO: 4862571 - DNA, 15 bp, Homo sapiens
cctctgctctgcctg

SEQ ID NO: 4862572 - DNA, 19 bp, Homo sapiens
cctctgctctgcctggagt

SEQ ID NO: 4862573 - DNA, 13 bp, Homo sapiens
cctctggactgga

SEQ ID NO: 4862574 - DNA, 16 bp, Homo sapiens
cctctggactggaaag

SEQ ID NO: 4862575 - DNA, 13 bp, Homo sapiens
cctctgtccttcc

SEQ ID NO: 4862576 - DNA, 17 bp, Homo sapiens
cctctgtctgagacagg

SEQ ID NO: 4862577 - DNA, 20 bp, Homo sapiens
cctctgtctgagacaggtgc

SEQ ID NO: 4862578 - DNA, 21 bp, Homo sapiens
cctcttctctcctcccctaca

SEQ ID NO: 4862579 - DNA, 16 bp, Homo sapiens
cctcttgaaacctgat

SEQ ID NO: 4862580 - DNA, 15 bp, Homo sapiens
cctcttgcagggtct

SEQ ID NO: 4862581 - DNA, 23 bp, Homo sapiens
cctctttagtttttggttgggaa

SEQ ID NO: 4862582 - DNA, 16 bp, Homo sapiens
cctctttgcgtttcct

SEQ ID NO: 4862583 - DNA, 12 bp, Homo sapiens
cctcttttgtgc

SEQ ID NO: 4862584 - DNA, 13 bp, Homo sapiens
cctgaagagcatt

SEQ ID NO: 4862585 - DNA, 15 bp, Homo sapiens
cctgaatttgtatat

SEQ ID NO: 4862586 - DNA, 22 bp, Homo sapiens
cctgacaactcattttcatatt

SEQ ID NO: 4862587 - DNA, 19 bp, Homo sapiens
cctgacatcatcattcttg

SEQ ID NO: 4862588 - DNA, 21 bp, Homo sapiens
cctgactagaactcctgtctt

SEQ ID NO: 4862589 - DNA, 19 bp, Homo sapiens
cctgagaaacactatttgt

SEQ ID NO: 4862590 - DNA, 20 bp, Homo sapiens
cctgatggagtgtgcagaca

SEQ ID NO: 4862591 - DNA, 17 bp, Homo sapiens
cctgcactaacagagtg

SEQ ID NO: 4862592 - DNA, 15 bp, Homo sapiens
cctgcatgttctgtg

SEQ ID NO: 4862593 - DNA, 16 bp, Homo sapiens
cctgccaaggagcatc

SEQ ID NO: 4862594 - DNA, 21 bp, Homo sapiens
cctgcccacaactcccttgca

SEQ ID NO: 4862595 - DNA, 20 bp, Homo sapiens
cctgcccgcctaagaccctg

SEQ ID NO: 4862596 - DNA, 22 bp, Homo sapiens
cctgccctctgctctgcctgga

SEQ ID NO: 4862597 - DNA, 11 bp, Homo sapiens
cctgcctggag

SEQ ID NO: 4862598 - DNA, 19 bp, Homo sapiens
cctgcctggaggctcctct

SEQ ID NO: 4862599 - DNA, 22 bp, Homo sapiens
cctgctcaactctacccctgct

SEQ ID NO: 4862600 - DNA, 22 bp, Homo sapiens
cgctgcccttgggtccccccga

SEQ ID NO: 4862601 - DNA, 14 bp, Homo sapiens
cggaggccttccct

SEQ ID NO: 4862602 - DNA, 19 bp, Homo sapiens
cggagtcagtgccaggtcc

SEQ ID NO: 4862603 - DNA, 14 bp, Homo sapiens
cggatcctgtgagt

SEQ ID NO: 4862604 - DNA, 19 bp, Homo sapiens
cggatcctgtgagtaggct

SEQ ID NO: 4862605 - DNA, 18 bp, Homo sapiens
cggcgggtgacagctccg

SEQ ID NO: 4862606 - DNA, 20 bp, Homo sapiens
cggctactggttacctggag

SEQ ID NO: 4862607 - DNA, 18 bp, Homo sapiens
cggctgccaggggctctg

SEQ ID NO: 4862608 - DNA, 15 bp, Homo sapiens
cgggatgacctccag

SEQ ID NO: 4862609 - DNA, 23 bp, Homo sapiens
cgggtacttatttctcagctgtg

SEQ ID NO: 4862610 - DNA, 22 bp, Homo sapiens
cggtgctcactcccaagggaca

SEQ ID NO: 4862611 - DNA, 12 bp, Homo sapiens
cggtggccttga

SEQ ID NO: 4862612 - DNA, 13 bp, Homo sapiens
cggtggccttgag

SEQ ID NO: 4862613 - DNA, 16 bp, Homo sapiens
cggttcagacccctgc

SEQ ID NO: 4862614 - DNA, 19 bp, Homo sapiens
cggttcagacccctgcctg

SEQ ID NO: 4862615 - DNA, 17 bp, Homo sapiens
cggttctaaggctcaga

SEQ ID NO: 4862616 - DNA, 13 bp, Homo sapiens
cgtaagcagtata

SEQ ID NO: 4862617 - DNA, 14 bp, Homo sapiens
cgtaataattatta

SEQ ID NO: 4862618 - DNA, 17 bp, Homo sapiens
cgtaataattattatta

SEQ ID NO: 4862619 - DNA, 21 bp, Homo sapiens
cgtagattcccatcatacact

SEQ ID NO: 4862620 - DNA, 17 bp, Homo sapiens
cgtagcttcagccaggc

SEQ ID NO: 4862621 - DNA, 18 bp, Homo sapiens
cgtagcttcagccaggca

SEQ ID NO: 4862622 - DNA, 19 bp, Homo sapiens
cgtattggacctgcccaca

SEQ ID NO: 4862623 - DNA, 23 bp, Homo sapiens
cgtccatcacgttagctgtccca

SEQ ID NO: 4862624 - DNA, 13 bp, Homo sapiens
cgtcccaccccct

SEQ ID NO: 4862625 - DNA, 12 bp, Homo sapiens
cgtcccttctct

SEQ ID NO: 4862626 - DNA, 14 bp, Homo sapiens
cgtctggggtgtgg

SEQ ID NO: 4862627 - DNA, 23 bp, Homo sapiens
cgtcttccagagaacctgtgggc

SEQ ID NO: 4862628 - DNA, 19 bp, Homo sapiens
cgtgatgggctaggcctcc

SEQ ID NO: 4862629 - DNA, 19 bp, Homo sapiens
cgtgccccttccctgggtt

SEQ ID NO: 4862630 - DNA, 19 bp, Homo sapiens
cgtgccctcgtcagctggg

SEQ ID NO: 4862631 - DNA, 20 bp, Homo sapiens
cgtggatcgagtgtagctgt

SEQ ID NO: 4862632 - DNA, 22 bp, Homo sapiens
cgtggatcgagtgtagctgtga

SEQ ID NO: 4862633 - DNA, 23 bp, Homo sapiens
cgtggatcgagtgtagctgtgaa

SEQ ID NO: 4862634 - DNA, 21 bp, Homo sapiens
cgtggcagcttgctgggcttt

SEQ ID NO: 4862635 - DNA, 21 bp, Homo sapiens
cgtggccacgggggcagtgtg

SEQ ID NO: 4862636 - DNA, 22 bp, Homo sapiens
cgtggccacgggggcagtgtga

SEQ ID NO: 4862637 - DNA, 22 bp, Homo sapiens
cgtgggaacccccctcccaccc

SEQ ID NO: 4862638 - DNA, 13 bp, Homo sapiens
cgtgtgtgacact

SEQ ID NO: 4862639 - DNA, 17 bp, Homo sapiens
cgttaggccaggcctta

SEQ ID NO: 4862640 - DNA, 15 bp, Homo sapiens
cgttctaaatatgaa

SEQ ID NO: 4862641 - DNA, 21 bp, Homo sapiens
cgttctaaatatgaatgaatg

SEQ ID NO: 4862642 - DNA, 15 bp, Homo sapiens
cgtttttgtattttc

SEQ ID NO: 4862643 - DNA, 21 bp, Homo sapiens
cgtttttgtattttcatgaaa

SEQ ID NO: 4862644 - DNA, 15 bp, Homo sapiens
ctaaaaaaaagatga

SEQ ID NO: 4862645 - DNA, 16 bp, Homo sapiens
ctaaaaagtataaaat

SEQ ID NO: 4862646 - DNA, 23 bp, Homo sapiens
ctaaaaatgagcttgattaaatc

SEQ ID NO: 4862647 - DNA, 16 bp, Homo sapiens
ctaaagagcatcctga

SEQ ID NO: 4862648 - DNA, 12 bp, Homo sapiens
ctaaagccaggc

SEQ ID NO: 4862649 - DNA, 13 bp, Homo sapiens
ctaaagccaggct

SEQ ID NO: 4862650 - DNA, 16 bp, Homo sapiens
ctaaagccaggctcag

SEQ ID NO: 4862651 - DNA, 19 bp, Homo sapiens
ctaaatgtgtaataatgta

SEQ ID NO: 4862652 - DNA, 15 bp, Homo sapiens
ctaaattatttactg

SEQ ID NO: 4862653 - DNA, 13 bp, Homo sapiens
ctaaatttcacta

SEQ ID NO: 4862654 - DNA, 17 bp, Homo sapiens
ctaacctcgggcctgct

SEQ ID NO: 4862655 - DNA, 18 bp, Homo sapiens
ctaagaagaaggccagag

SEQ ID NO: 4862656 - DNA, 18 bp, Homo sapiens
ctaagatgtgttcttatt

SEQ ID NO: 4862657 - DNA, 14 bp, Homo sapiens
ctaagcaaccacac

SEQ ID NO: 4862658 - DNA, 15 bp, Homo sapiens
ctaaggctcctcctt

SEQ ID NO: 4862659 - DNA, 16 bp, Homo sapiens
ctaaggctcctccttg

SEQ ID NO: 4862660 - DNA, 16 bp, Homo sapiens
ctaaggtttccagtca

SEQ ID NO: 4862661 - DNA, 17 bp, Homo sapiens
ctaagtcattggcaaag

SEQ ID NO: 4862662 - DNA, 14 bp, Homo sapiens
ctaagtgatataaa

SEQ ID NO: 4862663 - DNA, 13 bp, Homo sapiens
ctaagtgctgctg

SEQ ID NO: 4862664 - DNA, 12 bp, Homo sapiens
ctaagtgggaga

SEQ ID NO: 4862665 - DNA, 18 bp, Homo sapiens
ctaatgtattatgagcca

SEQ ID NO: 4862666 - DNA, 18 bp, Homo sapiens
ctaattaatatattaaaa

SEQ ID NO: 4862667 - DNA, 11 bp, Homo sapiens
ctaatttaaca

SEQ ID NO: 4862668 - DNA, 20 bp, Homo sapiens
ctacagttttaactgtggat

SEQ ID NO: 4862669 - DNA, 15 bp, Homo sapiens
ctacattccaccctg

SEQ ID NO: 4862670 - DNA, 20 bp, Homo sapiens
ctaccaacttgtatccaggc

SEQ ID NO: 4862671 - DNA, 15 bp, Homo sapiens
ctacccctgctccca

SEQ ID NO: 4862672 - DNA, 16 bp, Homo sapiens
ctaccgtcttttcctg

SEQ ID NO: 4862673 - DNA, 14 bp, Homo sapiens
ctacctctgtctga

SEQ ID NO: 4862674 - DNA, 15 bp, Homo sapiens
ctacctctgtctgag

SEQ ID NO: 4862675 - DNA, 16 bp, Homo sapiens
ctacctctgtctgaga

SEQ ID NO: 4862676 - DNA, 15 bp, Homo sapiens
ctacctgaggccagg

SEQ ID NO: 4862677 - DNA, 15 bp, Homo sapiens
ctactagattgacta

SEQ ID NO: 4862678 - DNA, 15 bp, Homo sapiens
ctactagtgtgactc

SEQ ID NO: 4862679 - DNA, 20 bp, Homo sapiens
ctactgaacacatgtgtatg

SEQ ID NO: 4862680 - DNA, 17 bp, Homo sapiens
ctactgctcctgtggca

SEQ ID NO: 4862681 - DNA, 22 bp, Homo sapiens
ctactggtgtaatctcaatgca

SEQ ID NO: 4862682 - DNA, 17 bp, Homo sapiens
ctactggttacctggag

SEQ ID NO: 4862683 - DNA, 13 bp, Homo sapiens
ctactgtgggcaa

SEQ ID NO: 4862684 - DNA, 15 bp, Homo sapiens
ctactgtgtgccagg

SEQ ID NO: 4862685 - DNA, 23 bp, Homo sapiens
ctactgttatcagtaatgctaaa

SEQ ID NO: 4862686 - DNA, 18 bp, Homo sapiens
ctagaactcctgtcttct

SEQ ID NO: 4862687 - DNA, 21 bp, Homo sapiens
ctagaactcctgtcttctttc

SEQ ID NO: 4862688 - DNA, 22 bp, Homo sapiens
ctagaactcctgtcttctttct

SEQ ID NO: 4862689 - DNA, 23 bp, Homo sapiens
ctagaactcctgtcttctttctc

SEQ ID NO: 4862690 - DNA, 13 bp, Homo sapiens
ctagactgctcct

SEQ ID NO: 4862691 - DNA, 23 bp, Homo sapiens
ctagagggcgagggatgatgagg

SEQ ID NO: 4862692 - DNA, 12 bp, Homo sapiens
ctagataaaatg

SEQ ID NO: 4862693 - DNA, 23 bp, Homo sapiens
ctagatccagcccaaacctggga

SEQ ID NO: 4862694 - DNA, 20 bp, Homo sapiens
ctagatgattttttgaaagt

SEQ ID NO: 4862695 - DNA, 21 bp, Homo sapiens
ctagatgattttttgaaagtt

SEQ ID NO: 4862696 - DNA, 21 bp, Homo sapiens
ctagatttattagtcctaatt

SEQ ID NO: 4862697 - DNA, 22 bp, Homo sapiens
ctagcattgtaaaattatttca

SEQ ID NO: 4862698 - DNA, 12 bp, Homo sapiens
ctagcccaacct

SEQ ID NO: 4862699 - DNA, 15 bp, Homo sapiens
ctagcctatgtctgg

SEQ ID NO: 4862700 - DNA, 17 bp, Homo sapiens
ctagcctatgtctggca

SEQ ID NO: 4862701 - DNA, 19 bp, Homo sapiens
ctagcctatgtctggcaga

SEQ ID NO: 4862702 - DNA, 22 bp, Homo sapiens
ctagcctatgtctggcagatga

SEQ ID NO: 4862703 - DNA, 15 bp, Homo sapiens
ctagcctctggactg

SEQ ID NO: 4862704 - DNA, 22 bp, Homo sapiens
ctagctctttgggcctctcctg

SEQ ID NO: 4862705 - DNA, 23 bp, Homo sapiens
ctagctgtgtgaatacctgctca

SEQ ID NO: 4862706 - DNA, 16 bp, Homo sapiens
ctaggaatcccagagg

SEQ ID NO: 4862707 - DNA, 17 bp, Homo sapiens
ctaggaatcccagaggt

SEQ ID NO: 4862708 - DNA, 12 bp, Homo sapiens
ctaggactcaga

SEQ ID NO: 4862709 - DNA, 14 bp, Homo sapiens
ctaggactcagaaa

SEQ ID NO: 4862710 - DNA, 19 bp, Homo sapiens
ctaggactcagaaacgaga

SEQ ID NO: 4862711 - DNA, 15 bp, Homo sapiens
ctaggccctgtgagc

SEQ ID NO: 4862712 - DNA, 17 bp, Homo sapiens
ctaggccctgtgagcac

SEQ ID NO: 4862713 - DNA, 18 bp, Homo sapiens
ctaggccctgtgagcaca

SEQ ID NO: 4862714 - DNA, 17 bp, Homo sapiens
ctaggtctcctcagggt

SEQ ID NO: 4862715 - DNA, 15 bp, Homo sapiens
ctagtacctgtgact

SEQ ID NO: 4862716 - DNA, 18 bp, Homo sapiens
ctagttgcccccattccc

SEQ ID NO: 4862717 - DNA, 20 bp, Homo sapiens
ctagttgcccccattcccag

SEQ ID NO: 4862718 - DNA, 21 bp, Homo sapiens
ctagttgcccccattcccagc

SEQ ID NO: 4862719 - DNA, 15 bp, Homo sapiens
ctataaaactctgca

SEQ ID NO: 4862720 - DNA, 15 bp, Homo sapiens
gtttcagtttgttgg

SEQ ID NO: 4862721 - DNA, 22 bp, Homo sapiens
gtttctgccctgccagctgcag

SEQ ID NO: 4862722 - DNA, 14 bp, Homo sapiens
gtttcttttgtttg

SEQ ID NO: 4862723 - DNA, 18 bp, Homo sapiens
gtttcttttgtttggtaa

SEQ ID NO: 4862724 - DNA, 17 bp, Homo sapiens
gtttgaaggagaatggc

SEQ ID NO: 4862725 - DNA, 18 bp, Homo sapiens
gtttgcaggagcccccct

SEQ ID NO: 4862726 - DNA, 19 bp, Homo sapiens
gtttggaaataaactgtgc

SEQ ID NO: 4862727 - DNA, 16 bp, Homo sapiens
gtttggaatattaaaa

SEQ ID NO: 4862728 - DNA, 17 bp, Homo sapiens
gtttgggaaaggcaggg

SEQ ID NO: 4862729 - DNA, 18 bp, Homo sapiens
gtttgggaaaggcagggc

SEQ ID NO: 4862730 - DNA, 12 bp, Homo sapiens
gtttgggagcca

SEQ ID NO: 4862731 - DNA, 20 bp, Homo sapiens
gtttgggagccaggactccc

SEQ ID NO: 4862732 - DNA, 22 bp, Homo sapiens
gtttgggagccaggactcccag

SEQ ID NO: 4862733 - DNA, 19 bp, Homo sapiens
gtttggtaaatgtttcttt

SEQ ID NO: 4862734 - DNA, 13 bp, Homo sapiens
gtttgttggaaag

SEQ ID NO: 4862735 - DNA, 15 bp, Homo sapiens
gtttgttttgtgaat

SEQ ID NO: 4862736 - DNA, 13 bp, Homo sapiens
gttttactgtcta

SEQ ID NO: 4862737 - DNA, 19 bp, Homo sapiens
gttttcagcaaattccaga

SEQ ID NO: 4862738 - DNA, 18 bp, Homo sapiens
gttttccaaaagtaaaga

SEQ ID NO: 4862739 - DNA, 15 bp, Homo sapiens
gttttgcacagccaa

SEQ ID NO: 4862740 - DNA, 22 bp, Homo sapiens
gttttgcacagccaaatttaaa

SEQ ID NO: 4862741 - DNA, 17 bp, Homo sapiens
gtttttgacatttatat

SEQ ID NO: 4862742 - DNA, 13 bp, Homo sapiens
gtttttttccagt

SEQ ID NO: 4862743 - DNA, 15 bp, Homo sapiens
taaaaaaaaattgta

SEQ ID NO: 4862744 - DNA, 22 bp, Homo sapiens
taaaaaatcatgccagtatttt

SEQ ID NO: 4862745 - DNA, 15 bp, Homo sapiens
taaaaaggcccttag

SEQ ID NO: 4862746 - DNA, 16 bp, Homo sapiens
taaaaaggcccttaga

SEQ ID NO: 4862747 - DNA, 17 bp, Homo sapiens
taaaaaggcccttagag

SEQ ID NO: 4862748 - DNA, 15 bp, Homo sapiens
taaaacaatccttac

SEQ ID NO: 4862749 - DNA, 16 bp, Homo sapiens
taaaagctttcatgtc

SEQ ID NO: 4862750 - DNA, 22 bp, Homo sapiens
taaaaggcccatagcagccagt

SEQ ID NO: 4862751 - DNA, 15 bp, Homo sapiens
taaaagttctcaatg

SEQ ID NO: 4862752 - DNA, 17 bp, Homo sapiens
taaaagttttatatgct

SEQ ID NO: 4862753 - DNA, 15 bp, Homo sapiens
taaaatactattgcc

SEQ ID NO: 4862754 - DNA, 15 bp, Homo sapiens
taaaatgaggatcca

SEQ ID NO: 4862755 - DNA, 10 bp, Homo sapiens
taaaatgtaa

SEQ ID NO: 4862756 - DNA, 13 bp, Homo sapiens
taaaattatttca

SEQ ID NO: 4862757 - DNA, 15 bp, Homo sapiens
taaaattgttatcaa

SEQ ID NO: 4862758 - DNA, 16 bp, Homo sapiens
taaaattttgtatgtt

SEQ ID NO: 4862759 - DNA, 19 bp, Homo sapiens
taaaattttgtatgttaaa

SEQ ID NO: 4862760 - DNA, 22 bp, Homo sapiens
taaacaaacaagccccctgccc

SEQ ID NO: 4862761 - DNA, 18 bp, Homo sapiens
taaacaaagtttcagagt

SEQ ID NO: 4862762 - DNA, 17 bp, Homo sapiens
taaacagtaagatatct

SEQ ID NO: 4862763 - DNA, 14 bp, Homo sapiens
taaactaaatgtgc

SEQ ID NO: 4862764 - DNA, 15 bp, Homo sapiens
taaacttacaaactt

SEQ ID NO: 4862765 - DNA, 17 bp, Homo sapiens
taaagaagtgcatgaaa

SEQ ID NO: 4862766 - DNA, 23 bp, Homo sapiens
taaagaccctcctattctataaa

SEQ ID NO: 4862767 - DNA, 22 bp, Homo sapiens
taaagacttgtatagcatgaaa

SEQ ID NO: 4862768 - DNA, 18 bp, Homo sapiens
taaagagataaagaataa

SEQ ID NO: 4862769 - DNA, 15 bp, Homo sapiens
taaagagcatcctga

SEQ ID NO: 4862770 - DNA, 19 bp, Homo sapiens
taaagcagttcctgtccca

SEQ ID NO: 4862771 - DNA, 13 bp, Homo sapiens
taaagcatttcct

SEQ ID NO: 4862772 - DNA, 14 bp, Homo sapiens
taaagccaggctca

SEQ ID NO: 4862773 - DNA, 14 bp, Homo sapiens
taaagctcaaatga

SEQ ID NO: 4862774 - DNA, 14 bp, Homo sapiens
taaaggataaagaa

SEQ ID NO: 4862775 - DNA, 13 bp, Homo sapiens
taaagtataatgt

SEQ ID NO: 4862776 - DNA, 15 bp, Homo sapiens
taaagtataatgttt

SEQ ID NO: 4862777 - DNA, 21 bp, Homo sapiens
taaagtatgcattattaaatt

SEQ ID NO: 4862778 - DNA, 21 bp, Homo sapiens
taaagtcagttgctcaaaaag

SEQ ID NO: 4862779 - DNA, 16 bp, Homo sapiens
taaagtgcctcggaca

SEQ ID NO: 4862780 - DNA, 16 bp, Homo sapiens
taaagtttggttttga

SEQ ID NO: 4862781 - DNA, 14 bp, Homo sapiens
taaataaaaactaa

SEQ ID NO: 4862782 - DNA, 13 bp, Homo sapiens
taaataacatgtt

SEQ ID NO: 4862783 - DNA, 15 bp, Homo sapiens
taaatacatgcatat

SEQ ID NO: 4862784 - DNA, 19 bp, Homo sapiens
taaatggtaataagcactg

SEQ ID NO: 4862785 - DNA, 15 bp, Homo sapiens
taaatgtataaatat

SEQ ID NO: 4862786 - DNA, 20 bp, Homo sapiens
taaatgtgtaataatgtaac

SEQ ID NO: 4862787 - DNA, 19 bp, Homo sapiens
taaatgtttcttttgtttg

SEQ ID NO: 4862788 - DNA, 23 bp, Homo sapiens
taaattatttgattatttaagac

SEQ ID NO: 4862789 - DNA, 18 bp, Homo sapiens
taaattcaactttgtaaa

SEQ ID NO: 4862790 - DNA, 18 bp, Homo sapiens
taaattcccaaatcctag

SEQ ID NO: 4862791 - DNA, 12 bp, Homo sapiens
taaattgcatca

SEQ ID NO: 4862792 - DNA, 13 bp, Homo sapiens
taaattgtaaaac

SEQ ID NO: 4862793 - DNA, 14 bp, Homo sapiens
taaattttaaagcc

SEQ ID NO: 4862794 - DNA, 12 bp, Homo sapiens
taacacattttt

SEQ ID NO: 4862795 - DNA, 20 bp, Homo sapiens
taacacatttttttgcatgc

SEQ ID NO: 4862796 - DNA, 13 bp, Homo sapiens
taacaccagtggg

SEQ ID NO: 4862797 - DNA, 21 bp, Homo sapiens
taacatgtttctctataaagt

SEQ ID NO: 4862798 - DNA, 21 bp, Homo sapiens
taacattaatgcctgcttttt

SEQ ID NO: 4862799 - DNA, 17 bp, Homo sapiens
taaccagctcagtgttt

SEQ ID NO: 4862800 - DNA, 19 bp, Homo sapiens
taacccccttaaatttaat

SEQ ID NO: 4862801 - DNA, 19 bp, Homo sapiens
taacctagttaaagaaagg

SEQ ID NO: 4862802 - DNA, 15 bp, Homo sapiens
aagtgctgctgtgga

SEQ ID NO: 4862803 - DNA, 17 bp, Homo sapiens
aagtggtaattgggaac

SEQ ID NO: 4862804 - DNA, 17 bp, Homo sapiens
aagtggtgtttattgca

SEQ ID NO: 4862805 - DNA, 14 bp, Homo sapiens
aagtgtacatatgt

SEQ ID NO: 4862806 - DNA, 16 bp, Homo sapiens
aagtgtgctgggcaga

SEQ ID NO: 4862807 - DNA, 19 bp, Homo sapiens
aagtgtgtatatattttgt

SEQ ID NO: 4862808 - DNA, 18 bp, Homo sapiens
aagtgtgtgattgaaggt

SEQ ID NO: 4862809 - DNA, 19 bp, Homo sapiens
aagtgtttatgttgtttat

SEQ ID NO: 4862810 - DNA, 13 bp, Homo sapiens
aagttaaaattgt

SEQ ID NO: 4862811 - DNA, 16 bp, Homo sapiens
aagttagtggaaatct

SEQ ID NO: 4862812 - DNA, 19 bp, Homo sapiens
aagttagtggaaatctgaa

SEQ ID NO: 4862813 - DNA, 22 bp, Homo sapiens
aagttatctttgaatatgtagt

SEQ ID NO: 4862814 - DNA, 23 bp, Homo sapiens
aagtttcattctccctttcacta

SEQ ID NO: 4862815 - DNA, 11 bp, Homo sapiens
aagtttgctgt

SEQ ID NO: 4862816 - DNA, 13 bp, Homo sapiens
aagttttgttgta

SEQ ID NO: 4862817 - DNA, 13 bp, Homo sapiens
aataaagatgagt

SEQ ID NO: 4862818 - DNA, 12 bp, Homo sapiens
aataaagtataa

SEQ ID NO: 4862819 - DNA, 12 bp, Homo sapiens
aataacatgttt

SEQ ID NO: 4862820 - DNA, 13 bp, Homo sapiens
aataactgaattt

SEQ ID NO: 4862821 - DNA, 16 bp, Homo sapiens
aataactgaatttgga

SEQ ID NO: 4862822 - DNA, 13 bp, Homo sapiens
aataatagactgt

SEQ ID NO: 4862823 - DNA, 19 bp, Homo sapiens
aataatgctacaattttaa

SEQ ID NO: 4862824 - DNA, 17 bp, Homo sapiens
aataatgtaacatgatt

SEQ ID NO: 4862825 - DNA, 13 bp, Homo sapiens
aataatttccttc

SEQ ID NO: 4862826 - DNA, 14 bp, Homo sapiens
aatacacatttgct

SEQ ID NO: 4862827 - DNA, 23 bp, Homo sapiens
aatacccgtcctctcggctgcca

SEQ ID NO: 4862828 - DNA, 21 bp, Homo sapiens
aatacccttgtgagagcccat

SEQ ID NO: 4862829 - DNA, 15 bp, Homo sapiens
aatacgtttgtgttt

SEQ ID NO: 4862830 - DNA, 20 bp, Homo sapiens
aatactgcttaattgctgat

SEQ ID NO: 4862831 - DNA, 13 bp, Homo sapiens
aatagaacacagt

SEQ ID NO: 4862832 - DNA, 16 bp, Homo sapiens
aatagaattataactg

SEQ ID NO: 4862833 - DNA, 15 bp, Homo sapiens
aatagacaaaaagta

SEQ ID NO: 4862834 - DNA, 20 bp, Homo sapiens
aatagatgtgcagtttggaa

SEQ ID NO: 4862835 - DNA, 15 bp, Homo sapiens
aatagattcagagaa

SEQ ID NO: 4862836 - DNA, 16 bp, Homo sapiens
aatagattcagagaaa

SEQ ID NO: 4862837 - DNA, 16 bp, Homo sapiens
aatagctacagtgcat

SEQ ID NO: 4862838 - DNA, 14 bp, Homo sapiens
aatagctttagtga

SEQ ID NO: 4862839 - DNA, 22 bp, Homo sapiens
aatagctttagtgaattaaatt

SEQ ID NO: 4862840 - DNA, 22 bp, Homo sapiens
aataggaatcattcagaaatgt

SEQ ID NO: 4862841 - DNA, 23 bp, Homo sapiens
aataggaatcattcagaaatgtt

SEQ ID NO: 4862842 - DNA, 21 bp, Homo sapiens
aataggagtggtgatttgaaa

SEQ ID NO: 4862843 - DNA, 13 bp, Homo sapiens
aataggccacaga

SEQ ID NO: 4862844 - DNA, 22 bp, Homo sapiens
aatagtagatgtggcctttgaa

SEQ ID NO: 4862845 - DNA, 16 bp, Homo sapiens
aatataaaaaatcatg

SEQ ID NO: 4862846 - DNA, 12 bp, Homo sapiens
aatataaaatta

SEQ ID NO: 4862847 - DNA, 15 bp, Homo sapiens
aatataaaattatga

SEQ ID NO: 4862848 - DNA, 13 bp, Homo sapiens
aatatatatatat

SEQ ID NO: 4862849 - DNA, 21 bp, Homo sapiens
aatatgacaaacatcattgtt

SEQ ID NO: 4862850 - DNA, 17 bp, Homo sapiens
aatatgtatatatgtat

SEQ ID NO: 4862851 - DNA, 22 bp, Homo sapiens
aatattccagatctttcagaaa

SEQ ID NO: 4862852 - DNA, 13 bp, Homo sapiens
aatattgaaaatt

SEQ ID NO: 4862853 - DNA, 20 bp, Homo sapiens
aatattgaaaattgaaaagt

SEQ ID NO: 4862854 - DNA, 21 bp, Homo sapiens
aatattgaaaattgaaaagta

SEQ ID NO: 4862855 - DNA, 16 bp, Homo sapiens
aatattgattgggaaa

SEQ ID NO: 4862856 - DNA, 22 bp, Homo sapiens
aatattgattgggaaaacattt

SEQ ID NO: 4862857 - DNA, 16 bp, Homo sapiens
aatattgtttggtaaa

SEQ ID NO: 4862858 - DNA, 22 bp, Homo sapiens
aatattgtttggtaaatgtttc

SEQ ID NO: 4862859 - DNA, 14 bp, Homo sapiens
aatatttatatatt

SEQ ID NO: 4862860 - DNA, 17 bp, Homo sapiens
aatatttatatatttat

SEQ ID NO: 4862861 - DNA, 21 bp, Homo sapiens
aatcaaagccggcctgagaaa

SEQ ID NO: 4862862 - DNA, 16 bp, Homo sapiens
aatcaaattctgtctg

SEQ ID NO: 4862863 - DNA, 13 bp, Homo sapiens
aatcacagggaat

SEQ ID NO: 4862864 - DNA, 15 bp, Homo sapiens
aatcactttcataat

SEQ ID NO: 4862865 - DNA, 21 bp, Homo sapiens
aatcagaagatagtcttggaa

SEQ ID NO: 4862866 - DNA, 13 bp, Homo sapiens
aatcagaattaga

SEQ ID NO: 4862867 - DNA, 15 bp, Homo sapiens
aatcatgccagtatt

SEQ ID NO: 4862868 - DNA, 15 bp, Homo sapiens
aatcattcagaaatg

SEQ ID NO: 4862869 - DNA, 18 bp, Homo sapiens
aatcattcttactaaaaa

SEQ ID NO: 4862870 - DNA, 13 bp, Homo sapiens
aatccagttataa

SEQ ID NO: 4862871 - DNA, 16 bp, Homo sapiens
aatccagttataagaa

SEQ ID NO: 4862872 - DNA, 17 bp, Homo sapiens
aatcctagactgctcct

SEQ ID NO: 4862873 - DNA, 20 bp, Homo sapiens
aatctatgaacctgaaaagg

SEQ ID NO: 4862874 - DNA, 15 bp, Homo sapiens
aatctatgtttataa

SEQ ID NO: 4862875 - DNA, 14 bp, Homo sapiens
aatctcaaaattag

SEQ ID NO: 4862876 - DNA, 12 bp, Homo sapiens
aatctcaaatag

SEQ ID NO: 4862877 - DNA, 13 bp, Homo sapiens
aatctcaatgcaa

SEQ ID NO: 4862878 - DNA, 22 bp, Homo sapiens
aatctcctctctctttcctcca

SEQ ID NO: 4862879 - DNA, 18 bp, Homo sapiens
aatctctttttgtttgcc

SEQ ID NO: 4862880 - DNA, 16 bp, Homo sapiens
aatctggattcatatt

SEQ ID NO: 4862881 - DNA, 18 bp, Homo sapiens
aatctggattcatattta

SEQ ID NO: 4862882 - DNA, 16 bp, Homo sapiens
aatcttcaaagccttc

SEQ ID NO: 4862883 - DNA, 17 bp, Homo sapiens
aatcttcccatgcattc

SEQ ID NO: 4862884 - DNA, 13 bp, Homo sapiens
aatcttgttttga

SEQ ID NO: 4862885 - DNA, 16 bp, Homo sapiens
aatctttataaatgta

SEQ ID NO: 4862886 - DNA, 14 bp, Homo sapiens
aatcttttcttatt

SEQ ID NO: 4862887 - DNA, 15 bp, Homo sapiens
aatcttttcttattt

SEQ ID NO: 4862888 - DNA, 18 bp, Homo sapiens
aatgaaagctactcatag

SEQ ID NO: 4862889 - DNA, 14 bp, Homo sapiens
aatgaaatgcatat

SEQ ID NO: 4862890 - DNA, 16 bp, Homo sapiens
aatgaagatctttata

SEQ ID NO: 4862891 - DNA, 10 bp, Homo sapiens
aatgaataat

SEQ ID NO: 4862892 - DNA, 17 bp, Homo sapiens
aatgaataatggaaaat

SEQ ID NO: 4862893 - DNA, 12 bp, Homo sapiens
aatgagagcata

SEQ ID NO: 4862894 - DNA, 19 bp, Homo sapiens
aatgagcttgattaaatca

SEQ ID NO: 4862895 - DNA, 14 bp, Homo sapiens
aatgaggatccagg

SEQ ID NO: 4862896 - DNA, 17 bp, Homo sapiens
aatgaggatccagggca

SEQ ID NO: 4862897 - DNA, 18 bp, Homo sapiens
aatgaggatccagggcag

SEQ ID NO: 4862898 - DNA, 17 bp, Homo sapiens
aatgatcagcaaaaaga

SEQ ID NO: 4862899 - DNA, 19 bp, Homo sapiens
aatgatgttatacatcaat

SEQ ID NO: 4862900 - DNA, 19 bp, Homo sapiens
aatgcacatatagacacat

SEQ ID NO: 4862901 - DNA, 21 bp, Homo sapiens
aatgccagtggtggaggtggg

SEQ ID NO: 4862902 - DNA, 13 bp, Homo sapiens
aatgccatgaatt

SEQ ID NO: 4862903 - DNA, 13 bp, Homo sapiens
aatgcctgctttt

SEQ ID NO: 4862904 - DNA, 16 bp, Homo sapiens
aatgctacaattttaa

SEQ ID NO: 4862905 - DNA, 15 bp, Homo sapiens
aatgctacatgtgag

SEQ ID NO: 4862906 - DNA, 15 bp, Homo sapiens
aatgctgcctcagga

SEQ ID NO: 4862907 - DNA, 21 bp, Homo sapiens
aatgcttgcatggagaatggg

SEQ ID NO: 4862908 - DNA, 21 bp, Homo sapiens
aatgcttttagtgtgtgcata

SEQ ID NO: 4862909 - DNA, 13 bp, Homo sapiens
aatggatttttct

SEQ ID NO: 4862910 - DNA, 16 bp, Homo sapiens
aatgggacgaggacat

SEQ ID NO: 4862911 - DNA, 18 bp, Homo sapiens
aatggggaactcccccag

SEQ ID NO: 4862912 - DNA, 20 bp, Homo sapiens
aatggggaactcccccagag

SEQ ID NO: 4862913 - DNA, 21 bp, Homo sapiens
aatggggaactcccccagagg

SEQ ID NO: 4862914 - DNA, 17 bp, Homo sapiens
aatggtgtggtgaatgt

SEQ ID NO: 4862915 - DNA, 23 bp, Homo sapiens
aatggttaatttttcctgcatgt

SEQ ID NO: 4862916 - DNA, 16 bp, Homo sapiens
aatgtaacatgatttc

SEQ ID NO: 4862917 - DNA, 13 bp, Homo sapiens
aatgtaatttaaa

SEQ ID NO: 4862918 - DNA, 13 bp, Homo sapiens
aatgtataaatat

SEQ ID NO: 4862919 - DNA, 14 bp, Homo sapiens
aatgtataaatata

SEQ ID NO: 4862920 - DNA, 20 bp, Homo sapiens
aatgtatataaactgggatg

SEQ ID NO: 4862921 - DNA, 20 bp, Homo sapiens
aatgtatgcattcacattta

SEQ ID NO: 4862922 - DNA, 13 bp, Homo sapiens
aatgtccaaaatt

SEQ ID NO: 4862923 - DNA, 16 bp, Homo sapiens
aatgtccaaaatttat

SEQ ID NO: 4862924 - DNA, 18 bp, Homo sapiens
aatgtccaaaatttatat

SEQ ID NO: 4862925 - DNA, 17 bp, Homo sapiens
aatgtctgtaataatag

SEQ ID NO: 4862926 - DNA, 18 bp, Homo sapiens
acagccatgcgtggccac

SEQ ID NO: 4862927 - DNA, 12 bp, Homo sapiens
acagccctggca

SEQ ID NO: 4862928 - DNA, 12 bp, Homo sapiens
acagcctagggt

SEQ ID NO: 4862929 - DNA, 23 bp, Homo sapiens
acagccttattttgttggtgctt

SEQ ID NO: 4862930 - DNA, 21 bp, Homo sapiens
acagccttctaaattcccaaa

SEQ ID NO: 4862931 - DNA, 12 bp, Homo sapiens
acagccttgcaa

SEQ ID NO: 4862932 - DNA, 19 bp, Homo sapiens
acagccttgcagcggctcc

SEQ ID NO: 4862933 - DNA, 23 bp, Homo sapiens
acagccttgcagcggctcctgca

SEQ ID NO: 4862934 - DNA, 14 bp, Homo sapiens
acagctctcctcca

SEQ ID NO: 4862935 - DNA, 16 bp, Homo sapiens
acagctctcctccagc

SEQ ID NO: 4862936 - DNA, 24 bp, Homo sapiens
acagctggcggaggctgctcggct

SEQ ID NO: 4862937 - DNA, 18 bp, Homo sapiens
acagcttacaggagccag

SEQ ID NO: 4862938 - DNA, 15 bp, Homo sapiens
acaggaaagagctag

SEQ ID NO: 4862939 - DNA, 23 bp, Homo sapiens
acaggacagttgatggagcccca

SEQ ID NO: 4862940 - DNA, 16 bp, Homo sapiens
acaggatcctggcctg

SEQ ID NO: 4862941 - DNA, 22 bp, Homo sapiens
acagtccgcagttgtagcagaa

SEQ ID NO: 4862942 - DNA, 23 bp, Homo sapiens
acagtgaagttttactgtctatt

SEQ ID NO: 4862943 - DNA, 15 bp, Homo sapiens
acagtggatcacaaa

SEQ ID NO: 4862944 - DNA, 17 bp, Homo sapiens
acagtggatcacaaagt

SEQ ID NO: 4862945 - DNA, 21 bp, Homo sapiens
acagtgtaatccaggggtgta

SEQ ID NO: 4862946 - DNA, 17 bp, Homo sapiens
acagttgatggagcccc

SEQ ID NO: 4862947 - DNA, 21 bp, Homo sapiens
acagttgatggagccccaggg

SEQ ID NO: 4862948 - DNA, 22 bp, Homo sapiens
acagttgatggagccccagggt

SEQ ID NO: 4862949 - DNA, 13 bp, Homo sapiens
acagttttaactg

SEQ ID NO: 4862950 - DNA, 21 bp, Homo sapiens
acagtttttgacatttatatt

SEQ ID NO: 4862951 - DNA, 14 bp, Homo sapiens
acataaaagaaata

SEQ ID NO: 4862952 - DNA, 21 bp, Homo sapiens
acataactcacacccctgccc

SEQ ID NO: 4862953 - DNA, 20 bp, Homo sapiens
acataacttctcatgtatat

SEQ ID NO: 4862954 - DNA, 18 bp, Homo sapiens
acataagcttccatttta

SEQ ID NO: 4862955 - DNA, 19 bp, Homo sapiens
acataagtttaggataaaa

SEQ ID NO: 4862956 - DNA, 14 bp, Homo sapiens
acatcagcctcctt

SEQ ID NO: 4862957 - DNA, 20 bp, Homo sapiens
acatcctttcttttaatgat

SEQ ID NO: 4862958 - DNA, 20 bp, Homo sapiens
acatgagagtagggccctga

SEQ ID NO: 4862959 - DNA, 14 bp, Homo sapiens
acatgcaataaaat

SEQ ID NO: 4862960 - DNA, 18 bp, Homo sapiens
acatgcatataatgaata

SEQ ID NO: 4862961 - DNA, 22 bp, Homo sapiens
acatgccacatcaaacctttga

SEQ ID NO: 4862962 - DNA, 19 bp, Homo sapiens
acatgtattgcacattgta

SEQ ID NO: 4862963 - DNA, 23 bp, Homo sapiens
acatgtgatacattttttaagct

SEQ ID NO: 4862964 - DNA, 11 bp, Homo sapiens
acatgtttctc

SEQ ID NO: 4862965 - DNA, 12 bp, Homo sapiens
acattaactgtt

SEQ ID NO: 4862966 - DNA, 18 bp, Homo sapiens
acattcaacagagactga

SEQ ID NO: 4862967 - DNA, 20 bp, Homo sapiens
acattctggggaaacaacat

SEQ ID NO: 4862968 - DNA, 16 bp, Homo sapiens
acatttagaaaagtga

SEQ ID NO: 4862969 - DNA, 15 bp, Homo sapiens
acatttagaagaaag

SEQ ID NO: 4862970 - DNA, 18 bp, Homo sapiens
acatttagaagaaagatg

SEQ ID NO: 4862971 - DNA, 19 bp, Homo sapiens
acatttcttctagtgatga

SEQ ID NO: 4862972 - DNA, 18 bp, Homo sapiens
acatttctttgcattcca

SEQ ID NO: 4862973 - DNA, 20 bp, Homo sapiens
acatttgggagacatgtgac

SEQ ID NO: 4862974 - DNA, 13 bp, Homo sapiens
acattttatgtct

SEQ ID NO: 4862975 - DNA, 15 bp, Homo sapiens
acattttatgtcttt

SEQ ID NO: 4862976 - DNA, 14 bp, Homo sapiens
accaaaagacactg

SEQ ID NO: 4862977 - DNA, 18 bp, Homo sapiens
accaaaattttaaaaaag

SEQ ID NO: 4862978 - DNA, 17 bp, Homo sapiens
accaaactactgaatga

SEQ ID NO: 4862979 - DNA, 12 bp, Homo sapiens
accaacctccag

SEQ ID NO: 4862980 - DNA, 14 bp, Homo sapiens
accaacctccagac

SEQ ID NO: 4862981 - DNA, 15 bp, Homo sapiens
accaagaacataaac

SEQ ID NO: 4862982 - DNA, 14 bp, Homo sapiens
accaaggctgtgtt

SEQ ID NO: 4862983 - DNA, 15 bp, Homo sapiens
accaataaaagtggt

SEQ ID NO: 4862984 - DNA, 20 bp, Homo sapiens
accaatacaaaatgtattac

SEQ ID NO: 4862985 - DNA, 18 bp, Homo sapiens
accaataccttcaaggct

SEQ ID NO: 4862986 - DNA, 17 bp, Homo sapiens
accacatcaaataagaa

SEQ ID NO: 4862987 - DNA, 19 bp, Homo sapiens
accactaggaatcccagag

SEQ ID NO: 4862988 - DNA, 17 bp, Homo sapiens
accagaaagcttcatcc

SEQ ID NO: 4862989 - DNA, 15 bp, Homo sapiens
accagagagagttgt

SEQ ID NO: 4862990 - DNA, 22 bp, Homo sapiens
accagagtctgtatttttctaa

SEQ ID NO: 4862991 - DNA, 22 bp, Homo sapiens
accagataccttatcttacaat

SEQ ID NO: 4862992 - DNA, 22 bp, Homo sapiens
accaggggccaacctcaggctc

SEQ ID NO: 4862993 - DNA, 23 bp, Homo sapiens
accaggggccaacctcaggctcc

SEQ ID NO: 4862994 - DNA, 14 bp, Homo sapiens
accagtctgaccct

SEQ ID NO: 4862995 - DNA, 15 bp, Homo sapiens
accagttgctgctgc

SEQ ID NO: 4862996 - DNA, 15 bp, Homo sapiens
accatatgaatgaaa

SEQ ID NO: 4862997 - DNA, 13 bp, Homo sapiens
accatcatgtgta

SEQ ID NO: 4862998 - DNA, 19 bp, Homo sapiens
accatgtgagctcttccta

SEQ ID NO: 4862999 - DNA, 13 bp, Homo sapiens
accattaaagtca

SEQ ID NO: 4863000 - DNA, 21 bp, Homo sapiens
accattctattctccagacat

SEQ ID NO: 4863001 - DNA, 22 bp, Homo sapiens
accattctattctccagacatg

SEQ ID NO: 4863002 - DNA, 23 bp, Homo sapiens
accattttgttattgactaacag

SEQ ID NO: 4863003 - DNA, 17 bp, Homo sapiens
accattttttaatttac

SEQ ID NO: 4863004 - DNA, 12 bp, Homo sapiens
acccacaaactc

SEQ ID NO: 4863005 - DNA, 16 bp, Homo sapiens
acccacaaactccagg

SEQ ID NO: 4863006 - DNA, 20 bp, Homo sapiens
acccatccctgcctggaggc

SEQ ID NO: 4863007 - DNA, 15 bp, Homo sapiens
acccatcctaggaac

SEQ ID NO: 4863008 - DNA, 22 bp, Homo sapiens
acccatcctaggaaccagccaa

SEQ ID NO: 4863009 - DNA, 19 bp, Homo sapiens
acccatcttttgttctcct

SEQ ID NO: 4863010 - DNA, 14 bp, Homo sapiens
accccaaagagaaa

SEQ ID NO: 4863011 - DNA, 15 bp, Homo sapiens
accccaagcttccca

SEQ ID NO: 4863012 - DNA, 16 bp, Homo sapiens
accccaagcttcccaa

SEQ ID NO: 4863013 - DNA, 20 bp, Homo sapiens
accccaagggggctgctgct

SEQ ID NO: 4863014 - DNA, 21 bp, Homo sapiens
accccaagggggctgctgctc

SEQ ID NO: 4863015 - DNA, 16 bp, Homo sapiens
accccaatatatgtat

SEQ ID NO: 4863016 - DNA, 23 bp, Homo sapiens
accccaatatatgtattttttga

SEQ ID NO: 4863017 - DNA, 15 bp, Homo sapiens
acccccactccagct

SEQ ID NO: 4863018 - DNA, 13 bp, Homo sapiens
accccctccttct

SEQ ID NO: 4863019 - DNA, 19 bp, Homo sapiens
acccctgctcccattcctc

SEQ ID NO: 4863020 - DNA, 23 bp, Homo sapiens
accccttaccccaaagagaaaga

SEQ ID NO: 4863021 - DNA, 23 bp, Homo sapiens
acccgtcctctcggctgccaggg

SEQ ID NO: 4863022 - DNA, 14 bp, Homo sapiens
accctccaaaggaa

SEQ ID NO: 4863023 - DNA, 22 bp, Homo sapiens
accctccaaaggaactctagag

SEQ ID NO: 4863024 - DNA, 13 bp, Homo sapiens
accctccatgctc

SEQ ID NO: 4863025 - DNA, 20 bp, Homo sapiens
accctccggcgggtgacagc

SEQ ID NO: 4863026 - DNA, 16 bp, Homo sapiens
accctctgtccttccc

SEQ ID NO: 4863027 - DNA, 19 bp, Homo sapiens
accctctgtccttccccca

SEQ ID NO: 4863028 - DNA, 14 bp, Homo sapiens
accctgggaagctg

SEQ ID NO: 4863029 - DNA, 21 bp, Homo sapiens
accctgttacttatgtagaaa

SEQ ID NO: 4863030 - DNA, 19 bp, Homo sapiens
acccttacagcctctgact

SEQ ID NO: 4863031 - DNA, 11 bp, Homo sapiens
acccttgacac

SEQ ID NO: 4863032 - DNA, 18 bp, Homo sapiens
acccttgtgagagcccat

SEQ ID NO: 4863033 - DNA, 13 bp, Homo sapiens
acccttttaagca

SEQ ID NO: 4863034 - DNA, 23 bp, Homo sapiens
acccttttaagcatgtgatgttg

SEQ ID NO: 4863035 - DNA, 13 bp, Homo sapiens
accggagagagaa

SEQ ID NO: 4863036 - DNA, 16 bp, Homo sapiens
acctacagttttaact

SEQ ID NO: 4863037 - DNA, 20 bp, Homo sapiens
acctatttttgacatggaaa

SEQ ID NO: 4863038 - DNA, 14 bp, Homo sapiens
acctcaggctccta

SEQ ID NO: 4863039 - DNA, 18 bp, Homo sapiens
acctcatcactggactgc

SEQ ID NO: 4863040 - DNA, 21 bp, Homo sapiens
acctcatcactggactgcatg

SEQ ID NO: 4863041 - DNA, 10 bp, Homo sapiens
acctccagaa

SEQ ID NO: 4863042 - DNA, 16 bp, Homo sapiens
acctccagactcagca

SEQ ID NO: 4863043 - DNA, 17 bp, Homo sapiens
acctccctgtctcccgg

SEQ ID NO: 4863044 - DNA, 15 bp, Homo sapiens
acctcctcatggcag

SEQ ID NO: 4863045 - DNA, 17 bp, Homo sapiens
acctccttagccctgtc

SEQ ID NO: 4863046 - DNA, 12 bp, Homo sapiens
acctccttctgc

SEQ ID NO: 4863047 - DNA, 22 bp, Homo sapiens
acctctgtctgagacaggtgcc

SEQ ID NO: 4863048 - DNA, 19 bp, Homo sapiens
aatgtctgtaataatagac

SEQ ID NO: 4863049 - DNA, 23 bp, Homo sapiens
aatgtgctggtgaacactgtgac

SEQ ID NO: 4863050 - DNA, 16 bp, Homo sapiens
aatgtggtctgccaat

SEQ ID NO: 4863051 - DNA, 13 bp, Homo sapiens
aatgttaaaggga

SEQ ID NO: 4863052 - DNA, 12 bp, Homo sapiens
aatgttctttct

SEQ ID NO: 4863053 - DNA, 13 bp, Homo sapiens
aatgttgggaaag

SEQ ID NO: 4863054 - DNA, 22 bp, Homo sapiens
aattaaacttccaaagaaagtt

SEQ ID NO: 4863055 - DNA, 20 bp, Homo sapiens
aattaagaaatactcatgtg

SEQ ID NO: 4863056 - DNA, 19 bp, Homo sapiens
aattaatatattaaaattc

SEQ ID NO: 4863057 - DNA, 21 bp, Homo sapiens
aattaatatccctacatgtat

SEQ ID NO: 4863058 - DNA, 22 bp, Homo sapiens
aattaatggtttattctttgca

SEQ ID NO: 4863059 - DNA, 18 bp, Homo sapiens
aattacctggatgttctt

SEQ ID NO: 4863060 - DNA, 13 bp, Homo sapiens
aattatcagcaaa

SEQ ID NO: 4863061 - DNA, 17 bp, Homo sapiens
aattatgagattggttt

SEQ ID NO: 4863062 - DNA, 23 bp, Homo sapiens
aattatgagattggttttcctgt

SEQ ID NO: 4863063 - DNA, 14 bp, Homo sapiens
aattatgtaaataa

SEQ ID NO: 4863064 - DNA, 20 bp, Homo sapiens
aattatttgattatttaaga

SEQ ID NO: 4863065 - DNA, 15 bp, Homo sapiens
aattcaactttgtaa

SEQ ID NO: 4863066 - DNA, 17 bp, Homo sapiens
aattcaatcctactttt

SEQ ID NO: 4863067 - DNA, 14 bp, Homo sapiens
aattccagatttgt

SEQ ID NO: 4863068 - DNA, 14 bp, Homo sapiens
aattgaaaagtaca

SEQ ID NO: 4863069 - DNA, 17 bp, Homo sapiens
aattgactcttatttat

SEQ ID NO: 4863070 - DNA, 19 bp, Homo sapiens
aattgaggggaggtggcca

SEQ ID NO: 4863071 - DNA, 18 bp, Homo sapiens
aattgagttgcacttatt

SEQ ID NO: 4863072 - DNA, 22 bp, Homo sapiens
aattgcatactttgtattttga

SEQ ID NO: 4863073 - DNA, 21 bp, Homo sapiens
aattgctgataccatatgaat

SEQ ID NO: 4863074 - DNA, 12 bp, Homo sapiens
aattgtacaaaa

SEQ ID NO: 4863075 - DNA, 18 bp, Homo sapiens
aattgtacaaaattaagc

SEQ ID NO: 4863076 - DNA, 19 bp, Homo sapiens
aattgtacaaaattaagca

SEQ ID NO: 4863077 - DNA, 15 bp, Homo sapiens
aattgtcacatctat

SEQ ID NO: 4863078 - DNA, 18 bp, Homo sapiens
aatttaaatgaaagaaaa

SEQ ID NO: 4863079 - DNA, 16 bp, Homo sapiens
aatttaactttccagt

SEQ ID NO: 4863080 - DNA, 15 bp, Homo sapiens
aatttaatatatata

SEQ ID NO: 4863081 - DNA, 21 bp, Homo sapiens
aatttactgatgagagaatgt

SEQ ID NO: 4863082 - DNA, 13 bp, Homo sapiens
aatttacttgttt

SEQ ID NO: 4863083 - DNA, 15 bp, Homo sapiens
aatttatattttaga

SEQ ID NO: 4863084 - DNA, 22 bp, Homo sapiens
aatttcactactagattgacta

SEQ ID NO: 4863085 - DNA, 21 bp, Homo sapiens
aatttcatagctgtacttctt

SEQ ID NO: 4863086 - DNA, 14 bp, Homo sapiens
aatttcctgtgagg

SEQ ID NO: 4863087 - DNA, 16 bp, Homo sapiens
aatttccttcaggcag

SEQ ID NO: 4863088 - DNA, 15 bp, Homo sapiens
aatttgaactttgga

SEQ ID NO: 4863089 - DNA, 23 bp, Homo sapiens
aatttgccagaggaccaatgctt

SEQ ID NO: 4863090 - DNA, 18 bp, Homo sapiens
aatttggagcacaaaatt

SEQ ID NO: 4863091 - DNA, 20 bp, Homo sapiens
aatttggagcacaaaattca

SEQ ID NO: 4863092 - DNA, 12 bp, Homo sapiens
aatttggattta

SEQ ID NO: 4863093 - DNA, 21 bp, Homo sapiens
aatttgtatatgactgcattt

SEQ ID NO: 4863094 - DNA, 20 bp, Homo sapiens
aatttgtcgggttctcccat

SEQ ID NO: 4863095 - DNA, 17 bp, Homo sapiens
aatttgtgtgtttttag

SEQ ID NO: 4863096 - DNA, 13 bp, Homo sapiens
aattttaaagcca

SEQ ID NO: 4863097 - DNA, 15 bp, Homo sapiens
aattttaaagccatt

SEQ ID NO: 4863098 - DNA, 16 bp, Homo sapiens
aattttaaagtgcaaa

SEQ ID NO: 4863099 - DNA, 13 bp, Homo sapiens
aattttagaaata

SEQ ID NO: 4863100 - DNA, 16 bp, Homo sapiens
aattttagaaatattc

SEQ ID NO: 4863101 - DNA, 16 bp, Homo sapiens
aattttctaaaagctt

SEQ ID NO: 4863102 - DNA, 21 bp, Homo sapiens
aattttctaaaagctttcatg

SEQ ID NO: 4863103 - DNA, 12 bp, Homo sapiens
aatttttaactg

SEQ ID NO: 4863104 - DNA, 13 bp, Homo sapiens
aatttttaactgt

SEQ ID NO: 4863105 - DNA, 13 bp, Homo sapiens
aatttttcctgca

SEQ ID NO: 4863106 - DNA, 16 bp, Homo sapiens
aatttttcctgcatgt

SEQ ID NO: 4863107 - DNA, 17 bp, Homo sapiens
aattttttataaaagtg

SEQ ID NO: 4863108 - DNA, 20 bp, Homo sapiens
aattttttggcacttgccat

SEQ ID NO: 4863109 - DNA, 14 bp, Homo sapiens
acaaaaattatgca

SEQ ID NO: 4863110 - DNA, 11 bp, Homo sapiens
acaaaagcaat

SEQ ID NO: 4863111 - DNA, 13 bp, Homo sapiens
acaaaattcaaag

SEQ ID NO: 4863112 - DNA, 15 bp, Homo sapiens
acaaactccaggctg

SEQ ID NO: 4863113 - DNA, 22 bp, Homo sapiens
acaaactgcttcccttactttg

SEQ ID NO: 4863114 - DNA, 20 bp, Homo sapiens
acaaagtttcagagtatatt

SEQ ID NO: 4863115 - DNA, 17 bp, Homo sapiens
acaaataatttgaactt

SEQ ID NO: 4863116 - DNA, 23 bp, Homo sapiens
acaaatgctcccacctgaatttg

SEQ ID NO: 4863117 - DNA, 20 bp, Homo sapiens
acaactactagtgtgactcc

SEQ ID NO: 4863118 - DNA, 12 bp, Homo sapiens
acaagccagcca

SEQ ID NO: 4863119 - DNA, 19 bp, Homo sapiens
acaagctgtatcactgcct

SEQ ID NO: 4863120 - DNA, 15 bp, Homo sapiens
acaagtaatttcagt

SEQ ID NO: 4863121 - DNA, 23 bp, Homo sapiens
acaagtcataggttaatatttaa

SEQ ID NO: 4863122 - DNA, 23 bp, Homo sapiens
acaataaagatcgcccccacctc

SEQ ID NO: 4863123 - DNA, 22 bp, Homo sapiens
acaataggagtggtgatttgaa

SEQ ID NO: 4863124 - DNA, 18 bp, Homo sapiens
acaatcacagggaatggc

SEQ ID NO: 4863125 - DNA, 19 bp, Homo sapiens
acaatggtgtggtgaatgt

SEQ ID NO: 4863126 - DNA, 20 bp, Homo sapiens
acaatggtgtggtgaatgtg

SEQ ID NO: 4863127 - DNA, 15 bp, Homo sapiens
acaatgttggagcag

SEQ ID NO: 4863128 - DNA, 19 bp, Homo sapiens
acaatgttggagcagcagg

SEQ ID NO: 4863129 - DNA, 22 bp, Homo sapiens
acaatgttggagcagcaggcct

SEQ ID NO: 4863130 - DNA, 12 bp, Homo sapiens
acaattaactgc

SEQ ID NO: 4863131 - DNA, 15 bp, Homo sapiens
acaattaactgccct

SEQ ID NO: 4863132 - DNA, 16 bp, Homo sapiens
acaatttatactgcga

SEQ ID NO: 4863133 - DNA, 16 bp, Homo sapiens
acacaatttatactgc

SEQ ID NO: 4863134 - DNA, 9 bp, Homo sapiens
acacacaca

SEQ ID NO: 4863135 - DNA, 16 bp, Homo sapiens
acacacacacgatgca

SEQ ID NO: 4863136 - DNA, 22 bp, Homo sapiens
acacacacgatgcatttaataa

SEQ ID NO: 4863137 - DNA, 18 bp, Homo sapiens
acacagcattgtatatgt

SEQ ID NO: 4863138 - DNA, 20 bp, Homo sapiens
acacagcattgtatatgtga

SEQ ID NO: 4863139 - DNA, 18 bp, Homo sapiens
acacattacaaagttaaa

SEQ ID NO: 4863140 - DNA, 23 bp, Homo sapiens
acacattacaaagttaaaattgt

SEQ ID NO: 4863141 - DNA, 16 bp, Homo sapiens
acacatttgctactgt

SEQ ID NO: 4863142 - DNA, 17 bp, Homo sapiens
acacatttgctactgtt

SEQ ID NO: 4863143 - DNA, 17 bp, Homo sapiens
acaccacagcattgtgt

SEQ ID NO: 4863144 - DNA, 16 bp, Homo sapiens
acaccattaccaaaat

SEQ ID NO: 4863145 - DNA, 13 bp, Homo sapiens
acacgatgcattt

SEQ ID NO: 4863146 - DNA, 24 bp, Homo sapiens
acacgatgcatttaataaagatga

SEQ ID NO: 4863147 - DNA, 16 bp, Homo sapiens
acactaacgaaatatc

SEQ ID NO: 4863148 - DNA, 16 bp, Homo sapiens
acactatttgtgactt

SEQ ID NO: 4863149 - DNA, 21 bp, Homo sapiens
acactatttgtgactttttaa

SEQ ID NO: 4863150 - DNA, 23 bp, Homo sapiens
acactcagaaaattccctggggt

SEQ ID NO: 4863151 - DNA, 22 bp, Homo sapiens
acactgaaaagaaggaaagatg

SEQ ID NO: 4863152 - DNA, 20 bp, Homo sapiens
acactgacttaggtttcagg

SEQ ID NO: 4863153 - DNA, 23 bp, Homo sapiens
acactgacttaggtttcaggaag

SEQ ID NO: 4863154 - DNA, 21 bp, Homo sapiens
acactgatgagtttcactgta

SEQ ID NO: 4863155 - DNA, 18 bp, Homo sapiens
acacttcacctccttctg

SEQ ID NO: 4863156 - DNA, 13 bp, Homo sapiens
acacttgaaacct

SEQ ID NO: 4863157 - DNA, 19 bp, Homo sapiens
acactttgcactgatatat

SEQ ID NO: 4863158 - DNA, 21 bp, Homo sapiens
acagaacatatgttgcaagac

SEQ ID NO: 4863159 - DNA, 13 bp, Homo sapiens
acagaatttgaat

SEQ ID NO: 4863160 - DNA, 16 bp, Homo sapiens
acagactgttgagtta

SEQ ID NO: 4863161 - DNA, 13 bp, Homo sapiens
acagagctctggg

SEQ ID NO: 4863162 - DNA, 22 bp, Homo sapiens
acagaggtattaaaactaaatt

SEQ ID NO: 4863163 - DNA, 18 bp, Homo sapiens
acagaggtttgaaggaga

SEQ ID NO: 4863164 - DNA, 22 bp, Homo sapiens
acagaggtttgaaggagaatgg

SEQ ID NO: 4863165 - DNA, 20 bp, Homo sapiens
acagattctttcagttcttt

SEQ ID NO: 4863166 - DNA, 11 bp, Homo sapiens
acagcattgtg

SEQ ID NO: 4863167 - DNA, 16 bp, Homo sapiens
acagcattgtgtggaa

SEQ ID NO: 4863168 - DNA, 12 bp, Homo sapiens
acagccacaccg

SEQ ID NO: 4863169 - DNA, 15 bp, Homo sapiens
acagccatgcgtggc

SEQ ID NO: 4863170 - DNA, 22 bp, Homo sapiens
acctcttaaagaaaacccaccc

SEQ ID NO: 4863171 - DNA, 20 bp, Homo sapiens
acctcttctctcctccccta

SEQ ID NO: 4863172 - DNA, 14 bp, Homo sapiens
acctgaatttgtat

SEQ ID NO: 4863173 - DNA, 22 bp, Homo sapiens
acctgcccacaactcccttgca

SEQ ID NO: 4863174 - DNA, 11 bp, Homo sapiens
acctgccccaa

SEQ ID NO: 4863175 - DNA, 22 bp, Homo sapiens
acctgccccaagtggtgagcaa

SEQ ID NO: 4863176 - DNA, 21 bp, Homo sapiens
acctgcccgcctaagaccctg

SEQ ID NO: 4863177 - DNA, 20 bp, Homo sapiens
acctgctcacgtcaaatgca

SEQ ID NO: 4863178 - DNA, 23 bp, Homo sapiens
acctggagcttcagccaggtctg

SEQ ID NO: 4863179 - DNA, 21 bp, Homo sapiens
acctggcatctaattctgatt

SEQ ID NO: 4863180 - DNA, 17 bp, Homo sapiens
acctggcctagaaaggg

SEQ ID NO: 4863181 - DNA, 17 bp, Homo sapiens
acctggcttatttaata

SEQ ID NO: 4863182 - DNA, 15 bp, Homo sapiens
acctgtgactcttag

SEQ ID NO: 4863183 - DNA, 18 bp, Homo sapiens
acctgtgactcttagccc

SEQ ID NO: 4863184 - DNA, 14 bp, Homo sapiens
acctgtgaggactg

SEQ ID NO: 4863185 - DNA, 13 bp, Homo sapiens
acctgtgggctga

SEQ ID NO: 4863186 - DNA, 14 bp, Homo sapiens
accttaatttaact

SEQ ID NO: 4863187 - DNA, 18 bp, Homo sapiens
accttcaaggctcttctt

SEQ ID NO: 4863188 - DNA, 23 bp, Homo sapiens
accttcccctaaaccccaagctt

SEQ ID NO: 4863189 - DNA, 18 bp, Homo sapiens
accttcttatttaatctt

SEQ ID NO: 4863190 - DNA, 16 bp, Homo sapiens
accttgaaaaaaaaca

SEQ ID NO: 4863191 - DNA, 23 bp, Homo sapiens
accttgaaaaaaaacagtggatc

SEQ ID NO: 4863192 - DNA, 17 bp, Homo sapiens
accttgagttaacagga

SEQ ID NO: 4863193 - DNA, 20 bp, Homo sapiens
accttgagttaacaggacag

SEQ ID NO: 4863194 - DNA, 14 bp, Homo sapiens
accttgatggggtg

SEQ ID NO: 4863195 - DNA, 17 bp, Homo sapiens
accttgcttccttctca

SEQ ID NO: 4863196 - DNA, 17 bp, Homo sapiens
acgaaatatcaaagtca

SEQ ID NO: 4863197 - DNA, 19 bp, Homo sapiens
acgaacctacagttttaac

SEQ ID NO: 4863198 - DNA, 21 bp, Homo sapiens
acgaatgaaaataactgaatt

SEQ ID NO: 4863199 - DNA, 23 bp, Homo sapiens
acgatgcatttaataaagatgag

SEQ ID NO: 4863200 - DNA, 15 bp, Homo sapiens
acgggatgacctcca

SEQ ID NO: 4863201 - DNA, 18 bp, Homo sapiens
acgtcatgtatttgagca

SEQ ID NO: 4863202 - DNA, 20 bp, Homo sapiens
acgtccatcacgttagctgt

SEQ ID NO: 4863203 - DNA, 14 bp, Homo sapiens
acgtctggggtgtg

SEQ ID NO: 4863204 - DNA, 15 bp, Homo sapiens
acgtggctctgctgg

SEQ ID NO: 4863205 - DNA, 22 bp, Homo sapiens
acgtgtaaatgaagatctttat

SEQ ID NO: 4863206 - DNA, 17 bp, Homo sapiens
actaaaaaaaagatgaa

SEQ ID NO: 4863207 - DNA, 20 bp, Homo sapiens
actaaaaagtataaaatagt

SEQ ID NO: 4863208 - DNA, 15 bp, Homo sapiens
actaaattttaaagc

SEQ ID NO: 4863209 - DNA, 21 bp, Homo sapiens
actaacccagtctttcttcac

SEQ ID NO: 4863210 - DNA, 22 bp, Homo sapiens
actaacgaaatatcaaagtcat

SEQ ID NO: 4863211 - DNA, 11 bp, Homo sapiens
actacaggccc

SEQ ID NO: 4863212 - DNA, 15 bp, Homo sapiens
actaccagggtctct

SEQ ID NO: 4863213 - DNA, 19 bp, Homo sapiens
actaccagggtctctcagg

SEQ ID NO: 4863214 - DNA, 20 bp, Homo sapiens
actaccagggtctctcaggg

SEQ ID NO: 4863215 - DNA, 19 bp, Homo sapiens
actacccatagacatgaaa

SEQ ID NO: 4863216 - DNA, 14 bp, Homo sapiens
actacctactggtg

SEQ ID NO: 4863217 - DNA, 17 bp, Homo sapiens
actacctactggtgtaa

SEQ ID NO: 4863218 - DNA, 13 bp, Homo sapiens
actactactgtta

SEQ ID NO: 4863219 - DNA, 17 bp, Homo sapiens
actactagtgtgactcc

SEQ ID NO: 4863220 - DNA, 20 bp, Homo sapiens
actactagtgtgactcctta

SEQ ID NO: 4863221 - DNA, 18 bp, Homo sapiens
actactgaacacatgtgt

SEQ ID NO: 4863222 - DNA, 15 bp, Homo sapiens
actagattgtgatcc

SEQ ID NO: 4863223 - DNA, 22 bp, Homo sapiens
actaggctcttatgtgtgcctt

SEQ ID NO: 4863224 - DNA, 13 bp, Homo sapiens
actaggttctgta

SEQ ID NO: 4863225 - DNA, 14 bp, Homo sapiens
actagtgtgactcc

SEQ ID NO: 4863226 - DNA, 15 bp, Homo sapiens
actagtgtgactcct

SEQ ID NO: 4863227 - DNA, 17 bp, Homo sapiens
actatatatataaatgt

SEQ ID NO: 4863228 - DNA, 13 bp, Homo sapiens
actatcttctttg

SEQ ID NO: 4863229 - DNA, 18 bp, Homo sapiens
actatcttctttggactt

SEQ ID NO: 4863230 - DNA, 19 bp, Homo sapiens
actatgcgtggctggaacc

SEQ ID NO: 4863231 - DNA, 14 bp, Homo sapiens
actcaaattttggc

SEQ ID NO: 4863232 - DNA, 21 bp, Homo sapiens
actcagaaaattccctggggt

SEQ ID NO: 4863233 - DNA, 13 bp, Homo sapiens
actcagaaattca

SEQ ID NO: 4863234 - DNA, 21 bp, Homo sapiens
actcatgtgcaataggtgaga

SEQ ID NO: 4863235 - DNA, 16 bp, Homo sapiens
actccaagccctgggg

SEQ ID NO: 4863236 - DNA, 17 bp, Homo sapiens
actccaagccctggggc

SEQ ID NO: 4863237 - DNA, 20 bp, Homo sapiens
actccaagccctggggcagg

SEQ ID NO: 4863238 - DNA, 14 bp, Homo sapiens
actccagactctgg

SEQ ID NO: 4863239 - DNA, 16 bp, Homo sapiens
actccagactctgggg

SEQ ID NO: 4863240 - DNA, 13 bp, Homo sapiens
actccaggcagga

SEQ ID NO: 4863241 - DNA, 23 bp, Homo sapiens
actccaggcatgtgtctggccct

SEQ ID NO: 4863242 - DNA, 15 bp, Homo sapiens
actccaggctggaag

SEQ ID NO: 4863243 - DNA, 19 bp, Homo sapiens
actccagggtgacaaggcc

SEQ ID NO: 4863244 - DNA, 21 bp, Homo sapiens
actccagggtgacaaggcctg

SEQ ID NO: 4863245 - DNA, 22 bp, Homo sapiens
actccagggtgacaaggcctgc

SEQ ID NO: 4863246 - DNA, 22 bp, Homo sapiens
actccataccccgccaaggaaa

SEQ ID NO: 4863247 - DNA, 16 bp, Homo sapiens
actcccacagcagccc

SEQ ID NO: 4863248 - DNA, 12 bp, Homo sapiens
actcccagaacc

SEQ ID NO: 4863249 - DNA, 17 bp, Homo sapiens
actcccccagaggtgga

SEQ ID NO: 4863250 - DNA, 20 bp, Homo sapiens
actccccgcctccccaagtc

SEQ ID NO: 4863251 - DNA, 16 bp, Homo sapiens
actcctataaagtgcc

SEQ ID NO: 4863252 - DNA, 14 bp, Homo sapiens
actccttgcttcct

SEQ ID NO: 4863253 - DNA, 21 bp, Homo sapiens
actctaaaattataaatgaca

SEQ ID NO: 4863254 - DNA, 23 bp, Homo sapiens
actctacccctgctcccattcct

SEQ ID NO: 4863255 - DNA, 16 bp, Homo sapiens
actctacctgcacact

SEQ ID NO: 4863256 - DNA, 16 bp, Homo sapiens
actctagagggcgagg

SEQ ID NO: 4863257 - DNA, 22 bp, Homo sapiens
actctcattttatttacagctg

SEQ ID NO: 4863258 - DNA, 13 bp, Homo sapiens
actctccatatcc

SEQ ID NO: 4863259 - DNA, 23 bp, Homo sapiens
actctgctgtctaacctgtgacc

SEQ ID NO: 4863260 - DNA, 23 bp, Homo sapiens
actctggcttcaaaaagccacag

SEQ ID NO: 4863261 - DNA, 18 bp, Homo sapiens
actctgttcccccaccct

SEQ ID NO: 4863262 - DNA, 19 bp, Homo sapiens
actctgttcccccaccctc

SEQ ID NO: 4863263 - DNA, 23 bp, Homo sapiens
actctgttcccccaccctccatg

SEQ ID NO: 4863264 - DNA, 14 bp, Homo sapiens
actgaaaagaagga

SEQ ID NO: 4863265 - DNA, 17 bp, Homo sapiens
actgaaaagaaggaaag

SEQ ID NO: 4863266 - DNA, 20 bp, Homo sapiens
actgaacacatgtgtatgat

SEQ ID NO: 4863267 - DNA, 15 bp, Homo sapiens
actgacatttcttct

SEQ ID NO: 4863268 - DNA, 15 bp, Homo sapiens
actgaggatattcag

SEQ ID NO: 4863269 - DNA, 12 bp, Homo sapiens
actgaggcccag

SEQ ID NO: 4863270 - DNA, 14 bp, Homo sapiens
actgaggcccagag

SEQ ID NO: 4863271 - DNA, 15 bp, Homo sapiens
actgaggcccagaga

SEQ ID NO: 4863272 - DNA, 21 bp, Homo sapiens
actgaggcccagagagggaag

SEQ ID NO: 4863273 - DNA, 16 bp, Homo sapiens
actgatgagagaatgt

SEQ ID NO: 4863274 - DNA, 22 bp, Homo sapiens
actgatgagtttcactgtactg

SEQ ID NO: 4863275 - DNA, 12 bp, Homo sapiens
actgatttcaga

SEQ ID NO: 4863276 - DNA, 15 bp, Homo sapiens
actgatttcagagtg

SEQ ID NO: 4863277 - DNA, 14 bp, Homo sapiens
actgcaatcactgt

SEQ ID NO: 4863278 - DNA, 18 bp, Homo sapiens
actgcaatcactgtgcta

SEQ ID NO: 4863279 - DNA, 15 bp, Homo sapiens
actgccaaaacattt

SEQ ID NO: 4863280 - DNA, 14 bp, Homo sapiens
actgccctctgaaa

SEQ ID NO: 4863281 - DNA, 12 bp, Homo sapiens
actgctcctggg

SEQ ID NO: 4863282 - DNA, 13 bp, Homo sapiens
actgctcctgggc

SEQ ID NO: 4863283 - DNA, 17 bp, Homo sapiens
actgctgcaaggtggcc

SEQ ID NO: 4863284 - DNA, 16 bp, Homo sapiens
actgcttaattgctga

SEQ ID NO: 4863285 - DNA, 23 bp, Homo sapiens
actggacccttgattcattctga

SEQ ID NO: 4863286 - DNA, 14 bp, Homo sapiens
actggactgcatgg

SEQ ID NO: 4863287 - DNA, 14 bp, Homo sapiens
actggaggagcaca

SEQ ID NO: 4863288 - DNA, 19 bp, Homo sapiens
actggccttgcctccagga

SEQ ID NO: 4863289 - DNA, 21 bp, Homo sapiens
actggccttgcctccaggacc

SEQ ID NO: 4863290 - DNA, 20 bp, Homo sapiens
actgggagccacttctcccc

SEQ ID NO: 4863291 - DNA, 15 bp, Homo sapiens
actggggggcaggcc

SEQ ID NO: 4863292 - DNA, 16 bp, Homo sapiens
actggggggcaggcct

SEQ ID NO: 4863293 - DNA, 18 bp, Homo sapiens
actggggggcaggcctcc

SEQ ID NO: 4863294 - DNA, 21 bp, Homo sapiens
actggggggcaggcctcccaa

SEQ ID NO: 4863295 - DNA, 22 bp, Homo sapiens
actggggggcaggcctcccaag

SEQ ID NO: 4863296 - DNA, 16 bp, Homo sapiens
actgggttcccatgct

SEQ ID NO: 4863297 - DNA, 19 bp, Homo sapiens
actggtgtaatctcaatgc

SEQ ID NO: 4863298 - DNA, 21 bp, Homo sapiens
actggtgtaatctcaatgcaa

SEQ ID NO: 4863299 - DNA, 16 bp, Homo sapiens
actggttctgaggcca

SEQ ID NO: 4863300 - DNA, 22 bp, Homo sapiens
actgtaacttccaaataaataa

SEQ ID NO: 4863301 - DNA, 15 bp, Homo sapiens
actgtactgcatgtg

SEQ ID NO: 4863302 - DNA, 15 bp, Homo sapiens
actgtaggcacactt

SEQ ID NO: 4863303 - DNA, 14 bp, Homo sapiens
actgtatattcagg

SEQ ID NO: 4863304 - DNA, 23 bp, Homo sapiens
actgtatgggggagattgaactt

SEQ ID NO: 4863305 - DNA, 16 bp, Homo sapiens
actgtccagagtctct

SEQ ID NO: 4863306 - DNA, 16 bp, Homo sapiens
actgtcctattatatt

SEQ ID NO: 4863307 - DNA, 15 bp, Homo sapiens
actgtggatattgtt

SEQ ID NO: 4863308 - DNA, 17 bp, Homo sapiens
actgtggccagtaaaat

SEQ ID NO: 4863309 - DNA, 15 bp, Homo sapiens
actgtggcctgcagg

SEQ ID NO: 4863310 - DNA, 16 bp, Homo sapiens
actgtggcctgcagga

SEQ ID NO: 4863311 - DNA, 17 bp, Homo sapiens
actgtggcctgcaggag

SEQ ID NO: 4863312 - DNA, 18 bp, Homo sapiens
actgtggcctgcaggagg

SEQ ID NO: 4863313 - DNA, 19 bp, Homo sapiens
actgtgggcaaagtcctcc

SEQ ID NO: 4863314 - DNA, 17 bp, Homo sapiens
actgttgcacttttgaa

SEQ ID NO: 4863315 - DNA, 21 bp, Homo sapiens
acttaactgtccgtaagcagt

SEQ ID NO: 4863316 - DNA, 17 bp, Homo sapiens
acttaagggagaaaaaa

SEQ ID NO: 4863317 - DNA, 15 bp, Homo sapiens
acttacatcatgtgt

SEQ ID NO: 4863318 - DNA, 20 bp, Homo sapiens
acttacatgttcccaaaaca

SEQ ID NO: 4863319 - DNA, 20 bp, Homo sapiens
acttatggcatgactcttca

SEQ ID NO: 4863320 - DNA, 21 bp, Homo sapiens
acttatgtagaaactgaggcc

SEQ ID NO: 4863321 - DNA, 23 bp, Homo sapiens
acttatgtagaaactgaggccca

SEQ ID NO: 4863322 - DNA, 17 bp, Homo sapiens
acttattgaatatatga

SEQ ID NO: 4863323 - DNA, 14 bp, Homo sapiens
acttcaaagtgcct

SEQ ID NO: 4863324 - DNA, 19 bp, Homo sapiens
acttcaaagtgcctgggct

SEQ ID NO: 4863325 - DNA, 20 bp, Homo sapiens
acttcaaagtgcctgggctc

SEQ ID NO: 4863326 - DNA, 17 bp, Homo sapiens
acttcacctccttctgc

SEQ ID NO: 4863327 - DNA, 22 bp, Homo sapiens
acttcatgtaattttattttaa

SEQ ID NO: 4863328 - DNA, 16 bp, Homo sapiens
acttccaaagaaagtt

SEQ ID NO: 4863329 - DNA, 12 bp, Homo sapiens
acttccaccttg

SEQ ID NO: 4863330 - DNA, 13 bp, Homo sapiens
acttcctgtggat

SEQ ID NO: 4863331 - DNA, 15 bp, Homo sapiens
acttctcccctgccc

SEQ ID NO: 4863332 - DNA, 15 bp, Homo sapiens
acttctgtaattgtg

SEQ ID NO: 4863333 - DNA, 21 bp, Homo sapiens
acttctgtaattgtgtggatt

SEQ ID NO: 4863334 - DNA, 14 bp, Homo sapiens
acttgctcccaacc

SEQ ID NO: 4863335 - DNA, 19 bp, Homo sapiens
acttggagaatactgccaa

SEQ ID NO: 4863336 - DNA, 21 bp, Homo sapiens
acttggcccccttcaggagcc

SEQ ID NO: 4863337 - DNA, 16 bp, Homo sapiens
acttggggaaggggcc

SEQ ID NO: 4863338 - DNA, 20 bp, Homo sapiens
acttgggtcacatgactctc

SEQ ID NO: 4863339 - DNA, 20 bp, Homo sapiens
acttgtatccaggcctggga

SEQ ID NO: 4863340 - DNA, 14 bp, Homo sapiens
actttctgttatgg

SEQ ID NO: 4863341 - DNA, 23 bp, Homo sapiens
actttggtagctgggaaagcata

SEQ ID NO: 4863342 - DNA, 14 bp, Homo sapiens
actttgtcagtgtt

SEQ ID NO: 4863343 - DNA, 18 bp, Homo sapiens
acttttaaggataaatca

SEQ ID NO: 4863344 - DNA, 14 bp, Homo sapiens
acttttataaagca

SEQ ID NO: 4863345 - DNA, 13 bp, Homo sapiens
acttttccttttc

SEQ ID NO: 4863346 - DNA, 15 bp, Homo sapiens
acttttccttttctt

SEQ ID NO: 4863347 - DNA, 17 bp, Homo sapiens
acttttccttttcttaa

SEQ ID NO: 4863348 - DNA, 13 bp, Homo sapiens
agaaaaactaact

SEQ ID NO: 4863349 - DNA, 14 bp, Homo sapiens
agaaaagtgaattg

SEQ ID NO: 4863350 - DNA, 14 bp, Homo sapiens
agaaaattccctgg

SEQ ID NO: 4863351 - DNA, 13 bp, Homo sapiens
agaaaattgagtt

SEQ ID NO: 4863352 - DNA, 13 bp, Homo sapiens
agaaacaaagatg

SEQ ID NO: 4863353 - DNA, 19 bp, Homo sapiens
agaaacactatttgtgact

SEQ ID NO: 4863354 - DNA, 16 bp, Homo sapiens
agaaacactgaaaaga

SEQ ID NO: 4863355 - DNA, 17 bp, Homo sapiens
agaaacactgaaaagaa

SEQ ID NO: 4863356 - DNA, 21 bp, Homo sapiens
agaaacccagagatgcctgat

SEQ ID NO: 4863357 - DNA, 23 bp, Homo sapiens
agaaacctgccaaggagcatcct

SEQ ID NO: 4863358 - DNA, 15 bp, Homo sapiens
agaaactgaggccca

SEQ ID NO: 4863359 - DNA, 18 bp, Homo sapiens
agaaactgaggcccagag

SEQ ID NO: 4863360 - DNA, 21 bp, Homo sapiens
agaaactgaggcccagagagg

SEQ ID NO: 4863361 - DNA, 21 bp, Homo sapiens
agaaagcacaatttaaaacaa

SEQ ID NO: 4863362 - DNA, 14 bp, Homo sapiens
agaaagcttccttc

SEQ ID NO: 4863363 - DNA, 14 bp, Homo sapiens
agaaagggcaaggg

SEQ ID NO: 4863364 - DNA, 17 bp, Homo sapiens
agaaataatgctacaat

SEQ ID NO: 4863365 - DNA, 19 bp, Homo sapiens
agaaataatgctacaattt

SEQ ID NO: 4863366 - DNA, 14 bp, Homo sapiens
agaaatactcatgt

SEQ ID NO: 4863367 - DNA, 16 bp, Homo sapiens
agaaatagaattataa

SEQ ID NO: 4863368 - DNA, 18 bp, Homo sapiens
agaaatagacaaaaagta

SEQ ID NO: 4863369 - DNA, 17 bp, Homo sapiens
agaaatataacacattt

SEQ ID NO: 4863370 - DNA, 16 bp, Homo sapiens
agaaatggaaagcaga

SEQ ID NO: 4863371 - DNA, 16 bp, Homo sapiens
agaaatttagagctaa

SEQ ID NO: 4863372 - DNA, 20 bp, Homo sapiens
agaaccacacttgaaacctt

SEQ ID NO: 4863373 - DNA, 17 bp, Homo sapiens
agaacctctaagtgctg

SEQ ID NO: 4863374 - DNA, 19 bp, Homo sapiens
agaacctctaagtgctgct

SEQ ID NO: 4863375 - DNA, 20 bp, Homo sapiens
agaacctctaagtgctgctg

SEQ ID NO: 4863376 - DNA, 17 bp, Homo sapiens
agaacgtggctctgctg

SEQ ID NO: 4863377 - DNA, 18 bp, Homo sapiens
agaacgtggctctgctgg

SEQ ID NO: 4863378 - DNA, 13 bp, Homo sapiens
agaactcttcctc

SEQ ID NO: 4863379 - DNA, 16 bp, Homo sapiens
agaacttcagcattgt

SEQ ID NO: 4863380 - DNA, 12 bp, Homo sapiens
agaagaaagatg

SEQ ID NO: 4863381 - DNA, 15 bp, Homo sapiens
agaagaaggccagag

SEQ ID NO: 4863382 - DNA, 16 bp, Homo sapiens
agaagaaggccagaga

SEQ ID NO: 4863383 - DNA, 17 bp, Homo sapiens
agaagaaggccagagag

SEQ ID NO: 4863384 - DNA, 18 bp, Homo sapiens
agaagaaggccagagagg

SEQ ID NO: 4863385 - DNA, 20 bp, Homo sapiens
agaagaatcttcctggcaca

SEQ ID NO: 4863386 - DNA, 15 bp, Homo sapiens
agaagacaaactgct

SEQ ID NO: 4863387 - DNA, 21 bp, Homo sapiens
agaagcctccaagcctgcctc

SEQ ID NO: 4863388 - DNA, 11 bp, Homo sapiens
agaagcctgca

SEQ ID NO: 4863389 - DNA, 21 bp, Homo sapiens
agaagcctgcataatgtttct

SEQ ID NO: 4863390 - DNA, 19 bp, Homo sapiens
agaaggaaagatggttaaa

SEQ ID NO: 4863391 - DNA, 14 bp, Homo sapiens
agaaggccagagag

SEQ ID NO: 4863392 - DNA, 15 bp, Homo sapiens
agaagtacagggcag

SEQ ID NO: 4863393 - DNA, 14 bp, Homo sapiens
agaagtacaggtca

SEQ ID NO: 4863394 - DNA, 14 bp, Homo sapiens
agaagtcccttcaa

SEQ ID NO: 4863395 - DNA, 13 bp, Homo sapiens
agaatagactgga

SEQ ID NO: 4863396 - DNA, 17 bp, Homo sapiens
agaatcagaagatagtc

SEQ ID NO: 4863397 - DNA, 16 bp, Homo sapiens
agaatcagacagcagg

SEQ ID NO: 4863398 - DNA, 12 bp, Homo sapiens
agaatcttcctg

SEQ ID NO: 4863399 - DNA, 14 bp, Homo sapiens
agaatgaccttgag

SEQ ID NO: 4863400 - DNA, 18 bp, Homo sapiens
agaatggcatggcaggag

SEQ ID NO: 4863401 - DNA, 21 bp, Homo sapiens
agaatggcatggcaggagtct

SEQ ID NO: 4863402 - DNA, 19 bp, Homo sapiens
agaatggcctggagcaggc

SEQ ID NO: 4863403 - DNA, 22 bp, Homo sapiens
agaatgggacgaggacatttgt

SEQ ID NO: 4863404 - DNA, 23 bp, Homo sapiens
agaatgggacgaggacatttgtg

SEQ ID NO: 4863405 - DNA, 17 bp, Homo sapiens
agaatgtattttcatag

SEQ ID NO: 4863406 - DNA, 12 bp, Homo sapiens
agaatgttttca

SEQ ID NO: 4863407 - DNA, 15 bp, Homo sapiens
agaattctgattgat

SEQ ID NO: 4863408 - DNA, 14 bp, Homo sapiens
agacaaaaagtata

SEQ ID NO: 4863409 - DNA, 15 bp, Homo sapiens
agacaaaacagataa

SEQ ID NO: 4863410 - DNA, 12 bp, Homo sapiens
agacaaatattc

SEQ ID NO: 4863411 - DNA, 20 bp, Homo sapiens
agacaaccttgtcccaagga

SEQ ID NO: 4863412 - DNA, 14 bp, Homo sapiens
agacagagacaagt

SEQ ID NO: 4863413 - DNA, 22 bp, Homo sapiens
agacagctggcggaggctgctc

SEQ ID NO: 4863414 - DNA, 19 bp, Homo sapiens
agacagcttacaggagcca

SEQ ID NO: 4863415 - DNA, 18 bp, Homo sapiens
ataaatgtaccagagaga

SEQ ID NO: 4863416 - DNA, 17 bp, Homo sapiens
ataaatgtataaatata

SEQ ID NO: 4863417 - DNA, 19 bp, Homo sapiens
ataaatgtataaatataca

SEQ ID NO: 4863418 - DNA, 13 bp, Homo sapiens
ataacacattttt

SEQ ID NO: 4863419 - DNA, 23 bp, Homo sapiens
ataacagaaagcctgggtgacat

SEQ ID NO: 4863420 - DNA, 18 bp, Homo sapiens
ataacatctttattgaaa

SEQ ID NO: 4863421 - DNA, 21 bp, Homo sapiens
ataacatctttattgaaattc

SEQ ID NO: 4863422 - DNA, 15 bp, Homo sapiens
ataacctagttaaag

SEQ ID NO: 4863423 - DNA, 19 bp, Homo sapiens
ataacctagttaaagaaag

SEQ ID NO: 4863424 - DNA, 22 bp, Homo sapiens
ataactctaaccaaggctgtgt

SEQ ID NO: 4863425 - DNA, 15 bp, Homo sapiens
ataacttctcatgta

SEQ ID NO: 4863426 - DNA, 20 bp, Homo sapiens
ataacttctcatgtatatta

SEQ ID NO: 4863427 - DNA, 18 bp, Homo sapiens
ataacttggggaggcaag

SEQ ID NO: 4863428 - DNA, 12 bp, Homo sapiens
ataagagaaacc

SEQ ID NO: 4863429 - DNA, 22 bp, Homo sapiens
ataagagaaacctgccaaggag

SEQ ID NO: 4863430 - DNA, 17 bp, Homo sapiens
ataagcactgtaaactt

SEQ ID NO: 4863431 - DNA, 15 bp, Homo sapiens
ataagggaaaagata

SEQ ID NO: 4863432 - DNA, 13 bp, Homo sapiens
ataagtgtacata

SEQ ID NO: 4863433 - DNA, 19 bp, Homo sapiens
ataagtgtacatatgtgct

SEQ ID NO: 4863434 - DNA, 20 bp, Homo sapiens
ataagtgtacatatgtgctg

SEQ ID NO: 4863435 - DNA, 16 bp, Homo sapiens
ataataaaaagaaaga

SEQ ID NO: 4863436 - DNA, 11 bp, Homo sapiens
ataataaaaat

SEQ ID NO: 4863437 - DNA, 22 bp, Homo sapiens
agctggctctataaggcagcct

SEQ ID NO: 4863438 - DNA, 20 bp, Homo sapiens
agctgtacttcttgaatata

SEQ ID NO: 4863439 - DNA, 14 bp, Homo sapiens
agctgtatcactgc

SEQ ID NO: 4863440 - DNA, 16 bp, Homo sapiens
agctgtcactctgtgc

SEQ ID NO: 4863441 - DNA, 14 bp, Homo sapiens
agctgtgaaatcca

SEQ ID NO: 4863442 - DNA, 19 bp, Homo sapiens
agctgtgctccacactcag

SEQ ID NO: 4863443 - DNA, 20 bp, Homo sapiens
agctgttccattacaccaca

SEQ ID NO: 4863444 - DNA, 14 bp, Homo sapiens
agcttaatgctaca

SEQ ID NO: 4863445 - DNA, 23 bp, Homo sapiens
agcttacaggagccagcctgctt

SEQ ID NO: 4863446 - DNA, 16 bp, Homo sapiens
agcttacctgggcaca

SEQ ID NO: 4863447 - DNA, 18 bp, Homo sapiens
agcttacctgggcacaaa

SEQ ID NO: 4863448 - DNA, 18 bp, Homo sapiens
agcttcacagtacccaaa

SEQ ID NO: 4863449 - DNA, 13 bp, Homo sapiens
agcttcagccagg

SEQ ID NO: 4863450 - DNA, 14 bp, Homo sapiens
agcttcccaacaga

SEQ ID NO: 4863451 - DNA, 19 bp, Homo sapiens
agcttctgggagatttttt

SEQ ID NO: 4863452 - DNA, 13 bp, Homo sapiens
agcttcttcacag

SEQ ID NO: 4863453 - DNA, 20 bp, Homo sapiens
agctttgtaactgttttcaa

SEQ ID NO: 4863454 - DNA, 13 bp, Homo sapiens
agctttttggaat

SEQ ID NO: 4863455 - DNA, 17 bp, Homo sapiens
aggaaaaggttgaataa

SEQ ID NO: 4863456 - DNA, 22 bp, Homo sapiens
aggaaaaggttgaataatatat

SEQ ID NO: 4863457 - DNA, 16 bp, Homo sapiens
aggaaaagtcttccta

SEQ ID NO: 4863458 - DNA, 14 bp, Homo sapiens
aggaaaatgtctgt

SEQ ID NO: 4863459 - DNA, 14 bp, Homo sapiens
aggaaagagctagg

SEQ ID NO: 4863460 - DNA, 18 bp, Homo sapiens
aggaaaggcatgtacaaa

SEQ ID NO: 4863461 - DNA, 14 bp, Homo sapiens
aggaaccctggagg

SEQ ID NO: 4863462 - DNA, 20 bp, Homo sapiens
aggaacggtggaggcagagg

SEQ ID NO: 4863463 - DNA, 17 bp, Homo sapiens
aggaactctagagggcg

SEQ ID NO: 4863464 - DNA, 17 bp, Homo sapiens
aggaatcattcagaaat

SEQ ID NO: 4863465 - DNA, 13 bp, Homo sapiens
aggacagagggat

SEQ ID NO: 4863466 - DNA, 22 bp, Homo sapiens
aggacagttgatggagccccag

SEQ ID NO: 4863467 - DNA, 16 bp, Homo sapiens
aggacatgcaataaaa

SEQ ID NO: 4863468 - DNA, 20 bp, Homo sapiens
aggacatgcaataaaattta

SEQ ID NO: 4863469 - DNA, 22 bp, Homo sapiens
aggacccatccctgcctggagg

SEQ ID NO: 4863470 - DNA, 23 bp, Homo sapiens
aggacccatccctgcctggaggc

SEQ ID NO: 4863471 - DNA, 13 bp, Homo sapiens
aggaccgtgccct

SEQ ID NO: 4863472 - DNA, 18 bp, Homo sapiens
aggaccttgcttccttct

SEQ ID NO: 4863473 - DNA, 19 bp, Homo sapiens
aggaccttgcttccttctc

SEQ ID NO: 4863474 - DNA, 20 bp, Homo sapiens
aggaccttgcttccttctca

SEQ ID NO: 4863475 - DNA, 13 bp, Homo sapiens
aggactcccagaa

SEQ ID NO: 4863476 - DNA, 18 bp, Homo sapiens
aggactcccagaacctct

SEQ ID NO: 4863477 - DNA, 14 bp, Homo sapiens
aggactctctccag

SEQ ID NO: 4863478 - DNA, 16 bp, Homo sapiens
aggactctctccagga

SEQ ID NO: 4863479 - DNA, 20 bp, Homo sapiens
aggactggttctgaggccag

SEQ ID NO: 4863480 - DNA, 13 bp, Homo sapiens
aggagaagccagt

SEQ ID NO: 4863481 - DNA, 17 bp, Homo sapiens
aggagaatggcatggca

SEQ ID NO: 4863482 - DNA, 23 bp, Homo sapiens
aggagaatggcatggcaggagtc

SEQ ID NO: 4863483 - DNA, 13 bp, Homo sapiens
aggagacaaaaga

SEQ ID NO: 4863484 - DNA, 18 bp, Homo sapiens
aggagagaggaggaaaag

SEQ ID NO: 4863485 - DNA, 22 bp, Homo sapiens
aggagcacacatccaagaggga

SEQ ID NO: 4863486 - DNA, 15 bp, Homo sapiens
aggagccagcctgct

SEQ ID NO: 4863487 - DNA, 20 bp, Homo sapiens
aggagccagcctgcttccca

SEQ ID NO: 4863488 - DNA, 20 bp, Homo sapiens
aggagcctggccaggcaggg

SEQ ID NO: 4863489 - DNA, 22 bp, Homo sapiens
aggagcctggccaggcagggag

SEQ ID NO: 4863490 - DNA, 15 bp, Homo sapiens
aggagctgatacttt

SEQ ID NO: 4863491 - DNA, 21 bp, Homo sapiens
aggagtttgagaccagcttag

SEQ ID NO: 4863492 - DNA, 17 bp, Homo sapiens
aggatagcgctcccctt

SEQ ID NO: 4863493 - DNA, 19 bp, Homo sapiens
aggatattcagatgtatgt

SEQ ID NO: 4863494 - DNA, 17 bp, Homo sapiens
aggatccagggcagcag

SEQ ID NO: 4863495 - DNA, 18 bp, Homo sapiens
aggatccagggcagcagg

SEQ ID NO: 4863496 - DNA, 22 bp, Homo sapiens
aggatccagggcagcaggccag

SEQ ID NO: 4863497 - DNA, 14 bp, Homo sapiens
aggatccccctctt

SEQ ID NO: 4863498 - DNA, 14 bp, Homo sapiens
aggatctctaaaga

SEQ ID NO: 4863499 - DNA, 19 bp, Homo sapiens
aggatctctaaagagcatc

SEQ ID NO: 4863500 - DNA, 23 bp, Homo sapiens
aggatgatgtctttttattaaaa

SEQ ID NO: 4863501 - DNA, 23 bp, Homo sapiens
aggatgctaacatctaaaaatag

SEQ ID NO: 4863502 - DNA, 21 bp, Homo sapiens
aggatgtgatatataagtgta

SEQ ID NO: 4863503 - DNA, 22 bp, Homo sapiens
aggcaaaaatgtccagccaccc

SEQ ID NO: 4863504 - DNA, 18 bp, Homo sapiens
aggcaaactgaggcagca

SEQ ID NO: 4863505 - DNA, 20 bp, Homo sapiens
aggcaagaaagcttccttca

SEQ ID NO: 4863506 - DNA, 15 bp, Homo sapiens
aggcaagctgaaatt

SEQ ID NO: 4863507 - DNA, 16 bp, Homo sapiens
aggcacattaactgtt

SEQ ID NO: 4863508 - DNA, 21 bp, Homo sapiens
aggcacctacactcacctgca

SEQ ID NO: 4863509 - DNA, 23 bp, Homo sapiens
aggcacctacactcacctgcact

SEQ ID NO: 4863510 - DNA, 14 bp, Homo sapiens
aggcagctgaaatt

SEQ ID NO: 4863511 - DNA, 14 bp, Homo sapiens
aggcagggagagag

SEQ ID NO: 4863512 - DNA, 23 bp, Homo sapiens
aggcagggagagagtagctgcag

SEQ ID NO: 4863513 - DNA, 14 bp, Homo sapiens
aggcagggccctga

SEQ ID NO: 4863514 - DNA, 15 bp, Homo sapiens
aggcagggccctgaa

SEQ ID NO: 4863515 - DNA, 14 bp, Homo sapiens
aggcaggggaatgt

SEQ ID NO: 4863516 - DNA, 19 bp, Homo sapiens
aggcaggggaatgtatgtg

SEQ ID NO: 4863517 - DNA, 12 bp, Homo sapiens
aggcaggtgctt

SEQ ID NO: 4863518 - DNA, 14 bp, Homo sapiens
aggcaggtgctttt

SEQ ID NO: 4863519 - DNA, 18 bp, Homo sapiens
aggcataaacctgtgctg

SEQ ID NO: 4863520 - DNA, 20 bp, Homo sapiens
aggcatgaaattcttcctaa

SEQ ID NO: 4863521 - DNA, 17 bp, Homo sapiens
aggcatgtgtctggccc

SEQ ID NO: 4863522 - DNA, 14 bp, Homo sapiens
aggcattctcccag

SEQ ID NO: 4863523 - DNA, 15 bp, Homo sapiens
aggcattctcccagc

SEQ ID NO: 4863524 - DNA, 21 bp, Homo sapiens
aggccaaagagtctccagttt

SEQ ID NO: 4863525 - DNA, 15 bp, Homo sapiens
aggccaagctgagga

SEQ ID NO: 4863526 - DNA, 15 bp, Homo sapiens
aggccaagggaccag

SEQ ID NO: 4863527 - DNA, 21 bp, Homo sapiens
aggccacagaaggtgaacttt

SEQ ID NO: 4863528 - DNA, 20 bp, Homo sapiens
agacagcttacaggagccag

SEQ ID NO: 4863529 - DNA, 21 bp, Homo sapiens
agacagcttacaggagccagc

SEQ ID NO: 4863530 - DNA, 21 bp, Homo sapiens
agacaggtgcctaacctggga

SEQ ID NO: 4863531 - DNA, 12 bp, Homo sapiens
agacatgtgaca

SEQ ID NO: 4863532 - DNA, 13 bp, Homo sapiens
agacatgtgacat

SEQ ID NO: 4863533 - DNA, 15 bp, Homo sapiens
agaccagagctgtct

SEQ ID NO: 4863534 - DNA, 13 bp, Homo sapiens
agaccataagaga

SEQ ID NO: 4863535 - DNA, 15 bp, Homo sapiens
agaccataagagaaa

SEQ ID NO: 4863536 - DNA, 22 bp, Homo sapiens
agaccataagagaaacctgcca

SEQ ID NO: 4863537 - DNA, 23 bp, Homo sapiens
agaccataagagaaacctgccaa

SEQ ID NO: 4863538 - DNA, 18 bp, Homo sapiens
agacccctgcctggactt

SEQ ID NO: 4863539 - DNA, 17 bp, Homo sapiens
agacctgaaagagagga

SEQ ID NO: 4863540 - DNA, 21 bp, Homo sapiens
agacgtttataaacagaaatg

SEQ ID NO: 4863541 - DNA, 16 bp, Homo sapiens
agactcaaagaagtac

SEQ ID NO: 4863542 - DNA, 12 bp, Homo sapiens
agactcagcaga

SEQ ID NO: 4863543 - DNA, 13 bp, Homo sapiens
agactcagcagag

SEQ ID NO: 4863544 - DNA, 15 bp, Homo sapiens
agactctagtattta

SEQ ID NO: 4863545 - DNA, 17 bp, Homo sapiens
agactctagtatttatg

SEQ ID NO: 4863546 - DNA, 17 bp, Homo sapiens
agactgagccagattgg

SEQ ID NO: 4863547 - DNA, 17 bp, Homo sapiens
agactggatttgcagaa

SEQ ID NO: 4863548 - DNA, 21 bp, Homo sapiens
agactggatttgcagaagttt

SEQ ID NO: 4863549 - DNA, 18 bp, Homo sapiens
agactgggagccacttct

SEQ ID NO: 4863550 - DNA, 22 bp, Homo sapiens
agactgggagccacttctcccc

SEQ ID NO: 4863551 - DNA, 14 bp, Homo sapiens
agactgttgagtta

SEQ ID NO: 4863552 - DNA, 21 bp, Homo sapiens
agacttaaagggcccaatgaa

SEQ ID NO: 4863553 - DNA, 22 bp, Homo sapiens
agacttgaaatacgtttgtgtt

SEQ ID NO: 4863554 - DNA, 16 bp, Homo sapiens
agacttgcagttagac

SEQ ID NO: 4863555 - DNA, 18 bp, Homo sapiens
agacttggagaatactgc

SEQ ID NO: 4863556 - DNA, 21 bp, Homo sapiens
agacttgtatagcatgaaata

SEQ ID NO: 4863557 - DNA, 16 bp, Homo sapiens
agagaaatgccccagt

SEQ ID NO: 4863558 - DNA, 18 bp, Homo sapiens
agagaagtatacataagt

SEQ ID NO: 4863559 - DNA, 18 bp, Homo sapiens
agagaatgtattttcata

SEQ ID NO: 4863560 - DNA, 22 bp, Homo sapiens
agagaatgtattttcatagatg

SEQ ID NO: 4863561 - DNA, 15 bp, Homo sapiens
agagaatgttcctac

SEQ ID NO: 4863562 - DNA, 22 bp, Homo sapiens
agagacactgttgataaaaact

SEQ ID NO: 4863563 - DNA, 17 bp, Homo sapiens
agagaccataagagaaa

SEQ ID NO: 4863564 - DNA, 15 bp, Homo sapiens
agagagcagagaagt

SEQ ID NO: 4863565 - DNA, 14 bp, Homo sapiens
agagagggaagatg

SEQ ID NO: 4863566 - DNA, 19 bp, Homo sapiens
agagaggtagcactctcag

SEQ ID NO: 4863567 - DNA, 19 bp, Homo sapiens
agagagttctggatgtctg

SEQ ID NO: 4863568 - DNA, 22 bp, Homo sapiens
agagagttctggatgtctggct

SEQ ID NO: 4863569 - DNA, 14 bp, Homo sapiens
agagatcaaagatg

SEQ ID NO: 4863570 - DNA, 12 bp, Homo sapiens
agagcattgtca

SEQ ID NO: 4863571 - DNA, 23 bp, Homo sapiens
agagcattgtcaccgcaggtgct

SEQ ID NO: 4863572 - DNA, 21 bp, Homo sapiens
agagccatacataaaagaaat

SEQ ID NO: 4863573 - DNA, 23 bp, Homo sapiens
agagcccctactgtgggcaaagt

SEQ ID NO: 4863574 - DNA, 20 bp, Homo sapiens
agagcctttttacctggcct

SEQ ID NO: 4863575 - DNA, 22 bp, Homo sapiens
agagcctttttacctggcctag

SEQ ID NO: 4863576 - DNA, 16 bp, Homo sapiens
agagctaaaaaggccc

SEQ ID NO: 4863577 - DNA, 17 bp, Homo sapiens
agagctactcccacagc

SEQ ID NO: 4863578 - DNA, 18 bp, Homo sapiens
agagctaggaaccctgga

SEQ ID NO: 4863579 - DNA, 19 bp, Homo sapiens
agagctaggaaccctggag

SEQ ID NO: 4863580 - DNA, 19 bp, Homo sapiens
agagctatggtgcttgctg

SEQ ID NO: 4863581 - DNA, 16 bp, Homo sapiens
agagctcttgtgttca

SEQ ID NO: 4863582 - DNA, 18 bp, Homo sapiens
agagctcttgtgttcaga

SEQ ID NO: 4863583 - DNA, 23 bp, Homo sapiens
agagctcttgtgttcagaagaat

SEQ ID NO: 4863584 - DNA, 16 bp, Homo sapiens
agagctgtctgaactc

SEQ ID NO: 4863585 - DNA, 21 bp, Homo sapiens
agagcttgtggtggggcagga

SEQ ID NO: 4863586 - DNA, 14 bp, Homo sapiens
agaggaccaatgct

SEQ ID NO: 4863587 - DNA, 19 bp, Homo sapiens
agaggactcacttgcccac

SEQ ID NO: 4863588 - DNA, 24 bp, Homo sapiens
agaggactggttctgaggccagaa

SEQ ID NO: 4863589 - DNA, 20 bp, Homo sapiens
agaggaggaaaagtcttcct

SEQ ID NO: 4863590 - DNA, 21 bp, Homo sapiens
agaggaggaaaagtcttccta

SEQ ID NO: 4863591 - DNA, 16 bp, Homo sapiens
agaggcaagctgaaat

SEQ ID NO: 4863592 - DNA, 22 bp, Homo sapiens
agaggcataaacctgtgctgaa

SEQ ID NO: 4863593 - DNA, 14 bp, Homo sapiens
agaggcttgtttac

SEQ ID NO: 4863594 - DNA, 23 bp, Homo sapiens
agagggacataagataaaatgat

SEQ ID NO: 4863595 - DNA, 16 bp, Homo sapiens
agagggactccaagcc

SEQ ID NO: 4863596 - DNA, 17 bp, Homo sapiens
agagggactccaagccc

SEQ ID NO: 4863597 - DNA, 17 bp, Homo sapiens
agaggtagcactctcag

SEQ ID NO: 4863598 - DNA, 15 bp, Homo sapiens
agaggtggatactgg

SEQ ID NO: 4863599 - DNA, 19 bp, Homo sapiens
agaggtgggatcctccctc

SEQ ID NO: 4863600 - DNA, 21 bp, Homo sapiens
agaggtgggatcctccctcat

SEQ ID NO: 4863601 - DNA, 20 bp, Homo sapiens
agaggtggggtgctggggct

SEQ ID NO: 4863602 - DNA, 22 bp, Homo sapiens
agaggtggggtgctggggctgc

SEQ ID NO: 4863603 - DNA, 23 bp, Homo sapiens
agaggtggggtgctggggctgca

SEQ ID NO: 4863604 - DNA, 14 bp, Homo sapiens
agagtaagcagtgt

SEQ ID NO: 4863605 - DNA, 15 bp, Homo sapiens
agagtaagcagtgtt

SEQ ID NO: 4863606 - DNA, 21 bp, Homo sapiens
agagtcagacatttctttgga

SEQ ID NO: 4863607 - DNA, 18 bp, Homo sapiens
agagttccggggagaaac

SEQ ID NO: 4863608 - DNA, 12 bp, Homo sapiens
agagttcctcct

SEQ ID NO: 4863609 - DNA, 20 bp, Homo sapiens
agagtttcagtttgttggaa

SEQ ID NO: 4863610 - DNA, 22 bp, Homo sapiens
agagtttgaaactcgagaccat

SEQ ID NO: 4863611 - DNA, 15 bp, Homo sapiens
agataaaatgatgtt

SEQ ID NO: 4863612 - DNA, 19 bp, Homo sapiens
agataaagaccagaaattc

SEQ ID NO: 4863613 - DNA, 17 bp, Homo sapiens
agataatattgtttggt

SEQ ID NO: 4863614 - DNA, 14 bp, Homo sapiens
agatacctgtgagg

SEQ ID NO: 4863615 - DNA, 15 bp, Homo sapiens
agatactgtgtatat

SEQ ID NO: 4863616 - DNA, 15 bp, Homo sapiens
agatatctgcatgtg

SEQ ID NO: 4863617 - DNA, 18 bp, Homo sapiens
agatatctgcatgtgtca

SEQ ID NO: 4863618 - DNA, 14 bp, Homo sapiens
agatatgtattctt

SEQ ID NO: 4863619 - DNA, 20 bp, Homo sapiens
agatcatatggtaggaccct

SEQ ID NO: 4863620 - DNA, 19 bp, Homo sapiens
agatccatttccattgctt

SEQ ID NO: 4863621 - DNA, 16 bp, Homo sapiens
agatcctaagatgtgt

SEQ ID NO: 4863622 - DNA, 21 bp, Homo sapiens
agatctattgtttgttgcact

SEQ ID NO: 4863623 - DNA, 15 bp, Homo sapiens
agatctttatatttc

SEQ ID NO: 4863624 - DNA, 12 bp, Homo sapiens
agatctttcaga

SEQ ID NO: 4863625 - DNA, 14 bp, Homo sapiens
agatctttcagaaa

SEQ ID NO: 4863626 - DNA, 20 bp, Homo sapiens
agatctttcagaaatataac

SEQ ID NO: 4863627 - DNA, 13 bp, Homo sapiens
agatgacctgccc

SEQ ID NO: 4863628 - DNA, 21 bp, Homo sapiens
agatgaggcaaacagcaagag

SEQ ID NO: 4863629 - DNA, 13 bp, Homo sapiens
agatgaggctcag

SEQ ID NO: 4863630 - DNA, 14 bp, Homo sapiens
agatgaggctcaga

SEQ ID NO: 4863631 - DNA, 18 bp, Homo sapiens
agatgatgctttggaaga

SEQ ID NO: 4863632 - DNA, 20 bp, Homo sapiens
agatgattttttgaaagtta

SEQ ID NO: 4863633 - DNA, 13 bp, Homo sapiens
agatgctggctgg

SEQ ID NO: 4863634 - DNA, 14 bp, Homo sapiens
agatggagcccata

SEQ ID NO: 4863635 - DNA, 13 bp, Homo sapiens
agatggcgatgtg

SEQ ID NO: 4863636 - DNA, 19 bp, Homo sapiens
agatgggggcctctctgga

SEQ ID NO: 4863637 - DNA, 17 bp, Homo sapiens
agatggttaaacatttt

SEQ ID NO: 4863638 - DNA, 18 bp, Homo sapiens
agatggttaaacattttc

SEQ ID NO: 4863639 - DNA, 20 bp, Homo sapiens
agatgtaggaaccgatctgc

SEQ ID NO: 4863640 - DNA, 16 bp, Homo sapiens
agatgtttatttcagg

SEQ ID NO: 4863641 - DNA, 22 bp, Homo sapiens
agatgttttaccgtaataatta

SEQ ID NO: 4863642 - DNA, 18 bp, Homo sapiens
agattctatgttaatatt

SEQ ID NO: 4863643 - DNA, 11 bp, Homo sapiens
agattctgaag

SEQ ID NO: 4863644 - DNA, 11 bp, Homo sapiens
agattgaactt

SEQ ID NO: 4863645 - DNA, 21 bp, Homo sapiens
agattgactaactcaaataca

SEQ ID NO: 4863646 - DNA, 18 bp, Homo sapiens
agattggccaattaaaaa

SEQ ID NO: 4863647 - DNA, 13 bp, Homo sapiens
agatttgtttcct

SEQ ID NO: 4863648 - DNA, 14 bp, Homo sapiens
agcaaaaaagagtt

SEQ ID NO: 4863649 - DNA, 13 bp, Homo sapiens
agcaaactctgct

SEQ ID NO: 4863650 - DNA, 16 bp, Homo sapiens
agcaaaggtgcactcc

SEQ ID NO: 4863651 - DNA, 18 bp, Homo sapiens
agcaaaggtgcactccag

SEQ ID NO: 4863652 - DNA, 20 bp, Homo sapiens
agcaaaggtgcactccagac

SEQ ID NO: 4863653 - DNA, 13 bp, Homo sapiens
agcaaattccaga

SEQ ID NO: 4863654 - DNA, 23 bp, Homo sapiens
agcaaattccagatttgtttcct

SEQ ID NO: 4863655 - DNA, 15 bp, Homo sapiens
agcaaccacactgct

SEQ ID NO: 4863656 - DNA, 14 bp, Homo sapiens
agcaaggcagagcc

SEQ ID NO: 4863657 - DNA, 20 bp, Homo sapiens
agcaagtccttaggctactg

SEQ ID NO: 4863658 - DNA, 20 bp, Homo sapiens
agcaataggtagctggggag

SEQ ID NO: 4863659 - DNA, 14 bp, Homo sapiens
agcaatttactgat

SEQ ID NO: 4863660 - DNA, 11 bp, Homo sapiens
agcacaaaatt

SEQ ID NO: 4863661 - DNA, 14 bp, Homo sapiens
agcacaaaattcaa

SEQ ID NO: 4863662 - DNA, 19 bp, Homo sapiens
agcacaaagaagaaagctg

SEQ ID NO: 4863663 - DNA, 19 bp, Homo sapiens
agcacaaagcactggcctt

SEQ ID NO: 4863664 - DNA, 16 bp, Homo sapiens
agcacaagactggccc

SEQ ID NO: 4863665 - DNA, 18 bp, Homo sapiens
agcacaagactggcccag

SEQ ID NO: 4863666 - DNA, 21 bp, Homo sapiens
agcacaagactggcccagtgc

SEQ ID NO: 4863667 - DNA, 20 bp, Homo sapiens
agcacacatccaagagggac

SEQ ID NO: 4863668 - DNA, 18 bp, Homo sapiens
agcaccaacctccagact

SEQ ID NO: 4863669 - DNA, 20 bp, Homo sapiens
agcactcctgcttaatcttc

SEQ ID NO: 4863670 - DNA, 13 bp, Homo sapiens
agcactggccttg

SEQ ID NO: 4863671 - DNA, 20 bp, Homo sapiens
agcactggccttgcctccag

SEQ ID NO: 4863672 - DNA, 22 bp, Homo sapiens
agcactggccttgcctccagga

SEQ ID NO: 4863673 - DNA, 15 bp, Homo sapiens
agcactgtaaacttc

SEQ ID NO: 4863674 - DNA, 15 bp, Homo sapiens
agcagacagccctgg

SEQ ID NO: 4863675 - DNA, 14 bp, Homo sapiens
agcagagtctgtct

SEQ ID NO: 4863676 - DNA, 17 bp, Homo sapiens
agcagagtctgtctctt

SEQ ID NO: 4863677 - DNA, 12 bp, Homo sapiens
agcagagttaaa

SEQ ID NO: 4863678 - DNA, 18 bp, Homo sapiens
agcagagttaaatctcaa

SEQ ID NO: 4863679 - DNA, 15 bp, Homo sapiens
agcagcaggcctctg

SEQ ID NO: 4863680 - DNA, 22 bp, Homo sapiens
agcagcaggcctctgggaccca

SEQ ID NO: 4863681 - DNA, 15 bp, Homo sapiens
agcagccccaggaga

SEQ ID NO: 4863682 - DNA, 21 bp, Homo sapiens
agcaggacctactaggagagg

SEQ ID NO: 4863683 - DNA, 18 bp, Homo sapiens
agcaggcccaatgctgct

SEQ ID NO: 4863684 - DNA, 14 bp, Homo sapiens
agcaggcctctggg

SEQ ID NO: 4863685 - DNA, 17 bp, Homo sapiens
agcagggatctgccccc

SEQ ID NO: 4863686 - DNA, 13 bp, Homo sapiens
agcagtattttgg

SEQ ID NO: 4863687 - DNA, 17 bp, Homo sapiens
agcagttcctgtcccac

SEQ ID NO: 4863688 - DNA, 18 bp, Homo sapiens
agcataaagctcaaatga

SEQ ID NO: 4863689 - DNA, 17 bp, Homo sapiens
agcataatttaaaaata

SEQ ID NO: 4863690 - DNA, 21 bp, Homo sapiens
agcataatttaaaaatatatt

SEQ ID NO: 4863691 - DNA, 16 bp, Homo sapiens
agcatagaaaccacta

SEQ ID NO: 4863692 - DNA, 20 bp, Homo sapiens
agcatagaaaccactagaaa

SEQ ID NO: 4863693 - DNA, 13 bp, Homo sapiens
agcatagagaaca

SEQ ID NO: 4863694 - DNA, 19 bp, Homo sapiens
agcatagataatattgttt

SEQ ID NO: 4863695 - DNA, 18 bp, Homo sapiens
agcataggctggggacac

SEQ ID NO: 4863696 - DNA, 14 bp, Homo sapiens
agcatcacccacct

SEQ ID NO: 4863697 - DNA, 15 bp, Homo sapiens
agcatccaccccacc

SEQ ID NO: 4863698 - DNA, 17 bp, Homo sapiens
agcatccagtgtgagat

SEQ ID NO: 4863699 - DNA, 18 bp, Homo sapiens
agcatcctgataccattc

SEQ ID NO: 4863700 - DNA, 23 bp, Homo sapiens
agcatctcagtggtgtgtgaagt

SEQ ID NO: 4863701 - DNA, 17 bp, Homo sapiens
agcatgcagctttgcaa

SEQ ID NO: 4863702 - DNA, 15 bp, Homo sapiens
agcatggggccagga

SEQ ID NO: 4863703 - DNA, 19 bp, Homo sapiens
agcatgtgatgttgtctta

SEQ ID NO: 4863704 - DNA, 21 bp, Homo sapiens
agcattgcagcctaagaagaa

SEQ ID NO: 4863705 - DNA, 16 bp, Homo sapiens
agcattgtaattatgt

SEQ ID NO: 4863706 - DNA, 21 bp, Homo sapiens
agcattgtaattatgtaaata

SEQ ID NO: 4863707 - DNA, 16 bp, Homo sapiens
agcattgtgtggaatt

SEQ ID NO: 4863708 - DNA, 22 bp, Homo sapiens
agcatttaatggcagctagtgc

SEQ ID NO: 4863709 - DNA, 11 bp, Homo sapiens
agcatttccta

SEQ ID NO: 4863710 - DNA, 22 bp, Homo sapiens
agccaaatgcagggaggggagg

SEQ ID NO: 4863711 - DNA, 23 bp, Homo sapiens
agccaaatgcagggaggggaggc

SEQ ID NO: 4863712 - DNA, 18 bp, Homo sapiens
agccaagctggcacaaaa

SEQ ID NO: 4863713 - DNA, 16 bp, Homo sapiens
agccaagctttaaatt

SEQ ID NO: 4863714 - DNA, 19 bp, Homo sapiens
agccaatctacaatctctt

SEQ ID NO: 4863715 - DNA, 22 bp, Homo sapiens
agccaatctacaatctcttttt

SEQ ID NO: 4863716 - DNA, 14 bp, Homo sapiens
agccaattagactt

SEQ ID NO: 4863717 - DNA, 15 bp, Homo sapiens
agccacagcagagca

SEQ ID NO: 4863718 - DNA, 15 bp, Homo sapiens
agccacttctcccca

SEQ ID NO: 4863719 - DNA, 18 bp, Homo sapiens
agccagattggccaatta

SEQ ID NO: 4863720 - DNA, 19 bp, Homo sapiens
agccagattggccaattaa

SEQ ID NO: 4863721 - DNA, 11 bp, Homo sapiens
agccagctgct

SEQ ID NO: 4863722 - DNA, 20 bp, Homo sapiens
agccaggactcccagaacct

SEQ ID NO: 4863723 - DNA, 16 bp, Homo sapiens
agccaggcaagaaagc

SEQ ID NO: 4863724 - DNA, 14 bp, Homo sapiens
agccaggctcagga

SEQ ID NO: 4863725 - DNA, 15 bp, Homo sapiens
agccaggctcaggag

SEQ ID NO: 4863726 - DNA, 17 bp, Homo sapiens
agccaggctcaggagaa

SEQ ID NO: 4863727 - DNA, 22 bp, Homo sapiens
agccaggtctgactccaaagct

SEQ ID NO: 4863728 - DNA, 18 bp, Homo sapiens
agccatacataaaagaaa

SEQ ID NO: 4863729 - DNA, 23 bp, Homo sapiens
agcccaaacctgggaaggccagc

SEQ ID NO: 4863730 - DNA, 24 bp, Homo sapiens
agcccataggccaccccctatcct

SEQ ID NO: 4863731 - DNA, 14 bp, Homo sapiens
agcccattcccacc

SEQ ID NO: 4863732 - DNA, 13 bp, Homo sapiens
agcccgcagaggt

SEQ ID NO: 4863733 - DNA, 14 bp, Homo sapiens
agcccgcagaggtg

SEQ ID NO: 4863734 - DNA, 16 bp, Homo sapiens
agccctattgctgcta

SEQ ID NO: 4863735 - DNA, 13 bp, Homo sapiens
agccctcaccaca

SEQ ID NO: 4863736 - DNA, 17 bp, Homo sapiens
agccctcaccacagcct

SEQ ID NO: 4863737 - DNA, 15 bp, Homo sapiens
agccctcctgagggc

SEQ ID NO: 4863738 - DNA, 17 bp, Homo sapiens
agccctcctgagggccg

SEQ ID NO: 4863739 - DNA, 12 bp, Homo sapiens
agccctgggcac

SEQ ID NO: 4863740 - DNA, 16 bp, Homo sapiens
agccctggggcagggt

SEQ ID NO: 4863741 - DNA, 17 bp, Homo sapiens
agccctggggcagggtg

SEQ ID NO: 4863742 - DNA, 19 bp, Homo sapiens
agccgcagacctggagctt

SEQ ID NO: 4863743 - DNA, 14 bp, Homo sapiens
agccgcagagaaat

SEQ ID NO: 4863744 - DNA, 18 bp, Homo sapiens
agccggcctgagaaacac

SEQ ID NO: 4863745 - DNA, 19 bp, Homo sapiens
agcctaagaagaaggccag

SEQ ID NO: 4863746 - DNA, 23 bp, Homo sapiens
agcctacctctgtctgagacagg

SEQ ID NO: 4863747 - DNA, 14 bp, Homo sapiens
agcctactctcctt

SEQ ID NO: 4863748 - DNA, 14 bp, Homo sapiens
agcctatgtctggc

SEQ ID NO: 4863749 - DNA, 16 bp, Homo sapiens
agcctatgtctggcag

SEQ ID NO: 4863750 - DNA, 18 bp, Homo sapiens
agcctatgtctggcagat

SEQ ID NO: 4863751 - DNA, 18 bp, Homo sapiens
agcctccaagcctgcctc

SEQ ID NO: 4863752 - DNA, 19 bp, Homo sapiens
agcctccaagcctgcctcc

SEQ ID NO: 4863753 - DNA, 22 bp, Homo sapiens
agcctccaccccacaacccaaa

SEQ ID NO: 4863754 - DNA, 14 bp, Homo sapiens
agcctctccgactc

SEQ ID NO: 4863755 - DNA, 16 bp, Homo sapiens
agcctggccaggcagg

SEQ ID NO: 4863756 - DNA, 17 bp, Homo sapiens
agcctggccaggcaggg

SEQ ID NO: 4863757 - DNA, 18 bp, Homo sapiens
agcctggccaggcaggga

SEQ ID NO: 4863758 - DNA, 22 bp, Homo sapiens
agcctggtttctgggtgctaga

SEQ ID NO: 4863759 - DNA, 20 bp, Homo sapiens
agccttacttcaaagtgcct

SEQ ID NO: 4863760 - DNA, 22 bp, Homo sapiens
agccttacttcaaagtgcctgg

SEQ ID NO: 4863761 - DNA, 20 bp, Homo sapiens
agccttcaaaactatagctt

SEQ ID NO: 4863762 - DNA, 14 bp, Homo sapiens
agccttcatcagaa

SEQ ID NO: 4863763 - DNA, 12 bp, Homo sapiens
agccttctccct

SEQ ID NO: 4863764 - DNA, 20 bp, Homo sapiens
agccttctccctagctcctc

SEQ ID NO: 4863765 - DNA, 22 bp, Homo sapiens
agccttgcagcggctcctgcaa

SEQ ID NO: 4863766 - DNA, 20 bp, Homo sapiens
agcctttactgtttgatata

SEQ ID NO: 4863767 - DNA, 18 bp, Homo sapiens
agcctttttacctggcct

SEQ ID NO: 4863768 - DNA, 16 bp, Homo sapiens
agcgaacagccttaga

SEQ ID NO: 4863769 - DNA, 23 bp, Homo sapiens
agcgcggacccttctgggtccag

SEQ ID NO: 4863770 - DNA, 16 bp, Homo sapiens
agcggattgctctgga

SEQ ID NO: 4863771 - DNA, 22 bp, Homo sapiens
agcggattgctctggagcagcc

SEQ ID NO: 4863772 - DNA, 16 bp, Homo sapiens
atattgacttgtatat

SEQ ID NO: 4863773 - DNA, 15 bp, Homo sapiens
atattgattgggaaa

SEQ ID NO: 4863774 - DNA, 18 bp, Homo sapiens
atattgtaatctatgttt

SEQ ID NO: 4863775 - DNA, 23 bp, Homo sapiens
atattgtaatctatgtttataat

SEQ ID NO: 4863776 - DNA, 14 bp, Homo sapiens
atattgtttggtaa

SEQ ID NO: 4863777 - DNA, 18 bp, Homo sapiens
atattgtttggtaaatgt

SEQ ID NO: 4863778 - DNA, 19 bp, Homo sapiens
atattgtttggtaaatgtt

SEQ ID NO: 4863779 - DNA, 17 bp, Homo sapiens
atatttatttatttatt

SEQ ID NO: 4863780 - DNA, 14 bp, Homo sapiens
atatttcaataaat

SEQ ID NO: 4863781 - DNA, 20 bp, Homo sapiens
atatttcaggttcttcagaa

SEQ ID NO: 4863782 - DNA, 23 bp, Homo sapiens
atatttctgaggagcctgcaaca

SEQ ID NO: 4863783 - DNA, 17 bp, Homo sapiens
atatttgcaaagtgtat

SEQ ID NO: 4863784 - DNA, 14 bp, Homo sapiens
atattttatattac

SEQ ID NO: 4863785 - DNA, 24 bp, Homo sapiens
atattttcctagtagatctatatt

SEQ ID NO: 4863786 - DNA, 13 bp, Homo sapiens
atattttgtgtga

SEQ ID NO: 4863787 - DNA, 16 bp, Homo sapiens
atatttttttaactgt

SEQ ID NO: 4863788 - DNA, 17 bp, Homo sapiens
atatttttttaactgtg

SEQ ID NO: 4863789 - DNA, 18 bp, Homo sapiens
atatttttttaactgtga

SEQ ID NO: 4863790 - DNA, 21 bp, Homo sapiens
atatttttttaactgtgataa

SEQ ID NO: 4863791 - DNA, 21 bp, Homo sapiens
caatccatcgtattaaaaaac

SEQ ID NO: 4863792 - DNA, 15 bp, Homo sapiens
caatctgtacaaaat

SEQ ID NO: 4863793 - DNA, 17 bp, Homo sapiens
caatctgtacaaaatgg

SEQ ID NO: 4863794 - DNA, 18 bp, Homo sapiens
caatctgtacaaaatggt

SEQ ID NO: 4863795 - DNA, 20 bp, Homo sapiens
caatctttcctactttctat

SEQ ID NO: 4863796 - DNA, 15 bp, Homo sapiens
caatgaaccataaat

SEQ ID NO: 4863797 - DNA, 14 bp, Homo sapiens
caatgactgagcag

SEQ ID NO: 4863798 - DNA, 13 bp, Homo sapiens
caatgagagcata

SEQ ID NO: 4863799 - DNA, 19 bp, Homo sapiens
caatgagagcataatttaa

SEQ ID NO: 4863800 - DNA, 19 bp, Homo sapiens
caatgagatcattgtgaag

SEQ ID NO: 4863801 - DNA, 19 bp, Homo sapiens
caatgaggcagatagcact

SEQ ID NO: 4863802 - DNA, 12 bp, Homo sapiens
caatgcctcagt

SEQ ID NO: 4863803 - DNA, 15 bp, Homo sapiens
caatgcctcagtagc

SEQ ID NO: 4863804 - DNA, 18 bp, Homo sapiens
caatgcttgcatggagaa

SEQ ID NO: 4863805 - DNA, 20 bp, Homo sapiens
caatggtgtggtgaatgtgt

SEQ ID NO: 4863806 - DNA, 22 bp, Homo sapiens
caatgtagaggcataaacctgt

SEQ ID NO: 4863807 - DNA, 19 bp, Homo sapiens
caattaaacttccaaagaa

SEQ ID NO: 4863808 - DNA, 15 bp, Homo sapiens
caattagacttgaaa

SEQ ID NO: 4863809 - DNA, 23 bp, Homo sapiens
caattgcgaccttaatttaactt

SEQ ID NO: 4863810 - DNA, 13 bp, Homo sapiens
caatttaaaacaa

SEQ ID NO: 4863811 - DNA, 13 bp, Homo sapiens
caatttatactgc

SEQ ID NO: 4863812 - DNA, 23 bp, Homo sapiens
caatttctagtacctgtgactct

SEQ ID NO: 4863813 - DNA, 13 bp, Homo sapiens
cacaaaagacagc

SEQ ID NO: 4863814 - DNA, 13 bp, Homo sapiens
cacaaaattcaaa

SEQ ID NO: 4863815 - DNA, 21 bp, Homo sapiens
cacaaacagaattttccattt

SEQ ID NO: 4863816 - DNA, 13 bp, Homo sapiens
cacaaacctgccc

SEQ ID NO: 4863817 - DNA, 22 bp, Homo sapiens
cacaactactagtgtgactcct

SEQ ID NO: 4863818 - DNA, 16 bp, Homo sapiens
cacaagactggcccag

SEQ ID NO: 4863819 - DNA, 21 bp, Homo sapiens
cacaagactggcccagtgcca

SEQ ID NO: 4863820 - DNA, 23 bp, Homo sapiens
cacaagactggcccagtgccagc

SEQ ID NO: 4863821 - DNA, 17 bp, Homo sapiens
cacaatgttggagcagc

SEQ ID NO: 4863822 - DNA, 23 bp, Homo sapiens
cacaatgttggagcagcaggcct

SEQ ID NO: 4863823 - DNA, 14 bp, Homo sapiens
cacacacacacaca

SEQ ID NO: 4863824 - DNA, 16 bp, Homo sapiens
cacacacacacacaca

SEQ ID NO: 4863825 - DNA, 15 bp, Homo sapiens
cacacacacacacga

SEQ ID NO: 4863826 - DNA, 23 bp, Homo sapiens
cacacatccaagagggactccaa

SEQ ID NO: 4863827 - DNA, 18 bp, Homo sapiens
cacacgatgcatttaata

SEQ ID NO: 4863828 - DNA, 13 bp, Homo sapiens
cacactcagaaaa

SEQ ID NO: 4863829 - DNA, 15 bp, Homo sapiens
cacactcagaaaatt

SEQ ID NO: 4863830 - DNA, 20 bp, Homo sapiens
cacactcagaaaattccctg

SEQ ID NO: 4863831 - DNA, 23 bp, Homo sapiens
cacactcagaaaattccctgggg

SEQ ID NO: 4863832 - DNA, 16 bp, Homo sapiens
cacactgcttggccct

SEQ ID NO: 4863833 - DNA, 19 bp, Homo sapiens
cacactggaggagcacaca

SEQ ID NO: 4863834 - DNA, 17 bp, Homo sapiens
cacagaaggtgaacttt

SEQ ID NO: 4863835 - DNA, 19 bp, Homo sapiens
cacagaaggtgaactttgt

SEQ ID NO: 4863836 - DNA, 20 bp, Homo sapiens
cacagaaggtgaactttgtg

SEQ ID NO: 4863837 - DNA, 18 bp, Homo sapiens
cacagcagccccaggaga

SEQ ID NO: 4863838 - DNA, 20 bp, Homo sapiens
cacagcagccccaggagaag

SEQ ID NO: 4863839 - DNA, 18 bp, Homo sapiens
cacagccttctaaattcc

SEQ ID NO: 4863840 - DNA, 22 bp, Homo sapiens
cacagccttctaaattcccaaa

SEQ ID NO: 4863841 - DNA, 19 bp, Homo sapiens
cacagccttgcagcggctc

SEQ ID NO: 4863842 - DNA, 21 bp, Homo sapiens
cacagccttgcagcggctcct

SEQ ID NO: 4863843 - DNA, 17 bp, Homo sapiens
cacagggaatggccaca

SEQ ID NO: 4863844 - DNA, 19 bp, Homo sapiens
cacagtacgaacctacagt

SEQ ID NO: 4863845 - DNA, 21 bp, Homo sapiens
cacagtgtaatccaggggtgt

SEQ ID NO: 4863846 - DNA, 19 bp, Homo sapiens
cacatagcataggctgggg

SEQ ID NO: 4863847 - DNA, 14 bp, Homo sapiens
cacatcaaaccttt

SEQ ID NO: 4863848 - DNA, 14 bp, Homo sapiens
cacatcaaataaga

SEQ ID NO: 4863849 - DNA, 16 bp, Homo sapiens
cacatccatccctcca

SEQ ID NO: 4863850 - DNA, 21 bp, Homo sapiens
cacatctatccacactgtcaa

SEQ ID NO: 4863851 - DNA, 15 bp, Homo sapiens
cacatctgttttgta

SEQ ID NO: 4863852 - DNA, 16 bp, Homo sapiens
cacatgagaagtgata

SEQ ID NO: 4863853 - DNA, 17 bp, Homo sapiens
cacatggccatcttctt

SEQ ID NO: 4863854 - DNA, 19 bp, Homo sapiens
cacatggccatcttctttc

SEQ ID NO: 4863855 - DNA, 13 bp, Homo sapiens
cacattaactgtt

SEQ ID NO: 4863856 - DNA, 14 bp, Homo sapiens
cacattaactgttg

SEQ ID NO: 4863857 - DNA, 13 bp, Homo sapiens
cacattgaagaat

SEQ ID NO: 4863858 - DNA, 19 bp, Homo sapiens
cacatttctttgcattcca

SEQ ID NO: 4863859 - DNA, 12 bp, Homo sapiens
caccaacctcca

SEQ ID NO: 4863860 - DNA, 13 bp, Homo sapiens
caccaacctccag

SEQ ID NO: 4863861 - DNA, 22 bp, Homo sapiens
caccaacctccagactcagcag

SEQ ID NO: 4863862 - DNA, 12 bp, Homo sapiens
caccacagcctt

SEQ ID NO: 4863863 - DNA, 19 bp, Homo sapiens
caccactaggaatcccaga

SEQ ID NO: 4863864 - DNA, 21 bp, Homo sapiens
caccactaggaatcccagagg

SEQ ID NO: 4863865 - DNA, 15 bp, Homo sapiens
caccagttgctgctg

SEQ ID NO: 4863866 - DNA, 14 bp, Homo sapiens
caccataccttaga

SEQ ID NO: 4863867 - DNA, 17 bp, Homo sapiens
caccatactccttgctt

SEQ ID NO: 4863868 - DNA, 19 bp, Homo sapiens
caccatactccttgcttcc

SEQ ID NO: 4863869 - DNA, 12 bp, Homo sapiens
cacccacaaact

SEQ ID NO: 4863870 - DNA, 16 bp, Homo sapiens
cacccacaaactccag

SEQ ID NO: 4863871 - DNA, 19 bp, Homo sapiens
cacccacaaactccaggct

SEQ ID NO: 4863872 - DNA, 19 bp, Homo sapiens
cacccatcctaggaaccag

SEQ ID NO: 4863873 - DNA, 16 bp, Homo sapiens
cacccatttagtgggg

SEQ ID NO: 4863874 - DNA, 23 bp, Homo sapiens
caccccatctttgctgccagctc

SEQ ID NO: 4863875 - DNA, 14 bp, Homo sapiens
caccccctccttct

SEQ ID NO: 4863876 - DNA, 21 bp, Homo sapiens
caccctccggcgggtgacagc

SEQ ID NO: 4863877 - DNA, 22 bp, Homo sapiens
caccctgttacttatgtagaaa

SEQ ID NO: 4863878 - DNA, 12 bp, Homo sapiens
caccgcaggtgc

SEQ ID NO: 4863879 - DNA, 23 bp, Homo sapiens
caccgcaggtgctcatgctgctc

SEQ ID NO: 4863880 - DNA, 23 bp, Homo sapiens
caccgtggcagcttgctgggctt

SEQ ID NO: 4863881 - DNA, 15 bp, Homo sapiens
cacctcatcactgga

SEQ ID NO: 4863882 - DNA, 17 bp, Homo sapiens
cacctcatcactggact

SEQ ID NO: 4863883 - DNA, 23 bp, Homo sapiens
cacctcatcactggactgcatgg

SEQ ID NO: 4863884 - DNA, 15 bp, Homo sapiens
cacctgaatttgtat

SEQ ID NO: 4863885 - DNA, 21 bp, Homo sapiens
cacctgcactaacagagtggc

SEQ ID NO: 4863886 - DNA, 23 bp, Homo sapiens
cacctgctgagaaaacatgcctc

SEQ ID NO: 4863887 - DNA, 13 bp, Homo sapiens
cacgagagcccgg

SEQ ID NO: 4863888 - DNA, 22 bp, Homo sapiens
cacgagtgtagtcccggaggcc

SEQ ID NO: 4863889 - DNA, 20 bp, Homo sapiens
cacgatgcatttaataaaga

SEQ ID NO: 4863890 - DNA, 22 bp, Homo sapiens
cacgatgcatttaataaagatg

SEQ ID NO: 4863891 - DNA, 20 bp, Homo sapiens
cacgtcaaatgcatacaagt

SEQ ID NO: 4863892 - DNA, 22 bp, Homo sapiens
cactacaggtgaaggctctcac

SEQ ID NO: 4863893 - DNA, 12 bp, Homo sapiens
cactactgaaca

SEQ ID NO: 4863894 - DNA, 15 bp, Homo sapiens
cactagccttcccag

SEQ ID NO: 4863895 - DNA, 18 bp, Homo sapiens
cactagccttcccagctt

SEQ ID NO: 4863896 - DNA, 19 bp, Homo sapiens
cactcaatccatccatgta

SEQ ID NO: 4863897 - DNA, 13 bp, Homo sapiens
cactcacctctaa

SEQ ID NO: 4863898 - DNA, 12 bp, Homo sapiens
cactcagaaaat

SEQ ID NO: 4863899 - DNA, 20 bp, Homo sapiens
cactcagaaaattccctggg

SEQ ID NO: 4863900 - DNA, 22 bp, Homo sapiens
cactcagaaaattccctggggt

SEQ ID NO: 4863901 - DNA, 11 bp, Homo sapiens
cactccagact

SEQ ID NO: 4863902 - DNA, 13 bp, Homo sapiens
cactccagactct

SEQ ID NO: 4863903 - DNA, 14 bp, Homo sapiens
cactccagactctg

SEQ ID NO: 4863904 - DNA, 12 bp, Homo sapiens
cactccagctga

SEQ ID NO: 4863905 - DNA, 17 bp, Homo sapiens
cactccccgcctcccca

SEQ ID NO: 4863906 - DNA, 18 bp, Homo sapiens
cactgatgagtttcactg

SEQ ID NO: 4863907 - DNA, 21 bp, Homo sapiens
cactgatgagtttcactgtac

SEQ ID NO: 4863908 - DNA, 23 bp, Homo sapiens
cactgatgagtttcactgtactg

SEQ ID NO: 4863909 - DNA, 15 bp, Homo sapiens
cactgtactgcatgt

SEQ ID NO: 4863910 - DNA, 13 bp, Homo sapiens
cactgtccagagt

SEQ ID NO: 4863911 - DNA, 15 bp, Homo sapiens
cactgtccagagtct

SEQ ID NO: 4863912 - DNA, 16 bp, Homo sapiens
cactgtcctattatat

SEQ ID NO: 4863913 - DNA, 23 bp, Homo sapiens
cactgtggccagtaaaatactat

SEQ ID NO: 4863914 - DNA, 13 bp, Homo sapiens
cactgttgataaa

SEQ ID NO: 4863915 - DNA, 16 bp, Homo sapiens
cactgttgataaaaac

SEQ ID NO: 4863916 - DNA, 21 bp, Homo sapiens
cacttaaacgaagagttccct

SEQ ID NO: 4863917 - DNA, 12 bp, Homo sapiens
cacttagtcctt

SEQ ID NO: 4863918 - DNA, 16 bp, Homo sapiens
cacttattgaatatat

SEQ ID NO: 4863919 - DNA, 17 bp, Homo sapiens
cacttattgaatatatg

SEQ ID NO: 4863920 - DNA, 15 bp, Homo sapiens
cacttcacctccttc

SEQ ID NO: 4863921 - DNA, 17 bp, Homo sapiens
cacttcacctccttctg

SEQ ID NO: 4863922 - DNA, 19 bp, Homo sapiens
cactttgcactgatatatc

SEQ ID NO: 4863923 - DNA, 13 bp, Homo sapiens
cacttttcctttt

SEQ ID NO: 4863924 - DNA, 16 bp, Homo sapiens
cagaaaattccctggg

SEQ ID NO: 4863925 - DNA, 22 bp, Homo sapiens
cagaaaccctcattgtgtttct

SEQ ID NO: 4863926 - DNA, 23 bp, Homo sapiens
cagaaacgagatcgggaagcaga

SEQ ID NO: 4863927 - DNA, 22 bp, Homo sapiens
cagaaagcctgggtgacatttg

SEQ ID NO: 4863928 - DNA, 13 bp, Homo sapiens
cagaaagcttcat

SEQ ID NO: 4863929 - DNA, 18 bp, Homo sapiens
cagaaaggtgtgaggaga

SEQ ID NO: 4863930 - DNA, 19 bp, Homo sapiens
cagaaaggtgtgaggagag

SEQ ID NO: 4863931 - DNA, 20 bp, Homo sapiens
cagaaatataacacattttt

SEQ ID NO: 4863932 - DNA, 20 bp, Homo sapiens
cagaaatcagtaatatttat

SEQ ID NO: 4863933 - DNA, 16 bp, Homo sapiens
cagaaattcaatttgg

SEQ ID NO: 4863934 - DNA, 22 bp, Homo sapiens
cagaacactttgctaggagata

SEQ ID NO: 4863935 - DNA, 21 bp, Homo sapiens
cagaaccacacttgaaacctt

SEQ ID NO: 4863936 - DNA, 23 bp, Homo sapiens
cagaacctctaagtgctgctgtg

SEQ ID NO: 4863937 - DNA, 12 bp, Homo sapiens
cagaaccttctt

SEQ ID NO: 4863938 - DNA, 15 bp, Homo sapiens
cagaacgtggctctg

SEQ ID NO: 4863939 - DNA, 18 bp, Homo sapiens
cagaacgtggctctgctg

SEQ ID NO: 4863940 - DNA, 19 bp, Homo sapiens
cagaacgtggctctgctgg

SEQ ID NO: 4863941 - DNA, 20 bp, Homo sapiens
cagaactcttcctcctccca

SEQ ID NO: 4863942 - DNA, 19 bp, Homo sapiens
cagaacttcagcattgtaa

SEQ ID NO: 4863943 - DNA, 13 bp, Homo sapiens
cagaagaaaattt

SEQ ID NO: 4863944 - DNA, 16 bp, Homo sapiens
cagaagaatcttcctg

SEQ ID NO: 4863945 - DNA, 18 bp, Homo sapiens
cagaagaatcttcctggc

SEQ ID NO: 4863946 - DNA, 21 bp, Homo sapiens
cagaagcctccaagcctgcct

SEQ ID NO: 4863947 - DNA, 15 bp, Homo sapiens
cagaaggtgaacttt

SEQ ID NO: 4863948 - DNA, 17 bp, Homo sapiens
cagaatcttgttttgaa

SEQ ID NO: 4863949 - DNA, 15 bp, Homo sapiens
cagaatttgaattat

SEQ ID NO: 4863950 - DNA, 16 bp, Homo sapiens
cagaatttttaactgt

SEQ ID NO: 4863951 - DNA, 13 bp, Homo sapiens
cagacaaccttgt

SEQ ID NO: 4863952 - DNA, 18 bp, Homo sapiens
cagacaaccttgtcccaa

SEQ ID NO: 4863953 - DNA, 21 bp, Homo sapiens
cagacaaccttgtcccaagga

SEQ ID NO: 4863954 - DNA, 20 bp, Homo sapiens
cagacagccatgcgtggcca

SEQ ID NO: 4863955 - DNA, 15 bp, Homo sapiens
cagacagccctggca

SEQ ID NO: 4863956 - DNA, 20 bp, Homo sapiens
cagacatggaggggatgata

SEQ ID NO: 4863957 - DNA, 17 bp, Homo sapiens
cagacatttctttggaa

SEQ ID NO: 4863958 - DNA, 17 bp, Homo sapiens
cagaccagagctgtctg

SEQ ID NO: 4863959 - DNA, 11 bp, Homo sapiens
cagacccctgc

SEQ ID NO: 4863960 - DNA, 14 bp, Homo sapiens
cagacccctgcctg

SEQ ID NO: 4863961 - DNA, 15 bp, Homo sapiens
cagacctggagcttc

SEQ ID NO: 4863962 - DNA, 12 bp, Homo sapiens
cagactcagcag

SEQ ID NO: 4863963 - DNA, 13 bp, Homo sapiens
cagactcagcaga

SEQ ID NO: 4863964 - DNA, 14 bp, Homo sapiens
cagactcagcagag

SEQ ID NO: 4863965 - DNA, 16 bp, Homo sapiens
cagagaaagcaaaggt

SEQ ID NO: 4863966 - DNA, 15 bp, Homo sapiens
cagagaaagcacaat

SEQ ID NO: 4863967 - DNA, 16 bp, Homo sapiens
cagagaaatgccccag

SEQ ID NO: 4863968 - DNA, 17 bp, Homo sapiens
cagagaacctgtgggct

SEQ ID NO: 4863969 - DNA, 19 bp, Homo sapiens
cagagaacctgtgggctga

SEQ ID NO: 4863970 - DNA, 17 bp, Homo sapiens
cagagaagtacaggtca

SEQ ID NO: 4863971 - DNA, 17 bp, Homo sapiens
cagagagggaaaaggca

SEQ ID NO: 4863972 - DNA, 23 bp, Homo sapiens
cagagagggaagatgacctgccc

SEQ ID NO: 4863973 - DNA, 16 bp, Homo sapiens
cagagaggtagcactc

SEQ ID NO: 4863974 - DNA, 22 bp, Homo sapiens
cagagaggtagcactctcagag

SEQ ID NO: 4863975 - DNA, 16 bp, Homo sapiens
cagagatgtactgcaa

SEQ ID NO: 4863976 - DNA, 21 bp, Homo sapiens
cagagatttctcattgacttt

SEQ ID NO: 4863977 - DNA, 21 bp, Homo sapiens
cagagcctttttacctggcct

SEQ ID NO: 4863978 - DNA, 19 bp, Homo sapiens
cagagcggggtcccctctg

SEQ ID NO: 4863979 - DNA, 20 bp, Homo sapiens
cagagcggggtcccctctgt

SEQ ID NO: 4863980 - DNA, 18 bp, Homo sapiens
cagagctctcccctcctg

SEQ ID NO: 4863981 - DNA, 23 bp, Homo sapiens
cagagctctcccctcctgctggg

SEQ ID NO: 4863982 - DNA, 24 bp, Homo sapiens
cagagctctcccctcctgctgggc

SEQ ID NO: 4863983 - DNA, 15 bp, Homo sapiens
cagagctgctgcaca

SEQ ID NO: 4863984 - DNA, 22 bp, Homo sapiens
cagagcttgtggtggggcagga

SEQ ID NO: 4863985 - DNA, 22 bp, Homo sapiens
cagaggactcacttgcccacac

SEQ ID NO: 4863986 - DNA, 23 bp, Homo sapiens
cagaggtattaaaactaaatttc

SEQ ID NO: 4863987 - DNA, 22 bp, Homo sapiens
cagaggtggggtgctggggctg

SEQ ID NO: 4863988 - DNA, 18 bp, Homo sapiens
cagaggtttgaaggagaa

SEQ ID NO: 4863989 - DNA, 22 bp, Homo sapiens
cagaggtttgaaggagaatggc

SEQ ID NO: 4863990 - DNA, 12 bp, Homo sapiens
cagagtctgtct

SEQ ID NO: 4863991 - DNA, 15 bp, Homo sapiens
cagagtctgtctctt

SEQ ID NO: 4863992 - DNA, 17 bp, Homo sapiens
cagagtgttttgaccag

SEQ ID NO: 4863993 - DNA, 23 bp, Homo sapiens
cagagttttcattaaatcctttt

SEQ ID NO: 4863994 - DNA, 16 bp, Homo sapiens
cagatacctgtgagga

SEQ ID NO: 4863995 - DNA, 21 bp, Homo sapiens
cagatcatatggtaggaccct

SEQ ID NO: 4863996 - DNA, 13 bp, Homo sapiens
cagatctgttttg

SEQ ID NO: 4863997 - DNA, 23 bp, Homo sapiens
cagatctgttttgtggtttggaa

SEQ ID NO: 4863998 - DNA, 21 bp, Homo sapiens
cagatgacagaggtttgaagg

SEQ ID NO: 4863999 - DNA, 13 bp, Homo sapiens
cagatgagggctg

SEQ ID NO: 4864000 - DNA, 14 bp, Homo sapiens
cagatgagggctgg

SEQ ID NO: 4864001 - DNA, 17 bp, Homo sapiens
cagatgatgctttggaa

SEQ ID NO: 4864002 - DNA, 17 bp, Homo sapiens
cagatgggggcctctct

SEQ ID NO: 4864003 - DNA, 15 bp, Homo sapiens
cagatgtttgcctca

SEQ ID NO: 4864004 - DNA, 21 bp, Homo sapiens
cagattactgctttaatcaga

SEQ ID NO: 4864005 - DNA, 15 bp, Homo sapiens
cagattggccaatta

SEQ ID NO: 4864006 - DNA, 23 bp, Homo sapiens
cagcaaagcaaatgttgggaaag

SEQ ID NO: 4864007 - DNA, 18 bp, Homo sapiens
cagcaagagtaagcagtg

SEQ ID NO: 4864008 - DNA, 13 bp, Homo sapiens
cagcacaaagcac

SEQ ID NO: 4864009 - DNA, 21 bp, Homo sapiens
cagcacaaagcactggccttg

SEQ ID NO: 4864010 - DNA, 13 bp, Homo sapiens
cagcaccctaaga

SEQ ID NO: 4864011 - DNA, 14 bp, Homo sapiens
cagcagagcggggt

SEQ ID NO: 4864012 - DNA, 15 bp, Homo sapiens
cagcagagtgagggg

SEQ ID NO: 4864013 - DNA, 17 bp, Homo sapiens
cagcagccccaggagaa

SEQ ID NO: 4864014 - DNA, 14 bp, Homo sapiens
cagcagctgatgct

SEQ ID NO: 4864015 - DNA, 14 bp, Homo sapiens
cagcaggccagaga

SEQ ID NO: 4864016 - DNA, 16 bp, Homo sapiens
cagcaggccagagaaa

SEQ ID NO: 4864017 - DNA, 12 bp, Homo sapiens
cagcaggcctct

SEQ ID NO: 4864018 - DNA, 14 bp, Homo sapiens
cagcaggcctctgg

SEQ ID NO: 4864019 - DNA, 17 bp, Homo sapiens
cagcaggcctctgggac

SEQ ID NO: 4864020 - DNA, 18 bp, Homo sapiens
cagcaggcctctgggacc

SEQ ID NO: 4864021 - DNA, 12 bp, Homo sapiens
cagcatctgctc

SEQ ID NO: 4864022 - DNA, 23 bp, Homo sapiens
cagcattgtgtggaatttgaggt

SEQ ID NO: 4864023 - DNA, 14 bp, Homo sapiens
cagccaaatttaaa

SEQ ID NO: 4864024 - DNA, 15 bp, Homo sapiens
cagccacccccaggc

SEQ ID NO: 4864025 - DNA, 20 bp, Homo sapiens
cagccagaacgtggctctgc

SEQ ID NO: 4864026 - DNA, 19 bp, Homo sapiens
cagccaggcaagaaagctt

SEQ ID NO: 4864027 - DNA, 20 bp, Homo sapiens
cagccaggcaagaaagcttc

SEQ ID NO: 4864028 - DNA, 12 bp, Homo sapiens
cagccaggtctg

SEQ ID NO: 4864029 - DNA, 15 bp, Homo sapiens
cagccagttcaaaaa

SEQ ID NO: 4864030 - DNA, 23 bp, Homo sapiens
cagcccaaacctgggaaggccag

SEQ ID NO: 4864031 - DNA, 14 bp, Homo sapiens
cagcccgcagaggt

SEQ ID NO: 4864032 - DNA, 15 bp, Homo sapiens
cagccctgggcacat

SEQ ID NO: 4864033 - DNA, 23 bp, Homo sapiens
cagccgcagagaaatgccccagt

SEQ ID NO: 4864034 - DNA, 19 bp, Homo sapiens
cagcctaagaagaaggcca

SEQ ID NO: 4864035 - DNA, 16 bp, Homo sapiens
cagcctagcctatgtc

SEQ ID NO: 4864036 - DNA, 19 bp, Homo sapiens
cagcctagcctatgtctgg

SEQ ID NO: 4864037 - DNA, 15 bp, Homo sapiens
cagcctgactagaac

SEQ ID NO: 4864038 - DNA, 16 bp, Homo sapiens
cagcctgactagaact

SEQ ID NO: 4864039 - DNA, 17 bp, Homo sapiens
cagcctgactagaactc

SEQ ID NO: 4864040 - DNA, 13 bp, Homo sapiens
cagcctgcttccc

SEQ ID NO: 4864041 - DNA, 13 bp, Homo sapiens
cagccttagagct

SEQ ID NO: 4864042 - DNA, 16 bp, Homo sapiens
cagccttagagctctt

SEQ ID NO: 4864043 - DNA, 23 bp, Homo sapiens
cagccttcatcagaactcttcct

SEQ ID NO: 4864044 - DNA, 14 bp, Homo sapiens
cagcgaacagcctt

SEQ ID NO: 4864045 - DNA, 15 bp, Homo sapiens
cagcgaacagcctta

SEQ ID NO: 4864046 - DNA, 16 bp, Homo sapiens
cagctccgggatcagc

SEQ ID NO: 4864047 - DNA, 15 bp, Homo sapiens
cagctctagcctctg

SEQ ID NO: 4864048 - DNA, 19 bp, Homo sapiens
cagctctagcctctggact

SEQ ID NO: 4864049 - DNA, 22 bp, Homo sapiens
cagctctcctccagccctgggc

SEQ ID NO: 4864050 - DNA, 22 bp, Homo sapiens
cagctgaaattcaccaagaaca

SEQ ID NO: 4864051 - DNA, 20 bp, Homo sapiens
cagctgacagccacaccgtg

SEQ ID NO: 4864052 - DNA, 19 bp, Homo sapiens
cagctgcagcctggttggc

SEQ ID NO: 4864053 - DNA, 17 bp, Homo sapiens
cagctgctgttgaactt

SEQ ID NO: 4864054 - DNA, 18 bp, Homo sapiens
cagctgctgttgaacttt

SEQ ID NO: 4864055 - DNA, 22 bp, Homo sapiens
cagctgcttgacctagctcttt

SEQ ID NO: 4864056 - DNA, 13 bp, Homo sapiens
cagctgtgcactt

SEQ ID NO: 4864057 - DNA, 11 bp, Homo sapiens
cagctgtgctc

SEQ ID NO: 4864058 - DNA, 15 bp, Homo sapiens
cagctgtgctccaca

SEQ ID NO: 4864059 - DNA, 18 bp, Homo sapiens
cagctgtgctccacactc

SEQ ID NO: 4864060 - DNA, 22 bp, Homo sapiens
cagctgtgctccacactcagaa

SEQ ID NO: 4864061 - DNA, 14 bp, Homo sapiens
cagcttacaggagc

SEQ ID NO: 4864062 - DNA, 17 bp, Homo sapiens
cagcttacaggagccag

SEQ ID NO: 4864063 - DNA, 21 bp, Homo sapiens
cagcttacaggagccagcctg

SEQ ID NO: 4864064 - DNA, 22 bp, Homo sapiens
cagcttacaggagccagcctgc

SEQ ID NO: 4864065 - DNA, 23 bp, Homo sapiens
cagcttacaggagccagcctgct

SEQ ID NO: 4864066 - DNA, 21 bp, Homo sapiens
cagcttcggagggcccctgcg

SEQ ID NO: 4864067 - DNA, 22 bp, Homo sapiens
cagcttgctgggctttgggaag

SEQ ID NO: 4864068 - DNA, 12 bp, Homo sapiens
cagctttgcaaa

SEQ ID NO: 4864069 - DNA, 17 bp, Homo sapiens
caggaaagagctaggaa

SEQ ID NO: 4864070 - DNA, 18 bp, Homo sapiens
caggaaagagctaggaac

SEQ ID NO: 4864071 - DNA, 20 bp, Homo sapiens
caggaacggtggaggcagag

SEQ ID NO: 4864072 - DNA, 24 bp, Homo sapiens
caggaacggtggaggcagaggtga

SEQ ID NO: 4864073 - DNA, 23 bp, Homo sapiens
caggaagttgccatgggaaacaa

SEQ ID NO: 4864074 - DNA, 21 bp, Homo sapiens
caggaattcttggagaaaatg

SEQ ID NO: 4864075 - DNA, 20 bp, Homo sapiens
caggacagttgatggagccc

SEQ ID NO: 4864076 - DNA, 22 bp, Homo sapiens
caggacagttgatggagcccca

SEQ ID NO: 4864077 - DNA, 21 bp, Homo sapiens
caggacatgcaataaaattta

SEQ ID NO: 4864078 - DNA, 20 bp, Homo sapiens
caggacccatccctgcctgg

SEQ ID NO: 4864079 - DNA, 17 bp, Homo sapiens
caggacgtctggggtgt

SEQ ID NO: 4864080 - DNA, 12 bp, Homo sapiens
caggactcccag

SEQ ID NO: 4864081 - DNA, 13 bp, Homo sapiens
caggactcccaga

SEQ ID NO: 4864082 - DNA, 16 bp, Homo sapiens
caggactcccagaacc

SEQ ID NO: 4864083 - DNA, 17 bp, Homo sapiens
caggactcccagaacct

SEQ ID NO: 4864084 - DNA, 18 bp, Homo sapiens
caggactcccagaacctc

SEQ ID NO: 4864085 - DNA, 14 bp, Homo sapiens
caggactctctcca

SEQ ID NO: 4864086 - DNA, 16 bp, Homo sapiens
caggacttctcaccag

SEQ ID NO: 4864087 - DNA, 17 bp, Homo sapiens
caggagaagccagtgtc

SEQ ID NO: 4864088 - DNA, 21 bp, Homo sapiens
caggagagactggttcggctc

SEQ ID NO: 4864089 - DNA, 23 bp, Homo sapiens
caggagatggggaataatttcct

SEQ ID NO: 4864090 - DNA, 11 bp, Homo sapiens
caggagccagc

SEQ ID NO: 4864091 - DNA, 21 bp, Homo sapiens
caggagccagcctgcttccca

SEQ ID NO: 4864092 - DNA, 18 bp, Homo sapiens
caggagcctggccaggca

SEQ ID NO: 4864093 - DNA, 19 bp, Homo sapiens
caggagcctggccaggcag

SEQ ID NO: 4864094 - DNA, 20 bp, Homo sapiens
caggagcctggccaggcagg

SEQ ID NO: 4864095 - DNA, 22 bp, Homo sapiens
caggagcctggccaggcaggga

SEQ ID NO: 4864096 - DNA, 15 bp, Homo sapiens
caggagggttggagt

SEQ ID NO: 4864097 - DNA, 20 bp, Homo sapiens
caggagggttggagtgctct

SEQ ID NO: 4864098 - DNA, 12 bp, Homo sapiens
caggagtctctg

SEQ ID NO: 4864099 - DNA, 17 bp, Homo sapiens
caggagtctctgccagt

SEQ ID NO: 4864100 - DNA, 20 bp, Homo sapiens
caggagtctctgccagttac

SEQ ID NO: 4864101 - DNA, 14 bp, Homo sapiens
caggatccccctct

SEQ ID NO: 4864102 - DNA, 14 bp, Homo sapiens
caggatcctggcct

SEQ ID NO: 4864103 - DNA, 16 bp, Homo sapiens
caggatcctggcctga

SEQ ID NO: 4864104 - DNA, 19 bp, Homo sapiens
caggatcctggcctgagaa

SEQ ID NO: 4864105 - DNA, 23 bp, Homo sapiens
caggatgctaacatctaaaaata

SEQ ID NO: 4864106 - DNA, 20 bp, Homo sapiens
caggcaagaaagcttccttc

SEQ ID NO: 4864107 - DNA, 21 bp, Homo sapiens
caggcaagaaagcttccttca

SEQ ID NO: 4864108 - DNA, 14 bp, Homo sapiens
caggcagctgaaat

SEQ ID NO: 4864109 - DNA, 20 bp, Homo sapiens
caggcatctgttagcagagt

SEQ ID NO: 4864110 - DNA, 24 bp, Homo sapiens
caggcatctgttagcagagtctgt

SEQ ID NO: 4864111 - DNA, 20 bp, Homo sapiens
caggcatgaaattcttccta

SEQ ID NO: 4864112 - DNA, 19 bp, Homo sapiens
caggcatgtgtctggccct

SEQ ID NO: 4864113 - DNA, 12 bp, Homo sapiens
caggccagagaa

SEQ ID NO: 4864114 - DNA, 16 bp, Homo sapiens
caggccagagaaagca

SEQ ID NO: 4864115 - DNA, 17 bp, Homo sapiens
caggcccaatgctgctt

SEQ ID NO: 4864116 - DNA, 19 bp, Homo sapiens
caggcccaatgctgctttt

SEQ ID NO: 4864117 - DNA, 16 bp, Homo sapiens
caggcctcccaagctg

SEQ ID NO: 4864118 - DNA, 13 bp, Homo sapiens
caggcctctggga

SEQ ID NO: 4864119 - DNA, 18 bp, Homo sapiens
caggcctctgggacccac

SEQ ID NO: 4864120 - DNA, 23 bp, Homo sapiens
caggcctctgggacccacagaac

SEQ ID NO: 4864121 - DNA, 15 bp, Homo sapiens
caggctcaggagaag

SEQ ID NO: 4864122 - DNA, 19 bp, Homo sapiens
caggctcaggagaagccag

SEQ ID NO: 4864123 - DNA, 20 bp, Homo sapiens
cagggaatggccacaaacct

SEQ ID NO: 4864124 - DNA, 21 bp, Homo sapiens
cagggaatggccacaaacctg

SEQ ID NO: 4864125 - DNA, 22 bp, Homo sapiens
cagggagagagtagctgcagcc

SEQ ID NO: 4864126 - DNA, 13 bp, Homo sapiens
cagggaggggagg

SEQ ID NO: 4864127 - DNA, 16 bp, Homo sapiens
cagggaggggaggcag

SEQ ID NO: 4864128 - DNA, 17 bp, Homo sapiens
cagggaggggaggcaga

SEQ ID NO: 4864129 - DNA, 16 bp, Homo sapiens
cagggatggagggaag

SEQ ID NO: 4864130 - DNA, 23 bp, Homo sapiens
cagggattctgggcttggggtgt

SEQ ID NO: 4864131 - DNA, 21 bp, Homo sapiens
cagggcaccgtattcctctcc

SEQ ID NO: 4864132 - DNA, 15 bp, Homo sapiens
cagggcagcaggcca

SEQ ID NO: 4864133 - DNA, 18 bp, Homo sapiens
cagggcagcaggccagag

SEQ ID NO: 4864134 - DNA, 19 bp, Homo sapiens
cagggcagcaggccagaga

SEQ ID NO: 4864135 - DNA, 12 bp, Homo sapiens
caggggagccag

SEQ ID NO: 4864136 - DNA, 15 bp, Homo sapiens
caggggagccagctg

SEQ ID NO: 4864137 - DNA, 19 bp, Homo sapiens
caggggccaacctcaggct

SEQ ID NO: 4864138 - DNA, 21 bp, Homo sapiens
caggggccaacctcaggctcc

SEQ ID NO: 4864139 - DNA, 23 bp, Homo sapiens
caggggccaacctcaggctccta

SEQ ID NO: 4864140 - DNA, 20 bp, Homo sapiens
caggggctgtggccgtctcc

SEQ ID NO: 4864141 - DNA, 19 bp, Homo sapiens
cagggggtatgcagagctt

SEQ ID NO: 4864142 - DNA, 18 bp, Homo sapiens
cagggtccttgtttctgc

SEQ ID NO: 4864143 - DNA, 23 bp, Homo sapiens
cagggtcttgctttctttgacct

SEQ ID NO: 4864144 - DNA, 13 bp, Homo sapiens
cagggtgacaagg

SEQ ID NO: 4864145 - DNA, 17 bp, Homo sapiens
cagggtgacaaggcctg

SEQ ID NO: 4864146 - DNA, 21 bp, Homo sapiens
cagggtgacaaggcctgcttg

SEQ ID NO: 4864147 - DNA, 23 bp, Homo sapiens
cagggtgagacgtgatgggctag

SEQ ID NO: 4864148 - DNA, 15 bp, Homo sapiens
cagggtggggggcca

SEQ ID NO: 4864149 - DNA, 16 bp, Homo sapiens
cagggtggggggccat

SEQ ID NO: 4864150 - DNA, 13 bp, Homo sapiens
caggtactttggt

SEQ ID NO: 4864151 - DNA, 21 bp, Homo sapiens
caggtccaaattcaccttccc

SEQ ID NO: 4864152 - DNA, 20 bp, Homo sapiens
caggtctgactccaaagctg

SEQ ID NO: 4864153 - DNA, 14 bp, Homo sapiens
caggtgcctaacct

SEQ ID NO: 4864154 - DNA, 19 bp, Homo sapiens
caggtgctcatgctgctcc

SEQ ID NO: 4864155 - DNA, 15 bp, Homo sapiens
caggtgcttttggca

SEQ ID NO: 4864156 - DNA, 18 bp, Homo sapiens
caggtgcttttggcagag

SEQ ID NO: 4864157 - DNA, 20 bp, Homo sapiens
caggtggttgtcttattgca

SEQ ID NO: 4864158 - DNA, 17 bp, Homo sapiens
caggttagtgacattta

SEQ ID NO: 4864159 - DNA, 17 bp, Homo sapiens
caggttataacagtgtt

SEQ ID NO: 4864160 - DNA, 22 bp, Homo sapiens
caggttattgcaataaagtata

SEQ ID NO: 4864161 - DNA, 15 bp, Homo sapiens
caggtttgcaggagc

SEQ ID NO: 4864162 - DNA, 21 bp, Homo sapiens
caggtttgcaggagcccccct

SEQ ID NO: 4864163 - DNA, 18 bp, Homo sapiens
cagtaacccccttaaatt

SEQ ID NO: 4864164 - DNA, 20 bp, Homo sapiens
cagtaagatatctcaatgaa

SEQ ID NO: 4864165 - DNA, 13 bp, Homo sapiens
cagtaatatttat

SEQ ID NO: 4864166 - DNA, 20 bp, Homo sapiens
cagtaatgctaaatgtgtaa

SEQ ID NO: 4864167 - DNA, 22 bp, Homo sapiens
cagtaatgctaaatgtgtaata

SEQ ID NO: 4864168 - DNA, 17 bp, Homo sapiens
cagtacatttaaatttt

SEQ ID NO: 4864169 - DNA, 22 bp, Homo sapiens
cagtacatttaaattttttggc

SEQ ID NO: 4864170 - DNA, 15 bp, Homo sapiens
cagtatgtgggatat

SEQ ID NO: 4864171 - DNA, 20 bp, Homo sapiens
cagtcacactgtggccagta

SEQ ID NO: 4864172 - DNA, 16 bp, Homo sapiens
cagtcactgctgcaag

SEQ ID NO: 4864173 - DNA, 20 bp, Homo sapiens
cagtcaggctgcagaggcac

SEQ ID NO: 4864174 - DNA, 19 bp, Homo sapiens
cagtcattatgttaatatt

SEQ ID NO: 4864175 - DNA, 23 bp, Homo sapiens
cagtccaggatgctaacatctaa

SEQ ID NO: 4864176 - DNA, 12 bp, Homo sapiens
cagtctgaccct

SEQ ID NO: 4864177 - DNA, 13 bp, Homo sapiens
cagtctgctcctc

SEQ ID NO: 4864178 - DNA, 16 bp, Homo sapiens
cagtgaccagtgcctg

SEQ ID NO: 4864179 - DNA, 12 bp, Homo sapiens
cagtgactccag

SEQ ID NO: 4864180 - DNA, 14 bp, Homo sapiens
cagtgactccaggg

SEQ ID NO: 4864181 - DNA, 18 bp, Homo sapiens
cagtgactccagggtgac

SEQ ID NO: 4864182 - DNA, 21 bp, Homo sapiens
cagtgcatagttgtagacaaa

SEQ ID NO: 4864183 - DNA, 22 bp, Homo sapiens
cagtgcatagttgtagacaaag

SEQ ID NO: 4864184 - DNA, 23 bp, Homo sapiens
cagtgccagcaagtccttaggct

SEQ ID NO: 4864185 - DNA, 11 bp, Homo sapiens
cagtgccttct

SEQ ID NO: 4864186 - DNA, 16 bp, Homo sapiens
cagtggtaagaatagt

SEQ ID NO: 4864187 - DNA, 23 bp, Homo sapiens
cagtggtgtgtgaagtttggaga

SEQ ID NO: 4864188 - DNA, 15 bp, Homo sapiens
cagtgtaaagtgtgt

SEQ ID NO: 4864189 - DNA, 19 bp, Homo sapiens
cagtgtgagatactgtgta

SEQ ID NO: 4864190 - DNA, 22 bp, Homo sapiens
cagtgtgaggacctccctgtct

SEQ ID NO: 4864191 - DNA, 15 bp, Homo sapiens
cagttagactcaaag

SEQ ID NO: 4864192 - DNA, 15 bp, Homo sapiens
cagttcccagagtgg

SEQ ID NO: 4864193 - DNA, 14 bp, Homo sapiens
cagttcctgtccca

SEQ ID NO: 4864194 - DNA, 18 bp, Homo sapiens
cagttctctcccttcctc

SEQ ID NO: 4864195 - DNA, 19 bp, Homo sapiens
cagttgatggagccccagg

SEQ ID NO: 4864196 - DNA, 13 bp, Homo sapiens
cagttgcttgtct

SEQ ID NO: 4864197 - DNA, 14 bp, Homo sapiens
cagttgcttgtctt

SEQ ID NO: 4864198 - DNA, 15 bp, Homo sapiens
cagttggactctcag

SEQ ID NO: 4864199 - DNA, 16 bp, Homo sapiens
cagttggactctcagg

SEQ ID NO: 4864200 - DNA, 18 bp, Homo sapiens
cagttggactctcaggga

SEQ ID NO: 4864201 - DNA, 20 bp, Homo sapiens
cagtttaagccgcagacctg

SEQ ID NO: 4864202 - DNA, 18 bp, Homo sapiens
cagtttgtagtgccactg

SEQ ID NO: 4864203 - DNA, 16 bp, Homo sapiens
cagtttgtcttggata

SEQ ID NO: 4864204 - DNA, 14 bp, Homo sapiens
cagttttaactgtg

SEQ ID NO: 4864205 - DNA, 15 bp, Homo sapiens
cagttttaactgtgg

SEQ ID NO: 4864206 - DNA, 18 bp, Homo sapiens
cagttttaactgtggata

SEQ ID NO: 4864207 - DNA, 14 bp, Homo sapiens
cataaagtaaatac

SEQ ID NO: 4864208 - DNA, 11 bp, Homo sapiens
cataaatcaac

SEQ ID NO: 4864209 - DNA, 16 bp, Homo sapiens
cataaattcaactttg

SEQ ID NO: 4864210 - DNA, 18 bp, Homo sapiens
cataaattcaactttgta

SEQ ID NO: 4864211 - DNA, 20 bp, Homo sapiens
cataaattcaactttgtaaa

SEQ ID NO: 4864212 - DNA, 12 bp, Homo sapiens
cataagagaaac

SEQ ID NO: 4864213 - DNA, 15 bp, Homo sapiens
cataagagaaacctg

SEQ ID NO: 4864214 - DNA, 19 bp, Homo sapiens
cataagagaaacctgccaa

SEQ ID NO: 4864215 - DNA, 22 bp, Homo sapiens
cataagagaaacctgccaagga

SEQ ID NO: 4864216 - DNA, 24 bp, Homo sapiens
cataagataaaatgatgttataca

SEQ ID NO: 4864217 - DNA, 17 bp, Homo sapiens
cataagcttccatttta

SEQ ID NO: 4864218 - DNA, 20 bp, Homo sapiens
cataatgtactgatttcagt

SEQ ID NO: 4864219 - DNA, 15 bp, Homo sapiens
cataatttaaaaata

SEQ ID NO: 4864220 - DNA, 20 bp, Homo sapiens
cataatttaaaaatatattt

SEQ ID NO: 4864221 - DNA, 15 bp, Homo sapiens
catacacttccttct

SEQ ID NO: 4864222 - DNA, 13 bp, Homo sapiens
catacataaaaga

SEQ ID NO: 4864223 - DNA, 14 bp, Homo sapiens
catacataaaagaa

SEQ ID NO: 4864224 - DNA, 16 bp, Homo sapiens
catagacatgaaaggt

SEQ ID NO: 4864225 - DNA, 22 bp, Homo sapiens
catagataatattgtttggtaa

SEQ ID NO: 4864226 - DNA, 24 bp, Homo sapiens
catagataatattgtttggtaaat

SEQ ID NO: 4864227 - DNA, 13 bp, Homo sapiens
catagcaaacttc

SEQ ID NO: 4864228 - DNA, 14 bp, Homo sapiens
catagcagtatatg

SEQ ID NO: 4864229 - DNA, 18 bp, Homo sapiens
catagcataggctgggga

SEQ ID NO: 4864230 - DNA, 23 bp, Homo sapiens
cataggttaaaaaaaaaagtcac

SEQ ID NO: 4864231 - DNA, 21 bp, Homo sapiens
catagttgtagacaaagtaca

SEQ ID NO: 4864232 - DNA, 16 bp, Homo sapiens
catataatgaataaat

SEQ ID NO: 4864233 - DNA, 13 bp, Homo sapiens
catatatttattg

SEQ ID NO: 4864234 - DNA, 14 bp, Homo sapiens
catatgcagaaata

SEQ ID NO: 4864235 - DNA, 20 bp, Homo sapiens
catatgcagaaatagacaaa

SEQ ID NO: 4864236 - DNA, 17 bp, Homo sapiens
catattataaaggataa

SEQ ID NO: 4864237 - DNA, 22 bp, Homo sapiens
catattataaaggataaagaag

SEQ ID NO: 4864238 - DNA, 14 bp, Homo sapiens
catattgtaatcta

SEQ ID NO: 4864239 - DNA, 20 bp, Homo sapiens
catattgtaatctatgttta

SEQ ID NO: 4864240 - DNA, 14 bp, Homo sapiens
catcaatatgtata

SEQ ID NO: 4864241 - DNA, 13 bp, Homo sapiens
catcacccacctt

SEQ ID NO: 4864242 - DNA, 19 bp, Homo sapiens
catcacgttagctgtccca

SEQ ID NO: 4864243 - DNA, 21 bp, Homo sapiens
catcagaactcttcctcctcc

SEQ ID NO: 4864244 - DNA, 16 bp, Homo sapiens
catcagcctccttctt

SEQ ID NO: 4864245 - DNA, 20 bp, Homo sapiens
catcattgtttagatgaggc

SEQ ID NO: 4864246 - DNA, 21 bp, Homo sapiens
catccacctcatcactggact

SEQ ID NO: 4864247 - DNA, 21 bp, Homo sapiens
catccagtgtgagatactgtg

SEQ ID NO: 4864248 - DNA, 22 bp, Homo sapiens
catccagtgtgagatactgtgt

SEQ ID NO: 4864249 - DNA, 20 bp, Homo sapiens
catccatccctccattcatc

SEQ ID NO: 4864250 - DNA, 15 bp, Homo sapiens
catccatcctgagcc

SEQ ID NO: 4864251 - DNA, 14 bp, Homo sapiens
catccatccttcca

SEQ ID NO: 4864252 - DNA, 22 bp, Homo sapiens
catccatgtacttccctcttga

SEQ ID NO: 4864253 - DNA, 15 bp, Homo sapiens
catccattacctcca

SEQ ID NO: 4864254 - DNA, 18 bp, Homo sapiens
catccattacctccatcc

SEQ ID NO: 4864255 - DNA, 11 bp, Homo sapiens
catccattcct

SEQ ID NO: 4864256 - DNA, 14 bp, Homo sapiens
catccctccattca

SEQ ID NO: 4864257 - DNA, 14 bp, Homo sapiens
catccctgcctgga

SEQ ID NO: 4864258 - DNA, 17 bp, Homo sapiens
catccctgcctggaggc

SEQ ID NO: 4864259 - DNA, 18 bp, Homo sapiens
catccctgcctggaggct

SEQ ID NO: 4864260 - DNA, 12 bp, Homo sapiens
catcctaggaac

SEQ ID NO: 4864261 - DNA, 14 bp, Homo sapiens
catctaatgtatta

SEQ ID NO: 4864262 - DNA, 13 bp, Homo sapiens
catctaattctga

SEQ ID NO: 4864263 - DNA, 19 bp, Homo sapiens
catctatccacactgtcaa

SEQ ID NO: 4864264 - DNA, 13 bp, Homo sapiens
catctgaccccaa

SEQ ID NO: 4864265 - DNA, 23 bp, Homo sapiens
catctgaccccaagggggctgct

SEQ ID NO: 4864266 - DNA, 15 bp, Homo sapiens
catctgttagcagag

SEQ ID NO: 4864267 - DNA, 18 bp, Homo sapiens
catctgttagcagagtct

SEQ ID NO: 4864268 - DNA, 22 bp, Homo sapiens
tatattaaacaaagtttcagag

SEQ ID NO: 4864269 - DNA, 20 bp, Homo sapiens
tatattcattctttttgaaa

SEQ ID NO: 4864270 - DNA, 15 bp, Homo sapiens
tatattgttgaagag

SEQ ID NO: 4864271 - DNA, 22 bp, Homo sapiens
tatattttgtgtgaaattgcat

SEQ ID NO: 4864272 - DNA, 19 bp, Homo sapiens
tatatttttttaactgtga

SEQ ID NO: 4864273 - DNA, 14 bp, Homo sapiens
tatcaaaatagtct

SEQ ID NO: 4864274 - DNA, 20 bp, Homo sapiens
tatcaaagtcattaaagaca

SEQ ID NO: 4864275 - DNA, 19 bp, Homo sapiens
tatcactgccttcgtttat

SEQ ID NO: 4864276 - DNA, 23 bp, Homo sapiens
tatcactgccttcgtttatattt

SEQ ID NO: 4864277 - DNA, 16 bp, Homo sapiens
tatcatgaattttaaa

SEQ ID NO: 4864278 - DNA, 24 bp, Homo sapiens
tatcatgaattttaaagtatgcat

SEQ ID NO: 4864279 - DNA, 21 bp, Homo sapiens
tatcctccttctcctgttcca

SEQ ID NO: 4864280 - DNA, 23 bp, Homo sapiens
tatcggcagatgatgctttggaa

SEQ ID NO: 4864281 - DNA, 12 bp, Homo sapiens
tatcgtttttgt

SEQ ID NO: 4864282 - DNA, 23 bp, Homo sapiens
tatctcctttgaagaaggcaagg

SEQ ID NO: 4864283 - DNA, 19 bp, Homo sapiens
tatctgaaaggccagcagc

SEQ ID NO: 4864284 - DNA, 20 bp, Homo sapiens
tcactgtactgcatgtgact

SEQ ID NO: 4864285 - DNA, 11 bp, Homo sapiens
tcacttttcct

SEQ ID NO: 4864286 - DNA, 17 bp, Homo sapiens
tcacttttccttttctt

SEQ ID NO: 4864287 - DNA, 20 bp, Homo sapiens
tcagaaaccctcattgtgtt

SEQ ID NO: 4864288 - DNA, 21 bp, Homo sapiens
tcagaaaccctcattgtgttt

SEQ ID NO: 4864289 - DNA, 19 bp, Homo sapiens
tcagaaatataacacattt

SEQ ID NO: 4864290 - DNA, 14 bp, Homo sapiens
tcagaactcttcct

SEQ ID NO: 4864291 - DNA, 16 bp, Homo sapiens
tcagaagaatcttcct

SEQ ID NO: 4864292 - DNA, 22 bp, Homo sapiens
tcagaagcctccaagcctgcct

SEQ ID NO: 4864293 - DNA, 18 bp, Homo sapiens
tcagaatttttaactgta

SEQ ID NO: 4864294 - DNA, 12 bp, Homo sapiens
tcagacagcagg

SEQ ID NO: 4864295 - DNA, 12 bp, Homo sapiens
tcagacatttct

SEQ ID NO: 4864296 - DNA, 17 bp, Homo sapiens
tcagacatttctttgga

SEQ ID NO: 4864297 - DNA, 15 bp, Homo sapiens
tcagacccctgcctg

SEQ ID NO: 4864298 - DNA, 21 bp, Homo sapiens
tcagactgggcactggggcct

SEQ ID NO: 4864299 - DNA, 12 bp, Homo sapiens
tcagagacactg

SEQ ID NO: 4864300 - DNA, 20 bp, Homo sapiens
tcagagtgactacacacagt

SEQ ID NO: 4864301 - DNA, 16 bp, Homo sapiens
tcagcatcacccacct

SEQ ID NO: 4864302 - DNA, 16 bp, Homo sapiens
tcagccaggtctgact

SEQ ID NO: 4864303 - DNA, 17 bp, Homo sapiens
tcagcctggtttctggg

SEQ ID NO: 4864304 - DNA, 16 bp, Homo sapiens
tcagctcaatgcagtt

SEQ ID NO: 4864305 - DNA, 18 bp, Homo sapiens
tcagctctctgggacctc

SEQ ID NO: 4864306 - DNA, 16 bp, Homo sapiens
tcagctgccccacagg

SEQ ID NO: 4864307 - DNA, 21 bp, Homo sapiens
tcagcttcttcacaggcactc

SEQ ID NO: 4864308 - DNA, 16 bp, Homo sapiens
tcaggaattcttggag

SEQ ID NO: 4864309 - DNA, 17 bp, Homo sapiens
tcaggactctctccagg

SEQ ID NO: 4864310 - DNA, 16 bp, Homo sapiens
tcaggagcctggccag

SEQ ID NO: 4864311 - DNA, 22 bp, Homo sapiens
tcaggctccgggcaccaggggc

SEQ ID NO: 4864312 - DNA, 21 bp, Homo sapiens
tcagggatggagggaagacct

SEQ ID NO: 4864313 - DNA, 21 bp, Homo sapiens
tcagtaacccccttaaattta

SEQ ID NO: 4864314 - DNA, 22 bp, Homo sapiens
tcagtaacccccttaaatttaa

SEQ ID NO: 4864315 - DNA, 23 bp, Homo sapiens
tcagtaacccccttaaatttaat

SEQ ID NO: 4864316 - DNA, 14 bp, Homo sapiens
tcagtaatatttat

SEQ ID NO: 4864317 - DNA, 21 bp, Homo sapiens
tcagtaatgctaaatgtgtaa

SEQ ID NO: 4864318 - DNA, 18 bp, Homo sapiens
tcagtccagcagtttcca

SEQ ID NO: 4864319 - DNA, 14 bp, Homo sapiens
tcagtgtaaagtgt

SEQ ID NO: 4864320 - DNA, 15 bp, Homo sapiens
tcagtgttggtatat

SEQ ID NO: 4864321 - DNA, 20 bp, Homo sapiens
tcagttccaaacagacaaaa

SEQ ID NO: 4864322 - DNA, 19 bp, Homo sapiens
tcagttctctcccttcctc

SEQ ID NO: 4864323 - DNA, 20 bp, Homo sapiens
tcagttgctcaaaaagaaat

SEQ ID NO: 4864324 - DNA, 12 bp, Homo sapiens
tcagttgtgttt

SEQ ID NO: 4864325 - DNA, 18 bp, Homo sapiens
tcagttgtgttttttaag

SEQ ID NO: 4864326 - DNA, 20 bp, Homo sapiens
tcagttgttatttattgaaa

SEQ ID NO: 4864327 - DNA, 11 bp, Homo sapiens
tcataaagtca

SEQ ID NO: 4864328 - DNA, 11 bp, Homo sapiens
tcataaattat

SEQ ID NO: 4864329 - DNA, 13 bp, Homo sapiens
tcataaattattt

SEQ ID NO: 4864330 - DNA, 22 bp, Homo sapiens
tcataaattatttgattattta

SEQ ID NO: 4864331 - DNA, 14 bp, Homo sapiens
tcatacacttcctt

SEQ ID NO: 4864332 - DNA, 12 bp, Homo sapiens
tcatacataaaa

SEQ ID NO: 4864333 - DNA, 23 bp, Homo sapiens
tcatagagttgattgtctagtga

SEQ ID NO: 4864334 - DNA, 21 bp, Homo sapiens
tcataggttaaaaaaaaaagt

SEQ ID NO: 4864335 - DNA, 19 bp, Homo sapiens
tcatcactggactgcatgg

SEQ ID NO: 4864336 - DNA, 23 bp, Homo sapiens
tcatcattcttgtgggagacagc

SEQ ID NO: 4864337 - DNA, 14 bp, Homo sapiens
tcatccatcctgag

SEQ ID NO: 4864338 - DNA, 12 bp, Homo sapiens
tcatccattcct

SEQ ID NO: 4864339 - DNA, 12 bp, Homo sapiens
tcatctcttcct

SEQ ID NO: 4864340 - DNA, 14 bp, Homo sapiens
tcatgaaaatacca

SEQ ID NO: 4864341 - DNA, 16 bp, Homo sapiens
tcatgaaaataccatt

SEQ ID NO: 4864342 - DNA, 18 bp, Homo sapiens
tcatgaagaatgtttctg

SEQ ID NO: 4864343 - DNA, 13 bp, Homo sapiens
tcatgaatgcttt

SEQ ID NO: 4864344 - DNA, 21 bp, Homo sapiens
tcatgaatgcttttagtgtgt

SEQ ID NO: 4864345 - DNA, 11 bp, Homo sapiens
tcatgaatgtg

SEQ ID NO: 4864346 - DNA, 15 bp, Homo sapiens
tcatgaattttaaag

SEQ ID NO: 4864347 - DNA, 15 bp, Homo sapiens
tcatgccagtatttt

SEQ ID NO: 4864348 - DNA, 15 bp, Homo sapiens
tcatgtatttgagca

SEQ ID NO: 4864349 - DNA, 18 bp, Homo sapiens
tcatgtatttgagcatat

SEQ ID NO: 4864350 - DNA, 17 bp, Homo sapiens
tcattatgttaatattt

SEQ ID NO: 4864351 - DNA, 13 bp, Homo sapiens
tcattcagaaaaa

SEQ ID NO: 4864352 - DNA, 14 bp, Homo sapiens
tcattcagaaaaaa

SEQ ID NO: 4864353 - DNA, 14 bp, Homo sapiens
tcattcagaaatgt

SEQ ID NO: 4864354 - DNA, 11 bp, Homo sapiens
tcattgacttt

SEQ ID NO: 4864355 - DNA, 14 bp, Homo sapiens
tcattgacttttat

SEQ ID NO: 4864356 - DNA, 24 bp, Homo sapiens
tcattgacttttataaagcatgtt

SEQ ID NO: 4864357 - DNA, 23 bp, Homo sapiens
tcattgcacataagcttccattt

SEQ ID NO: 4864358 - DNA, 12 bp, Homo sapiens
tcattggcaaag

SEQ ID NO: 4864359 - DNA, 15 bp, Homo sapiens
tcattggcaaagtga

SEQ ID NO: 4864360 - DNA, 21 bp, Homo sapiens
tcattggcattctttgcaata

SEQ ID NO: 4864361 - DNA, 22 bp, Homo sapiens
tcattggcattctttgcaatac

SEQ ID NO: 4864362 - DNA, 12 bp, Homo sapiens
tcattgtttaga

SEQ ID NO: 4864363 - DNA, 18 bp, Homo sapiens
tcatttagtcatgtgacc

SEQ ID NO: 4864364 - DNA, 22 bp, Homo sapiens
tcatttctatattcctccagct

SEQ ID NO: 4864365 - DNA, 17 bp, Homo sapiens
tccaaaatttatatttt

SEQ ID NO: 4864366 - DNA, 16 bp, Homo sapiens
tccaaagctgttccat

SEQ ID NO: 4864367 - DNA, 17 bp, Homo sapiens
tccaacagacacaattt

SEQ ID NO: 4864368 - DNA, 20 bp, Homo sapiens
tccaagcactagccttccca

SEQ ID NO: 4864369 - DNA, 13 bp, Homo sapiens
tccaagccctggg

SEQ ID NO: 4864370 - DNA, 14 bp, Homo sapiens
tccaagccctgggg

SEQ ID NO: 4864371 - DNA, 19 bp, Homo sapiens
tccaagccctggggcaggg

SEQ ID NO: 4864372 - DNA, 14 bp, Homo sapiens
tccaagcctgcctc

SEQ ID NO: 4864373 - DNA, 22 bp, Homo sapiens
tccacactcagaaaattccctg

SEQ ID NO: 4864374 - DNA, 15 bp, Homo sapiens
tccacagcctgcaag

SEQ ID NO: 4864375 - DNA, 19 bp, Homo sapiens
tccacccacaaactccagg

SEQ ID NO: 4864376 - DNA, 18 bp, Homo sapiens
tccacctcatcactggac

SEQ ID NO: 4864377 - DNA, 21 bp, Homo sapiens
tccactggacccttgattcat

SEQ ID NO: 4864378 - DNA, 20 bp, Homo sapiens
tccacttctggggccacctc

SEQ ID NO: 4864379 - DNA, 18 bp, Homo sapiens
tccagaatgaccttgagt

SEQ ID NO: 4864380 - DNA, 12 bp, Homo sapiens
tccagactcagc

SEQ ID NO: 4864381 - DNA, 13 bp, Homo sapiens
tccagactcagca

SEQ ID NO: 4864382 - DNA, 14 bp, Homo sapiens
tccagactcagcag

SEQ ID NO: 4864383 - DNA, 17 bp, Homo sapiens
tccagagaaagcacaat

SEQ ID NO: 4864384 - DNA, 20 bp, Homo sapiens
tccagagaaagcacaattta

SEQ ID NO: 4864385 - DNA, 18 bp, Homo sapiens
tccagagaacctgtgggc

SEQ ID NO: 4864386 - DNA, 20 bp, Homo sapiens
tccagccactggctgctaac

SEQ ID NO: 4864387 - DNA, 19 bp, Homo sapiens
tccagcccaaacctgggaa

SEQ ID NO: 4864388 - DNA, 20 bp, Homo sapiens
tccagcccaaacctgggaag

SEQ ID NO: 4864389 - DNA, 23 bp, Homo sapiens
tccagcccaaacctgggaaggcc

SEQ ID NO: 4864390 - DNA, 13 bp, Homo sapiens
tccagccctgggc

SEQ ID NO: 4864391 - DNA, 17 bp, Homo sapiens
tccagctgacagccaca

SEQ ID NO: 4864392 - DNA, 18 bp, Homo sapiens
tccaggaccttgcttcct

SEQ ID NO: 4864393 - DNA, 15 bp, Homo sapiens
tccaggagggctcgg

SEQ ID NO: 4864394 - DNA, 15 bp, Homo sapiens
tccttgcttcctgat

SEQ ID NO: 4864395 - DNA, 22 bp, Homo sapiens
tccttggattttcctgaaagtg

SEQ ID NO: 4864396 - DNA, 12 bp, Homo sapiens
tcgacctcccca

SEQ ID NO: 4864397 - DNA, 15 bp, Homo sapiens
tcgactactgctcct

SEQ ID NO: 4864398 - DNA, 21 bp, Homo sapiens
tcgactactgctcctgtggca

SEQ ID NO: 4864399 - DNA, 14 bp, Homo sapiens
tcgactcagcctca

SEQ ID NO: 4864400 - DNA, 13 bp, Homo sapiens
tcgagagccttac

SEQ ID NO: 4864401 - DNA, 16 bp, Homo sapiens
tcgccagtcactgctg

SEQ ID NO: 4864402 - DNA, 14 bp, Homo sapiens
ggctcttcttcctc

SEQ ID NO: 4864403 - DNA, 15 bp, Homo sapiens
ggctcttgactactt

SEQ ID NO: 4864404 - DNA, 20 bp, Homo sapiens
ggctgcatgatttttgccct

SEQ ID NO: 4864405 - DNA, 21 bp, Homo sapiens
ggctgcatgatttttgccctg

SEQ ID NO: 4864406 - DNA, 18 bp, Homo sapiens
ggctgccaggggctctgt

SEQ ID NO: 4864407 - DNA, 15 bp, Homo sapiens
ggctgccgttttctg

SEQ ID NO: 4864408 - DNA, 19 bp, Homo sapiens
ggctggaagtacttggccc

SEQ ID NO: 4864409 - DNA, 16 bp, Homo sapiens
ggctgtgaggacaggg

SEQ ID NO: 4864410 - DNA, 20 bp, Homo sapiens
ggctgtgaggacagggcccc

SEQ ID NO: 4864411 - DNA, 22 bp, Homo sapiens
ggctgtggccgtctcctccctc

SEQ ID NO: 4864412 - DNA, 18 bp, Homo sapiens
ggcttcaaaaagccacag

SEQ ID NO: 4864413 - DNA, 19 bp, Homo sapiens
ggcttcaaaaagccacagc

SEQ ID NO: 4864414 - DNA, 21 bp, Homo sapiens
ggcttcaaaaagccacagcag

SEQ ID NO: 4864415 - DNA, 22 bp, Homo sapiens
ggcttcaaaaagccacagcaga

SEQ ID NO: 4864416 - DNA, 23 bp, Homo sapiens
ggcttcaaaaagccacagcagag

SEQ ID NO: 4864417 - DNA, 18 bp, Homo sapiens
ggcttcaacagccaagct

SEQ ID NO: 4864418 - DNA, 16 bp, Homo sapiens
ggcttggggtgtgggg

SEQ ID NO: 4864419 - DNA, 17 bp, Homo sapiens
ggcttgtttacctttct

SEQ ID NO: 4864420 - DNA, 20 bp, Homo sapiens
ggctttgggaagtttgctgt

SEQ ID NO: 4864421 - DNA, 20 bp, Homo sapiens
ggctttgttgtgagaatggc

SEQ ID NO: 4864422 - DNA, 22 bp, Homo sapiens
gggaaacaaataatttgaactt

SEQ ID NO: 4864423 - DNA, 16 bp, Homo sapiens
gggaaaggcagggccc

SEQ ID NO: 4864424 - DNA, 17 bp, Homo sapiens
gggaagatgacctgccc

SEQ ID NO: 4864425 - DNA, 17 bp, Homo sapiens
gggaaggggcctgggct

SEQ ID NO: 4864426 - DNA, 12 bp, Homo sapiens
gggaatatttta

SEQ ID NO: 4864427 - DNA, 21 bp, Homo sapiens
gggacacaggatcctggcctg

SEQ ID NO: 4864428 - DNA, 12 bp, Homo sapiens
gggaccccagat

SEQ ID NO: 4864429 - DNA, 18 bp, Homo sapiens
gggactccaagccctggg

SEQ ID NO: 4864430 - DNA, 21 bp, Homo sapiens
gggactccaagccctggggca

SEQ ID NO: 4864431 - DNA, 23 bp, Homo sapiens
gggactccaagccctggggcagg

SEQ ID NO: 4864432 - DNA, 18 bp, Homo sapiens
gggagaaacccagagatg

SEQ ID NO: 4864433 - DNA, 16 bp, Homo sapiens
gggagacagcagcctg

SEQ ID NO: 4864434 - DNA, 15 bp, Homo sapiens
gggagacatgtgaca

SEQ ID NO: 4864435 - DNA, 21 bp, Homo sapiens
gggagcatttaatggcagcta

SEQ ID NO: 4864436 - DNA, 15 bp, Homo sapiens
gggagccagctgctt

SEQ ID NO: 4864437 - DNA, 11 bp, Homo sapiens
gggagccagga

SEQ ID NO: 4864438 - DNA, 15 bp, Homo sapiens
gggagctgctgccct

SEQ ID NO: 4864439 - DNA, 13 bp, Homo sapiens
gggaggcagcaga

SEQ ID NO: 4864440 - DNA, 18 bp, Homo sapiens
gggaggctgaggcagaag

SEQ ID NO: 4864441 - DNA, 13 bp, Homo sapiens
gggaggggccctg

SEQ ID NO: 4864442 - DNA, 22 bp, Homo sapiens
gggatattttgaaatgaacttt

SEQ ID NO: 4864443 - DNA, 15 bp, Homo sapiens
gggatatttttttct

SEQ ID NO: 4864444 - DNA, 14 bp, Homo sapiens
gggatgacctccag

SEQ ID NO: 4864445 - DNA, 15 bp, Homo sapiens
gggatgacctccaga

SEQ ID NO: 4864446 - DNA, 17 bp, Homo sapiens
gggatgacctccagaag

SEQ ID NO: 4864447 - DNA, 23 bp, Homo sapiens
gggatgacctccagaagtccctt

SEQ ID NO: 4864448 - DNA, 13 bp, Homo sapiens
gggatggagggaa

SEQ ID NO: 4864449 - DNA, 21 bp, Homo sapiens
gggcacatagcataggctggg

SEQ ID NO: 4864450 - DNA, 22 bp, Homo sapiens
gggcacatagcataggctgggg

SEQ ID NO: 4864451 - DNA, 23 bp, Homo sapiens
gggcacatagcataggctgggga

SEQ ID NO: 4864452 - DNA, 13 bp, Homo sapiens
gggcaccaggggc

SEQ ID NO: 4864453 - DNA, 21 bp, Homo sapiens
gggcaccgtattcctctccca

SEQ ID NO: 4864454 - DNA, 22 bp, Homo sapiens
gggcaccgtattcctctcccag

SEQ ID NO: 4864455 - DNA, 13 bp, Homo sapiens
gggcagcaggcca

SEQ ID NO: 4864456 - DNA, 20 bp, Homo sapiens
gggcagcaggccagagaaag

SEQ ID NO: 4864457 - DNA, 21 bp, Homo sapiens
gggcagcctctccgactctgc

SEQ ID NO: 4864458 - DNA, 18 bp, Homo sapiens
gggcattagcaaggcaga

SEQ ID NO: 4864459 - DNA, 20 bp, Homo sapiens
gggcattagcaaggcagagc

SEQ ID NO: 4864460 - DNA, 17 bp, Homo sapiens
gggcccaggggctgtgg

SEQ ID NO: 4864461 - DNA, 18 bp, Homo sapiens
gggccctgaaatggcctg

SEQ ID NO: 4864462 - DNA, 13 bp, Homo sapiens
gggccctgtcact

SEQ ID NO: 4864463 - DNA, 16 bp, Homo sapiens
gggcctctcctgccct

SEQ ID NO: 4864464 - DNA, 19 bp, Homo sapiens
gggcctctcctgccctctg

SEQ ID NO: 4864465 - DNA, 14 bp, Homo sapiens
gggcctctctggaa

SEQ ID NO: 4864466 - DNA, 18 bp, Homo sapiens
gggcctctctggaagagg

SEQ ID NO: 4864467 - DNA, 23 bp, Homo sapiens
gggcctgggctgtgaggacaggg

SEQ ID NO: 4864468 - DNA, 21 bp, Homo sapiens
gggcgagggatgatgagggaa

SEQ ID NO: 4864469 - DNA, 14 bp, Homo sapiens
gggcggcacagcct

SEQ ID NO: 4864470 - DNA, 17 bp, Homo sapiens
gggctcagcctggtttc

SEQ ID NO: 4864471 - DNA, 15 bp, Homo sapiens
gggctctccaagcac

SEQ ID NO: 4864472 - DNA, 13 bp, Homo sapiens
gggctctgtggca

SEQ ID NO: 4864473 - DNA, 13 bp, Homo sapiens
gggctgctgctcc

SEQ ID NO: 4864474 - DNA, 18 bp, Homo sapiens
gggctgctgctcctctct

SEQ ID NO: 4864475 - DNA, 13 bp, Homo sapiens
gggctgtgaggac

SEQ ID NO: 4864476 - DNA, 17 bp, Homo sapiens
gggcttcaacagccaag

SEQ ID NO: 4864477 - DNA, 14 bp, Homo sapiens
gggcttttttcttt

SEQ ID NO: 4864478 - DNA, 19 bp, Homo sapiens
ggggaactcccccagaggt

SEQ ID NO: 4864479 - DNA, 21 bp, Homo sapiens
ggggaactcccccagaggtgg

SEQ ID NO: 4864480 - DNA, 22 bp, Homo sapiens
ggggaactcccccagaggtgga

SEQ ID NO: 4864481 - DNA, 14 bp, Homo sapiens
ggggaaggggcctg

SEQ ID NO: 4864482 - DNA, 15 bp, Homo sapiens
ggggaaggggcctgg

SEQ ID NO: 4864483 - DNA, 11 bp, Homo sapiens
ggggagccagc

SEQ ID NO: 4864484 - DNA, 14 bp, Homo sapiens
ggggagccagctgc

SEQ ID NO: 4864485 - DNA, 13 bp, Homo sapiens
ggggcagtgtgag

SEQ ID NO: 4864486 - DNA, 15 bp, Homo sapiens
ggggcagtgtgagga

SEQ ID NO: 4864487 - DNA, 20 bp, Homo sapiens
ggggccatgttcccagaacc

SEQ ID NO: 4864488 - DNA, 20 bp, Homo sapiens
ggggccctgtcactgtccag

SEQ ID NO: 4864489 - DNA, 14 bp, Homo sapiens
ggggcctcaggctc

SEQ ID NO: 4864490 - DNA, 15 bp, Homo sapiens
ggggcctcaggctcc

SEQ ID NO: 4864491 - DNA, 15 bp, Homo sapiens
ggggcctgggctgtg

SEQ ID NO: 4864492 - DNA, 24 bp, Homo sapiens
ggggctaaggtttccagtcagatg

SEQ ID NO: 4864493 - DNA, 17 bp, Homo sapiens
ggggctctgtggcaaaa

SEQ ID NO: 4864494 - DNA, 23 bp, Homo sapiens
ggggctgagccctcctgagggcc

SEQ ID NO: 4864495 - DNA, 22 bp, Homo sapiens
ggggctgtggccgtctcctccc

SEQ ID NO: 4864496 - DNA, 18 bp, Homo sapiens
ggggcttctctgctgaga

SEQ ID NO: 4864497 - DNA, 14 bp, Homo sapiens
gggggcaggcctcc

SEQ ID NO: 4864498 - DNA, 14 bp, Homo sapiens
gggggccaaggtcc

SEQ ID NO: 4864499 - DNA, 17 bp, Homo sapiens
gggggccaaggtcctgc

SEQ ID NO: 4864500 - DNA, 19 bp, Homo sapiens
gggggccgggggaggggcg

SEQ ID NO: 4864501 - DNA, 23 bp, Homo sapiens
ggggtaaagcagttcctgtccca

SEQ ID NO: 4864502 - DNA, 19 bp, Homo sapiens
ggggtgctggggctgcatg

SEQ ID NO: 4864503 - DNA, 15 bp, Homo sapiens
gggtatgctcaggtc

SEQ ID NO: 4864504 - DNA, 21 bp, Homo sapiens
gggtcaggggagacgaggcca

SEQ ID NO: 4864505 - DNA, 21 bp, Homo sapiens
gggtctgagtcatggccgggt

SEQ ID NO: 4864506 - DNA, 17 bp, Homo sapiens
gggtgacagctccggga

SEQ ID NO: 4864507 - DNA, 21 bp, Homo sapiens
gggtgccctttcctggcagtc

SEQ ID NO: 4864508 - DNA, 23 bp, Homo sapiens
gggtgggctttgttgtgagaatg

SEQ ID NO: 4864509 - DNA, 13 bp, Homo sapiens
ggtaaacaaagac

SEQ ID NO: 4864510 - DNA, 16 bp, Homo sapiens
ggtaaatgtttctttt

SEQ ID NO: 4864511 - DNA, 20 bp, Homo sapiens
ggtaatacttccagaagtgc

SEQ ID NO: 4864512 - DNA, 23 bp, Homo sapiens
ggtacttatttctcagctgtgcc

SEQ ID NO: 4864513 - DNA, 23 bp, Homo sapiens
ggtagaatgttttcaaatgttct

SEQ ID NO: 4864514 - DNA, 18 bp, Homo sapiens
ggtagctgggaaagcata

SEQ ID NO: 4864515 - DNA, 17 bp, Homo sapiens
ggtaggaccctcgagag

SEQ ID NO: 4864516 - DNA, 15 bp, Homo sapiens
ggtcaggggggagaa

SEQ ID NO: 4864517 - DNA, 19 bp, Homo sapiens
ggtcatgtgagtctgggat

SEQ ID NO: 4864518 - DNA, 21 bp, Homo sapiens
ggtccagggaggggtccctgc

SEQ ID NO: 4864519 - DNA, 20 bp, Homo sapiens
ggtcccatggctgaagctgg

SEQ ID NO: 4864520 - DNA, 22 bp, Homo sapiens
ggtcccggttcagacccctgcc

SEQ ID NO: 4864521 - DNA, 19 bp, Homo sapiens
taatggcagctagtgcctt

SEQ ID NO: 4864522 - DNA, 20 bp, Homo sapiens
taatggcagctagtgccttt

SEQ ID NO: 4864523 - DNA, 17 bp, Homo sapiens
taatgggattagaaaca

SEQ ID NO: 4864524 - DNA, 13 bp, Homo sapiens
taatgtaacatga

SEQ ID NO: 4864525 - DNA, 14 bp, Homo sapiens
taatgtaacatgat

SEQ ID NO: 4864526 - DNA, 16 bp, Homo sapiens
taatgtaacatgattt

SEQ ID NO: 4864527 - DNA, 18 bp, Homo sapiens
taatgtactgatttcagt

SEQ ID NO: 4864528 - DNA, 19 bp, Homo sapiens
taatgtactgatttcagta

SEQ ID NO: 4864529 - DNA, 16 bp, Homo sapiens
taatgtattatgagcc

SEQ ID NO: 4864530 - DNA, 23 bp, Homo sapiens
taatgtgtggattgcctctgaaa

SEQ ID NO: 4864531 - DNA, 17 bp, Homo sapiens
taatgtttattaaatgc

SEQ ID NO: 4864532 - DNA, 14 bp, Homo sapiens
taatgttttcaaaa

SEQ ID NO: 4864533 - DNA, 20 bp, Homo sapiens
taattaatatattaaaattc

SEQ ID NO: 4864534 - DNA, 13 bp, Homo sapiens
taattattattaa

SEQ ID NO: 4864535 - DNA, 12 bp, Homo sapiens
taattcagcact

SEQ ID NO: 4864536 - DNA, 18 bp, Homo sapiens
taattgctgataccatat

SEQ ID NO: 4864537 - DNA, 24 bp, Homo sapiens
taattgggaactgaaatccttgag

SEQ ID NO: 4864538 - DNA, 22 bp, Homo sapiens
taatttaaaaatatatttataa

SEQ ID NO: 4864539 - DNA, 11 bp, Homo sapiens
taatttaactt

SEQ ID NO: 4864540 - DNA, 13 bp, Homo sapiens
taatttaactttc

SEQ ID NO: 4864541 - DNA, 19 bp, Homo sapiens
taatttccttcaggcagct

SEQ ID NO: 4864542 - DNA, 15 bp, Homo sapiens
taatttgaactttgg

SEQ ID NO: 4864543 - DNA, 17 bp, Homo sapiens
taatttgaactttggaa

SEQ ID NO: 4864544 - DNA, 17 bp, Homo sapiens
taatttggagcacaaaa

SEQ ID NO: 4864545 - DNA, 23 bp, Homo sapiens
taatttggagcacaaaattcaaa

SEQ ID NO: 4864546 - DNA, 20 bp, Homo sapiens
tacaactaacgcaaccaagt

SEQ ID NO: 4864547 - DNA, 17 bp, Homo sapiens
tacaactgattgcaaca

SEQ ID NO: 4864548 - DNA, 13 bp, Homo sapiens
tacaattttaaga

SEQ ID NO: 4864549 - DNA, 16 bp, Homo sapiens
tacacacacacacaca

SEQ ID NO: 4864550 - DNA, 13 bp, Homo sapiens
tacacatttgcta

SEQ ID NO: 4864551 - DNA, 21 bp, Homo sapiens
tacacatttgctactgttgta

SEQ ID NO: 4864552 - DNA, 22 bp, Homo sapiens
tacagaacactttgctaggaga

SEQ ID NO: 4864553 - DNA, 14 bp, Homo sapiens
tacagaatttgaat

SEQ ID NO: 4864554 - DNA, 16 bp, Homo sapiens
tacagaatttgaatta

SEQ ID NO: 4864555 - DNA, 20 bp, Homo sapiens
tacagccttaatattttcct

SEQ ID NO: 4864556 - DNA, 22 bp, Homo sapiens
tacagctctcctccagccctgg

SEQ ID NO: 4864557 - DNA, 13 bp, Homo sapiens
tacagctgtgctc

SEQ ID NO: 4864558 - DNA, 16 bp, Homo sapiens
tacaggagccagcctg

SEQ ID NO: 4864559 - DNA, 23 bp, Homo sapiens
tacaggagccagcctgcttccca

SEQ ID NO: 4864560 - DNA, 21 bp, Homo sapiens
tacagttttaactgtggatat

SEQ ID NO: 4864561 - DNA, 13 bp, Homo sapiens
tacataaaagaaa

SEQ ID NO: 4864562 - DNA, 17 bp, Homo sapiens
tacataaaagaaataaa

SEQ ID NO: 4864563 - DNA, 15 bp, Homo sapiens
tacataagtttagga

SEQ ID NO: 4864564 - DNA, 15 bp, Homo sapiens
tacatcaatatgtat

SEQ ID NO: 4864565 - DNA, 16 bp, Homo sapiens
tacatgaagcagaacc

SEQ ID NO: 4864566 - DNA, 17 bp, Homo sapiens
tacatgaagcagaacct

SEQ ID NO: 4864567 - DNA, 14 bp, Homo sapiens
tacatgcatataat

SEQ ID NO: 4864568 - DNA, 20 bp, Homo sapiens
tacatgtattgcacattgta

SEQ ID NO: 4864569 - DNA, 13 bp, Homo sapiens
taccaaaatttta

SEQ ID NO: 4864570 - DNA, 16 bp, Homo sapiens
taccagggtctctcag

SEQ ID NO: 4864571 - DNA, 16 bp, Homo sapiens
taccatatgaatgaaa

SEQ ID NO: 4864572 - DNA, 20 bp, Homo sapiens
taccattctattctccagac

SEQ ID NO: 4864573 - DNA, 21 bp, Homo sapiens
taccattctattctccagaca

SEQ ID NO: 4864574 - DNA, 22 bp, Homo sapiens
taccattctattctccagacat

SEQ ID NO: 4864575 - DNA, 23 bp, Homo sapiens
taccattctattctccagacatg

SEQ ID NO: 4864576 - DNA, 14 bp, Homo sapiens
tacccaaactgctt

SEQ ID NO: 4864577 - DNA, 15 bp, Homo sapiens
tacccaaactgcttt

SEQ ID NO: 4864578 - DNA, 15 bp, Homo sapiens
tacccatagacatga

SEQ ID NO: 4864579 - DNA, 20 bp, Homo sapiens
tacccctgctcccattcctc

SEQ ID NO: 4864580 - DNA, 18 bp, Homo sapiens
taccctacagacagctta

SEQ ID NO: 4864581 - DNA, 18 bp, Homo sapiens
taccctgggaagctgccg

SEQ ID NO: 4864582 - DNA, 23 bp, Homo sapiens
tacctactggtgtaatctcaatg

SEQ ID NO: 4864583 - DNA, 21 bp, Homo sapiens
tacctactgtgtgccaggggc

SEQ ID NO: 4864584 - DNA, 17 bp, Homo sapiens
tacctagctaattattt

SEQ ID NO: 4864585 - DNA, 20 bp, Homo sapiens
tacctccatccatccttcca

SEQ ID NO: 4864586 - DNA, 21 bp, Homo sapiens
tacctccatccatccttccaa

SEQ ID NO: 4864587 - DNA, 17 bp, Homo sapiens
tacctctgtctgagaca

SEQ ID NO: 4864588 - DNA, 14 bp, Homo sapiens
tacctggcctagaa

SEQ ID NO: 4864589 - DNA, 22 bp, Homo sapiens
taccttcaaggctcttcttcct

SEQ ID NO: 4864590 - DNA, 14 bp, Homo sapiens
taccttgtatactg

SEQ ID NO: 4864591 - DNA, 23 bp, Homo sapiens
tacctttcctgatgcccctgaca

SEQ ID NO: 4864592 - DNA, 18 bp, Homo sapiens
taccttttttttttcttg

SEQ ID NO: 4864593 - DNA, 22 bp, Homo sapiens
tacgaacctacagttttaactg

SEQ ID NO: 4864594 - DNA, 22 bp, Homo sapiens
tacgaatgcccctgttcatgtt

SEQ ID NO: 4864595 - DNA, 16 bp, Homo sapiens
tactaaaaaaaagatg

SEQ ID NO: 4864596 - DNA, 18 bp, Homo sapiens
tactaaaaaaaagatgaa

SEQ ID NO: 4864597 - DNA, 18 bp, Homo sapiens
tactaaaaagtataaaat

SEQ ID NO: 4864598 - DNA, 16 bp, Homo sapiens
tactaaggagaaatga

SEQ ID NO: 4864599 - DNA, 14 bp, Homo sapiens
tactactactgtta

SEQ ID NO: 4864600 - DNA, 13 bp, Homo sapiens
tactactgttatc

SEQ ID NO: 4864601 - DNA, 15 bp, Homo sapiens
tactagataaaatgt

SEQ ID NO: 4864602 - DNA, 16 bp, Homo sapiens
tactagtgtgactcct

SEQ ID NO: 4864603 - DNA, 13 bp, Homo sapiens
tactattgcctca

SEQ ID NO: 4864604 - DNA, 14 bp, Homo sapiens
tactattgcctcat

SEQ ID NO: 4864605 - DNA, 23 bp, Homo sapiens
tactcccacagcagccccaggag

SEQ ID NO: 4864606 - DNA, 15 bp, Homo sapiens
tactccttgcttcct

SEQ ID NO: 4864607 - DNA, 17 bp, Homo sapiens
tactccttgcttcctga

SEQ ID NO: 4864608 - DNA, 18 bp, Homo sapiens
tactccttgcttcctgat

SEQ ID NO: 4864609 - DNA, 20 bp, Homo sapiens
tactgaacacatgtgtatga

SEQ ID NO: 4864610 - DNA, 13 bp, Homo sapiens
tactgaatctgct

SEQ ID NO: 4864611 - DNA, 21 bp, Homo sapiens
tactgaatgaagcagtatttt

SEQ ID NO: 4864612 - DNA, 16 bp, Homo sapiens
tactgcaaaaagaaaa

SEQ ID NO: 4864613 - DNA, 18 bp, Homo sapiens
tactgccaaaacatttat

SEQ ID NO: 4864614 - DNA, 17 bp, Homo sapiens
tactgctttaatcagaa

SEQ ID NO: 4864615 - DNA, 12 bp, Homo sapiens
tactggtgtaat

SEQ ID NO: 4864616 - DNA, 16 bp, Homo sapiens
tactggttacctggag

SEQ ID NO: 4864617 - DNA, 17 bp, Homo sapiens
tactggttacctggaga

SEQ ID NO: 4864618 - DNA, 15 bp, Homo sapiens
tactgtaatgctgcc

SEQ ID NO: 4864619 - DNA, 15 bp, Homo sapiens
tactgtactttccca

SEQ ID NO: 4864620 - DNA, 16 bp, Homo sapiens
tactgtactttcccag

SEQ ID NO: 4864621 - DNA, 18 bp, Homo sapiens
tactgtactttcccaggt

SEQ ID NO: 4864622 - DNA, 19 bp, Homo sapiens
tactgtctattaatattca

SEQ ID NO: 4864623 - DNA, 21 bp, Homo sapiens
tactgtgggcaaagtcctcct

SEQ ID NO: 4864624 - DNA, 22 bp, Homo sapiens
tactgttgtaagaattctgatt

SEQ ID NO: 4864625 - DNA, 12 bp, Homo sapiens
tacttacatgtt

SEQ ID NO: 4864626 - DNA, 18 bp, Homo sapiens
tacttatttctcagctgt

SEQ ID NO: 4864627 - DNA, 20 bp, Homo sapiens
tacttcaaagtgcctgggct

SEQ ID NO: 4864628 - DNA, 16 bp, Homo sapiens
tacttccctcttgaaa

SEQ ID NO: 4864629 - DNA, 22 bp, Homo sapiens
tacttctgtaattgtgtggatt

SEQ ID NO: 4864630 - DNA, 17 bp, Homo sapiens
tacttgactacctactg

SEQ ID NO: 4864631 - DNA, 18 bp, Homo sapiens
tacttgggcttcaacagc

SEQ ID NO: 4864632 - DNA, 13 bp, Homo sapiens
tacttgttttgga

SEQ ID NO: 4864633 - DNA, 21 bp, Homo sapiens
tactttatcatgaatgctttt

SEQ ID NO: 4864634 - DNA, 12 bp, Homo sapiens
tactttcccagg

SEQ ID NO: 4864635 - DNA, 17 bp, Homo sapiens
tagaaaagtgaattgaa

SEQ ID NO: 4864636 - DNA, 18 bp, Homo sapiens
tagaaaagtgaattgaag

SEQ ID NO: 4864637 - DNA, 16 bp, Homo sapiens
tagaaactgaggccca

SEQ ID NO: 4864638 - DNA, 21 bp, Homo sapiens
tagaaactgaggcccagagag

SEQ ID NO: 4864639 - DNA, 16 bp, Homo sapiens
tagaaattacctgtgg

SEQ ID NO: 4864640 - DNA, 15 bp, Homo sapiens
tagaactcctgtctt

SEQ ID NO: 4864641 - DNA, 21 bp, Homo sapiens
tagaactcctgtcttctttct

SEQ ID NO: 4864642 - DNA, 22 bp, Homo sapiens
tagaactcctgtcttctttctc

SEQ ID NO: 4864643 - DNA, 12 bp, Homo sapiens
tagaagcctgca

SEQ ID NO: 4864644 - DNA, 19 bp, Homo sapiens
tagaatgttttcaaatgtt

SEQ ID NO: 4864645 - DNA, 22 bp, Homo sapiens
tagaattataactgtaaagatg

SEQ ID NO: 4864646 - DNA, 14 bp, Homo sapiens
tagacaaaaagtat

SEQ ID NO: 4864647 - DNA, 15 bp, Homo sapiens
tagacaaaaagtata

SEQ ID NO: 4864648 - DNA, 14 bp, Homo sapiens
tagacggtgctcac

SEQ ID NO: 4864649 - DNA, 18 bp, Homo sapiens
tagacttggagaatactg

SEQ ID NO: 4864650 - DNA, 20 bp, Homo sapiens
tagacttggagaatactgcc

SEQ ID NO: 4864651 - DNA, 19 bp, Homo sapiens
tagagaagtatacataagt

SEQ ID NO: 4864652 - DNA, 20 bp, Homo sapiens
tagagacttgcagttagact

SEQ ID NO: 4864653 - DNA, 18 bp, Homo sapiens
tagagcccctactgtggg

SEQ ID NO: 4864654 - DNA, 18 bp, Homo sapiens
tagagctaaaaaggccct

SEQ ID NO: 4864655 - DNA, 13 bp, Homo sapiens
tagagggaatcta

SEQ ID NO: 4864656 - DNA, 21 bp, Homo sapiens
tagagtcaactacacaaagca

SEQ ID NO: 4864657 - DNA, 21 bp, Homo sapiens
tagatccatttccattgctta

SEQ ID NO: 4864658 - DNA, 13 bp, Homo sapiens
tagatgaggctca

SEQ ID NO: 4864659 - DNA, 18 bp, Homo sapiens
tagatgaggctcagagag

SEQ ID NO: 4864660 - DNA, 14 bp, Homo sapiens
tagattcagagaaa

SEQ ID NO: 4864661 - DNA, 22 bp, Homo sapiens
tagattgactaactcaaataca

SEQ ID NO: 4864662 - DNA, 13 bp, Homo sapiens
tagcactctcaga

SEQ ID NO: 4864663 - DNA, 19 bp, Homo sapiens
tagcagaaaccaacaagaa

SEQ ID NO: 4864664 - DNA, 11 bp, Homo sapiens
tagcagagtct

SEQ ID NO: 4864665 - DNA, 17 bp, Homo sapiens
tagcagagtctgtctct

SEQ ID NO: 4864666 - DNA, 16 bp, Homo sapiens
tagcagagttaaatct

SEQ ID NO: 4864667 - DNA, 16 bp, Homo sapiens
tagcagccagttcaaa

SEQ ID NO: 4864668 - DNA, 14 bp, Homo sapiens
tagcataggctggg

SEQ ID NO: 4864669 - DNA, 15 bp, Homo sapiens
tagcatgaaataaaa

SEQ ID NO: 4864670 - DNA, 14 bp, Homo sapiens
tagcattctttgga

SEQ ID NO: 4864671 - DNA, 22 bp, Homo sapiens
tagcccaacctacattccaccc

SEQ ID NO: 4864672 - DNA, 13 bp, Homo sapiens
tagcctctggact

SEQ ID NO: 4864673 - DNA, 22 bp, Homo sapiens
tagcctttacctgtgaagtgtt

SEQ ID NO: 4864674 - DNA, 16 bp, Homo sapiens
tagctcctccccttcc

SEQ ID NO: 4864675 - DNA, 19 bp, Homo sapiens
tagctcctccccttcctct

SEQ ID NO: 4864676 - DNA, 17 bp, Homo sapiens
tagctgaagaattgaaa

SEQ ID NO: 4864677 - DNA, 20 bp, Homo sapiens
tagctgcagccttcatcaga

SEQ ID NO: 4864678 - DNA, 16 bp, Homo sapiens
tagctgggaaagcata

SEQ ID NO: 4864679 - DNA, 14 bp, Homo sapiens
tagctggggagccc

SEQ ID NO: 4864680 - DNA, 23 bp, Homo sapiens
tagctgtacttcttgaatataaa

SEQ ID NO: 4864681 - DNA, 15 bp, Homo sapiens
tagcttcagccaggc

SEQ ID NO: 4864682 - DNA, 20 bp, Homo sapiens
taggaatcattcagaaatgt

SEQ ID NO: 4864683 - DNA, 22 bp, Homo sapiens
taggaatcattcagaaatgttg

SEQ ID NO: 4864684 - DNA, 20 bp, Homo sapiens
taggaatcccagaggtggga

SEQ ID NO: 4864685 - DNA, 15 bp, Homo sapiens
taggaccctcgagag

SEQ ID NO: 4864686 - DNA, 20 bp, Homo sapiens
taggagaagtcttctattta

SEQ ID NO: 4864687 - DNA, 21 bp, Homo sapiens
taggccacagaaggtgaactt

SEQ ID NO: 4864688 - DNA, 19 bp, Homo sapiens
taggccaccccctatcctc

SEQ ID NO: 4864689 - DNA, 12 bp, Homo sapiens
taggccaggcct

SEQ ID NO: 4864690 - DNA, 22 bp, Homo sapiens
taggccctgtgagcacaaagaa

SEQ ID NO: 4864691 - DNA, 20 bp, Homo sapiens
taggctactgtaatgctgcc

SEQ ID NO: 4864692 - DNA, 21 bp, Homo sapiens
taggctactgtaatgctgcct

SEQ ID NO: 4864693 - DNA, 17 bp, Homo sapiens
taggctattaaaaaagt

SEQ ID NO: 4864694 - DNA, 21 bp, Homo sapiens
taggctgggcctcccctgggc

SEQ ID NO: 4864695 - DNA, 13 bp, Homo sapiens
taggctggggaca

SEQ ID NO: 4864696 - DNA, 14 bp, Homo sapiens
taggctggggacac

SEQ ID NO: 4864697 - DNA, 20 bp, Homo sapiens
tagggccctgacaggccttc

SEQ ID NO: 4864698 - DNA, 17 bp, Homo sapiens
tagggcctcagtctgga

SEQ ID NO: 4864699 - DNA, 18 bp, Homo sapiens
tagggtctaccaatacaa

SEQ ID NO: 4864700 - DNA, 14 bp, Homo sapiens
taggtagctgggga

SEQ ID NO: 4864701 - DNA, 16 bp, Homo sapiens
taggtctcctcagggt

SEQ ID NO: 4864702 - DNA, 11 bp, Homo sapiens
taggttctttt

SEQ ID NO: 4864703 - DNA, 11 bp, Homo sapiens
tagtaagaata

SEQ ID NO: 4864704 - DNA, 22 bp, Homo sapiens
tagtaagaataccacatcaaat

SEQ ID NO: 4864705 - DNA, 15 bp, Homo sapiens
tagtatctatatgac

SEQ ID NO: 4864706 - DNA, 13 bp, Homo sapiens
tagtcatgtgacc

SEQ ID NO: 4864707 - DNA, 18 bp, Homo sapiens
tagtcccggaggccttcc

SEQ ID NO: 4864708 - DNA, 17 bp, Homo sapiens
tagtgacatttaatgcc

SEQ ID NO: 4864709 - DNA, 19 bp, Homo sapiens
tagtgaggaagacaagcat

SEQ ID NO: 4864710 - DNA, 21 bp, Homo sapiens
tagtgatgtccttaaaatgtg

SEQ ID NO: 4864711 - DNA, 11 bp, Homo sapiens
tagtgtgactc

SEQ ID NO: 4864712 - DNA, 19 bp, Homo sapiens
tagttatacttatttgtat

SEQ ID NO: 4864713 - DNA, 18 bp, Homo sapiens
tataaaaaaggtggtggt

SEQ ID NO: 4864714 - DNA, 20 bp, Homo sapiens
tataaaattatgagattggt

SEQ ID NO: 4864715 - DNA, 21 bp, Homo sapiens
tataaacagaaatggaaagca

SEQ ID NO: 4864716 - DNA, 19 bp, Homo sapiens
tataaagtgcctcggacag

SEQ ID NO: 4864717 - DNA, 13 bp, Homo sapiens
tataacacatttt

SEQ ID NO: 4864718 - DNA, 20 bp, Homo sapiens
tataacctagttaaagaaag

SEQ ID NO: 4864719 - DNA, 22 bp, Homo sapiens
tataacctagttaaagaaagga

SEQ ID NO: 4864720 - DNA, 16 bp, Homo sapiens
tataaggcagccttga

SEQ ID NO: 4864721 - DNA, 14 bp, Homo sapiens
tataataaaaatat

SEQ ID NO: 4864722 - DNA, 12 bp, Homo sapiens
tataatactact

SEQ ID NO: 4864723 - DNA, 16 bp, Homo sapiens
tataatactactactg

SEQ ID NO: 4864724 - DNA, 20 bp, Homo sapiens
tataatactactactgttat

SEQ ID NO: 4864725 - DNA, 13 bp, Homo sapiens
tataatgaataaa

SEQ ID NO: 4864726 - DNA, 17 bp, Homo sapiens
tataatgtttattaaat

SEQ ID NO: 4864727 - DNA, 22 bp, Homo sapiens
tatacagtatagatttttgggt

SEQ ID NO: 4864728 - DNA, 16 bp, Homo sapiens
tatacagtttagaata

SEQ ID NO: 4864729 - DNA, 18 bp, Homo sapiens
tatacatcaatatgtata

SEQ ID NO: 4864730 - DNA, 19 bp, Homo sapiens
tatacatcaatatgtatat

SEQ ID NO: 4864731 - DNA, 18 bp, Homo sapiens
tatacatgtgatacattt

SEQ ID NO: 4864732 - DNA, 21 bp, Homo sapiens
tatactgtggcctgcaggagg

SEQ ID NO: 4864733 - DNA, 12 bp, Homo sapiens
tatactttagta

SEQ ID NO: 4864734 - DNA, 15 bp, Homo sapiens
tatagcttgcagaac

SEQ ID NO: 4864735 - DNA, 13 bp, Homo sapiens
tataggctatttt

SEQ ID NO: 4864736 - DNA, 18 bp, Homo sapiens
tatagtctaagactatat

SEQ ID NO: 4864737 - DNA, 21 bp, Homo sapiens
tatagtgcaatagtgcaacat

SEQ ID NO: 4864738 - DNA, 18 bp, Homo sapiens
tatataggctattttcta

SEQ ID NO: 4864739 - DNA, 13 bp, Homo sapiens
tatatataatgta

SEQ ID NO: 4864740 - DNA, 14 bp, Homo sapiens
tatatatatatata

SEQ ID NO: 4864741 - DNA, 23 bp, Homo sapiens
tatatattttgtgtgaaattgca

SEQ ID NO: 4864742 - DNA, 13 bp, Homo sapiens
tatatgactgcat

SEQ ID NO: 4864743 - DNA, 16 bp, Homo sapiens
tatatggaagaaagta

SEQ ID NO: 4864744 - DNA, 15 bp, Homo sapiens
tatatgtatttctat

SEQ ID NO: 4864745 - DNA, 18 bp, Homo sapiens
gcatggggaggcagcaga

SEQ ID NO: 4864746 - DNA, 15 bp, Homo sapiens
gcatggggccaggaa

SEQ ID NO: 4864747 - DNA, 21 bp, Homo sapiens
gcattagagtcaactacacaa

SEQ ID NO: 4864748 - DNA, 12 bp, Homo sapiens
gcattagcaagg

SEQ ID NO: 4864749 - DNA, 18 bp, Homo sapiens
gcattagcaaggcagagc

SEQ ID NO: 4864750 - DNA, 19 bp, Homo sapiens
gcattagcaaggcagagcc

SEQ ID NO: 4864751 - DNA, 21 bp, Homo sapiens
gcattagcaaggcagagcctt

SEQ ID NO: 4864752 - DNA, 21 bp, Homo sapiens
gcattagcctggatcctcagt

SEQ ID NO: 4864753 - DNA, 14 bp, Homo sapiens
gcattctcccagct

SEQ ID NO: 4864754 - DNA, 13 bp, Homo sapiens
gcattctgtttat

SEQ ID NO: 4864755 - DNA, 17 bp, Homo sapiens
gcattgagtattgttta

SEQ ID NO: 4864756 - DNA, 20 bp, Homo sapiens
gcattgtcaccgcaggtgct

SEQ ID NO: 4864757 - DNA, 14 bp, Homo sapiens
gcattgtgtggaat

SEQ ID NO: 4864758 - DNA, 23 bp, Homo sapiens
gcattgtgtggaatttgaggtct

SEQ ID NO: 4864759 - DNA, 14 bp, Homo sapiens
gcatttaataaaga

SEQ ID NO: 4864760 - DNA, 17 bp, Homo sapiens
gcatttaataaagatga

SEQ ID NO: 4864761 - DNA, 19 bp, Homo sapiens
gcatttaataaagatgagt

SEQ ID NO: 4864762 - DNA, 10 bp, Homo sapiens
gcatttccta

SEQ ID NO: 4864763 - DNA, 16 bp, Homo sapiens
gccaaaggatgtgata

SEQ ID NO: 4864764 - DNA, 17 bp, Homo sapiens
gccaaatttcttttgct

SEQ ID NO: 4864765 - DNA, 23 bp, Homo sapiens
gccaaccatcatgtgtagagccc

SEQ ID NO: 4864766 - DNA, 17 bp, Homo sapiens
gccaacctcaggctcct

SEQ ID NO: 4864767 - DNA, 18 bp, Homo sapiens
gccaacctcaggctccta

SEQ ID NO: 4864768 - DNA, 13 bp, Homo sapiens
gccaagctgagga

SEQ ID NO: 4864769 - DNA, 15 bp, Homo sapiens
gccaagctttaaatt

SEQ ID NO: 4864770 - DNA, 17 bp, Homo sapiens
gccaaggccgccagcgt

SEQ ID NO: 4864771 - DNA, 16 bp, Homo sapiens
gccaaggtcctgctca

SEQ ID NO: 4864772 - DNA, 18 bp, Homo sapiens
gccaattagacttgaaat

SEQ ID NO: 4864773 - DNA, 23 bp, Homo sapiens
gccacaccgtggcagcttgctgg

SEQ ID NO: 4864774 - DNA, 23 bp, Homo sapiens
gccacagaggactcacttgccca

SEQ ID NO: 4864775 - DNA, 15 bp, Homo sapiens
gccacagcagagcat

SEQ ID NO: 4864776 - DNA, 16 bp, Homo sapiens
gccacatcaaaccttt

SEQ ID NO: 4864777 - DNA, 19 bp, Homo sapiens
gccacgggggcagtgtgag

SEQ ID NO: 4864778 - DNA, 16 bp, Homo sapiens
gccactgttgttttgg

SEQ ID NO: 4864779 - DNA, 15 bp, Homo sapiens
gccagaaaggtgtga

SEQ ID NO: 4864780 - DNA, 19 bp, Homo sapiens
gccagaaaggtgtgaggag

SEQ ID NO: 4864781 - DNA, 22 bp, Homo sapiens
gccagaacgtggctctgctggc

SEQ ID NO: 4864782 - DNA, 11 bp, Homo sapiens
gccagagaaag

SEQ ID NO: 4864783 - DNA, 17 bp, Homo sapiens
gccagattggccaatta

SEQ ID NO: 4864784 - DNA, 13 bp, Homo sapiens
gccagcccgcaga

SEQ ID NO: 4864785 - DNA, 12 bp, Homo sapiens
gccagctgcagc

SEQ ID NO: 4864786 - DNA, 11 bp, Homo sapiens
gccagctgctt

SEQ ID NO: 4864787 - DNA, 15 bp, Homo sapiens
gccagctgcttgacc

SEQ ID NO: 4864788 - DNA, 17 bp, Homo sapiens
gccagctgtgcactttc

SEQ ID NO: 4864789 - DNA, 22 bp, Homo sapiens
gccaggacatgcaataaaattt

SEQ ID NO: 4864790 - DNA, 13 bp, Homo sapiens
gccaggactccca

SEQ ID NO: 4864791 - DNA, 16 bp, Homo sapiens
gccaggactcccagaa

SEQ ID NO: 4864792 - DNA, 21 bp, Homo sapiens
gccaggactcccagaacctct

SEQ ID NO: 4864793 - DNA, 13 bp, Homo sapiens
gccaggatgacta

SEQ ID NO: 4864794 - DNA, 14 bp, Homo sapiens
gccaggctcaggag

SEQ ID NO: 4864795 - DNA, 16 bp, Homo sapiens
gccaggctcaggagaa

SEQ ID NO: 4864796 - DNA, 17 bp, Homo sapiens
gccaggctcaggagaag

SEQ ID NO: 4864797 - DNA, 17 bp, Homo sapiens
gccaggggctctgtggc

SEQ ID NO: 4864798 - DNA, 13 bp, Homo sapiens
gcttacaggagcc

SEQ ID NO: 4864799 - DNA, 15 bp, Homo sapiens
gcttacaggagccag

SEQ ID NO: 4864800 - DNA, 20 bp, Homo sapiens
gcttacaggagccagcctgc

SEQ ID NO: 4864801 - DNA, 17 bp, Homo sapiens
gcttacctgggcacaaa

SEQ ID NO: 4864802 - DNA, 15 bp, Homo sapiens
gcttattacatttta

SEQ ID NO: 4864803 - DNA, 19 bp, Homo sapiens
gcttcaaaaagccacagca

SEQ ID NO: 4864804 - DNA, 23 bp, Homo sapiens
gcttcaaaaagccacagcagagc

SEQ ID NO: 4864805 - DNA, 15 bp, Homo sapiens
gcttcaacagccaag

SEQ ID NO: 4864806 - DNA, 15 bp, Homo sapiens
gcttcactgccccct

SEQ ID NO: 4864807 - DNA, 16 bp, Homo sapiens
gcttcagccaggcaag

SEQ ID NO: 4864808 - DNA, 15 bp, Homo sapiens
gcttcagccaggtct

SEQ ID NO: 4864809 - DNA, 18 bp, Homo sapiens
gcttcccatctgaagagt

SEQ ID NO: 4864810 - DNA, 13 bp, Homo sapiens
gcttcgactactg

SEQ ID NO: 4864811 - DNA, 15 bp, Homo sapiens
gcttcgactactgct

SEQ ID NO: 4864812 - DNA, 19 bp, Homo sapiens
gcttcgactactgctcctg

SEQ ID NO: 4864813 - DNA, 21 bp, Homo sapiens
gcttcgactactgctcctgtg

SEQ ID NO: 4864814 - DNA, 22 bp, Homo sapiens
gcttcgactactgctcctgtgg

SEQ ID NO: 4864815 - DNA, 23 bp, Homo sapiens
gcttcgactactgctcctgtggc

SEQ ID NO: 4864816 - DNA, 24 bp, Homo sapiens
gcttcgactactgctcctgtggca

SEQ ID NO: 4864817 - DNA, 18 bp, Homo sapiens
gcttctcacactggagga

SEQ ID NO: 4864818 - DNA, 14 bp, Homo sapiens
gcttgactttccag

SEQ ID NO: 4864819 - DNA, 13 bp, Homo sapiens
gcttgcatggaga

SEQ ID NO: 4864820 - DNA, 22 bp, Homo sapiens
gcttgccaaagtacagaatttg

SEQ ID NO: 4864821 - DNA, 22 bp, Homo sapiens
gcttgcccagtacatttaaatt

SEQ ID NO: 4864822 - DNA, 23 bp, Homo sapiens
gcttgcccagtacatttaaattt

SEQ ID NO: 4864823 - DNA, 13 bp, Homo sapiens
gcttgctgggctt

SEQ ID NO: 4864824 - DNA, 14 bp, Homo sapiens
gcttgctgggcttt

SEQ ID NO: 4864825 - DNA, 17 bp, Homo sapiens
gcttgctgggctttggg

SEQ ID NO: 4864826 - DNA, 18 bp, Homo sapiens
gcttgtttacctttctct

SEQ ID NO: 4864827 - DNA, 13 bp, Homo sapiens
gctttaagccttc

SEQ ID NO: 4864828 - DNA, 15 bp, Homo sapiens
gctttagtgaattaa

SEQ ID NO: 4864829 - DNA, 20 bp, Homo sapiens
gctttcccagtcccattcct

SEQ ID NO: 4864830 - DNA, 16 bp, Homo sapiens
gctttctttgacctct

SEQ ID NO: 4864831 - DNA, 20 bp, Homo sapiens
gctttgactctataagcaaa

SEQ ID NO: 4864832 - DNA, 18 bp, Homo sapiens
gctttggaacaatcacag

SEQ ID NO: 4864833 - DNA, 22 bp, Homo sapiens
gctttggaacaatcacagggaa

SEQ ID NO: 4864834 - DNA, 21 bp, Homo sapiens
gctttgggaagtttgctgtgc

SEQ ID NO: 4864835 - DNA, 22 bp, Homo sapiens
gctttgggaagtttgctgtgct

SEQ ID NO: 4864836 - DNA, 16 bp, Homo sapiens
gctttggtggccaggg

SEQ ID NO: 4864837 - DNA, 18 bp, Homo sapiens
gctttgttgtgagaatgg

SEQ ID NO: 4864838 - DNA, 14 bp, Homo sapiens
gcttttgaattgca

SEQ ID NO: 4864839 - DNA, 15 bp, Homo sapiens
gcttttgggggtcag

SEQ ID NO: 4864840 - DNA, 23 bp, Homo sapiens
gcttttgggggtcagcatccagt

SEQ ID NO: 4864841 - DNA, 22 bp, Homo sapiens
gcttttgtagatggcgatgtgt

SEQ ID NO: 4864842 - DNA, 22 bp, Homo sapiens
ggaaacaaataatttgaacttt

SEQ ID NO: 4864843 - DNA, 20 bp, Homo sapiens
ggaaaccagagtctgtattt

SEQ ID NO: 4864844 - DNA, 12 bp, Homo sapiens
ggaaaggcaggg

SEQ ID NO: 4864845 - DNA, 20 bp, Homo sapiens
ggaaaggcagggccctgaaa

SEQ ID NO: 4864846 - DNA, 12 bp, Homo sapiens
ggaaatggggaa

SEQ ID NO: 4864847 - DNA, 17 bp, Homo sapiens
ggaacccccctcccacc

SEQ ID NO: 4864848 - DNA, 22 bp, Homo sapiens
ggaacccccctcccacccaccg

SEQ ID NO: 4864849 - DNA, 13 bp, Homo sapiens
ggaaccctggagg

SEQ ID NO: 4864850 - DNA, 19 bp, Homo sapiens
ggaactcccccagaggtgg

SEQ ID NO: 4864851 - DNA, 15 bp, Homo sapiens
ggaagacctgaaaga

SEQ ID NO: 4864852 - DNA, 20 bp, Homo sapiens
ggaagacctgaaagagagga

SEQ ID NO: 4864853 - DNA, 14 bp, Homo sapiens
ggaagagggagggg

SEQ ID NO: 4864854 - DNA, 18 bp, Homo sapiens
ggaagagggaggggccct

SEQ ID NO: 4864855 - DNA, 24 bp, Homo sapiens
ggaagcaataggtagctggggagc

SEQ ID NO: 4864856 - DNA, 15 bp, Homo sapiens
ggaaggcagagaaat

SEQ ID NO: 4864857 - DNA, 17 bp, Homo sapiens
ggaagggaaagtttttt

SEQ ID NO: 4864858 - DNA, 12 bp, Homo sapiens
ggaagggacccc

SEQ ID NO: 4864859 - DNA, 12 bp, Homo sapiens
ggaaggggcctg

SEQ ID NO: 4864860 - DNA, 22 bp, Homo sapiens
ggaaggggcctgggctgtgagg

SEQ ID NO: 4864861 - DNA, 19 bp, Homo sapiens
ggaagtgtgtgccaagagc

SEQ ID NO: 4864862 - DNA, 19 bp, Homo sapiens
ggaagttgccatgggaaac

SEQ ID NO: 4864863 - DNA, 14 bp, Homo sapiens
ggaagtttgctgtg

SEQ ID NO: 4864864 - DNA, 20 bp, Homo sapiens
ggaataataggccacagaag

SEQ ID NO: 4864865 - DNA, 21 bp, Homo sapiens
ggaataatttccttcaggcag

SEQ ID NO: 4864866 - DNA, 14 bp, Homo sapiens
ggaatctagcccaa

SEQ ID NO: 4864867 - DNA, 17 bp, Homo sapiens
ggaatctagcccaacct

SEQ ID NO: 4864868 - DNA, 14 bp, Homo sapiens
ggaatgttctttct

SEQ ID NO: 4864869 - DNA, 21 bp, Homo sapiens
ggacacaggatcctggcctga

SEQ ID NO: 4864870 - DNA, 21 bp, Homo sapiens
ggacaccattaccaaaataat

SEQ ID NO: 4864871 - DNA, 17 bp, Homo sapiens
ggacagttgatggagcc

SEQ ID NO: 4864872 - DNA, 20 bp, Homo sapiens
ggacagttgatggagcccca

SEQ ID NO: 4864873 - DNA, 19 bp, Homo sapiens
ctctgccaaaggatgtgat

SEQ ID NO: 4864874 - DNA, 21 bp, Homo sapiens
ctctgccaaaggatgtgatat

SEQ ID NO: 4864875 - DNA, 18 bp, Homo sapiens
ctctgccagttacttggg

SEQ ID NO: 4864876 - DNA, 20 bp, Homo sapiens
ctctgccagttacttgggct

SEQ ID NO: 4864877 - DNA, 14 bp, Homo sapiens
ctctgcctggagtg

SEQ ID NO: 4864878 - DNA, 17 bp, Homo sapiens
ctctgctctgcctggag

SEQ ID NO: 4864879 - DNA, 17 bp, Homo sapiens
ctctgctgagaaggcaa

SEQ ID NO: 4864880 - DNA, 14 bp, Homo sapiens
ctctgctggccgga

SEQ ID NO: 4864881 - DNA, 22 bp, Homo sapiens
ctctggactggaaagcacaaga

SEQ ID NO: 4864882 - DNA, 15 bp, Homo sapiens
ctctggagcagccaa

SEQ ID NO: 4864883 - DNA, 20 bp, Homo sapiens
ctctggatcccgttcagaaa

SEQ ID NO: 4864884 - DNA, 24 bp, Homo sapiens
ctctggatcccgttcagaaaacca

SEQ ID NO: 4864885 - DNA, 19 bp, Homo sapiens
ctctggcttcaaaaagcca

SEQ ID NO: 4864886 - DNA, 21 bp, Homo sapiens
ctctgggacccacagaacttg

SEQ ID NO: 4864887 - DNA, 17 bp, Homo sapiens
ctctgtccttcccccag

SEQ ID NO: 4864888 - DNA, 13 bp, Homo sapiens
ctctgtgcttcga

SEQ ID NO: 4864889 - DNA, 20 bp, Homo sapiens
ctctgtgcttcgactactgc

SEQ ID NO: 4864890 - DNA, 21 bp, Homo sapiens
ctctgtgtaaccagctcagtg

SEQ ID NO: 4864891 - DNA, 23 bp, Homo sapiens
ctcttaagtcctaaaagttctca

SEQ ID NO: 4864892 - DNA, 23 bp, Homo sapiens
ctcttatttatagaatttaatat

SEQ ID NO: 4864893 - DNA, 14 bp, Homo sapiens
ctcttcccactcca

SEQ ID NO: 4864894 - DNA, 15 bp, Homo sapiens
ctcttcccactccag

SEQ ID NO: 4864895 - DNA, 18 bp, Homo sapiens
ctcttcccactccagctg

SEQ ID NO: 4864896 - DNA, 16 bp, Homo sapiens
ctcttcctcctcccaa

SEQ ID NO: 4864897 - DNA, 17 bp, Homo sapiens
ctcttcctcctcccaag

SEQ ID NO: 4864898 - DNA, 18 bp, Homo sapiens
ctcttcggtggccttgag

SEQ ID NO: 4864899 - DNA, 19 bp, Homo sapiens
ctcttcggtggccttgagt

SEQ ID NO: 4864900 - DNA, 17 bp, Homo sapiens
ctcttctctcctcccct

SEQ ID NO: 4864901 - DNA, 12 bp, Homo sapiens
ctcttgcaatgc

SEQ ID NO: 4864902 - DNA, 23 bp, Homo sapiens
ctcttggctttgtcacttttcct

SEQ ID NO: 4864903 - DNA, 17 bp, Homo sapiens
ctcttgggtagggtagt

SEQ ID NO: 4864904 - DNA, 16 bp, Homo sapiens
ctcttgtgttcagaag

SEQ ID NO: 4864905 - DNA, 16 bp, Homo sapiens
ctcttgttcctgaaat

SEQ ID NO: 4864906 - DNA, 22 bp, Homo sapiens
ctctttccaccataccttagag

SEQ ID NO: 4864907 - DNA, 13 bp, Homo sapiens
ctctttcctccac

SEQ ID NO: 4864908 - DNA, 13 bp, Homo sapiens
ctctttttgtttg

SEQ ID NO: 4864909 - DNA, 16 bp, Homo sapiens
ctgaaaagaaggaaag

SEQ ID NO: 4864910 - DNA, 18 bp, Homo sapiens
ctgaaaagaaggaaagat

SEQ ID NO: 4864911 - DNA, 18 bp, Homo sapiens
ctgaaagctggtggcaga

SEQ ID NO: 4864912 - DNA, 17 bp, Homo sapiens
ctgaaaggccagcagct

SEQ ID NO: 4864913 - DNA, 23 bp, Homo sapiens
ctgaaaggccagcagctgatgct

SEQ ID NO: 4864914 - DNA, 17 bp, Homo sapiens
ctgaaattcaccaagaa

SEQ ID NO: 4864915 - DNA, 17 bp, Homo sapiens
ctgaacacatgtgtatg

SEQ ID NO: 4864916 - DNA, 19 bp, Homo sapiens
ctgaacacatgtgtatgat

SEQ ID NO: 4864917 - DNA, 19 bp, Homo sapiens
ctgaacataacttctcatg

SEQ ID NO: 4864918 - DNA, 14 bp, Homo sapiens
ctgaaccctccaaa

SEQ ID NO: 4864919 - DNA, 13 bp, Homo sapiens
ctgaagaattgaa

SEQ ID NO: 4864920 - DNA, 18 bp, Homo sapiens
ctgaagctggagcagcgg

SEQ ID NO: 4864921 - DNA, 16 bp, Homo sapiens
ctgaatccgtacttgg

SEQ ID NO: 4864922 - DNA, 22 bp, Homo sapiens
ctgaatctgctaccaaaacagt

SEQ ID NO: 4864923 - DNA, 16 bp, Homo sapiens
ctgaattaattaattt

SEQ ID NO: 4864924 - DNA, 14 bp, Homo sapiens
ctgaatttgtatat

SEQ ID NO: 4864925 - DNA, 17 bp, Homo sapiens
ctgaatttgtatatgac

SEQ ID NO: 4864926 - DNA, 19 bp, Homo sapiens
ctgacaaccattaaagtca

SEQ ID NO: 4864927 - DNA, 22 bp, Homo sapiens
ctgacaaccattaaagtcagaa

SEQ ID NO: 4864928 - DNA, 22 bp, Homo sapiens
ctgacagccacaccgtggcagc

SEQ ID NO: 4864929 - DNA, 13 bp, Homo sapiens
ctgacaggccttc

SEQ ID NO: 4864930 - DNA, 22 bp, Homo sapiens
ctgacaggccttcctcctctca

SEQ ID NO: 4864931 - DNA, 23 bp, Homo sapiens
ctgacaggccttcctcctctcaa

SEQ ID NO: 4864932 - DNA, 20 bp, Homo sapiens
ctgacatcatcattcttgtg

SEQ ID NO: 4864933 - DNA, 23 bp, Homo sapiens
ctgacatcatcattcttgtggga

SEQ ID NO: 4864934 - DNA, 17 bp, Homo sapiens
ctgaccccattcctgat

SEQ ID NO: 4864935 - DNA, 22 bp, Homo sapiens
ctgacccttacagcctctgact

SEQ ID NO: 4864936 - DNA, 19 bp, Homo sapiens
ctgacctgaccccattcct

SEQ ID NO: 4864937 - DNA, 11 bp, Homo sapiens
ctgactagaac

SEQ ID NO: 4864938 - DNA, 20 bp, Homo sapiens
ctgactagaactcctgtctt

SEQ ID NO: 4864939 - DNA, 12 bp, Homo sapiens
ctgactccaaag

SEQ ID NO: 4864940 - DNA, 14 bp, Homo sapiens
ctgactccaaagct

SEQ ID NO: 4864941 - DNA, 20 bp, Homo sapiens
ctgactccaaagctgttcca

SEQ ID NO: 4864942 - DNA, 23 bp, Homo sapiens
ctgacttatggcatgactcttca

SEQ ID NO: 4864943 - DNA, 20 bp, Homo sapiens
ctgagaaggcaaactgaggc

SEQ ID NO: 4864944 - DNA, 17 bp, Homo sapiens
ctgagaattgaggggag

SEQ ID NO: 4864945 - DNA, 21 bp, Homo sapiens
ctgagaattgaggggaggtgg

SEQ ID NO: 4864946 - DNA, 11 bp, Homo sapiens
ctgagacaggt

SEQ ID NO: 4864947 - DNA, 17 bp, Homo sapiens
ctgagcagaaagaggcc

SEQ ID NO: 4864948 - DNA, 14 bp, Homo sapiens
ctgagcagggatct

SEQ ID NO: 4864949 - DNA, 16 bp, Homo sapiens
ctgagccaaatttctt

SEQ ID NO: 4864950 - DNA, 19 bp, Homo sapiens
ctgagccaaatttcttttg

SEQ ID NO: 4864951 - DNA, 15 bp, Homo sapiens
ctgagccagattggc

SEQ ID NO: 4864952 - DNA, 21 bp, Homo sapiens
ctgagccagattggccaatta

SEQ ID NO: 4864953 - DNA, 22 bp, Homo sapiens
ctgagccagattggccaattaa

SEQ ID NO: 4864954 - DNA, 17 bp, Homo sapiens
ctgagccctcctgaggg

SEQ ID NO: 4864955 - DNA, 22 bp, Homo sapiens
ctgaggactgatttcagagtga

SEQ ID NO: 4864956 - DNA, 16 bp, Homo sapiens
ctgaggaggtgctgca

SEQ ID NO: 4864957 - DNA, 17 bp, Homo sapiens
ctgaggccagaaaggtg

SEQ ID NO: 4864958 - DNA, 22 bp, Homo sapiens
ctgaggccagaaaggtgtgagg

SEQ ID NO: 4864959 - DNA, 15 bp, Homo sapiens
ctgaggcccagagag

SEQ ID NO: 4864960 - DNA, 16 bp, Homo sapiens
ctgaggcccagagagg

SEQ ID NO: 4864961 - DNA, 20 bp, Homo sapiens
ctgaggcccagagagggaag

SEQ ID NO: 4864962 - DNA, 18 bp, Homo sapiens
ctgagtcatggccgggtg

SEQ ID NO: 4864963 - DNA, 15 bp, Homo sapiens
ctgagtgtttggaaa

SEQ ID NO: 4864964 - DNA, 19 bp, Homo sapiens
ctgataacttggggaggca

SEQ ID NO: 4864965 - DNA, 23 bp, Homo sapiens
ctgataccatatgaatgaaacat

SEQ ID NO: 4864966 - DNA, 16 bp, Homo sapiens
ctgatcccatggccag

SEQ ID NO: 4864967 - DNA, 13 bp, Homo sapiens
ctgatgagagaat

SEQ ID NO: 4864968 - DNA, 20 bp, Homo sapiens
ctgatgagtttcactgtact

SEQ ID NO: 4864969 - DNA, 15 bp, Homo sapiens
ctgatgcccctgaca

SEQ ID NO: 4864970 - DNA, 14 bp, Homo sapiens
ctgatgctgtacta

SEQ ID NO: 4864971 - DNA, 14 bp, Homo sapiens
ctgatggacatgag

SEQ ID NO: 4864972 - DNA, 13 bp, Homo sapiens
ctgattaggtaac

SEQ ID NO: 4864973 - DNA, 22 bp, Homo sapiens
ctgattctggctttaagccttc

SEQ ID NO: 4864974 - DNA, 15 bp, Homo sapiens
ctgatttcattcctc

SEQ ID NO: 4864975 - DNA, 17 bp, Homo sapiens
ctgcaaaactccaggca

SEQ ID NO: 4864976 - DNA, 18 bp, Homo sapiens
ctgcaaggtggcctctgc

SEQ ID NO: 4864977 - DNA, 19 bp, Homo sapiens
ctgcaaggtggcctctgcc

SEQ ID NO: 4864978 - DNA, 13 bp, Homo sapiens
ctgcaatcactgt

SEQ ID NO: 4864979 - DNA, 13 bp, Homo sapiens
ctgcacccgcctc

SEQ ID NO: 4864980 - DNA, 14 bp, Homo sapiens
ctgcagagatttct

SEQ ID NO: 4864981 - DNA, 15 bp, Homo sapiens
ctgcataatgtttct

SEQ ID NO: 4864982 - DNA, 14 bp, Homo sapiens
ctgcatagccggtg

SEQ ID NO: 4864983 - DNA, 16 bp, Homo sapiens
ctgcatggggaggcag

SEQ ID NO: 4864984 - DNA, 19 bp, Homo sapiens
ctgcatggggaggcagcag

SEQ ID NO: 4864985 - DNA, 20 bp, Homo sapiens
ctgcatggggaggcagcaga

SEQ ID NO: 4864986 - DNA, 12 bp, Homo sapiens
ctgcatgtgact

SEQ ID NO: 4864987 - DNA, 14 bp, Homo sapiens
ctgccaaaggatgt

SEQ ID NO: 4864988 - DNA, 17 bp, Homo sapiens
ctgccaaggagcatcct

SEQ ID NO: 4864989 - DNA, 21 bp, Homo sapiens
ctgccaatctgtacaaaatgg

SEQ ID NO: 4864990 - DNA, 16 bp, Homo sapiens
ctgccaggggctctgt

SEQ ID NO: 4864991 - DNA, 23 bp, Homo sapiens
ctgccaggggctctgtggcaaaa

SEQ ID NO: 4864992 - DNA, 20 bp, Homo sapiens
ctgccctctgctctgcctgg

SEQ ID NO: 4864993 - DNA, 15 bp, Homo sapiens
ctgcccttcctcctg

SEQ ID NO: 4864994 - DNA, 19 bp, Homo sapiens
ctgcccttcctcctgatgg

SEQ ID NO: 4864995 - DNA, 21 bp, Homo sapiens
ctgccgtagcttcagccaggc

SEQ ID NO: 4864996 - DNA, 14 bp, Homo sapiens
ctgcctcaggaccc

SEQ ID NO: 4864997 - DNA, 23 bp, Homo sapiens
ctgcctcccaaggtcctctcagt

SEQ ID NO: 4864998 - DNA, 12 bp, Homo sapiens
ctgcctggactt

SEQ ID NO: 4864999 - DNA, 21 bp, Homo sapiens
ctgcctggaggctcctctagg

SEQ ID NO: 4865000 - DNA, 22 bp, Homo sapiens
ctgcctggggcctccagaagct

SEQ ID NO: 4865001 - DNA, 18 bp, Homo sapiens
ctgccttcgtttatattt

SEQ ID NO: 4865002 - DNA, 23 bp, Homo sapiens
ctgcctttgcagttggactctca

SEQ ID NO: 4865003 - DNA, 14 bp, Homo sapiens
ctgcggctgtctcc

SEQ ID NO: 4865004 - DNA, 15 bp, Homo sapiens
ctgcgtcccttctct

SEQ ID NO: 4865005 - DNA, 16 bp, Homo sapiens
ctgctaaggctcctcc

SEQ ID NO: 4865006 - DNA, 21 bp, Homo sapiens
ctgctaagtcattggcaaagt

SEQ ID NO: 4865007 - DNA, 16 bp, Homo sapiens
ctgctaggcgctgggg

SEQ ID NO: 4865008 - DNA, 19 bp, Homo sapiens
ctgctccaatgactgagca

SEQ ID NO: 4865009 - DNA, 20 bp, Homo sapiens
ctgctccaatgactgagcag

SEQ ID NO: 4865010 - DNA, 15 bp, Homo sapiens
ctgctcccattcctc

SEQ ID NO: 4865011 - DNA, 19 bp, Homo sapiens
ctgctcccctaaagccagg

SEQ ID NO: 4865012 - DNA, 22 bp, Homo sapiens
ctgctcctcttgttcctgaaat

SEQ ID NO: 4865013 - DNA, 23 bp, Homo sapiens
ctgctcctcttgttcctgaaatg

SEQ ID NO: 4865014 - DNA, 19 bp, Homo sapiens
ctgctcctgtggcaggagg

SEQ ID NO: 4865015 - DNA, 18 bp, Homo sapiens
ctgctctatactgtggcc

SEQ ID NO: 4865016 - DNA, 13 bp, Homo sapiens
ctgctctgcctgg

SEQ ID NO: 4865017 - DNA, 15 bp, Homo sapiens
ctgctgagaaggcaa

SEQ ID NO: 4865018 - DNA, 14 bp, Homo sapiens
ctgctgccgccgcc

SEQ ID NO: 4865019 - DNA, 14 bp, Homo sapiens
ctgctgctactgct

SEQ ID NO: 4865020 - DNA, 13 bp, Homo sapiens
ctgctgctcctct

SEQ ID NO: 4865021 - DNA, 18 bp, Homo sapiens
ctgctgctcctctcttgg

SEQ ID NO: 4865022 - DNA, 18 bp, Homo sapiens
ctgctgggccccatctcc

SEQ ID NO: 4865023 - DNA, 15 bp, Homo sapiens
ctgctgtggagtgag

SEQ ID NO: 4865024 - DNA, 16 bp, Homo sapiens
ctgctgtggagtgagg

SEQ ID NO: 4865025 - DNA, 12 bp, Homo sapiens
ctgctgttgaac

SEQ ID NO: 4865026 - DNA, 15 bp, Homo sapiens
ctgctgttgaacttt

SEQ ID NO: 4865027 - DNA, 17 bp, Homo sapiens
ctgctgttgaacttttt

SEQ ID NO: 4865028 - DNA, 22 bp, Homo sapiens
ctgcttaatcttcaaagccttc

SEQ ID NO: 4865029 - DNA, 16 bp, Homo sapiens
ctgcttaattgctgat

SEQ ID NO: 4865030 - DNA, 17 bp, Homo sapiens
ctgcttcactgccccct

SEQ ID NO: 4865031 - DNA, 15 bp, Homo sapiens
ctgcttcccttactt

SEQ ID NO: 4865032 - DNA, 23 bp, Homo sapiens
ctgcttgacctagctctttgggc

SEQ ID NO: 4865033 - DNA, 16 bp, Homo sapiens
ctgcttgactttccag

SEQ ID NO: 4865034 - DNA, 17 bp, Homo sapiens
ctgctttcctgcagcag

SEQ ID NO: 4865035 - DNA, 20 bp, Homo sapiens
ctgcttttgggggtcagcat

SEQ ID NO: 4865036 - DNA, 22 bp, Homo sapiens
ctgctttttccaactcagaaat

SEQ ID NO: 4865037 - DNA, 14 bp, Homo sapiens
ctgctttttggaaa

SEQ ID NO: 4865038 - DNA, 20 bp, Homo sapiens
ctggaaagcacaagactggc

SEQ ID NO: 4865039 - DNA, 18 bp, Homo sapiens
ctggaagagggaggggcc

SEQ ID NO: 4865040 - DNA, 12 bp, Homo sapiens
ctggaaggacct

SEQ ID NO: 4865041 - DNA, 21 bp, Homo sapiens
ctggaaggacctgctcccaca

SEQ ID NO: 4865042 - DNA, 19 bp, Homo sapiens
ctggaatttggacaagtgc

SEQ ID NO: 4865043 - DNA, 22 bp, Homo sapiens
ctggacccttgattcattctga

SEQ ID NO: 4865044 - DNA, 13 bp, Homo sapiens
ctggactgcatgg

SEQ ID NO: 4865045 - DNA, 20 bp, Homo sapiens
ctggactgcatggggaggca

SEQ ID NO: 4865046 - DNA, 21 bp, Homo sapiens
ctggactggaaagcacaagac

SEQ ID NO: 4865047 - DNA, 20 bp, Homo sapiens
ctggagaagtagtatttgcc

SEQ ID NO: 4865048 - DNA, 13 bp, Homo sapiens
ctggagatatgaa

SEQ ID NO: 4865049 - DNA, 13 bp, Homo sapiens
ctggagcagccaa

SEQ ID NO: 4865050 - DNA, 23 bp, Homo sapiens
ctggagcagccaaggccgccagc

SEQ ID NO: 4865051 - DNA, 24 bp, Homo sapiens
ctggagcaggcccaatgctgcttt

SEQ ID NO: 4865052 - DNA, 14 bp, Homo sapiens
ctggagcttcagcc

SEQ ID NO: 4865053 - DNA, 22 bp, Homo sapiens
ctggagcttcagccaggtctga

SEQ ID NO: 4865054 - DNA, 21 bp, Homo sapiens
ctggaggctcctctaggccct

SEQ ID NO: 4865055 - DNA, 22 bp, Homo sapiens
ctggaggctcctctaggccctg

SEQ ID NO: 4865056 - DNA, 20 bp, Homo sapiens
ctggagtgtcggatcctgtg

SEQ ID NO: 4865057 - DNA, 21 bp, Homo sapiens
ctggagtgtcggatcctgtga

SEQ ID NO: 4865058 - DNA, 23 bp, Homo sapiens
ctggatcccgttcagaaaaccac

SEQ ID NO: 4865059 - DNA, 12 bp, Homo sapiens
ctggcacaaaag

SEQ ID NO: 4865060 - DNA, 19 bp, Homo sapiens
ctggcacaaaagacagctg

SEQ ID NO: 4865061 - DNA, 17 bp, Homo sapiens
ctggcagatgagggctg

SEQ ID NO: 4865062 - DNA, 16 bp, Homo sapiens
ctggcagatgggggcc

SEQ ID NO: 4865063 - DNA, 21 bp, Homo sapiens
ctggcatctaattctgattct

SEQ ID NO: 4865064 - DNA, 17 bp, Homo sapiens
ctggcccagtgccagca

SEQ ID NO: 4865065 - DNA, 20 bp, Homo sapiens
ctggcccagtgccagcaagt

SEQ ID NO: 4865066 - DNA, 20 bp, Homo sapiens
ctggcctagaaagggcaagg

SEQ ID NO: 4865067 - DNA, 16 bp, Homo sapiens
ctggccttgcctccag

SEQ ID NO: 4865068 - DNA, 17 bp, Homo sapiens
ctggccttgcctccagg

SEQ ID NO: 4865069 - DNA, 19 bp, Homo sapiens
ctggctcaaagcagcagga

SEQ ID NO: 4865070 - DNA, 12 bp, Homo sapiens
ctggcttattta

SEQ ID NO: 4865071 - DNA, 23 bp, Homo sapiens
ctggcttcaaaaagccacagcag

SEQ ID NO: 4865072 - DNA, 21 bp, Homo sapiens
cttcaggagcctggccaggca

SEQ ID NO: 4865073 - DNA, 18 bp, Homo sapiens
cttcaggttggtttaatc

SEQ ID NO: 4865074 - DNA, 15 bp, Homo sapiens
cttcagttgcttgtc

SEQ ID NO: 4865075 - DNA, 20 bp, Homo sapiens
cttcatcagaactcttcctc

SEQ ID NO: 4865076 - DNA, 16 bp, Homo sapiens
cttcatgcctgatgaa

SEQ ID NO: 4865077 - DNA, 14 bp, Homo sapiens
cttccaaataaata

SEQ ID NO: 4865078 - DNA, 15 bp, Homo sapiens
cttccaaataaataa

SEQ ID NO: 4865079 - DNA, 15 bp, Homo sapiens
cttccacccacaaac

SEQ ID NO: 4865080 - DNA, 16 bp, Homo sapiens
cttccacccacaaact

SEQ ID NO: 4865081 - DNA, 20 bp, Homo sapiens
cttccacccacaaactccag

SEQ ID NO: 4865082 - DNA, 21 bp, Homo sapiens
cttccacccacaaactccagg

SEQ ID NO: 4865083 - DNA, 17 bp, Homo sapiens
cttccagagaacctgtg

SEQ ID NO: 4865084 - DNA, 22 bp, Homo sapiens
cttcccacaactactagtgtga

SEQ ID NO: 4865085 - DNA, 24 bp, Homo sapiens
cttcccacaactactagtgtgact

SEQ ID NO: 4865086 - DNA, 13 bp, Homo sapiens
cttcccactccag

SEQ ID NO: 4865087 - DNA, 15 bp, Homo sapiens
cttcccactccagct

SEQ ID NO: 4865088 - DNA, 17 bp, Homo sapiens
cttcccactccagctga

SEQ ID NO: 4865089 - DNA, 14 bp, Homo sapiens
cttcccagcttccc

SEQ ID NO: 4865090 - DNA, 20 bp, Homo sapiens
cttcccatctgaagagtgga

SEQ ID NO: 4865091 - DNA, 22 bp, Homo sapiens
cttcccccagcacaaagcactg

SEQ ID NO: 4865092 - DNA, 22 bp, Homo sapiens
cttccctgggtttgggagccag

SEQ ID NO: 4865093 - DNA, 20 bp, Homo sapiens
cttccctttacagctctcct

SEQ ID NO: 4865094 - DNA, 16 bp, Homo sapiens
cttccctttctaagca

SEQ ID NO: 4865095 - DNA, 13 bp, Homo sapiens
cttcctcctctca

SEQ ID NO: 4865096 - DNA, 15 bp, Homo sapiens
cttcctctctcctta

SEQ ID NO: 4865097 - DNA, 12 bp, Homo sapiens
cttcctggcaca

SEQ ID NO: 4865098 - DNA, 20 bp, Homo sapiens
cttcctgtggatgcaaatag

SEQ ID NO: 4865099 - DNA, 12 bp, Homo sapiens
cttccttctcat

SEQ ID NO: 4865100 - DNA, 18 bp, Homo sapiens
cttcggagggcccctgcg

SEQ ID NO: 4865101 - DNA, 22 bp, Homo sapiens
cttcggagggcccctgcgtggg

SEQ ID NO: 4865102 - DNA, 13 bp, Homo sapiens
cttcggtggcctt

SEQ ID NO: 4865103 - DNA, 16 bp, Homo sapiens
cttctaaattcccaaa

SEQ ID NO: 4865104 - DNA, 22 bp, Homo sapiens
cttctaaattcccaaatcctag

SEQ ID NO: 4865105 - DNA, 21 bp, Homo sapiens
cttctaggatagcgctcccct

SEQ ID NO: 4865106 - DNA, 16 bp, Homo sapiens
cttctccctagctcct

SEQ ID NO: 4865107 - DNA, 18 bp, Homo sapiens
cttctccctattccctct

SEQ ID NO: 4865108 - DNA, 21 bp, Homo sapiens
cttctctgttcccttgcaggg

SEQ ID NO: 4865109 - DNA, 21 bp, Homo sapiens
cttctgaagagaccactcaat

SEQ ID NO: 4865110 - DNA, 19 bp, Homo sapiens
cttctgggtccagggaggg

SEQ ID NO: 4865111 - DNA, 15 bp, Homo sapiens
cttctgtaattgtgt

SEQ ID NO: 4865112 - DNA, 19 bp, Homo sapiens
cttctttctccatggagcc

SEQ ID NO: 4865113 - DNA, 17 bp, Homo sapiens
cttctttggacttctga

SEQ ID NO: 4865114 - DNA, 18 bp, Homo sapiens
cttgaaaaaaaacagtgg

SEQ ID NO: 4865115 - DNA, 13 bp, Homo sapiens
cttgaaacctgat

SEQ ID NO: 4865116 - DNA, 23 bp, Homo sapiens
cttgaaactttgggaaaacatgt

SEQ ID NO: 4865117 - DNA, 23 bp, Homo sapiens
cttgaaatacgtttgtgtttcta

SEQ ID NO: 4865118 - DNA, 15 bp, Homo sapiens
cttgactttccagaa

SEQ ID NO: 4865119 - DNA, 13 bp, Homo sapiens
cttgagattctga

SEQ ID NO: 4865120 - DNA, 23 bp, Homo sapiens
cttgagattctgaagtatgaagt

SEQ ID NO: 4865121 - DNA, 12 bp, Homo sapiens
cttgagggcctg

SEQ ID NO: 4865122 - DNA, 22 bp, Homo sapiens
cttgaggggctaccctgggaag

SEQ ID NO: 4865123 - DNA, 13 bp, Homo sapiens
cttgattaaatca

SEQ ID NO: 4865124 - DNA, 15 bp, Homo sapiens
cttgattaaatcaac

SEQ ID NO: 4865125 - DNA, 19 bp, Homo sapiens
cttgatttcaaagttttgt

SEQ ID NO: 4865126 - DNA, 23 bp, Homo sapiens
cttgatttcaaagttttgttgta

SEQ ID NO: 4865127 - DNA, 16 bp, Homo sapiens
cttgcagggtcttgct

SEQ ID NO: 4865128 - DNA, 15 bp, Homo sapiens
cttgcatggagaatg

SEQ ID NO: 4865129 - DNA, 16 bp, Homo sapiens
cttgcatggagaatgg

SEQ ID NO: 4865130 - DNA, 22 bp, Homo sapiens
cttgctggtgcctgccaccttc

SEQ ID NO: 4865131 - DNA, 18 bp, Homo sapiens
cttgcttctgtatttcct

SEQ ID NO: 4865132 - DNA, 15 bp, Homo sapiens
cttggaagctgtttg

SEQ ID NO: 4865133 - DNA, 20 bp, Homo sapiens
cttggaagctgtttggaaaa

SEQ ID NO: 4865134 - DNA, 18 bp, Homo sapiens
cttggacattttatgtct

SEQ ID NO: 4865135 - DNA, 18 bp, Homo sapiens
cttggagaatactgccaa

SEQ ID NO: 4865136 - DNA, 18 bp, Homo sapiens
cttggcacttattgaata

SEQ ID NO: 4865137 - DNA, 18 bp, Homo sapiens
cttggcccccttcaggag

SEQ ID NO: 4865138 - DNA, 19 bp, Homo sapiens
cttggcccccttcaggagc

SEQ ID NO: 4865139 - DNA, 20 bp, Homo sapiens
cttggcccccttcaggagcc

SEQ ID NO: 4865140 - DNA, 21 bp, Homo sapiens
cttggcccccttcaggagcct

SEQ ID NO: 4865141 - DNA, 22 bp, Homo sapiens
cttggcccccttcaggagcctg

SEQ ID NO: 4865142 - DNA, 17 bp, Homo sapiens
gaaactttgggaaaaca

SEQ ID NO: 4865143 - DNA, 21 bp, Homo sapiens
gaaactttgggaaaacatgtt

SEQ ID NO: 4865144 - DNA, 13 bp, Homo sapiens
gaaagacaaactg

SEQ ID NO: 4865145 - DNA, 15 bp, Homo sapiens
gaaagagaggactgg

SEQ ID NO: 4865146 - DNA, 20 bp, Homo sapiens
gaaagaggtaaaattctcta

SEQ ID NO: 4865147 - DNA, 15 bp, Homo sapiens
gaaagatacttacat

SEQ ID NO: 4865148 - DNA, 23 bp, Homo sapiens
gaaagatgcatcatctcttcctc

SEQ ID NO: 4865149 - DNA, 18 bp, Homo sapiens
gaaagcaaaggtgcactc

SEQ ID NO: 4865150 - DNA, 19 bp, Homo sapiens
gaaagcacaagactggccc

SEQ ID NO: 4865151 - DNA, 18 bp, Homo sapiens
gaaagcataaagctcaaa

SEQ ID NO: 4865152 - DNA, 14 bp, Homo sapiens
gaaagctaaagttt

SEQ ID NO: 4865153 - DNA, 15 bp, Homo sapiens
gaaagctgtgtttat

SEQ ID NO: 4865154 - DNA, 20 bp, Homo sapiens
gaaagctgtgtttatatgga

SEQ ID NO: 4865155 - DNA, 12 bp, Homo sapiens
gaaaggaaaaga

SEQ ID NO: 4865156 - DNA, 19 bp, Homo sapiens
gaaaggcagggccctgaaa

SEQ ID NO: 4865157 - DNA, 14 bp, Homo sapiens
gaaaggccagcagc

SEQ ID NO: 4865158 - DNA, 16 bp, Homo sapiens
gaaaggtgtgaggaga

SEQ ID NO: 4865159 - DNA, 20 bp, Homo sapiens
gaaaggtgtgaggagagagg

SEQ ID NO: 4865160 - DNA, 22 bp, Homo sapiens
gaaagtgggcttaatggagttc

SEQ ID NO: 4865161 - DNA, 19 bp, Homo sapiens
gaaagtttttttttattat

SEQ ID NO: 4865162 - DNA, 19 bp, Homo sapiens
gaaataatgctacaatttt

SEQ ID NO: 4865163 - DNA, 21 bp, Homo sapiens
gaaataatgggattagaaaca

SEQ ID NO: 4865164 - DNA, 14 bp, Homo sapiens
gaaatacgtttgtg

SEQ ID NO: 4865165 - DNA, 16 bp, Homo sapiens
gaaatacgtttgtgtt

SEQ ID NO: 4865166 - DNA, 20 bp, Homo sapiens
gaaatacgtttgtgtttcta

SEQ ID NO: 4865167 - DNA, 18 bp, Homo sapiens
gaaatcagtaatatttat

SEQ ID NO: 4865168 - DNA, 20 bp, Homo sapiens
gaaatccatatatatgaaat

SEQ ID NO: 4865169 - DNA, 12 bp, Homo sapiens
gaaatgaacttt

SEQ ID NO: 4865170 - DNA, 21 bp, Homo sapiens
gaaatgaactttgtcagtgtt

SEQ ID NO: 4865171 - DNA, 20 bp, Homo sapiens
gaaatggggaactcccccag

SEQ ID NO: 4865172 - DNA, 22 bp, Homo sapiens
gaaatgtgtttccttttcagga

SEQ ID NO: 4865173 - DNA, 13 bp, Homo sapiens
gaaattcttccta

SEQ ID NO: 4865174 - DNA, 23 bp, Homo sapiens
gaaatttgggagagccatacata

SEQ ID NO: 4865175 - DNA, 13 bp, Homo sapiens
gaacaagcttcag

SEQ ID NO: 4865176 - DNA, 16 bp, Homo sapiens
gaacacatgtgtatga

SEQ ID NO: 4865177 - DNA, 18 bp, Homo sapiens
gaacactgtgaccaggct

SEQ ID NO: 4865178 - DNA, 16 bp, Homo sapiens
gaacactttgctagga

SEQ ID NO: 4865179 - DNA, 19 bp, Homo sapiens
gaacactttgctaggagat

SEQ ID NO: 4865180 - DNA, 14 bp, Homo sapiens
gaacagccttagag

SEQ ID NO: 4865181 - DNA, 15 bp, Homo sapiens
gaacatatgttgcaa

SEQ ID NO: 4865182 - DNA, 21 bp, Homo sapiens
gaacctacagttttaactgtg

SEQ ID NO: 4865183 - DNA, 20 bp, Homo sapiens
gaacctctaagtgctgctgt

SEQ ID NO: 4865184 - DNA, 14 bp, Homo sapiens
gaaccttctttggt

SEQ ID NO: 4865185 - DNA, 17 bp, Homo sapiens
gaaccttgatggggtga

SEQ ID NO: 4865186 - DNA, 16 bp, Homo sapiens
gaacgtggctctgctg

SEQ ID NO: 4865187 - DNA, 17 bp, Homo sapiens
gaacgtggctctgctgg

SEQ ID NO: 4865188 - DNA, 20 bp, Homo sapiens
gaactattgtgctcagagac

SEQ ID NO: 4865189 - DNA, 14 bp, Homo sapiens
gaactccaggcatg

SEQ ID NO: 4865190 - DNA, 16 bp, Homo sapiens
gaactcccccagaggt

SEQ ID NO: 4865191 - DNA, 20 bp, Homo sapiens
gaactcctgtcttctttctc

SEQ ID NO: 4865192 - DNA, 22 bp, Homo sapiens
gaactctagagggcgagggatg

SEQ ID NO: 4865193 - DNA, 19 bp, Homo sapiens
gaacttcagcattgtaatt

SEQ ID NO: 4865194 - DNA, 16 bp, Homo sapiens
gaactttgtcagtgtt

SEQ ID NO: 4865195 - DNA, 15 bp, Homo sapiens
gaagaaagctgattt

SEQ ID NO: 4865196 - DNA, 12 bp, Homo sapiens
gaagaaggcaag

SEQ ID NO: 4865197 - DNA, 14 bp, Homo sapiens
gaagaaggcaaggc

SEQ ID NO: 4865198 - DNA, 14 bp, Homo sapiens
gaagaatcttcctg

SEQ ID NO: 4865199 - DNA, 15 bp, Homo sapiens
gaagaatcttcctgg

SEQ ID NO: 4865200 - DNA, 19 bp, Homo sapiens
gaagaatgttagagtaatg

SEQ ID NO: 4865201 - DNA, 21 bp, Homo sapiens
gaagaattgaaaagtttttgt

SEQ ID NO: 4865202 - DNA, 13 bp, Homo sapiens
gaagacaagcatt

SEQ ID NO: 4865203 - DNA, 11 bp, Homo sapiens
gaagagaccac

SEQ ID NO: 4865204 - DNA, 22 bp, Homo sapiens
gaagagagttctggatgtctgg

SEQ ID NO: 4865205 - DNA, 17 bp, Homo sapiens
gaagagggaggggccct

SEQ ID NO: 4865206 - DNA, 18 bp, Homo sapiens
gaagagggaggggccctg

SEQ ID NO: 4865207 - DNA, 12 bp, Homo sapiens
gaagatgacctg

SEQ ID NO: 4865208 - DNA, 12 bp, Homo sapiens
gaagatgagcct

SEQ ID NO: 4865209 - DNA, 19 bp, Homo sapiens
gaagcaataataaagtact

SEQ ID NO: 4865210 - DNA, 22 bp, Homo sapiens
gaagcagaaatatagtgcaata

SEQ ID NO: 4865211 - DNA, 17 bp, Homo sapiens
gaagcagggtttctttt

SEQ ID NO: 4865212 - DNA, 13 bp, Homo sapiens
gaagccagtgtct

SEQ ID NO: 4865213 - DNA, 21 bp, Homo sapiens
gaagccatagatgctggctgg

SEQ ID NO: 4865214 - DNA, 18 bp, Homo sapiens
gaagcccaccactggcca

SEQ ID NO: 4865215 - DNA, 20 bp, Homo sapiens
gaagcctccaagcctgcctc

SEQ ID NO: 4865216 - DNA, 13 bp, Homo sapiens
gaaggagaatggc

SEQ ID NO: 4865217 - DNA, 18 bp, Homo sapiens
gaaggcaaactgaggcag

SEQ ID NO: 4865218 - DNA, 21 bp, Homo sapiens
gaaggccagagagggaaaagg

SEQ ID NO: 4865219 - DNA, 16 bp, Homo sapiens
gaagggagcattgcag

SEQ ID NO: 4865220 - DNA, 15 bp, Homo sapiens
gaaggggcctgggct

SEQ ID NO: 4865221 - DNA, 17 bp, Homo sapiens
gaaggggcctgggctgt

SEQ ID NO: 4865222 - DNA, 20 bp, Homo sapiens
gaaggggcctgggctgtgag

SEQ ID NO: 4865223 - DNA, 22 bp, Homo sapiens
gaaggggcctgggctgtgagga

SEQ ID NO: 4865224 - DNA, 13 bp, Homo sapiens
gaaggggctggtg

SEQ ID NO: 4865225 - DNA, 14 bp, Homo sapiens
gaaggggctggtgg

SEQ ID NO: 4865226 - DNA, 20 bp, Homo sapiens
gaagtacaggtcatctgctg

SEQ ID NO: 4865227 - DNA, 22 bp, Homo sapiens
gaagtacttggcccccttcagg

SEQ ID NO: 4865228 - DNA, 21 bp, Homo sapiens
gaagtatgtatattaaaaaag

SEQ ID NO: 4865229 - DNA, 14 bp, Homo sapiens
gaagtcagaatttt

SEQ ID NO: 4865230 - DNA, 16 bp, Homo sapiens
gaagtttgctgtgctt

SEQ ID NO: 4865231 - DNA, 19 bp, Homo sapiens
gaataccacatcaaataag

SEQ ID NO: 4865232 - DNA, 22 bp, Homo sapiens
gaataccacatcaaataagaaa

SEQ ID NO: 4865233 - DNA, 13 bp, Homo sapiens
gaatacctgctca

SEQ ID NO: 4865234 - DNA, 22 bp, Homo sapiens
gaatactgccaaaacatttatg

SEQ ID NO: 4865235 - DNA, 17 bp, Homo sapiens
gaatcagacagcaggaa

SEQ ID NO: 4865236 - DNA, 17 bp, Homo sapiens
gaatcccagaggtggga

SEQ ID NO: 4865237 - DNA, 17 bp, Homo sapiens
gaatctagcccaaccta

SEQ ID NO: 4865238 - DNA, 15 bp, Homo sapiens
gaatctcaaaattag

SEQ ID NO: 4865239 - DNA, 13 bp, Homo sapiens
gaatgaaaataac

SEQ ID NO: 4865240 - DNA, 17 bp, Homo sapiens
gaatgaagcagtatttt

SEQ ID NO: 4865241 - DNA, 20 bp, Homo sapiens
gaatgcccctgttcatgttt

SEQ ID NO: 4865242 - DNA, 15 bp, Homo sapiens
gaatggcatggcagg

SEQ ID NO: 4865243 - DNA, 18 bp, Homo sapiens
gaatggcatggcaggagt

SEQ ID NO: 4865244 - DNA, 16 bp, Homo sapiens
gaatggccacaaacct

SEQ ID NO: 4865245 - DNA, 17 bp, Homo sapiens
gaatggcctggagcagg

SEQ ID NO: 4865246 - DNA, 20 bp, Homo sapiens
gaatggcctggagcaggccc

SEQ ID NO: 4865247 - DNA, 16 bp, Homo sapiens
gaatgggatattttga

SEQ ID NO: 4865248 - DNA, 20 bp, Homo sapiens
gaatgggatattttgaaatg

SEQ ID NO: 4865249 - DNA, 23 bp, Homo sapiens
gaatgttagagtaatgaaatgga

SEQ ID NO: 4865250 - DNA, 14 bp, Homo sapiens
gaatgttctttctg

SEQ ID NO: 4865251 - DNA, 19 bp, Homo sapiens
gaatgttctttctgctcta

SEQ ID NO: 4865252 - DNA, 17 bp, Homo sapiens
gaatgttttcaaatgtt

SEQ ID NO: 4865253 - DNA, 13 bp, Homo sapiens
gaattataactgt

SEQ ID NO: 4865254 - DNA, 16 bp, Homo sapiens
gaattatcagcaaaga

SEQ ID NO: 4865255 - DNA, 17 bp, Homo sapiens
gaattgaaaagtttttg

SEQ ID NO: 4865256 - DNA, 19 bp, Homo sapiens
gaatttgaggtctagagag

SEQ ID NO: 4865257 - DNA, 15 bp, Homo sapiens
gaatttgccagagga

SEQ ID NO: 4865258 - DNA, 13 bp, Homo sapiens
gaattttaaagta

SEQ ID NO: 4865259 - DNA, 16 bp, Homo sapiens
gaattttctaaaagct

SEQ ID NO: 4865260 - DNA, 11 bp, Homo sapiens
gacaaatattc

SEQ ID NO: 4865261 - DNA, 22 bp, Homo sapiens
gacaaatattcctttgcatatt

SEQ ID NO: 4865262 - DNA, 23 bp, Homo sapiens
gagaccataagagaaacctgcca

SEQ ID NO: 4865263 - DNA, 19 bp, Homo sapiens
gagacttgcagttagactc

SEQ ID NO: 4865264 - DNA, 21 bp, Homo sapiens
gagactttgatactaccaggg

SEQ ID NO: 4865265 - DNA, 15 bp, Homo sapiens
gagagaatgtggaaa

SEQ ID NO: 4865266 - DNA, 14 bp, Homo sapiens
gagagatcaaagat

SEQ ID NO: 4865267 - DNA, 12 bp, Homo sapiens
gagagcataatt

SEQ ID NO: 4865268 - DNA, 16 bp, Homo sapiens
gagagccatacataaa

SEQ ID NO: 4865269 - DNA, 14 bp, Homo sapiens
gagagcccattccc

SEQ ID NO: 4865270 - DNA, 19 bp, Homo sapiens
gagaggactggttctgagg

SEQ ID NO: 4865271 - DNA, 21 bp, Homo sapiens
gagagggaaaaggcaggtgct

SEQ ID NO: 4865272 - DNA, 17 bp, Homo sapiens
gagagtagctgcagcct

SEQ ID NO: 4865273 - DNA, 14 bp, Homo sapiens
gagagttccgggga

SEQ ID NO: 4865274 - DNA, 11 bp, Homo sapiens
gagatactgtg

SEQ ID NO: 4865275 - DNA, 12 bp, Homo sapiens
gagatactgtgt

SEQ ID NO: 4865276 - DNA, 13 bp, Homo sapiens
gagatcaaagatg

SEQ ID NO: 4865277 - DNA, 15 bp, Homo sapiens
gagatcgggaagcag

SEQ ID NO: 4865278 - DNA, 16 bp, Homo sapiens
gagatcgggaagcaga

SEQ ID NO: 4865279 - DNA, 19 bp, Homo sapiens
gagatgaggagtaaaattc

SEQ ID NO: 4865280 - DNA, 12 bp, Homo sapiens
gagattgaactt

SEQ ID NO: 4865281 - DNA, 13 bp, Homo sapiens
gagattgaacttt

SEQ ID NO: 4865282 - DNA, 21 bp, Homo sapiens
gagcaagcaccaacctccaga

SEQ ID NO: 4865283 - DNA, 22 bp, Homo sapiens
gagcacaaaattcaaagcatgg

SEQ ID NO: 4865284 - DNA, 20 bp, Homo sapiens
gagcacaaagaagaaagctg

SEQ ID NO: 4865285 - DNA, 22 bp, Homo sapiens
gagcacaaagaagaaagctgat

SEQ ID NO: 4865286 - DNA, 13 bp, Homo sapiens
gagcagcaggcct

SEQ ID NO: 4865287 - DNA, 14 bp, Homo sapiens
gagcagcaggcctc

SEQ ID NO: 4865288 - DNA, 17 bp, Homo sapiens
gagcagccaaggccgcc

SEQ ID NO: 4865289 - DNA, 19 bp, Homo sapiens
gagcagcggattgctctgg

SEQ ID NO: 4865290 - DNA, 21 bp, Homo sapiens
gagcagcggattgctctggag

SEQ ID NO: 4865291 - DNA, 19 bp, Homo sapiens
gagcaggcccaatgctgct

SEQ ID NO: 4865292 - DNA, 23 bp, Homo sapiens
gagcaggcccaatgctgcttttg

SEQ ID NO: 4865293 - DNA, 12 bp, Homo sapiens
gagcataattta

SEQ ID NO: 4865294 - DNA, 11 bp, Homo sapiens
gagcatcctga

SEQ ID NO: 4865295 - DNA, 22 bp, Homo sapiens
gagcatccttggcagtgggaat

SEQ ID NO: 4865296 - DNA, 17 bp, Homo sapiens
gagcatggggccaggaa

SEQ ID NO: 4865297 - DNA, 13 bp, Homo sapiens
gagcattgcagcc

SEQ ID NO: 4865298 - DNA, 16 bp, Homo sapiens
gagcattgcagcctaa

SEQ ID NO: 4865299 - DNA, 17 bp, Homo sapiens
gagcatttaatggcagc

SEQ ID NO: 4865300 - DNA, 18 bp, Homo sapiens
gagccaattagacttgaa

SEQ ID NO: 4865301 - DNA, 15 bp, Homo sapiens
gagccacttctcccc

SEQ ID NO: 4865302 - DNA, 12 bp, Homo sapiens
gagccagcctgc

SEQ ID NO: 4865303 - DNA, 20 bp, Homo sapiens
gagccagcctgcttcccaca

SEQ ID NO: 4865304 - DNA, 12 bp, Homo sapiens
gagccaggactc

SEQ ID NO: 4865305 - DNA, 14 bp, Homo sapiens
gagccaggactccc

SEQ ID NO: 4865306 - DNA, 17 bp, Homo sapiens
gagccaggactcccaga

SEQ ID NO: 4865307 - DNA, 18 bp, Homo sapiens
gagccaggactcccagaa

SEQ ID NO: 4865308 - DNA, 22 bp, Homo sapiens
gagccaggactcccagaacctc

SEQ ID NO: 4865309 - DNA, 22 bp, Homo sapiens
gagcccccctagtggtatgggg

SEQ ID NO: 4865310 - DNA, 16 bp, Homo sapiens
gagcctacctctgtct

SEQ ID NO: 4865311 - DNA, 17 bp, Homo sapiens
gagcctacctctgtctg

SEQ ID NO: 4865312 - DNA, 13 bp, Homo sapiens
gagcctggccagg

SEQ ID NO: 4865313 - DNA, 17 bp, Homo sapiens
gagcctggccaggcagg

SEQ ID NO: 4865314 - DNA, 21 bp, Homo sapiens
gagccttacttcaaagtgcct

SEQ ID NO: 4865315 - DNA, 23 bp, Homo sapiens
gagccttgcagatatctgcatgt

SEQ ID NO: 4865316 - DNA, 17 bp, Homo sapiens
gagcctttttacctggc

SEQ ID NO: 4865317 - DNA, 20 bp, Homo sapiens
gagctaaaaaggcccttaga

SEQ ID NO: 4865318 - DNA, 21 bp, Homo sapiens
gagctcttgtgttcagaagaa

SEQ ID NO: 4865319 - DNA, 21 bp, Homo sapiens
gagctgaaagctggtggcaga

SEQ ID NO: 4865320 - DNA, 22 bp, Homo sapiens
gagcttaatgctacatgtgagt

SEQ ID NO: 4865321 - DNA, 15 bp, Homo sapiens
gagcttcagccaggt

SEQ ID NO: 4865322 - DNA, 17 bp, Homo sapiens
gagcttcagccaggtct

SEQ ID NO: 4865323 - DNA, 17 bp, Homo sapiens
gaggaaaagtcttccta

SEQ ID NO: 4865324 - DNA, 12 bp, Homo sapiens
gaggacagggcc

SEQ ID NO: 4865325 - DNA, 13 bp, Homo sapiens
gaggaccaatgct

SEQ ID NO: 4865326 - DNA, 16 bp, Homo sapiens
gaggaccaatgcttgc

SEQ ID NO: 4865327 - DNA, 17 bp, Homo sapiens
gaggagagaggaggaaa

SEQ ID NO: 4865328 - DNA, 14 bp, Homo sapiens
gaggagtaaaattc

SEQ ID NO: 4865329 - DNA, 21 bp, Homo sapiens
gaggagtaaaattcagttttt

SEQ ID NO: 4865330 - DNA, 13 bp, Homo sapiens
gaggataggacag

SEQ ID NO: 4865331 - DNA, 14 bp, Homo sapiens
gaggatccagggca

SEQ ID NO: 4865332 - DNA, 16 bp, Homo sapiens
gaggatccagggcagc

SEQ ID NO: 4865333 - DNA, 14 bp, Homo sapiens
gaggcaaacagcaa

SEQ ID NO: 4865334 - DNA, 12 bp, Homo sapiens
gaggccagaaag

SEQ ID NO: 4865335 - DNA, 16 bp, Homo sapiens
gaggcccagagaggga

SEQ ID NO: 4865336 - DNA, 13 bp, Homo sapiens
gaggctcagagag

SEQ ID NO: 4865337 - DNA, 14 bp, Homo sapiens
gaggctcagagagg

SEQ ID NO: 4865338 - DNA, 16 bp, Homo sapiens
gaggctcctctaggcc

SEQ ID NO: 4865339 - DNA, 14 bp, Homo sapiens
gagggaaaccagag

SEQ ID NO: 4865340 - DNA, 15 bp, Homo sapiens
gagggaagacctgaa

SEQ ID NO: 4865341 - DNA, 23 bp, Homo sapiens
gagggaagacctgaaagagagga

SEQ ID NO: 4865342 - DNA, 19 bp, Homo sapiens
gagggaagatgacctgccc

SEQ ID NO: 4865343 - DNA, 16 bp, Homo sapiens
gagggactccaagccc

SEQ ID NO: 4865344 - DNA, 21 bp, Homo sapiens
gagggactccaagccctgggg

SEQ ID NO: 4865345 - DNA, 12 bp, Homo sapiens
gagggaggggcc

SEQ ID NO: 4865346 - DNA, 23 bp, Homo sapiens
gagggattttgttcaagtttgct

SEQ ID NO: 4865347 - DNA, 16 bp, Homo sapiens
gagggccacgggtctg

SEQ ID NO: 4865348 - DNA, 23 bp, Homo sapiens
gagggcgaccccgtcacagcctc

SEQ ID NO: 4865349 - DNA, 13 bp, Homo sapiens
gaggggaggcaga

SEQ ID NO: 4865350 - DNA, 13 bp, Homo sapiens
gaggggaggtggc

SEQ ID NO: 4865351 - DNA, 16 bp, Homo sapiens
gaggggatgataaagg

SEQ ID NO: 4865352 - DNA, 18 bp, Homo sapiens
gaggggcgcgggaggggg

SEQ ID NO: 4865353 - DNA, 19 bp, Homo sapiens
gaggggctaccctgggaag

SEQ ID NO: 4865354 - DNA, 22 bp, Homo sapiens
gaggggggccaaggtcctgctc

SEQ ID NO: 4865355 - DNA, 16 bp, Homo sapiens
gaggtctagagagaac

SEQ ID NO: 4865356 - DNA, 23 bp, Homo sapiens
gaggtggccagcccgcagaggtg

SEQ ID NO: 4865357 - DNA, 17 bp, Homo sapiens
gaggtgggatcctccct

SEQ ID NO: 4865358 - DNA, 21 bp, Homo sapiens
gaggtgggtgtttgggaaagg

SEQ ID NO: 4865359 - DNA, 14 bp, Homo sapiens
gaggttgtggggcc

SEQ ID NO: 4865360 - DNA, 21 bp, Homo sapiens
gaggttgtggggcctcaggct

SEQ ID NO: 4865361 - DNA, 11 bp, Homo sapiens
gaggtttgaag

SEQ ID NO: 4865362 - DNA, 13 bp, Homo sapiens
gagtaagcagtgt

SEQ ID NO: 4865363 - DNA, 22 bp, Homo sapiens
gagtagggccctgacaggcctt

SEQ ID NO: 4865364 - DNA, 21 bp, Homo sapiens
gagtattgtttaaaatgtaat

SEQ ID NO: 4865365 - DNA, 11 bp, Homo sapiens
gagtccactcc

SEQ ID NO: 4865366 - DNA, 14 bp, Homo sapiens
gagtgaataaatgt

SEQ ID NO: 4865367 - DNA, 22 bp, Homo sapiens
gagtgctcttcccactccagct

SEQ ID NO: 4865368 - DNA, 23 bp, Homo sapiens
gagtgggaagggagcattgcagc

SEQ ID NO: 4865369 - DNA, 14 bp, Homo sapiens
gagtgtagctgtga

SEQ ID NO: 4865370 - DNA, 15 bp, Homo sapiens
gagtgtagctgtgaa

SEQ ID NO: 4865371 - DNA, 16 bp, Homo sapiens
gagtgtagctgtgaaa

SEQ ID NO: 4865372 - DNA, 13 bp, Homo sapiens
gagtgtagtcccg

SEQ ID NO: 4865373 - DNA, 18 bp, Homo sapiens
gagtgtgcagacagccat

SEQ ID NO: 4865374 - DNA, 20 bp, Homo sapiens
gagttatcatgaattttaaa

SEQ ID NO: 4865375 - DNA, 20 bp, Homo sapiens
gagttatgataacaccagtg

SEQ ID NO: 4865376 - DNA, 23 bp, Homo sapiens
gagttgattgtctagtgaggaag

SEQ ID NO: 4865377 - DNA, 16 bp, Homo sapiens
gagttttcattaaatc

SEQ ID NO: 4865378 - DNA, 15 bp, Homo sapiens
gataacaccagtggg

SEQ ID NO: 4865379 - DNA, 16 bp, Homo sapiens
gataccattctattct

SEQ ID NO: 4865380 - DNA, 19 bp, Homo sapiens
gataccattctattctcca

SEQ ID NO: 4865381 - DNA, 21 bp, Homo sapiens
gataccattctattctccaga

SEQ ID NO: 4865382 - DNA, 20 bp, Homo sapiens
gatactggggggcaggcctc

SEQ ID NO: 4865383 - DNA, 20 bp, Homo sapiens
tgacactgatgagtttcact

SEQ ID NO: 4865384 - DNA, 21 bp, Homo sapiens
tgacactgatgagtttcactg

SEQ ID NO: 4865385 - DNA, 16 bp, Homo sapiens
tgctcctttaccctct

SEQ ID NO: 4865386 - DNA, 15 bp, Homo sapiens
tgctctatactgtgg

SEQ ID NO: 4865387 - DNA, 20 bp, Homo sapiens
tgctctatactgtggcctgc

SEQ ID NO: 4865388 - DNA, 23 bp, Homo sapiens
tcttagctgaggctgagaaagct

SEQ ID NO: 4865389 - DNA, 21 bp, Homo sapiens
tcttataaagtggaagtatgt

SEQ ID NO: 4865390 - DNA, 15 bp, Homo sapiens
tcttatttatagaat

SEQ ID NO: 4865391 - DNA, 19 bp, Homo sapiens
tcttattttctcaatctcc

SEQ ID NO: 4865392 - DNA, 19 bp, Homo sapiens
tgttgctgtacaaaagcaa

SEQ ID NO: 4865393 - DNA, 17 bp, Homo sapiens
tgttggagcagcaggcc

SEQ ID NO: 4865394 - DNA, 16 bp, Homo sapiens
tgttgtaagaattctg

SEQ ID NO: 4865395 - DNA, 16 bp, Homo sapiens
tgttgtacttaaatgg

SEQ ID NO: 4865396 - DNA, 14 bp, Homo sapiens
tgttgtcttagcat

SEQ ID NO: 4865397 - DNA, 15 bp, Homo sapiens
tgttgtgagaatggc

SEQ ID NO: 4865398 - DNA, 15 bp, Homo sapiens
tgttgtttataataa

SEQ ID NO: 4865399 - DNA, 14 bp, Homo sapiens
tgtttaaaatgtaa

SEQ ID NO: 4865400 - DNA, 15 bp, Homo sapiens
tgtttaatggtagtt

SEQ ID NO: 4865401 - DNA, 14 bp, Homo sapiens
tgtttagatgaggc

SEQ ID NO: 4865402 - DNA, 23 bp, Homo sapiens
tgtttagattgtattaactatct

SEQ ID NO: 4865403 - DNA, 17 bp, Homo sapiens
tgtttatatggaagaaa

SEQ ID NO: 4865404 - DNA, 19 bp, Homo sapiens
tgtttatgtaacttcctgt

SEQ ID NO: 4865405 - DNA, 16 bp, Homo sapiens
tgtttattaaatgctt

SEQ ID NO: 4865406 - DNA, 12 bp, Homo sapiens
tgtttattgcaa

SEQ ID NO: 4865407 - DNA, 23 bp, Homo sapiens
tgtttccttttggcctcctgcaa

SEQ ID NO: 4865408 - DNA, 19 bp, Homo sapiens
tgtttctctataaagtatg

SEQ ID NO: 4865409 - DNA, 17 bp, Homo sapiens
tgtttctggatttcata

SEQ ID NO: 4865410 - DNA, 18 bp, Homo sapiens
tgtttctggcttagaaca

SEQ ID NO: 4865411 - DNA, 18 bp, Homo sapiens
tgtttcttttgtttggta

SEQ ID NO: 4865412 - DNA, 13 bp, Homo sapiens
tgtttgccaggac

SEQ ID NO: 4865413 - DNA, 19 bp, Homo sapiens
tgtttgccaggacatgcaa

SEQ ID NO: 4865414 - DNA, 12 bp, Homo sapiens
tgtttggtaaat

SEQ ID NO: 4865415 - DNA, 15 bp, Homo sapiens
tgtttggtaaatgtt

SEQ ID NO: 4865416 - DNA, 18 bp, Homo sapiens
tgtttgtcacaagtggtg

SEQ ID NO: 4865417 - DNA, 16 bp, Homo sapiens
tgttttaataacttat

SEQ ID NO: 4865418 - DNA, 18 bp, Homo sapiens
tgttttgcacagccaaat

SEQ ID NO: 4865419 - DNA, 15 bp, Homo sapiens
ttaaaaaaaaaagtc

SEQ ID NO: 4865420 - DNA, 19 bp, Homo sapiens
ttaaaaaaaaattgtatct

SEQ ID NO: 4865421 - DNA, 12 bp, Homo sapiens
ttaaaaaacaat

SEQ ID NO: 4865422 - DNA, 22 bp, Homo sapiens
ttaaaaaacaattaactgccct

SEQ ID NO: 4865423 - DNA, 13 bp, Homo sapiens
ttaaaaaacttca

SEQ ID NO: 4865424 - DNA, 20 bp, Homo sapiens
ttaaaaaacttcatgtaatt

SEQ ID NO: 4865425 - DNA, 14 bp, Homo sapiens
ttaaaaattgttat

SEQ ID NO: 4865426 - DNA, 18 bp, Homo sapiens
ttaaaacaatccttacta

SEQ ID NO: 4865427 - DNA, 19 bp, Homo sapiens
ttaaaaggtactggtacta

SEQ ID NO: 4865428 - DNA, 13 bp, Homo sapiens
ttaaaatttcata

SEQ ID NO: 4865429 - DNA, 17 bp, Homo sapiens
ttaaacaaagtttcaga

SEQ ID NO: 4865430 - DNA, 14 bp, Homo sapiens
ttaaaccacttaaa

SEQ ID NO: 4865431 - DNA, 19 bp, Homo sapiens
ttaaacgaagagttccctt

SEQ ID NO: 4865432 - DNA, 14 bp, Homo sapiens
ttaaactaaatgtg

SEQ ID NO: 4865433 - DNA, 16 bp, Homo sapiens
ttaaacttccaaagaa

SEQ ID NO: 4865434 - DNA, 17 bp, Homo sapiens
ttaaacttccaaagaaa

SEQ ID NO: 4865435 - DNA, 13 bp, Homo sapiens
ttaaataacatgt

SEQ ID NO: 4865436 - DNA, 19 bp, Homo sapiens
ttaaatccttttacctttt

SEQ ID NO: 4865437 - DNA, 16 bp, Homo sapiens
ttaaatctcattgctt

SEQ ID NO: 4865438 - DNA, 14 bp, Homo sapiens
ttaacaagaacttt

SEQ ID NO: 4865439 - DNA, 17 bp, Homo sapiens
ttaactaaattttaaag

SEQ ID NO: 4865440 - DNA, 12 bp, Homo sapiens
ttaactgtactg

SEQ ID NO: 4865441 - DNA, 19 bp, Homo sapiens
ttaagaactaaaatgttct

SEQ ID NO: 4865442 - DNA, 20 bp, Homo sapiens
ttaagaactaaaatgttcta

SEQ ID NO: 4865443 - DNA, 20 bp, Homo sapiens
ttaagacactgaaaaatcta

SEQ ID NO: 4865444 - DNA, 19 bp, Homo sapiens
ttaaggacccttttaagca

SEQ ID NO: 4865445 - DNA, 17 bp, Homo sapiens
ttaaggggaagaatgaa

SEQ ID NO: 4865446 - DNA, 20 bp, Homo sapiens
ttaaggggaagaatgaaagc

SEQ ID NO: 4865447 - DNA, 13 bp, Homo sapiens
ttaatatattaaa

SEQ ID NO: 4865448 - DNA, 18 bp, Homo sapiens
ttaatatattaaaattcc

SEQ ID NO: 4865449 - DNA, 20 bp, Homo sapiens
ttaatatccctacatgtatt

SEQ ID NO: 4865450 - DNA, 19 bp, Homo sapiens
ttaatccagttataagaag

SEQ ID NO: 4865451 - DNA, 22 bp, Homo sapiens
ttaatgccatctagctagcaat

SEQ ID NO: 4865452 - DNA, 16 bp, Homo sapiens
ttaatgcctgcttttt

SEQ ID NO: 4865453 - DNA, 19 bp, Homo sapiens
ttaatgcctgctttttgga

SEQ ID NO: 4865454 - DNA, 19 bp, Homo sapiens
ttaatggtagttttacagt

SEQ ID NO: 4865455 - DNA, 14 bp, Homo sapiens
ttaatttcctgtga

SEQ ID NO: 4865456 - DNA, 15 bp, Homo sapiens
ttaatttcctgtgag

SEQ ID NO: 4865457 - DNA, 15 bp, Homo sapiens
ttacaggagccagcc

SEQ ID NO: 4865458 - DNA, 17 bp, Homo sapiens
ttaccccaaagagaaag

SEQ ID NO: 4865459 - DNA, 18 bp, Homo sapiens
ttaccccaaagagaaaga

SEQ ID NO: 4865460 - DNA, 18 bp, Homo sapiens
ttacctagctaattattt

SEQ ID NO: 4865461 - DNA, 21 bp, Homo sapiens
ttacctagctaattatttaat

SEQ ID NO: 4865462 - DNA, 11 bp, Homo sapiens
ttacctggaga

SEQ ID NO: 4865463 - DNA, 12 bp, Homo sapiens
ttacctgtggat

SEQ ID NO: 4865464 - DNA, 14 bp, Homo sapiens
ttacctttctctct

SEQ ID NO: 4865465 - DNA, 21 bp, Homo sapiens
ttacgaatgcccctgttcatg

SEQ ID NO: 4865466 - DNA, 18 bp, Homo sapiens
ttactacagccttaatat

SEQ ID NO: 4865467 - DNA, 13 bp, Homo sapiens
ttactgcaatcac

SEQ ID NO: 4865468 - DNA, 14 bp, Homo sapiens
ttacttatgtagaa

SEQ ID NO: 4865469 - DNA, 13 bp, Homo sapiens
ttacttgcaggta

SEQ ID NO: 4865470 - DNA, 13 bp, Homo sapiens
ttactttgctgag

SEQ ID NO: 4865471 - DNA, 13 bp, Homo sapiens
ttagaaaagtgaa

SEQ ID NO: 4865472 - DNA, 21 bp, Homo sapiens
ttagaaacaaacaaaactctt

SEQ ID NO: 4865473 - DNA, 23 bp, Homo sapiens
ttagaaataataaaaagaaagat

SEQ ID NO: 4865474 - DNA, 19 bp, Homo sapiens
ttagaaatattcacatctt

SEQ ID NO: 4865475 - DNA, 16 bp, Homo sapiens
ttagaagcctgacaac

SEQ ID NO: 4865476 - DNA, 19 bp, Homo sapiens
ttagagctaaaaaggccct

SEQ ID NO: 4865477 - DNA, 12 bp, Homo sapiens
ttagagctcttg

SEQ ID NO: 4865478 - DNA, 22 bp, Homo sapiens
ttagagtcaactacacaaagca

SEQ ID NO: 4865479 - DNA, 15 bp, Homo sapiens
ttagcaaggcagagc

SEQ ID NO: 4865480 - DNA, 18 bp, Homo sapiens
ttagcaaggcagagcctt

SEQ ID NO: 4865481 - DNA, 16 bp, Homo sapiens
ttagccctcaccacag

SEQ ID NO: 4865482 - DNA, 20 bp, Homo sapiens
ttaggagaagtcttctattt

SEQ ID NO: 4865483 - DNA, 19 bp, Homo sapiens
ttagtgaattaaatttagt

SEQ ID NO: 4865484 - DNA, 23 bp, Homo sapiens
ttagtgatgtccttaaaatgtgg

SEQ ID NO: 4865485 - DNA, 19 bp, Homo sapiens
ttagtttttggttgggaat

SEQ ID NO: 4865486 - DNA, 17 bp, Homo sapiens
ttataactgtaaagatg

SEQ ID NO: 4865487 - DNA, 18 bp, Homo sapiens
ttataactgtaaagatgt

SEQ ID NO: 4865488 - DNA, 14 bp, Homo sapiens
ttatacatcaatat

SEQ ID NO: 4865489 - DNA, 18 bp, Homo sapiens
ttatacatcaatatgtat

SEQ ID NO: 4865490 - DNA, 15 bp, Homo sapiens
ttatatggaagaaag

SEQ ID NO: 4865491 - DNA, 18 bp, Homo sapiens
ttatatggaagaaagtaa

SEQ ID NO: 4865492 - DNA, 13 bp, Homo sapiens
ttatatttcaata

SEQ ID NO: 4865493 - DNA, 15 bp, Homo sapiens
ttatatttcaataaa

SEQ ID NO: 4865494 - DNA, 16 bp, Homo sapiens
ttatatttcaataaat

SEQ ID NO: 4865495 - DNA, 16 bp, Homo sapiens
ttatattttagaaata

SEQ ID NO: 4865496 - DNA, 22 bp, Homo sapiens
ttatattttagaaataataaaa

SEQ ID NO: 4865497 - DNA, 18 bp, Homo sapiens
ttatatttttttaactgt

SEQ ID NO: 4865498 - DNA, 22 bp, Homo sapiens
ttatatttttttaactgtgata

SEQ ID NO: 4865499 - DNA, 23 bp, Homo sapiens
ttatcaaaatagtctaaggccat

SEQ ID NO: 4865500 - DNA, 14 bp, Homo sapiens
ttatcagcaaagaa

SEQ ID NO: 4865501 - DNA, 18 bp, Homo sapiens
ttatcagtaatgctaaat

SEQ ID NO: 4865502 - DNA, 20 bp, Homo sapiens
ttatcagtaatgctaaatgt

SEQ ID NO: 4865503 - DNA, 23 bp, Homo sapiens
ttatcagtaatgctaaatgtgta

SEQ ID NO: 4865504 - DNA, 18 bp, Homo sapiens
ttatcatgaattttaaag

SEQ ID NO: 4865505 - DNA, 19 bp, Homo sapiens
ttatcatgaattttaaagt

SEQ ID NO: 4865506 - DNA, 17 bp, Homo sapiens
ttatccctcacctgtag

SEQ ID NO: 4865507 - DNA, 20 bp, Homo sapiens
ttatccctcacctgtagcag

SEQ ID NO: 4865508 - DNA, 17 bp, Homo sapiens
ttatctcctttgaagaa

SEQ ID NO: 4865509 - DNA, 21 bp, Homo sapiens
ttatctcctttgaagaaggca

SEQ ID NO: 4865510 - DNA, 14 bp, Homo sapiens
ttatcttattttct

SEQ ID NO: 4865511 - DNA, 16 bp, Homo sapiens
ttatgtaaataactct

SEQ ID NO: 4865512 - DNA, 15 bp, Homo sapiens
ttattaaatgcttca

SEQ ID NO: 4865513 - DNA, 18 bp, Homo sapiens
ttattcattagttttgaa

SEQ ID NO: 4865514 - DNA, 18 bp, Homo sapiens
ttattccccagtgactcc

SEQ ID NO: 4865515 - DNA, 23 bp, Homo sapiens
tgctctatactgtggcctgcagg

SEQ ID NO: 4865516 - DNA, 17 bp, Homo sapiens
tgctctggagcagccaa

SEQ ID NO: 4865517 - DNA, 21 bp, Homo sapiens
tgctctggagcagccaaggcc

SEQ ID NO: 4865518 - DNA, 13 bp, Homo sapiens
tgctcttcccact

SEQ ID NO: 4865519 - DNA, 19 bp, Homo sapiens
tgctcttcccactccagct

SEQ ID NO: 4865520 - DNA, 19 bp, Homo sapiens
tgctgaacataacttctca

SEQ ID NO: 4865521 - DNA, 14 bp, Homo sapiens
tgctgcaaggtggc

SEQ ID NO: 4865522 - DNA, 22 bp, Homo sapiens
tgctgcacacactcacctctaa

SEQ ID NO: 4865523 - DNA, 19 bp, Homo sapiens
tgctgccattacagaggta

SEQ ID NO: 4865524 - DNA, 19 bp, Homo sapiens
tgctgccccactacaggcc

SEQ ID NO: 4865525 - DNA, 12 bp, Homo sapiens
tgctgccgccgc

SEQ ID NO: 4865526 - DNA, 14 bp, Homo sapiens
tgctgccgccgccg

SEQ ID NO: 4865527 - DNA, 17 bp, Homo sapiens
tgctgcctcaggaccca

SEQ ID NO: 4865528 - DNA, 24 bp, Homo sapiens
tgctgcctcaggacccatccctgc

SEQ ID NO: 4865529 - DNA, 17 bp, Homo sapiens
tgctgctaagtcattgg

SEQ ID NO: 4865530 - DNA, 22 bp, Homo sapiens
tgctgctaagtcattggcaaag

SEQ ID NO: 4865531 - DNA, 22 bp, Homo sapiens
tgctgctcccctaaagccaggc

SEQ ID NO: 4865532 - DNA, 16 bp, Homo sapiens
tgctggaattctaaca

SEQ ID NO: 4865533 - DNA, 17 bp, Homo sapiens
tgctggaattctaacaa

SEQ ID NO: 4865534 - DNA, 15 bp, Homo sapiens
tgctgggcagaggga

SEQ ID NO: 4865535 - DNA, 18 bp, Homo sapiens
tgctgggccccatctcca

SEQ ID NO: 4865536 - DNA, 20 bp, Homo sapiens
tgctggtgaacactgtgacc

SEQ ID NO: 4865537 - DNA, 19 bp, Homo sapiens
tgctgtactaacccagtct

SEQ ID NO: 4865538 - DNA, 22 bp, Homo sapiens
tgctgttgaactttttaaagaa

SEQ ID NO: 4865539 - DNA, 13 bp, Homo sapiens
tgcttaaatttta

SEQ ID NO: 4865540 - DNA, 16 bp, Homo sapiens
tgcttaaattttaact

SEQ ID NO: 4865541 - DNA, 15 bp, Homo sapiens
tgcttaatcttcaaa

SEQ ID NO: 4865542 - DNA, 14 bp, Homo sapiens
tgcttcacaatgtt

SEQ ID NO: 4865543 - DNA, 20 bp, Homo sapiens
tgcttcatttgtatgtcaaa

SEQ ID NO: 4865544 - DNA, 15 bp, Homo sapiens
tgcttcctgatgctg

SEQ ID NO: 4865545 - DNA, 16 bp, Homo sapiens
tgcttcctgatgctgg

SEQ ID NO: 4865546 - DNA, 21 bp, Homo sapiens
tgcttcgactactgctcctgt

SEQ ID NO: 4865547 - DNA, 17 bp, Homo sapiens
tgcttctgtatttcctt

SEQ ID NO: 4865548 - DNA, 18 bp, Homo sapiens
tgcttgactttccagaat

SEQ ID NO: 4865549 - DNA, 21 bp, Homo sapiens
tgcttgactttccagaatgac

SEQ ID NO: 4865550 - DNA, 14 bp, Homo sapiens
tgcttgccaaagta

SEQ ID NO: 4865551 - DNA, 17 bp, Homo sapiens
tgctttattaatgtttt

SEQ ID NO: 4865552 - DNA, 21 bp, Homo sapiens
tgctttattaatgttttcaaa

SEQ ID NO: 4865553 - DNA, 23 bp, Homo sapiens
tgctttattaatgttttcaaaag

SEQ ID NO: 4865554 - DNA, 19 bp, Homo sapiens
tgctttgtaggtgtctcat

SEQ ID NO: 4865555 - DNA, 13 bp, Homo sapiens
tggaaaaaacatt

SEQ ID NO: 4865556 - DNA, 14 bp, Homo sapiens
tggaaaaaacattt

SEQ ID NO: 4865557 - DNA, 16 bp, Homo sapiens
tggaaaaataaacact

SEQ ID NO: 4865558 - DNA, 16 bp, Homo sapiens
tggaaaatataatgat

SEQ ID NO: 4865559 - DNA, 18 bp, Homo sapiens
tggaaaatgccatgaatt

SEQ ID NO: 4865560 - DNA, 17 bp, Homo sapiens
tggaaagcacaagactg

SEQ ID NO: 4865561 - DNA, 22 bp, Homo sapiens
tggaaagcacaagactggccca

SEQ ID NO: 4865562 - DNA, 23 bp, Homo sapiens
tggaaagcacaagactggcccag

SEQ ID NO: 4865563 - DNA, 16 bp, Homo sapiens
tggaaataaactgtgc

SEQ ID NO: 4865564 - DNA, 20 bp, Homo sapiens
tggaacaatcacagggaatg

SEQ ID NO: 4865565 - DNA, 17 bp, Homo sapiens
tggaacagggttggcat

SEQ ID NO: 4865566 - DNA, 17 bp, Homo sapiens
tggaagctgtttggaaa

SEQ ID NO: 4865567 - DNA, 19 bp, Homo sapiens
tggaagctgtttggaaaag

SEQ ID NO: 4865568 - DNA, 20 bp, Homo sapiens
tggaagctgtttggaaaaga

SEQ ID NO: 4865569 - DNA, 19 bp, Homo sapiens
tggaaggacctgctcccac

SEQ ID NO: 4865570 - DNA, 20 bp, Homo sapiens
tggaaggacctgctcccaca

SEQ ID NO: 4865571 - DNA, 13 bp, Homo sapiens
tggaagtacttgg

SEQ ID NO: 4865572 - DNA, 22 bp, Homo sapiens
tggaattatgttggtgtgaatt

SEQ ID NO: 4865573 - DNA, 22 bp, Homo sapiens
tggaattcttagtcacaaaata

SEQ ID NO: 4865574 - DNA, 23 bp, Homo sapiens
tggaatttgaggtctagagagaa

SEQ ID NO: 4865575 - DNA, 16 bp, Homo sapiens
tggacattttatgtct

SEQ ID NO: 4865576 - DNA, 18 bp, Homo sapiens
tggacgggatgacctcca

SEQ ID NO: 4865577 - DNA, 23 bp, Homo sapiens
tggacgggatgacctccagaagt

SEQ ID NO: 4865578 - DNA, 13 bp, Homo sapiens
tggactgcatggg

SEQ ID NO: 4865579 - DNA, 23 bp, Homo sapiens
tggactgcatggggaggcagcag

SEQ ID NO: 4865580 - DNA, 22 bp, Homo sapiens
tggactggaaagcacaagactg

SEQ ID NO: 4865581 - DNA, 13 bp, Homo sapiens
tggagaaaatggg

SEQ ID NO: 4865582 - DNA, 12 bp, Homo sapiens
tggagaatactg

SEQ ID NO: 4865583 - DNA, 16 bp, Homo sapiens
tggagaatactgccaa

SEQ ID NO: 4865584 - DNA, 15 bp, Homo sapiens
tggagatgtaggaac

SEQ ID NO: 4865585 - DNA, 12 bp, Homo sapiens
tggagcagcagg

SEQ ID NO: 4865586 - DNA, 14 bp, Homo sapiens
tggagcagcaggcc

SEQ ID NO: 4865587 - DNA, 21 bp, Homo sapiens
tggagcagcaggcctctggga

SEQ ID NO: 4865588 - DNA, 13 bp, Homo sapiens
tggagcaggccca

SEQ ID NO: 4865589 - DNA, 16 bp, Homo sapiens
tggagcaggcccaatg

SEQ ID NO: 4865590 - DNA, 22 bp, Homo sapiens
tggagcaggcccaatgctgctt

SEQ ID NO: 4865591 - DNA, 21 bp, Homo sapiens
tggagcccataggccaccccc

SEQ ID NO: 4865592 - DNA, 18 bp, Homo sapiens
tggagcctacctctgtct

SEQ ID NO: 4865593 - DNA, 14 bp, Homo sapiens
tggaggcagaggtg

SEQ ID NO: 4865594 - DNA, 20 bp, Homo sapiens
tggaggctcctctaggccct

SEQ ID NO: 4865595 - DNA, 16 bp, Homo sapiens
tggagggaagacctga

SEQ ID NO: 4865596 - DNA, 16 bp, Homo sapiens
tggagtgctcttccca

SEQ ID NO: 4865597 - DNA, 17 bp, Homo sapiens
tggagtgctcttcccac

SEQ ID NO: 4865598 - DNA, 23 bp, Homo sapiens
tggagtgctcttcccactccagc

SEQ ID NO: 4865599 - DNA, 22 bp, Homo sapiens
tggagtgggaagggagcattgc

SEQ ID NO: 4865600 - DNA, 22 bp, Homo sapiens
tggagtgtcggatcctgtgagt

SEQ ID NO: 4865601 - DNA, 18 bp, Homo sapiens
tggagtgtgcagacagcc

SEQ ID NO: 4865602 - DNA, 15 bp, Homo sapiens
tggagttaaaatgca

SEQ ID NO: 4865603 - DNA, 21 bp, Homo sapiens
tggatactggggggcaggcct

SEQ ID NO: 4865604 - DNA, 18 bp, Homo sapiens
tggatcctcagttctcaa

SEQ ID NO: 4865605 - DNA, 17 bp, Homo sapiens
tggattcatatttaatt

SEQ ID NO: 4865606 - DNA, 15 bp, Homo sapiens
tggattctaaataca

SEQ ID NO: 4865607 - DNA, 16 bp, Homo sapiens
tggatttaaaagcctg

SEQ ID NO: 4865608 - DNA, 15 bp, Homo sapiens
tggatttgcagaagt

SEQ ID NO: 4865609 - DNA, 15 bp, Homo sapiens
tggatttttctttaa

SEQ ID NO: 4865610 - DNA, 18 bp, Homo sapiens
tggatttttctttaactg

SEQ ID NO: 4865611 - DNA, 17 bp, Homo sapiens
tggcaaaaagagtcaga

SEQ ID NO: 4865612 - DNA, 20 bp, Homo sapiens
tggcaaagtgacaaagcaat

SEQ ID NO: 4865613 - DNA, 19 bp, Homo sapiens
tggcaatgactcaaagtct

SEQ ID NO: 4865614 - DNA, 16 bp, Homo sapiens
tggcacaaaagacagc

SEQ ID NO: 4865615 - DNA, 15 bp, Homo sapiens
tggcagagtcctgga

SEQ ID NO: 4865616 - DNA, 21 bp, Homo sapiens
tggcagatgagggctggctgc

SEQ ID NO: 4865617 - DNA, 16 bp, Homo sapiens
tggcagatgggggcct

SEQ ID NO: 4865618 - DNA, 15 bp, Homo sapiens
tggcagctagtgcct

SEQ ID NO: 4865619 - DNA, 16 bp, Homo sapiens
tggcattctttgcaat

SEQ ID NO: 4865620 - DNA, 20 bp, Homo sapiens
tggcattctttgcaatactg

SEQ ID NO: 4865621 - DNA, 18 bp, Homo sapiens
tggccacaaacctgcccg

SEQ ID NO: 4865622 - DNA, 18 bp, Homo sapiens
tggccacgggggcagtgt

SEQ ID NO: 4865623 - DNA, 21 bp, Homo sapiens
tggccagcccgcagaggtggg

SEQ ID NO: 4865624 - DNA, 13 bp, Homo sapiens
tggccaggcaggg

SEQ ID NO: 4865625 - DNA, 19 bp, Homo sapiens
tggccaggtggttgtctta

SEQ ID NO: 4865626 - DNA, 16 bp, Homo sapiens
tggccatcttctttct

SEQ ID NO: 4865627 - DNA, 23 bp, Homo sapiens
tggccatcttctttcttccaccc

SEQ ID NO: 4865628 - DNA, 15 bp, Homo sapiens
tggcccagtgccagc

SEQ ID NO: 4865629 - DNA, 15 bp, Homo sapiens
tggcccccttcagga

SEQ ID NO: 4865630 - DNA, 14 bp, Homo sapiens
tggccgtctcctcc

SEQ ID NO: 4865631 - DNA, 17 bp, Homo sapiens
tggccgtctcctccctc

SEQ ID NO: 4865632 - DNA, 13 bp, Homo sapiens
tggcctctgcctg

SEQ ID NO: 4865633 - DNA, 14 bp, Homo sapiens
tggcctctgcctgg

SEQ ID NO: 4865634 - DNA, 22 bp, Homo sapiens
tggcctgctaaggctcctcctt

SEQ ID NO: 4865635 - DNA, 17 bp, Homo sapiens
tggcctggagcaggccc

SEQ ID NO: 4865636 - DNA, 14 bp, Homo sapiens
tggcctgtccctag

SEQ ID NO: 4865637 - DNA, 18 bp, Homo sapiens
tggcctgtccctagggct

SEQ ID NO: 4865638 - DNA, 21 bp, Homo sapiens
tggcctgtccctagggctctc

SEQ ID NO: 4865639 - DNA, 22 bp, Homo sapiens
tggcctgtccctagggctctcc

SEQ ID NO: 4865640 - DNA, 23 bp, Homo sapiens
tggcctgtccctagggctctcca

SEQ ID NO: 4865641 - DNA, 16 bp, Homo sapiens
tggccttgagtctctg

SEQ ID NO: 4865642 - DNA, 14 bp, Homo sapiens
tggctcaaagcagc

SEQ ID NO: 4865643 - DNA, 12 bp, Homo sapiens
tggctcactact

SEQ ID NO: 4865644 - DNA, 14 bp, Homo sapiens
tggctcactactga

SEQ ID NO: 4865645 - DNA, 11 bp, Homo sapiens
tggctctgctg

SEQ ID NO: 4865646 - DNA, 12 bp, Homo sapiens
tggctctgctgg

SEQ ID NO: 4865647 - DNA, 16 bp, Homo sapiens
tggctgaagctggagc

SEQ ID NO: 4865648 - DNA, 18 bp, Homo sapiens
tggcttcaaaaagccaca

SEQ ID NO: 4865649 - DNA, 13 bp, Homo sapiens
tggcttgtctata

SEQ ID NO: 4865650 - DNA, 23 bp, Homo sapiens
tggctttaagccttcaaaactat

SEQ ID NO: 4865651 - DNA, 15 bp, Homo sapiens
tggctttcagcctct

SEQ ID NO: 4865652 - DNA, 18 bp, Homo sapiens
tgggaaacaaataatttg

SEQ ID NO: 4865653 - DNA, 15 bp, Homo sapiens
tgggaaagcataaag

SEQ ID NO: 4865654 - DNA, 14 bp, Homo sapiens
tgggaactgaaatc

SEQ ID NO: 4865655 - DNA, 16 bp, Homo sapiens
tgggaatgaggaaaat

SEQ ID NO: 4865656 - DNA, 16 bp, Homo sapiens
tgggaatgttctttct

SEQ ID NO: 4865657 - DNA, 21 bp, Homo sapiens
tgggaatgttctttctgctct

SEQ ID NO: 4865658 - DNA, 17 bp, Homo sapiens
tgggaattgctggagga

SEQ ID NO: 4865659 - DNA, 13 bp, Homo sapiens
tgggacccacaga

SEQ ID NO: 4865660 - DNA, 15 bp, Homo sapiens
tgggagacagcagcc

SEQ ID NO: 4865661 - DNA, 18 bp, Homo sapiens
tgggagacagcagcctgt

SEQ ID NO: 4865662 - DNA, 13 bp, Homo sapiens
tgggagccaggac

SEQ ID NO: 4865663 - DNA, 14 bp, Homo sapiens
tgggagccaggact

SEQ ID NO: 4865664 - DNA, 19 bp, Homo sapiens
tgggagccaggactcccag

SEQ ID NO: 4865665 - DNA, 14 bp, Homo sapiens
tgggataggagcag

SEQ ID NO: 4865666 - DNA, 18 bp, Homo sapiens
tgggatattgaatgttaa

SEQ ID NO: 4865667 - DNA, 23 bp, Homo sapiens
tgggatattttgaaatgaacttt

SEQ ID NO: 4865668 - DNA, 15 bp, Homo sapiens
tgggatcctccctca

SEQ ID NO: 4865669 - DNA, 19 bp, Homo sapiens
tgggatcctccctcatggc

SEQ ID NO: 4865670 - DNA, 22 bp, Homo sapiens
tgggatttccagaaccacactt

SEQ ID NO: 4865671 - DNA, 18 bp, Homo sapiens
tgggcacatagcataggc

SEQ ID NO: 4865672 - DNA, 22 bp, Homo sapiens
tgggcacatagcataggctggg

SEQ ID NO: 4865673 - DNA, 23 bp, Homo sapiens
tgggcacatagcataggctgggg

SEQ ID NO: 4865674 - DNA, 14 bp, Homo sapiens
tgggcactggggcc

SEQ ID NO: 4865675 - DNA, 18 bp, Homo sapiens
tgggcactggggcctcag

SEQ ID NO: 4865676 - DNA, 20 bp, Homo sapiens
tgggcatgacatcctttctt

SEQ ID NO: 4865677 - DNA, 23 bp, Homo sapiens
tgggcattagcaaggcagagcct

SEQ ID NO: 4865678 - DNA, 19 bp, Homo sapiens
tgggccaggatccccctct

SEQ ID NO: 4865679 - DNA, 16 bp, Homo sapiens
tgggccccatctccac

SEQ ID NO: 4865680 - DNA, 18 bp, Homo sapiens
tgggccctctctctgggc

SEQ ID NO: 4865681 - DNA, 19 bp, Homo sapiens
tgggcctcccctgggcagg

SEQ ID NO: 4865682 - DNA, 14 bp, Homo sapiens
tgggcctctcctgc

SEQ ID NO: 4865683 - DNA, 22 bp, Homo sapiens
tgggcgtgtgtgacactgatga

SEQ ID NO: 4865684 - DNA, 12 bp, Homo sapiens
tgggctgtgagg

SEQ ID NO: 4865685 - DNA, 18 bp, Homo sapiens
tgggcttcaacagccaag

SEQ ID NO: 4865686 - DNA, 21 bp, Homo sapiens
tgggcttcaacagccaagctg

SEQ ID NO: 4865687 - DNA, 20 bp, Homo sapiens
tgggctttggtggccaggga

SEQ ID NO: 4865688 - DNA, 20 bp, Homo sapiens
tgggcttttggggagccaga

SEQ ID NO: 4865689 - DNA, 21 bp, Homo sapiens
tgggcttttggggagccagaa

SEQ ID NO: 4865690 - DNA, 16 bp, Homo sapiens
tggggaacggaggagg

SEQ ID NO: 4865691 - DNA, 22 bp, Homo sapiens
tggggaactcccccagaggtgg

SEQ ID NO: 4865692 - DNA, 23 bp, Homo sapiens
tggggaactcccccagaggtgga

SEQ ID NO: 4865693 - DNA, 23 bp, Homo sapiens
tggggacacaggatcctggcctg

SEQ ID NO: 4865694 - DNA, 18 bp, Homo sapiens
tggggaggcagcagagcg

SEQ ID NO: 4865695 - DNA, 11 bp, Homo sapiens
tggggcagggt

SEQ ID NO: 4865696 - DNA, 12 bp, Homo sapiens
tggggccaggaa

SEQ ID NO: 4865697 - DNA, 15 bp, Homo sapiens
tggggcctcaggctc

SEQ ID NO: 4865698 - DNA, 17 bp, Homo sapiens
tggggcctcaggctccg

SEQ ID NO: 4865699 - DNA, 18 bp, Homo sapiens
tggggcctccagaagctg

SEQ ID NO: 4865700 - DNA, 19 bp, Homo sapiens
tggggcctccagaagctgc

SEQ ID NO: 4865701 - DNA, 10 bp, Homo sapiens
tggggctcct

SEQ ID NO: 4865702 - DNA, 18 bp, Homo sapiens
tgggggagattgaacttt

SEQ ID NO: 4865703 - DNA, 21 bp, Homo sapiens
tggggtgagaagtacagggca

SEQ ID NO: 4865704 - DNA, 17 bp, Homo sapiens
tgggtatgctcaggtca

SEQ ID NO: 4865705 - DNA, 22 bp, Homo sapiens
tgggtatgctcaggtcaactga

SEQ ID NO: 4865706 - DNA, 17 bp, Homo sapiens
tgggtcacatccatccc

SEQ ID NO: 4865707 - DNA, 12 bp, Homo sapiens
tgggtccaggga

SEQ ID NO: 4865708 - DNA, 16 bp, Homo sapiens
tgggtgccctttcctg

SEQ ID NO: 4865709 - DNA, 20 bp, Homo sapiens
tgggtgccctttcctggcag

SEQ ID NO: 4865710 - DNA, 21 bp, Homo sapiens
tgggtgccctttcctggcagt

SEQ ID NO: 4865711 - DNA, 17 bp, Homo sapiens
tgggtggctcactactg

SEQ ID NO: 4865712 - DNA, 23 bp, Homo sapiens
tgggtggctcactactgaacaca

SEQ ID NO: 4865713 - DNA, 17 bp, Homo sapiens
tgggtgtctccttaagc

SEQ ID NO: 4865714 - DNA, 22 bp, Homo sapiens
tgggtgtttgggaaaggcaggg

SEQ ID NO: 4865715 - DNA, 17 bp, Homo sapiens
tgggtttgggagccagg

SEQ ID NO: 4865716 - DNA, 19 bp, Homo sapiens
tgggtttgggagccaggac

SEQ ID NO: 4865717 - DNA, 22 bp, Homo sapiens
tgggtttgggagccaggactcc

SEQ ID NO: 4865718 - DNA, 12 bp, Homo sapiens
tggtaagagaaa

SEQ ID NO: 4865719 - DNA, 13 bp, Homo sapiens
tggtaagagaaaa

SEQ ID NO: 4865720 - DNA, 22 bp, Homo sapiens
tggtaggaccctcgagagcctt

SEQ ID NO: 4865721 - DNA, 18 bp, Homo sapiens
tggtatggggctgagccc

SEQ ID NO: 4865722 - DNA, 14 bp, Homo sapiens
tggtcaacatttct

SEQ ID NO: 4865723 - DNA, 23 bp, Homo sapiens
tggtcaagggctgtcattgcaca

SEQ ID NO: 4865724 - DNA, 21 bp, Homo sapiens
tggtcctatttttgtgaagag

SEQ ID NO: 4865725 - DNA, 22 bp, Homo sapiens
tggtcctatttttgtgaagagg

SEQ ID NO: 4865726 - DNA, 18 bp, Homo sapiens
tggtctgccaatctgtac

SEQ ID NO: 4865727 - DNA, 14 bp, Homo sapiens
tggtgaacactgtg

SEQ ID NO: 4865728 - DNA, 15 bp, Homo sapiens
tggtgaacactgtga

SEQ ID NO: 4865729 - DNA, 12 bp, Homo sapiens
tggtgaaggggc

SEQ ID NO: 4865730 - DNA, 14 bp, Homo sapiens
tggtgaaggggctg

SEQ ID NO: 4865731 - DNA, 21 bp, Homo sapiens
tggtgagcaagcaccaacctc

SEQ ID NO: 4865732 - DNA, 18 bp, Homo sapiens
tggtggtgaaggggctgg

SEQ ID NO: 4865733 - DNA, 21 bp, Homo sapiens
tggtgtaatctcaatgcaagc

SEQ ID NO: 4865734 - DNA, 16 bp, Homo sapiens
tggtgtgaatttgcca

SEQ ID NO: 4865735 - DNA, 15 bp, Homo sapiens
tggtgtggtgaatgt

SEQ ID NO: 4865736 - DNA, 16 bp, Homo sapiens
tggtgtggtgaatgtg

SEQ ID NO: 4865737 - DNA, 16 bp, Homo sapiens
tggtgttgcagccgca

SEQ ID NO: 4865738 - DNA, 15 bp, Homo sapiens
tggttaatttttcct

SEQ ID NO: 4865739 - DNA, 21 bp, Homo sapiens
tggttaatttttcctgcatgt

SEQ ID NO: 4865740 - DNA, 17 bp, Homo sapiens
tggttacctggagaagt

SEQ ID NO: 4865741 - DNA, 20 bp, Homo sapiens
tggttctgaggccagaaagg

SEQ ID NO: 4865742 - DNA, 13 bp, Homo sapiens
tggttctgtgaac

SEQ ID NO: 4865743 - DNA, 15 bp, Homo sapiens
tggttgatgtttaaa

SEQ ID NO: 4865744 - DNA, 16 bp, Homo sapiens
tggttgtcttattgca

SEQ ID NO: 4865745 - DNA, 16 bp, Homo sapiens
tggtttattctttgca

SEQ ID NO: 4865746 - DNA, 17 bp, Homo sapiens
tggtttattctttgcaa

SEQ ID NO: 4865747 - DNA, 19 bp, Homo sapiens
tgtaaatgaagatctttat

SEQ ID NO: 4865748 - DNA, 18 bp, Homo sapiens
tgtaaccagctcagtgtt

SEQ ID NO: 4865749 - DNA, 21 bp, Homo sapiens
tgtaactgtttagatgaatgt

SEQ ID NO: 4865750 - DNA, 21 bp, Homo sapiens
tgtaacttccaaataaataat

SEQ ID NO: 4865751 - DNA, 18 bp, Homo sapiens
tgtaataatgtaacatga

SEQ ID NO: 4865752 - DNA, 21 bp, Homo sapiens
tgtaataatgtaacatgattt

SEQ ID NO: 4865753 - DNA, 20 bp, Homo sapiens
tgtaatgctgcctcaggacc

SEQ ID NO: 4865754 - DNA, 20 bp, Homo sapiens
tgtaattgtgtggattcttt

SEQ ID NO: 4865755 - DNA, 20 bp, Homo sapiens
tgtacaaaaattatgcaatt

SEQ ID NO: 4865756 - DNA, 13 bp, Homo sapiens
tgtacaaaagcaa

SEQ ID NO: 4865757 - DNA, 13 bp, Homo sapiens
tgtacaaaattaa

SEQ ID NO: 4865758 - DNA, 17 bp, Homo sapiens
tgtacatatgtgctgga

SEQ ID NO: 4865759 - DNA, 20 bp, Homo sapiens
tgtacatatgtgctggaatt

SEQ ID NO: 4865760 - DNA, 12 bp, Homo sapiens
tgtactgcatgt

SEQ ID NO: 4865761 - DNA, 16 bp, Homo sapiens
tgtactgcatgtgact

SEQ ID NO: 4865762 - DNA, 20 bp, Homo sapiens
tgtactttatcatgaatgct

SEQ ID NO: 4865763 - DNA, 19 bp, Homo sapiens
tgtagacaaagtacattct

SEQ ID NO: 4865764 - DNA, 18 bp, Homo sapiens
tgtagagcccctactgtg

SEQ ID NO: 4865765 - DNA, 21 bp, Homo sapiens
tgtagagcccctactgtgggc

SEQ ID NO: 4865766 - DNA, 18 bp, Homo sapiens
tgtagatatgtattcttt

SEQ ID NO: 4865767 - DNA, 20 bp, Homo sapiens
tgtataatattgaaaattga

SEQ ID NO: 4865768 - DNA, 20 bp, Homo sapiens
tgtatatattttgtgtgaaa

SEQ ID NO: 4865769 - DNA, 14 bp, Homo sapiens
tgtatatgactgca

SEQ ID NO: 4865770 - DNA, 15 bp, Homo sapiens
tgtatatgactgcat

SEQ ID NO: 4865771 - DNA, 23 bp, Homo sapiens
tgtatcactgccttcgtttatat

SEQ ID NO: 4865772 - DNA, 15 bp, Homo sapiens
tgtatgatactaaag

SEQ ID NO: 4865773 - DNA, 16 bp, Homo sapiens
tgtatgatactaaaga

SEQ ID NO: 4865774 - DNA, 16 bp, Homo sapiens
tgtatgtggtgtgggg

SEQ ID NO: 4865775 - DNA, 20 bp, Homo sapiens
tgtatgtgtttatgtaactt

SEQ ID NO: 4865776 - DNA, 22 bp, Homo sapiens
tgtatgttaaagagaatgagtc

SEQ ID NO: 4865777 - DNA, 19 bp, Homo sapiens
tgtattatctcctttgaag

SEQ ID NO: 4865778 - DNA, 14 bp, Homo sapiens
tgtattatgagcca

SEQ ID NO: 4865779 - DNA, 14 bp, Homo sapiens
tgtattgcacattg

SEQ ID NO: 4865780 - DNA, 19 bp, Homo sapiens
tgtattttcatagatgtgt

SEQ ID NO: 4865781 - DNA, 17 bp, Homo sapiens
tgtcaatgagagcataa

SEQ ID NO: 4865782 - DNA, 21 bp, Homo sapiens
tgtcacaagtggtgtttattg

SEQ ID NO: 4865783 - DNA, 18 bp, Homo sapiens
tgtcagctgctgttgaac

SEQ ID NO: 4865784 - DNA, 16 bp, Homo sapiens
tgtcagtggggcagcc

SEQ ID NO: 4865785 - DNA, 18 bp, Homo sapiens
tgtcagttgttatttatt

SEQ ID NO: 4865786 - DNA, 22 bp, Homo sapiens
tgtcagttgttatttattgaaa

SEQ ID NO: 4865787 - DNA, 15 bp, Homo sapiens
tgtcatgaagaatgt

SEQ ID NO: 4865788 - DNA, 20 bp, Homo sapiens
tgtcatgaagaatgtttctg

SEQ ID NO: 4865789 - DNA, 15 bp, Homo sapiens
tgtcattcagaaaaa

SEQ ID NO: 4865790 - DNA, 22 bp, Homo sapiens
tgtcatttctatattcctccag

SEQ ID NO: 4865791 - DNA, 13 bp, Homo sapiens
tgtccaaaattta

SEQ ID NO: 4865792 - DNA, 14 bp, Homo sapiens
tgtccagagtctct

SEQ ID NO: 4865793 - DNA, 15 bp, Homo sapiens
tgtccctagggctct

SEQ ID NO: 4865794 - DNA, 17 bp, Homo sapiens
tgtccctagggctctcc

SEQ ID NO: 4865795 - DNA, 15 bp, Homo sapiens
tgtccttaaaatgtg

SEQ ID NO: 4865796 - DNA, 16 bp, Homo sapiens
tgtcggatcctgtgag

SEQ ID NO: 4865797 - DNA, 16 bp, Homo sapiens
tgtcgggttctcccat

SEQ ID NO: 4865798 - DNA, 21 bp, Homo sapiens
tgtctaagtagggccagggca

SEQ ID NO: 4865799 - DNA, 13 bp, Homo sapiens
tgtctaggcactg

SEQ ID NO: 4865800 - DNA, 20 bp, Homo sapiens
tgtctaggtctcctcagggt

SEQ ID NO: 4865801 - DNA, 21 bp, Homo sapiens
tgtctccttaagctgcagaga

SEQ ID NO: 4865802 - DNA, 22 bp, Homo sapiens
tgtctctcttcggtggccttga

SEQ ID NO: 4865803 - DNA, 23 bp, Homo sapiens
tgtctgagacaggtgcctaacct

SEQ ID NO: 4865804 - DNA, 13 bp, Homo sapiens
tgtctgatttctt

SEQ ID NO: 4865805 - DNA, 14 bp, Homo sapiens
tgtcttctttctcc

SEQ ID NO: 4865806 - DNA, 15 bp, Homo sapiens
tgtgaatttgccaga

SEQ ID NO: 4865807 - DNA, 13 bp, Homo sapiens
tgtgacactgatg

SEQ ID NO: 4865808 - DNA, 19 bp, Homo sapiens
tgtgaccagtctgaccctt

SEQ ID NO: 4865809 - DNA, 19 bp, Homo sapiens
tgtgactcagcatcaccca

SEQ ID NO: 4865810 - DNA, 21 bp, Homo sapiens
tgtgagaatggcctggagcag

SEQ ID NO: 4865811 - DNA, 17 bp, Homo sapiens
tgtgagcacaaagaaga

SEQ ID NO: 4865812 - DNA, 17 bp, Homo sapiens
tgtgaggacctccctgt

SEQ ID NO: 4865813 - DNA, 18 bp, Homo sapiens
tgtgaggagagaggagga

SEQ ID NO: 4865814 - DNA, 14 bp, Homo sapiens
tgtgagtaggctgg

SEQ ID NO: 4865815 - DNA, 22 bp, Homo sapiens
tgtgagtttaccttgtatactg

SEQ ID NO: 4865816 - DNA, 23 bp, Homo sapiens
tgtgagtttaccttgtatactgt

SEQ ID NO: 4865817 - DNA, 14 bp, Homo sapiens
tgtgatatataagt

SEQ ID NO: 4865818 - DNA, 16 bp, Homo sapiens
tgtgatatataagtgt

SEQ ID NO: 4865819 - DNA, 15 bp, Homo sapiens
tgtgcacatctgttt

SEQ ID NO: 4865820 - DNA, 17 bp, Homo sapiens
tgtgcacatctgttttg

SEQ ID NO: 4865821 - DNA, 18 bp, Homo sapiens
tgtgcccctaaagagcat

SEQ ID NO: 4865822 - DNA, 19 bp, Homo sapiens
tgtgcccctaaagagcatc

SEQ ID NO: 4865823 - DNA, 18 bp, Homo sapiens
tgtgctatacacacacac

SEQ ID NO: 4865824 - DNA, 13 bp, Homo sapiens
tgtgctttggaac

SEQ ID NO: 4865825 - DNA, 21 bp, Homo sapiens
tgtgctttggaacaatcacag

SEQ ID NO: 4865826 - DNA, 23 bp, Homo sapiens
tgtggcataaattgcatcactgt

SEQ ID NO: 4865827 - DNA, 16 bp, Homo sapiens
tgtggccgtctcctcc

SEQ ID NO: 4865828 - DNA, 16 bp, Homo sapiens
tgtggcctttatgttc

SEQ ID NO: 4865829 - DNA, 19 bp, Homo sapiens
tgtggcctttatgttcttt

SEQ ID NO: 4865830 - DNA, 17 bp, Homo sapiens
tgtggctttcagcctct

SEQ ID NO: 4865831 - DNA, 16 bp, Homo sapiens
tgtgggagacagcagc

SEQ ID NO: 4865832 - DNA, 17 bp, Homo sapiens
tgtgggagacagcagcc

SEQ ID NO: 4865833 - DNA, 18 bp, Homo sapiens
tgtgggcaaagtcctcct

SEQ ID NO: 4865834 - DNA, 18 bp, Homo sapiens
tgtggggcctcaggctcc

SEQ ID NO: 4865835 - DNA, 12 bp, Homo sapiens
tgtggggctgga

SEQ ID NO: 4865836 - DNA, 12 bp, Homo sapiens
tgtggggtgggg

SEQ ID NO: 4865837 - DNA, 13 bp, Homo sapiens
tgtggggtggggt

SEQ ID NO: 4865838 - DNA, 15 bp, Homo sapiens
tgtggtgaatgtgtg

SEQ ID NO: 4865839 - DNA, 18 bp, Homo sapiens
tgtggtttggaatattaa

SEQ ID NO: 4865840 - DNA, 14 bp, Homo sapiens
tgtgtaataatgta

SEQ ID NO: 4865841 - DNA, 21 bp, Homo sapiens
tgtgtagagcccctactgtgg

SEQ ID NO: 4865842 - DNA, 13 bp, Homo sapiens
tgtgtcatttcta

SEQ ID NO: 4865843 - DNA, 14 bp, Homo sapiens
tgtgtgaaattgca

SEQ ID NO: 4865844 - DNA, 12 bp, Homo sapiens
tgtgtgaagttt

SEQ ID NO: 4865845 - DNA, 13 bp, Homo sapiens
tgtgtgacactga

SEQ ID NO: 4865846 - DNA, 16 bp, Homo sapiens
tgtgtgacactgatga

SEQ ID NO: 4865847 - DNA, 23 bp, Homo sapiens
tgtgtgagaaaaactaacttgat

SEQ ID NO: 4865848 - DNA, 14 bp, Homo sapiens
tgtgtggattcttt

SEQ ID NO: 4865849 - DNA, 22 bp, Homo sapiens
tgtgtggcagccaggatgacta

SEQ ID NO: 4865850 - DNA, 22 bp, Homo sapiens
tgtgttatagacggtgctcact

SEQ ID NO: 4865851 - DNA, 21 bp, Homo sapiens
tgtgttcagaagaatcttcct

SEQ ID NO: 4865852 - DNA, 20 bp, Homo sapiens
tgtgtttccttttcaggaga

SEQ ID NO: 4865853 - DNA, 16 bp, Homo sapiens
tgtgttttgaaagaat

SEQ ID NO: 4865854 - DNA, 12 bp, Homo sapiens
tgttaaagagaa

SEQ ID NO: 4865855 - DNA, 14 bp, Homo sapiens
tgttaaagagataa

SEQ ID NO: 4865856 - DNA, 21 bp, Homo sapiens
tgttaaagagataaagaataa

SEQ ID NO: 4865857 - DNA, 20 bp, Homo sapiens
tgttaaggacccttttaagc

SEQ ID NO: 4865858 - DNA, 23 bp, Homo sapiens
tgttaaggacccttttaagcatg

SEQ ID NO: 4865859 - DNA, 13 bp, Homo sapiens
tgttaatatttta

SEQ ID NO: 4865860 - DNA, 17 bp, Homo sapiens
tgttacttatgtagaaa

SEQ ID NO: 4865861 - DNA, 14 bp, Homo sapiens
tgttacttgcaggt

SEQ ID NO: 4865862 - DNA, 14 bp, Homo sapiens
tgttagcagagtct

SEQ ID NO: 4865863 - DNA, 20 bp, Homo sapiens
tgttatacatcaatatgtat

SEQ ID NO: 4865864 - DNA, 21 bp, Homo sapiens
tgttatacatcaatatgtata

SEQ ID NO: 4865865 - DNA, 14 bp, Homo sapiens
tgttatatcaggga

SEQ ID NO: 4865866 - DNA, 18 bp, Homo sapiens
tgttatcagtaatgctaa

SEQ ID NO: 4865867 - DNA, 13 bp, Homo sapiens
tgttatttattga

SEQ ID NO: 4865868 - DNA, 18 bp, Homo sapiens
tgttcaagtttgctgcaa

SEQ ID NO: 4865869 - DNA, 22 bp, Homo sapiens
tgttcagaagaatcttcctggc

SEQ ID NO: 4865870 - DNA, 23 bp, Homo sapiens
tgttcaggaaaaggttgaataat

SEQ ID NO: 4865871 - DNA, 14 bp, Homo sapiens
tgttccaagtctct

SEQ ID NO: 4865872 - DNA, 14 bp, Homo sapiens
tgttcctgaaatgt

SEQ ID NO: 4865873 - DNA, 16 bp, Homo sapiens
tgttctccattttcaa

SEQ ID NO: 4865874 - DNA, 20 bp, Homo sapiens
tgttctccattttcaagctg

SEQ ID NO: 4865875 - DNA, 19 bp, Homo sapiens
tgttctttcacccatccta

SEQ ID NO: 4865876 - DNA, 16 bp, Homo sapiens
tgttgaaactttaaga

SEQ ID NO: 4865877 - DNA, 14 bp, Homo sapiens
tgttgactgtgtca

SEQ ID NO: 4865878 - DNA, 12 bp, Homo sapiens
tgttgatgagga

SEQ ID NO: 4865879 - DNA, 14 bp, Homo sapiens
tgttgcacttttga

SEQ ID NO: 4865880 - DNA, 18 bp, Homo sapiens
tgttgcacttttgaatgt

SEQ ID NO: 4865881 - DNA, 14 bp, Homo sapiens
tgttgcctcttgca

SEQ ID NO: 4865882 - DNA, 15 bp, Homo sapiens
tttgcaatactgctt

SEQ ID NO: 4865883 - DNA, 18 bp, Homo sapiens
tttgcactgatatatcat

SEQ ID NO: 4865884 - DNA, 20 bp, Homo sapiens
tttgcagttggactctcagg

SEQ ID NO: 4865885 - DNA, 20 bp, Homo sapiens
tttgcatgcatgcaaatgag

SEQ ID NO: 4865886 - DNA, 20 bp, Homo sapiens
tttgccagaggaccaatgct

SEQ ID NO: 4865887 - DNA, 12 bp, Homo sapiens
tttgccttctct

SEQ ID NO: 4865888 - DNA, 12 bp, Homo sapiens
tttgctgtgctt

SEQ ID NO: 4865889 - DNA, 13 bp, Homo sapiens
tttgctgtgcttt

SEQ ID NO: 4865890 - DNA, 15 bp, Homo sapiens
tttggaatattaaaa

SEQ ID NO: 4865891 - DNA, 18 bp, Homo sapiens
tttgggagacatgtgaca

SEQ ID NO: 4865892 - DNA, 13 bp, Homo sapiens
tttggtaaatgtt

SEQ ID NO: 4865893 - DNA, 16 bp, Homo sapiens
tttggtaaatgtttct

SEQ ID NO: 4865894 - DNA, 20 bp, Homo sapiens
tttgtataaaagtgtgaaat

SEQ ID NO: 4865895 - DNA, 18 bp, Homo sapiens
tttgtatatgactgcatt

SEQ ID NO: 4865896 - DNA, 18 bp, Homo sapiens
tttgtcgggttctcccat

SEQ ID NO: 4865897 - DNA, 19 bp, Homo sapiens
tttgtcgggttctcccatg

SEQ ID NO: 4865898 - DNA, 16 bp, Homo sapiens
tttgtggtttggaata

SEQ ID NO: 4865899 - DNA, 18 bp, Homo sapiens
tttgttgtacttaaatgg

SEQ ID NO: 4865900 - DNA, 23 bp, Homo sapiens
ttttaaagaccctcctattctat

SEQ ID NO: 4865901 - DNA, 13 bp, Homo sapiens
ttttaaaggcatt

SEQ ID NO: 4865902 - DNA, 14 bp, Homo sapiens
ttttaaagtgcaaa

SEQ ID NO: 4865903 - DNA, 12 bp, Homo sapiens
ttttaaagttca

SEQ ID NO: 4865904 - DNA, 24 bp, Homo sapiens
ttttaactaaattttaaagccatt

SEQ ID NO: 4865905 - DNA, 11 bp, Homo sapiens
ttttaactgta

SEQ ID NO: 4865906 - DNA, 19 bp, Homo sapiens
ttttacctagctaattatt

SEQ ID NO: 4865907 - DNA, 23 bp, Homo sapiens
ttttactccaggttattgcaata

SEQ ID NO: 4865908 - DNA, 13 bp, Homo sapiens
ttttactgtctat

SEQ ID NO: 4865909 - DNA, 20 bp, Homo sapiens
ttttagattgagaaatgtgt

SEQ ID NO: 4865910 - DNA, 16 bp, Homo sapiens
ttttagtgttaaagag

SEQ ID NO: 4865911 - DNA, 18 bp, Homo sapiens
ttattctttgcaaataaa

SEQ ID NO: 4865912 - DNA, 16 bp, Homo sapiens
ttattgaatatatgat

SEQ ID NO: 4865913 - DNA, 15 bp, Homo sapiens
ttattgatgttttca

SEQ ID NO: 4865914 - DNA, 20 bp, Homo sapiens
ttattgtagaataagtcatt

SEQ ID NO: 4865915 - DNA, 14 bp, Homo sapiens
ttatttaagactaa

SEQ ID NO: 4865916 - DNA, 15 bp, Homo sapiens
ttatttattccccag

SEQ ID NO: 4865917 - DNA, 16 bp, Homo sapiens
ttatttttataattgt

SEQ ID NO: 4865918 - DNA, 13 bp, Homo sapiens
ttattttttaaga

SEQ ID NO: 4865919 - DNA, 16 bp, Homo sapiens
ttcaaagtgcctgggc

SEQ ID NO: 4865920 - DNA, 17 bp, Homo sapiens
ttcaaccacgcaggaag

SEQ ID NO: 4865921 - DNA, 16 bp, Homo sapiens
ttcaacggaaagtgct

SEQ ID NO: 4865922 - DNA, 14 bp, Homo sapiens
ttcaagtttgctgc

SEQ ID NO: 4865923 - DNA, 14 bp, Homo sapiens
ttcaagttttaaag

SEQ ID NO: 4865924 - DNA, 18 bp, Homo sapiens
ttcaagttttaaagttca

SEQ ID NO: 4865925 - DNA, 14 bp, Homo sapiens
ttcacatttagaaa

SEQ ID NO: 4865926 - DNA, 15 bp, Homo sapiens
ttcaccaagaacagc

SEQ ID NO: 4865927 - DNA, 15 bp, Homo sapiens
ttcacgagagcccgg

SEQ ID NO: 4865928 - DNA, 14 bp, Homo sapiens
ttcactctggcttc

SEQ ID NO: 4865929 - DNA, 18 bp, Homo sapiens
ttcactgtactgcatgtg

SEQ ID NO: 4865930 - DNA, 23 bp, Homo sapiens
ttcagaagaatcttcctggcaca

SEQ ID NO: 4865931 - DNA, 22 bp, Homo sapiens
ttcagaagtcacacattacaaa

SEQ ID NO: 4865932 - DNA, 19 bp, Homo sapiens
ttcagagaaatttagagct

SEQ ID NO: 4865933 - DNA, 16 bp, Homo sapiens
ttcagcaaattccaga

SEQ ID NO: 4865934 - DNA, 13 bp, Homo sapiens
ttcagccaggtct

SEQ ID NO: 4865935 - DNA, 12 bp, Homo sapiens
ttcagcctctgg

SEQ ID NO: 4865936 - DNA, 19 bp, Homo sapiens
ttcagctgggtcacatcca

SEQ ID NO: 4865937 - DNA, 23 bp, Homo sapiens
ttcagctgggtcacatccatccc

SEQ ID NO: 4865938 - DNA, 18 bp, Homo sapiens
ttcaggactctctccagg

SEQ ID NO: 4865939 - DNA, 11 bp, Homo sapiens
ttcaggagcct

SEQ ID NO: 4865940 - DNA, 21 bp, Homo sapiens
ttcaggagcctggccaggcag

SEQ ID NO: 4865941 - DNA, 13 bp, Homo sapiens
ttcaggcagctga

SEQ ID NO: 4865942 - DNA, 14 bp, Homo sapiens
ttcaggcagctgaa

SEQ ID NO: 4865943 - DNA, 20 bp, Homo sapiens
ttcagtaagttatctttgaa

SEQ ID NO: 4865944 - DNA, 20 bp, Homo sapiens
ttcagtgtcccaccttgacc

SEQ ID NO: 4865945 - DNA, 14 bp, Homo sapiens
ttcagttctttgga

SEQ ID NO: 4865946 - DNA, 18 bp, Homo sapiens
ttcagttgcttgtcttct

SEQ ID NO: 4865947 - DNA, 18 bp, Homo sapiens
ttcatagagaatataaaa

SEQ ID NO: 4865948 - DNA, 18 bp, Homo sapiens
ttcatagctgtacttctt

SEQ ID NO: 4865949 - DNA, 13 bp, Homo sapiens
ttcatattgtaat

SEQ ID NO: 4865950 - DNA, 14 bp, Homo sapiens
ttcatattgtaatc

SEQ ID NO: 4865951 - DNA, 13 bp, Homo sapiens
ttcatccattcct

SEQ ID NO: 4865952 - DNA, 15 bp, Homo sapiens
ttcatgaaaatacca

SEQ ID NO: 4865953 - DNA, 21 bp, Homo sapiens
ttcatgaatgtgctggtgaac

SEQ ID NO: 4865954 - DNA, 15 bp, Homo sapiens
ttcatgacagcctcc

SEQ ID NO: 4865955 - DNA, 16 bp, Homo sapiens
ttcatgacagcctcca

SEQ ID NO: 4865956 - DNA, 19 bp, Homo sapiens
ttcatggctgctgttgctt

SEQ ID NO: 4865957 - DNA, 16 bp, Homo sapiens
ttcatgtcccagaact

SEQ ID NO: 4865958 - DNA, 22 bp, Homo sapiens
ttcatgtcccagaacttagcct

SEQ ID NO: 4865959 - DNA, 14 bp, Homo sapiens
ttcatgtttggaaa

SEQ ID NO: 4865960 - DNA, 19 bp, Homo sapiens
ttcattagttttgaagatt

SEQ ID NO: 4865961 - DNA, 15 bp, Homo sapiens
ttcattctgaaccct

SEQ ID NO: 4865962 - DNA, 21 bp, Homo sapiens
ttcattctgaaccctccaaag

SEQ ID NO: 4865963 - DNA, 22 bp, Homo sapiens
ttcattggcattctttgcaata

SEQ ID NO: 4865964 - DNA, 15 bp, Homo sapiens
ttccaaacagacaaa

SEQ ID NO: 4865965 - DNA, 14 bp, Homo sapiens
ttccaaataaataa

SEQ ID NO: 4865966 - DNA, 16 bp, Homo sapiens
ttccaaataaataatt

SEQ ID NO: 4865967 - DNA, 19 bp, Homo sapiens
ttccaagtctctgtgtaac

SEQ ID NO: 4865968 - DNA, 20 bp, Homo sapiens
ttccacccacaaactccagg

SEQ ID NO: 4865969 - DNA, 22 bp, Homo sapiens
ttccacccacaaactccaggct

SEQ ID NO: 4865970 - DNA, 12 bp, Homo sapiens
ttccacttctgg

SEQ ID NO: 4865971 - DNA, 22 bp, Homo sapiens
ttccatccatctttccatccat

SEQ ID NO: 4865972 - DNA, 21 bp, Homo sapiens
ttccatccattacctccatcc

SEQ ID NO: 4865973 - DNA, 22 bp, Homo sapiens
ttccatccattacctccatcca

SEQ ID NO: 4865974 - DNA, 18 bp, Homo sapiens
ttccattacaccacagca

SEQ ID NO: 4865975 - DNA, 13 bp, Homo sapiens
ttccattgcttat

SEQ ID NO: 4865976 - DNA, 12 bp, Homo sapiens
ttcccactccag

SEQ ID NO: 4865977 - DNA, 14 bp, Homo sapiens
ttcccagcttcccg

SEQ ID NO: 4865978 - DNA, 18 bp, Homo sapiens
ttccccagtgactccagg

SEQ ID NO: 4865979 - DNA, 15 bp, Homo sapiens
ttcccggcccttacc

SEQ ID NO: 4865980 - DNA, 22 bp, Homo sapiens
ttccctaggatcccgtcttcca

SEQ ID NO: 4865981 - DNA, 21 bp, Homo sapiens
ttccctgggtttgggagccag

SEQ ID NO: 4865982 - DNA, 14 bp, Homo sapiens
ttcccttgaaactt

SEQ ID NO: 4865983 - DNA, 20 bp, Homo sapiens
ttcccttgcaggggtccccc

SEQ ID NO: 4865984 - DNA, 18 bp, Homo sapiens
ttccgcccactcctggga

SEQ ID NO: 4865985 - DNA, 23 bp, Homo sapiens
ttcctaatcaaattctgtctggg

SEQ ID NO: 4865986 - DNA, 20 bp, Homo sapiens
ttcctactcacacttcagct

SEQ ID NO: 4865987 - DNA, 18 bp, Homo sapiens
ttcctagctgtgtgaata

SEQ ID NO: 4865988 - DNA, 13 bp, Homo sapiens
ttcctcctctcaa

SEQ ID NO: 4865989 - DNA, 12 bp, Homo sapiens
ttcctctcccag

SEQ ID NO: 4865990 - DNA, 12 bp, Homo sapiens
ttcctgaaatgt

SEQ ID NO: 4865991 - DNA, 23 bp, Homo sapiens
ttcctgatgctgggcaatgaggc

SEQ ID NO: 4865992 - DNA, 15 bp, Homo sapiens
ttcctgctgctgcta

SEQ ID NO: 4865993 - DNA, 14 bp, Homo sapiens
ttcctggcacaatg

SEQ ID NO: 4865994 - DNA, 12 bp, Homo sapiens
ttcctgtgagga

SEQ ID NO: 4865995 - DNA, 23 bp, Homo sapiens
ttccttaggtttttttccttctg

SEQ ID NO: 4865996 - DNA, 14 bp, Homo sapiens
ttcctttgcatatt

SEQ ID NO: 4865997 - DNA, 19 bp, Homo sapiens
ttcctttgcatattataaa

SEQ ID NO: 4865998 - DNA, 14 bp, Homo sapiens
ttccttttcttaaa

SEQ ID NO: 4865999 - DNA, 16 bp, Homo sapiens
ttcgactactgctcct

SEQ ID NO: 4866000 - DNA, 17 bp, Homo sapiens
ttcgactcagcctcagg

SEQ ID NO: 4866001 - DNA, 16 bp, Homo sapiens
ttcggtttcaaagtga

SEQ ID NO: 4866002 - DNA, 23 bp, Homo sapiens
ttcgtttatatttttttaactgt

SEQ ID NO: 4866003 - DNA, 23 bp, Homo sapiens
ttctaaactccctggctgttctg

SEQ ID NO: 4866004 - DNA, 20 bp, Homo sapiens
ttctacaactgattgcaaca

SEQ ID NO: 4866005 - DNA, 17 bp, Homo sapiens
ttctatattcctccagc

SEQ ID NO: 4866006 - DNA, 18 bp, Homo sapiens
ttctatattcctccagct

SEQ ID NO: 4866007 - DNA, 14 bp, Homo sapiens
ttctattctccaga

SEQ ID NO: 4866008 - DNA, 13 bp, Homo sapiens
ttctatttataat

SEQ ID NO: 4866009 - DNA, 11 bp, Homo sapiens
ttctcaatgta

SEQ ID NO: 4866010 - DNA, 17 bp, Homo sapiens
ttctcaccctctgtcct

SEQ ID NO: 4866011 - DNA, 14 bp, Homo sapiens
ttctcagctgtgcc

SEQ ID NO: 4866012 - DNA, 15 bp, Homo sapiens
ttctcagctgtgcct

SEQ ID NO: 4866013 - DNA, 23 bp, Homo sapiens
ttgtacttaaatggtaataagca

SEQ ID NO: 4866014 - DNA, 19 bp, Homo sapiens
ttgtactttatcatgaatg

SEQ ID NO: 4866015 - DNA, 18 bp, Homo sapiens
ttgtattttgattatttt

SEQ ID NO: 4866016 - DNA, 17 bp, Homo sapiens
ttgtcaccgcaggtgct

SEQ ID NO: 4866017 - DNA, 21 bp, Homo sapiens
ttgtgaccagaaagcttcatc

SEQ ID NO: 4866018 - DNA, 21 bp, Homo sapiens
ttgtgagaatggcctggagca

SEQ ID NO: 4866019 - DNA, 13 bp, Homo sapiens
ttgtgcccctaaa

SEQ ID NO: 4866020 - DNA, 15 bp, Homo sapiens
ttgtgcccctaaaga

SEQ ID NO: 4866021 - DNA, 19 bp, Homo sapiens
ttgtggggcctcaggctcc

SEQ ID NO: 4866022 - DNA, 20 bp, Homo sapiens
ttgtggggcctcaggctccg

SEQ ID NO: 4866023 - DNA, 20 bp, Homo sapiens
ttgtggggctggaaggacct

SEQ ID NO: 4866024 - DNA, 15 bp, Homo sapiens
ttgtgtgaaattgca

SEQ ID NO: 4866025 - DNA, 19 bp, Homo sapiens
ttgtgtggtctggttcctg

SEQ ID NO: 4866026 - DNA, 14 bp, Homo sapiens
ttgttatcaaaata

SEQ ID NO: 4866027 - DNA, 16 bp, Homo sapiens
ttgttatcaaaatagt

SEQ ID NO: 4866028 - DNA, 12 bp, Homo sapiens
ttgttgtactta

SEQ ID NO: 4866029 - DNA, 23 bp, Homo sapiens
ttgttgtgagaatggcctggagc

SEQ ID NO: 4866030 - DNA, 15 bp, Homo sapiens
ttgtttaaaatgtaa

SEQ ID NO: 4866031 - DNA, 16 bp, Homo sapiens
ttgtttaatagatttg

SEQ ID NO: 4866032 - DNA, 16 bp, Homo sapiens
ttgtttataataaaaa

SEQ ID NO: 4866033 - DNA, 12 bp, Homo sapiens
ttgtttggagac

SEQ ID NO: 4866034 - DNA, 15 bp, Homo sapiens
ttgtttgtcacaagt

SEQ ID NO: 4866035 - DNA, 17 bp, Homo sapiens
ttgttttggatggcttg

SEQ ID NO: 4866036 - DNA, 22 bp, Homo sapiens
tttaaaaaataaataaaaacta

SEQ ID NO: 4866037 - DNA, 22 bp, Homo sapiens
tttaaaactgttggaatggatt

SEQ ID NO: 4866038 - DNA, 13 bp, Homo sapiens
aaaaaaaattgta

SEQ ID NO: 4866039 - DNA, 12 bp, Homo sapiens
aaaaaaagatga

SEQ ID NO: 4866040 - DNA, 12 bp, Homo sapiens
aaaaaaagctgc

SEQ ID NO: 4866041 - DNA, 11 bp, Homo sapiens
aaaaaagatga

SEQ ID NO: 4866042 - DNA, 16 bp, Homo sapiens
aaaaaagtcaccaaat

SEQ ID NO: 4866043 - DNA, 22 bp, Homo sapiens
aaaaacttcatgtaattttatt

SEQ ID NO: 4866044 - DNA, 23 bp, Homo sapiens
aaaaacttcatgtaattttattt

SEQ ID NO: 4866045 - DNA, 19 bp, Homo sapiens
aaaaaggcccttagaggga

SEQ ID NO: 4866046 - DNA, 14 bp, Homo sapiens
aaaaagtataaaat

SEQ ID NO: 4866047 - DNA, 12 bp, Homo sapiens
aaaaattatgca

SEQ ID NO: 4866048 - DNA, 10 bp, Homo sapiens
aaaacaaaaa

SEQ ID NO: 4866049 - DNA, 11 bp, Homo sapiens
aaaacaaaaag

SEQ ID NO: 4866050 - DNA, 12 bp, Homo sapiens
aaaacatttgct

SEQ ID NO: 4866051 - DNA, 20 bp, Homo sapiens
aaaacattttaagttttact

SEQ ID NO: 4866052 - DNA, 21 bp, Homo sapiens
aaaaccatttttgaaccttaa

SEQ ID NO: 4866053 - DNA, 23 bp, Homo sapiens
aaaactcaggcaaagaaaatgaa

SEQ ID NO: 4866054 - DNA, 14 bp, Homo sapiens
aaaagaaggaaaga

SEQ ID NO: 4866055 - DNA, 15 bp, Homo sapiens
aaaagacactgcaga

SEQ ID NO: 4866056 - DNA, 13 bp, Homo sapiens
aaaagacagctgg

SEQ ID NO: 4866057 - DNA, 21 bp, Homo sapiens
aaaagagcagtggtaagaata

SEQ ID NO: 4866058 - DNA, 22 bp, Homo sapiens
aaaagataaagaccagaaattc

SEQ ID NO: 4866059 - DNA, 18 bp, Homo sapiens
aaaagccacagcagagca

SEQ ID NO: 4866060 - DNA, 22 bp, Homo sapiens
aaaagccagccaagctttaaat

SEQ ID NO: 4866061 - DNA, 11 bp, Homo sapiens
aaaagcctgct

SEQ ID NO: 4866062 - DNA, 11 bp, Homo sapiens
aaaaggaaagc

SEQ ID NO: 4866063 - DNA, 13 bp, Homo sapiens
aaaaggttgaata

SEQ ID NO: 4866064 - DNA, 23 bp, Homo sapiens
aaaagtcaccaaatagtgtgaaa

SEQ ID NO: 4866065 - DNA, 20 bp, Homo sapiens
aaaagtgtgtatatattttg

SEQ ID NO: 4866066 - DNA, 21 bp, Homo sapiens
aaaagtgtgtatatattttgt

SEQ ID NO: 4866067 - DNA, 19 bp, Homo sapiens
aaaagtgttgactgtgtca

SEQ ID NO: 4866068 - DNA, 16 bp, Homo sapiens
aaaagtttttgtttgg

SEQ ID NO: 4866069 - DNA, 17 bp, Homo sapiens
aaaatactattgcctca

SEQ ID NO: 4866070 - DNA, 19 bp, Homo sapiens
aaaatcatgccagtatttt

SEQ ID NO: 4866071 - DNA, 17 bp, Homo sapiens
aaaatcccccagcactt

SEQ ID NO: 4866072 - DNA, 18 bp, Homo sapiens
aaaatgaaatgcatattt

SEQ ID NO: 4866073 - DNA, 18 bp, Homo sapiens
aaaatgaggatccagggc

SEQ ID NO: 4866074 - DNA, 21 bp, Homo sapiens
aaaatggcagggggtggaatt

SEQ ID NO: 4866075 - DNA, 22 bp, Homo sapiens
aaaatggtcctatttttgtgaa

SEQ ID NO: 4866076 - DNA, 14 bp, Homo sapiens
aaaatgtaatttaa

SEQ ID NO: 4866077 - DNA, 18 bp, Homo sapiens
aaaatgtaatttaaatga

SEQ ID NO: 4866078 - DNA, 21 bp, Homo sapiens
aaaattcaaagcatggacatt

SEQ ID NO: 4866079 - DNA, 22 bp, Homo sapiens
aaaattcaaagcatggacattt

SEQ ID NO: 4866080 - DNA, 17 bp, Homo sapiens
aaaattccaaattcatg

SEQ ID NO: 4866081 - DNA, 13 bp, Homo sapiens
aaaattgttattt

SEQ ID NO: 4866082 - DNA, 17 bp, Homo sapiens
aaacaaataatttgaac

SEQ ID NO: 4866083 - DNA, 12 bp, Homo sapiens
aaacaacattta

SEQ ID NO: 4866084 - DNA, 17 bp, Homo sapiens
aaacaagccccctgccc

SEQ ID NO: 4866085 - DNA, 13 bp, Homo sapiens
aaacactatttgt

SEQ ID NO: 4866086 - DNA, 13 bp, Homo sapiens
aaacagacaaaac

SEQ ID NO: 4866087 - DNA, 21 bp, Homo sapiens
aaacatgttaatgacaatatt

SEQ ID NO: 4866088 - DNA, 16 bp, Homo sapiens
aaacatttatgacaag

SEQ ID NO: 4866089 - DNA, 15 bp, Homo sapiens
aaaccactagaaagt

SEQ ID NO: 4866090 - DNA, 22 bp, Homo sapiens
aaaccacttaaacgaagagttc

SEQ ID NO: 4866091 - DNA, 19 bp, Homo sapiens
aaaccactttattgcaatg

SEQ ID NO: 4866092 - DNA, 19 bp, Homo sapiens
aaacccaagattattaaaa

SEQ ID NO: 4866093 - DNA, 15 bp, Homo sapiens
aaacccatcttttgt

SEQ ID NO: 4866094 - DNA, 21 bp, Homo sapiens
aaacctgccaaggagcatcct

SEQ ID NO: 4866095 - DNA, 16 bp, Homo sapiens
aaacctgggaaggcca

SEQ ID NO: 4866096 - DNA, 20 bp, Homo sapiens
aaactactgaatgaagcagt

SEQ ID NO: 4866097 - DNA, 17 bp, Homo sapiens
aaactatatataatgta

SEQ ID NO: 4866098 - DNA, 18 bp, Homo sapiens
aaactatatataatgtat

SEQ ID NO: 4866099 - DNA, 12 bp, Homo sapiens
aaactctgctgt

SEQ ID NO: 4866100 - DNA, 22 bp, Homo sapiens
aaactgatccagtataagacta

SEQ ID NO: 4866101 - DNA, 20 bp, Homo sapiens
aaactgggatgtaagtttgt

SEQ ID NO: 4866102 - DNA, 14 bp, Homo sapiens
aaactgtgcaatcc

SEQ ID NO: 4866103 - DNA, 13 bp, Homo sapiens
aaactttgggaaa

SEQ ID NO: 4866104 - DNA, 22 bp, Homo sapiens
aaagaagagcgagagatcaaag

SEQ ID NO: 4866105 - DNA, 12 bp, Homo sapiens
aaagagaaagag

SEQ ID NO: 4866106 - DNA, 14 bp, Homo sapiens
aaagagaatgagtc

SEQ ID NO: 4866107 - DNA, 14 bp, Homo sapiens
aaagagcatcctga

SEQ ID NO: 4866108 - DNA, 22 bp, Homo sapiens
aaagagctaggaaccctggagg

SEQ ID NO: 4866109 - DNA, 20 bp, Homo sapiens
aaagagtcagacatttcttt

SEQ ID NO: 4866110 - DNA, 12 bp, Homo sapiens
aaagatgagttg

SEQ ID NO: 4866111 - DNA, 21 bp, Homo sapiens
aaagatgcatcatctcttcct

SEQ ID NO: 4866112 - DNA, 19 bp, Homo sapiens
aaagatggttaaacatttt

SEQ ID NO: 4866113 - DNA, 20 bp, Homo sapiens
aaagcacaatttaaaacaat

SEQ ID NO: 4866114 - DNA, 21 bp, Homo sapiens
aaagcactggccttgcctcca

SEQ ID NO: 4866115 - DNA, 22 bp, Homo sapiens
aaagcactggccttgcctccag

SEQ ID NO: 4866116 - DNA, 12 bp, Homo sapiens
aaagcagcagga

SEQ ID NO: 4866117 - DNA, 22 bp, Homo sapiens
aaagcatgttcacccttatagt

SEQ ID NO: 4866118 - DNA, 13 bp, Homo sapiens
aaagcatttccta

SEQ ID NO: 4866119 - DNA, 17 bp, Homo sapiens
aaagccacagcagagca

SEQ ID NO: 4866120 - DNA, 14 bp, Homo sapiens
aaagccaggctcag

SEQ ID NO: 4866121 - DNA, 17 bp, Homo sapiens
aaagccaggctcaggag

SEQ ID NO: 4866122 - DNA, 21 bp, Homo sapiens
aaagccaggctcaggagaagc

SEQ ID NO: 4866123 - DNA, 13 bp, Homo sapiens
aaagcctgctcaa

SEQ ID NO: 4866124 - DNA, 15 bp, Homo sapiens
aaagctaaagtttgg

SEQ ID NO: 4866125 - DNA, 18 bp, Homo sapiens
aaagctcaaatgaaatgt

SEQ ID NO: 4866126 - DNA, 20 bp, Homo sapiens
aaagctgcaaaaattatata

SEQ ID NO: 4866127 - DNA, 14 bp, Homo sapiens
aaagctgttccttg

SEQ ID NO: 4866128 - DNA, 16 bp, Homo sapiens
aaagcttcacagtacc

SEQ ID NO: 4866129 - DNA, 18 bp, Homo sapiens
aaagcttggttctgtgaa

SEQ ID NO: 4866130 - DNA, 14 bp, Homo sapiens
aaaggataaagaag

SEQ ID NO: 4866131 - DNA, 21 bp, Homo sapiens
aaaggatagtaagcatagaaa

SEQ ID NO: 4866132 - DNA, 22 bp, Homo sapiens
aaaggtgtgaggagagaggagg

SEQ ID NO: 4866133 - DNA, 16 bp, Homo sapiens
aaaggttgaataatat

SEQ ID NO: 4866134 - DNA, 13 bp, Homo sapiens
aaagtacttgact

SEQ ID NO: 4866135 - DNA, 14 bp, Homo sapiens
aaagtataatgttt

SEQ ID NO: 4866136 - DNA, 15 bp, Homo sapiens
aaagtcagaagtttt

SEQ ID NO: 4866137 - DNA, 17 bp, Homo sapiens
aaagtcattaaagacag

SEQ ID NO: 4866138 - DNA, 22 bp, Homo sapiens
aaagtgcctgggctcagcctgg

SEQ ID NO: 4866139 - DNA, 23 bp, Homo sapiens
aaagtgcctgggctcagcctggt

SEQ ID NO: 4866140 - DNA, 13 bp, Homo sapiens
aaagtggaacgaa

SEQ ID NO: 4866141 - DNA, 20 bp, Homo sapiens
aaagtggaacgaaaatgaaa

SEQ ID NO: 4866142 - DNA, 17 bp, Homo sapiens
aaagtgggcttaatgga

SEQ ID NO: 4866143 - DNA, 20 bp, Homo sapiens
aaagtgtgtatatattttgt

SEQ ID NO: 4866144 - DNA, 17 bp, Homo sapiens
aaagttaaaattgttat

SEQ ID NO: 4866145 - DNA, 12 bp, Homo sapiens
aaagttttgttg

SEQ ID NO: 4866146 - DNA, 23 bp, Homo sapiens
aaagttttgttgtacttaaatgg

SEQ ID NO: 4866147 - DNA, 16 bp, Homo sapiens
aaataaacactacaga

SEQ ID NO: 4866148 - DNA, 11 bp, Homo sapiens
aaataaataat

SEQ ID NO: 4866149 - DNA, 21 bp, Homo sapiens
aaataacatgtttctctataa

SEQ ID NO: 4866150 - DNA, 15 bp, Homo sapiens
aaataactgaatttg

SEQ ID NO: 4866151 - DNA, 14 bp, Homo sapiens
aaataagaaataat

SEQ ID NO: 4866152 - DNA, 15 bp, Homo sapiens
aaatactcatgtgca

SEQ ID NO: 4866153 - DNA, 14 bp, Homo sapiens
aaatagacaaaaag

SEQ ID NO: 4866154 - DNA, 20 bp, Homo sapiens
aaataggaatcattcagaaa

SEQ ID NO: 4866155 - DNA, 19 bp, Homo sapiens
aaataggctattaaaaaag

SEQ ID NO: 4866156 - DNA, 16 bp, Homo sapiens
aaatagtatgaaaatg

SEQ ID NO: 4866157 - DNA, 13 bp, Homo sapiens
aaatagtgtgaaa

SEQ ID NO: 4866158 - DNA, 20 bp, Homo sapiens
aaatagttgcatagcagtat

SEQ ID NO: 4866159 - DNA, 23 bp, Homo sapiens
aaatagttgcatagcagtatatg

SEQ ID NO: 4866160 - DNA, 18 bp, Homo sapiens
aaatataaaattatgaga

SEQ ID NO: 4866161 - DNA, 18 bp, Homo sapiens
aaatatattacttaactg

SEQ ID NO: 4866162 - DNA, 19 bp, Homo sapiens
aaatatattacttaactgt

SEQ ID NO: 4866163 - DNA, 13 bp, Homo sapiens
aaatatgaatgaa

SEQ ID NO: 4866164 - DNA, 16 bp, Homo sapiens
aaatattcacatcttc

SEQ ID NO: 4866165 - DNA, 15 bp, Homo sapiens
aaatatttatttatt

SEQ ID NO: 4866166 - DNA, 17 bp, Homo sapiens
aaatcaatagttgaatt

SEQ ID NO: 4866167 - DNA, 16 bp, Homo sapiens
aaatcataaagtcagt

SEQ ID NO: 4866168 - DNA, 18 bp, Homo sapiens
aaatcatgccagtatttt

SEQ ID NO: 4866169 - DNA, 15 bp, Homo sapiens
aaatcctgaagagca

SEQ ID NO: 4866170 - DNA, 23 bp, Homo sapiens
aaatccttgagagttccggggag

SEQ ID NO: 4866171 - DNA, 15 bp, Homo sapiens
aaatcttttgaagca

SEQ ID NO: 4866172 - DNA, 15 bp, Homo sapiens
aaatgaaatgtatgc

SEQ ID NO: 4866173 - DNA, 18 bp, Homo sapiens
aaatgagcttgattaaat

SEQ ID NO: 4866174 - DNA, 19 bp, Homo sapiens
aaatgagcttgattaaatc

SEQ ID NO: 4866175 - DNA, 14 bp, Homo sapiens
aaatgaggatccag

SEQ ID NO: 4866176 - DNA, 22 bp, Homo sapiens
aaatgcagggaggggaggcaga

SEQ ID NO: 4866177 - DNA, 21 bp, Homo sapiens
aaatggcctgtccctagggct

SEQ ID NO: 4866178 - DNA, 22 bp, Homo sapiens
aaatggggaactcccccagagg

SEQ ID NO: 4866179 - DNA, 22 bp, Homo sapiens
aaatggtcctatttttgtgaag

SEQ ID NO: 4866180 - DNA, 19 bp, Homo sapiens
aaatggttaatttttcctg

SEQ ID NO: 4866181 - DNA, 18 bp, Homo sapiens
aaatgtaatttaaatgaa

SEQ ID NO: 4866182 - DNA, 13 bp, Homo sapiens
aaatgtgactcag

SEQ ID NO: 4866183 - DNA, 14 bp, Homo sapiens
aaatgtggtctgcc

SEQ ID NO: 4866184 - DNA, 15 bp, Homo sapiens
aaatgtgtttccttt

SEQ ID NO: 4866185 - DNA, 16 bp, Homo sapiens
aaatgttaaaagtttt

SEQ ID NO: 4866186 - DNA, 19 bp, Homo sapiens
aaatgttaaaagttttata

SEQ ID NO: 4866187 - DNA, 23 bp, Homo sapiens
aaatgttaaaagttttatatgct

SEQ ID NO: 4866188 - DNA, 14 bp, Homo sapiens
aaatgtttcttttg

SEQ ID NO: 4866189 - DNA, 12 bp, Homo sapiens
aaattaaaaaaa

SEQ ID NO: 4866190 - DNA, 15 bp, Homo sapiens
aaattaaaaaaaaat

SEQ ID NO: 4866191 - DNA, 15 bp, Homo sapiens
aaattacctgtggat

SEQ ID NO: 4866192 - DNA, 20 bp, Homo sapiens
aaattagatcctaagatgtg

SEQ ID NO: 4866193 - DNA, 15 bp, Homo sapiens
aaattcaactttgta

SEQ ID NO: 4866194 - DNA, 13 bp, Homo sapiens
aaattcaccttcc

SEQ ID NO: 4866195 - DNA, 20 bp, Homo sapiens
aaattcagtttttttccagt

SEQ ID NO: 4866196 - DNA, 18 bp, Homo sapiens
aaattcatggcatgctta

SEQ ID NO: 4866197 - DNA, 12 bp, Homo sapiens
aaattccctggg

SEQ ID NO: 4866198 - DNA, 17 bp, Homo sapiens
aaattctgtctggggac

SEQ ID NO: 4866199 - DNA, 17 bp, Homo sapiens
aaattgcatactttgta

SEQ ID NO: 4866200 - DNA, 18 bp, Homo sapiens
aaattgtatctcattact

SEQ ID NO: 4866201 - DNA, 13 bp, Homo sapiens
aaatttaaaaaat

SEQ ID NO: 4866202 - DNA, 19 bp, Homo sapiens
aaatttaaaaaataaataa

SEQ ID NO: 4866203 - DNA, 13 bp, Homo sapiens
aaattttaaaaaa

SEQ ID NO: 4866204 - DNA, 14 bp, Homo sapiens
aaattttaaaaaag

SEQ ID NO: 4866205 - DNA, 14 bp, Homo sapiens
aaattttagaaata

SEQ ID NO: 4866206 - DNA, 15 bp, Homo sapiens
aaattttagaaatat

SEQ ID NO: 4866207 - DNA, 13 bp, Homo sapiens
aacaaaaagatgt

SEQ ID NO: 4866208 - DNA, 14 bp, Homo sapiens
aacaaaactcttaa

SEQ ID NO: 4866209 - DNA, 18 bp, Homo sapiens
aacaaacaagccccctgc

SEQ ID NO: 4866210 - DNA, 11 bp, Homo sapiens
aacaaagaaac

SEQ ID NO: 4866211 - DNA, 18 bp, Homo sapiens
aacaaataatttgaactt

SEQ ID NO: 4866212 - DNA, 19 bp, Homo sapiens
aacaaataatttgaacttt

SEQ ID NO: 4866213 - DNA, 23 bp, Homo sapiens
aacaaataatttgaactttggaa

SEQ ID NO: 4866214 - DNA, 16 bp, Homo sapiens
aacaagaaccactcct

SEQ ID NO: 4866215 - DNA, 13 bp, Homo sapiens
aacaagcatgcag

SEQ ID NO: 4866216 - DNA, 14 bp, Homo sapiens
aacaagcttcagta

SEQ ID NO: 4866217 - DNA, 17 bp, Homo sapiens
aacaatccttactaagt

SEQ ID NO: 4866218 - DNA, 21 bp, Homo sapiens
aacacacaggtgcaacagact

SEQ ID NO: 4866219 - DNA, 20 bp, Homo sapiens
aacacatttttttgcatgca

SEQ ID NO: 4866220 - DNA, 23 bp, Homo sapiens
aacactagggccttggaaattcc

SEQ ID NO: 4866221 - DNA, 22 bp, Homo sapiens
aacagaaagcctgggtgacatt

SEQ ID NO: 4866222 - DNA, 14 bp, Homo sapiens
aacagaaatggaaa

SEQ ID NO: 4866223 - DNA, 18 bp, Homo sapiens
aacagccaagctggcaca

SEQ ID NO: 4866224 - DNA, 19 bp, Homo sapiens
aacagccttagagctcttg

SEQ ID NO: 4866225 - DNA, 17 bp, Homo sapiens
aacaggaaagagctagg

SEQ ID NO: 4866226 - DNA, 20 bp, Homo sapiens
aacagtatgtgggatattga

SEQ ID NO: 4866227 - DNA, 14 bp, Homo sapiens
aacagtggatcaca

SEQ ID NO: 4866228 - DNA, 13 bp, Homo sapiens
aacatctctgaat

SEQ ID NO: 4866229 - DNA, 14 bp, Homo sapiens
aacatgccctgttc

SEQ ID NO: 4866230 - DNA, 22 bp, Homo sapiens
aacatgttaatgacaatattcc

SEQ ID NO: 4866231 - DNA, 23 bp, Homo sapiens
aacattaatgcctgctttttgga

SEQ ID NO: 4866232 - DNA, 13 bp, Homo sapiens
aacatttgctgcc

SEQ ID NO: 4866233 - DNA, 14 bp, Homo sapiens
aaccacgcaggaag

SEQ ID NO: 4866234 - DNA, 18 bp, Homo sapiens
aaccaggtccagatgtgc

SEQ ID NO: 4866235 - DNA, 14 bp, Homo sapiens
aaccataaattcaa

SEQ ID NO: 4866236 - DNA, 14 bp, Homo sapiens
aaccattaaagtca

SEQ ID NO: 4866237 - DNA, 17 bp, Homo sapiens
aaccatttttgaacctt

SEQ ID NO: 4866238 - DNA, 11 bp, Homo sapiens
aacccagtctt

SEQ ID NO: 4866239 - DNA, 23 bp, Homo sapiens
aacccattaaggggaagaatgaa

SEQ ID NO: 4866240 - DNA, 17 bp, Homo sapiens
aacccattcactacagg

SEQ ID NO: 4866241 - DNA, 17 bp, Homo sapiens
aaccccaagcttcccaa

SEQ ID NO: 4866242 - DNA, 16 bp, Homo sapiens
aaccccaagttagttc

SEQ ID NO: 4866243 - DNA, 11 bp, Homo sapiens
aaccctggagg

SEQ ID NO: 4866244 - DNA, 20 bp, Homo sapiens
aacctacagttttaactgtg

SEQ ID NO: 4866245 - DNA, 17 bp, Homo sapiens
aacctctaagtgctgct

SEQ ID NO: 4866246 - DNA, 16 bp, Homo sapiens
aacctgccaaggagca

SEQ ID NO: 4866247 - DNA, 22 bp, Homo sapiens
aacctgtgaccagtctgaccct

SEQ ID NO: 4866248 - DNA, 17 bp, Homo sapiens
aacgaaaacctgactag

SEQ ID NO: 4866249 - DNA, 16 bp, Homo sapiens
aacgaagagttccctt

SEQ ID NO: 4866250 - DNA, 23 bp, Homo sapiens
aacgaagagttcccttgaaactt

SEQ ID NO: 4866251 - DNA, 20 bp, Homo sapiens
aacgctctaggtacgatgac

SEQ ID NO: 4866252 - DNA, 12 bp, Homo sapiens
aacgctttcccc

SEQ ID NO: 4866253 - DNA, 19 bp, Homo sapiens
aacgtcctctttagttttt

SEQ ID NO: 4866254 - DNA, 16 bp, Homo sapiens
aacgtggctctgctgg

SEQ ID NO: 4866255 - DNA, 13 bp, Homo sapiens
aactaaatttcac

SEQ ID NO: 4866256 - DNA, 13 bp, Homo sapiens
aactaggctctta

SEQ ID NO: 4866257 - DNA, 15 bp, Homo sapiens
aactatatataatgt

SEQ ID NO: 4866258 - DNA, 16 bp, Homo sapiens
aactatatataatgta

SEQ ID NO: 4866259 - DNA, 18 bp, Homo sapiens
aactatcttctttggact

SEQ ID NO: 4866260 - DNA, 19 bp, Homo sapiens
aactatcttctttggactt

SEQ ID NO: 4866261 - DNA, 21 bp, Homo sapiens
aactattgtgctcagagacac

SEQ ID NO: 4866262 - DNA, 14 bp, Homo sapiens
aactcaggcaaaga

SEQ ID NO: 4866263 - DNA, 15 bp, Homo sapiens
aactcaggcaaagaa

SEQ ID NO: 4866264 - DNA, 17 bp, Homo sapiens
aactcaggcaaagaaaa

SEQ ID NO: 4866265 - DNA, 18 bp, Homo sapiens
aactcattttcatattgt

SEQ ID NO: 4866266 - DNA, 12 bp, Homo sapiens
aactccaggcat

SEQ ID NO: 4866267 - DNA, 14 bp, Homo sapiens
aactccaggctgga

SEQ ID NO: 4866268 - DNA, 16 bp, Homo sapiens
aactccaggctggaag

SEQ ID NO: 4866269 - DNA, 17 bp, Homo sapiens
aactctacccctgctcc

SEQ ID NO: 4866270 - DNA, 14 bp, Homo sapiens
aactctgttccccc

SEQ ID NO: 4866271 - DNA, 19 bp, Homo sapiens
aactctgttcccccaccct

SEQ ID NO: 4866272 - DNA, 13 bp, Homo sapiens
aactgaatttgga

SEQ ID NO: 4866273 - DNA, 14 bp, Homo sapiens
aactgaatttggag

SEQ ID NO: 4866274 - DNA, 21 bp, Homo sapiens
aactgaggcccagagagggaa

SEQ ID NO: 4866275 - DNA, 18 bp, Homo sapiens
aactgtccgtaagcagta

SEQ ID NO: 4866276 - DNA, 16 bp, Homo sapiens
aacttcagcattgtaa

SEQ ID NO: 4866277 - DNA, 23 bp, Homo sapiens
aacttcagcattgtaattatgta

SEQ ID NO: 4866278 - DNA, 14 bp, Homo sapiens
aacttcatgtaatt

SEQ ID NO: 4866279 - DNA, 16 bp, Homo sapiens
aacttcatgtaatttt

SEQ ID NO: 4866280 - DNA, 16 bp, Homo sapiens
aacttccaaataaata

SEQ ID NO: 4866281 - DNA, 23 bp, Homo sapiens
aacttggggaaggggcctgggct

SEQ ID NO: 4866282 - DNA, 13 bp, Homo sapiens
aacttggggaggc

SEQ ID NO: 4866283 - DNA, 18 bp, Homo sapiens
aactttccagtcttagct

SEQ ID NO: 4866284 - DNA, 20 bp, Homo sapiens
aactttccagtcttagctga

SEQ ID NO: 4866285 - DNA, 22 bp, Homo sapiens
aactttgggaaaacatgttaat

SEQ ID NO: 4866286 - DNA, 15 bp, Homo sapiens
aactttgtcagtgtt

SEQ ID NO: 4866287 - DNA, 18 bp, Homo sapiens
aagaaaaaaaaaaaagcc

SEQ ID NO: 4866288 - DNA, 14 bp, Homo sapiens
aagaaaacccaccc

SEQ ID NO: 4866289 - DNA, 15 bp, Homo sapiens
aagaaaatctttata

SEQ ID NO: 4866290 - DNA, 15 bp, Homo sapiens
aagaaacaaagatgt

SEQ ID NO: 4866291 - DNA, 12 bp, Homo sapiens
aagaaagcttcc

SEQ ID NO: 4866292 - DNA, 19 bp, Homo sapiens
aagaaataatgctacaatt

SEQ ID NO: 4866293 - DNA, 22 bp, Homo sapiens
aagaaccactccttcatgtttg

SEQ ID NO: 4866294 - DNA, 23 bp, Homo sapiens
aagaactattgtgctcagagaca

SEQ ID NO: 4866295 - DNA, 17 bp, Homo sapiens
aagaactttaaattgtg

SEQ ID NO: 4866296 - DNA, 12 bp, Homo sapiens
aagaagaaagct

SEQ ID NO: 4866297 - DNA, 22 bp, Homo sapiens
aagaagagcgagagatcaaaga

SEQ ID NO: 4866298 - DNA, 12 bp, Homo sapiens
aagaagatgagc

SEQ ID NO: 4866299 - DNA, 14 bp, Homo sapiens
aagaaggatgatgt

SEQ ID NO: 4866300 - DNA, 13 bp, Homo sapiens
aagaaggccagag

SEQ ID NO: 4866301 - DNA, 15 bp, Homo sapiens
aagaaggccagagag

SEQ ID NO: 4866302 - DNA, 15 bp, Homo sapiens
aagaagtgcatgaaa

SEQ ID NO: 4866303 - DNA, 17 bp, Homo sapiens
aagaagttcatgtccaa

SEQ ID NO: 4866304 - DNA, 11 bp, Homo sapiens
aagaatagaac

SEQ ID NO: 4866305 - DNA, 13 bp, Homo sapiens
aagaatgaaagct

SEQ ID NO: 4866306 - DNA, 17 bp, Homo sapiens
aagaatgaaagctgttc

SEQ ID NO: 4866307 - DNA, 19 bp, Homo sapiens
aagaatgaaagctgttcct

SEQ ID NO: 4866308 - DNA, 16 bp, Homo sapiens
aagaatgttagagtaa

SEQ ID NO: 4866309 - DNA, 20 bp, Homo sapiens
aagaattctgattgatttga

SEQ ID NO: 4866310 - DNA, 14 bp, Homo sapiens
aagacaggagacaa

SEQ ID NO: 4866311 - DNA, 18 bp, Homo sapiens
aagacaggagacaaaaga

SEQ ID NO: 4866312 - DNA, 23 bp, Homo sapiens
aagacggtattaaaatggagcga

SEQ ID NO: 4866313 - DNA, 14 bp, Homo sapiens
aagactatatatat

SEQ ID NO: 4866314 - DNA, 14 bp, Homo sapiens
aagactgagccaga

SEQ ID NO: 4866315 - DNA, 14 bp, Homo sapiens
aagactggatttgc

SEQ ID NO: 4866316 - DNA, 16 bp, Homo sapiens
aagactggcccagtgc

SEQ ID NO: 4866317 - DNA, 22 bp, Homo sapiens
aagactggcccagtgccagcaa

SEQ ID NO: 4866318 - DNA, 15 bp, Homo sapiens
aagagaaacctgcca

SEQ ID NO: 4866319 - DNA, 16 bp, Homo sapiens
aagagaatgagtcctt

SEQ ID NO: 4866320 - DNA, 15 bp, Homo sapiens
aagagacatccaaat

SEQ ID NO: 4866321 - DNA, 12 bp, Homo sapiens
aagagaggactg

SEQ ID NO: 4866322 - DNA, 12 bp, Homo sapiens
aagagcatcctg

SEQ ID NO: 4866323 - DNA, 13 bp, Homo sapiens
aagagcatcctga

SEQ ID NO: 4866324 - DNA, 21 bp, Homo sapiens
aagagcgagagatcaaagatg

SEQ ID NO: 4866325 - DNA, 20 bp, Homo sapiens
aagagggacataagataaaa

SEQ ID NO: 4866326 - DNA, 23 bp, Homo sapiens
aagagggacataagataaaatga

SEQ ID NO: 4866327 - DNA, 16 bp, Homo sapiens
aagagggactccaagc

SEQ ID NO: 4866328 - DNA, 23 bp, Homo sapiens
aagagggactccaagccctgggg

SEQ ID NO: 4866329 - DNA, 13 bp, Homo sapiens
aagagtcagacat

SEQ ID NO: 4866330 - DNA, 18 bp, Homo sapiens
aagagtcagacatttctt

SEQ ID NO: 4866331 - DNA, 19 bp, Homo sapiens
aagagtcagacatttcttt

SEQ ID NO: 4866332 - DNA, 18 bp, Homo sapiens
aagataaagaccagaaat

SEQ ID NO: 4866333 - DNA, 20 bp, Homo sapiens
aagatctttatatttcaata

SEQ ID NO: 4866334 - DNA, 22 bp, Homo sapiens
aagatgagccttgcagatatct

SEQ ID NO: 4866335 - DNA, 23 bp, Homo sapiens
aagatgcatcatctcttcctcac

SEQ ID NO: 4866336 - DNA, 23 bp, Homo sapiens
aagatgtctcaggtttgttttgt

SEQ ID NO: 4866337 - DNA, 16 bp, Homo sapiens
aagatgtgttcttatt

SEQ ID NO: 4866338 - DNA, 20 bp, Homo sapiens
aagatgttatggtgtttaga

SEQ ID NO: 4866339 - DNA, 11 bp, Homo sapiens
aagattctatg

SEQ ID NO: 4866340 - DNA, 22 bp, Homo sapiens
aagattctatgttaatatttta

SEQ ID NO: 4866341 - DNA, 23 bp, Homo sapiens
aagattggtctcccatatgcaga

SEQ ID NO: 4866342 - DNA, 21 bp, Homo sapiens
aagcaaactctaaaattataa

SEQ ID NO: 4866343 - DNA, 13 bp, Homo sapiens
aagcaaaggtgca

SEQ ID NO: 4866344 - DNA, 23 bp, Homo sapiens
aagcaaaggtgcactccagactc

SEQ ID NO: 4866345 - DNA, 17 bp, Homo sapiens
aagcaaattgctttttt

SEQ ID NO: 4866346 - DNA, 19 bp, Homo sapiens
aagcaaccacactgcttgg

SEQ ID NO: 4866347 - DNA, 22 bp, Homo sapiens
aagcaagaggcaagctgaaatt

SEQ ID NO: 4866348 - DNA, 13 bp, Homo sapiens
aagcaatggttga

SEQ ID NO: 4866349 - DNA, 13 bp, Homo sapiens
aagcacaagactg

SEQ ID NO: 4866350 - DNA, 19 bp, Homo sapiens
aagcacaatttaaaacaat

SEQ ID NO: 4866351 - DNA, 14 bp, Homo sapiens
aagcaccaacctcc

SEQ ID NO: 4866352 - DNA, 13 bp, Homo sapiens
aagcactggcctt

SEQ ID NO: 4866353 - DNA, 14 bp, Homo sapiens
aagcagagttttca

SEQ ID NO: 4866354 - DNA, 11 bp, Homo sapiens
aagcagatgac

SEQ ID NO: 4866355 - DNA, 13 bp, Homo sapiens
aagcagtattttg

SEQ ID NO: 4866356 - DNA, 22 bp, Homo sapiens
aagcatagataatattgtttgg

SEQ ID NO: 4866357 - DNA, 14 bp, Homo sapiens
aagcatggacattt

SEQ ID NO: 4866358 - DNA, 20 bp, Homo sapiens
aagcatgtgatgttgtctta

SEQ ID NO: 4866359 - DNA, 16 bp, Homo sapiens
aagccacagcagagca

SEQ ID NO: 4866360 - DNA, 16 bp, Homo sapiens
aagccaccgggagatt

SEQ ID NO: 4866361 - DNA, 17 bp, Homo sapiens
aagccaggctcaggaga

SEQ ID NO: 4866362 - DNA, 20 bp, Homo sapiens
aagccatagatgctggctgg

SEQ ID NO: 4866363 - DNA, 16 bp, Homo sapiens
aagccctggggcaggg

SEQ ID NO: 4866364 - DNA, 15 bp, Homo sapiens
aagccgcagacctgg

SEQ ID NO: 4866365 - DNA, 16 bp, Homo sapiens
aagccgcagacctgga

SEQ ID NO: 4866366 - DNA, 18 bp, Homo sapiens
aagccgcagacctggagc

SEQ ID NO: 4866367 - DNA, 21 bp, Homo sapiens
aagccggcctgagaaacacta

SEQ ID NO: 4866368 - DNA, 12 bp, Homo sapiens
aagcctgacaac

SEQ ID NO: 4866369 - DNA, 15 bp, Homo sapiens
aagcctgcctcccaa

SEQ ID NO: 4866370 - DNA, 13 bp, Homo sapiens
aagccttcaaaac

SEQ ID NO: 4866371 - DNA, 18 bp, Homo sapiens
aagctgaaattttagaaa

SEQ ID NO: 4866372 - DNA, 22 bp, Homo sapiens
aagctgaaattttagaaatatt

SEQ ID NO: 4866373 - DNA, 19 bp, Homo sapiens
aagctgaggaggtgctgca

SEQ ID NO: 4866374 - DNA, 18 bp, Homo sapiens
aagctgccgtagcttcag

SEQ ID NO: 4866375 - DNA, 23 bp, Homo sapiens
aagctgccgtagcttcagccagg

SEQ ID NO: 4866376 - DNA, 13 bp, Homo sapiens
aagctggagcagc

SEQ ID NO: 4866377 - DNA, 13 bp, Homo sapiens
aagctggcacaaa

SEQ ID NO: 4866378 - DNA, 21 bp, Homo sapiens
aagctggcacaaaagacagct

SEQ ID NO: 4866379 - DNA, 15 bp, Homo sapiens
aagctgtatcactgc

SEQ ID NO: 4866380 - DNA, 23 bp, Homo sapiens
aagctgtgtctgcccaatgaata

SEQ ID NO: 4866381 - DNA, 21 bp, Homo sapiens
aagctgtttggaaaagacagt

SEQ ID NO: 4866382 - DNA, 16 bp, Homo sapiens
aagcttcagttgcttg

SEQ ID NO: 4866383 - DNA, 13 bp, Homo sapiens
aagctttttggaa

SEQ ID NO: 4866384 - DNA, 20 bp, Homo sapiens
aaggaaaagaaaacaaaaaa

SEQ ID NO: 4866385 - DNA, 13 bp, Homo sapiens
aaggaaattttac

SEQ ID NO: 4866386 - DNA, 12 bp, Homo sapiens
aaggagaaatga

SEQ ID NO: 4866387 - DNA, 15 bp, Homo sapiens
aaggagaatggcatg

SEQ ID NO: 4866388 - DNA, 13 bp, Homo sapiens
aaggagcatcctt

SEQ ID NO: 4866389 - DNA, 13 bp, Homo sapiens
aaggataaagaag

SEQ ID NO: 4866390 - DNA, 19 bp, Homo sapiens
aaggataaatcataaagtc

SEQ ID NO: 4866391 - DNA, 15 bp, Homo sapiens
aaggatagtaagcat

SEQ ID NO: 4866392 - DNA, 19 bp, Homo sapiens
aaggatgatgtctttttat

SEQ ID NO: 4866393 - DNA, 14 bp, Homo sapiens
aaggcagggccctg

SEQ ID NO: 4866394 - DNA, 18 bp, Homo sapiens
aaggcaggggaatgtatg

SEQ ID NO: 4866395 - DNA, 18 bp, Homo sapiens
aaggcaggtgcttttggc

SEQ ID NO: 4866396 - DNA, 15 bp, Homo sapiens
aaggcattctcccag

SEQ ID NO: 4866397 - DNA, 19 bp, Homo sapiens
aaggcattctcccagctct

SEQ ID NO: 4866398 - DNA, 15 bp, Homo sapiens
aaggccagagaggga

SEQ ID NO: 4866399 - DNA, 16 bp, Homo sapiens
aaggcccttagaggga

SEQ ID NO: 4866400 - DNA, 18 bp, Homo sapiens
aaggcccttagagggaat

SEQ ID NO: 4866401 - DNA, 21 bp, Homo sapiens
aaggcctgcttgactttccag

SEQ ID NO: 4866402 - DNA, 22 bp, Homo sapiens
aaggcctgcttgactttccaga

SEQ ID NO: 4866403 - DNA, 19 bp, Homo sapiens
aaggctctcacccccatcc

SEQ ID NO: 4866404 - DNA, 16 bp, Homo sapiens
aaggctcttcttcctc

SEQ ID NO: 4866405 - DNA, 22 bp, Homo sapiens
aaggctgagacagtgaatttgg

SEQ ID NO: 4866406 - DNA, 15 bp, Homo sapiens
aagggaaagtttttt

SEQ ID NO: 4866407 - DNA, 12 bp, Homo sapiens
aagggacagcaa

SEQ ID NO: 4866408 - DNA, 12 bp, Homo sapiens
aagggatatttt

SEQ ID NO: 4866409 - DNA, 16 bp, Homo sapiens
aagggcaaggggtgag

SEQ ID NO: 4866410 - DNA, 21 bp, Homo sapiens
aagggcataaagtaaatacat

SEQ ID NO: 4866411 - DNA, 21 bp, Homo sapiens
aagggccagcgtggctctaaa

SEQ ID NO: 4866412 - DNA, 15 bp, Homo sapiens
aaggggcctgggctg

SEQ ID NO: 4866413 - DNA, 11 bp, Homo sapiens
aaggggctggt

SEQ ID NO: 4866414 - DNA, 18 bp, Homo sapiens
aaggggctggtggagatg

SEQ ID NO: 4866415 - DNA, 14 bp, Homo sapiens
aagggggctgctgc

SEQ ID NO: 4866416 - DNA, 15 bp, Homo sapiens
aagggggctgctgct

SEQ ID NO: 4866417 - DNA, 11 bp, Homo sapiens
aagggtcaggg

SEQ ID NO: 4866418 - DNA, 13 bp, Homo sapiens
aaggtaatgtgtg

SEQ ID NO: 4866419 - DNA, 16 bp, Homo sapiens
aaggtattatacatgt

SEQ ID NO: 4866420 - DNA, 22 bp, Homo sapiens
aaggtattatacatgtgataca

SEQ ID NO: 4866421 - DNA, 12 bp, Homo sapiens
aaggtgaacttt

SEQ ID NO: 4866422 - DNA, 17 bp, Homo sapiens
aaggtgagcataaatca

SEQ ID NO: 4866423 - DNA, 15 bp, Homo sapiens
aaggtgcactccaga

SEQ ID NO: 4866424 - DNA, 18 bp, Homo sapiens
aaggtggcctctgcctgg

SEQ ID NO: 4866425 - DNA, 17 bp, Homo sapiens
aaggttgaataatatat

SEQ ID NO: 4866426 - DNA, 23 bp, Homo sapiens
aagtacagggcagaaccaagaac

SEQ ID NO: 4866427 - DNA, 20 bp, Homo sapiens
aagtacaggtcatctgctgg

SEQ ID NO: 4866428 - DNA, 20 bp, Homo sapiens
aagtataaaatagtatgaaa

SEQ ID NO: 4866429 - DNA, 22 bp, Homo sapiens
aagtataaaatagtatgaaaat

SEQ ID NO: 4866430 - DNA, 20 bp, Homo sapiens
aagtataatgtttattaaat

SEQ ID NO: 4866431 - DNA, 15 bp, Homo sapiens
aagtatacataagtt

SEQ ID NO: 4866432 - DNA, 12 bp, Homo sapiens
aagtatattaaa

SEQ ID NO: 4866433 - DNA, 14 bp, Homo sapiens
aagtatattaaaca

SEQ ID NO: 4866434 - DNA, 21 bp, Homo sapiens
aagtatgtatattaaaaaaga

SEQ ID NO: 4866435 - DNA, 16 bp, Homo sapiens
aagtcaccaaatagtg

SEQ ID NO: 4866436 - DNA, 12 bp, Homo sapiens
aagtcagaagtt

SEQ ID NO: 4866437 - DNA, 16 bp, Homo sapiens
aagtcagaatcagaag

SEQ ID NO: 4866438 - DNA, 13 bp, Homo sapiens
aagtcagaatttt

SEQ ID NO: 4866439 - DNA, 20 bp, Homo sapiens
aagtcagttgctcaaaaaga

SEQ ID NO: 4866440 - DNA, 20 bp, Homo sapiens
aagtctcataggttaaaaaa

SEQ ID NO: 4866441 - DNA, 17 bp, Homo sapiens
aagtctccagaagaaaa

SEQ ID NO: 4866442 - DNA, 18 bp, Homo sapiens
aagtctccagaagaaaat

SEQ ID NO: 4866443 - DNA, 17 bp, Homo sapiens
aagtcttctatttattt

SEQ ID NO: 4866444 - DNA, 14 bp, Homo sapiens
aagtgaattgaagt

SEQ ID NO: 4866445 - DNA, 17 bp, Homo sapiens
aagtgatctgtgttcaa

SEQ ID NO: 4866446 - DNA, 14 bp, Homo sapiens
aagtgcatgaaaaa

SEQ ID NO: 4866447 - DNA, 17 bp, Homo sapiens
aagtgcatgaaaaacca

SEQ ID NO: 4866448 - DNA, 13 bp, Homo sapiens
aagtgcctgggct

SEQ ID NO: 4866449 - DNA, 15 bp, Homo sapiens
aagtgcctgggctca

SEQ ID NO: 4866450 - DNA, 14 bp, Homo sapiens
aagtgctgctgtgg

SEQ ID NO: 4866451 - DNA, 16 bp, Homo sapiens
aagtgctgctgtggag

SEQ ID NO: 4866452 - DNA, 23 bp, Homo sapiens
aagtgctgctgtggagtgaggtg

SEQ ID NO: 4866453 - DNA, 19 bp, Homo sapiens
aagtggtaattgggaactg

SEQ ID NO: 4866454 - DNA, 15 bp, Homo sapiens
aagtgtgctgggcag

SEQ ID NO: 4866455 - DNA, 20 bp, Homo sapiens
aagtgtgctgggcagaggga

SEQ ID NO: 4866456 - DNA, 16 bp, Homo sapiens
aagtgtgtatatattt

SEQ ID NO: 4866457 - DNA, 21 bp, Homo sapiens
aagtgtgtatatattttgtgt

SEQ ID NO: 4866458 - DNA, 14 bp, Homo sapiens
aagtgttcattgtt

SEQ ID NO: 4866459 - DNA, 22 bp, Homo sapiens
aagtgttgtatcaaagtgtgat

SEQ ID NO: 4866460 - DNA, 15 bp, Homo sapiens
aagtgtttatgttgt

SEQ ID NO: 4866461 - DNA, 21 bp, Homo sapiens
aagttcatattccatatttat

SEQ ID NO: 4866462 - DNA, 22 bp, Homo sapiens
aagttcatattccatatttatt

SEQ ID NO: 4866463 - DNA, 23 bp, Homo sapiens
aagttcatattccatatttattc

SEQ ID NO: 4866464 - DNA, 15 bp, Homo sapiens
aagttttaaagttca

SEQ ID NO: 4866465 - DNA, 17 bp, Homo sapiens
aagttttactgataatt

SEQ ID NO: 4866466 - DNA, 13 bp, Homo sapiens
aagttttatatgc

SEQ ID NO: 4866467 - DNA, 12 bp, Homo sapiens
aagttttgttgt

SEQ ID NO: 4866468 - DNA, 22 bp, Homo sapiens
aagttttgttgtacttaaatgg

SEQ ID NO: 4866469 - DNA, 11 bp, Homo sapiens
aataaaaatat

SEQ ID NO: 4866470 - DNA, 22 bp, Homo sapiens
aataaaagtggtaattgggaac

SEQ ID NO: 4866471 - DNA, 20 bp, Homo sapiens
aataaaatatatcttataaa

SEQ ID NO: 4866472 - DNA, 15 bp, Homo sapiens
aataaagatgagttg

SEQ ID NO: 4866473 - DNA, 14 bp, Homo sapiens
aataaagtacttga

SEQ ID NO: 4866474 - DNA, 18 bp, Homo sapiens
aataaataaaaactaatt

SEQ ID NO: 4866475 - DNA, 16 bp, Homo sapiens
aataaataattttcat

SEQ ID NO: 4866476 - DNA, 19 bp, Homo sapiens
aataaatttaaacttacaa

SEQ ID NO: 4866477 - DNA, 15 bp, Homo sapiens
aataactgaatttgg

SEQ ID NO: 4866478 - DNA, 19 bp, Homo sapiens
aataagcactgtaaacttc

SEQ ID NO: 4866479 - DNA, 21 bp, Homo sapiens
aataatgctacaattttaaga

SEQ ID NO: 4866480 - DNA, 16 bp, Homo sapiens
aataatgtaacatgat

SEQ ID NO: 4866481 - DNA, 18 bp, Homo sapiens
aataatgtaacatgattt

SEQ ID NO: 4866482 - DNA, 14 bp, Homo sapiens
aataatttgaactt

SEQ ID NO: 4866483 - DNA, 15 bp, Homo sapiens
aatacacatttgcta

SEQ ID NO: 4866484 - DNA, 18 bp, Homo sapiens
aatacatgccacatcaaa

SEQ ID NO: 4866485 - DNA, 21 bp, Homo sapiens
aataccacatcaaataagaaa

SEQ ID NO: 4866486 - DNA, 15 bp, Homo sapiens
aataccatttagtaa

SEQ ID NO: 4866487 - DNA, 20 bp, Homo sapiens
aatacccgtcctctcggctg

SEQ ID NO: 4866488 - DNA, 13 bp, Homo sapiens
aatacgtttgtgt

SEQ ID NO: 4866489 - DNA, 15 bp, Homo sapiens
aatactactactgtt

SEQ ID NO: 4866490 - DNA, 22 bp, Homo sapiens
aatactgccaaaacatttatga

SEQ ID NO: 4866491 - DNA, 19 bp, Homo sapiens
aatactgcttaattgctga

SEQ ID NO: 4866492 - DNA, 17 bp, Homo sapiens
aatagtatgaaaatgga

SEQ ID NO: 4866493 - DNA, 12 bp, Homo sapiens
aatataaaaaat

SEQ ID NO: 4866494 - DNA, 21 bp, Homo sapiens
aatatatttataaggaaattt

SEQ ID NO: 4866495 - DNA, 20 bp, Homo sapiens
aatatcaaagtcattaaaga

SEQ ID NO: 4866496 - DNA, 17 bp, Homo sapiens
aatatccctacatgtat

SEQ ID NO: 4866497 - DNA, 22 bp, Homo sapiens
aatatcccttggacattttatg

SEQ ID NO: 4866498 - DNA, 12 bp, Homo sapiens
aatatgaatgaa

SEQ ID NO: 4866499 - DNA, 13 bp, Homo sapiens
aatatgaatgaat

SEQ ID NO: 4866500 - DNA, 16 bp, Homo sapiens
aatattccagatcttt

SEQ ID NO: 4866501 - DNA, 20 bp, Homo sapiens
aatattcctttgcatattat

SEQ ID NO: 4866502 - DNA, 21 bp, Homo sapiens
aatattcctttgcatattata

SEQ ID NO: 4866503 - DNA, 17 bp, Homo sapiens
aatattgacttgtatat

SEQ ID NO: 4866504 - DNA, 20 bp, Homo sapiens
aatattgtttggtaaatgtt

SEQ ID NO: 4866505 - DNA, 12 bp, Homo sapiens
aatatttaagac

SEQ ID NO: 4866506 - DNA, 11 bp, Homo sapiens
aatatttattt

SEQ ID NO: 4866507 - DNA, 22 bp, Homo sapiens
aatcaaagccggcctgagaaac

SEQ ID NO: 4866508 - DNA, 13 bp, Homo sapiens
aatcaaattctgt

SEQ ID NO: 4866509 - DNA, 14 bp, Homo sapiens
aatcactgtgctat

SEQ ID NO: 4866510 - DNA, 17 bp, Homo sapiens
aatcatgccagtatttt

SEQ ID NO: 4866511 - DNA, 14 bp, Homo sapiens
aatcattcagaaat

SEQ ID NO: 4866512 - DNA, 17 bp, Homo sapiens
aatccatccatgtactt

SEQ ID NO: 4866513 - DNA, 24 bp, Homo sapiens
aatccatttcaggactctctccag

SEQ ID NO: 4866514 - DNA, 14 bp, Homo sapiens
aatcccctaaaata

SEQ ID NO: 4866515 - DNA, 17 bp, Homo sapiens
aatcccctaaaataaca

SEQ ID NO: 4866516 - DNA, 22 bp, Homo sapiens
aatcctagactgctcctgggca

SEQ ID NO: 4866517 - DNA, 23 bp, Homo sapiens
aatccttactaagtaggtgatga

SEQ ID NO: 4866518 - DNA, 15 bp, Homo sapiens
aatctaagtgatata

SEQ ID NO: 4866519 - DNA, 17 bp, Homo sapiens
aatctaagtgatataaa

SEQ ID NO: 4866520 - DNA, 22 bp, Homo sapiens
aatctatgaacctgaaaagggt

SEQ ID NO: 4866521 - DNA, 22 bp, Homo sapiens
aatctcaaataggctattaaaa

SEQ ID NO: 4866522 - DNA, 19 bp, Homo sapiens
aatctggatgcctcattat

SEQ ID NO: 4866523 - DNA, 17 bp, Homo sapiens
aatctggattcatattt

SEQ ID NO: 4866524 - DNA, 17 bp, Homo sapiens
aatctgtacaaaatggt

SEQ ID NO: 4866525 - DNA, 17 bp, Homo sapiens
aatcttcaaagccttct

SEQ ID NO: 4866526 - DNA, 12 bp, Homo sapiens
aatcttcctggc

SEQ ID NO: 4866527 - DNA, 17 bp, Homo sapiens
aatcttcctggcacaat

SEQ ID NO: 4866528 - DNA, 23 bp, Homo sapiens
aatctttgtaccaaaattttaaa

SEQ ID NO: 4866529 - DNA, 13 bp, Homo sapiens
aatcttttcttat

SEQ ID NO: 4866530 - DNA, 16 bp, Homo sapiens
aatgaaagaaaattga

SEQ ID NO: 4866531 - DNA, 17 bp, Homo sapiens
aatgaaccataaattca

SEQ ID NO: 4866532 - DNA, 18 bp, Homo sapiens
aatgaaccataaattcaa

SEQ ID NO: 4866533 - DNA, 20 bp, Homo sapiens
aatgaactttgtcagtgttg

SEQ ID NO: 4866534 - DNA, 23 bp, Homo sapiens
aatgaactttgtcagtgttgcct

SEQ ID NO: 4866535 - DNA, 16 bp, Homo sapiens
aatgaagcagtatttt

SEQ ID NO: 4866536 - DNA, 23 bp, Homo sapiens
aatgaatgggatattttgaaatg

SEQ ID NO: 4866537 - DNA, 15 bp, Homo sapiens
aatgactcaaagtct

SEQ ID NO: 4866538 - DNA, 14 bp, Homo sapiens
aatgagctctgaaa

SEQ ID NO: 4866539 - DNA, 17 bp, Homo sapiens
aatgagcttgattaaat

SEQ ID NO: 4866540 - DNA, 17 bp, Homo sapiens
aatgaggaaaattctta

SEQ ID NO: 4866541 - DNA, 19 bp, Homo sapiens
aatgaggatccagggcagc

SEQ ID NO: 4866542 - DNA, 22 bp, Homo sapiens
aatgaggatccagggcagcagg

SEQ ID NO: 4866543 - DNA, 20 bp, Homo sapiens
aatgatcagcaaaaagactg

SEQ ID NO: 4866544 - DNA, 12 bp, Homo sapiens
aatgatgttata

SEQ ID NO: 4866545 - DNA, 14 bp, Homo sapiens
aatgcatacaagtt

SEQ ID NO: 4866546 - DNA, 23 bp, Homo sapiens
aatgcatatttgcaaagtgtatt

SEQ ID NO: 4866547 - DNA, 14 bp, Homo sapiens
aatgccccagtgtt

SEQ ID NO: 4866548 - DNA, 15 bp, Homo sapiens
aatgcccctgttcat

SEQ ID NO: 4866549 - DNA, 19 bp, Homo sapiens
aatgcccctgttcatgttt

SEQ ID NO: 4866550 - DNA, 17 bp, Homo sapiens
aatgcctgctttttgga

SEQ ID NO: 4866551 - DNA, 21 bp, Homo sapiens
aatgcctgctttttggaaagt

SEQ ID NO: 4866552 - DNA, 16 bp, Homo sapiens
aatgctaaatgtgtaa

SEQ ID NO: 4866553 - DNA, 17 bp, Homo sapiens
aatgctcccacctgaat

SEQ ID NO: 4866554 - DNA, 21 bp, Homo sapiens
aatgctcccacctgaatttgt

SEQ ID NO: 4866555 - DNA, 20 bp, Homo sapiens
aatgcttgcatggagaatgg

SEQ ID NO: 4866556 - DNA, 14 bp, Homo sapiens
aatgcttttagtgt

SEQ ID NO: 4866557 - DNA, 20 bp, Homo sapiens
aatggaaaatgccatgaatt

SEQ ID NO: 4866558 - DNA, 20 bp, Homo sapiens
aatggaggatctctaaagag

SEQ ID NO: 4866559 - DNA, 16 bp, Homo sapiens
aatggcatggcaggag

SEQ ID NO: 4866560 - DNA, 17 bp, Homo sapiens
aatggcatggcaggagt

SEQ ID NO: 4866561 - DNA, 19 bp, Homo sapiens
aatggccacaaacctgccc

SEQ ID NO: 4866562 - DNA, 17 bp, Homo sapiens
aatggcctggagcaggc

SEQ ID NO: 4866563 - DNA, 18 bp, Homo sapiens
aatggcctggagcaggcc

SEQ ID NO: 4866564 - DNA, 19 bp, Homo sapiens
aatggcctgtccctagggc

SEQ ID NO: 4866565 - DNA, 16 bp, Homo sapiens
aatgggaatattttat

SEQ ID NO: 4866566 - DNA, 18 bp, Homo sapiens
aatggttaatttttcctg

SEQ ID NO: 4866567 - DNA, 17 bp, Homo sapiens
aatggttgatgatactt

SEQ ID NO: 4866568 - DNA, 13 bp, Homo sapiens
aatgtaacatgat

SEQ ID NO: 4866569 - DNA, 15 bp, Homo sapiens
aatgtataaatatac

SEQ ID NO: 4866570 - DNA, 16 bp, Homo sapiens
aatgtataaatataca

SEQ ID NO: 4866571 - DNA, 19 bp, Homo sapiens
aatgtcagttgttatttat

SEQ ID NO: 4866572 - DNA, 20 bp, Homo sapiens
aatgtccaaaatttatattt

SEQ ID NO: 4866573 - DNA, 16 bp, Homo sapiens
aatgtccagccacccc

SEQ ID NO: 4866574 - DNA, 15 bp, Homo sapiens
aatgtgcaatagaag

SEQ ID NO: 4866575 - DNA, 22 bp, Homo sapiens
aatgtgctggtgaacactgtga

SEQ ID NO: 4866576 - DNA, 16 bp, Homo sapiens
aatgtgtgagaaaaac

SEQ ID NO: 4866577 - DNA, 18 bp, Homo sapiens
aatgtgtgagaaaaacta

SEQ ID NO: 4866578 - DNA, 12 bp, Homo sapiens
aatgttagagta

SEQ ID NO: 4866579 - DNA, 14 bp, Homo sapiens
aatgttctttctgc

SEQ ID NO: 4866580 - DNA, 19 bp, Homo sapiens
aatgttggagcagcaggcc

SEQ ID NO: 4866581 - DNA, 16 bp, Homo sapiens
aattaaaaaaaaattg

SEQ ID NO: 4866582 - DNA, 23 bp, Homo sapiens
aattaagaaatactcatgtgcaa

SEQ ID NO: 4866583 - DNA, 14 bp, Homo sapiens
aattaaggaaatgt

SEQ ID NO: 4866584 - DNA, 13 bp, Homo sapiens
aattaatttggag

SEQ ID NO: 4866585 - DNA, 14 bp, Homo sapiens
aattacctgtggat

SEQ ID NO: 4866586 - DNA, 23 bp, Homo sapiens
aattactttggggctaatttaac

SEQ ID NO: 4866587 - DNA, 19 bp, Homo sapiens
aattatgcaattcagtgtt

SEQ ID NO: 4866588 - DNA, 17 bp, Homo sapiens
aattatgtaaataactc

SEQ ID NO: 4866589 - DNA, 11 bp, Homo sapiens
aattatgtgac

SEQ ID NO: 4866590 - DNA, 14 bp, Homo sapiens
aattatttgattat

SEQ ID NO: 4866591 - DNA, 22 bp, Homo sapiens
aattcaactttgtaaaaatctt

SEQ ID NO: 4866592 - DNA, 22 bp, Homo sapiens
aattcatggcatgcttaaattt

SEQ ID NO: 4866593 - DNA, 22 bp, Homo sapiens
aattccctggggtcaccttcta

SEQ ID NO: 4866594 - DNA, 15 bp, Homo sapiens
aattctgtttaattt

SEQ ID NO: 4866595 - DNA, 23 bp, Homo sapiens
aattcttaaaaggcccatagcag

SEQ ID NO: 4866596 - DNA, 20 bp, Homo sapiens
aattgaagtttcaagtttta

SEQ ID NO: 4866597 - DNA, 16 bp, Homo sapiens
aattgcatactttgta

SEQ ID NO: 4866598 - DNA, 17 bp, Homo sapiens
aattgggaactgaaatc

SEQ ID NO: 4866599 - DNA, 20 bp, Homo sapiens
aattgtacaaaattaagcaa

SEQ ID NO: 4866600 - DNA, 20 bp, Homo sapiens
aattgtgttttaattgtaaa

SEQ ID NO: 4866601 - DNA, 14 bp, Homo sapiens
aatttaaaaaataa

SEQ ID NO: 4866602 - DNA, 18 bp, Homo sapiens
aatttaaaaaataaataa

SEQ ID NO: 4866603 - DNA, 19 bp, Homo sapiens
aatttactgatgagagaat

SEQ ID NO: 4866604 - DNA, 15 bp, Homo sapiens
aatttacttgttttg

SEQ ID NO: 4866605 - DNA, 22 bp, Homo sapiens
aatttagttgagcatagagaac

SEQ ID NO: 4866606 - DNA, 17 bp, Homo sapiens
aatttatattttagaaa

SEQ ID NO: 4866607 - DNA, 13 bp, Homo sapiens
aatttcagtgtaa

SEQ ID NO: 4866608 - DNA, 15 bp, Homo sapiens
aatttcctgtgagga

SEQ ID NO: 4866609 - DNA, 16 bp, Homo sapiens
aatttcctgtgaggat

SEQ ID NO: 4866610 - DNA, 12 bp, Homo sapiens
aatttctcttgt

SEQ ID NO: 4866611 - DNA, 15 bp, Homo sapiens
aatttcttttgctga

SEQ ID NO: 4866612 - DNA, 22 bp, Homo sapiens
aatttgaattatcagcaaagaa

SEQ ID NO: 4866613 - DNA, 21 bp, Homo sapiens
aatttgaggtctagagagaac

SEQ ID NO: 4866614 - DNA, 17 bp, Homo sapiens
aatttgccagaggacca

SEQ ID NO: 4866615 - DNA, 19 bp, Homo sapiens
aatttggagcacaaaattc

SEQ ID NO: 4866616 - DNA, 21 bp, Homo sapiens
aatttggagcacaaaattcaa

SEQ ID NO: 4866617 - DNA, 23 bp, Homo sapiens
aatttgtgtgtttttagctgtga

SEQ ID NO: 4866618 - DNA, 17 bp, Homo sapiens
aatttgttttggatata

SEQ ID NO: 4866619 - DNA, 14 bp, Homo sapiens
aattttaaagtatg

SEQ ID NO: 4866620 - DNA, 13 bp, Homo sapiens
aattttaaagtgc

SEQ ID NO: 4866621 - DNA, 17 bp, Homo sapiens
aattttaaagtgcaaaa

SEQ ID NO: 4866622 - DNA, 23 bp, Homo sapiens
aattttacaagggcataaagtaa

SEQ ID NO: 4866623 - DNA, 15 bp, Homo sapiens
aattttagaaatatt

SEQ ID NO: 4866624 - DNA, 19 bp, Homo sapiens
aattttcattttgcactga

SEQ ID NO: 4866625 - DNA, 15 bp, Homo sapiens
aattttccatttatt

SEQ ID NO: 4866626 - DNA, 15 bp, Homo sapiens
aattttctaaaagct

SEQ ID NO: 4866627 - DNA, 16 bp, Homo sapiens
aattttgtatgttaaa

SEQ ID NO: 4866628 - DNA, 14 bp, Homo sapiens
aatttttaactgta

SEQ ID NO: 4866629 - DNA, 18 bp, Homo sapiens
aatttttaactgtactga

SEQ ID NO: 4866630 - DNA, 14 bp, Homo sapiens
aatttttcctgcat

SEQ ID NO: 4866631 - DNA, 13 bp, Homo sapiens
acaaaactcttaa

SEQ ID NO: 4866632 - DNA, 13 bp, Homo sapiens
acaaaagagcagt

SEQ ID NO: 4866633 - DNA, 23 bp, Homo sapiens
acaaaatggtcctatttttgtga

SEQ ID NO: 4866634 - DNA, 20 bp, Homo sapiens
acaaaattaagcaaatgtta

SEQ ID NO: 4866635 - DNA, 11 bp, Homo sapiens
acaaacaaaac

SEQ ID NO: 4866636 - DNA, 18 bp, Homo sapiens
acaaacaagccccctgcc

SEQ ID NO: 4866637 - DNA, 14 bp, Homo sapiens
acaaagaagaaagc

SEQ ID NO: 4866638 - DNA, 17 bp, Homo sapiens
acaaaggggcttaatta

SEQ ID NO: 4866639 - DNA, 18 bp, Homo sapiens
acaaagttaaaattgtta

SEQ ID NO: 4866640 - DNA, 13 bp, Homo sapiens
acaaccattaaag

SEQ ID NO: 4866641 - DNA, 21 bp, Homo sapiens
acaactactagtgtgactcct

SEQ ID NO: 4866642 - DNA, 15 bp, Homo sapiens
acaactcccttgcac

SEQ ID NO: 4866643 - DNA, 14 bp, Homo sapiens
acaagactggccca

SEQ ID NO: 4866644 - DNA, 19 bp, Homo sapiens
acaagcatgcagctttgca

SEQ ID NO: 4866645 - DNA, 17 bp, Homo sapiens
acaagctgtatcactgc

SEQ ID NO: 4866646 - DNA, 16 bp, Homo sapiens
acaagcttcagtaagt

SEQ ID NO: 4866647 - DNA, 15 bp, Homo sapiens
acaaggcctgcttga

SEQ ID NO: 4866648 - DNA, 22 bp, Homo sapiens
acaaggcctgcttgactttcca

SEQ ID NO: 4866649 - DNA, 19 bp, Homo sapiens
acaatctctttttgtttgc

SEQ ID NO: 4866650 - DNA, 23 bp, Homo sapiens
acaatggtgtggtgaatgtgtga

SEQ ID NO: 4866651 - DNA, 16 bp, Homo sapiens
acaatgttggagcagc

SEQ ID NO: 4866652 - DNA, 18 bp, Homo sapiens
acaatgttggagcagcag

SEQ ID NO: 4866653 - DNA, 20 bp, Homo sapiens
acaatgttggagcagcaggc

SEQ ID NO: 4866654 - DNA, 21 bp, Homo sapiens
acaatgttggagcagcaggcc

SEQ ID NO: 4866655 - DNA, 14 bp, Homo sapiens
acaatttatactgc

SEQ ID NO: 4866656 - DNA, 17 bp, Homo sapiens
acacacacacacacgat

SEQ ID NO: 4866657 - DNA, 14 bp, Homo sapiens
acacacacacgatg

SEQ ID NO: 4866658 - DNA, 11 bp, Homo sapiens
acacacgatgc

SEQ ID NO: 4866659 - DNA, 18 bp, Homo sapiens
acacacgatgcatttaat

SEQ ID NO: 4866660 - DNA, 19 bp, Homo sapiens
acacacgatgcatttaata

SEQ ID NO: 4866661 - DNA, 21 bp, Homo sapiens
acacacgatgcatttaataaa

SEQ ID NO: 4866662 - DNA, 22 bp, Homo sapiens
acacacgatgcatttaataaag

SEQ ID NO: 4866663 - DNA, 17 bp, Homo sapiens
acacagcattgtatatg

SEQ ID NO: 4866664 - DNA, 18 bp, Homo sapiens
acacaggatcctggcctg

SEQ ID NO: 4866665 - DNA, 22 bp, Homo sapiens
acacattacaaagttaaaattg

SEQ ID NO: 4866666 - DNA, 20 bp, Homo sapiens
acacatttgctactgttgta

SEQ ID NO: 4866667 - DNA, 23 bp, Homo sapiens
acaccgtggcagcttgctgggct

SEQ ID NO: 4866668 - DNA, 17 bp, Homo sapiens
acacctgccctgggcat

SEQ ID NO: 4866669 - DNA, 14 bp, Homo sapiens
acactatttgtgac

SEQ ID NO: 4866670 - DNA, 21 bp, Homo sapiens
acactcagaaaattccctggg

SEQ ID NO: 4866671 - DNA, 24 bp, Homo sapiens
acactcagaaaattccctggggtc

SEQ ID NO: 4866672 - DNA, 19 bp, Homo sapiens
acactgatgagtttcactg

SEQ ID NO: 4866673 - DNA, 23 bp, Homo sapiens
acactgatgagtttcactgtact

SEQ ID NO: 4866674 - DNA, 19 bp, Homo sapiens
acactgcttggcccttcaa

SEQ ID NO: 4866675 - DNA, 14 bp, Homo sapiens
acacttgaaacctt

SEQ ID NO: 4866676 - DNA, 17 bp, Homo sapiens
acactttgcactgatat

SEQ ID NO: 4866677 - DNA, 22 bp, Homo sapiens
acactttgcactgatatatcat

SEQ ID NO: 4866678 - DNA, 22 bp, Homo sapiens
acagaaggtgaactttgtgctt

SEQ ID NO: 4866679 - DNA, 18 bp, Homo sapiens
acagaatcttgttttgaa

SEQ ID NO: 4866680 - DNA, 20 bp, Homo sapiens
acagacagcttacaggagcc

SEQ ID NO: 4866681 - DNA, 14 bp, Homo sapiens
acagagctctgggt

SEQ ID NO: 4866682 - DNA, 20 bp, Homo sapiens
acagaggtttgaaggagaat

SEQ ID NO: 4866683 - DNA, 23 bp, Homo sapiens
acagaggtttgaaggagaatggc

SEQ ID NO: 4866684 - DNA, 15 bp, Homo sapiens
acagattctttcagt

SEQ ID NO: 4866685 - DNA, 19 bp, Homo sapiens
acagattctttcagttctt

SEQ ID NO: 4866686 - DNA, 22 bp, Homo sapiens
acagcaaacaggtgctaatttg

SEQ ID NO: 4866687 - DNA, 18 bp, Homo sapiens
acagcagccccaggagaa

SEQ ID NO: 4866688 - DNA, 12 bp, Homo sapiens
acagcagcctgt

SEQ ID NO: 4866689 - DNA, 15 bp, Homo sapiens
acagcattgtgtgga

SEQ ID NO: 4866690 - DNA, 14 bp, Homo sapiens
acagccaaatttaa

SEQ ID NO: 4866691 - DNA, 15 bp, Homo sapiens
acagccaaatttaaa

SEQ ID NO: 4866692 - DNA, 12 bp, Homo sapiens
acagccaagctg

SEQ ID NO: 4866693 - DNA, 17 bp, Homo sapiens
acagccaagctggcaca

SEQ ID NO: 4866694 - DNA, 18 bp, Homo sapiens
acagccaagctggcacaa

SEQ ID NO: 4866695 - DNA, 19 bp, Homo sapiens
acagccacaccgtggcagc

SEQ ID NO: 4866696 - DNA, 15 bp, Homo sapiens
acagccttattttgt

SEQ ID NO: 4866697 - DNA, 21 bp, Homo sapiens
acagccttgcaacccaaggtg

SEQ ID NO: 4866698 - DNA, 22 bp, Homo sapiens
acagccttgcagcggctcctgc

SEQ ID NO: 4866699 - DNA, 19 bp, Homo sapiens
acagcgaacagccttagag

SEQ ID NO: 4866700 - DNA, 17 bp, Homo sapiens
acagctctcctccagcc

SEQ ID NO: 4866701 - DNA, 21 bp, Homo sapiens
acagctctcctccagccctgg

SEQ ID NO: 4866702 - DNA, 22 bp, Homo sapiens
acagctctcctccagccctggg

SEQ ID NO: 4866703 - DNA, 23 bp, Homo sapiens
acagctctcctccagccctgggc

SEQ ID NO: 4866704 - DNA, 15 bp, Homo sapiens
acagctgtgctccac

SEQ ID NO: 4866705 - DNA, 17 bp, Homo sapiens
acagcttacaggagcca

SEQ ID NO: 4866706 - DNA, 19 bp, Homo sapiens
acagcttacaggagccagc

SEQ ID NO: 4866707 - DNA, 12 bp, Homo sapiens
acaggaaagagc

SEQ ID NO: 4866708 - DNA, 12 bp, Homo sapiens
acaggagccagc

SEQ ID NO: 4866709 - DNA, 20 bp, Homo sapiens
acaggatcctggcctgagaa

SEQ ID NO: 4866710 - DNA, 17 bp, Homo sapiens
acaggcacattaactgt

SEQ ID NO: 4866711 - DNA, 18 bp, Homo sapiens
acaggcacattaactgtt

SEQ ID NO: 4866712 - DNA, 20 bp, Homo sapiens
acaggcacattaactgttgc

SEQ ID NO: 4866713 - DNA, 16 bp, Homo sapiens
acaggccttcctcctc

SEQ ID NO: 4866714 - DNA, 18 bp, Homo sapiens
acaggtgctaatttgttt

SEQ ID NO: 4866715 - DNA, 18 bp, Homo sapiens
acaggttataacagtgtt

SEQ ID NO: 4866716 - DNA, 21 bp, Homo sapiens
acaggttttccaaaagtaaag

SEQ ID NO: 4866717 - DNA, 18 bp, Homo sapiens
acagtggatcacaaagtg

SEQ ID NO: 4866718 - DNA, 15 bp, Homo sapiens
acagttgatggagcc

SEQ ID NO: 4866719 - DNA, 19 bp, Homo sapiens
acagttttaactgtggata

SEQ ID NO: 4866720 - DNA, 16 bp, Homo sapiens
acagtttttgacattt

SEQ ID NO: 4866721 - DNA, 17 bp, Homo sapiens
acataaaagaaataaac

SEQ ID NO: 4866722 - DNA, 17 bp, Homo sapiens
acataacttctcatgta

SEQ ID NO: 4866723 - DNA, 18 bp, Homo sapiens
acataacttctcatgtat

SEQ ID NO: 4866724 - DNA, 22 bp, Homo sapiens
acatacacccaaacacttacac

SEQ ID NO: 4866725 - DNA, 15 bp, Homo sapiens
acatatatttattga

SEQ ID NO: 4866726 - DNA, 21 bp, Homo sapiens
acatatgtgctggaattctaa

SEQ ID NO: 4866727 - DNA, 17 bp, Homo sapiens
acatcaaacctttgagt

SEQ ID NO: 4866728 - DNA, 13 bp, Homo sapiens
acatcaaataaga

SEQ ID NO: 4866729 - DNA, 18 bp, Homo sapiens
acatcaaataagaaataa

SEQ ID NO: 4866730 - DNA, 13 bp, Homo sapiens
acatcaatatgta

SEQ ID NO: 4866731 - DNA, 20 bp, Homo sapiens
acatcagcctccttctttca

SEQ ID NO: 4866732 - DNA, 12 bp, Homo sapiens
acatccatccct

SEQ ID NO: 4866733 - DNA, 19 bp, Homo sapiens
acatctatccacactgtca

SEQ ID NO: 4866734 - DNA, 22 bp, Homo sapiens
acatctccatggggaggcctca

SEQ ID NO: 4866735 - DNA, 21 bp, Homo sapiens
acatctgaccccaagggggct

SEQ ID NO: 4866736 - DNA, 18 bp, Homo sapiens
acatctgacctggcatct

SEQ ID NO: 4866737 - DNA, 19 bp, Homo sapiens
acatctttattgaaattct

SEQ ID NO: 4866738 - DNA, 23 bp, Homo sapiens
acatgaagcagaaccttctttgg

SEQ ID NO: 4866739 - DNA, 18 bp, Homo sapiens
acatgagagtagggccct

SEQ ID NO: 4866740 - DNA, 15 bp, Homo sapiens
acatgcaataaaatt

SEQ ID NO: 4866741 - DNA, 13 bp, Homo sapiens
acatgcatataat

SEQ ID NO: 4866742 - DNA, 16 bp, Homo sapiens
acatgcatataatgaa

SEQ ID NO: 4866743 - DNA, 23 bp, Homo sapiens
acatgcatataatgaataaatca

SEQ ID NO: 4866744 - DNA, 19 bp, Homo sapiens
acatgccacatcaaacctt

SEQ ID NO: 4866745 - DNA, 17 bp, Homo sapiens
acatggccatcttcttt

SEQ ID NO: 4866746 - DNA, 20 bp, Homo sapiens
acatggccatcttctttctt

SEQ ID NO: 4866747 - DNA, 13 bp, Homo sapiens
acatgtgacattt

SEQ ID NO: 4866748 - DNA, 16 bp, Homo sapiens
acatgtgacatttata

SEQ ID NO: 4866749 - DNA, 21 bp, Homo sapiens
acatgtgacatttatatattg

SEQ ID NO: 4866750 - DNA, 14 bp, Homo sapiens
acatgtgatacatt

SEQ ID NO: 4866751 - DNA, 17 bp, Homo sapiens
acatgtgatacattttt

SEQ ID NO: 4866752 - DNA, 16 bp, Homo sapiens
acatgttaatgacaat

SEQ ID NO: 4866753 - DNA, 18 bp, Homo sapiens
acatgttcccaaaacaat

SEQ ID NO: 4866754 - DNA, 19 bp, Homo sapiens
acatgttcccaaaacaatg

SEQ ID NO: 4866755 - DNA, 23 bp, Homo sapiens
acatgttcccaaaacaatggtgt

SEQ ID NO: 4866756 - DNA, 13 bp, Homo sapiens
acattaactgttg

SEQ ID NO: 4866757 - DNA, 19 bp, Homo sapiens
acattcaggaattcttgga

SEQ ID NO: 4866758 - DNA, 11 bp, Homo sapiens
acatttatatt

SEQ ID NO: 4866759 - DNA, 17 bp, Homo sapiens
acatttctcatgttgaa

SEQ ID NO: 4866760 - DNA, 13 bp, Homo sapiens
acatttctttgga

SEQ ID NO: 4866761 - DNA, 15 bp, Homo sapiens
accaaaataataaaa

SEQ ID NO: 4866762 - DNA, 14 bp, Homo sapiens
accaaaattttaaa

SEQ ID NO: 4866763 - DNA, 23 bp, Homo sapiens
accaaggctgagacagtgaattt

SEQ ID NO: 4866764 - DNA, 14 bp, Homo sapiens
accaatgcttgcat

SEQ ID NO: 4866765 - DNA, 21 bp, Homo sapiens
accacagccttctaaattccc

SEQ ID NO: 4866766 - DNA, 15 bp, Homo sapiens
accacattgaagaat

SEQ ID NO: 4866767 - DNA, 14 bp, Homo sapiens
accacgcaggaagc

SEQ ID NO: 4866768 - DNA, 17 bp, Homo sapiens
accactttattgcaatg

SEQ ID NO: 4866769 - DNA, 18 bp, Homo sapiens
accagccccccgcgcgcc

SEQ ID NO: 4866770 - DNA, 18 bp, Homo sapiens
accagtgggaattgctgg

SEQ ID NO: 4866771 - DNA, 22 bp, Homo sapiens
accataaattcaactttgtaaa

SEQ ID NO: 4866772 - DNA, 14 bp, Homo sapiens
accataagagaaac

SEQ ID NO: 4866773 - DNA, 15 bp, Homo sapiens
accataagagaaacc

SEQ ID NO: 4866774 - DNA, 22 bp, Homo sapiens
accataagagaaacctgccaag

SEQ ID NO: 4866775 - DNA, 18 bp, Homo sapiens
accattctattctccaga

SEQ ID NO: 4866776 - DNA, 19 bp, Homo sapiens
accattctattctccagac

SEQ ID NO: 4866777 - DNA, 15 bp, Homo sapiens
acccaaggtgaggtg

SEQ ID NO: 4866778 - DNA, 22 bp, Homo sapiens
acccaagtggacgttaggccag

SEQ ID NO: 4866779 - DNA, 23 bp, Homo sapiens
acccaagtggacgttaggccagg

SEQ ID NO: 4866780 - DNA, 17 bp, Homo sapiens
acccacaaactccaggc

SEQ ID NO: 4866781 - DNA, 21 bp, Homo sapiens
acccacaaactccaggctgga

SEQ ID NO: 4866782 - DNA, 12 bp, Homo sapiens
acccacagaact

SEQ ID NO: 4866783 - DNA, 13 bp, Homo sapiens
acccacagaactt

SEQ ID NO: 4866784 - DNA, 23 bp, Homo sapiens
acccagagatgcctgatttcatt

SEQ ID NO: 4866785 - DNA, 12 bp, Homo sapiens
acccagagctgc

SEQ ID NO: 4866786 - DNA, 13 bp, Homo sapiens
acccagtctttct

SEQ ID NO: 4866787 - DNA, 21 bp, Homo sapiens
acccatccctgcctggaggct

SEQ ID NO: 4866788 - DNA, 14 bp, Homo sapiens
acccatcctaggaa

SEQ ID NO: 4866789 - DNA, 17 bp, Homo sapiens
acccatcctaggaacca

SEQ ID NO: 4866790 - DNA, 21 bp, Homo sapiens
acccattaaggggaagaatga

SEQ ID NO: 4866791 - DNA, 16 bp, Homo sapiens
accccaaagagaaaga

SEQ ID NO: 4866792 - DNA, 17 bp, Homo sapiens
accccaagggggctgct

SEQ ID NO: 4866793 - DNA, 17 bp, Homo sapiens
accccagatacctgtga

SEQ ID NO: 4866794 - DNA, 19 bp, Homo sapiens
accccagatacctgtgagg

SEQ ID NO: 4866795 - DNA, 11 bp, Homo sapiens
accccctcctt

SEQ ID NO: 4866796 - DNA, 22 bp, Homo sapiens
acccctgctcccattcctccct

SEQ ID NO: 4866797 - DNA, 23 bp, Homo sapiens
acccctgctcccattcctccctc

SEQ ID NO: 4866798 - DNA, 21 bp, Homo sapiens
acccgtcctctcggctgccag

SEQ ID NO: 4866799 - DNA, 21 bp, Homo sapiens
accctccaaaggaactctaga

SEQ ID NO: 4866800 - DNA, 16 bp, Homo sapiens
accctccatgctcctc

SEQ ID NO: 4866801 - DNA, 14 bp, Homo sapiens
acccttcctgctgc

SEQ ID NO: 4866802 - DNA, 19 bp, Homo sapiens
acccttcctgctgctgcta

SEQ ID NO: 4866803 - DNA, 14 bp, Homo sapiens
acccttctgggtcc

SEQ ID NO: 4866804 - DNA, 16 bp, Homo sapiens
acccttgattcattct

SEQ ID NO: 4866805 - DNA, 17 bp, Homo sapiens
acccttgattcattctg

SEQ ID NO: 4866806 - DNA, 22 bp, Homo sapiens
acccttgattcattctgaaccc

SEQ ID NO: 4866807 - DNA, 20 bp, Homo sapiens
accgcagaagcctccccagc

SEQ ID NO: 4866808 - DNA, 15 bp, Homo sapiens
acctaattaatatat

SEQ ID NO: 4866809 - DNA, 17 bp, Homo sapiens
acctacattccaccctg

SEQ ID NO: 4866810 - DNA, 16 bp, Homo sapiens
acctagctaattattt

SEQ ID NO: 4866811 - DNA, 18 bp, Homo sapiens
acctagttaaagaaagga

SEQ ID NO: 4866812 - DNA, 12 bp, Homo sapiens
acctcaggctcc

SEQ ID NO: 4866813 - DNA, 15 bp, Homo sapiens
acctcatcactggac

SEQ ID NO: 4866814 - DNA, 22 bp, Homo sapiens
acctcatcactggactgcatgg

SEQ ID NO: 4866815 - DNA, 16 bp, Homo sapiens
acctccagaagtccct

SEQ ID NO: 4866816 - DNA, 11 bp, Homo sapiens
acctccagact

SEQ ID NO: 4866817 - DNA, 12 bp, Homo sapiens
acctccagactc

SEQ ID NO: 4866818 - DNA, 18 bp, Homo sapiens
acctccagactcagcaga

SEQ ID NO: 4866819 - DNA, 19 bp, Homo sapiens
acctccttagccctgtctg

SEQ ID NO: 4866820 - DNA, 16 bp, Homo sapiens
acctctaagtgctgct

SEQ ID NO: 4866821 - DNA, 18 bp, Homo sapiens
acctctgtctgagacagg

SEQ ID NO: 4866822 - DNA, 23 bp, Homo sapiens
acctctgtctgagacaggtgcct

SEQ ID NO: 4866823 - DNA, 18 bp, Homo sapiens
acctctttgcgtttcctt

SEQ ID NO: 4866824 - DNA, 21 bp, Homo sapiens
acctctttgctcaacagaaca

SEQ ID NO: 4866825 - DNA, 17 bp, Homo sapiens
acctgaccccattcctg

SEQ ID NO: 4866826 - DNA, 18 bp, Homo sapiens
acctgaccccattcctga

SEQ ID NO: 4866827 - DNA, 20 bp, Homo sapiens
acctgatgtcagctgctgtt

SEQ ID NO: 4866828 - DNA, 16 bp, Homo sapiens
acctgccaaggagcat

SEQ ID NO: 4866829 - DNA, 19 bp, Homo sapiens
acctgccaaggagcatcct

SEQ ID NO: 4866830 - DNA, 23 bp, Homo sapiens
acctgcccacaactcccttgcac

SEQ ID NO: 4866831 - DNA, 13 bp, Homo sapiens
acctgccccaagt

SEQ ID NO: 4866832 - DNA, 18 bp, Homo sapiens
acctggagcttcagccag

SEQ ID NO: 4866833 - DNA, 20 bp, Homo sapiens
acctggagcttcagccaggt

SEQ ID NO: 4866834 - DNA, 13 bp, Homo sapiens
acctggcctagaa

SEQ ID NO: 4866835 - DNA, 14 bp, Homo sapiens
acctggcttattta

SEQ ID NO: 4866836 - DNA, 16 bp, Homo sapiens
acctgggaaggccagc

SEQ ID NO: 4866837 - DNA, 19 bp, Homo sapiens
acctgggaaggccagcctt

SEQ ID NO: 4866838 - DNA, 12 bp, Homo sapiens
acctgtgactct

SEQ ID NO: 4866839 - DNA, 16 bp, Homo sapiens
acctgtgactcttagc

SEQ ID NO: 4866840 - DNA, 15 bp, Homo sapiens
acctgtgaggactgg

SEQ ID NO: 4866841 - DNA, 13 bp, Homo sapiens
acctgtggatatt

SEQ ID NO: 4866842 - DNA, 16 bp, Homo sapiens
accttaaaaggtactg

SEQ ID NO: 4866843 - DNA, 22 bp, Homo sapiens
accttaatttaactttccagtc

SEQ ID NO: 4866844 - DNA, 22 bp, Homo sapiens
accttctagttgcccccattcc

SEQ ID NO: 4866845 - DNA, 18 bp, Homo sapiens
accttgaaaaaaaacagt

SEQ ID NO: 4866846 - DNA, 12 bp, Homo sapiens
accttgcttcct

SEQ ID NO: 4866847 - DNA, 14 bp, Homo sapiens
accttgcttccttc

SEQ ID NO: 4866848 - DNA, 15 bp, Homo sapiens
accttgcttccttct

SEQ ID NO: 4866849 - DNA, 19 bp, Homo sapiens
acctttcctgatgcccctg

SEQ ID NO: 4866850 - DNA, 22 bp, Homo sapiens
accttttcaggaaaataactta

SEQ ID NO: 4866851 - DNA, 24 bp, Homo sapiens
acctttttttatcgtttttgtatt

SEQ ID NO: 4866852 - DNA, 20 bp, Homo sapiens
acgaggacatttgtgggcaa

SEQ ID NO: 4866853 - DNA, 18 bp, Homo sapiens
acgaggccaagctgagga

SEQ ID NO: 4866854 - DNA, 22 bp, Homo sapiens
acgagtgtagtcccggaggcct

SEQ ID NO: 4866855 - DNA, 14 bp, Homo sapiens
acgatgcatttaat

SEQ ID NO: 4866856 - DNA, 15 bp, Homo sapiens
acggaaagtgctgtc

SEQ ID NO: 4866857 - DNA, 16 bp, Homo sapiens
acgggatgacctccag

SEQ ID NO: 4866858 - DNA, 14 bp, Homo sapiens
acgggggcagtgtg

SEQ ID NO: 4866859 - DNA, 20 bp, Homo sapiens
acgtaaacttcagtgtccca

SEQ ID NO: 4866860 - DNA, 14 bp, Homo sapiens
acgtggctctgctg

SEQ ID NO: 4866861 - DNA, 22 bp, Homo sapiens
acgtgtcagaagcctccaagcc

SEQ ID NO: 4866862 - DNA, 16 bp, Homo sapiens
acgtttataaacagaa

SEQ ID NO: 4866863 - DNA, 19 bp, Homo sapiens
acgtttataaacagaaatg

SEQ ID NO: 4866864 - DNA, 17 bp, Homo sapiens
actaaaaagtataaaat

SEQ ID NO: 4866865 - DNA, 23 bp, Homo sapiens
actaaaggaaaaaactttgactt

SEQ ID NO: 4866866 - DNA, 14 bp, Homo sapiens
actaacccagtctt

SEQ ID NO: 4866867 - DNA, 17 bp, Homo sapiens
actaacccagtctttct

SEQ ID NO: 4866868 - DNA, 18 bp, Homo sapiens
actaacccagtctttctt

SEQ ID NO: 4866869 - DNA, 14 bp, Homo sapiens
actactagattgac

SEQ ID NO: 4866870 - DNA, 19 bp, Homo sapiens
actactgaacacatgtgta

SEQ ID NO: 4866871 - DNA, 18 bp, Homo sapiens
actaggactcagaaacga

SEQ ID NO: 4866872 - DNA, 20 bp, Homo sapiens
actatagcttgcagaactgt

SEQ ID NO: 4866873 - DNA, 16 bp, Homo sapiens
actatatatataaatg

SEQ ID NO: 4866874 - DNA, 14 bp, Homo sapiens
actatttgtgactt

SEQ ID NO: 4866875 - DNA, 19 bp, Homo sapiens
actatttgtgactttttaa

SEQ ID NO: 4866876 - DNA, 15 bp, Homo sapiens
actcaaatacacatt

SEQ ID NO: 4866877 - DNA, 16 bp, Homo sapiens
actcaaatacacattt

SEQ ID NO: 4866878 - DNA, 18 bp, Homo sapiens
actcaatccatccatgta

SEQ ID NO: 4866879 - DNA, 15 bp, Homo sapiens
actcacacccctgcc

SEQ ID NO: 4866880 - DNA, 22 bp, Homo sapiens
actcacctgcactaacagagtg

SEQ ID NO: 4866881 - DNA, 22 bp, Homo sapiens
actcagaaaattccctggggtc

SEQ ID NO: 4866882 - DNA, 15 bp, Homo sapiens
actcagcatcaccca

SEQ ID NO: 4866883 - DNA, 14 bp, Homo sapiens
actccaagccctgg

SEQ ID NO: 4866884 - DNA, 12 bp, Homo sapiens
actccaggctgg

SEQ ID NO: 4866885 - DNA, 20 bp, Homo sapiens
actcccacagcagccccagg

SEQ ID NO: 4866886 - DNA, 14 bp, Homo sapiens
actcccagaacctc

SEQ ID NO: 4866887 - DNA, 22 bp, Homo sapiens
actcccagaacctctaagtgct

SEQ ID NO: 4866888 - DNA, 20 bp, Homo sapiens
actcctataaagtgcctcgg

SEQ ID NO: 4866889 - DNA, 14 bp, Homo sapiens
actcctgtcttctt

SEQ ID NO: 4866890 - DNA, 24 bp, Homo sapiens
actcctgtcttctttctccatgga

SEQ ID NO: 4866891 - DNA, 18 bp, Homo sapiens
actctacccctgctccca

SEQ ID NO: 4866892 - DNA, 19 bp, Homo sapiens
actctacccctgctcccat

SEQ ID NO: 4866893 - DNA, 12 bp, Homo sapiens
actctctccagg

SEQ ID NO: 4866894 - DNA, 21 bp, Homo sapiens
actctctccaggagggctcgg

SEQ ID NO: 4866895 - DNA, 22 bp, Homo sapiens
actctgctgtctaacctgtgac

SEQ ID NO: 4866896 - DNA, 19 bp, Homo sapiens
actctggcttcaaaaagcc

SEQ ID NO: 4866897 - DNA, 21 bp, Homo sapiens
actctgggggtggacatctga

SEQ ID NO: 4866898 - DNA, 21 bp, Homo sapiens
actcttagccctcaccacagc

SEQ ID NO: 4866899 - DNA, 18 bp, Homo sapiens
actgaagaagatgagcct

SEQ ID NO: 4866900 - DNA, 22 bp, Homo sapiens
actgacctgaccccattcctga

SEQ ID NO: 4866901 - DNA, 22 bp, Homo sapiens
actgagccagattggccaatta

SEQ ID NO: 4866902 - DNA, 21 bp, Homo sapiens
actgataacttggggaggcaa

SEQ ID NO: 4866903 - DNA, 14 bp, Homo sapiens
actgatgagagaat

SEQ ID NO: 4866904 - DNA, 21 bp, Homo sapiens
actgatgagtttcactgtact

SEQ ID NO: 4866905 - DNA, 22 bp, Homo sapiens
actgcaaaaagaaaatctttat

SEQ ID NO: 4866906 - DNA, 22 bp, Homo sapiens
actgcaaagtcgccagtcactg

SEQ ID NO: 4866907 - DNA, 16 bp, Homo sapiens
actgcaatcactgtgc

SEQ ID NO: 4866908 - DNA, 21 bp, Homo sapiens
actgcatcttggttatttctg

SEQ ID NO: 4866909 - DNA, 19 bp, Homo sapiens
actgcatggggaggcagca

SEQ ID NO: 4866910 - DNA, 14 bp, Homo sapiens
actgcatgtgactt

SEQ ID NO: 4866911 - DNA, 12 bp, Homo sapiens
actgccccctcc

SEQ ID NO: 4866912 - DNA, 13 bp, Homo sapiens
actgccctctgaa

SEQ ID NO: 4866913 - DNA, 15 bp, Homo sapiens
actgccgtaatttaa

SEQ ID NO: 4866914 - DNA, 19 bp, Homo sapiens
actgccttcgtttatattt

SEQ ID NO: 4866915 - DNA, 15 bp, Homo sapiens
actgcggctgtctcc

SEQ ID NO: 4866916 - DNA, 15 bp, Homo sapiens
actgctcctgggcat

SEQ ID NO: 4866917 - DNA, 13 bp, Homo sapiens
actgctcctgtgg

SEQ ID NO: 4866918 - DNA, 19 bp, Homo sapiens
actgctcctgtggcaggag

SEQ ID NO: 4866919 - DNA, 18 bp, Homo sapiens
actgctgctgctgctgcc

SEQ ID NO: 4866920 - DNA, 16 bp, Homo sapiens
actggcccagtgccag

SEQ ID NO: 4866921 - DNA, 14 bp, Homo sapiens
actggccctctagc

SEQ ID NO: 4866922 - DNA, 18 bp, Homo sapiens
actggccttgcctccagg

SEQ ID NO: 4866923 - DNA, 22 bp, Homo sapiens
actgggagccacttctccccag

SEQ ID NO: 4866924 - DNA, 16 bp, Homo sapiens
actgggcactggggcc

SEQ ID NO: 4866925 - DNA, 17 bp, Homo sapiens
actgggcactggggcct

SEQ ID NO: 4866926 - DNA, 13 bp, Homo sapiens
actggggggcagg

SEQ ID NO: 4866927 - DNA, 20 bp, Homo sapiens
actggtgtaatctcaatgca

SEQ ID NO: 4866928 - DNA, 15 bp, Homo sapiens
actggttctgaggcc

SEQ ID NO: 4866929 - DNA, 17 bp, Homo sapiens
actggttctgaggccag

SEQ ID NO: 4866930 - DNA, 20 bp, Homo sapiens
actgtaacttccaaataaat

SEQ ID NO: 4866931 - DNA, 15 bp, Homo sapiens
actgtaatgctgcct

SEQ ID NO: 4866932 - DNA, 20 bp, Homo sapiens
actgtaatgctgcctcagga

SEQ ID NO: 4866933 - DNA, 15 bp, Homo sapiens
actgtactttcccag

SEQ ID NO: 4866934 - DNA, 14 bp, Homo sapiens
actgtatcattttc

SEQ ID NO: 4866935 - DNA, 15 bp, Homo sapiens
actgtatcattttct

SEQ ID NO: 4866936 - DNA, 16 bp, Homo sapiens
actgttgcacttttga

SEQ ID NO: 4866937 - DNA, 14 bp, Homo sapiens
actgttgtaagaat

SEQ ID NO: 4866938 - DNA, 15 bp, Homo sapiens
actgttgtaagaatt

SEQ ID NO: 4866939 - DNA, 21 bp, Homo sapiens
actgttgtaagaattctgatt

SEQ ID NO: 4866940 - DNA, 22 bp, Homo sapiens
actgttgtaagaattctgattg

SEQ ID NO: 4866941 - DNA, 22 bp, Homo sapiens
actgtttgatataccaaattaa

SEQ ID NO: 4866942 - DNA, 21 bp, Homo sapiens
acttaaagggcccaatgaatt

SEQ ID NO: 4866943 - DNA, 23 bp, Homo sapiens
acttacaaactttgtttgtcaca

SEQ ID NO: 4866944 - DNA, 23 bp, Homo sapiens
acttacatgttcccaaaacaatg

SEQ ID NO: 4866945 - DNA, 20 bp, Homo sapiens
acttagcctttacctgtgaa

SEQ ID NO: 4866946 - DNA, 18 bp, Homo sapiens
acttaggtttcaggaagt

SEQ ID NO: 4866947 - DNA, 17 bp, Homo sapiens
acttatggcatgactct

SEQ ID NO: 4866948 - DNA, 13 bp, Homo sapiens
acttattgaatat

SEQ ID NO: 4866949 - DNA, 15 bp, Homo sapiens
acttattgaccattt

SEQ ID NO: 4866950 - DNA, 13 bp, Homo sapiens
acttcaaagtgcc

SEQ ID NO: 4866951 - DNA, 16 bp, Homo sapiens
acttcaaagtgcctgg

SEQ ID NO: 4866952 - DNA, 16 bp, Homo sapiens
acttcacctccttctg

SEQ ID NO: 4866953 - DNA, 18 bp, Homo sapiens
acttcagtgtcccacctt

SEQ ID NO: 4866954 - DNA, 17 bp, Homo sapiens
acttccaaagaaagttc

SEQ ID NO: 4866955 - DNA, 14 bp, Homo sapiens
acttctcatgtata

SEQ ID NO: 4866956 - DNA, 12 bp, Homo sapiens
acttctccccag

SEQ ID NO: 4866957 - DNA, 16 bp, Homo sapiens
acttctgaagagacca

SEQ ID NO: 4866958 - DNA, 24 bp, Homo sapiens
acttctgcaacaagcatgcagctt

SEQ ID NO: 4866959 - DNA, 17 bp, Homo sapiens
acttctggggccacctc

SEQ ID NO: 4866960 - DNA, 13 bp, Homo sapiens
acttcttgaatat

SEQ ID NO: 4866961 - DNA, 23 bp, Homo sapiens
acttcttgaatataaaaaatcat

SEQ ID NO: 4866962 - DNA, 12 bp, Homo sapiens
acttgaaagaaa

SEQ ID NO: 4866963 - DNA, 16 bp, Homo sapiens
acttgagggcctgagc

SEQ ID NO: 4866964 - DNA, 21 bp, Homo sapiens
acttgcccacaccgagggcga

SEQ ID NO: 4866965 - DNA, 16 bp, Homo sapiens
acttggagaatactgc

SEQ ID NO: 4866966 - DNA, 20 bp, Homo sapiens
acttggagaatactgccaaa

SEQ ID NO: 4866967 - DNA, 20 bp, Homo sapiens
acttggcccccttcaggagc

SEQ ID NO: 4866968 - DNA, 23 bp, Homo sapiens
acttggcccccttcaggagcctg

SEQ ID NO: 4866969 - DNA, 17 bp, Homo sapiens
acttggttgatgtttaa

SEQ ID NO: 4866970 - DNA, 14 bp, Homo sapiens
acttgtatatttta

SEQ ID NO: 4866971 - DNA, 20 bp, Homo sapiens
acttgttttggatggcttgt

SEQ ID NO: 4866972 - DNA, 15 bp, Homo sapiens
actttagaagcctgc

SEQ ID NO: 4866973 - DNA, 13 bp, Homo sapiens
actttatcatgaa

SEQ ID NO: 4866974 - DNA, 16 bp, Homo sapiens
actttatcatgaatgc

SEQ ID NO: 4866975 - DNA, 18 bp, Homo sapiens
actttatcatgaatgctt

SEQ ID NO: 4866976 - DNA, 17 bp, Homo sapiens
actttattgcaatgcag

SEQ ID NO: 4866977 - DNA, 12 bp, Homo sapiens
actttccagaat

SEQ ID NO: 4866978 - DNA, 20 bp, Homo sapiens
actttctatttttatgatga

SEQ ID NO: 4866979 - DNA, 22 bp, Homo sapiens
actttctatttttatgatgaca

SEQ ID NO: 4866980 - DNA, 14 bp, Homo sapiens
actttgacagtgtt

SEQ ID NO: 4866981 - DNA, 18 bp, Homo sapiens
actttgacagtgttttta

SEQ ID NO: 4866982 - DNA, 22 bp, Homo sapiens
actttgacctaaattatttact

SEQ ID NO: 4866983 - DNA, 20 bp, Homo sapiens
actttgatactaccagggtc

SEQ ID NO: 4866984 - DNA, 18 bp, Homo sapiens
actttgcactgatatatc

SEQ ID NO: 4866985 - DNA, 22 bp, Homo sapiens
actttggtagctgggaaagcat

SEQ ID NO: 4866986 - DNA, 19 bp, Homo sapiens
acttttaaggataaatcat

SEQ ID NO: 4866987 - DNA, 14 bp, Homo sapiens
acttttccttttct

SEQ ID NO: 4866988 - DNA, 18 bp, Homo sapiens
actttttaaagaagtgca

SEQ ID NO: 4866989 - DNA, 23 bp, Homo sapiens
agaaaaccactttattgcaatgc

SEQ ID NO: 4866990 - DNA, 13 bp, Homo sapiens
agaaaacccaccc

SEQ ID NO: 4866991 - DNA, 12 bp, Homo sapiens
agaaaagtgaat

SEQ ID NO: 4866992 - DNA, 15 bp, Homo sapiens
agaaaagtgaattga

SEQ ID NO: 4866993 - DNA, 15 bp, Homo sapiens
agaaaatctttataa

SEQ ID NO: 4866994 - DNA, 16 bp, Homo sapiens
agaaacaaacaaaact

SEQ ID NO: 4866995 - DNA, 17 bp, Homo sapiens
agaaacaaagatgttat

SEQ ID NO: 4866996 - DNA, 20 bp, Homo sapiens
agaaacactatttgtgactt

SEQ ID NO: 4866997 - DNA, 15 bp, Homo sapiens
agaaacactgaaaag

SEQ ID NO: 4866998 - DNA, 19 bp, Homo sapiens
agaaacactgaaaagaagg

SEQ ID NO: 4866999 - DNA, 23 bp, Homo sapiens
agaaaccaacaagaaccactcct

SEQ ID NO: 4867000 - DNA, 12 bp, Homo sapiens
agaaacccagag

SEQ ID NO: 4867001 - DNA, 15 bp, Homo sapiens
agaaacccagagatg

SEQ ID NO: 4867002 - DNA, 17 bp, Homo sapiens
agaaacctgccaaggag

SEQ ID NO: 4867003 - DNA, 18 bp, Homo sapiens
agaaacctgccaaggagc

SEQ ID NO: 4867004 - DNA, 16 bp, Homo sapiens
agaaactgaggcccag

SEQ ID NO: 4867005 - DNA, 15 bp, Homo sapiens
agaaagagtttgaaa

SEQ ID NO: 4867006 - DNA, 15 bp, Homo sapiens
agaaagcaaaggtgc

SEQ ID NO: 4867007 - DNA, 23 bp, Homo sapiens
agaaagcaaaggtgcactccaga

SEQ ID NO: 4867008 - DNA, 20 bp, Homo sapiens
agaaagcctgggtgacattt

SEQ ID NO: 4867009 - DNA, 14 bp, Homo sapiens
agaaaggaaaagaa

SEQ ID NO: 4867010 - DNA, 23 bp, Homo sapiens
agaaataaaccaaaggaaaatgt

SEQ ID NO: 4867011 - DNA, 17 bp, Homo sapiens
agaaataataaaaagaa

SEQ ID NO: 4867012 - DNA, 22 bp, Homo sapiens
agaaataatgctacaattttaa

SEQ ID NO: 4867013 - DNA, 13 bp, Homo sapiens
agaaatagacaaa

SEQ ID NO: 4867014 - DNA, 14 bp, Homo sapiens
agaaatagacaaaa

SEQ ID NO: 4867015 - DNA, 16 bp, Homo sapiens
agaaatataacacatt

SEQ ID NO: 4867016 - DNA, 19 bp, Homo sapiens
agaaatatagtgcaatagt

SEQ ID NO: 4867017 - DNA, 15 bp, Homo sapiens
agaaatcaatagttg

SEQ ID NO: 4867018 - DNA, 20 bp, Homo sapiens
agaaatgccagtggtggagg

SEQ ID NO: 4867019 - DNA, 13 bp, Homo sapiens
agaaatgccccag

SEQ ID NO: 4867020 - DNA, 16 bp, Homo sapiens
agaaatgccccagtgt

SEQ ID NO: 4867021 - DNA, 21 bp, Homo sapiens
agaaatgtgtagctgcaaaaa

SEQ ID NO: 4867022 - DNA, 19 bp, Homo sapiens
agaaattcaatttggattt

SEQ ID NO: 4867023 - DNA, 22 bp, Homo sapiens
agaaattcaatttggatttaaa

SEQ ID NO: 4867024 - DNA, 11 bp, Homo sapiens
agaacacagtt

SEQ ID NO: 4867025 - DNA, 22 bp, Homo sapiens
agaacagcgggtacttatttct

SEQ ID NO: 4867026 - DNA, 19 bp, Homo sapiens
agaaccacacttgaaacct

SEQ ID NO: 4867027 - DNA, 22 bp, Homo sapiens
agaacctctaagtgctgctgtg

SEQ ID NO: 4867028 - DNA, 23 bp, Homo sapiens
agaacctctaagtgctgctgtgg

SEQ ID NO: 4867029 - DNA, 15 bp, Homo sapiens
agaacctgtgggctg

SEQ ID NO: 4867030 - DNA, 23 bp, Homo sapiens
agaactattgtgctcagagacac

SEQ ID NO: 4867031 - DNA, 20 bp, Homo sapiens
agaactcctgtcttctttct

SEQ ID NO: 4867032 - DNA, 13 bp, Homo sapiens
agaagaaagatgt

SEQ ID NO: 4867033 - DNA, 15 bp, Homo sapiens
agaagaaagatgttt

SEQ ID NO: 4867034 - DNA, 23 bp, Homo sapiens
agaagaatcttcctggcacaatg

SEQ ID NO: 4867035 - DNA, 24 bp, Homo sapiens
agaagagcgagagatcaaagatga

SEQ ID NO: 4867036 - DNA, 14 bp, Homo sapiens
agaagccagtgtct

SEQ ID NO: 4867037 - DNA, 13 bp, Homo sapiens
agaaggatgatgt

SEQ ID NO: 4867038 - DNA, 17 bp, Homo sapiens
agaaggcaaactgaggc

SEQ ID NO: 4867039 - DNA, 23 bp, Homo sapiens
agaaggcaaactgaggcagcatg

SEQ ID NO: 4867040 - DNA, 20 bp, Homo sapiens
agaaggccagagagggaaaa

SEQ ID NO: 4867041 - DNA, 19 bp, Homo sapiens
agaaggggctttgtgacca

SEQ ID NO: 4867042 - DNA, 14 bp, Homo sapiens
agaaggtgaacttt

SEQ ID NO: 4867043 - DNA, 21 bp, Homo sapiens
agaagtaagaggctacctctt

SEQ ID NO: 4867044 - DNA, 14 bp, Homo sapiens
agaagtacagggca

SEQ ID NO: 4867045 - DNA, 14 bp, Homo sapiens
agaagtgagcaaaa

SEQ ID NO: 4867046 - DNA, 18 bp, Homo sapiens
agaagtgagcaaaaaaga

SEQ ID NO: 4867047 - DNA, 17 bp, Homo sapiens
agaatactgccaaaaca

SEQ ID NO: 4867048 - DNA, 16 bp, Homo sapiens
agaatcagaagatagt

SEQ ID NO: 4867049 - DNA, 19 bp, Homo sapiens
agaatcttgttttgaaaat

SEQ ID NO: 4867050 - DNA, 22 bp, Homo sapiens
agaatcttgttttgaaaataac

SEQ ID NO: 4867051 - DNA, 16 bp, Homo sapiens
agaatgaccttgagtt

SEQ ID NO: 4867052 - DNA, 17 bp, Homo sapiens
agaatggcctggagcag

SEQ ID NO: 4867053 - DNA, 17 bp, Homo sapiens
agaatgggaatatttta

SEQ ID NO: 4867054 - DNA, 18 bp, Homo sapiens
agaatgggacgaggacat

SEQ ID NO: 4867055 - DNA, 11 bp, Homo sapiens
agaatgtattt

SEQ ID NO: 4867056 - DNA, 20 bp, Homo sapiens
agaatgtggaaatagatgtg

SEQ ID NO: 4867057 - DNA, 22 bp, Homo sapiens
agaatgttcctactcacacttc

SEQ ID NO: 4867058 - DNA, 15 bp, Homo sapiens
agaatgttttcaaat

SEQ ID NO: 4867059 - DNA, 21 bp, Homo sapiens
agaatgttttcaaatgttctc

SEQ ID NO: 4867060 - DNA, 23 bp, Homo sapiens
agaattaagaaatactcatgtgc

SEQ ID NO: 4867061 - DNA, 23 bp, Homo sapiens
agaattctgattgatttgattgg

SEQ ID NO: 4867062 - DNA, 16 bp, Homo sapiens
agaattgaaaagtttt

SEQ ID NO: 4867063 - DNA, 17 bp, Homo sapiens
agaattgaaaagttttt

SEQ ID NO: 4867064 - DNA, 19 bp, Homo sapiens
agaattgaaaagtttttgt

SEQ ID NO: 4867065 - DNA, 12 bp, Homo sapiens
agacaaaaagta

SEQ ID NO: 4867066 - DNA, 22 bp, Homo sapiens
agacaaatattcctttgcatat

SEQ ID NO: 4867067 - DNA, 18 bp, Homo sapiens
agacactgaaaaatctaa

SEQ ID NO: 4867068 - DNA, 14 bp, Homo sapiens
agacactgttgata

SEQ ID NO: 4867069 - DNA, 18 bp, Homo sapiens
agacactgttgataaaaa

SEQ ID NO: 4867070 - DNA, 14 bp, Homo sapiens
agacacttgctccc

SEQ ID NO: 4867071 - DNA, 17 bp, Homo sapiens
agacagagacaagtaat

SEQ ID NO: 4867072 - DNA, 14 bp, Homo sapiens
agacagcagcctgt

SEQ ID NO: 4867073 - DNA, 16 bp, Homo sapiens
agacagcagcctgtat

SEQ ID NO: 4867074 - DNA, 21 bp, Homo sapiens
agacagctggcggaggctgct

SEQ ID NO: 4867075 - DNA, 17 bp, Homo sapiens
agacagcttacaggagc

SEQ ID NO: 4867076 - DNA, 15 bp, Homo sapiens
agacaggagacaaaa

SEQ ID NO: 4867077 - DNA, 23 bp, Homo sapiens
agacatcagcctccttctttcac

SEQ ID NO: 4867078 - DNA, 22 bp, Homo sapiens
agacatccaaatttttttttaa

SEQ ID NO: 4867079 - DNA, 17 bp, Homo sapiens
agacatggaggggatga

SEQ ID NO: 4867080 - DNA, 21 bp, Homo sapiens
agacatggaggggatgataaa

SEQ ID NO: 4867081 - DNA, 14 bp, Homo sapiens
agacatgtgacatt

SEQ ID NO: 4867082 - DNA, 16 bp, Homo sapiens
agacatgtgacattta

SEQ ID NO: 4867083 - DNA, 17 bp, Homo sapiens
agacatgtgacatttat

SEQ ID NO: 4867084 - DNA, 16 bp, Homo sapiens
agaccataagagaaac

SEQ ID NO: 4867085 - DNA, 17 bp, Homo sapiens
agaccataagagaaacc

SEQ ID NO: 4867086 - DNA, 21 bp, Homo sapiens
agaccataagagaaacctgcc

SEQ ID NO: 4867087 - DNA, 11 bp, Homo sapiens
agacctgaaag

SEQ ID NO: 4867088 - DNA, 21 bp, Homo sapiens
agacctggagcttcagccagg

SEQ ID NO: 4867089 - DNA, 16 bp, Homo sapiens
agacgtggtgcttctc

SEQ ID NO: 4867090 - DNA, 16 bp, Homo sapiens
agacgtttataaacag

SEQ ID NO: 4867091 - DNA, 14 bp, Homo sapiens
agactcagcagagt

SEQ ID NO: 4867092 - DNA, 17 bp, Homo sapiens
agactcagcagagtgag

SEQ ID NO: 4867093 - DNA, 24 bp, Homo sapiens
agactgaatagatatgaaagctga

SEQ ID NO: 4867094 - DNA, 20 bp, Homo sapiens
agactggatttgcagaagtt

SEQ ID NO: 4867095 - DNA, 18 bp, Homo sapiens
agactgggcactggggcc

SEQ ID NO: 4867096 - DNA, 16 bp, Homo sapiens
agactggttcggctct

SEQ ID NO: 4867097 - DNA, 20 bp, Homo sapiens
agacttggagaatactgcca

SEQ ID NO: 4867098 - DNA, 21 bp, Homo sapiens
agagaaacctgccaaggagca

SEQ ID NO: 4867099 - DNA, 15 bp, Homo sapiens
agagaaagcacaatt

SEQ ID NO: 4867100 - DNA, 14 bp, Homo sapiens
agagaaatgcccca

SEQ ID NO: 4867101 - DNA, 18 bp, Homo sapiens
agagaatgagtccttgat

SEQ ID NO: 4867102 - DNA, 20 bp, Homo sapiens
agagacactgttgataaaaa

SEQ ID NO: 4867103 - DNA, 20 bp, Homo sapiens
agagaccataagagaaacct

SEQ ID NO: 4867104 - DNA, 18 bp, Homo sapiens
agagacttgcagttagac

SEQ ID NO: 4867105 - DNA, 22 bp, Homo sapiens
agagagcagagaagtacaggtc

SEQ ID NO: 4867106 - DNA, 17 bp, Homo sapiens
agagagggaaaaggcag

SEQ ID NO: 4867107 - DNA, 18 bp, Homo sapiens
agagagtagctgcagcct

SEQ ID NO: 4867108 - DNA, 12 bp, Homo sapiens
agagatttctca

SEQ ID NO: 4867109 - DNA, 12 bp, Homo sapiens
agagcagagaag

SEQ ID NO: 4867110 - DNA, 20 bp, Homo sapiens
agagcagagaagtacaggtc

SEQ ID NO: 4867111 - DNA, 14 bp, Homo sapiens
agagcataatttaa

SEQ ID NO: 4867112 - DNA, 18 bp, Homo sapiens
agagcataatttaaaaat

SEQ ID NO: 4867113 - DNA, 20 bp, Homo sapiens
agagcataatttaaaaatat

SEQ ID NO: 4867114 - DNA, 21 bp, Homo sapiens
agagcataatttaaaaatata

SEQ ID NO: 4867115 - DNA, 23 bp, Homo sapiens
agagcataatttaaaaatatatt

SEQ ID NO: 4867116 - DNA, 13 bp, Homo sapiens
agagcatcctgat

SEQ ID NO: 4867117 - DNA, 23 bp, Homo sapiens
agagcatcctgataccattctat

SEQ ID NO: 4867118 - DNA, 17 bp, Homo sapiens
agagccaattagacttg

SEQ ID NO: 4867119 - DNA, 20 bp, Homo sapiens
agagccttacttcaaagtgc

SEQ ID NO: 4867120 - DNA, 19 bp, Homo sapiens
agagcgagagatcaaagat

SEQ ID NO: 4867121 - DNA, 18 bp, Homo sapiens
agagcggggtcccctctg

SEQ ID NO: 4867122 - DNA, 19 bp, Homo sapiens
agagcggggtcccctctgt

SEQ ID NO: 4867123 - DNA, 22 bp, Homo sapiens
agagctctcccctcctgctggg

SEQ ID NO: 4867124 - DNA, 19 bp, Homo sapiens
agagctcttgtgttcagaa

SEQ ID NO: 4867125 - DNA, 18 bp, Homo sapiens
agagcttgtggtggggca

SEQ ID NO: 4867126 - DNA, 20 bp, Homo sapiens
agaggaccaatgcttgcatg

SEQ ID NO: 4867127 - DNA, 13 bp, Homo sapiens
agaggaggaaaag

SEQ ID NO: 4867128 - DNA, 22 bp, Homo sapiens
agaggcaagctgaaattttaga

SEQ ID NO: 4867129 - DNA, 17 bp, Homo sapiens
agagggaagatgacctg

SEQ ID NO: 4867130 - DNA, 14 bp, Homo sapiens
agagggaggggccc

SEQ ID NO: 4867131 - DNA, 15 bp, Homo sapiens
agagggcgagggatg

SEQ ID NO: 4867132 - DNA, 16 bp, Homo sapiens
agaggtagcactctca

SEQ ID NO: 4867133 - DNA, 19 bp, Homo sapiens
agaggtagcactctcagag

SEQ ID NO: 4867134 - DNA, 17 bp, Homo sapiens
agaggtattaaaactaa

SEQ ID NO: 4867135 - DNA, 15 bp, Homo sapiens
agaggtggggtgctg

SEQ ID NO: 4867136 - DNA, 21 bp, Homo sapiens
agaggtggggtgctggggctg

SEQ ID NO: 4867137 - DNA, 19 bp, Homo sapiens
agagtaagcagtgttactt

SEQ ID NO: 4867138 - DNA, 14 bp, Homo sapiens
agagtagggccctg

SEQ ID NO: 4867139 - DNA, 22 bp, Homo sapiens
agagtagggccctgacaggcct

SEQ ID NO: 4867140 - DNA, 12 bp, Homo sapiens
agagtcagacat

SEQ ID NO: 4867141 - DNA, 12 bp, Homo sapiens
agagtctgtctc

SEQ ID NO: 4867142 - DNA, 13 bp, Homo sapiens
agagtctgtctct

SEQ ID NO: 4867143 - DNA, 19 bp, Homo sapiens
agagtgcaacccagtcaca

SEQ ID NO: 4867144 - DNA, 17 bp, Homo sapiens
agagtggaaatggggaa

SEQ ID NO: 4867145 - DNA, 13 bp, Homo sapiens
agagtgggctttg

SEQ ID NO: 4867146 - DNA, 23 bp, Homo sapiens
agagtgggctttggtggccaggg

SEQ ID NO: 4867147 - DNA, 16 bp, Homo sapiens
agagttccggggagaa

SEQ ID NO: 4867148 - DNA, 20 bp, Homo sapiens
agagttctggatgtctggct

SEQ ID NO: 4867149 - DNA, 19 bp, Homo sapiens
agagttgggtgtctcctta

SEQ ID NO: 4867150 - DNA, 22 bp, Homo sapiens
agagttgggtgtctccttaagc

SEQ ID NO: 4867151 - DNA, 14 bp, Homo sapiens
agataaaatgatgt

SEQ ID NO: 4867152 - DNA, 16 bp, Homo sapiens
agataaagaataataa

SEQ ID NO: 4867153 - DNA, 14 bp, Homo sapiens
agataatattgttt

SEQ ID NO: 4867154 - DNA, 13 bp, Homo sapiens
agatacctgtgag

SEQ ID NO: 4867155 - DNA, 16 bp, Homo sapiens
agatacctgtgaggac

SEQ ID NO: 4867156 - DNA, 13 bp, Homo sapiens
agatatctgcatg

SEQ ID NO: 4867157 - DNA, 16 bp, Homo sapiens
agatatctgcatgtgt

SEQ ID NO: 4867158 - DNA, 12 bp, Homo sapiens
agatcaaagatg

SEQ ID NO: 4867159 - DNA, 14 bp, Homo sapiens
agatcaaatagttg

SEQ ID NO: 4867160 - DNA, 16 bp, Homo sapiens
agatcctgggtttcca

SEQ ID NO: 4867161 - DNA, 22 bp, Homo sapiens
agatctattgtttgttgcacta

SEQ ID NO: 4867162 - DNA, 22 bp, Homo sapiens
agatctgttttgtggtttggaa

SEQ ID NO: 4867163 - DNA, 22 bp, Homo sapiens
agatgacagaggtttgaaggag

SEQ ID NO: 4867164 - DNA, 18 bp, Homo sapiens
agatgaggctcagagagg

SEQ ID NO: 4867165 - DNA, 21 bp, Homo sapiens
agatgaggtcagttgtgtttt

SEQ ID NO: 4867166 - DNA, 16 bp, Homo sapiens
agatgatgctttggaa

SEQ ID NO: 4867167 - DNA, 20 bp, Homo sapiens
agatgcatcatctcttcctc

SEQ ID NO: 4867168 - DNA, 21 bp, Homo sapiens
agatgcctgatttcattcctc

SEQ ID NO: 4867169 - DNA, 21 bp, Homo sapiens
agatgctacttcccactgtat

SEQ ID NO: 4867170 - DNA, 15 bp, Homo sapiens
agatgtgttcttatt

SEQ ID NO: 4867171 - DNA, 15 bp, Homo sapiens
agatgtttatttcag

SEQ ID NO: 4867172 - DNA, 13 bp, Homo sapiens
agattcagagaaa

SEQ ID NO: 4867173 - DNA, 14 bp, Homo sapiens
agattcagagaaat

SEQ ID NO: 4867174 - DNA, 13 bp, Homo sapiens
agattcccacctt

SEQ ID NO: 4867175 - DNA, 18 bp, Homo sapiens
agattcccaccttccata

SEQ ID NO: 4867176 - DNA, 20 bp, Homo sapiens
agattctttcagttctttgg

SEQ ID NO: 4867177 - DNA, 12 bp, Homo sapiens
agattgaacttt

SEQ ID NO: 4867178 - DNA, 13 bp, Homo sapiens
agattgaactttc

SEQ ID NO: 4867179 - DNA, 19 bp, Homo sapiens
agattgactaactcaaata

SEQ ID NO: 4867180 - DNA, 21 bp, Homo sapiens
agattggccaattaaaaacga

SEQ ID NO: 4867181 - DNA, 15 bp, Homo sapiens
agattggttttcctg

SEQ ID NO: 4867182 - DNA, 20 bp, Homo sapiens
agattgtgatcccttgagat

SEQ ID NO: 4867183 - DNA, 14 bp, Homo sapiens
agcaaactctgctg

SEQ ID NO: 4867184 - DNA, 15 bp, Homo sapiens
agcaaactctgctgt

SEQ ID NO: 4867185 - DNA, 17 bp, Homo sapiens
agcaaattccagatttg

SEQ ID NO: 4867186 - DNA, 13 bp, Homo sapiens
agcaaccacactg

SEQ ID NO: 4867187 - DNA, 17 bp, Homo sapiens
agcaagagtaagcagtg

SEQ ID NO: 4867188 - DNA, 18 bp, Homo sapiens
agcaagagtaagcagtgt

SEQ ID NO: 4867189 - DNA, 13 bp, Homo sapiens
agcaaggcagagc

SEQ ID NO: 4867190 - DNA, 15 bp, Homo sapiens
agcaagtccttaggc

SEQ ID NO: 4867191 - DNA, 15 bp, Homo sapiens
agcaagtgagcagag

SEQ ID NO: 4867192 - DNA, 14 bp, Homo sapiens
agcacaaagaagaa

SEQ ID NO: 4867193 - DNA, 15 bp, Homo sapiens
agcacaaagaagaaa

SEQ ID NO: 4867194 - DNA, 17 bp, Homo sapiens
agcacaatttaaaacaa

SEQ ID NO: 4867195 - DNA, 19 bp, Homo sapiens
agcaccaacctccagactc

SEQ ID NO: 4867196 - DNA, 22 bp, Homo sapiens
agcactagccttcccagcttcc

SEQ ID NO: 4867197 - DNA, 18 bp, Homo sapiens
agcagaaaccaacaagaa

SEQ ID NO: 4867198 - DNA, 17 bp, Homo sapiens
agcagagatgtactgca

SEQ ID NO: 4867199 - DNA, 14 bp, Homo sapiens
agcagagcattgtc

SEQ ID NO: 4867200 - DNA, 15 bp, Homo sapiens
agcagagtctgtctc

SEQ ID NO: 4867201 - DNA, 19 bp, Homo sapiens
agcagagttttcattaaat

SEQ ID NO: 4867202 - DNA, 15 bp, Homo sapiens
agcagatgacagagg

SEQ ID NO: 4867203 - DNA, 16 bp, Homo sapiens
agcagcaggactgtgg

SEQ ID NO: 4867204 - DNA, 16 bp, Homo sapiens
agcagcaggcctctgg

SEQ ID NO: 4867205 - DNA, 17 bp, Homo sapiens
agcagcaggcctctggg

SEQ ID NO: 4867206 - DNA, 22 bp, Homo sapiens
agcagccaaggccgccagcgtg

SEQ ID NO: 4867207 - DNA, 20 bp, Homo sapiens
agcagcggattgctctggag

SEQ ID NO: 4867208 - DNA, 21 bp, Homo sapiens
agcaggaagccatagatgctg

SEQ ID NO: 4867209 - DNA, 12 bp, Homo sapiens
agcaggccagag

SEQ ID NO: 4867210 - DNA, 14 bp, Homo sapiens
agcaggccagagaa

SEQ ID NO: 4867211 - DNA, 19 bp, Homo sapiens
agcaggcccaatgctgctt

SEQ ID NO: 4867212 - DNA, 17 bp, Homo sapiens
agcaggcctctgggacc

SEQ ID NO: 4867213 - DNA, 22 bp, Homo sapiens
agcaggcctctgggacccacag

SEQ ID NO: 4867214 - DNA, 15 bp, Homo sapiens
agcagtatattagta

SEQ ID NO: 4867215 - DNA, 16 bp, Homo sapiens
agcagttcctgtccca

SEQ ID NO: 4867216 - DNA, 13 bp, Homo sapiens
agcagtttccagt

SEQ ID NO: 4867217 - DNA, 15 bp, Homo sapiens
agcataggctgggga

SEQ ID NO: 4867218 - DNA, 16 bp, Homo sapiens
agcatccagtgtgaga

SEQ ID NO: 4867219 - DNA, 17 bp, Homo sapiens
agcatgaaataaaatat

SEQ ID NO: 4867220 - DNA, 17 bp, Homo sapiens
agcatggacatttagaa

SEQ ID NO: 4867221 - DNA, 16 bp, Homo sapiens
agcatggggccaggaa

SEQ ID NO: 4867222 - DNA, 22 bp, Homo sapiens
agcattctttggagttaaaatg

SEQ ID NO: 4867223 - DNA, 22 bp, Homo sapiens
agcattgtaaaattatttcatg

SEQ ID NO: 4867224 - DNA, 13 bp, Homo sapiens
agcattgtaatta

SEQ ID NO: 4867225 - DNA, 21 bp, Homo sapiens
agcattgtcaccgcaggtgct

SEQ ID NO: 4867226 - DNA, 20 bp, Homo sapiens
agccaaatgcagggagggga

SEQ ID NO: 4867227 - DNA, 13 bp, Homo sapiens
agccaaatttaaa

SEQ ID NO: 4867228 - DNA, 19 bp, Homo sapiens
agccaaatttaaaactgtt

SEQ ID NO: 4867229 - DNA, 13 bp, Homo sapiens
agccaagctggca

SEQ ID NO: 4867230 - DNA, 14 bp, Homo sapiens
agccaagctggcac

SEQ ID NO: 4867231 - DNA, 20 bp, Homo sapiens
agccaaggccgccagcgtgt

SEQ ID NO: 4867232 - DNA, 13 bp, Homo sapiens
agccacagcagag

SEQ ID NO: 4867233 - DNA, 16 bp, Homo sapiens
agccacagcagagcat

SEQ ID NO: 4867234 - DNA, 15 bp, Homo sapiens
agccacccccaggca

SEQ ID NO: 4867235 - DNA, 20 bp, Homo sapiens
agccactggctgctaacaag

SEQ ID NO: 4867236 - DNA, 13 bp, Homo sapiens
agccacttctccc

SEQ ID NO: 4867237 - DNA, 17 bp, Homo sapiens
agccacttctccccaga

SEQ ID NO: 4867238 - DNA, 18 bp, Homo sapiens
agccacttctccccagaa

SEQ ID NO: 4867239 - DNA, 20 bp, Homo sapiens
agccagaacgtggctctgct

SEQ ID NO: 4867240 - DNA, 21 bp, Homo sapiens
agccagaacgtggctctgctg

SEQ ID NO: 4867241 - DNA, 19 bp, Homo sapiens
agccagccaagctttaaat

SEQ ID NO: 4867242 - DNA, 24 bp, Homo sapiens
agccagccaagctttaaattatgt

SEQ ID NO: 4867243 - DNA, 19 bp, Homo sapiens
agccagcctgcttcccaca

SEQ ID NO: 4867244 - DNA, 11 bp, Homo sapiens
agccaggactc

SEQ ID NO: 4867245 - DNA, 13 bp, Homo sapiens
agccaggactccc

SEQ ID NO: 4867246 - DNA, 14 bp, Homo sapiens
agccaggcaagaaa

SEQ ID NO: 4867247 - DNA, 17 bp, Homo sapiens
agccaggcaagaaagct

SEQ ID NO: 4867248 - DNA, 21 bp, Homo sapiens
agccaggctcaggagaagcca

SEQ ID NO: 4867249 - DNA, 22 bp, Homo sapiens
agccaggctcaggagaagccag

SEQ ID NO: 4867250 - DNA, 18 bp, Homo sapiens
agccaggtctgactccaa

SEQ ID NO: 4867251 - DNA, 15 bp, Homo sapiens
agccatgccaataaa

SEQ ID NO: 4867252 - DNA, 20 bp, Homo sapiens
agccatgccaataaagtgat

SEQ ID NO: 4867253 - DNA, 13 bp, Homo sapiens
agccatgcgtggc

SEQ ID NO: 4867254 - DNA, 15 bp, Homo sapiens
agcccaaacctggga

SEQ ID NO: 4867255 - DNA, 21 bp, Homo sapiens
agcccaaacctgggaaggcca

SEQ ID NO: 4867256 - DNA, 14 bp, Homo sapiens
agcccaacctacat

SEQ ID NO: 4867257 - DNA, 19 bp, Homo sapiens
agcccataggccaccccct

SEQ ID NO: 4867258 - DNA, 12 bp, Homo sapiens
agccccaggaga

SEQ ID NO: 4867259 - DNA, 16 bp, Homo sapiens
agccccctccttgtct

SEQ ID NO: 4867260 - DNA, 22 bp, Homo sapiens
agcccgcagaggtggggtgctg

SEQ ID NO: 4867261 - DNA, 16 bp, Homo sapiens
agccctcctgagggcc

SEQ ID NO: 4867262 - DNA, 20 bp, Homo sapiens
agccctcctgagggccggtt

SEQ ID NO: 4867263 - DNA, 18 bp, Homo sapiens
agccctggcaaatgcctg

SEQ ID NO: 4867264 - DNA, 23 bp, Homo sapiens
agccctggcaaatgcctgactca

SEQ ID NO: 4867265 - DNA, 17 bp, Homo sapiens
agccgcagacctggagc

SEQ ID NO: 4867266 - DNA, 18 bp, Homo sapiens
agccgcagacctggagct

SEQ ID NO: 4867267 - DNA, 21 bp, Homo sapiens
agccgcagagaaatgccccag

SEQ ID NO: 4867268 - DNA, 22 bp, Homo sapiens
agccgcagagaaatgccccagt

SEQ ID NO: 4867269 - DNA, 20 bp, Homo sapiens
agccggggggccgggggagg

SEQ ID NO: 4867270 - DNA, 16 bp, Homo sapiens
agccggtgggtgagga

SEQ ID NO: 4867271 - DNA, 13 bp, Homo sapiens
agcctaagaagaa

SEQ ID NO: 4867272 - DNA, 15 bp, Homo sapiens
agcctaagaagaagg

SEQ ID NO: 4867273 - DNA, 19 bp, Homo sapiens
agcctaaggctcctgtttt

SEQ ID NO: 4867274 - DNA, 16 bp, Homo sapiens
agcctacctctgtctg

SEQ ID NO: 4867275 - DNA, 17 bp, Homo sapiens
agcctacctctgtctga

SEQ ID NO: 4867276 - DNA, 19 bp, Homo sapiens
agcctacctctgtctgaga

SEQ ID NO: 4867277 - DNA, 18 bp, Homo sapiens
agcctagcctatgtctgg

SEQ ID NO: 4867278 - DNA, 13 bp, Homo sapiens
agcctatgtctgg

SEQ ID NO: 4867279 - DNA, 15 bp, Homo sapiens
agcctatgtctggca

SEQ ID NO: 4867280 - DNA, 17 bp, Homo sapiens
agcctatgtctggcaga

SEQ ID NO: 4867281 - DNA, 17 bp, Homo sapiens
agcctatttttttagat

SEQ ID NO: 4867282 - DNA, 17 bp, Homo sapiens
agcctctccgactctgc

SEQ ID NO: 4867283 - DNA, 19 bp, Homo sapiens
agcctctccgactctgcac

SEQ ID NO: 4867284 - DNA, 11 bp, Homo sapiens
agcctctggac

SEQ ID NO: 4867285 - DNA, 13 bp, Homo sapiens
agcctctggactg

SEQ ID NO: 4867286 - DNA, 18 bp, Homo sapiens
agcctctggactggaaag

SEQ ID NO: 4867287 - DNA, 19 bp, Homo sapiens
agcctctggactggaaagc

SEQ ID NO: 4867288 - DNA, 20 bp, Homo sapiens
agcctgactagaactcctgt

SEQ ID NO: 4867289 - DNA, 15 bp, Homo sapiens
agcctggccaggcag

SEQ ID NO: 4867290 - DNA, 20 bp, Homo sapiens
agcctggccaggcagggaga

SEQ ID NO: 4867291 - DNA, 21 bp, Homo sapiens
agcctggccaggcagggagag

SEQ ID NO: 4867292 - DNA, 15 bp, Homo sapiens
agcctgtatgtggtg

SEQ ID NO: 4867293 - DNA, 15 bp, Homo sapiens
agccttacttcaaag

SEQ ID NO: 4867294 - DNA, 18 bp, Homo sapiens
agccttagagctcttgtg

SEQ ID NO: 4867295 - DNA, 21 bp, Homo sapiens
agccttcaaaactatagcttg

SEQ ID NO: 4867296 - DNA, 22 bp, Homo sapiens
agccttcaaaactatagcttgc

SEQ ID NO: 4867297 - DNA, 17 bp, Homo sapiens
agccttcatcagaactc

SEQ ID NO: 4867298 - DNA, 23 bp, Homo sapiens
agccttcatcagaactcttcctc

SEQ ID NO: 4867299 - DNA, 17 bp, Homo sapiens
agccttctaaattccca

SEQ ID NO: 4867300 - DNA, 20 bp, Homo sapiens
agccttgcagatatctgcat

SEQ ID NO: 4867301 - DNA, 22 bp, Homo sapiens
agccttgtacagtctgctcctc

SEQ ID NO: 4867302 - DNA, 18 bp, Homo sapiens
agcctttacctgtgaagt

SEQ ID NO: 4867303 - DNA, 16 bp, Homo sapiens
agcctttactgtttga

SEQ ID NO: 4867304 - DNA, 19 bp, Homo sapiens
agcctttactgtttgatat

SEQ ID NO: 4867305 - DNA, 17 bp, Homo sapiens
agcggggtcccctctgt

SEQ ID NO: 4867306 - DNA, 12 bp, Homo sapiens
agcgtgtggagc

SEQ ID NO: 4867307 - DNA, 13 bp, Homo sapiens
agctacagaacac

SEQ ID NO: 4867308 - DNA, 17 bp, Homo sapiens
agctaggaaccctggag

SEQ ID NO: 4867309 - DNA, 17 bp, Homo sapiens
agctagtgcctttagag

SEQ ID NO: 4867310 - DNA, 23 bp, Homo sapiens
agctcaaatgaaatgtatgcatt

SEQ ID NO: 4867311 - DNA, 18 bp, Homo sapiens
agctccgggatcagcaac

SEQ ID NO: 4867312 - DNA, 19 bp, Homo sapiens
agctctagcctctggactg

SEQ ID NO: 4867313 - DNA, 20 bp, Homo sapiens
agctctcccctcctgctggg

SEQ ID NO: 4867314 - DNA, 23 bp, Homo sapiens
agctctcccctcctgctgggcgt

SEQ ID NO: 4867315 - DNA, 13 bp, Homo sapiens
agctctcctccag

SEQ ID NO: 4867316 - DNA, 15 bp, Homo sapiens
agctctcctccagcc

SEQ ID NO: 4867317 - DNA, 12 bp, Homo sapiens
agctctctggga

SEQ ID NO: 4867318 - DNA, 22 bp, Homo sapiens
agctctgggttgtgcacatttc

SEQ ID NO: 4867319 - DNA, 20 bp, Homo sapiens
agctcttgtgttcagaagaa

SEQ ID NO: 4867320 - DNA, 18 bp, Homo sapiens
agctgaagaattgaaaag

SEQ ID NO: 4867321 - DNA, 15 bp, Homo sapiens
agctgacagccacac

SEQ ID NO: 4867322 - DNA, 20 bp, Homo sapiens
agctgatactttgacagtgt

SEQ ID NO: 4867323 - DNA, 11 bp, Homo sapiens
agctgcagcct

SEQ ID NO: 4867324 - DNA, 13 bp, Homo sapiens
agctgcagcctgg

SEQ ID NO: 4867325 - DNA, 18 bp, Homo sapiens
agctgcagcctggttggc

SEQ ID NO: 4867326 - DNA, 21 bp, Homo sapiens
agctgcagcctggttggcagc

SEQ ID NO: 4867327 - DNA, 13 bp, Homo sapiens
agctgcagccttc

SEQ ID NO: 4867328 - DNA, 15 bp, Homo sapiens
agctgccatggctag

SEQ ID NO: 4867329 - DNA, 23 bp, Homo sapiens
agctgccgtagcttcagccaggc

SEQ ID NO: 4867330 - DNA, 20 bp, Homo sapiens
agctgctgttgaacttttta

SEQ ID NO: 4867331 - DNA, 13 bp, Homo sapiens
agctggggagccc

SEQ ID NO: 4867332 - DNA, 22 bp, Homo sapiens
agctggggagccctattgctgc

SEQ ID NO: 4867333 - DNA, 19 bp, Homo sapiens
agctgtacttcttgaatat

SEQ ID NO: 4867334 - DNA, 16 bp, Homo sapiens
agctgtatcactgcct

SEQ ID NO: 4867335 - DNA, 23 bp, Homo sapiens
agctgttccattacaccacagca

SEQ ID NO: 4867336 - DNA, 16 bp, Homo sapiens
agctgtttggaaaaga

SEQ ID NO: 4867337 - DNA, 14 bp, Homo sapiens
agcttacaggagcc

SEQ ID NO: 4867338 - DNA, 15 bp, Homo sapiens
agcttacaggagcca

SEQ ID NO: 4867339 - DNA, 14 bp, Homo sapiens
agcttacctgggca

SEQ ID NO: 4867340 - DNA, 22 bp, Homo sapiens
agcttacctgggcacaaacaga

SEQ ID NO: 4867341 - DNA, 23 bp, Homo sapiens
agcttcagccaggcaagaaagct

SEQ ID NO: 4867342 - DNA, 22 bp, Homo sapiens
agcttcagccaggtctgactcc

SEQ ID NO: 4867343 - DNA, 23 bp, Homo sapiens
agcttcagttgcttgtcttctgg

SEQ ID NO: 4867344 - DNA, 15 bp, Homo sapiens
agcttcatccacagc

SEQ ID NO: 4867345 - DNA, 15 bp, Homo sapiens
agcttccattttaat

SEQ ID NO: 4867346 - DNA, 10 bp, Homo sapiens
agcttcccaa

SEQ ID NO: 4867347 - DNA, 11 bp, Homo sapiens
agcttcccaac

SEQ ID NO: 4867348 - DNA, 14 bp, Homo sapiens
agcttcggagggcc

SEQ ID NO: 4867349 - DNA, 19 bp, Homo sapiens
agcttcggagggcccctgc

SEQ ID NO: 4867350 - DNA, 21 bp, Homo sapiens
agcttcggagggcccctgcgt

SEQ ID NO: 4867351 - DNA, 18 bp, Homo sapiens
agcttgctgggctttggg

SEQ ID NO: 4867352 - DNA, 19 bp, Homo sapiens
agcttgctgggctttggga

SEQ ID NO: 4867353 - DNA, 18 bp, Homo sapiens
agcttggttctgtgaaca

SEQ ID NO: 4867354 - DNA, 17 bp, Homo sapiens
agcttgtggtggggcag

SEQ ID NO: 4867355 - DNA, 19 bp, Homo sapiens
agcttgtggtggggcagga

SEQ ID NO: 4867356 - DNA, 19 bp, Homo sapiens
agctttgactctataagca

SEQ ID NO: 4867357 - DNA, 16 bp, Homo sapiens
aggaaaattcttaaaa

SEQ ID NO: 4867358 - DNA, 13 bp, Homo sapiens
aggaaagaaaagg

SEQ ID NO: 4867359 - DNA, 19 bp, Homo sapiens
aggaaagagctaggaaccc

SEQ ID NO: 4867360 - DNA, 13 bp, Homo sapiens
aggaactctagag

SEQ ID NO: 4867361 - DNA, 23 bp, Homo sapiens
aggaagtcagaatttttaactgt

SEQ ID NO: 4867362 - DNA, 14 bp, Homo sapiens
aggaagtgtttatg

SEQ ID NO: 4867363 - DNA, 15 bp, Homo sapiens
aggaatcccagaggt

SEQ ID NO: 4867364 - DNA, 22 bp, Homo sapiens
aggacatgcaataaaatttaaa

SEQ ID NO: 4867365 - DNA, 20 bp, Homo sapiens
aggacatttgtgggcaagca

SEQ ID NO: 4867366 - DNA, 23 bp, Homo sapiens
aggacatttgtgggcaagcagat

SEQ ID NO: 4867367 - DNA, 15 bp, Homo sapiens
aggacccagagctgc

SEQ ID NO: 4867368 - DNA, 16 bp, Homo sapiens
aggacccagagctgct

SEQ ID NO: 4867369 - DNA, 14 bp, Homo sapiens
aggacccatccctg

SEQ ID NO: 4867370 - DNA, 19 bp, Homo sapiens
aggacccatccctgcctgg

SEQ ID NO: 4867371 - DNA, 14 bp, Homo sapiens
aggaccctcgagag

SEQ ID NO: 4867372 - DNA, 23 bp, Homo sapiens
aggacctccctgtctcccggctc

SEQ ID NO: 4867373 - DNA, 11 bp, Homo sapiens
aggaccttgct

SEQ ID NO: 4867374 - DNA, 14 bp, Homo sapiens
aggactcccagaac

SEQ ID NO: 4867375 - DNA, 18 bp, Homo sapiens
aggactctctccaggagg

SEQ ID NO: 4867376 - DNA, 18 bp, Homo sapiens
aggactgatttcagagtg

SEQ ID NO: 4867377 - DNA, 18 bp, Homo sapiens
aggactggttctgaggcc

SEQ ID NO: 4867378 - DNA, 13 bp, Homo sapiens
aggacttgaaaga

SEQ ID NO: 4867379 - DNA, 16 bp, Homo sapiens
aggacttgaaagaaat

SEQ ID NO: 4867380 - DNA, 18 bp, Homo sapiens
aggacttggttgatgttt

SEQ ID NO: 4867381 - DNA, 22 bp, Homo sapiens
aggagaatggcatggcaggagt

SEQ ID NO: 4867382 - DNA, 14 bp, Homo sapiens
aggagatggggaat

SEQ ID NO: 4867383 - DNA, 15 bp, Homo sapiens
aggagattcccacct

SEQ ID NO: 4867384 - DNA, 21 bp, Homo sapiens
aggagattcccaccttccata

SEQ ID NO: 4867385 - DNA, 20 bp, Homo sapiens
aggagcacacatccaagagg

SEQ ID NO: 4867386 - DNA, 14 bp, Homo sapiens
aggagccagcctgc

SEQ ID NO: 4867387 - DNA, 16 bp, Homo sapiens
aggagccagcctgctt

SEQ ID NO: 4867388 - DNA, 13 bp, Homo sapiens
aggagcctggcca

SEQ ID NO: 4867389 - DNA, 14 bp, Homo sapiens
aggagcctggccag

SEQ ID NO: 4867390 - DNA, 15 bp, Homo sapiens
aggagcctggccagg

SEQ ID NO: 4867391 - DNA, 17 bp, Homo sapiens
aggagcctggccaggca

SEQ ID NO: 4867392 - DNA, 19 bp, Homo sapiens
aggagcctggccaggcagg

SEQ ID NO: 4867393 - DNA, 19 bp, Homo sapiens
aggagggttggagtgctct

SEQ ID NO: 4867394 - DNA, 20 bp, Homo sapiens
aggaggtgaaatccctgcct

SEQ ID NO: 4867395 - DNA, 17 bp, Homo sapiens
aggagtggtgatttgaa

SEQ ID NO: 4867396 - DNA, 12 bp, Homo sapiens
aggataaaataa

SEQ ID NO: 4867397 - DNA, 22 bp, Homo sapiens
aggatccccctctttgcacagc

SEQ ID NO: 4867398 - DNA, 17 bp, Homo sapiens
aggatcctggcctgaga

SEQ ID NO: 4867399 - DNA, 20 bp, Homo sapiens
aggatctccactggaccctt

SEQ ID NO: 4867400 - DNA, 17 bp, Homo sapiens
aggatgctaacatctaa

SEQ ID NO: 4867401 - DNA, 14 bp, Homo sapiens
aggatgtgatatat

SEQ ID NO: 4867402 - DNA, 15 bp, Homo sapiens
aggatgtgtgggcca

SEQ ID NO: 4867403 - DNA, 14 bp, Homo sapiens
aggcacattaactg

SEQ ID NO: 4867404 - DNA, 17 bp, Homo sapiens
aggcagatggagcccat

SEQ ID NO: 4867405 - DNA, 21 bp, Homo sapiens
aggcagcctagcctatgtctg

SEQ ID NO: 4867406 - DNA, 22 bp, Homo sapiens
aggcagcctagcctatgtctgg

SEQ ID NO: 4867407 - DNA, 16 bp, Homo sapiens
aggcaggggaatgtat

SEQ ID NO: 4867408 - DNA, 11 bp, Homo sapiens
aggcaggtgct

SEQ ID NO: 4867409 - DNA, 20 bp, Homo sapiens
aggcaggtgcttttggcaga

SEQ ID NO: 4867410 - DNA, 21 bp, Homo sapiens
aggcaggtgcttttggcagag

SEQ ID NO: 4867411 - DNA, 14 bp, Homo sapiens
aggcataaacctgt

SEQ ID NO: 4867412 - DNA, 20 bp, Homo sapiens
aggcatctgttagcagagtc

SEQ ID NO: 4867413 - DNA, 13 bp, Homo sapiens
aggcattggatat

SEQ ID NO: 4867414 - DNA, 22 bp, Homo sapiens
aggccacagaaggtgaactttg

SEQ ID NO: 4867415 - DNA, 21 bp, Homo sapiens
aggccagagaaagcaaaggtg

SEQ ID NO: 4867416 - DNA, 15 bp, Homo sapiens
aggccagagagggaa

SEQ ID NO: 4867417 - DNA, 23 bp, Homo sapiens
aggccagccttgtacagtctgct

SEQ ID NO: 4867418 - DNA, 17 bp, Homo sapiens
aggccaggacgtctggg

SEQ ID NO: 4867419 - DNA, 15 bp, Homo sapiens
aggcccaatgctgct

SEQ ID NO: 4867420 - DNA, 16 bp, Homo sapiens
aggcccaatgctgctt

SEQ ID NO: 4867421 - DNA, 12 bp, Homo sapiens
aggccgccagcg

SEQ ID NO: 4867422 - DNA, 22 bp, Homo sapiens
aggccgccagcgtgtggagcag

SEQ ID NO: 4867423 - DNA, 21 bp, Homo sapiens
aggcctctgggacccacagaa

SEQ ID NO: 4867424 - DNA, 19 bp, Homo sapiens
aggcctgcttgactttcca

SEQ ID NO: 4867425 - DNA, 21 bp, Homo sapiens
aggcctgcttgactttccaga

SEQ ID NO: 4867426 - DNA, 22 bp, Homo sapiens
aggcctgcttgactttccagaa

SEQ ID NO: 4867427 - DNA, 16 bp, Homo sapiens
aggccttatctgaaag

SEQ ID NO: 4867428 - DNA, 17 bp, Homo sapiens
aggccttcctcctctca

SEQ ID NO: 4867429 - DNA, 19 bp, Homo sapiens
aggccttcctcctctcaaa

SEQ ID NO: 4867430 - DNA, 24 bp, Homo sapiens
aggctactgtaatgctgcctcagg

SEQ ID NO: 4867431 - DNA, 17 bp, Homo sapiens
aggctattttctaaaga

SEQ ID NO: 4867432 - DNA, 13 bp, Homo sapiens
aggctcaggagaa

SEQ ID NO: 4867433 - DNA, 14 bp, Homo sapiens
aggctcaggagaag

SEQ ID NO: 4867434 - DNA, 18 bp, Homo sapiens
aggctccgggcaccaggg

SEQ ID NO: 4867435 - DNA, 23 bp, Homo sapiens
aggctccgggcaccaggggccaa

SEQ ID NO: 4867436 - DNA, 13 bp, Homo sapiens
aggctcctctagg

SEQ ID NO: 4867437 - DNA, 16 bp, Homo sapiens
aggctcctgttttgca

SEQ ID NO: 4867438 - DNA, 22 bp, Homo sapiens
aggctcctgttttgcacagcca

SEQ ID NO: 4867439 - DNA, 21 bp, Homo sapiens
aggctgagaaagctaaagttt

SEQ ID NO: 4867440 - DNA, 21 bp, Homo sapiens
aggctgcagaggcacctcaac

SEQ ID NO: 4867441 - DNA, 22 bp, Homo sapiens
aggctggatgtgcattagcctg

SEQ ID NO: 4867442 - DNA, 19 bp, Homo sapiens
aggctgggcctcccctggg

SEQ ID NO: 4867443 - DNA, 23 bp, Homo sapiens
aggctggggacacaggatcctgg

SEQ ID NO: 4867444 - DNA, 11 bp, Homo sapiens
aggctgtgttt

SEQ ID NO: 4867445 - DNA, 17 bp, Homo sapiens
aggctgtgtttagattg

SEQ ID NO: 4867446 - DNA, 21 bp, Homo sapiens
aggcttgtttacctttctctc

SEQ ID NO: 4867447 - DNA, 23 bp, Homo sapiens
aggctttgggtggctcactactg

SEQ ID NO: 4867448 - DNA, 22 bp, Homo sapiens
agggaaaagataaagaccagaa

SEQ ID NO: 4867449 - DNA, 15 bp, Homo sapiens
agggaaaaggcaggt

SEQ ID NO: 4867450 - DNA, 18 bp, Homo sapiens
agggaaaaggcaggtgct

SEQ ID NO: 4867451 - DNA, 21 bp, Homo sapiens
agggaaaccagagtctgtatt

SEQ ID NO: 4867452 - DNA, 14 bp, Homo sapiens
agggaagacctgaa

SEQ ID NO: 4867453 - DNA, 17 bp, Homo sapiens
agggaagatgacctgcc

SEQ ID NO: 4867454 - DNA, 21 bp, Homo sapiens
agggaataataggccacagaa

SEQ ID NO: 4867455 - DNA, 20 bp, Homo sapiens
agggaatctagcccaaccta

SEQ ID NO: 4867456 - DNA, 20 bp, Homo sapiens
agggaccccagatacctgtg

SEQ ID NO: 4867457 - DNA, 14 bp, Homo sapiens
agggactccaagcc

SEQ ID NO: 4867458 - DNA, 13 bp, Homo sapiens
agggagagagtag

SEQ ID NO: 4867459 - DNA, 14 bp, Homo sapiens
agggagttcatctg

SEQ ID NO: 4867460 - DNA, 20 bp, Homo sapiens
agggagttcatctggagggt

SEQ ID NO: 4867461 - DNA, 14 bp, Homo sapiens
agggatctgcttga

SEQ ID NO: 4867462 - DNA, 20 bp, Homo sapiens
agggatggagggaagacctg

SEQ ID NO: 4867463 - DNA, 22 bp, Homo sapiens
agggattctgggcttggggtgt

SEQ ID NO: 4867464 - DNA, 22 bp, Homo sapiens
agggcaccgtattcctctccca

SEQ ID NO: 4867465 - DNA, 19 bp, Homo sapiens
agggcagcaggccagagaa

SEQ ID NO: 4867466 - DNA, 14 bp, Homo sapiens
agggcataaagtaa

SEQ ID NO: 4867467 - DNA, 20 bp, Homo sapiens
agggcataaagtaaatacat

SEQ ID NO: 4867468 - DNA, 12 bp, Homo sapiens
agggcccctgcg

SEQ ID NO: 4867469 - DNA, 19 bp, Homo sapiens
agggcccctgcgtgggggc

SEQ ID NO: 4867470 - DNA, 22 bp, Homo sapiens
agggcgagggatgatgagggaa

SEQ ID NO: 4867471 - DNA, 24 bp, Homo sapiens
agggctcggggtgtgtcatttcta

SEQ ID NO: 4867472 - DNA, 22 bp, Homo sapiens
aggggagagagcagagaagtac

SEQ ID NO: 4867473 - DNA, 13 bp, Homo sapiens
aggggagccagct

SEQ ID NO: 4867474 - DNA, 15 bp, Homo sapiens
aggggagccagctgc

SEQ ID NO: 4867475 - DNA, 18 bp, Homo sapiens
aggggagccagctgcttg

SEQ ID NO: 4867476 - DNA, 14 bp, Homo sapiens
aggggaggcagatg

SEQ ID NO: 4867477 - DNA, 12 bp, Homo sapiens
aggggaggtggc

SEQ ID NO: 4867478 - DNA, 14 bp, Homo sapiens
aggggaggtggcca

SEQ ID NO: 4867479 - DNA, 19 bp, Homo sapiens
aggggaggtggccagcccg

SEQ ID NO: 4867480 - DNA, 23 bp, Homo sapiens
aggggaggtggccagcccgcaga

SEQ ID NO: 4867481 - DNA, 16 bp, Homo sapiens
aggggatgataaagga

SEQ ID NO: 4867482 - DNA, 17 bp, Homo sapiens
aggggatgataaaggaa

SEQ ID NO: 4867483 - DNA, 17 bp, Homo sapiens
aggggccccgtgtcctg

SEQ ID NO: 4867484 - DNA, 18 bp, Homo sapiens
aggggccccgtgtcctgc

SEQ ID NO: 4867485 - DNA, 20 bp, Homo sapiens
aggggccccgtgtcctgcct

SEQ ID NO: 4867486 - DNA, 15 bp, Homo sapiens
aggggccctgtcact

SEQ ID NO: 4867487 - DNA, 19 bp, Homo sapiens
aggggcctgggctgtgagg

SEQ ID NO: 4867488 - DNA, 22 bp, Homo sapiens
aggggcctgggctgtgaggaca

SEQ ID NO: 4867489 - DNA, 16 bp, Homo sapiens
aggggcgcgggagggg

SEQ ID NO: 4867490 - DNA, 14 bp, Homo sapiens
aggggctggtggag

SEQ ID NO: 4867491 - DNA, 15 bp, Homo sapiens
aggggctggtggaga

SEQ ID NO: 4867492 - DNA, 13 bp, Homo sapiens
agggggctgctgc

SEQ ID NO: 4867493 - DNA, 16 bp, Homo sapiens
agggggctgctgctcc

SEQ ID NO: 4867494 - DNA, 15 bp, Homo sapiens
agggtagtggctggg

SEQ ID NO: 4867495 - DNA, 20 bp, Homo sapiens
agggtctaccaatacaaaat

SEQ ID NO: 4867496 - DNA, 23 bp, Homo sapiens
agggtctaccaatacaaaatgta

SEQ ID NO: 4867497 - DNA, 13 bp, Homo sapiens
agggtctctcagg

SEQ ID NO: 4867498 - DNA, 21 bp, Homo sapiens
agggttggagtgctcttccca

SEQ ID NO: 4867499 - DNA, 14 bp, Homo sapiens
aggtaaacaaagac

SEQ ID NO: 4867500 - DNA, 19 bp, Homo sapiens
aggtacgatgacagtgttc

SEQ ID NO: 4867501 - DNA, 20 bp, Homo sapiens
aggtagcattctttggagtt

SEQ ID NO: 4867502 - DNA, 17 bp, Homo sapiens
aggtatactttagtaga

SEQ ID NO: 4867503 - DNA, 19 bp, Homo sapiens
aggtctgactccaaagctg

SEQ ID NO: 4867504 - DNA, 21 bp, Homo sapiens
aggtgaaatccctgcctcagg

SEQ ID NO: 4867505 - DNA, 21 bp, Homo sapiens
aggtgataagggaaaagataa

SEQ ID NO: 4867506 - DNA, 13 bp, Homo sapiens
aggtgatgagttt

SEQ ID NO: 4867507 - DNA, 16 bp, Homo sapiens
aggtgcttttggcaga

SEQ ID NO: 4867508 - DNA, 17 bp, Homo sapiens
aggtgcttttggcagag

SEQ ID NO: 4867509 - DNA, 17 bp, Homo sapiens
aggtgggatcctccctc

SEQ ID NO: 4867510 - DNA, 13 bp, Homo sapiens
aggtggggtgctg

SEQ ID NO: 4867511 - DNA, 21 bp, Homo sapiens
aggtggtggtggtggtgaagg

SEQ ID NO: 4867512 - DNA, 19 bp, Homo sapiens
aggtggttgtcttattgca

SEQ ID NO: 4867513 - DNA, 22 bp, Homo sapiens
aggtgtattggtgttgcagccg

SEQ ID NO: 4867514 - DNA, 13 bp, Homo sapiens
aggtgtgaggaga

SEQ ID NO: 4867515 - DNA, 17 bp, Homo sapiens
aggtgtgaggagagagg

SEQ ID NO: 4867516 - DNA, 13 bp, Homo sapiens
aggttaatattta

SEQ ID NO: 4867517 - DNA, 22 bp, Homo sapiens
aggttctgtagagccaattaga

SEQ ID NO: 4867518 - DNA, 14 bp, Homo sapiens
aggttgtggggcct

SEQ ID NO: 4867519 - DNA, 22 bp, Homo sapiens
aggttgtggggcctcaggctcc

SEQ ID NO: 4867520 - DNA, 22 bp, Homo sapiens
aggtttacaataggagtggtga

SEQ ID NO: 4867521 - DNA, 19 bp, Homo sapiens
aggtttcaggaagttgcca

SEQ ID NO: 4867522 - DNA, 19 bp, Homo sapiens
aggtttgaaggagaatggc

SEQ ID NO: 4867523 - DNA, 13 bp, Homo sapiens
aggtttgcaggag

SEQ ID NO: 4867524 - DNA, 19 bp, Homo sapiens
aggtttttttccttctgaa

SEQ ID NO: 4867525 - DNA, 14 bp, Homo sapiens
agtaaaattcagtt

SEQ ID NO: 4867526 - DNA, 21 bp, Homo sapiens
agtaacccccttaaatttaat

SEQ ID NO: 4867527 - DNA, 23 bp, Homo sapiens
agtaagaataccacatcaaataa

SEQ ID NO: 4867528 - DNA, 19 bp, Homo sapiens
agtaaggtgcttggagttt

SEQ ID NO: 4867529 - DNA, 16 bp, Homo sapiens
agtacatttaaatttt

SEQ ID NO: 4867530 - DNA, 15 bp, Homo sapiens
agtacctgtgactct

SEQ ID NO: 4867531 - DNA, 19 bp, Homo sapiens
agtacttggcccccttcag

SEQ ID NO: 4867532 - DNA, 22 bp, Homo sapiens
agtacttggcccccttcaggag

SEQ ID NO: 4867533 - DNA, 18 bp, Homo sapiens
agtagatgtggcctttga

SEQ ID NO: 4867534 - DNA, 23 bp, Homo sapiens
agtagcatctcagtggtgtgtga

SEQ ID NO: 4867535 - DNA, 15 bp, Homo sapiens
agtagctgcagcctt

SEQ ID NO: 4867536 - DNA, 13 bp, Homo sapiens
agtagggccctga

SEQ ID NO: 4867537 - DNA, 20 bp, Homo sapiens
agtagggccctgacaggcct

SEQ ID NO: 4867538 - DNA, 13 bp, Homo sapiens
agtataaaatagt

SEQ ID NO: 4867539 - DNA, 19 bp, Homo sapiens
agtataagactactgaatc

SEQ ID NO: 4867540 - DNA, 21 bp, Homo sapiens
agtatattgataaccttgaaa

SEQ ID NO: 4867541 - DNA, 14 bp, Homo sapiens
agtatattgttgaa

SEQ ID NO: 4867542 - DNA, 21 bp, Homo sapiens
agtatgcattattaaattgta

SEQ ID NO: 4867543 - DNA, 12 bp, Homo sapiens
agtattgtttaa

SEQ ID NO: 4867544 - DNA, 13 bp, Homo sapiens
agtattgtttaaa

SEQ ID NO: 4867545 - DNA, 16 bp, Homo sapiens
agtattgtttaaaatg

SEQ ID NO: 4867546 - DNA, 19 bp, Homo sapiens
agtattgtttaaaatgtaa

SEQ ID NO: 4867547 - DNA, 21 bp, Homo sapiens
agtcaccaaatagtgtgaaat

SEQ ID NO: 4867548 - DNA, 18 bp, Homo sapiens
agtcactgctgcaaggtg

SEQ ID NO: 4867549 - DNA, 20 bp, Homo sapiens
agtcagaatttttaactgta

SEQ ID NO: 4867550 - DNA, 19 bp, Homo sapiens
agtcagacatttctttgga

SEQ ID NO: 4867551 - DNA, 20 bp, Homo sapiens
agtcagatgaggcaaacagc

SEQ ID NO: 4867552 - DNA, 16 bp, Homo sapiens
agtcagtgccaggtcc

SEQ ID NO: 4867553 - DNA, 23 bp, Homo sapiens
agtcagttgctcaaaaagaaatc

SEQ ID NO: 4867554 - DNA, 16 bp, Homo sapiens
agtcataggttaatat

SEQ ID NO: 4867555 - DNA, 12 bp, Homo sapiens
agtcatgtgacc

SEQ ID NO: 4867556 - DNA, 23 bp, Homo sapiens
agtcattaaagacaggagacaaa

SEQ ID NO: 4867557 - DNA, 15 bp, Homo sapiens
agtcattggcaaagt

SEQ ID NO: 4867558 - DNA, 16 bp, Homo sapiens
agtccagcagtttcca

SEQ ID NO: 4867559 - DNA, 22 bp, Homo sapiens
agtccaggatgctaacatctaa

SEQ ID NO: 4867560 - DNA, 18 bp, Homo sapiens
agtccgcagttgtagcag

SEQ ID NO: 4867561 - DNA, 20 bp, Homo sapiens
agtcctaaaagttctcaatg

SEQ ID NO: 4867562 - DNA, 22 bp, Homo sapiens
agtcctaaaagttctcaatgta

SEQ ID NO: 4867563 - DNA, 24 bp, Homo sapiens
agtcctaaaagttctcaatgtaga

SEQ ID NO: 4867564 - DNA, 19 bp, Homo sapiens
agtccttaggctactgtaa

SEQ ID NO: 4867565 - DNA, 23 bp, Homo sapiens
agtccttgatttcaaagttttgt

SEQ ID NO: 4867566 - DNA, 15 bp, Homo sapiens
agtcgccagtcactg

SEQ ID NO: 4867567 - DNA, 14 bp, Homo sapiens
agtcgtggggaacg

SEQ ID NO: 4867568 - DNA, 20 bp, Homo sapiens
agtctcataggttaaaaaaa

SEQ ID NO: 4867569 - DNA, 17 bp, Homo sapiens
agtctccagaagaaaat

SEQ ID NO: 4867570 - DNA, 23 bp, Homo sapiens
agtctctgccagttacttgggct

SEQ ID NO: 4867571 - DNA, 16 bp, Homo sapiens
agtctctgtgtaacca

SEQ ID NO: 4867572 - DNA, 13 bp, Homo sapiens
agtctgctcctct

SEQ ID NO: 4867573 - DNA, 14 bp, Homo sapiens
agtctgctcctctt

SEQ ID NO: 4867574 - DNA, 20 bp, Homo sapiens
agtctgctcctcttgttcct

SEQ ID NO: 4867575 - DNA, 23 bp, Homo sapiens
agtctgctcctcttgttcctgaa

SEQ ID NO: 4867576 - DNA, 23 bp, Homo sapiens
agtctggagtgggataggagcag

SEQ ID NO: 4867577 - DNA, 22 bp, Homo sapiens
agtctgtactaaacagtaagat

SEQ ID NO: 4867578 - DNA, 23 bp, Homo sapiens
agtctgtctcttggctttgtcac

SEQ ID NO: 4867579 - DNA, 23 bp, Homo sapiens
agtcttagctgaggctgagaaag

SEQ ID NO: 4867580 - DNA, 22 bp, Homo sapiens
agtcttggaagctgtttggaaa

SEQ ID NO: 4867581 - DNA, 15 bp, Homo sapiens
agtctttcatggctg

SEQ ID NO: 4867582 - DNA, 20 bp, Homo sapiens
agtctttcttcactctggct

SEQ ID NO: 4867583 - DNA, 18 bp, Homo sapiens
agtgacaaagcctctgaa

SEQ ID NO: 4867584 - DNA, 17 bp, Homo sapiens
agtgacatttaatgcca

SEQ ID NO: 4867585 - DNA, 11 bp, Homo sapiens
agtgactccag

SEQ ID NO: 4867586 - DNA, 22 bp, Homo sapiens
agtgagcagagatgtactgcaa

SEQ ID NO: 4867587 - DNA, 21 bp, Homo sapiens
agtgagtgacaaagcctctga

SEQ ID NO: 4867588 - DNA, 20 bp, Homo sapiens
agtgatgtccttaaaatgtg

SEQ ID NO: 4867589 - DNA, 21 bp, Homo sapiens
agtgcatgaaaaaccattttt

SEQ ID NO: 4867590 - DNA, 14 bp, Homo sapiens
agtgcctcggacag

SEQ ID NO: 4867591 - DNA, 18 bp, Homo sapiens
agtgcctgggctcagcct

SEQ ID NO: 4867592 - DNA, 22 bp, Homo sapiens
agtgcctgtgagcatggggcca

SEQ ID NO: 4867593 - DNA, 19 bp, Homo sapiens
agtgctcttcccactccag

SEQ ID NO: 4867594 - DNA, 16 bp, Homo sapiens
agtgctgctgtggagt

SEQ ID NO: 4867595 - DNA, 23 bp, Homo sapiens
agtgctgtcttaaactaaatgtg

SEQ ID NO: 4867596 - DNA, 22 bp, Homo sapiens
agtgctgttgggatatagtcaa

SEQ ID NO: 4867597 - DNA, 23 bp, Homo sapiens
agtggaaatggggaactccccca

SEQ ID NO: 4867598 - DNA, 16 bp, Homo sapiens
agtggaacgaaaatga

SEQ ID NO: 4867599 - DNA, 21 bp, Homo sapiens
agtggaagtatgtatattaaa

SEQ ID NO: 4867600 - DNA, 15 bp, Homo sapiens
agtggatcacaaagt

SEQ ID NO: 4867601 - DNA, 23 bp, Homo sapiens
agtggcctgctaaggctcctcct

SEQ ID NO: 4867602 - DNA, 12 bp, Homo sapiens
agtgggaatgtt

SEQ ID NO: 4867603 - DNA, 18 bp, Homo sapiens
agtgggccctctctctgg

SEQ ID NO: 4867604 - DNA, 14 bp, Homo sapiens
agtggtgagcaagc

SEQ ID NO: 4867605 - DNA, 15 bp, Homo sapiens
agtggtgatttgaaa

SEQ ID NO: 4867606 - DNA, 12 bp, Homo sapiens
agtggtggaggt

SEQ ID NO: 4867607 - DNA, 15 bp, Homo sapiens
agtggtggaggtggg

SEQ ID NO: 4867608 - DNA, 17 bp, Homo sapiens
agtggtggaggtgggtg

SEQ ID NO: 4867609 - DNA, 16 bp, Homo sapiens
agtgtagctgtgaaat

SEQ ID NO: 4867610 - DNA, 19 bp, Homo sapiens
agtgtctaggcactgagca

SEQ ID NO: 4867611 - DNA, 20 bp, Homo sapiens
agtgtctaggcactgagcag

SEQ ID NO: 4867612 - DNA, 15 bp, Homo sapiens
agtgtgtgccaagag

SEQ ID NO: 4867613 - DNA, 19 bp, Homo sapiens
agtgttgcctcttgcaatg

SEQ ID NO: 4867614 - DNA, 21 bp, Homo sapiens
agtgttgcctcttgcaatgcc

SEQ ID NO: 4867615 - DNA, 20 bp, Homo sapiens
agttaaaattgttatcaaaa

SEQ ID NO: 4867616 - DNA, 18 bp, Homo sapiens
agttaaagaaaggaaaag

SEQ ID NO: 4867617 - DNA, 13 bp, Homo sapiens
agttaacaggaca

SEQ ID NO: 4867618 - DNA, 15 bp, Homo sapiens
agttacttgggcttc

SEQ ID NO: 4867619 - DNA, 15 bp, Homo sapiens
agttatcatgaattt

SEQ ID NO: 4867620 - DNA, 12 bp, Homo sapiens
agttcaaaaaca

SEQ ID NO: 4867621 - DNA, 19 bp, Homo sapiens
agttcatattccatattta

SEQ ID NO: 4867622 - DNA, 20 bp, Homo sapiens
agttcatattccatatttat

SEQ ID NO: 4867623 - DNA, 14 bp, Homo sapiens
agttcctcttttgt

SEQ ID NO: 4867624 - DNA, 15 bp, Homo sapiens
agttctcaaatgtgt

SEQ ID NO: 4867625 - DNA, 16 bp, Homo sapiens
agttctcaaatgtgtg

SEQ ID NO: 4867626 - DNA, 17 bp, Homo sapiens
agttctcaaatgtgtgt

SEQ ID NO: 4867627 - DNA, 16 bp, Homo sapiens
agttctctcccttcct

SEQ ID NO: 4867628 - DNA, 17 bp, Homo sapiens
agttctggatgtctggc

SEQ ID NO: 4867629 - DNA, 15 bp, Homo sapiens
agttctttggattct

SEQ ID NO: 4867630 - DNA, 17 bp, Homo sapiens
agttgaagttagtggaa

SEQ ID NO: 4867631 - DNA, 15 bp, Homo sapiens
agttgcactcaggtg

SEQ ID NO: 4867632 - DNA, 18 bp, Homo sapiens
agttgcatagcagtatat

SEQ ID NO: 4867633 - DNA, 21 bp, Homo sapiens
agttgcccccattcccagcct

SEQ ID NO: 4867634 - DNA, 22 bp, Homo sapiens
agttgcccccattcccagcctg

SEQ ID NO: 4867635 - DNA, 14 bp, Homo sapiens
agttggaagggacc

SEQ ID NO: 4867636 - DNA, 20 bp, Homo sapiens
agttggaagggaccccagat

SEQ ID NO: 4867637 - DNA, 17 bp, Homo sapiens
agttggactctcaggga

SEQ ID NO: 4867638 - DNA, 16 bp, Homo sapiens
agttgggtgtctcctt

SEQ ID NO: 4867639 - DNA, 16 bp, Homo sapiens
agttgtgtgtatgtgt

SEQ ID NO: 4867640 - DNA, 18 bp, Homo sapiens
agttgtgtgtatgtgtgt

SEQ ID NO: 4867641 - DNA, 23 bp, Homo sapiens
agttgtgtttcaacggaaagtgc

SEQ ID NO: 4867642 - DNA, 19 bp, Homo sapiens
agttgtgttttttaagatg

SEQ ID NO: 4867643 - DNA, 15 bp, Homo sapiens
agtttcaagttttaa

SEQ ID NO: 4867644 - DNA, 18 bp, Homo sapiens
agtttcaagttttaaagt

SEQ ID NO: 4867645 - DNA, 18 bp, Homo sapiens
agtttcagtttgttggaa

SEQ ID NO: 4867646 - DNA, 19 bp, Homo sapiens
agtttcagtttgttggaaa

SEQ ID NO: 4867647 - DNA, 18 bp, Homo sapiens
agtttgacagtttttgac

SEQ ID NO: 4867648 - DNA, 11 bp, Homo sapiens
agttttaaagt

SEQ ID NO: 4867649 - DNA, 18 bp, Homo sapiens
agttttaactgtggatat

SEQ ID NO: 4867650 - DNA, 16 bp, Homo sapiens
agttttatatgcttta

SEQ ID NO: 4867651 - DNA, 17 bp, Homo sapiens
agttttcggaaacactg

SEQ ID NO: 4867652 - DNA, 13 bp, Homo sapiens
ataaaaatatatt

SEQ ID NO: 4867653 - DNA, 13 bp, Homo sapiens
ataaaacgctttc

SEQ ID NO: 4867654 - DNA, 14 bp, Homo sapiens
ataaacactacaga

SEQ ID NO: 4867655 - DNA, 21 bp, Homo sapiens
ataaaccctccaagggatctg

SEQ ID NO: 4867656 - DNA, 17 bp, Homo sapiens
ataaagaccagaaattc

SEQ ID NO: 4867657 - DNA, 22 bp, Homo sapiens
ataaagctcaaatgaaatgtat

SEQ ID NO: 4867658 - DNA, 16 bp, Homo sapiens
ataaagtacttgacta

SEQ ID NO: 4867659 - DNA, 20 bp, Homo sapiens
ataaagtgatctgtgttcaa

SEQ ID NO: 4867660 - DNA, 22 bp, Homo sapiens
ataaagtggaagtatgtatatt

SEQ ID NO: 4867661 - DNA, 12 bp, Homo sapiens
ataaataatttt

SEQ ID NO: 4867662 - DNA, 15 bp, Homo sapiens
ataaatcataaagtc

SEQ ID NO: 4867663 - DNA, 16 bp, Homo sapiens
ataaatcataaagtca

SEQ ID NO: 4867664 - DNA, 18 bp, Homo sapiens
ataaatcataaagtcagt

SEQ ID NO: 4867665 - DNA, 20 bp, Homo sapiens
ataaatcattcttactaaaa

SEQ ID NO: 4867666 - DNA, 14 bp, Homo sapiens
ataaatgtgactca

SEQ ID NO: 4867667 - DNA, 20 bp, Homo sapiens
ataacatctttattgaaatt

SEQ ID NO: 4867668 - DNA, 16 bp, Homo sapiens
ataacattttgagaaa

SEQ ID NO: 4867669 - DNA, 15 bp, Homo sapiens
ataactgaatttgga

SEQ ID NO: 4867670 - DNA, 17 bp, Homo sapiens
ataacttggggaggcaa

SEQ ID NO: 4867671 - DNA, 22 bp, Homo sapiens
ataagaaataatgctacaattt

SEQ ID NO: 4867672 - DNA, 23 bp, Homo sapiens
ataagaagaagttcatgtccaaa

SEQ ID NO: 4867673 - DNA, 11 bp, Homo sapiens
ataagagaaac

SEQ ID NO: 4867674 - DNA, 18 bp, Homo sapiens
ataagataaaatgatgtt

SEQ ID NO: 4867675 - DNA, 18 bp, Homo sapiens
ataagcaaattgcttttt

SEQ ID NO: 4867676 - DNA, 13 bp, Homo sapiens
ataagcactgtaa

SEQ ID NO: 4867677 - DNA, 22 bp, Homo sapiens
ataagcttccattttaatttta

SEQ ID NO: 4867678 - DNA, 16 bp, Homo sapiens
ataagggaaaagataa

SEQ ID NO: 4867679 - DNA, 18 bp, Homo sapiens
ataataaagtacttgact

SEQ ID NO: 4867680 - DNA, 13 bp, Homo sapiens
ataatgaataaat

SEQ ID NO: 4867681 - DNA, 15 bp, Homo sapiens
ataatgctacaattt

SEQ ID NO: 4867682 - DNA, 19 bp, Homo sapiens
ataatgtactgatttcagt

SEQ ID NO: 4867683 - DNA, 24 bp, Homo sapiens
ataattgtacaaaattaagcaaat

SEQ ID NO: 4867684 - DNA, 16 bp, Homo sapiens
ataatttccttcaggc

SEQ ID NO: 4867685 - DNA, 13 bp, Homo sapiens
ataatttgaactt

SEQ ID NO: 4867686 - DNA, 14 bp, Homo sapiens
ataatttgaacttt

SEQ ID NO: 4867687 - DNA, 14 bp, Homo sapiens
atacacacacacac

SEQ ID NO: 4867688 - DNA, 20 bp, Homo sapiens
atacataaaagaaataaacc

SEQ ID NO: 4867689 - DNA, 15 bp, Homo sapiens
atacatcaatatgta

SEQ ID NO: 4867690 - DNA, 16 bp, Homo sapiens
atacatcaatatgtat

SEQ ID NO: 4867691 - DNA, 21 bp, Homo sapiens
atacatgcatataatgaataa

SEQ ID NO: 4867692 - DNA, 17 bp, Homo sapiens
atacatgccacatcaaa

SEQ ID NO: 4867693 - DNA, 19 bp, Homo sapiens
atacatgtgatacattttt

SEQ ID NO: 4867694 - DNA, 20 bp, Homo sapiens
atacattttttaagcttcag

SEQ ID NO: 4867695 - DNA, 13 bp, Homo sapiens
ataccacatcaaa

SEQ ID NO: 4867696 - DNA, 15 bp, Homo sapiens
ataccacatcaaata

SEQ ID NO: 4867697 - DNA, 16 bp, Homo sapiens
ataccatatgaatgaa

SEQ ID NO: 4867698 - DNA, 21 bp, Homo sapiens
ataccatatgaatgaaacatg

SEQ ID NO: 4867699 - DNA, 18 bp, Homo sapiens
ataccatttagtaagaat

SEQ ID NO: 4867700 - DNA, 15 bp, Homo sapiens
ataccttagagactt

SEQ ID NO: 4867701 - DNA, 14 bp, Homo sapiens
atactactactgtt

SEQ ID NO: 4867702 - DNA, 18 bp, Homo sapiens
atactactactgttatca

SEQ ID NO: 4867703 - DNA, 14 bp, Homo sapiens
atactcatgtgcaa

SEQ ID NO: 4867704 - DNA, 15 bp, Homo sapiens
atactccttgcttcc

SEQ ID NO: 4867705 - DNA, 22 bp, Homo sapiens
atactgccaaaacatttatgac

SEQ ID NO: 4867706 - DNA, 20 bp, Homo sapiens
atactgccttgtttaatggt

SEQ ID NO: 4867707 - DNA, 16 bp, Homo sapiens
atactggggggcaggc

SEQ ID NO: 4867708 - DNA, 19 bp, Homo sapiens
atactgtatattcaggact

SEQ ID NO: 4867709 - DNA, 20 bp, Homo sapiens
atactgtggcctgcaggagg

SEQ ID NO: 4867710 - DNA, 17 bp, Homo sapiens
atacttacatgttccca

SEQ ID NO: 4867711 - DNA, 20 bp, Homo sapiens
atactttagtagacatttat

SEQ ID NO: 4867712 - DNA, 17 bp, Homo sapiens
atactttgtattttgat

SEQ ID NO: 4867713 - DNA, 12 bp, Homo sapiens
atagacatgaaa

SEQ ID NO: 4867714 - DNA, 15 bp, Homo sapiens
atagataatattgtt

SEQ ID NO: 4867715 - DNA, 16 bp, Homo sapiens
atagattcagagaaat

SEQ ID NO: 4867716 - DNA, 17 bp, Homo sapiens
atagattcagagaaatt

SEQ ID NO: 4867717 - DNA, 19 bp, Homo sapiens
atagcagatctgttttgtg

SEQ ID NO: 4867718 - DNA, 17 bp, Homo sapiens
atagcagccagttcaaa

SEQ ID NO: 4867719 - DNA, 22 bp, Homo sapiens
atagctgtacttcttgaatata

SEQ ID NO: 4867720 - DNA, 15 bp, Homo sapiens
atagctttagtgaat

SEQ ID NO: 4867721 - DNA, 21 bp, Homo sapiens
ataggagtggtgatttgaaaa

SEQ ID NO: 4867722 - DNA, 14 bp, Homo sapiens
ataggctggggaca

SEQ ID NO: 4867723 - DNA, 21 bp, Homo sapiens
ataggtagctggggagcccta

SEQ ID NO: 4867724 - DNA, 23 bp, Homo sapiens
atagtctaagactatatatataa

SEQ ID NO: 4867725 - DNA, 23 bp, Homo sapiens
atagtgcaacatctctgaatcct

SEQ ID NO: 4867726 - DNA, 15 bp, Homo sapiens
atagtgggatttcca

SEQ ID NO: 4867727 - DNA, 19 bp, Homo sapiens
atagtgtagctgaggaggc

SEQ ID NO: 4867728 - DNA, 14 bp, Homo sapiens
atagtgtgaaatat

SEQ ID NO: 4867729 - DNA, 18 bp, Homo sapiens
atagttgtagacaaagta

SEQ ID NO: 4867730 - DNA, 14 bp, Homo sapiens
atataacacatttt

SEQ ID NO: 4867731 - DNA, 15 bp, Homo sapiens
atataacacattttt

SEQ ID NO: 4867732 - DNA, 15 bp, Homo sapiens
atataagtgtacata

SEQ ID NO: 4867733 - DNA, 14 bp, Homo sapiens
atataccaaattaa

SEQ ID NO: 4867734 - DNA, 16 bp, Homo sapiens
atataccaaattaaaa

SEQ ID NO: 4867735 - DNA, 12 bp, Homo sapiens
atatagacttgg

SEQ ID NO: 4867736 - DNA, 13 bp, Homo sapiens
atataggctattt

SEQ ID NO: 4867737 - DNA, 18 bp, Homo sapiens
atatagtcaacttattct

SEQ ID NO: 4867738 - DNA, 16 bp, Homo sapiens
atatataaatgtataa

SEQ ID NO: 4867739 - DNA, 20 bp, Homo sapiens
atatataggctattttctaa

SEQ ID NO: 4867740 - DNA, 12 bp, Homo sapiens
atatatatatat

SEQ ID NO: 4867741 - DNA, 20 bp, Homo sapiens
atatattaaaattccaaatt

SEQ ID NO: 4867742 - DNA, 13 bp, Homo sapiens
atatattgaatta

SEQ ID NO: 4867743 - DNA, 14 bp, Homo sapiens
atatattgaattaa

SEQ ID NO: 4867744 - DNA, 23 bp, Homo sapiens
atatcagtaacccccttaaattt

SEQ ID NO: 4867745 - DNA, 11 bp, Homo sapiens
atatcccaagt

SEQ ID NO: 4867746 - DNA, 23 bp, Homo sapiens
atatctcaatgaaccataaattc

SEQ ID NO: 4867747 - DNA, 17 bp, Homo sapiens
atatctgcatgtgtcat

SEQ ID NO: 4867748 - DNA, 16 bp, Homo sapiens
atatgactgcatttgt

SEQ ID NO: 4867749 - DNA, 14 bp, Homo sapiens
atatgctttattaa

SEQ ID NO: 4867750 - DNA, 15 bp, Homo sapiens
atatggaagaaagta

SEQ ID NO: 4867751 - DNA, 13 bp, Homo sapiens
atatggtaggacc

SEQ ID NO: 4867752 - DNA, 21 bp, Homo sapiens
atatggtaggaccctcgagag

SEQ ID NO: 4867753 - DNA, 15 bp, Homo sapiens
atatgtagtatctat

SEQ ID NO: 4867754 - DNA, 18 bp, Homo sapiens
atatgtattttttgaatc

SEQ ID NO: 4867755 - DNA, 18 bp, Homo sapiens
atatgtgctggaattcta

SEQ ID NO: 4867756 - DNA, 16 bp, Homo sapiens
atatgttaatttgtgt

SEQ ID NO: 4867757 - DNA, 17 bp, Homo sapiens
atattaaaaaacttcat

SEQ ID NO: 4867758 - DNA, 15 bp, Homo sapiens
atattaaaattccaa

SEQ ID NO: 4867759 - DNA, 22 bp, Homo sapiens
atattaaaattccaaattcatg

SEQ ID NO: 4867760 - DNA, 14 bp, Homo sapiens
atattactgacatt

SEQ ID NO: 4867761 - DNA, 15 bp, Homo sapiens
atattactgacattt

SEQ ID NO: 4867762 - DNA, 23 bp, Homo sapiens
atattataaaggataaagaagga

SEQ ID NO: 4867763 - DNA, 13 bp, Homo sapiens
atattcacatctt

SEQ ID NO: 4867764 - DNA, 17 bp, Homo sapiens
atattcattctttttga

SEQ ID NO: 4867765 - DNA, 21 bp, Homo sapiens
atattccagatctttcagaaa

SEQ ID NO: 4867766 - DNA, 13 bp, Homo sapiens
atattcctccagc

SEQ ID NO: 4867767 - DNA, 23 bp, Homo sapiens
atattcctttgcatattataaag

SEQ ID NO: 4867768 - DNA, 14 bp, Homo sapiens
atattgaaaattga

SEQ ID NO: 4867769 - DNA, 12 bp, Homo sapiens
atattgaatgtt

SEQ ID NO: 4867770 - DNA, 13 bp, Homo sapiens
atattgaatgtta

SEQ ID NO: 4867771 - DNA, 22 bp, Homo sapiens
atattgcaaggtgtgatggtct

SEQ ID NO: 4867772 - DNA, 11 bp, Homo sapiens
atatttctcaa

SEQ ID NO: 4867773 - DNA, 18 bp, Homo sapiens
atattttgtgtgaaattg

SEQ ID NO: 4867774 - DNA, 22 bp, Homo sapiens
atattttgtgtgaaattgcata

SEQ ID NO: 4867775 - DNA, 14 bp, Homo sapiens
atatttttttaact

SEQ ID NO: 4867776 - DNA, 14 bp, Homo sapiens
atcaaaatagtcta

SEQ ID NO: 4867777 - DNA, 12 bp, Homo sapiens
atcaaagatgaa

SEQ ID NO: 4867778 - DNA, 16 bp, Homo sapiens
atcaaattctgtctgg

SEQ ID NO: 4867779 - DNA, 16 bp, Homo sapiens
atcaagggaagaacta

SEQ ID NO: 4867780 - DNA, 13 bp, Homo sapiens
atcaatagttgaa

SEQ ID NO: 4867781 - DNA, 24 bp, Homo sapiens
atcacaaagtggaacgaaaatgaa

SEQ ID NO: 4867782 - DNA, 22 bp, Homo sapiens
atcacagctcaagcattctgtt

SEQ ID NO: 4867783 - DNA, 17 bp, Homo sapiens
atcactgccttcgttta

SEQ ID NO: 4867784 - DNA, 19 bp, Homo sapiens
atcactgccttcgtttata

SEQ ID NO: 4867785 - DNA, 13 bp, Homo sapiens
atcagacagcagg

SEQ ID NO: 4867786 - DNA, 14 bp, Homo sapiens
atcagcaaaaagac

SEQ ID NO: 4867787 - DNA, 15 bp, Homo sapiens
atcagcaaaaagact

SEQ ID NO: 4867788 - DNA, 13 bp, Homo sapiens
atcagcaaagaaa

SEQ ID NO: 4867789 - DNA, 17 bp, Homo sapiens
atcatatggtaggaccc

SEQ ID NO: 4867790 - DNA, 23 bp, Homo sapiens
atcatcattcttgtgggagacag

SEQ ID NO: 4867791 - DNA, 18 bp, Homo sapiens
atcatgaatgcttttagt

SEQ ID NO: 4867792 - DNA, 18 bp, Homo sapiens
atcatgaattttaaagta

SEQ ID NO: 4867793 - DNA, 19 bp, Homo sapiens
atcatgaattttaaagtat

SEQ ID NO: 4867794 - DNA, 16 bp, Homo sapiens
atcatgtgtagagccc

SEQ ID NO: 4867795 - DNA, 20 bp, Homo sapiens
atcattcttgtgggagacag

SEQ ID NO: 4867796 - DNA, 23 bp, Homo sapiens
atcattgtttagatgaggctcag

SEQ ID NO: 4867797 - DNA, 20 bp, Homo sapiens
atccaagagggactccaagc

SEQ ID NO: 4867798 - DNA, 20 bp, Homo sapiens
atccacctcatcactggact

SEQ ID NO: 4867799 - DNA, 15 bp, Homo sapiens
atccagggcagcagg

SEQ ID NO: 4867800 - DNA, 23 bp, Homo sapiens
atccagggcagcaggccagagaa

SEQ ID NO: 4867801 - DNA, 17 bp, Homo sapiens
atccagtgtgagatact

SEQ ID NO: 4867802 - DNA, 18 bp, Homo sapiens
atccagtgtgagatactg

SEQ ID NO: 4867803 - DNA, 20 bp, Homo sapiens
atccagtgtgagatactgtg

SEQ ID NO: 4867804 - DNA, 19 bp, Homo sapiens
atccagttataagaagaag

SEQ ID NO: 4867805 - DNA, 16 bp, Homo sapiens
atccatccatgtactt

SEQ ID NO: 4867806 - DNA, 11 bp, Homo sapiens
atccatcctga

SEQ ID NO: 4867807 - DNA, 13 bp, Homo sapiens
atccatcctgagc

SEQ ID NO: 4867808 - DNA, 13 bp, Homo sapiens
atccattcctaat

SEQ ID NO: 4867809 - DNA, 14 bp, Homo sapiens
atccatttcaggac

SEQ ID NO: 4867810 - DNA, 19 bp, Homo sapiens
atcccaagttggaagggac

SEQ ID NO: 4867811 - DNA, 22 bp, Homo sapiens
atccccacaggcacattaactg

SEQ ID NO: 4867812 - DNA, 23 bp, Homo sapiens
atcccgttcagaaaaccacttta

SEQ ID NO: 4867813 - DNA, 15 bp, Homo sapiens
atccctctcctaact

SEQ ID NO: 4867814 - DNA, 15 bp, Homo sapiens
atccctgcctggagg

SEQ ID NO: 4867815 - DNA, 17 bp, Homo sapiens
atccctgcctggaggct

SEQ ID NO: 4867816 - DNA, 19 bp, Homo sapiens
atccctgggggccttgggt

SEQ ID NO: 4867817 - DNA, 17 bp, Homo sapiens
atcccttggacatttta

SEQ ID NO: 4867818 - DNA, 19 bp, Homo sapiens
atcccttggacattttatg

SEQ ID NO: 4867819 - DNA, 19 bp, Homo sapiens
atcctagactgctcctggg

SEQ ID NO: 4867820 - DNA, 15 bp, Homo sapiens
atcctaggaaccagc

SEQ ID NO: 4867821 - DNA, 17 bp, Homo sapiens
atcctcagttctcaaat

SEQ ID NO: 4867822 - DNA, 12 bp, Homo sapiens
atcctggcctga

SEQ ID NO: 4867823 - DNA, 20 bp, Homo sapiens
atcgagtgtagctgtgaaat

SEQ ID NO: 4867824 - DNA, 19 bp, Homo sapiens
atcgtattaaaaaacaatt

SEQ ID NO: 4867825 - DNA, 14 bp, Homo sapiens
atctaagtgatata

SEQ ID NO: 4867826 - DNA, 15 bp, Homo sapiens
atctaattctgattc

SEQ ID NO: 4867827 - DNA, 19 bp, Homo sapiens
atctacttctgtaattgtg

SEQ ID NO: 4867828 - DNA, 12 bp, Homo sapiens
atctatattaga

SEQ ID NO: 4867829 - DNA, 15 bp, Homo sapiens
atctatccacactgt

SEQ ID NO: 4867830 - DNA, 11 bp, Homo sapiens
atctatgaacc

SEQ ID NO: 4867831 - DNA, 14 bp, Homo sapiens
atctatgaacctga

SEQ ID NO: 4867832 - DNA, 21 bp, Homo sapiens
atctatgtttataatactact

SEQ ID NO: 4867833 - DNA, 23 bp, Homo sapiens
atctcaaataggctattaaaaaa

SEQ ID NO: 4867834 - DNA, 23 bp, Homo sapiens
atctcaatgaaccataaattcaa

SEQ ID NO: 4867835 - DNA, 12 bp, Homo sapiens
atctcaatgcaa

SEQ ID NO: 4867836 - DNA, 22 bp, Homo sapiens
atctcaatgcaagccccaactt

SEQ ID NO: 4867837 - DNA, 16 bp, Homo sapiens
atctcacttagtcctt

SEQ ID NO: 4867838 - DNA, 17 bp, Homo sapiens
atctcagtggtgtgtga

SEQ ID NO: 4867839 - DNA, 16 bp, Homo sapiens
atctccactggaccct

SEQ ID NO: 4867840 - DNA, 23 bp, Homo sapiens
atctccactggacccttgattca

SEQ ID NO: 4867841 - DNA, 16 bp, Homo sapiens
atctccatggggaggc

SEQ ID NO: 4867842 - DNA, 15 bp, Homo sapiens
atctctttttgtttg

SEQ ID NO: 4867843 - DNA, 13 bp, Homo sapiens
atctgaaaggcca

SEQ ID NO: 4867844 - DNA, 17 bp, Homo sapiens
atctgaaaggccagcag

SEQ ID NO: 4867845 - DNA, 23 bp, Homo sapiens
atctgaccccaagggggctgctg

SEQ ID NO: 4867846 - DNA, 11 bp, Homo sapiens
atctgcatgtg

SEQ ID NO: 4867847 - DNA, 23 bp, Homo sapiens
atctgccccctagttcaggtcca

SEQ ID NO: 4867848 - DNA, 21 bp, Homo sapiens
atctgctatttttaatttcct

SEQ ID NO: 4867849 - DNA, 17 bp, Homo sapiens
atctgttagcagagtct

SEQ ID NO: 4867850 - DNA, 17 bp, Homo sapiens
atcttacaatattgatt

SEQ ID NO: 4867851 - DNA, 15 bp, Homo sapiens
atcttcaaagccttc

SEQ ID NO: 4867852 - DNA, 20 bp, Homo sapiens
atctttatatttcaataaat

SEQ ID NO: 4867853 - DNA, 14 bp, Homo sapiens
atctttcagaaata

SEQ ID NO: 4867854 - DNA, 16 bp, Homo sapiens
atctttcagaaatata

SEQ ID NO: 4867855 - DNA, 15 bp, Homo sapiens
atctttgaatatgta

SEQ ID NO: 4867856 - DNA, 15 bp, Homo sapiens
atctttgtaccaaaa

SEQ ID NO: 4867857 - DNA, 19 bp, Homo sapiens
atctttgtaccaaaatttt

SEQ ID NO: 4867858 - DNA, 21 bp, Homo sapiens
atctttgtaccaaaattttaa

SEQ ID NO: 4867859 - DNA, 16 bp, Homo sapiens
atcttttgaagcatag

SEQ ID NO: 4867860 - DNA, 17 bp, Homo sapiens
atcttttgaagcataga

SEQ ID NO: 4867861 - DNA, 18 bp, Homo sapiens
atcttttttagtgttaaa

SEQ ID NO: 4867862 - DNA, 18 bp, Homo sapiens
atgaaaataactgaattt

SEQ ID NO: 4867863 - DNA, 19 bp, Homo sapiens
atgaaaataactgaatttg

SEQ ID NO: 4867864 - DNA, 15 bp, Homo sapiens
atgaaattcttccta

SEQ ID NO: 4867865 - DNA, 18 bp, Homo sapiens
atgaactttgtcagtgtt

SEQ ID NO: 4867866 - DNA, 14 bp, Homo sapiens
atgaataatggaaa

SEQ ID NO: 4867867 - DNA, 12 bp, Homo sapiens
atgaatgtgctg

SEQ ID NO: 4867868 - DNA, 14 bp, Homo sapiens
atgaatgtgctggt

SEQ ID NO: 4867869 - DNA, 15 bp, Homo sapiens
atgaatgtgctggtg

SEQ ID NO: 4867870 - DNA, 14 bp, Homo sapiens
atgaattttaaagt

SEQ ID NO: 4867871 - DNA, 15 bp, Homo sapiens
atgaattttaaagta

SEQ ID NO: 4867872 - DNA, 17 bp, Homo sapiens
atgaattttaaagtatg

SEQ ID NO: 4867873 - DNA, 22 bp, Homo sapiens
atgaattttaaagtatgcatta

SEQ ID NO: 4867874 - DNA, 22 bp, Homo sapiens
atgacaaacatcattgtttaga

SEQ ID NO: 4867875 - DNA, 20 bp, Homo sapiens
atgacagaggtttgaaggag

SEQ ID NO: 4867876 - DNA, 12 bp, Homo sapiens
atgacagccttg

SEQ ID NO: 4867877 - DNA, 13 bp, Homo sapiens
atgacagccttgc

SEQ ID NO: 4867878 - DNA, 19 bp, Homo sapiens
atgacagccttgcaaccca

SEQ ID NO: 4867879 - DNA, 22 bp, Homo sapiens
atgacctccagaagtcccttca

SEQ ID NO: 4867880 - DNA, 20 bp, Homo sapiens
atgaccttgagttaacagga

SEQ ID NO: 4867881 - DNA, 14 bp, Homo sapiens
atgactctcatttt

SEQ ID NO: 4867882 - DNA, 20 bp, Homo sapiens
atgagagcataatttaaaaa

SEQ ID NO: 4867883 - DNA, 21 bp, Homo sapiens
atgagtccttgatttcaaagt

SEQ ID NO: 4867884 - DNA, 11 bp, Homo sapiens
atgatgacaat

SEQ ID NO: 4867885 - DNA, 16 bp, Homo sapiens
atgatgacaatcaaag

SEQ ID NO: 4867886 - DNA, 18 bp, Homo sapiens
atgatgtacagattcttt

SEQ ID NO: 4867887 - DNA, 21 bp, Homo sapiens
atgatgtacagattctttcag

SEQ ID NO: 4867888 - DNA, 22 bp, Homo sapiens
atgattagaaattacctgtgga

SEQ ID NO: 4867889 - DNA, 23 bp, Homo sapiens
atgattagaaattacctgtggat

SEQ ID NO: 4867890 - DNA, 17 bp, Homo sapiens
atgatttttgccctgcg

SEQ ID NO: 4867891 - DNA, 18 bp, Homo sapiens
atgcaagccccaactttc

SEQ ID NO: 4867892 - DNA, 18 bp, Homo sapiens
atgcaataaaatttaaaa

SEQ ID NO: 4867893 - DNA, 18 bp, Homo sapiens
atgcagaaatagacaaaa

SEQ ID NO: 4867894 - DNA, 11 bp, Homo sapiens
atgcagagctt

SEQ ID NO: 4867895 - DNA, 15 bp, Homo sapiens
atgcagagcttgtgg

SEQ ID NO: 4867896 - DNA, 17 bp, Homo sapiens
atgcagggaggggaggc

SEQ ID NO: 4867897 - DNA, 22 bp, Homo sapiens
atgcagttagctgaagaattga

SEQ ID NO: 4867898 - DNA, 15 bp, Homo sapiens
atgcatataatgaat

SEQ ID NO: 4867899 - DNA, 17 bp, Homo sapiens
atgcatatttgcaaagt

SEQ ID NO: 4867900 - DNA, 18 bp, Homo sapiens
atgcatcatctcttcctc

SEQ ID NO: 4867901 - DNA, 19 bp, Homo sapiens
atgcatcatctcttcctca

SEQ ID NO: 4867902 - DNA, 13 bp, Homo sapiens
atgcatgcaaatg

SEQ ID NO: 4867903 - DNA, 19 bp, Homo sapiens
atgcattcacatttagaaa

SEQ ID NO: 4867904 - DNA, 12 bp, Homo sapiens
atgcatttaata

SEQ ID NO: 4867905 - DNA, 13 bp, Homo sapiens
atgcatttaataa

SEQ ID NO: 4867906 - DNA, 15 bp, Homo sapiens
atgcatttaataaag

SEQ ID NO: 4867907 - DNA, 22 bp, Homo sapiens
atgcatttaataaagatgagtt

SEQ ID NO: 4867908 - DNA, 18 bp, Homo sapiens
atgccacatcaaaccttt

SEQ ID NO: 4867909 - DNA, 21 bp, Homo sapiens
atgcctcagtagcatctcagt

SEQ ID NO: 4867910 - DNA, 21 bp, Homo sapiens
atgccttgtataatattgaaa

SEQ ID NO: 4867911 - DNA, 13 bp, Homo sapiens
atgctaaatgtgt

SEQ ID NO: 4867912 - DNA, 17 bp, Homo sapiens
atgctaaatgtgtaata

SEQ ID NO: 4867913 - DNA, 16 bp, Homo sapiens
atgctaacatctaaaa

SEQ ID NO: 4867914 - DNA, 17 bp, Homo sapiens
atgctacaattttaaga

SEQ ID NO: 4867915 - DNA, 18 bp, Homo sapiens
atgctgctcccctaaagc

SEQ ID NO: 4867916 - DNA, 21 bp, Homo sapiens
atgctgctcccctaaagccag

SEQ ID NO: 4867917 - DNA, 13 bp, Homo sapiens
atgctgcttttgg

SEQ ID NO: 4867918 - DNA, 18 bp, Homo sapiens
atgcttgcatggagaatg

SEQ ID NO: 4867919 - DNA, 22 bp, Homo sapiens
atgcttgcggcaaaaggaaagc

SEQ ID NO: 4867920 - DNA, 23 bp, Homo sapiens
atggacatgagagtagggccctg

SEQ ID NO: 4867921 - DNA, 14 bp, Homo sapiens
atggagaatgggac

SEQ ID NO: 4867922 - DNA, 13 bp, Homo sapiens
atggagccccagg

SEQ ID NO: 4867923 - DNA, 20 bp, Homo sapiens
atggagcctacctctgtctg

SEQ ID NO: 4867924 - DNA, 19 bp, Homo sapiens
atggaggatctctaaagag

SEQ ID NO: 4867925 - DNA, 12 bp, Homo sapiens
atggagtgtgca

SEQ ID NO: 4867926 - DNA, 17 bp, Homo sapiens
atggagtgtgcagacag

SEQ ID NO: 4867927 - DNA, 18 bp, Homo sapiens
atggagtgtgcagacagc

SEQ ID NO: 4867928 - DNA, 19 bp, Homo sapiens
atggagtgtgcagacagcc

SEQ ID NO: 4867929 - DNA, 17 bp, Homo sapiens
atggcagggggtggaat

SEQ ID NO: 4867930 - DNA, 17 bp, Homo sapiens
atggcatccctttttca

SEQ ID NO: 4867931 - DNA, 21 bp, Homo sapiens
atggcatccctttttcataaa

SEQ ID NO: 4867932 - DNA, 13 bp, Homo sapiens
atggccacaaacc

SEQ ID NO: 4867933 - DNA, 14 bp, Homo sapiens
atggccacaaacct

SEQ ID NO: 4867934 - DNA, 18 bp, Homo sapiens
atggccacaaacctgccc

SEQ ID NO: 4867935 - DNA, 21 bp, Homo sapiens
atggccatcttctttcttcca

SEQ ID NO: 4867936 - DNA, 20 bp, Homo sapiens
atggcctggagcaggcccaa

SEQ ID NO: 4867937 - DNA, 20 bp, Homo sapiens
atggcctgtccctagggctc

SEQ ID NO: 4867938 - DNA, 16 bp, Homo sapiens
atggcgatgtgttata

SEQ ID NO: 4867939 - DNA, 14 bp, Homo sapiens
atggctgaagctgg

SEQ ID NO: 4867940 - DNA, 18 bp, Homo sapiens
atggctgcaagagcccag

SEQ ID NO: 4867941 - DNA, 15 bp, Homo sapiens
atgggacgaggacat

SEQ ID NO: 4867942 - DNA, 18 bp, Homo sapiens
atgggagacccttgacac

SEQ ID NO: 4867943 - DNA, 16 bp, Homo sapiens
atgggctgtgattact

SEQ ID NO: 4867944 - DNA, 16 bp, Homo sapiens
atggggaactccccca

SEQ ID NO: 4867945 - DNA, 18 bp, Homo sapiens
atggggaactcccccaga

SEQ ID NO: 4867946 - DNA, 20 bp, Homo sapiens
atggggaactcccccagagg

SEQ ID NO: 4867947 - DNA, 14 bp, Homo sapiens
atggggaggcagca

SEQ ID NO: 4867948 - DNA, 15 bp, Homo sapiens
atggggaggcagcag

SEQ ID NO: 4867949 - DNA, 13 bp, Homo sapiens
atggggccaggaa

SEQ ID NO: 4867950 - DNA, 15 bp, Homo sapiens
atggggccaggaaag

SEQ ID NO: 4867951 - DNA, 13 bp, Homo sapiens
atgggggcctctc

SEQ ID NO: 4867952 - DNA, 16 bp, Homo sapiens
atgggtatgctcaggt

SEQ ID NO: 4867953 - DNA, 16 bp, Homo sapiens
atggtaagagaaaaga

SEQ ID NO: 4867954 - DNA, 13 bp, Homo sapiens
atggtaataagca

SEQ ID NO: 4867955 - DNA, 20 bp, Homo sapiens
atggtaataagcactgtaaa

SEQ ID NO: 4867956 - DNA, 14 bp, Homo sapiens
atggtaggaccctc

SEQ ID NO: 4867957 - DNA, 22 bp, Homo sapiens
atggtaggaccctcgagagcct

SEQ ID NO: 4867958 - DNA, 15 bp, Homo sapiens
atggtagttttacag

SEQ ID NO: 4867959 - DNA, 13 bp, Homo sapiens
atggttaaacatt

SEQ ID NO: 4867960 - DNA, 20 bp, Homo sapiens
atggttaatttttcctgcat

SEQ ID NO: 4867961 - DNA, 22 bp, Homo sapiens
atggttaatttttcctgcatgt

SEQ ID NO: 4867962 - DNA, 15 bp, Homo sapiens
atgtaaataactcta

SEQ ID NO: 4867963 - DNA, 16 bp, Homo sapiens
atgtaacttcctgtgg

SEQ ID NO: 4867964 - DNA, 18 bp, Homo sapiens
atgtaacttcctgtggat

SEQ ID NO: 4867965 - DNA, 18 bp, Homo sapiens
atgtaagtttgtgtaaat

SEQ ID NO: 4867966 - DNA, 20 bp, Homo sapiens
atgtaattttattttaaaat

SEQ ID NO: 4867967 - DNA, 18 bp, Homo sapiens
atgtacagattctttcag

SEQ ID NO: 4867968 - DNA, 16 bp, Homo sapiens
atgtactgatttcagt

SEQ ID NO: 4867969 - DNA, 18 bp, Homo sapiens
atgtactgatttcagtaa

SEQ ID NO: 4867970 - DNA, 18 bp, Homo sapiens
atgtactgcaaagtcgcc

SEQ ID NO: 4867971 - DNA, 22 bp, Homo sapiens
atgtactgcaaagtcgccagtc

SEQ ID NO: 4867972 - DNA, 12 bp, Homo sapiens
atgtagaaactg

SEQ ID NO: 4867973 - DNA, 21 bp, Homo sapiens
atgtagaaactgaggcccaga

SEQ ID NO: 4867974 - DNA, 18 bp, Homo sapiens
atgtagaggcttgtttac

SEQ ID NO: 4867975 - DNA, 16 bp, Homo sapiens
atgtagcctttactgt

SEQ ID NO: 4867976 - DNA, 22 bp, Homo sapiens
atgtagcctttactgtttgata

SEQ ID NO: 4867977 - DNA, 16 bp, Homo sapiens
atgtaggtaagactgt

SEQ ID NO: 4867978 - DNA, 20 bp, Homo sapiens
atgtaggtaagactgtagat

SEQ ID NO: 4867979 - DNA, 14 bp, Homo sapiens
atgtataaatatac

SEQ ID NO: 4867980 - DNA, 13 bp, Homo sapiens
atgtatatatgta

SEQ ID NO: 4867981 - DNA, 17 bp, Homo sapiens
atgtatattaaaaaaga

SEQ ID NO: 4867982 - DNA, 20 bp, Homo sapiens
atgtatattaaaaaagagac

SEQ ID NO: 4867983 - DNA, 21 bp, Homo sapiens
atgtatattaaaaaagagaca

SEQ ID NO: 4867984 - DNA, 17 bp, Homo sapiens
atgtattcttttctcag

SEQ ID NO: 4867985 - DNA, 15 bp, Homo sapiens
atgtatttgctgaca

SEQ ID NO: 4867986 - DNA, 18 bp, Homo sapiens
atgtattttttgaatcta

SEQ ID NO: 4867987 - DNA, 23 bp, Homo sapiens
atgtcaaccaggtccagatgtgc

SEQ ID NO: 4867988 - DNA, 16 bp, Homo sapiens
atgtcagctgctgttg

SEQ ID NO: 4867989 - DNA, 15 bp, Homo sapiens
atgtcagttgttatt

SEQ ID NO: 4867990 - DNA, 20 bp, Homo sapiens
atgtccagccacccccaggc

SEQ ID NO: 4867991 - DNA, 13 bp, Homo sapiens
atgtctggcagat

SEQ ID NO: 4867992 - DNA, 14 bp, Homo sapiens
atgtctggcagatg

SEQ ID NO: 4867993 - DNA, 19 bp, Homo sapiens
atgtctggcagatgagggc

SEQ ID NO: 4867994 - DNA, 21 bp, Homo sapiens
atgtctggcagatgagggctg

SEQ ID NO: 4867995 - DNA, 23 bp, Homo sapiens
atgtctggctcaaagcagcagga

SEQ ID NO: 4867996 - DNA, 13 bp, Homo sapiens
atgtgacatttat

SEQ ID NO: 4867997 - DNA, 15 bp, Homo sapiens
atgtgaccataatgt

SEQ ID NO: 4867998 - DNA, 22 bp, Homo sapiens
atgtgactaaaggaaaaaactt

SEQ ID NO: 4867999 - DNA, 20 bp, Homo sapiens
atgtgagtgacgatgatgta

SEQ ID NO: 4868000 - DNA, 22 bp, Homo sapiens
atgtgatacattttttaagctt

SEQ ID NO: 4868001 - DNA, 23 bp, Homo sapiens
atgtgatatataagtgtacatat

SEQ ID NO: 4868002 - DNA, 15 bp, Homo sapiens
atgtgctatacacac

SEQ ID NO: 4868003 - DNA, 21 bp, Homo sapiens
atgtgctggtgaacactgtga

SEQ ID NO: 4868004 - DNA, 19 bp, Homo sapiens
atgtggtctgccaatctgt

SEQ ID NO: 4868005 - DNA, 15 bp, Homo sapiens
atgtgtaataatgta

SEQ ID NO: 4868006 - DNA, 17 bp, Homo sapiens
atgtgtaataatgtaac

SEQ ID NO: 4868007 - DNA, 22 bp, Homo sapiens
atgtgtaataatgtaacatgat

SEQ ID NO: 4868008 - DNA, 21 bp, Homo sapiens
atgtgtagctgcaaaaataat

SEQ ID NO: 4868009 - DNA, 14 bp, Homo sapiens
atgtgtctggccct

SEQ ID NO: 4868010 - DNA, 20 bp, Homo sapiens
atgttaatttgtgtgttttt

SEQ ID NO: 4868011 - DNA, 13 bp, Homo sapiens
atgttcccagaac

SEQ ID NO: 4868012 - DNA, 11 bp, Homo sapiens
atgttctttca

SEQ ID NO: 4868013 - DNA, 11 bp, Homo sapiens
atgttctttct

SEQ ID NO: 4868014 - DNA, 22 bp, Homo sapiens
atgttgccatcctaccgtcttt

SEQ ID NO: 4868015 - DNA, 23 bp, Homo sapiens
atgttggagcagcaggcctctgg

SEQ ID NO: 4868016 - DNA, 22 bp, Homo sapiens
atgttgtttataataaaaatat

SEQ ID NO: 4868017 - DNA, 14 bp, Homo sapiens
atgtttatttcagg

SEQ ID NO: 4868018 - DNA, 16 bp, Homo sapiens
atgtttcttttgtttg

SEQ ID NO: 4868019 - DNA, 18 bp, Homo sapiens
attaaaaaacaattaact

SEQ ID NO: 4868020 - DNA, 13 bp, Homo sapiens
attaaaaaagaga

SEQ ID NO: 4868021 - DNA, 17 bp, Homo sapiens
attaaaactaaatttca

SEQ ID NO: 4868022 - DNA, 14 bp, Homo sapiens
attaaaatatttca

SEQ ID NO: 4868023 - DNA, 17 bp, Homo sapiens
attaaaatatttcaggt

SEQ ID NO: 4868024 - DNA, 17 bp, Homo sapiens
attaaacttccaaagaa

SEQ ID NO: 4868025 - DNA, 13 bp, Homo sapiens
attaaagtcagaa

SEQ ID NO: 4868026 - DNA, 16 bp, Homo sapiens
attaaagtcagaagtt

SEQ ID NO: 4868027 - DNA, 15 bp, Homo sapiens
attaaattgtaaaac

SEQ ID NO: 4868028 - DNA, 22 bp, Homo sapiens
attaaccaaccttgtttaatag

SEQ ID NO: 4868029 - DNA, 14 bp, Homo sapiens
attaagcaaatgtt

SEQ ID NO: 4868030 - DNA, 17 bp, Homo sapiens
attaagctttttggaat

SEQ ID NO: 4868031 - DNA, 12 bp, Homo sapiens
attaatatatta

SEQ ID NO: 4868032 - DNA, 13 bp, Homo sapiens
attaatatattaa

SEQ ID NO: 4868033 - DNA, 15 bp, Homo sapiens
attaatgcctgcttt

SEQ ID NO: 4868034 - DNA, 22 bp, Homo sapiens
attaatgcctgctttttggaaa

SEQ ID NO: 4868035 - DNA, 21 bp, Homo sapiens
attaatggtttattctttgca

SEQ ID NO: 4868036 - DNA, 15 bp, Homo sapiens
attaatgttttcaaa

SEQ ID NO: 4868037 - DNA, 17 bp, Homo sapiens
attaatgttttcaaaag

SEQ ID NO: 4868038 - DNA, 15 bp, Homo sapiens
attaattaatttgga

SEQ ID NO: 4868039 - DNA, 21 bp, Homo sapiens
attaatttggagcacaaaatt

SEQ ID NO: 4868040 - DNA, 18 bp, Homo sapiens
attacaactgaccaagtt

SEQ ID NO: 4868041 - DNA, 18 bp, Homo sapiens
attacaccacagcattgt

SEQ ID NO: 4868042 - DNA, 23 bp, Homo sapiens
attacattttattaagctttttg

SEQ ID NO: 4868043 - DNA, 14 bp, Homo sapiens
attacctgtggata

SEQ ID NO: 4868044 - DNA, 19 bp, Homo sapiens
attacctgtggatatttgt

SEQ ID NO: 4868045 - DNA, 16 bp, Homo sapiens
attactgcaatcactg

SEQ ID NO: 4868046 - DNA, 21 bp, Homo sapiens
attactgcaatcactgtgcta

SEQ ID NO: 4868047 - DNA, 19 bp, Homo sapiens
attagaaacaaacaaaact

SEQ ID NO: 4868048 - DNA, 16 bp, Homo sapiens
attagatcaaatagtt

SEQ ID NO: 4868049 - DNA, 19 bp, Homo sapiens
attagcaaggcagagcctt

SEQ ID NO: 4868050 - DNA, 18 bp, Homo sapiens
attaggtttcagcagagc

SEQ ID NO: 4868051 - DNA, 22 bp, Homo sapiens
attataaaggataaagaaggat

SEQ ID NO: 4868052 - DNA, 15 bp, Homo sapiens
attataaatgacaac

SEQ ID NO: 4868053 - DNA, 20 bp, Homo sapiens
attatacatgtgatacattt

SEQ ID NO: 4868054 - DNA, 20 bp, Homo sapiens
attatatacatactgcatct

SEQ ID NO: 4868055 - DNA, 23 bp, Homo sapiens
attatatattgcaaggtgtgatg

SEQ ID NO: 4868056 - DNA, 15 bp, Homo sapiens
attatcagcaaagaa

SEQ ID NO: 4868057 - DNA, 11 bp, Homo sapiens
attatgagcca

SEQ ID NO: 4868058 - DNA, 15 bp, Homo sapiens
attatgtcaaccagg

SEQ ID NO: 4868059 - DNA, 16 bp, Homo sapiens
attatgttaatatttc

SEQ ID NO: 4868060 - DNA, 20 bp, Homo sapiens
attattgagttccagttgaa

SEQ ID NO: 4868061 - DNA, 21 bp, Homo sapiens
attattgagttccagttgaag

SEQ ID NO: 4868062 - DNA, 18 bp, Homo sapiens
attatttttttaaaattt

SEQ ID NO: 4868063 - DNA, 19 bp, Homo sapiens
attatttttttaaaatttt

SEQ ID NO: 4868064 - DNA, 20 bp, Homo sapiens
attatttttttaaaattttg

SEQ ID NO: 4868065 - DNA, 13 bp, Homo sapiens
attcaactttgta

SEQ ID NO: 4868066 - DNA, 15 bp, Homo sapiens
attcaactttgtaaa

SEQ ID NO: 4868067 - DNA, 18 bp, Homo sapiens
attcaggacttgaaagaa

SEQ ID NO: 4868068 - DNA, 19 bp, Homo sapiens
attcaggacttgaaagaaa

SEQ ID NO: 4868069 - DNA, 13 bp, Homo sapiens
attcagttttttt

SEQ ID NO: 4868070 - DNA, 21 bp, Homo sapiens
attcattctttttgaaatgtc

SEQ ID NO: 4868071 - DNA, 15 bp, Homo sapiens
attccaaaatattat

SEQ ID NO: 4868072 - DNA, 13 bp, Homo sapiens
attccaaattcat

SEQ ID NO: 4868073 - DNA, 22 bp, Homo sapiens
attccagctgtcactctgtgcc

SEQ ID NO: 4868074 - DNA, 17 bp, Homo sapiens
attccatatttattcaa

SEQ ID NO: 4868075 - DNA, 19 bp, Homo sapiens
attccccagtgactccagg

SEQ ID NO: 4868076 - DNA, 14 bp, Homo sapiens
attcctccagctgg

SEQ ID NO: 4868077 - DNA, 21 bp, Homo sapiens
attcctgtactgtgtctcatg

SEQ ID NO: 4868078 - DNA, 13 bp, Homo sapiens
attctattctcca

SEQ ID NO: 4868079 - DNA, 15 bp, Homo sapiens
attctattctccaga

SEQ ID NO: 4868080 - DNA, 12 bp, Homo sapiens
attctccagaca

SEQ ID NO: 4868081 - DNA, 13 bp, Homo sapiens
attctccagacat

SEQ ID NO: 4868082 - DNA, 15 bp, Homo sapiens
attctcccagctcta

SEQ ID NO: 4868083 - DNA, 19 bp, Homo sapiens
attctgaagtatgaagtct

SEQ ID NO: 4868084 - DNA, 14 bp, Homo sapiens
attctggctttaag

SEQ ID NO: 4868085 - DNA, 14 bp, Homo sapiens
attctgtctgggga

SEQ ID NO: 4868086 - DNA, 20 bp, Homo sapiens
attcttgttgctgtacaaaa

SEQ ID NO: 4868087 - DNA, 20 bp, Homo sapiens
attctttagcttacctgggc

SEQ ID NO: 4868088 - DNA, 21 bp, Homo sapiens
attctttagcttacctgggca

SEQ ID NO: 4868089 - DNA, 15 bp, Homo sapiens
attctttcagttctt

SEQ ID NO: 4868090 - DNA, 16 bp, Homo sapiens
attctttgcaatactg

SEQ ID NO: 4868091 - DNA, 19 bp, Homo sapiens
attcttttctcagtgttgg

SEQ ID NO: 4868092 - DNA, 12 bp, Homo sapiens
attgaaaagtac

SEQ ID NO: 4868093 - DNA, 16 bp, Homo sapiens
attgaaaagtttttgt

SEQ ID NO: 4868094 - DNA, 18 bp, Homo sapiens
attgaaaattgaaaagta

SEQ ID NO: 4868095 - DNA, 10 bp, Homo sapiens
attgaagaat

SEQ ID NO: 4868096 - DNA, 16 bp, Homo sapiens
attgaagaatgttaga

SEQ ID NO: 4868097 - DNA, 20 bp, Homo sapiens
attgaaggtgataagggaaa

SEQ ID NO: 4868098 - DNA, 16 bp, Homo sapiens
attgaagtttcaagtt

SEQ ID NO: 4868099 - DNA, 22 bp, Homo sapiens
attgaccattttttaatttact

SEQ ID NO: 4868100 - DNA, 23 bp, Homo sapiens
attgactaactcaaatacacatt

SEQ ID NO: 4868101 - DNA, 18 bp, Homo sapiens
attgaggggaggtggcca

SEQ ID NO: 4868102 - DNA, 16 bp, Homo sapiens
attgagtattgtttaa

SEQ ID NO: 4868103 - DNA, 23 bp, Homo sapiens
attgagtattgtttaaaatgtaa

SEQ ID NO: 4868104 - DNA, 17 bp, Homo sapiens
attgatgttttcataga

SEQ ID NO: 4868105 - DNA, 13 bp, Homo sapiens
attgattgggaaa

SEQ ID NO: 4868106 - DNA, 14 bp, Homo sapiens
attgattgggaaaa

SEQ ID NO: 4868107 - DNA, 23 bp, Homo sapiens
attgattgggaaaacatttgctg

SEQ ID NO: 4868108 - DNA, 15 bp, Homo sapiens
attgcacattgtaaa

SEQ ID NO: 4868109 - DNA, 19 bp, Homo sapiens
attgcagcctaagaagaag

SEQ ID NO: 4868110 - DNA, 23 bp, Homo sapiens
attgcagcctaagaagaaggcca

SEQ ID NO: 4868111 - DNA, 21 bp, Homo sapiens
attgcatactttgtattttga

SEQ ID NO: 4868112 - DNA, 19 bp, Homo sapiens
attgcatccactagcttct

SEQ ID NO: 4868113 - DNA, 18 bp, Homo sapiens
attgcctctgaaaagtgt

SEQ ID NO: 4868114 - DNA, 14 bp, Homo sapiens
attgctctggagca

SEQ ID NO: 4868115 - DNA, 11 bp, Homo sapiens
attggatattt

SEQ ID NO: 4868116 - DNA, 16 bp, Homo sapiens
attgggaactgaaatc

SEQ ID NO: 4868117 - DNA, 20 bp, Homo sapiens
attgtaaaattatttcatga

SEQ ID NO: 4868118 - DNA, 16 bp, Homo sapiens
attgtaattatgtaaa

SEQ ID NO: 4868119 - DNA, 15 bp, Homo sapiens
attgtacaaaattaa

SEQ ID NO: 4868120 - DNA, 18 bp, Homo sapiens
attgtacaaaattaagca

SEQ ID NO: 4868121 - DNA, 23 bp, Homo sapiens
attgtgcccctaaagagcatcct

SEQ ID NO: 4868122 - DNA, 19 bp, Homo sapiens
attgttacgtagcctaagg

SEQ ID NO: 4868123 - DNA, 12 bp, Homo sapiens
attgttatcaaa

SEQ ID NO: 4868124 - DNA, 14 bp, Homo sapiens
attgtttaaaatgt

SEQ ID NO: 4868125 - DNA, 15 bp, Homo sapiens
attgtttaaaatgta

SEQ ID NO: 4868126 - DNA, 19 bp, Homo sapiens
attgtttgttgcactaaaa

SEQ ID NO: 4868127 - DNA, 17 bp, Homo sapiens
atttaaaaaataaataa

SEQ ID NO: 4868128 - DNA, 15 bp, Homo sapiens
atttaaaaatatatt

SEQ ID NO: 4868129 - DNA, 17 bp, Homo sapiens
atttaaaagcctgctca

SEQ ID NO: 4868130 - DNA, 22 bp, Homo sapiens
atttaactttccagtcttagct

SEQ ID NO: 4868131 - DNA, 16 bp, Homo sapiens
atttaagacactgaaa

SEQ ID NO: 4868132 - DNA, 19 bp, Homo sapiens
atttaagttcatattccat

SEQ ID NO: 4868133 - DNA, 14 bp, Homo sapiens
atttaataaagatg

SEQ ID NO: 4868134 - DNA, 16 bp, Homo sapiens
atttaataaagatgag

SEQ ID NO: 4868135 - DNA, 20 bp, Homo sapiens
atttaatccagttataagaa

SEQ ID NO: 4868136 - DNA, 23 bp, Homo sapiens
atttaatccagttataagaagaa

SEQ ID NO: 4868137 - DNA, 19 bp, Homo sapiens
atttaatcttttcttattt

SEQ ID NO: 4868138 - DNA, 13 bp, Homo sapiens
atttaatttgaag

SEQ ID NO: 4868139 - DNA, 16 bp, Homo sapiens
atttacagctgtgctc

SEQ ID NO: 4868140 - DNA, 20 bp, Homo sapiens
atttactgatgagagaatgt

SEQ ID NO: 4868141 - DNA, 16 bp, Homo sapiens
atttacttgttttgga

SEQ ID NO: 4868142 - DNA, 23 bp, Homo sapiens
atttacttgttttggatggcttg

SEQ ID NO: 4868143 - DNA, 16 bp, Homo sapiens
atttagtcatgtgacc

SEQ ID NO: 4868144 - DNA, 17 bp, Homo sapiens
atttataatacagaatc

SEQ ID NO: 4868145 - DNA, 16 bp, Homo sapiens
atttatagaatttaat

SEQ ID NO: 4868146 - DNA, 14 bp, Homo sapiens
atttatatattgaa

SEQ ID NO: 4868147 - DNA, 24 bp, Homo sapiens
atttatgacaagctgtatcactgc

SEQ ID NO: 4868148 - DNA, 15 bp, Homo sapiens
atttatgcactgtgg

SEQ ID NO: 4868149 - DNA, 16 bp, Homo sapiens
atttatgggtggattt

SEQ ID NO: 4868150 - DNA, 23 bp, Homo sapiens
atttattccccagtgactccagg

SEQ ID NO: 4868151 - DNA, 15 bp, Homo sapiens
atttattttttaaga

SEQ ID NO: 4868152 - DNA, 16 bp, Homo sapiens
atttattttttaagaa

SEQ ID NO: 4868153 - DNA, 21 bp, Homo sapiens
atttattttttaagaaaaaaa

SEQ ID NO: 4868154 - DNA, 19 bp, Homo sapiens
atttcaaagttttgttgta

SEQ ID NO: 4868155 - DNA, 23 bp, Homo sapiens
atttcagagtgactacacacagt

SEQ ID NO: 4868156 - DNA, 12 bp, Homo sapiens
atttcaggactc

SEQ ID NO: 4868157 - DNA, 18 bp, Homo sapiens
atttcaggactctctcca

SEQ ID NO: 4868158 - DNA, 19 bp, Homo sapiens
atttcagtgtaaagtgtgt

SEQ ID NO: 4868159 - DNA, 12 bp, Homo sapiens
atttcctgtgag

SEQ ID NO: 4868160 - DNA, 12 bp, Homo sapiens
atttccttcagg

SEQ ID NO: 4868161 - DNA, 13 bp, Homo sapiens
atttccttcaggc

SEQ ID NO: 4868162 - DNA, 20 bp, Homo sapiens
atttctagtacctgtgactc

SEQ ID NO: 4868163 - DNA, 20 bp, Homo sapiens
atttctatattcctccagct

SEQ ID NO: 4868164 - DNA, 17 bp, Homo sapiens
atttctcagctgtgcct

SEQ ID NO: 4868165 - DNA, 22 bp, Homo sapiens
atttctcttgtattatctcctt

SEQ ID NO: 4868166 - DNA, 18 bp, Homo sapiens
atttgaaggtagaatgtt

SEQ ID NO: 4868167 - DNA, 18 bp, Homo sapiens
atttgaattatcagcaaa

SEQ ID NO: 4868168 - DNA, 16 bp, Homo sapiens
atttgagcatatcagt

SEQ ID NO: 4868169 - DNA, 17 bp, Homo sapiens
atttgaggtctagagag

SEQ ID NO: 4868170 - DNA, 13 bp, Homo sapiens
atttgccagagga

SEQ ID NO: 4868171 - DNA, 16 bp, Homo sapiens
atttgctactgttgta

SEQ ID NO: 4868172 - DNA, 17 bp, Homo sapiens
atttgctactgttgtaa

SEQ ID NO: 4868173 - DNA, 23 bp, Homo sapiens
atttggaggctggagtaatcaga

SEQ ID NO: 4868174 - DNA, 18 bp, Homo sapiens
atttggatttaaaagcct

SEQ ID NO: 4868175 - DNA, 14 bp, Homo sapiens
atttgtgacttttt

SEQ ID NO: 4868176 - DNA, 21 bp, Homo sapiens
atttgtgtgtgtgtgtgtgtt

SEQ ID NO: 4868177 - DNA, 15 bp, Homo sapiens
atttgttttggatat

SEQ ID NO: 4868178 - DNA, 14 bp, Homo sapiens
attttaaaatttca

SEQ ID NO: 4868179 - DNA, 15 bp, Homo sapiens
attttaaaatttcat

SEQ ID NO: 4868180 - DNA, 16 bp, Homo sapiens
attttaaaatttcata

SEQ ID NO: 4868181 - DNA, 13 bp, Homo sapiens
attttaaagtatg

SEQ ID NO: 4868182 - DNA, 18 bp, Homo sapiens
attttaactaaattttaa

SEQ ID NO: 4868183 - DNA, 21 bp, Homo sapiens
attttagaaataataaaaaga

SEQ ID NO: 4868184 - DNA, 15 bp, Homo sapiens
attttagaaatattc

SEQ ID NO: 4868185 - DNA, 22 bp, Homo sapiens
attttatattactgacatttct

SEQ ID NO: 4868186 - DNA, 20 bp, Homo sapiens
attttatccctcacctgtag

SEQ ID NO: 4868187 - DNA, 19 bp, Homo sapiens
attttattttaaaatttca

SEQ ID NO: 4868188 - DNA, 18 bp, Homo sapiens
attttcatagatgtgtta

SEQ ID NO: 4868189 - DNA, 22 bp, Homo sapiens
attttcccactcattctgaatt

SEQ ID NO: 4868190 - DNA, 15 bp, Homo sapiens
attttctaaaagctt

SEQ ID NO: 4868191 - DNA, 15 bp, Homo sapiens
attttgaaatgaact

SEQ ID NO: 4868192 - DNA, 23 bp, Homo sapiens
attttgcctctgtccgtgcccct

SEQ ID NO: 4868193 - DNA, 14 bp, Homo sapiens
attttgcttcccat

SEQ ID NO: 4868194 - DNA, 22 bp, Homo sapiens
attttggcgaatctcaaaatta

SEQ ID NO: 4868195 - DNA, 15 bp, Homo sapiens
attttgtatgttaaa

SEQ ID NO: 4868196 - DNA, 18 bp, Homo sapiens
attttgttcaagtttgct

SEQ ID NO: 4868197 - DNA, 12 bp, Homo sapiens
attttgtttaca

SEQ ID NO: 4868198 - DNA, 16 bp, Homo sapiens
atttttaaaatattta

SEQ ID NO: 4868199 - DNA, 13 bp, Homo sapiens
atttttaactgta

SEQ ID NO: 4868200 - DNA, 16 bp, Homo sapiens
atttttcctgcatgtt

SEQ ID NO: 4868201 - DNA, 16 bp, Homo sapiens
atttttctttaactgc

SEQ ID NO: 4868202 - DNA, 21 bp, Homo sapiens
attttttaagcttcagttgct

SEQ ID NO: 4868203 - DNA, 14 bp, Homo sapiens
atttttttaactgt

SEQ ID NO: 4868204 - DNA, 15 bp, Homo sapiens
atttttttaactgtg

SEQ ID NO: 4868205 - DNA, 17 bp, Homo sapiens
atttttttaactgtgat

SEQ ID NO: 4868206 - DNA, 21 bp, Homo sapiens
atttttttaactgtgataatc

SEQ ID NO: 4868207 - DNA, 19 bp, Homo sapiens
caaaaagccacagcagagc

SEQ ID NO: 4868208 - DNA, 15 bp, Homo sapiens
caaaactccaggcag

SEQ ID NO: 4868209 - DNA, 17 bp, Homo sapiens
caaaataataaaaatca

SEQ ID NO: 4868210 - DNA, 22 bp, Homo sapiens
caaaattaagcaaatgttaaaa

SEQ ID NO: 4868211 - DNA, 17 bp, Homo sapiens
caaacaagccccctgcc

SEQ ID NO: 4868212 - DNA, 14 bp, Homo sapiens
caaacagacaaaac

SEQ ID NO: 4868213 - DNA, 19 bp, Homo sapiens
caaacagcaagagtaagca

SEQ ID NO: 4868214 - DNA, 21 bp, Homo sapiens
caaacagcaagagtaagcagt

SEQ ID NO: 4868215 - DNA, 23 bp, Homo sapiens
caaacagcaagagtaagcagtgt

SEQ ID NO: 4868216 - DNA, 14 bp, Homo sapiens
caaacatcattgtt

SEQ ID NO: 4868217 - DNA, 20 bp, Homo sapiens
caaaccaacaggctaccaac

SEQ ID NO: 4868218 - DNA, 13 bp, Homo sapiens
caaacctggcaga

SEQ ID NO: 4868219 - DNA, 12 bp, Homo sapiens
caaacctgggaa

SEQ ID NO: 4868220 - DNA, 19 bp, Homo sapiens
caaacctgggaaggccagc

SEQ ID NO: 4868221 - DNA, 16 bp, Homo sapiens
caaactactgaatgaa

SEQ ID NO: 4868222 - DNA, 12 bp, Homo sapiens
caaactctgctg

SEQ ID NO: 4868223 - DNA, 13 bp, Homo sapiens
caaactctgctgt

SEQ ID NO: 4868224 - DNA, 21 bp, Homo sapiens
caaactgcttcccttactttg

SEQ ID NO: 4868225 - DNA, 16 bp, Homo sapiens
caaagaaaatgaaatg

SEQ ID NO: 4868226 - DNA, 21 bp, Homo sapiens
caaagaaaatgaaatgcatat

SEQ ID NO: 4868227 - DNA, 17 bp, Homo sapiens
caaagaaacaaagatgt

SEQ ID NO: 4868228 - DNA, 16 bp, Homo sapiens
caaagaagaaagctga

SEQ ID NO: 4868229 - DNA, 12 bp, Homo sapiens
caaagatgaaaa

SEQ ID NO: 4868230 - DNA, 16 bp, Homo sapiens
caaagcactggccttg

SEQ ID NO: 4868231 - DNA, 17 bp, Homo sapiens
caaagcactggccttgc

SEQ ID NO: 4868232 - DNA, 19 bp, Homo sapiens
caaagcactggccttgcct

SEQ ID NO: 4868233 - DNA, 22 bp, Homo sapiens
caaagcactggccttgcctcca

SEQ ID NO: 4868234 - DNA, 14 bp, Homo sapiens
caaaggatgtgata

SEQ ID NO: 4868235 - DNA, 17 bp, Homo sapiens
caaaggatgtgatatat

SEQ ID NO: 4868236 - DNA, 19 bp, Homo sapiens
caaaggtgcactccagact

SEQ ID NO: 4868237 - DNA, 22 bp, Homo sapiens
caaaggtgcactccagactctg

SEQ ID NO: 4868238 - DNA, 15 bp, Homo sapiens
caaagtcctcctttc

SEQ ID NO: 4868239 - DNA, 14 bp, Homo sapiens
caaagtcgccagtc

SEQ ID NO: 4868240 - DNA, 18 bp, Homo sapiens
caaagtctccagaagaaa

SEQ ID NO: 4868241 - DNA, 15 bp, Homo sapiens
caaagtgatagaaaa

SEQ ID NO: 4868242 - DNA, 15 bp, Homo sapiens
caaagtgcctgggct

SEQ ID NO: 4868243 - DNA, 14 bp, Homo sapiens
caaagtggaacgaa

SEQ ID NO: 4868244 - DNA, 15 bp, Homo sapiens
caaagtggaacgaaa

SEQ ID NO: 4868245 - DNA, 17 bp, Homo sapiens
caaagtttcagagtata

SEQ ID NO: 4868246 - DNA, 21 bp, Homo sapiens
caaataatttgaactttggaa

SEQ ID NO: 4868247 - DNA, 18 bp, Homo sapiens
caaatactgtatattcag

SEQ ID NO: 4868248 - DNA, 12 bp, Homo sapiens
caaatagtgtga

SEQ ID NO: 4868249 - DNA, 21 bp, Homo sapiens
caaatagtgtgaaatatatta

SEQ ID NO: 4868250 - DNA, 13 bp, Homo sapiens
caaatagttgcat

SEQ ID NO: 4868251 - DNA, 19 bp, Homo sapiens
caaatcctagactgctcct

SEQ ID NO: 4868252 - DNA, 20 bp, Homo sapiens
caaatcctagactgctcctg

SEQ ID NO: 4868253 - DNA, 22 bp, Homo sapiens
caaatcctagactgctcctggg

SEQ ID NO: 4868254 - DNA, 22 bp, Homo sapiens
caaatgctcccacctgaatttg

SEQ ID NO: 4868255 - DNA, 14 bp, Homo sapiens
caaattctgtctgg

SEQ ID NO: 4868256 - DNA, 18 bp, Homo sapiens
caaattctgtctggggac

SEQ ID NO: 4868257 - DNA, 22 bp, Homo sapiens
caaattgcttttttccaaaaca

SEQ ID NO: 4868258 - DNA, 19 bp, Homo sapiens
caaatttaaaactgttgga

SEQ ID NO: 4868259 - DNA, 20 bp, Homo sapiens
caacaaagaaacaaagatgt

SEQ ID NO: 4868260 - DNA, 17 bp, Homo sapiens
caacagccaagctggca

SEQ ID NO: 4868261 - DNA, 14 bp, Homo sapiens
caacatatatttat

SEQ ID NO: 4868262 - DNA, 15 bp, Homo sapiens
caaccatcatgtgta

SEQ ID NO: 4868263 - DNA, 17 bp, Homo sapiens
caacccttcctgctgct

SEQ ID NO: 4868264 - DNA, 17 bp, Homo sapiens
caacctccagactcagc

SEQ ID NO: 4868265 - DNA, 18 bp, Homo sapiens
caacctccagactcagca

SEQ ID NO: 4868266 - DNA, 19 bp, Homo sapiens
caacctccagactcagcag

SEQ ID NO: 4868267 - DNA, 17 bp, Homo sapiens
caaccttgtcccaagga

SEQ ID NO: 4868268 - DNA, 18 bp, Homo sapiens
caactgaggttcttggga

SEQ ID NO: 4868269 - DNA, 17 bp, Homo sapiens
caacttagagattgcat

SEQ ID NO: 4868270 - DNA, 15 bp, Homo sapiens
caactttttcatagt

SEQ ID NO: 4868271 - DNA, 14 bp, Homo sapiens
caagaaagcttcct

SEQ ID NO: 4868272 - DNA, 19 bp, Homo sapiens
caagaatcagacagcagga

SEQ ID NO: 4868273 - DNA, 13 bp, Homo sapiens
caagactggccca

SEQ ID NO: 4868274 - DNA, 14 bp, Homo sapiens
caagactggcccag

SEQ ID NO: 4868275 - DNA, 15 bp, Homo sapiens
caagagcccagatca

SEQ ID NO: 4868276 - DNA, 21 bp, Homo sapiens
caagagctactcccacagcag

SEQ ID NO: 4868277 - DNA, 20 bp, Homo sapiens
caagaggcaagctgaaattt

SEQ ID NO: 4868278 - DNA, 18 bp, Homo sapiens
caagagggactccaagcc

SEQ ID NO: 4868279 - DNA, 22 bp, Homo sapiens
caagagggactccaagccctgg

SEQ ID NO: 4868280 - DNA, 14 bp, Homo sapiens
caagcaccaacctc

SEQ ID NO: 4868281 - DNA, 16 bp, Homo sapiens
caagcaccaacctcca

SEQ ID NO: 4868282 - DNA, 19 bp, Homo sapiens
caagcaccaacctccagac

SEQ ID NO: 4868283 - DNA, 17 bp, Homo sapiens
caagcatgcagctttgc

SEQ ID NO: 4868284 - DNA, 18 bp, Homo sapiens
caagccccaactttctta

SEQ ID NO: 4868285 - DNA, 12 bp, Homo sapiens
caagccctgggg

SEQ ID NO: 4868286 - DNA, 18 bp, Homo sapiens
caagccctggggcagggt

SEQ ID NO: 4868287 - DNA, 14 bp, Homo sapiens
caagcctgcctccc

SEQ ID NO: 4868288 - DNA, 12 bp, Homo sapiens
caagctgaggag

SEQ ID NO: 4868289 - DNA, 15 bp, Homo sapiens
caagctggaagaagt

SEQ ID NO: 4868290 - DNA, 23 bp, Homo sapiens
caagctggaagaagtgagcagtg

SEQ ID NO: 4868291 - DNA, 22 bp, Homo sapiens
caagctggcacaaaagacagct

SEQ ID NO: 4868292 - DNA, 16 bp, Homo sapiens
caagctgtatcactgc

SEQ ID NO: 4868293 - DNA, 16 bp, Homo sapiens
caagcttcccaacaga

SEQ ID NO: 4868294 - DNA, 15 bp, Homo sapiens
caagcttcttgctga

SEQ ID NO: 4868295 - DNA, 13 bp, Homo sapiens
caagctttaaatt

SEQ ID NO: 4868296 - DNA, 22 bp, Homo sapiens
caaggaaaggcatgtacaaaaa

SEQ ID NO: 4868297 - DNA, 16 bp, Homo sapiens
caaggaatcagcagga

SEQ ID NO: 4868298 - DNA, 16 bp, Homo sapiens
caaggcattctcccag

SEQ ID NO: 4868299 - DNA, 19 bp, Homo sapiens
caaggcattctcccagctc

SEQ ID NO: 4868300 - DNA, 22 bp, Homo sapiens
caaggctgagacagtgaatttg

SEQ ID NO: 4868301 - DNA, 13 bp, Homo sapiens
caagggacagcaa

SEQ ID NO: 4868302 - DNA, 15 bp, Homo sapiens
caagggacagcaagt

SEQ ID NO: 4868303 - DNA, 14 bp, Homo sapiens
caagggggctgctg

SEQ ID NO: 4868304 - DNA, 16 bp, Homo sapiens
caagggggctgctgct

SEQ ID NO: 4868305 - DNA, 22 bp, Homo sapiens
caagggggctgctgctcctctc

SEQ ID NO: 4868306 - DNA, 23 bp, Homo sapiens
caaggggtgaggataggacagag

SEQ ID NO: 4868307 - DNA, 20 bp, Homo sapiens
caaggtggcctctgcctggg

SEQ ID NO: 4868308 - DNA, 14 bp, Homo sapiens
caagtaatttcagt

SEQ ID NO: 4868309 - DNA, 18 bp, Homo sapiens
caagtccttaggctactg

SEQ ID NO: 4868310 - DNA, 12 bp, Homo sapiens
caagtgagcaga

SEQ ID NO: 4868311 - DNA, 21 bp, Homo sapiens
caagtggacgttaggccaggc

SEQ ID NO: 4868312 - DNA, 18 bp, Homo sapiens
caagtggtgtttattgca

SEQ ID NO: 4868313 - DNA, 20 bp, Homo sapiens
caagtggtgtttattgcaat

SEQ ID NO: 4868314 - DNA, 16 bp, Homo sapiens
caagtgtgctaaaaat

SEQ ID NO: 4868315 - DNA, 18 bp, Homo sapiens
caataaagtataatgttt

SEQ ID NO: 4868316 - DNA, 14 bp, Homo sapiens
caataaagtgatct

SEQ ID NO: 4868317 - DNA, 22 bp, Homo sapiens
caataaagtgatctgtgttcaa

SEQ ID NO: 4868318 - DNA, 13 bp, Homo sapiens
caataataaagta

SEQ ID NO: 4868319 - DNA, 15 bp, Homo sapiens
caataataaagtact

SEQ ID NO: 4868320 - DNA, 23 bp, Homo sapiens
caataataaagtacttgactacc

SEQ ID NO: 4868321 - DNA, 13 bp, Homo sapiens
caataccttcaag

SEQ ID NO: 4868322 - DNA, 15 bp, Homo sapiens
caatagttgaattag

SEQ ID NO: 4868323 - DNA, 12 bp, Homo sapiens
caatatatgtat

SEQ ID NO: 4868324 - DNA, 17 bp, Homo sapiens
caatatgtatatatgta

SEQ ID NO: 4868325 - DNA, 21 bp, Homo sapiens
caatcacagggaatggccaca

SEQ ID NO: 4868326 - DNA, 14 bp, Homo sapiens
caatctctttttgt

SEQ ID NO: 4868327 - DNA, 17 bp, Homo sapiens
caatgaaccataaattc

SEQ ID NO: 4868328 - DNA, 11 bp, Homo sapiens
caatgctgctt

SEQ ID NO: 4868329 - DNA, 13 bp, Homo sapiens
caatgctgctttt

SEQ ID NO: 4868330 - DNA, 19 bp, Homo sapiens
caatgttggagcagcaggc

SEQ ID NO: 4868331 - DNA, 16 bp, Homo sapiens
caattaaaaacgaaaa

SEQ ID NO: 4868332 - DNA, 17 bp, Homo sapiens
caattagacttgaaata

SEQ ID NO: 4868333 - DNA, 18 bp, Homo sapiens
caattgcgaccttaattt

SEQ ID NO: 4868334 - DNA, 21 bp, Homo sapiens
caatttctagtacctgtgact

SEQ ID NO: 4868335 - DNA, 21 bp, Homo sapiens
caatttggatttaaaagcctg

SEQ ID NO: 4868336 - DNA, 23 bp, Homo sapiens
caatttggatttaaaagcctgct

SEQ ID NO: 4868337 - DNA, 17 bp, Homo sapiens
cacaaaagacagctggc

SEQ ID NO: 4868338 - DNA, 22 bp, Homo sapiens
cacaaaatatattttgtttaca

SEQ ID NO: 4868339 - DNA, 15 bp, Homo sapiens
cacaaactccaggct

SEQ ID NO: 4868340 - DNA, 17 bp, Homo sapiens
cacaaagcactggcctt

SEQ ID NO: 4868341 - DNA, 16 bp, Homo sapiens
cacaactcccttgcac

SEQ ID NO: 4868342 - DNA, 19 bp, Homo sapiens
cacaactgtgtgattaaaa

SEQ ID NO: 4868343 - DNA, 22 bp, Homo sapiens
cacaactgtgtgattaaaaggt

SEQ ID NO: 4868344 - DNA, 22 bp, Homo sapiens
cacaagactggcccagtgccag

SEQ ID NO: 4868345 - DNA, 15 bp, Homo sapiens
cacaatgttggagca

SEQ ID NO: 4868346 - DNA, 20 bp, Homo sapiens
cacaatgttggagcagcagg

SEQ ID NO: 4868347 - DNA, 12 bp, Homo sapiens
cacacacacaca

SEQ ID NO: 4868348 - DNA, 15 bp, Homo sapiens
cacacacacacacac

SEQ ID NO: 4868349 - DNA, 14 bp, Homo sapiens
cacacacacacacg

SEQ ID NO: 4868350 - DNA, 15 bp, Homo sapiens
cacacacacgatgca

SEQ ID NO: 4868351 - DNA, 22 bp, Homo sapiens
cacacacgatgcatttaataaa

SEQ ID NO: 4868352 - DNA, 23 bp, Homo sapiens
cacaccgtggcagcttgctgggc

SEQ ID NO: 4868353 - DNA, 20 bp, Homo sapiens
cacacgatgcatttaataaa

SEQ ID NO: 4868354 - DNA, 13 bp, Homo sapiens
cacactcacctct

SEQ ID NO: 4868355 - DNA, 15 bp, Homo sapiens
cacactcacctctaa

SEQ ID NO: 4868356 - DNA, 22 bp, Homo sapiens
cacactcagaaaattccctggg

SEQ ID NO: 4868357 - DNA, 12 bp, Homo sapiens
cacactgcttgg

SEQ ID NO: 4868358 - DNA, 16 bp, Homo sapiens
cacacttgaaaccttt

SEQ ID NO: 4868359 - DNA, 18 bp, Homo sapiens
cacagaaggtgaactttg

SEQ ID NO: 4868360 - DNA, 22 bp, Homo sapiens
cacagacactaacgaaatatca

SEQ ID NO: 4868361 - DNA, 12 bp, Homo sapiens
cacagcagagca

SEQ ID NO: 4868362 - DNA, 16 bp, Homo sapiens
cacagcattgtatatg

SEQ ID NO: 4868363 - DNA, 16 bp, Homo sapiens
cacagccaaatttaaa

SEQ ID NO: 4868364 - DNA, 19 bp, Homo sapiens
cacagccttctaaattccc

SEQ ID NO: 4868365 - DNA, 18 bp, Homo sapiens
cacagccttctccactgg

SEQ ID NO: 4868366 - DNA, 23 bp, Homo sapiens
cacagccttgcagcggctcctgc

SEQ ID NO: 4868367 - DNA, 21 bp, Homo sapiens
cacagctcaagcattctgttt

SEQ ID NO: 4868368 - DNA, 13 bp, Homo sapiens
cacaggatcctgg

SEQ ID NO: 4868369 - DNA, 16 bp, Homo sapiens
cacaggatcctggcct

SEQ ID NO: 4868370 - DNA, 18 bp, Homo sapiens
cacaggatcctggcctga

SEQ ID NO: 4868371 - DNA, 14 bp, Homo sapiens
cacagggaatggcc

SEQ ID NO: 4868372 - DNA, 22 bp, Homo sapiens
cacagggaatggccacaaacct

SEQ ID NO: 4868373 - DNA, 23 bp, Homo sapiens
cacagggaatggccacaaacctg

SEQ ID NO: 4868374 - DNA, 19 bp, Homo sapiens
cacaggtgcaacagacttg

SEQ ID NO: 4868375 - DNA, 20 bp, Homo sapiens
cacagtgtaatccaggggtg

SEQ ID NO: 4868376 - DNA, 21 bp, Homo sapiens
cacagtgtgtggtcaacattt

SEQ ID NO: 4868377 - DNA, 17 bp, Homo sapiens
cacatagcataggctgg

SEQ ID NO: 4868378 - DNA, 20 bp, Homo sapiens
cacatagcataggctgggga

SEQ ID NO: 4868379 - DNA, 20 bp, Homo sapiens
cacatcacaagactatgcca

SEQ ID NO: 4868380 - DNA, 22 bp, Homo sapiens
cacatgactctcattttattta

SEQ ID NO: 4868381 - DNA, 20 bp, Homo sapiens
cacatggccatcttctttct

SEQ ID NO: 4868382 - DNA, 23 bp, Homo sapiens
cacattgaagaatgttagagtaa

SEQ ID NO: 4868383 - DNA, 20 bp, Homo sapiens
caccaacctccagactcagc

SEQ ID NO: 4868384 - DNA, 23 bp, Homo sapiens
caccaacctccagactcagcaga

SEQ ID NO: 4868385 - DNA, 16 bp, Homo sapiens
caccacagcattgtgt

SEQ ID NO: 4868386 - DNA, 20 bp, Homo sapiens
caccactaggaatcccagag

SEQ ID NO: 4868387 - DNA, 14 bp, Homo sapiens
caccagccccccgc

SEQ ID NO: 4868388 - DNA, 19 bp, Homo sapiens
caccataccttagagactt

SEQ ID NO: 4868389 - DNA, 17 bp, Homo sapiens
caccatgtgagctcttc

SEQ ID NO: 4868390 - DNA, 17 bp, Homo sapiens
cacccacaaactccagg

SEQ ID NO: 4868391 - DNA, 18 bp, Homo sapiens
cacccacaaactccaggc

SEQ ID NO: 4868392 - DNA, 20 bp, Homo sapiens
cacccacaaactccaggctg

SEQ ID NO: 4868393 - DNA, 18 bp, Homo sapiens
cacccatcctaggaacca

SEQ ID NO: 4868394 - DNA, 21 bp, Homo sapiens
caccctccatgctcctcacct

SEQ ID NO: 4868395 - DNA, 22 bp, Homo sapiens
caccctccatgctcctcacctg

SEQ ID NO: 4868396 - DNA, 22 bp, Homo sapiens
caccctctgtccttcccccagc

SEQ ID NO: 4868397 - DNA, 17 bp, Homo sapiens
caccgagggcgaccccg

SEQ ID NO: 4868398 - DNA, 22 bp, Homo sapiens
caccgcaggtgctcatgctgct

SEQ ID NO: 4868399 - DNA, 22 bp, Homo sapiens
cacctccttctgcagtcagact

SEQ ID NO: 4868400 - DNA, 23 bp, Homo sapiens
cacctccttctgcagtcagactg

SEQ ID NO: 4868401 - DNA, 16 bp, Homo sapiens
caccttggctgggaag

SEQ ID NO: 4868402 - DNA, 18 bp, Homo sapiens
cacgagtgtagtcccgga

SEQ ID NO: 4868403 - DNA, 17 bp, Homo sapiens
cacgatgcatttaataa

SEQ ID NO: 4868404 - DNA, 15 bp, Homo sapiens
cacgtgggaaccccc

SEQ ID NO: 4868405 - DNA, 19 bp, Homo sapiens
cactaaaacacacaggtgc

SEQ ID NO: 4868406 - DNA, 23 bp, Homo sapiens
cactaaaatgaggatccagggca

SEQ ID NO: 4868407 - DNA, 17 bp, Homo sapiens
cactagggccttggaaa

SEQ ID NO: 4868408 - DNA, 18 bp, Homo sapiens
cactagggccttggaaat

SEQ ID NO: 4868409 - DNA, 13 bp, Homo sapiens
cactatttgtgac

SEQ ID NO: 4868410 - DNA, 14 bp, Homo sapiens
cactcacctctaac

SEQ ID NO: 4868411 - DNA, 19 bp, Homo sapiens
cactcagaaaattccctgg

SEQ ID NO: 4868412 - DNA, 18 bp, Homo sapiens
cactcattctgaattaat

SEQ ID NO: 4868413 - DNA, 10 bp, Homo sapiens
cactccagac

SEQ ID NO: 4868414 - DNA, 16 bp, Homo sapiens
cactccagactctggg

SEQ ID NO: 4868415 - DNA, 17 bp, Homo sapiens
cactccagactctgggg

SEQ ID NO: 4868416 - DNA, 12 bp, Homo sapiens
cactcccaagcc

SEQ ID NO: 4868417 - DNA, 19 bp, Homo sapiens
cactcccaagggacagcaa

SEQ ID NO: 4868418 - DNA, 14 bp, Homo sapiens
cactccgtctgctc

SEQ ID NO: 4868419 - DNA, 21 bp, Homo sapiens
cactcctgcttaatcttcaaa

SEQ ID NO: 4868420 - DNA, 19 bp, Homo sapiens
cactctcagagtgttttga

SEQ ID NO: 4868421 - DNA, 15 bp, Homo sapiens
cactctcccttgtac

SEQ ID NO: 4868422 - DNA, 20 bp, Homo sapiens
cactgaaaaatctaagtgat

SEQ ID NO: 4868423 - DNA, 14 bp, Homo sapiens
cactgagcagggat

SEQ ID NO: 4868424 - DNA, 20 bp, Homo sapiens
cactgatatatcatgagtga

SEQ ID NO: 4868425 - DNA, 20 bp, Homo sapiens
cactgatgagtttcactgta

SEQ ID NO: 4868426 - DNA, 16 bp, Homo sapiens
cactgcggctgtctcc

SEQ ID NO: 4868427 - DNA, 15 bp, Homo sapiens
cactgctgcaaggtg

SEQ ID NO: 4868428 - DNA, 14 bp, Homo sapiens
cactggactgcatg

SEQ ID NO: 4868429 - DNA, 23 bp, Homo sapiens
cactggactgcatggggaggcag

SEQ ID NO: 4868430 - DNA, 11 bp, Homo sapiens
cactggccttg

SEQ ID NO: 4868431 - DNA, 15 bp, Homo sapiens
cactggccttgcctc

SEQ ID NO: 4868432 - DNA, 20 bp, Homo sapiens
cactggtctgtttgcatttg

SEQ ID NO: 4868433 - DNA, 14 bp, Homo sapiens
cactgtgaccaggc

SEQ ID NO: 4868434 - DNA, 16 bp, Homo sapiens
cacttctccccagaaa

SEQ ID NO: 4868435 - DNA, 11 bp, Homo sapiens
cacttgagttt

SEQ ID NO: 4868436 - DNA, 20 bp, Homo sapiens
cacttgccattccaaaatat

SEQ ID NO: 4868437 - DNA, 14 bp, Homo sapiens
cacttgcccacacc

SEQ ID NO: 4868438 - DNA, 13 bp, Homo sapiens
cactttcaagaat

SEQ ID NO: 4868439 - DNA, 20 bp, Homo sapiens
cacttttccttttcttaaaa

SEQ ID NO: 4868440 - DNA, 11 bp, Homo sapiens
cagaaaaccac

SEQ ID NO: 4868441 - DNA, 18 bp, Homo sapiens
cagaaaattccctggggt

SEQ ID NO: 4868442 - DNA, 22 bp, Homo sapiens
cagaaacgagatcgggaagcag

SEQ ID NO: 4868443 - DNA, 20 bp, Homo sapiens
cagaaagcttcatccacagc

SEQ ID NO: 4868444 - DNA, 13 bp, Homo sapiens
cagaaaggtgtga

SEQ ID NO: 4868445 - DNA, 17 bp, Homo sapiens
cagaaaggtgtgaggag

SEQ ID NO: 4868446 - DNA, 14 bp, Homo sapiens
cagaaatagacaaa

SEQ ID NO: 4868447 - DNA, 20 bp, Homo sapiens
cagaaatagacaaaaagtat

SEQ ID NO: 4868448 - DNA, 22 bp, Homo sapiens
cagaaatgttgagtctgtacta

SEQ ID NO: 4868449 - DNA, 18 bp, Homo sapiens
cagaacactttgctagga

SEQ ID NO: 4868450 - DNA, 16 bp, Homo sapiens
cagaaccacacttgaa

SEQ ID NO: 4868451 - DNA, 17 bp, Homo sapiens
cagaagaatcttcctgg

SEQ ID NO: 4868452 - DNA, 20 bp, Homo sapiens
cagaagaatcttcctggcac

SEQ ID NO: 4868453 - DNA, 23 bp, Homo sapiens
cagaagccaatctacaatctctt

SEQ ID NO: 4868454 - DNA, 12 bp, Homo sapiens
cagaagctgctc

SEQ ID NO: 4868455 - DNA, 21 bp, Homo sapiens
cagaaggtgaactttgtgctt

SEQ ID NO: 4868456 - DNA, 13 bp, Homo sapiens
cagaatttgaatt

SEQ ID NO: 4868457 - DNA, 19 bp, Homo sapiens
cagacactaacgaaatatc

SEQ ID NO: 4868458 - DNA, 21 bp, Homo sapiens
cagacagcttacaggagccag

SEQ ID NO: 4868459 - DNA, 22 bp, Homo sapiens
cagacagcttacaggagccagc

SEQ ID NO: 4868460 - DNA, 20 bp, Homo sapiens
cagacatttctttggaaaac

SEQ ID NO: 4868461 - DNA, 12 bp, Homo sapiens
cagacccctgcc

SEQ ID NO: 4868462 - DNA, 19 bp, Homo sapiens
cagacccctgcctggactt

SEQ ID NO: 4868463 - DNA, 16 bp, Homo sapiens
cagacctggagcttca

SEQ ID NO: 4868464 - DNA, 22 bp, Homo sapiens
cagacctggagcttcagccagg

SEQ ID NO: 4868465 - DNA, 23 bp, Homo sapiens
cagacctggagcttcagccaggt

SEQ ID NO: 4868466 - DNA, 19 bp, Homo sapiens
cagacgtggtgcttctcac

SEQ ID NO: 4868467 - DNA, 18 bp, Homo sapiens
cagactgggcactggggc

SEQ ID NO: 4868468 - DNA, 13 bp, Homo sapiens
cagagaaagcaaa

SEQ ID NO: 4868469 - DNA, 19 bp, Homo sapiens
cagagaaagcaaaggtgca

SEQ ID NO: 4868470 - DNA, 24 bp, Homo sapiens
cagagaaagcaaaggtgcactcca

SEQ ID NO: 4868471 - DNA, 21 bp, Homo sapiens
cagagaaatttagagctaaaa

SEQ ID NO: 4868472 - DNA, 21 bp, Homo sapiens
cagagacactgttgataaaaa

SEQ ID NO: 4868473 - DNA, 18 bp, Homo sapiens
cagagaccataagagaaa

SEQ ID NO: 4868474 - DNA, 19 bp, Homo sapiens
cagagaccataagagaaac

SEQ ID NO: 4868475 - DNA, 21 bp, Homo sapiens
cagagaccataagagaaacct

SEQ ID NO: 4868476 - DNA, 16 bp, Homo sapiens
cagagagggaaaaggc

SEQ ID NO: 4868477 - DNA, 12 bp, Homo sapiens
cagagagggaag

SEQ ID NO: 4868478 - DNA, 19 bp, Homo sapiens
cagagatttctcattgact

SEQ ID NO: 4868479 - DNA, 20 bp, Homo sapiens
cagagatttctcattgactt

SEQ ID NO: 4868480 - DNA, 21 bp, Homo sapiens
cagagcggggtcccctctgtg

SEQ ID NO: 4868481 - DNA, 21 bp, Homo sapiens
cagagctctgggttgtgcaca

SEQ ID NO: 4868482 - DNA, 21 bp, Homo sapiens
cagagcttgtggtggggcagg

SEQ ID NO: 4868483 - DNA, 22 bp, Homo sapiens
cagaggtattaaaactaaattt

SEQ ID NO: 4868484 - DNA, 23 bp, Homo sapiens
cagaggtggatactggggggcag

SEQ ID NO: 4868485 - DNA, 16 bp, Homo sapiens
cagaggtggggtgctg

SEQ ID NO: 4868486 - DNA, 16 bp, Homo sapiens
cagaggtttgaaggag

SEQ ID NO: 4868487 - DNA, 13 bp, Homo sapiens
cagagtctgtctc

SEQ ID NO: 4868488 - DNA, 18 bp, Homo sapiens
cagagtgggctttggtgg

SEQ ID NO: 4868489 - DNA, 17 bp, Homo sapiens
cagagttaaatctcaaa

SEQ ID NO: 4868490 - DNA, 14 bp, Homo sapiens
cagatacctgtgag

SEQ ID NO: 4868491 - DNA, 18 bp, Homo sapiens
cagatagtgtagctgagg

SEQ ID NO: 4868492 - DNA, 20 bp, Homo sapiens
cagatagtgtagctgaggag

SEQ ID NO: 4868493 - DNA, 15 bp, Homo sapiens
cagatatctgcatgt

SEQ ID NO: 4868494 - DNA, 23 bp, Homo sapiens
cagatctattgtttgttgcacta

SEQ ID NO: 4868495 - DNA, 15 bp, Homo sapiens
cagatctttcagaaa

SEQ ID NO: 4868496 - DNA, 20 bp, Homo sapiens
cagatctttcagaaatataa

SEQ ID NO: 4868497 - DNA, 15 bp, Homo sapiens
cagatgggggcctct

SEQ ID NO: 4868498 - DNA, 16 bp, Homo sapiens
cagattggccaattaa

SEQ ID NO: 4868499 - DNA, 17 bp, Homo sapiens
cagattggccaattaaa

SEQ ID NO: 4868500 - DNA, 14 bp, Homo sapiens
cagcaaacaggtgc

SEQ ID NO: 4868501 - DNA, 15 bp, Homo sapiens
cagcaaagaaaaaaa

SEQ ID NO: 4868502 - DNA, 14 bp, Homo sapiens
cagcaaattccaga

SEQ ID NO: 4868503 - DNA, 19 bp, Homo sapiens
cagcaacccttcctgctgc

SEQ ID NO: 4868504 - DNA, 21 bp, Homo sapiens
cagcaacccttcctgctgctg

SEQ ID NO: 4868505 - DNA, 20 bp, Homo sapiens
cagcaagagtaagcagtgtt

SEQ ID NO: 4868506 - DNA, 16 bp, Homo sapiens
cagcaagtgagcagag

SEQ ID NO: 4868507 - DNA, 17 bp, Homo sapiens
cagcaagtgagcagaga

SEQ ID NO: 4868508 - DNA, 15 bp, Homo sapiens
cagcactttgggagg

SEQ ID NO: 4868509 - DNA, 23 bp, Homo sapiens
cagcagagcggggtcccctctgt

SEQ ID NO: 4868510 - DNA, 14 bp, Homo sapiens
cagcagcctgtatg

SEQ ID NO: 4868511 - DNA, 15 bp, Homo sapiens
cagcagcctgtatgt

SEQ ID NO: 4868512 - DNA, 15 bp, Homo sapiens
cagcagctgatgctg

SEQ ID NO: 4868513 - DNA, 17 bp, Homo sapiens
cagcaggccagagaaag

SEQ ID NO: 4868514 - DNA, 11 bp, Homo sapiens
cagcaggcctc

SEQ ID NO: 4868515 - DNA, 15 bp, Homo sapiens
cagcaggcctctggg

SEQ ID NO: 4868516 - DNA, 18 bp, Homo sapiens
cagcatccagtgtgagat

SEQ ID NO: 4868517 - DNA, 19 bp, Homo sapiens
cagcatccagtgtgagata

SEQ ID NO: 4868518 - DNA, 14 bp, Homo sapiens
cagcatctgctcca

SEQ ID NO: 4868519 - DNA, 12 bp, Homo sapiens
cagcattgtgtg

SEQ ID NO: 4868520 - DNA, 17 bp, Homo sapiens
cagccaaatgcagggag

SEQ ID NO: 4868521 - DNA, 18 bp, Homo sapiens
cagccaaatgcagggagg

SEQ ID NO: 4868522 - DNA, 22 bp, Homo sapiens
cagccaaatttaaaactgttgg

SEQ ID NO: 4868523 - DNA, 21 bp, Homo sapiens
cagccagaacgtggctctgct

SEQ ID NO: 4868524 - DNA, 22 bp, Homo sapiens
cagccagaacgtggctctgctg

SEQ ID NO: 4868525 - DNA, 17 bp, Homo sapiens
cagccaggtctgactcc

SEQ ID NO: 4868526 - DNA, 18 bp, Homo sapiens
cagccaggtctgactcca

SEQ ID NO: 4868527 - DNA, 20 bp, Homo sapiens
cagccaggtctgactccaaa

SEQ ID NO: 4868528 - DNA, 16 bp, Homo sapiens
cagcccaaacctggga

SEQ ID NO: 4868529 - DNA, 17 bp, Homo sapiens
cagcccaaacctgggaa

SEQ ID NO: 4868530 - DNA, 14 bp, Homo sapiens
cagcccagagcagg

SEQ ID NO: 4868531 - DNA, 18 bp, Homo sapiens
cagcccagagcagggtct

SEQ ID NO: 4868532 - DNA, 13 bp, Homo sapiens
cagccccaggaga

SEQ ID NO: 4868533 - DNA, 21 bp, Homo sapiens
cagccctggcaaatgcctgac

SEQ ID NO: 4868534 - DNA, 11 bp, Homo sapiens
cagccctgggc

SEQ ID NO: 4868535 - DNA, 13 bp, Homo sapiens
cagccctgggcac

SEQ ID NO: 4868536 - DNA, 13 bp, Homo sapiens
cagccgcagagaa

SEQ ID NO: 4868537 - DNA, 18 bp, Homo sapiens
cagccgcagagaaatgcc

SEQ ID NO: 4868538 - DNA, 22 bp, Homo sapiens
cagccgcagagaaatgccccag

SEQ ID NO: 4868539 - DNA, 14 bp, Homo sapiens
cagcctaagaagaa

SEQ ID NO: 4868540 - DNA, 15 bp, Homo sapiens
cagcctaagaagaag

SEQ ID NO: 4868541 - DNA, 23 bp, Homo sapiens
cagcctaagaagaaggccagaga

SEQ ID NO: 4868542 - DNA, 15 bp, Homo sapiens
cagcctactctcctt

SEQ ID NO: 4868543 - DNA, 16 bp, Homo sapiens
cagcctactctccttg

SEQ ID NO: 4868544 - DNA, 21 bp, Homo sapiens
cagcctagcctatgtctggca

SEQ ID NO: 4868545 - DNA, 23 bp, Homo sapiens
cagcctagcctatgtctggcaga

SEQ ID NO: 4868546 - DNA, 15 bp, Homo sapiens
cagcctgcttcccac

SEQ ID NO: 4868547 - DNA, 17 bp, Homo sapiens
cagcctgctttcctgca

SEQ ID NO: 4868548 - DNA, 20 bp, Homo sapiens
cagcctgctttcctgcagca

SEQ ID NO: 4868549 - DNA, 16 bp, Homo sapiens
cagcctggttggcagc

SEQ ID NO: 4868550 - DNA, 17 bp, Homo sapiens
cagcctggtttctgggt

SEQ ID NO: 4868551 - DNA, 19 bp, Homo sapiens
cagcctggtttctgggtgc

SEQ ID NO: 4868552 - DNA, 20 bp, Homo sapiens
cagcctggtttctgggtgct

SEQ ID NO: 4868553 - DNA, 15 bp, Homo sapiens
cagccttagagctct

SEQ ID NO: 4868554 - DNA, 18 bp, Homo sapiens
cagccttcatcagaactc

SEQ ID NO: 4868555 - DNA, 19 bp, Homo sapiens
cagccttctaaattcccaa

SEQ ID NO: 4868556 - DNA, 18 bp, Homo sapiens
cagccttgcaacccaagg

SEQ ID NO: 4868557 - DNA, 20 bp, Homo sapiens
cagccttgcaacccaaggtg

SEQ ID NO: 4868558 - DNA, 19 bp, Homo sapiens
cagccttgcagcggctcct

SEQ ID NO: 4868559 - DNA, 20 bp, Homo sapiens
cagccttgcagcggctcctg

SEQ ID NO: 4868560 - DNA, 22 bp, Homo sapiens
cagccttgtacagtctgctcct

SEQ ID NO: 4868561 - DNA, 21 bp, Homo sapiens
cagcggattgctctggagcag

SEQ ID NO: 4868562 - DNA, 22 bp, Homo sapiens
cagcggattgctctggagcagc

SEQ ID NO: 4868563 - DNA, 12 bp, Homo sapiens
cagcggctcctg

SEQ ID NO: 4868564 - DNA, 22 bp, Homo sapiens
cagcgggtacttatttctcagc

SEQ ID NO: 4868565 - DNA, 16 bp, Homo sapiens
cagcgtggctctaaaa

SEQ ID NO: 4868566 - DNA, 13 bp, Homo sapiens
cagcgtgtggagc

SEQ ID NO: 4868567 - DNA, 14 bp, Homo sapiens
cagcgtgtggagca

SEQ ID NO: 4868568 - DNA, 16 bp, Homo sapiens
cagcgtgtggagcaga

SEQ ID NO: 4868569 - DNA, 14 bp, Homo sapiens
cagctctagcctct

SEQ ID NO: 4868570 - DNA, 18 bp, Homo sapiens
cagctctagcctctggac

SEQ ID NO: 4868571 - DNA, 23 bp, Homo sapiens
cagctctcctccagccctgggca

SEQ ID NO: 4868572 - DNA, 13 bp, Homo sapiens
cagctctctggga

SEQ ID NO: 4868573 - DNA, 16 bp, Homo sapiens
cagctctggagggggt

SEQ ID NO: 4868574 - DNA, 11 bp, Homo sapiens
cagctgacagc

SEQ ID NO: 4868575 - DNA, 15 bp, Homo sapiens
cagctgacagccaca

SEQ ID NO: 4868576 - DNA, 16 bp, Homo sapiens
cagctgacagccacac

SEQ ID NO: 4868577 - DNA, 16 bp, Homo sapiens
cagctgatgctgtact

SEQ ID NO: 4868578 - DNA, 14 bp, Homo sapiens
cagctgcagcctgg

SEQ ID NO: 4868579 - DNA, 19 bp, Homo sapiens
cagctgctgttgaactttt

SEQ ID NO: 4868580 - DNA, 18 bp, Homo sapiens
cagctggcggaggctgct

SEQ ID NO: 4868581 - DNA, 11 bp, Homo sapiens
cagctgtgcct

SEQ ID NO: 4868582 - DNA, 15 bp, Homo sapiens
cagctgtgccttccc

SEQ ID NO: 4868583 - DNA, 13 bp, Homo sapiens
cagctgtgctcca

SEQ ID NO: 4868584 - DNA, 16 bp, Homo sapiens
cagctgtgctccacac

SEQ ID NO: 4868585 - DNA, 20 bp, Homo sapiens
cagctgtgctccacactcag

SEQ ID NO: 4868586 - DNA, 23 bp, Homo sapiens
cagctgtgctccacactcagaaa

SEQ ID NO: 4868587 - DNA, 16 bp, Homo sapiens
cagcttacaggagcca

SEQ ID NO: 4868588 - DNA, 19 bp, Homo sapiens
cagcttcttcacaggcact

SEQ ID NO: 4868589 - DNA, 13 bp, Homo sapiens
cagcttgctgggc

SEQ ID NO: 4868590 - DNA, 15 bp, Homo sapiens
cagcttgctgggctt

SEQ ID NO: 4868591 - DNA, 21 bp, Homo sapiens
cagcttgctgggctttgggaa

SEQ ID NO: 4868592 - DNA, 19 bp, Homo sapiens
caggaacggtggaggcaga

SEQ ID NO: 4868593 - DNA, 22 bp, Homo sapiens
caggaacggtggaggcagaggt

SEQ ID NO: 4868594 - DNA, 22 bp, Homo sapiens
caggaagccatagatgctggct

SEQ ID NO: 4868595 - DNA, 20 bp, Homo sapiens
caggaagcctactatttaaa

SEQ ID NO: 4868596 - DNA, 23 bp, Homo sapiens
caggacagttgatggagccccag

SEQ ID NO: 4868597 - DNA, 19 bp, Homo sapiens
caggacccatccctgcctg

SEQ ID NO: 4868598 - DNA, 15 bp, Homo sapiens
caggacctgggacag

SEQ ID NO: 4868599 - DNA, 15 bp, Homo sapiens
caggagcaggaccta

SEQ ID NO: 4868600 - DNA, 18 bp, Homo sapiens
caggagccagcctgcttc

SEQ ID NO: 4868601 - DNA, 22 bp, Homo sapiens
caggagccagcctgcttcccac

SEQ ID NO: 4868602 - DNA, 14 bp, Homo sapiens
caggagccccccta

SEQ ID NO: 4868603 - DNA, 14 bp, Homo sapiens
caggagcctggcca

SEQ ID NO: 4868604 - DNA, 15 bp, Homo sapiens
caggagtctctgcca

SEQ ID NO: 4868605 - DNA, 15 bp, Homo sapiens
caggatcctggcctg

SEQ ID NO: 4868606 - DNA, 22 bp, Homo sapiens
caggatgtgtgggccaggatcc

SEQ ID NO: 4868607 - DNA, 17 bp, Homo sapiens
caggcaaagaaaatgaa

SEQ ID NO: 4868608 - DNA, 15 bp, Homo sapiens
caggcaagaaagctt

SEQ ID NO: 4868609 - DNA, 17 bp, Homo sapiens
caggcacattaactgtt

SEQ ID NO: 4868610 - DNA, 17 bp, Homo sapiens
caggcagacaaccttgt

SEQ ID NO: 4868611 - DNA, 23 bp, Homo sapiens
caggcagggagagagtagctgca

SEQ ID NO: 4868612 - DNA, 22 bp, Homo sapiens
caggcatctgttagcagagtct

SEQ ID NO: 4868613 - DNA, 23 bp, Homo sapiens
caggcatctgttagcagagtctg

SEQ ID NO: 4868614 - DNA, 18 bp, Homo sapiens
caggcatgtgtctggccc

SEQ ID NO: 4868615 - DNA, 15 bp, Homo sapiens
caggcattggatatt

SEQ ID NO: 4868616 - DNA, 14 bp, Homo sapiens
caggcccaatgctg

SEQ ID NO: 4868617 - DNA, 16 bp, Homo sapiens
caggcccaatgctgct

SEQ ID NO: 4868618 - DNA, 18 bp, Homo sapiens
caggcccaatgctgcttt

SEQ ID NO: 4868619 - DNA, 15 bp, Homo sapiens
caggcctcccaagct

SEQ ID NO: 4868620 - DNA, 20 bp, Homo sapiens
caggcctctgggacccacag

SEQ ID NO: 4868621 - DNA, 18 bp, Homo sapiens
caggccttcctcctctca

SEQ ID NO: 4868622 - DNA, 11 bp, Homo sapiens
caggctcagga

SEQ ID NO: 4868623 - DNA, 12 bp, Homo sapiens
caggctcaggag

SEQ ID NO: 4868624 - DNA, 22 bp, Homo sapiens
caggctcaggagaagccagtgt

SEQ ID NO: 4868625 - DNA, 18 bp, Homo sapiens
caggctcctaaagagaca

SEQ ID NO: 4868626 - DNA, 20 bp, Homo sapiens
caggctgcagaggcacctca

SEQ ID NO: 4868627 - DNA, 18 bp, Homo sapiens
caggctggaagtacttgg

SEQ ID NO: 4868628 - DNA, 23 bp, Homo sapiens
cagggaatggccacaaacctgcc

SEQ ID NO: 4868629 - DNA, 23 bp, Homo sapiens
cagggagagagtagctgcagcct

SEQ ID NO: 4868630 - DNA, 22 bp, Homo sapiens
cagggagcatttaatggcagct

SEQ ID NO: 4868631 - DNA, 23 bp, Homo sapiens
cagggagcatttaatggcagcta

SEQ ID NO: 4868632 - DNA, 18 bp, Homo sapiens
cagggaggggaggcagat

SEQ ID NO: 4868633 - DNA, 21 bp, Homo sapiens
cagggatggagggaagacctg

SEQ ID NO: 4868634 - DNA, 18 bp, Homo sapiens
cagggcagaaccaagaac

SEQ ID NO: 4868635 - DNA, 14 bp, Homo sapiens
cagggcagcaggcc

SEQ ID NO: 4868636 - DNA, 14 bp, Homo sapiens
cagggcccccacag

SEQ ID NO: 4868637 - DNA, 20 bp, Homo sapiens
cagggcccccacaggggatg

SEQ ID NO: 4868638 - DNA, 21 bp, Homo sapiens
cagggcccccacaggggatgg

SEQ ID NO: 4868639 - DNA, 11 bp, Homo sapiens
cagggccctga

SEQ ID NO: 4868640 - DNA, 14 bp, Homo sapiens
cagggccctggagc

SEQ ID NO: 4868641 - DNA, 16 bp, Homo sapiens
caggggagccagctgc

SEQ ID NO: 4868642 - DNA, 17 bp, Homo sapiens
caggggagccagctgct

SEQ ID NO: 4868643 - DNA, 20 bp, Homo sapiens
caggggagccagctgcttga

SEQ ID NO: 4868644 - DNA, 20 bp, Homo sapiens
caggggccaacctcaggctc

SEQ ID NO: 4868645 - DNA, 13 bp, Homo sapiens
caggggctctgtg

SEQ ID NO: 4868646 - DNA, 23 bp, Homo sapiens
caggggctctgtggcaaaaagag

SEQ ID NO: 4868647 - DNA, 20 bp, Homo sapiens
caggggctggtgggacagtg

SEQ ID NO: 4868648 - DNA, 13 bp, Homo sapiens
cagggtctctcag

SEQ ID NO: 4868649 - DNA, 14 bp, Homo sapiens
cagggtctctcagg

SEQ ID NO: 4868650 - DNA, 19 bp, Homo sapiens
cagggtgacaaggcctgct

SEQ ID NO: 4868651 - DNA, 22 bp, Homo sapiens
cagggtgacaaggcctgcttga

SEQ ID NO: 4868652 - DNA, 11 bp, Homo sapiens
cagggtggggg

SEQ ID NO: 4868653 - DNA, 13 bp, Homo sapiens
cagggtggggggc

SEQ ID NO: 4868654 - DNA, 15 bp, Homo sapiens
cagggtggggggtga

SEQ ID NO: 4868655 - DNA, 18 bp, Homo sapiens
cagggtttacatgaagca

SEQ ID NO: 4868656 - DNA, 21 bp, Homo sapiens
cagggtttacatgaagcagaa

SEQ ID NO: 4868657 - DNA, 22 bp, Homo sapiens
cagggtttacatgaagcagaac

SEQ ID NO: 4868658 - DNA, 17 bp, Homo sapiens
caggtcatctgctggga

SEQ ID NO: 4868659 - DNA, 19 bp, Homo sapiens
caggtgcctaacctgggac

SEQ ID NO: 4868660 - DNA, 20 bp, Homo sapiens
caggtgcctaacctgggacc

SEQ ID NO: 4868661 - DNA, 20 bp, Homo sapiens
caggtgctaatttgttttgg

SEQ ID NO: 4868662 - DNA, 14 bp, Homo sapiens
caggtgctcatgct

SEQ ID NO: 4868663 - DNA, 19 bp, Homo sapiens
caggtgtttgtggggctgg

SEQ ID NO: 4868664 - DNA, 15 bp, Homo sapiens
caggttgactaagaa

SEQ ID NO: 4868665 - DNA, 21 bp, Homo sapiens
cagtaaaatactattgcctca

SEQ ID NO: 4868666 - DNA, 20 bp, Homo sapiens
cagtaacccccttaaattta

SEQ ID NO: 4868667 - DNA, 21 bp, Homo sapiens
cagtaacccccttaaatttaa

SEQ ID NO: 4868668 - DNA, 15 bp, Homo sapiens
cagtaagttatcttt

SEQ ID NO: 4868669 - DNA, 19 bp, Homo sapiens
cagtaatgctaaatgtgta

SEQ ID NO: 4868670 - DNA, 23 bp, Homo sapiens
cagtatatgttaatttgtgtgtt

SEQ ID NO: 4868671 - DNA, 14 bp, Homo sapiens
cagtatattagtat

SEQ ID NO: 4868672 - DNA, 16 bp, Homo sapiens
cagtatattagtatta

SEQ ID NO: 4868673 - DNA, 13 bp, Homo sapiens
cagtatttttaaa

SEQ ID NO: 4868674 - DNA, 18 bp, Homo sapiens
cagtatttttaaaggcat

SEQ ID NO: 4868675 - DNA, 19 bp, Homo sapiens
cagtatttttaaaggcatt

SEQ ID NO: 4868676 - DNA, 14 bp, Homo sapiens
cagtcactgctgca

SEQ ID NO: 4868677 - DNA, 22 bp, Homo sapiens
cagtcccagacaattccattca

SEQ ID NO: 4868678 - DNA, 16 bp, Homo sapiens
cagtctgctcctcttg

SEQ ID NO: 4868679 - DNA, 16 bp, Homo sapiens
cagtctttcttcactc

SEQ ID NO: 4868680 - DNA, 22 bp, Homo sapiens
cagtctttcttcactctggctt

SEQ ID NO: 4868681 - DNA, 14 bp, Homo sapiens
cagtgaccagtgcc

SEQ ID NO: 4868682 - DNA, 11 bp, Homo sapiens
cagtgactcca

SEQ ID NO: 4868683 - DNA, 16 bp, Homo sapiens
cagtgactccagggtg

SEQ ID NO: 4868684 - DNA, 16 bp, Homo sapiens
cagtgagtgacaaagc

SEQ ID NO: 4868685 - DNA, 21 bp, Homo sapiens
cagtgagtgacaaagcctctg

SEQ ID NO: 4868686 - DNA, 22 bp, Homo sapiens
cagtgagtgacaaagcctctga

SEQ ID NO: 4868687 - DNA, 23 bp, Homo sapiens
cagtgcatagttgtagacaaagt

SEQ ID NO: 4868688 - DNA, 17 bp, Homo sapiens
cagtggatcacaaagtg

SEQ ID NO: 4868689 - DNA, 17 bp, Homo sapiens
cagtgggaatgttcttt

SEQ ID NO: 4868690 - DNA, 16 bp, Homo sapiens
cagtggggcagcctct

SEQ ID NO: 4868691 - DNA, 14 bp, Homo sapiens
cagtggtggaggtg

SEQ ID NO: 4868692 - DNA, 16 bp, Homo sapiens
cagtggtggaggtggg

SEQ ID NO: 4868693 - DNA, 15 bp, Homo sapiens
cagtggtgtgtgaag

SEQ ID NO: 4868694 - DNA, 21 bp, Homo sapiens
cagtgtctaggcactgagcag

SEQ ID NO: 4868695 - DNA, 17 bp, Homo sapiens
cagtgtgagatactgtg

SEQ ID NO: 4868696 - DNA, 21 bp, Homo sapiens
cagtgtgtggtcaacatttct

SEQ ID NO: 4868697 - DNA, 23 bp, Homo sapiens
cagtgttacttgcaggtactttg

SEQ ID NO: 4868698 - DNA, 19 bp, Homo sapiens
cagtgttatttattcccca

SEQ ID NO: 4868699 - DNA, 20 bp, Homo sapiens
cagtgttatttattccccag

SEQ ID NO: 4868700 - DNA, 23 bp, Homo sapiens
cagtgttccaagtctctgtgtaa

SEQ ID NO: 4868701 - DNA, 16 bp, Homo sapiens
cagtgttggtatattt

SEQ ID NO: 4868702 - DNA, 19 bp, Homo sapiens
cagtgttttggtggaaaaa

SEQ ID NO: 4868703 - DNA, 15 bp, Homo sapiens
cagttacttgggctt

SEQ ID NO: 4868704 - DNA, 16 bp, Homo sapiens
cagttacttgggcttc

SEQ ID NO: 4868705 - DNA, 15 bp, Homo sapiens
cagttataagaagaa

SEQ ID NO: 4868706 - DNA, 17 bp, Homo sapiens
cagttcccagagtgggc

SEQ ID NO: 4868707 - DNA, 16 bp, Homo sapiens
cagttctcaaatgtgt

SEQ ID NO: 4868708 - DNA, 15 bp, Homo sapiens
cagttgatggagccc

SEQ ID NO: 4868709 - DNA, 20 bp, Homo sapiens
cagttgatggagccccaggg

SEQ ID NO: 4868710 - DNA, 21 bp, Homo sapiens
cagttgatggagccccagggt

SEQ ID NO: 4868711 - DNA, 23 bp, Homo sapiens
cagttgatggagccccagggttt

SEQ ID NO: 4868712 - DNA, 17 bp, Homo sapiens
cagttgctcaaaaagaa

SEQ ID NO: 4868713 - DNA, 23 bp, Homo sapiens
cagttgctcaaaaagaaatcaat

SEQ ID NO: 4868714 - DNA, 17 bp, Homo sapiens
cagttggactctcaggg

SEQ ID NO: 4868715 - DNA, 18 bp, Homo sapiens
cagttgtagcagaaacca

SEQ ID NO: 4868716 - DNA, 21 bp, Homo sapiens
cagttgttatttattgaaatg

SEQ ID NO: 4868717 - DNA, 14 bp, Homo sapiens
cagtttaagccgca

SEQ ID NO: 4868718 - DNA, 12 bp, Homo sapiens
cagtttccagtc

SEQ ID NO: 4868719 - DNA, 14 bp, Homo sapiens
cagtttgttggaaa

SEQ ID NO: 4868720 - DNA, 12 bp, Homo sapiens
cagttttaactg

SEQ ID NO: 4868721 - DNA, 20 bp, Homo sapiens
cagttttaactgtggatatt

SEQ ID NO: 4868722 - DNA, 22 bp, Homo sapiens
cagttttaactgtggatattgt

SEQ ID NO: 4868723 - DNA, 16 bp, Homo sapiens
cagtttttgacattta

SEQ ID NO: 4868724 - DNA, 17 bp, Homo sapiens
cataaacctgtgctgaa

SEQ ID NO: 4868725 - DNA, 21 bp, Homo sapiens
cataaagctcaaatgaaatgt

SEQ ID NO: 4868726 - DNA, 15 bp, Homo sapiens
cataaagtaaataca

SEQ ID NO: 4868727 - DNA, 11 bp, Homo sapiens
cataaagtcag

SEQ ID NO: 4868728 - DNA, 22 bp, Homo sapiens
cataaattatttgattatttaa

SEQ ID NO: 4868729 - DNA, 18 bp, Homo sapiens
cataactcacacccctgc

SEQ ID NO: 4868730 - DNA, 17 bp, Homo sapiens
cataagagaaacctgcc

SEQ ID NO: 4868731 - DNA, 18 bp, Homo sapiens
cataagagaaacctgcca

SEQ ID NO: 4868732 - DNA, 18 bp, Homo sapiens
catacataaaagaaataa

SEQ ID NO: 4868733 - DNA, 16 bp, Homo sapiens
catactccttgcttcc

SEQ ID NO: 4868734 - DNA, 19 bp, Homo sapiens
catactccttgcttcctga

SEQ ID NO: 4868735 - DNA, 17 bp, Homo sapiens
catactgtaacattcag

SEQ ID NO: 4868736 - DNA, 18 bp, Homo sapiens
catactttgtattttgat

SEQ ID NO: 4868737 - DNA, 13 bp, Homo sapiens
catagagaacaaa

SEQ ID NO: 4868738 - DNA, 22 bp, Homo sapiens
catagagaacaaagtaaaagta

SEQ ID NO: 4868739 - DNA, 16 bp, Homo sapiens
catagataatattgtt

SEQ ID NO: 4868740 - DNA, 17 bp, Homo sapiens
catagataatattgttt

SEQ ID NO: 4868741 - DNA, 23 bp, Homo sapiens
catagataatattgtttggtaaa

SEQ ID NO: 4868742 - DNA, 14 bp, Homo sapiens
catagcagatctgt

SEQ ID NO: 4868743 - DNA, 18 bp, Homo sapiens
catagcgggggcctaaaa

SEQ ID NO: 4868744 - DNA, 21 bp, Homo sapiens
catagctgtacttcttgaata

SEQ ID NO: 4868745 - DNA, 22 bp, Homo sapiens
cataggttaaaaaaaaaagtca

SEQ ID NO: 4868746 - DNA, 20 bp, Homo sapiens
catagttgtagacaaagtac

SEQ ID NO: 4868747 - DNA, 11 bp, Homo sapiens
catataagaca

SEQ ID NO: 4868748 - DNA, 16 bp, Homo sapiens
catatagacacataca

SEQ ID NO: 4868749 - DNA, 12 bp, Homo sapiens
catatgaatgaa

SEQ ID NO: 4868750 - DNA, 16 bp, Homo sapiens
catatggtaggaccct

SEQ ID NO: 4868751 - DNA, 21 bp, Homo sapiens
catattgtaatctatgtttat

SEQ ID NO: 4868752 - DNA, 13 bp, Homo sapiens
catcaatatgtat

SEQ ID NO: 4868753 - DNA, 18 bp, Homo sapiens
catcactggactgcatgg

SEQ ID NO: 4868754 - DNA, 12 bp, Homo sapiens
catcactgtatc

SEQ ID NO: 4868755 - DNA, 15 bp, Homo sapiens
catcactttgaccta

SEQ ID NO: 4868756 - DNA, 17 bp, Homo sapiens
catcagaactcttcctc

SEQ ID NO: 4868757 - DNA, 19 bp, Homo sapiens
catcagaactcttcctcct

SEQ ID NO: 4868758 - DNA, 15 bp, Homo sapiens
catcatctcttcctc

SEQ ID NO: 4868759 - DNA, 16 bp, Homo sapiens
catcatctcttcctca

SEQ ID NO: 4868760 - DNA, 18 bp, Homo sapiens
catcatctcttcctcaca

SEQ ID NO: 4868761 - DNA, 23 bp, Homo sapiens
catcattcttgtgggagacagca

SEQ ID NO: 4868762 - DNA, 20 bp, Homo sapiens
catccacctcatcactggac

SEQ ID NO: 4868763 - DNA, 23 bp, Homo sapiens
catccagtgtgagatactgtgta

SEQ ID NO: 4868764 - DNA, 23 bp, Homo sapiens
catccatgtacttccctcttgaa

SEQ ID NO: 4868765 - DNA, 19 bp, Homo sapiens
catccattacctccatcca

SEQ ID NO: 4868766 - DNA, 12 bp, Homo sapiens
catccattccta

SEQ ID NO: 4868767 - DNA, 16 bp, Homo sapiens
catccctgcctggagg

SEQ ID NO: 4868768 - DNA, 20 bp, Homo sapiens
catccctgcctggaggctcc

SEQ ID NO: 4868769 - DNA, 15 bp, Homo sapiens
catcctaccgtcttt

SEQ ID NO: 4868770 - DNA, 14 bp, Homo sapiens
catcctaggaacca

SEQ ID NO: 4868771 - DNA, 15 bp, Homo sapiens
catccttccatccat

SEQ ID NO: 4868772 - DNA, 21 bp, Homo sapiens
catctaatgtattatgagcca

SEQ ID NO: 4868773 - DNA, 14 bp, Homo sapiens
catctaattctgat

SEQ ID NO: 4868774 - DNA, 16 bp, Homo sapiens
catctaattctgattc

SEQ ID NO: 4868775 - DNA, 17 bp, Homo sapiens
catctatctagttctaa

SEQ ID NO: 4868776 - DNA, 19 bp, Homo sapiens
catctccacaggagagact

SEQ ID NO: 4868777 - DNA, 13 bp, Homo sapiens
catctccatgggg

SEQ ID NO: 4868778 - DNA, 12 bp, Homo sapiens
catctcttcctc

SEQ ID NO: 4868779 - DNA, 15 bp, Homo sapiens
catctgaccccaagg

SEQ ID NO: 4868780 - DNA, 21 bp, Homo sapiens
catctggagggttctaagtgg

SEQ ID NO: 4868781 - DNA, 20 bp, Homo sapiens
catctgtataccctctgttt

SEQ ID NO: 4868782 - DNA, 13 bp, Homo sapiens
catcttctttctt

SEQ ID NO: 4868783 - DNA, 12 bp, Homo sapiens
catcttgcctca

SEQ ID NO: 4868784 - DNA, 21 bp, Homo sapiens
catgaaataaaatatatctta

SEQ ID NO: 4868785 - DNA, 13 bp, Homo sapiens
catgaagcagaac

SEQ ID NO: 4868786 - DNA, 13 bp, Homo sapiens
catgaatgctttt

SEQ ID NO: 4868787 - DNA, 13 bp, Homo sapiens
catgaatgtgctg

SEQ ID NO: 4868788 - DNA, 16 bp, Homo sapiens
catgaatgtgctggtg

SEQ ID NO: 4868789 - DNA, 22 bp, Homo sapiens
catgaattacctggatgttctt

SEQ ID NO: 4868790 - DNA, 16 bp, Homo sapiens
catgaattttaaagta

SEQ ID NO: 4868791 - DNA, 17 bp, Homo sapiens
catgaattttaaagtat

SEQ ID NO: 4868792 - DNA, 17 bp, Homo sapiens
catgagagtagggccct

SEQ ID NO: 4868793 - DNA, 14 bp, Homo sapiens
catgagtgaataaa

SEQ ID NO: 4868794 - DNA, 18 bp, Homo sapiens
catgagttatcatgaatt

SEQ ID NO: 4868795 - DNA, 23 bp, Homo sapiens
catgagttatcatgaattttaaa

SEQ ID NO: 4868796 - DNA, 22 bp, Homo sapiens
catgatttccctccagagaaag

SEQ ID NO: 4868797 - DNA, 18 bp, Homo sapiens
catgcatataatgaataa

SEQ ID NO: 4868798 - DNA, 19 bp, Homo sapiens
catgcatgcaaatgagctc

SEQ ID NO: 4868799 - DNA, 21 bp, Homo sapiens
catgcccccaccctcccctca

SEQ ID NO: 4868800 - DNA, 18 bp, Homo sapiens
catggacatttagaagaa

SEQ ID NO: 4868801 - DNA, 20 bp, Homo sapiens
catggagaatgggacgagga

SEQ ID NO: 4868802 - DNA, 14 bp, Homo sapiens
catggagcctacct

SEQ ID NO: 4868803 - DNA, 21 bp, Homo sapiens
catggcaggagtctctgccag

SEQ ID NO: 4868804 - DNA, 17 bp, Homo sapiens
catggcatccctttttc

SEQ ID NO: 4868805 - DNA, 19 bp, Homo sapiens
catggcatgcttaaatttt

SEQ ID NO: 4868806 - DNA, 19 bp, Homo sapiens
catggccatcttctttctt

SEQ ID NO: 4868807 - DNA, 14 bp, Homo sapiens
catggggaggcagc

SEQ ID NO: 4868808 - DNA, 16 bp, Homo sapiens
catggggaggcagcag

SEQ ID NO: 4868809 - DNA, 18 bp, Homo sapiens
catggggaggcagcagag

SEQ ID NO: 4868810 - DNA, 19 bp, Homo sapiens
catggggaggcagcagagc

SEQ ID NO: 4868811 - DNA, 23 bp, Homo sapiens
catggggaggttgtggggcctca

SEQ ID NO: 4868812 - DNA, 11 bp, Homo sapiens
catggggccag

SEQ ID NO: 4868813 - DNA, 13 bp, Homo sapiens
catggggccagga

SEQ ID NO: 4868814 - DNA, 19 bp, Homo sapiens
catgtacaaaaattatgca

SEQ ID NO: 4868815 - DNA, 19 bp, Homo sapiens
catgtacttccctcttgaa

SEQ ID NO: 4868816 - DNA, 18 bp, Homo sapiens
catgtatgagtgtatgtg

SEQ ID NO: 4868817 - DNA, 17 bp, Homo sapiens
catgtattgcacattgt

SEQ ID NO: 4868818 - DNA, 16 bp, Homo sapiens
catgtgaccactctgt

SEQ ID NO: 4868819 - DNA, 15 bp, Homo sapiens
catgtgagtctggga

SEQ ID NO: 4868820 - DNA, 17 bp, Homo sapiens
catgtgagtctgggata

SEQ ID NO: 4868821 - DNA, 22 bp, Homo sapiens
catgtgatacattttttaagct

SEQ ID NO: 4868822 - DNA, 17 bp, Homo sapiens
catgttcccaaaacaat

SEQ ID NO: 4868823 - DNA, 13 bp, Homo sapiens
cattaaagtcaga

SEQ ID NO: 4868824 - DNA, 11 bp, Homo sapiens
cattaactgtt

SEQ ID NO: 4868825 - DNA, 18 bp, Homo sapiens
cattaaggggaagaatga

SEQ ID NO: 4868826 - DNA, 17 bp, Homo sapiens
cattaatgcctgctttt

SEQ ID NO: 4868827 - DNA, 15 bp, Homo sapiens
cattaccctacagac

SEQ ID NO: 4868828 - DNA, 17 bp, Homo sapiens
cattacctccatccatc

SEQ ID NO: 4868829 - DNA, 15 bp, Homo sapiens
cattagtcctttgtc

SEQ ID NO: 4868830 - DNA, 16 bp, Homo sapiens
cattatctcacttagt

SEQ ID NO: 4868831 - DNA, 19 bp, Homo sapiens
cattatctcacttagtcct

SEQ ID NO: 4868832 - DNA, 20 bp, Homo sapiens
cattcaaccacgcaggaagc

SEQ ID NO: 4868833 - DNA, 17 bp, Homo sapiens
cattcaatctttggagg

SEQ ID NO: 4868834 - DNA, 12 bp, Homo sapiens
cattcagaaatg

SEQ ID NO: 4868835 - DNA, 20 bp, Homo sapiens
cattcagaaatgttgagtct

SEQ ID NO: 4868836 - DNA, 23 bp, Homo sapiens
cattcagaaatgttgagtctgta

SEQ ID NO: 4868837 - DNA, 22 bp, Homo sapiens
cattccagctgtcactctgtgc

SEQ ID NO: 4868838 - DNA, 15 bp, Homo sapiens
cattctattctccag

SEQ ID NO: 4868839 - DNA, 17 bp, Homo sapiens
cattctattctccagac

SEQ ID NO: 4868840 - DNA, 21 bp, Homo sapiens
cattctggtcaagggctgtca

SEQ ID NO: 4868841 - DNA, 19 bp, Homo sapiens
cattcttactaaaaagtat

SEQ ID NO: 4868842 - DNA, 14 bp, Homo sapiens
cattcttgtgggag

SEQ ID NO: 4868843 - DNA, 14 bp, Homo sapiens
cattctttttgaaa

SEQ ID NO: 4868844 - DNA, 11 bp, Homo sapiens
cattgaaagag

SEQ ID NO: 4868845 - DNA, 14 bp, Homo sapiens
cattgagtattgtt

SEQ ID NO: 4868846 - DNA, 15 bp, Homo sapiens
cattgagtattgttt

SEQ ID NO: 4868847 - DNA, 18 bp, Homo sapiens
cattgagtattgtttaaa

SEQ ID NO: 4868848 - DNA, 22 bp, Homo sapiens
cattgagtattgtttaaaatgt

SEQ ID NO: 4868849 - DNA, 11 bp, Homo sapiens
cattggatatt

SEQ ID NO: 4868850 - DNA, 14 bp, Homo sapiens
cattgtaattatgt

SEQ ID NO: 4868851 - DNA, 14 bp, Homo sapiens
cattgtatatgtga

SEQ ID NO: 4868852 - DNA, 18 bp, Homo sapiens
cattgtcaccgcaggtgc

SEQ ID NO: 4868853 - DNA, 17 bp, Homo sapiens
cattgtttagatgaggc

SEQ ID NO: 4868854 - DNA, 12 bp, Homo sapiens
catttaataaag

SEQ ID NO: 4868855 - DNA, 15 bp, Homo sapiens
catttagaaaagtga

SEQ ID NO: 4868856 - DNA, 13 bp, Homo sapiens
catttagaagaaa

SEQ ID NO: 4868857 - DNA, 20 bp, Homo sapiens
catttagaagaaagatgttt

SEQ ID NO: 4868858 - DNA, 15 bp, Homo sapiens
catttagaagcctga

SEQ ID NO: 4868859 - DNA, 21 bp, Homo sapiens
catttagaagcctgacaactc

SEQ ID NO: 4868860 - DNA, 15 bp, Homo sapiens
catttatattaaata

SEQ ID NO: 4868861 - DNA, 15 bp, Homo sapiens
catttccattgctta

SEQ ID NO: 4868862 - DNA, 16 bp, Homo sapiens
catttccattgcttat

SEQ ID NO: 4868863 - DNA, 19 bp, Homo sapiens
catttctatattcctccag

SEQ ID NO: 4868864 - DNA, 20 bp, Homo sapiens
catttctatattcctccagc

SEQ ID NO: 4868865 - DNA, 15 bp, Homo sapiens
catttgctactgttg

SEQ ID NO: 4868866 - DNA, 18 bp, Homo sapiens
catttgctactgttgtaa

SEQ ID NO: 4868867 - DNA, 19 bp, Homo sapiens
catttgtatgtcaaagctt

SEQ ID NO: 4868868 - DNA, 21 bp, Homo sapiens
catttgtgggcaagcagatga

SEQ ID NO: 4868869 - DNA, 18 bp, Homo sapiens
cattttaaccctatttta

SEQ ID NO: 4868870 - DNA, 14 bp, Homo sapiens
cattttgcctctgt

SEQ ID NO: 4868871 - DNA, 20 bp, Homo sapiens
catttttgtactaactagca

SEQ ID NO: 4868872 - DNA, 23 bp, Homo sapiens
cattttttaatttacttgttttg

SEQ ID NO: 4868873 - DNA, 14 bp, Homo sapiens
catttttttgcatg

SEQ ID NO: 4868874 - DNA, 18 bp, Homo sapiens
ccaaaagtaaagatgcta

SEQ ID NO: 4868875 - DNA, 17 bp, Homo sapiens
ccaaaatttatatttta

SEQ ID NO: 4868876 - DNA, 20 bp, Homo sapiens
ccaaaggaaaatgtctgtaa

SEQ ID NO: 4868877 - DNA, 17 bp, Homo sapiens
ccaaaggaactctagag

SEQ ID NO: 4868878 - DNA, 16 bp, Homo sapiens
ccaaaggatgtgatat

SEQ ID NO: 4868879 - DNA, 19 bp, Homo sapiens
ccaaaggatgtgatatata

SEQ ID NO: 4868880 - DNA, 19 bp, Homo sapiens
ccaaattcaccttccccta

SEQ ID NO: 4868881 - DNA, 12 bp, Homo sapiens
ccaaatttcttt

SEQ ID NO: 4868882 - DNA, 14 bp, Homo sapiens
ccaacctacattcc

SEQ ID NO: 4868883 - DNA, 16 bp, Homo sapiens
ccaacctacattccac

SEQ ID NO: 4868884 - DNA, 15 bp, Homo sapiens
ccaacctcaggctcc

SEQ ID NO: 4868885 - DNA, 13 bp, Homo sapiens
ccaaccttgttta

SEQ ID NO: 4868886 - DNA, 14 bp, Homo sapiens
ccaagaacataaac

SEQ ID NO: 4868887 - DNA, 22 bp, Homo sapiens
ccaagaacataaaccctccaag

SEQ ID NO: 4868888 - DNA, 13 bp, Homo sapiens
ccaagccctgggg

SEQ ID NO: 4868889 - DNA, 13 bp, Homo sapiens
ccaagctgaggag

SEQ ID NO: 4868890 - DNA, 19 bp, Homo sapiens
ccaagctgaggaggtgctg

SEQ ID NO: 4868891 - DNA, 24 bp, Homo sapiens
ccaagctggcacaaaagacagctg

SEQ ID NO: 4868892 - DNA, 12 bp, Homo sapiens
ccaagcttccca

SEQ ID NO: 4868893 - DNA, 18 bp, Homo sapiens
ccaagctttaaattatgt

SEQ ID NO: 4868894 - DNA, 21 bp, Homo sapiens
ccaaggaaaggcatgtacaaa

SEQ ID NO: 4868895 - DNA, 17 bp, Homo sapiens
ccaaggctgtgtttaga

SEQ ID NO: 4868896 - DNA, 16 bp, Homo sapiens
ccaagggacagcaagt

SEQ ID NO: 4868897 - DNA, 15 bp, Homo sapiens
ccaagggggctgctg

SEQ ID NO: 4868898 - DNA, 16 bp, Homo sapiens
ccaagggggctgctgc

SEQ ID NO: 4868899 - DNA, 18 bp, Homo sapiens
ccaaggggtgggccacag

SEQ ID NO: 4868900 - DNA, 15 bp, Homo sapiens
ccaaggtgatgttgt

SEQ ID NO: 4868901 - DNA, 18 bp, Homo sapiens
ccaagtcagcagtcctag

SEQ ID NO: 4868902 - DNA, 20 bp, Homo sapiens
ccaagtggacgttaggccag

SEQ ID NO: 4868903 - DNA, 22 bp, Homo sapiens
ccaagtggacgttaggccaggc

SEQ ID NO: 4868904 - DNA, 17 bp, Homo sapiens
ccaagtggtgagcaagc

SEQ ID NO: 4868905 - DNA, 22 bp, Homo sapiens
ccaagtggtgagcaagcaccaa

SEQ ID NO: 4868906 - DNA, 12 bp, Homo sapiens
ccaagtgtgcta

SEQ ID NO: 4868907 - DNA, 15 bp, Homo sapiens
ccaagttctcacctc

SEQ ID NO: 4868908 - DNA, 14 bp, Homo sapiens
ccaatctgtacaaa

SEQ ID NO: 4868909 - DNA, 17 bp, Homo sapiens
ccaatctttcctacttt

SEQ ID NO: 4868910 - DNA, 20 bp, Homo sapiens
ccaatctttcctactttcta

SEQ ID NO: 4868911 - DNA, 12 bp, Homo sapiens
ccaatgaataat

SEQ ID NO: 4868912 - DNA, 13 bp, Homo sapiens
ccacaaactccag

SEQ ID NO: 4868913 - DNA, 15 bp, Homo sapiens
ccacaaactccaggc

SEQ ID NO: 4868914 - DNA, 16 bp, Homo sapiens
ccacaaactccaggct

SEQ ID NO: 4868915 - DNA, 21 bp, Homo sapiens
ccacaaactccaggctggaag

SEQ ID NO: 4868916 - DNA, 22 bp, Homo sapiens
ccacaactactagtgtgactcc

SEQ ID NO: 4868917 - DNA, 23 bp, Homo sapiens
ccacaactactagtgtgactcct

SEQ ID NO: 4868918 - DNA, 16 bp, Homo sapiens
ccacaactcccttgca

SEQ ID NO: 4868919 - DNA, 21 bp, Homo sapiens
ccacaccgtggcagcttgctg

SEQ ID NO: 4868920 - DNA, 23 bp, Homo sapiens
ccacactcagaaaattccctggg

SEQ ID NO: 4868921 - DNA, 12 bp, Homo sapiens
ccacagaacttg

SEQ ID NO: 4868922 - DNA, 19 bp, Homo sapiens
ccacagcagccccaggaga

SEQ ID NO: 4868923 - DNA, 20 bp, Homo sapiens
ccacagcagccccaggagaa

SEQ ID NO: 4868924 - DNA, 18 bp, Homo sapiens
ccacatggccatcttctt

SEQ ID NO: 4868925 - DNA, 21 bp, Homo sapiens
ccacatggccatcttctttct

SEQ ID NO: 4868926 - DNA, 14 bp, Homo sapiens
ccaccagttgctgc

SEQ ID NO: 4868927 - DNA, 15 bp, Homo sapiens
ccaccataccttaga

SEQ ID NO: 4868928 - DNA, 18 bp, Homo sapiens
ccacccacaaactccagg

SEQ ID NO: 4868929 - DNA, 19 bp, Homo sapiens
ccacccacaaactccaggc

SEQ ID NO: 4868930 - DNA, 15 bp, Homo sapiens
ccacctcatcactgg

SEQ ID NO: 4868931 - DNA, 18 bp, Homo sapiens
ccacctcatcactggact

SEQ ID NO: 4868932 - DNA, 23 bp, Homo sapiens
ccacctcatcactggactgcatg

SEQ ID NO: 4868933 - DNA, 21 bp, Homo sapiens
ccactagaggggcacccacca

SEQ ID NO: 4868934 - DNA, 21 bp, Homo sapiens
ccactcaatccatccatgtac

SEQ ID NO: 4868935 - DNA, 12 bp, Homo sapiens
ccactcctggga

SEQ ID NO: 4868936 - DNA, 16 bp, Homo sapiens
ccactggctgctaaca

SEQ ID NO: 4868937 - DNA, 20 bp, Homo sapiens
ccagaaaggtgtgaggagag

SEQ ID NO: 4868938 - DNA, 10 bp, Homo sapiens
ccagaaattc

SEQ ID NO: 4868939 - DNA, 17 bp, Homo sapiens
ccagaacctctaagtgc

SEQ ID NO: 4868940 - DNA, 23 bp, Homo sapiens
ccagaacctctaagtgctgctgt

SEQ ID NO: 4868941 - DNA, 20 bp, Homo sapiens
ccagaacgtggctctgctgg

SEQ ID NO: 4868942 - DNA, 21 bp, Homo sapiens
ccagaacgtggctctgctggc

SEQ ID NO: 4868943 - DNA, 13 bp, Homo sapiens
ccagaagctgctc

SEQ ID NO: 4868944 - DNA, 22 bp, Homo sapiens
ccagaagtcccttcaatttcta

SEQ ID NO: 4868945 - DNA, 12 bp, Homo sapiens
ccagagaaagca

SEQ ID NO: 4868946 - DNA, 15 bp, Homo sapiens
ccagagaaagcaaag

SEQ ID NO: 4868947 - DNA, 12 bp, Homo sapiens
ccagagagggaa

SEQ ID NO: 4868948 - DNA, 20 bp, Homo sapiens
ccagagagggaaaaggcagg

SEQ ID NO: 4868949 - DNA, 20 bp, Homo sapiens
ccagagagggaagatgacct

SEQ ID NO: 4868950 - DNA, 15 bp, Homo sapiens
ccagagatgcctgat

SEQ ID NO: 4868951 - DNA, 20 bp, Homo sapiens
ccagagatgcctgatttcat

SEQ ID NO: 4868952 - DNA, 21 bp, Homo sapiens
ccagaggaccaatgcttgcat

SEQ ID NO: 4868953 - DNA, 21 bp, Homo sapiens
ccagaggtgggatcctccctc

SEQ ID NO: 4868954 - DNA, 17 bp, Homo sapiens
ccagatacctgtgagga

SEQ ID NO: 4868955 - DNA, 19 bp, Homo sapiens
ccagatacctgtgaggact

SEQ ID NO: 4868956 - DNA, 17 bp, Homo sapiens
ccagatagtgtagctga

SEQ ID NO: 4868957 - DNA, 16 bp, Homo sapiens
ccagatctttcagaaa

SEQ ID NO: 4868958 - DNA, 17 bp, Homo sapiens
ccagcacaaagcactgg

SEQ ID NO: 4868959 - DNA, 21 bp, Homo sapiens
ccagcacaaagcactggcctt

SEQ ID NO: 4868960 - DNA, 17 bp, Homo sapiens
ccagcagctgatgctgt

SEQ ID NO: 4868961 - DNA, 23 bp, Homo sapiens
ccagccagaacgtggctctgctg

SEQ ID NO: 4868962 - DNA, 13 bp, Homo sapiens
ccagcccaaacct

SEQ ID NO: 4868963 - DNA, 21 bp, Homo sapiens
ccagcctgactagaactcctg

SEQ ID NO: 4868964 - DNA, 14 bp, Homo sapiens
ccagcctgcttccc

SEQ ID NO: 4868965 - DNA, 21 bp, Homo sapiens
ccagccttgtacagtctgctc

SEQ ID NO: 4868966 - DNA, 14 bp, Homo sapiens
ccagctccttcgct

SEQ ID NO: 4868967 - DNA, 21 bp, Homo sapiens
ccagcttcggagggcccctgc

SEQ ID NO: 4868968 - DNA, 20 bp, Homo sapiens
ccaggacatgcaataaaatt

SEQ ID NO: 4868969 - DNA, 19 bp, Homo sapiens
ccaggacgtctggggtgtg

SEQ ID NO: 4868970 - DNA, 16 bp, Homo sapiens
ccaggcaagaaagctt

SEQ ID NO: 4868971 - DNA, 18 bp, Homo sapiens
ccaggcagacaaccttgt

SEQ ID NO: 4868972 - DNA, 16 bp, Homo sapiens
ccaggcagggagagag

SEQ ID NO: 4868973 - DNA, 23 bp, Homo sapiens
ccaggcatctgttagcagagtct

SEQ ID NO: 4868974 - DNA, 24 bp, Homo sapiens
ccaggcatctgttagcagagtctg

SEQ ID NO: 4868975 - DNA, 23 bp, Homo sapiens
ccaggccttatctgaaaggccag

SEQ ID NO: 4868976 - DNA, 13 bp, Homo sapiens
ccaggctcaggag

SEQ ID NO: 4868977 - DNA, 13 bp, Homo sapiens
ccagggcagcagg

SEQ ID NO: 4868978 - DNA, 17 bp, Homo sapiens
ccagggcagcaggccag

SEQ ID NO: 4868979 - DNA, 23 bp, Homo sapiens
ccagggcagcaggccagagaaag

SEQ ID NO: 4868980 - DNA, 15 bp, Homo sapiens
ccaggggagccagct

SEQ ID NO: 4868981 - DNA, 21 bp, Homo sapiens
ccaggggagccagctgcttga

SEQ ID NO: 4868982 - DNA, 20 bp, Homo sapiens
ccaggggccaacctcaggct

SEQ ID NO: 4868983 - DNA, 16 bp, Homo sapiens
ccagggtgacaaggcc

SEQ ID NO: 4868984 - DNA, 22 bp, Homo sapiens
ccagggtgacaaggcctgcttg

SEQ ID NO: 4868985 - DNA, 15 bp, Homo sapiens
ccaggtctgactcca

SEQ ID NO: 4868986 - DNA, 18 bp, Homo sapiens
ccaggtctgactccaaag

SEQ ID NO: 4868987 - DNA, 19 bp, Homo sapiens
ccaggtctgactccaaagc

SEQ ID NO: 4868988 - DNA, 16 bp, Homo sapiens
ccaggttgactaagaa

SEQ ID NO: 4868989 - DNA, 17 bp, Homo sapiens
ccaggtttgcaggagcc

SEQ ID NO: 4868990 - DNA, 12 bp, Homo sapiens
ccagtcactgct

SEQ ID NO: 4868991 - DNA, 13 bp, Homo sapiens
ccagtcactgctg

SEQ ID NO: 4868992 - DNA, 17 bp, Homo sapiens
ccagtcagatgaggcaa

SEQ ID NO: 4868993 - DNA, 17 bp, Homo sapiens
ccagtcaggctgcagag

SEQ ID NO: 4868994 - DNA, 14 bp, Homo sapiens
ccagtcccattcct

SEQ ID NO: 4868995 - DNA, 12 bp, Homo sapiens
ccagtctgaccc

SEQ ID NO: 4868996 - DNA, 21 bp, Homo sapiens
ccagtctttcttcactctggc

SEQ ID NO: 4868997 - DNA, 14 bp, Homo sapiens
ccagtgactccagg

SEQ ID NO: 4868998 - DNA, 23 bp, Homo sapiens
ccagtgcctgtgagcatggggcc

SEQ ID NO: 4868999 - DNA, 20 bp, Homo sapiens
ccagtggtggaggtgggtgt

SEQ ID NO: 4869000 - DNA, 23 bp, Homo sapiens
ccagtgttatttattccccagtg

SEQ ID NO: 4869001 - DNA, 16 bp, Homo sapiens
ccagttacttgggctt

SEQ ID NO: 4869002 - DNA, 15 bp, Homo sapiens
ccagttcctcttttg

SEQ ID NO: 4869003 - DNA, 22 bp, Homo sapiens
ccagtttaagccgcagacctgg

SEQ ID NO: 4869004 - DNA, 19 bp, Homo sapiens
ccagttttcggaaacactg

SEQ ID NO: 4869005 - DNA, 15 bp, Homo sapiens
ccataagagaaacct

SEQ ID NO: 4869006 - DNA, 19 bp, Homo sapiens
ccatcatgtgtagagcccc

SEQ ID NO: 4869007 - DNA, 14 bp, Homo sapiens
ccatccctgggggc

SEQ ID NO: 4869008 - DNA, 23 bp, Homo sapiens
ccatcgtattaaaaaacaattaa

SEQ ID NO: 4869009 - DNA, 13 bp, Homo sapiens
ccatctgaagagt

SEQ ID NO: 4869010 - DNA, 14 bp, Homo sapiens
ccatcttctttctt

SEQ ID NO: 4869011 - DNA, 17 bp, Homo sapiens
ccatcttctttcttcca

SEQ ID NO: 4869012 - DNA, 15 bp, Homo sapiens
ccatctttccatcca

SEQ ID NO: 4869013 - DNA, 13 bp, Homo sapiens
ccatgccaataaa

SEQ ID NO: 4869014 - DNA, 11 bp, Homo sapiens
ccatggagcct

SEQ ID NO: 4869015 - DNA, 16 bp, Homo sapiens
ccatggagcctacctc

SEQ ID NO: 4869016 - DNA, 17 bp, Homo sapiens
ccatggctgaagctgga

SEQ ID NO: 4869017 - DNA, 19 bp, Homo sapiens
ccatggctgaagctggagc

SEQ ID NO: 4869018 - DNA, 20 bp, Homo sapiens
ccatggctgaagctggagca

SEQ ID NO: 4869019 - DNA, 21 bp, Homo sapiens
ccatggctgaagctggagcag

SEQ ID NO: 4869020 - DNA, 14 bp, Homo sapiens
ccatgttcccagaa

SEQ ID NO: 4869021 - DNA, 14 bp, Homo sapiens
ccattaaagtcaga

SEQ ID NO: 4869022 - DNA, 23 bp, Homo sapiens
ccattacagaggtattaaaacta

SEQ ID NO: 4869023 - DNA, 16 bp, Homo sapiens
ccattcatccttccat

SEQ ID NO: 4869024 - DNA, 15 bp, Homo sapiens
ccattcccagcctga

SEQ ID NO: 4869025 - DNA, 11 bp, Homo sapiens
ccattcctgat

SEQ ID NO: 4869026 - DNA, 16 bp, Homo sapiens
ccattctattctccag

SEQ ID NO: 4869027 - DNA, 19 bp, Homo sapiens
ccattctattctccagaca

SEQ ID NO: 4869028 - DNA, 14 bp, Homo sapiens
ccatttcaggactc

SEQ ID NO: 4869029 - DNA, 21 bp, Homo sapiens
ccatttcaggactctctccag

SEQ ID NO: 4869030 - DNA, 14 bp, Homo sapiens
ccattttaatttta

SEQ ID NO: 4869031 - DNA, 18 bp, Homo sapiens
ccattttgttattgacta

SEQ ID NO: 4869032 - DNA, 23 bp, Homo sapiens
ccattttgttattgactaacagg

SEQ ID NO: 4869033 - DNA, 14 bp, Homo sapiens
cccaaagagaaaga

SEQ ID NO: 4869034 - DNA, 20 bp, Homo sapiens
cccaacccattcactacagg

SEQ ID NO: 4869035 - DNA, 12 bp, Homo sapiens
cccaacctacat

SEQ ID NO: 4869036 - DNA, 12 bp, Homo sapiens
cccaagcttccc

SEQ ID NO: 4869037 - DNA, 15 bp, Homo sapiens
cccaagcttcccaac

SEQ ID NO: 4869038 - DNA, 18 bp, Homo sapiens
cccaagcttcccaacaga

SEQ ID NO: 4869039 - DNA, 17 bp, Homo sapiens
cccaaggcattctccca

SEQ ID NO: 4869040 - DNA, 16 bp, Homo sapiens
cccaagggggctgctg

SEQ ID NO: 4869041 - DNA, 22 bp, Homo sapiens
cccaagggggctgctgctcctc

SEQ ID NO: 4869042 - DNA, 23 bp, Homo sapiens
cccaaggtgaggtgaactccagg

SEQ ID NO: 4869043 - DNA, 17 bp, Homo sapiens
cccaagttggaagggac

SEQ ID NO: 4869044 - DNA, 21 bp, Homo sapiens
cccaagttggaagggacccca

SEQ ID NO: 4869045 - DNA, 12 bp, Homo sapiens
cccaatgctgct

SEQ ID NO: 4869046 - DNA, 17 bp, Homo sapiens
cccaatgctgcttttgg

SEQ ID NO: 4869047 - DNA, 15 bp, Homo sapiens
cccacaaactccagg

SEQ ID NO: 4869048 - DNA, 16 bp, Homo sapiens
cccacaaactccaggc

SEQ ID NO: 4869049 - DNA, 18 bp, Homo sapiens
cccacaaactccaggctg

SEQ ID NO: 4869050 - DNA, 23 bp, Homo sapiens
cccacatggccatcttctttctt

SEQ ID NO: 4869051 - DNA, 17 bp, Homo sapiens
cccacgcctcaccagcc

SEQ ID NO: 4869052 - DNA, 11 bp, Homo sapiens
cccactccagc

SEQ ID NO: 4869053 - DNA, 13 bp, Homo sapiens
cccactccagctg

SEQ ID NO: 4869054 - DNA, 13 bp, Homo sapiens
cccactcctggga

SEQ ID NO: 4869055 - DNA, 23 bp, Homo sapiens
cccactttcaagaatcagacagc

SEQ ID NO: 4869056 - DNA, 21 bp, Homo sapiens
cccagaaccttgatggggtga

SEQ ID NO: 4869057 - DNA, 20 bp, Homo sapiens
cccagacgtggtgcttctca

SEQ ID NO: 4869058 - DNA, 12 bp, Homo sapiens
cccagagaggga

SEQ ID NO: 4869059 - DNA, 16 bp, Homo sapiens
cccagagatgcctgat

SEQ ID NO: 4869060 - DNA, 15 bp, Homo sapiens
cccagagcagggtct

SEQ ID NO: 4869061 - DNA, 16 bp, Homo sapiens
cccagatacctgtgag

SEQ ID NO: 4869062 - DNA, 17 bp, Homo sapiens
cccagatacctgtgagg

SEQ ID NO: 4869063 - DNA, 18 bp, Homo sapiens
cccagatacctgtgagga

SEQ ID NO: 4869064 - DNA, 22 bp, Homo sapiens
cccagatacctgtgaggactgg

SEQ ID NO: 4869065 - DNA, 17 bp, Homo sapiens
cccagcacaaagcactg

SEQ ID NO: 4869066 - DNA, 18 bp, Homo sapiens
cccagcacaaagcactgg

SEQ ID NO: 4869067 - DNA, 17 bp, Homo sapiens
cccagcccctggtggtg

SEQ ID NO: 4869068 - DNA, 12 bp, Homo sapiens
cccagcttcccg

SEQ ID NO: 4869069 - DNA, 22 bp, Homo sapiens
cccaggcatctgttagcagagt

SEQ ID NO: 4869070 - DNA, 15 bp, Homo sapiens
cccaggggagccagc

SEQ ID NO: 4869071 - DNA, 16 bp, Homo sapiens
cccaggggagccagct

SEQ ID NO: 4869072 - DNA, 19 bp, Homo sapiens
cccaggggagccagctgct

SEQ ID NO: 4869073 - DNA, 22 bp, Homo sapiens
cccagtctttcttcactctggc

SEQ ID NO: 4869074 - DNA, 14 bp, Homo sapiens
cccagtgactccag

SEQ ID NO: 4869075 - DNA, 17 bp, Homo sapiens
cccatcctaggaaccag

SEQ ID NO: 4869076 - DNA, 21 bp, Homo sapiens
cccatcctaggaaccagccaa

SEQ ID NO: 4869077 - DNA, 14 bp, Homo sapiens
cccatgatttgggg

SEQ ID NO: 4869078 - DNA, 15 bp, Homo sapiens
cccatggctgaagct

SEQ ID NO: 4869079 - DNA, 22 bp, Homo sapiens
cccatggctgaagctggagcag

SEQ ID NO: 4869080 - DNA, 15 bp, Homo sapiens
cccattttgcctctg

SEQ ID NO: 4869081 - DNA, 13 bp, Homo sapiens
ccccaagcttccc

SEQ ID NO: 4869082 - DNA, 15 bp, Homo sapiens
ccccaagcttcccaa

SEQ ID NO: 4869083 - DNA, 21 bp, Homo sapiens
ccccacaggcacattaactgt

SEQ ID NO: 4869084 - DNA, 22 bp, Homo sapiens
ccccacaggcacattaactgtt

SEQ ID NO: 4869085 - DNA, 17 bp, Homo sapiens
ccccaccctccatgctc

SEQ ID NO: 4869086 - DNA, 14 bp, Homo sapiens
ccccaccctcccct

SEQ ID NO: 4869087 - DNA, 13 bp, Homo sapiens
ccccactccagct

SEQ ID NO: 4869088 - DNA, 13 bp, Homo sapiens
ccccagaggtgga

SEQ ID NO: 4869089 - DNA, 22 bp, Homo sapiens
ccccagggtttacatgaagcag

SEQ ID NO: 4869090 - DNA, 23 bp, Homo sapiens
ccccagggtttacatgaagcaga

SEQ ID NO: 4869091 - DNA, 19 bp, Homo sapiens
ccccagtgactccagggtg

SEQ ID NO: 4869092 - DNA, 20 bp, Homo sapiens
ccccattcctgatcccatgg

SEQ ID NO: 4869093 - DNA, 14 bp, Homo sapiens
cccccactccagct

SEQ ID NO: 4869094 - DNA, 19 bp, Homo sapiens
cccccagcacaaagcactg

SEQ ID NO: 4869095 - DNA, 13 bp, Homo sapiens
cccccattcccag

SEQ ID NO: 4869096 - DNA, 17 bp, Homo sapiens
cccccattcccagcctg

SEQ ID NO: 4869097 - DNA, 12 bp, Homo sapiens
ccccctcccacc

SEQ ID NO: 4869098 - DNA, 14 bp, Homo sapiens
ccccgagtctccgg

SEQ ID NO: 4869099 - DNA, 14 bp, Homo sapiens
ccccgtcacagcct

SEQ ID NO: 4869100 - DNA, 16 bp, Homo sapiens
ccccgtcacagcctca

SEQ ID NO: 4869101 - DNA, 15 bp, Homo sapiens
cccctaaaccccaag

SEQ ID NO: 4869102 - DNA, 22 bp, Homo sapiens
cccctaaaccccaagcttccca

SEQ ID NO: 4869103 - DNA, 21 bp, Homo sapiens
cccctaaagagcatcctgata

SEQ ID NO: 4869104 - DNA, 13 bp, Homo sapiens
cccctaaagccag

SEQ ID NO: 4869105 - DNA, 16 bp, Homo sapiens
cccctatcctctgagt

SEQ ID NO: 4869106 - DNA, 19 bp, Homo sapiens
cccctcccaggggagccag

SEQ ID NO: 4869107 - DNA, 21 bp, Homo sapiens
cccctcccaggggagccagct

SEQ ID NO: 4869108 - DNA, 21 bp, Homo sapiens
cccctgcgtgggggccagtca

SEQ ID NO: 4869109 - DNA, 21 bp, Homo sapiens
ccccttaccccaaagagaaag

SEQ ID NO: 4869110 - DNA, 13 bp, Homo sapiens
ccccttcaggagc

SEQ ID NO: 4869111 - DNA, 14 bp, Homo sapiens
ccccttcaggagcc

SEQ ID NO: 4869112 - DNA, 16 bp, Homo sapiens
ccccttcaggagcctg

SEQ ID NO: 4869113 - DNA, 20 bp, Homo sapiens
ccccttcaggagcctggcca

SEQ ID NO: 4869114 - DNA, 18 bp, Homo sapiens
ccccttcatccatcctga

SEQ ID NO: 4869115 - DNA, 23 bp, Homo sapiens
cccgcctcgacctccccacccgc

SEQ ID NO: 4869116 - DNA, 15 bp, Homo sapiens
cccgctcccacaccc

SEQ ID NO: 4869117 - DNA, 18 bp, Homo sapiens
cccggttcagacccctgc

SEQ ID NO: 4869118 - DNA, 15 bp, Homo sapiens
cccgtcacagcctca

SEQ ID NO: 4869119 - DNA, 22 bp, Homo sapiens
ccctaaaccccaagcttcccaa

SEQ ID NO: 4869120 - DNA, 18 bp, Homo sapiens
ccctaaagagcatcctga

SEQ ID NO: 4869121 - DNA, 12 bp, Homo sapiens
ccctaaagccag

SEQ ID NO: 4869122 - DNA, 13 bp, Homo sapiens
ccctacagacagc

SEQ ID NO: 4869123 - DNA, 11 bp, Homo sapiens
ccctactgtgg

SEQ ID NO: 4869124 - DNA, 19 bp, Homo sapiens
ccctagggctctccaagca

SEQ ID NO: 4869125 - DNA, 21 bp, Homo sapiens
ccctcacctgtagcagccagt

SEQ ID NO: 4869126 - DNA, 15 bp, Homo sapiens
ccctcatggctctgg

SEQ ID NO: 4869127 - DNA, 21 bp, Homo sapiens
ccctccaaaggaactctagag

SEQ ID NO: 4869128 - DNA, 14 bp, Homo sapiens
ccctccagagaaag

SEQ ID NO: 4869129 - DNA, 13 bp, Homo sapiens
ccctcccacgcct

SEQ ID NO: 4869130 - DNA, 13 bp, Homo sapiens
ccctcctgagggc

SEQ ID NO: 4869131 - DNA, 17 bp, Homo sapiens
ccctctgctctgcctgg

SEQ ID NO: 4869132 - DNA, 20 bp, Homo sapiens
ccctctgctctgcctggagt

SEQ ID NO: 4869133 - DNA, 20 bp, Homo sapiens
ccctctgtccttcccccagc

SEQ ID NO: 4869134 - DNA, 19 bp, Homo sapiens
ccctctttgcacagcatga

SEQ ID NO: 4869135 - DNA, 20 bp, Homo sapiens
ccctgaaatggcctgtccct

SEQ ID NO: 4869136 - DNA, 16 bp, Homo sapiens
ccctgaatccgtactt

SEQ ID NO: 4869137 - DNA, 23 bp, Homo sapiens
ccctgacaggccttcctcctctc

SEQ ID NO: 4869138 - DNA, 17 bp, Homo sapiens
ccctgcaaaactccagg

SEQ ID NO: 4869139 - DNA, 12 bp, Homo sapiens
ccctgcctggag

SEQ ID NO: 4869140 - DNA, 21 bp, Homo sapiens
ccctgctccacgtctgcgccg

SEQ ID NO: 4869141 - DNA, 17 bp, Homo sapiens
ccctgctcccattcctc

SEQ ID NO: 4869142 - DNA, 19 bp, Homo sapiens
ccctggaggtaaacaaaga

SEQ ID NO: 4869143 - DNA, 19 bp, Homo sapiens
ccctgggtttgggagccag

SEQ ID NO: 4869144 - DNA, 21 bp, Homo sapiens
ccctgggtttgggagccagga

SEQ ID NO: 4869145 - DNA, 22 bp, Homo sapiens
ccctgggtttgggagccaggac

SEQ ID NO: 4869146 - DNA, 23 bp, Homo sapiens
ccctgggtttgggagccaggact

SEQ ID NO: 4869147 - DNA, 18 bp, Homo sapiens
ccctgtctcccggctccc

SEQ ID NO: 4869148 - DNA, 18 bp, Homo sapiens
cccttacagcctctgact

SEQ ID NO: 4869149 - DNA, 21 bp, Homo sapiens
cccttactggcttacctcctc

SEQ ID NO: 4869150 - DNA, 12 bp, Homo sapiens
cccttcaggagc

SEQ ID NO: 4869151 - DNA, 14 bp, Homo sapiens
cccttcaggagcct

SEQ ID NO: 4869152 - DNA, 15 bp, Homo sapiens
cccttcaggagcctg

SEQ ID NO: 4869153 - DNA, 22 bp, Homo sapiens
cccttcaggagcctggccaggc

SEQ ID NO: 4869154 - DNA, 23 bp, Homo sapiens
cccttcaggagcctggccaggca

SEQ ID NO: 4869155 - DNA, 19 bp, Homo sapiens
cccttcatccatcctgagc

SEQ ID NO: 4869156 - DNA, 12 bp, Homo sapiens
cccttccctggg

SEQ ID NO: 4869157 - DNA, 13 bp, Homo sapiens
cccttctgggtcc

SEQ ID NO: 4869158 - DNA, 15 bp, Homo sapiens
cccttgcacgtaaac

SEQ ID NO: 4869159 - DNA, 17 bp, Homo sapiens
cccttgtgagagcccat

SEQ ID NO: 4869160 - DNA, 20 bp, Homo sapiens
ccgaagcccaccactggcca

SEQ ID NO: 4869161 - DNA, 14 bp, Homo sapiens
ccgagtctccggga

SEQ ID NO: 4869162 - DNA, 17 bp, Homo sapiens
ccgcagacctggagctt

SEQ ID NO: 4869163 - DNA, 18 bp, Homo sapiens
ccgcagaggtggggtgct

SEQ ID NO: 4869164 - DNA, 21 bp, Homo sapiens
ccgcagaggtggggtgctggg

SEQ ID NO: 4869165 - DNA, 14 bp, Homo sapiens
ccgcccactcctgg

SEQ ID NO: 4869166 - DNA, 15 bp, Homo sapiens
ccgccccgcccctcc

SEQ ID NO: 4869167 - DNA, 15 bp, Homo sapiens
ccgcccctcccacgc

SEQ ID NO: 4869168 - DNA, 15 bp, Homo sapiens
ccgcctccccaagtc

SEQ ID NO: 4869169 - DNA, 17 bp, Homo sapiens
ccggagcaaactctgct

SEQ ID NO: 4869170 - DNA, 17 bp, Homo sapiens
ccggatgaaacttctca

SEQ ID NO: 4869171 - DNA, 19 bp, Homo sapiens
ccggatgaaacttctcagt

SEQ ID NO: 4869172 - DNA, 16 bp, Homo sapiens
ccggccatactgcctt

SEQ ID NO: 4869173 - DNA, 22 bp, Homo sapiens
ccggcgggtgacagctccggga

SEQ ID NO: 4869174 - DNA, 12 bp, Homo sapiens
ccgggactccag

SEQ ID NO: 4869175 - DNA, 18 bp, Homo sapiens
ccggggagaaacccagag

SEQ ID NO: 4869176 - DNA, 22 bp, Homo sapiens
ccgggggcagctctggaggggg

SEQ ID NO: 4869177 - DNA, 16 bp, Homo sapiens
ccgtattcctctccca

SEQ ID NO: 4869178 - DNA, 14 bp, Homo sapiens
ccgtctcctccctc

SEQ ID NO: 4869179 - DNA, 16 bp, Homo sapiens
ccgtgccccttccctg

SEQ ID NO: 4869180 - DNA, 15 bp, Homo sapiens
ccgtggcagcttgct

SEQ ID NO: 4869181 - DNA, 23 bp, Homo sapiens
ccgtttcatttagtcatgtgacc

SEQ ID NO: 4869182 - DNA, 16 bp, Homo sapiens
cctaaagccaggctca

SEQ ID NO: 4869183 - DNA, 15 bp, Homo sapiens
cctaaattatttact

SEQ ID NO: 4869184 - DNA, 21 bp, Homo sapiens
cctaacatctgacctggcatc

SEQ ID NO: 4869185 - DNA, 21 bp, Homo sapiens
cctaactcctataaagtgcct

SEQ ID NO: 4869186 - DNA, 21 bp, Homo sapiens
cctaagaagaaggccagagag

SEQ ID NO: 4869187 - DNA, 20 bp, Homo sapiens
cctaagagatgggactagga

SEQ ID NO: 4869188 - DNA, 19 bp, Homo sapiens
cctaagatgtgttcttatt

SEQ ID NO: 4869189 - DNA, 19 bp, Homo sapiens
cctaatcaaattctgtctg

SEQ ID NO: 4869190 - DNA, 12 bp, Homo sapiens
cctaatgtgttt

SEQ ID NO: 4869191 - DNA, 18 bp, Homo sapiens
cctacactcacctgcact

SEQ ID NO: 4869192 - DNA, 12 bp, Homo sapiens
cctacagacagc

SEQ ID NO: 4869193 - DNA, 15 bp, Homo sapiens
cctacagttttaact

SEQ ID NO: 4869194 - DNA, 17 bp, Homo sapiens
cctacagttttaactgt

SEQ ID NO: 4869195 - DNA, 21 bp, Homo sapiens
cctacattccaccctgttact

SEQ ID NO: 4869196 - DNA, 14 bp, Homo sapiens
cctacctctgtctg

SEQ ID NO: 4869197 - DNA, 15 bp, Homo sapiens
cctacctctgtctga

SEQ ID NO: 4869198 - DNA, 19 bp, Homo sapiens
cctactaggagaggggggc

SEQ ID NO: 4869199 - DNA, 16 bp, Homo sapiens
cctactggtgtaatct

SEQ ID NO: 4869200 - DNA, 17 bp, Homo sapiens
cctactgtgggcaaagt

SEQ ID NO: 4869201 - DNA, 13 bp, Homo sapiens
cctactttctatt

SEQ ID NO: 4869202 - DNA, 18 bp, Homo sapiens
cctagactgctcctgggc

SEQ ID NO: 4869203 - DNA, 20 bp, Homo sapiens
cctagcctatgtctggcaga

SEQ ID NO: 4869204 - DNA, 24 bp, Homo sapiens
cctagctctttgggcctctcctgc

SEQ ID NO: 4869205 - DNA, 22 bp, Homo sapiens
cctagctgtgtgaatacctgct

SEQ ID NO: 4869206 - DNA, 19 bp, Homo sapiens
cctaggatcccgtcttcca

SEQ ID NO: 4869207 - DNA, 21 bp, Homo sapiens
cctagggtcttgggggtcagg

SEQ ID NO: 4869208 - DNA, 14 bp, Homo sapiens
cctagtaagaagac

SEQ ID NO: 4869209 - DNA, 15 bp, Homo sapiens
cctagttaaagaaag

SEQ ID NO: 4869210 - DNA, 16 bp, Homo sapiens
cctagttcaggtccaa

SEQ ID NO: 4869211 - DNA, 14 bp, Homo sapiens
cctataaagtgcct

SEQ ID NO: 4869212 - DNA, 19 bp, Homo sapiens
cctataaagtgcctcggac

SEQ ID NO: 4869213 - DNA, 17 bp, Homo sapiens
cctatatcctccttctc

SEQ ID NO: 4869214 - DNA, 14 bp, Homo sapiens
cctatctcttcctg

SEQ ID NO: 4869215 - DNA, 16 bp, Homo sapiens
cctatctcttcctgtc

SEQ ID NO: 4869216 - DNA, 15 bp, Homo sapiens
cctatgtctggcaga

SEQ ID NO: 4869217 - DNA, 21 bp, Homo sapiens
cctcaccgagcatgcttccct

SEQ ID NO: 4869218 - DNA, 15 bp, Homo sapiens
cctcacctgtagcag

SEQ ID NO: 4869219 - DNA, 14 bp, Homo sapiens
cctcagctctctgg

SEQ ID NO: 4869220 - DNA, 18 bp, Homo sapiens
cctcaggacccatccctg

SEQ ID NO: 4869221 - DNA, 18 bp, Homo sapiens
cctcaggccaagggacca

SEQ ID NO: 4869222 - DNA, 12 bp, Homo sapiens
cctcaggctccg

SEQ ID NO: 4869223 - DNA, 21 bp, Homo sapiens
cctcaggctccgggcaccagg

SEQ ID NO: 4869224 - DNA, 19 bp, Homo sapiens
cctcagggtggggggtgac

SEQ ID NO: 4869225 - DNA, 15 bp, Homo sapiens
cctcatcactggact

SEQ ID NO: 4869226 - DNA, 17 bp, Homo sapiens
cctcatcactggactgc

SEQ ID NO: 4869227 - DNA, 15 bp, Homo sapiens
cctcattttgcttcc

SEQ ID NO: 4869228 - DNA, 17 bp, Homo sapiens
cctcattttgcttccca

SEQ ID NO: 4869229 - DNA, 20 bp, Homo sapiens
cctccaaaggaactctagag

SEQ ID NO: 4869230 - DNA, 14 bp, Homo sapiens
cctccaagggatct

SEQ ID NO: 4869231 - DNA, 17 bp, Homo sapiens
cctccagccctgggcac

SEQ ID NO: 4869232 - DNA, 14 bp, Homo sapiens
cctccagctgggat

SEQ ID NO: 4869233 - DNA, 19 bp, Homo sapiens
cctccaggaccttgcttcc

SEQ ID NO: 4869234 - DNA, 23 bp, Homo sapiens
cctccatgctcctcacctgtcta

SEQ ID NO: 4869235 - DNA, 22 bp, Homo sapiens
cctccattcatccttccatcca

SEQ ID NO: 4869236 - DNA, 23 bp, Homo sapiens
cctccattcatccttccatccat

SEQ ID NO: 4869237 - DNA, 20 bp, Homo sapiens
cctcccaaggcattctccca

SEQ ID NO: 4869238 - DNA, 19 bp, Homo sapiens
cctcccaaggtcctctcag

SEQ ID NO: 4869239 - DNA, 19 bp, Homo sapiens
cctcccacgcctcaccagc

SEQ ID NO: 4869240 - DNA, 21 bp, Homo sapiens
cctcccaggggagccagctgc

SEQ ID NO: 4869241 - DNA, 22 bp, Homo sapiens
cctcccaggggagccagctgct

SEQ ID NO: 4869242 - DNA, 23 bp, Homo sapiens
cctcccaggggagccagctgctt

SEQ ID NO: 4869243 - DNA, 12 bp, Homo sapiens
cctccccagctc

SEQ ID NO: 4869244 - DNA, 14 bp, Homo sapiens
cctcccctgggcag

SEQ ID NO: 4869245 - DNA, 23 bp, Homo sapiens
cctccctccggccatactgcctt

SEQ ID NO: 4869246 - DNA, 22 bp, Homo sapiens
cctccggcgggtgacagctccg

SEQ ID NO: 4869247 - DNA, 19 bp, Homo sapiens
cctcctattctataaaact

SEQ ID NO: 4869248 - DNA, 18 bp, Homo sapiens
cctccttctgcagtcaga

SEQ ID NO: 4869249 - DNA, 13 bp, Homo sapiens
cctcgagagcctt

SEQ ID NO: 4869250 - DNA, 21 bp, Homo sapiens
cctcggggagcgttctaaata

SEQ ID NO: 4869251 - DNA, 16 bp, Homo sapiens
cctctaagtgctgctg

SEQ ID NO: 4869252 - DNA, 17 bp, Homo sapiens
cctctaagtgctgctgt

SEQ ID NO: 4869253 - DNA, 18 bp, Homo sapiens
cctctaagtgctgctgtg

SEQ ID NO: 4869254 - DNA, 19 bp, Homo sapiens
cctctaagtgctgctgtgg

SEQ ID NO: 4869255 - DNA, 17 bp, Homo sapiens
cctctaggccctgtgag

SEQ ID NO: 4869256 - DNA, 22 bp, Homo sapiens
cctctcagttctctcccttcct

SEQ ID NO: 4869257 - DNA, 22 bp, Homo sapiens
cctctcctgccctctgctctgc

SEQ ID NO: 4869258 - DNA, 23 bp, Homo sapiens
cctctccttcatgacagcctcca

SEQ ID NO: 4869259 - DNA, 16 bp, Homo sapiens
cctctcggctgccagg

SEQ ID NO: 4869260 - DNA, 21 bp, Homo sapiens
cctctcggctgccaggggctc

SEQ ID NO: 4869261 - DNA, 23 bp, Homo sapiens
cctctctccttatagacacttgc

SEQ ID NO: 4869262 - DNA, 22 bp, Homo sapiens
cctctgacttaagctgcctcaa

SEQ ID NO: 4869263 - DNA, 19 bp, Homo sapiens
cctctgccaaaggatgtga

SEQ ID NO: 4869264 - DNA, 11 bp, Homo sapiens
cctctgcctgg

SEQ ID NO: 4869265 - DNA, 17 bp, Homo sapiens
cctctgctctgcctgga

SEQ ID NO: 4869266 - DNA, 18 bp, Homo sapiens
cctctgctctgcctggag

SEQ ID NO: 4869267 - DNA, 11 bp, Homo sapiens
cctctgggacc

SEQ ID NO: 4869268 - DNA, 16 bp, Homo sapiens
cctctgggacccacag

SEQ ID NO: 4869269 - DNA, 20 bp, Homo sapiens
cctctgggacccacagaact

SEQ ID NO: 4869270 - DNA, 18 bp, Homo sapiens
cctctgtccttcccccag

SEQ ID NO: 4869271 - DNA, 20 bp, Homo sapiens
cctctgtccttcccccagca

SEQ ID NO: 4869272 - DNA, 17 bp, Homo sapiens
cctcttgttcctgaaat

SEQ ID NO: 4869273 - DNA, 15 bp, Homo sapiens
cctgaaatggcctgt

SEQ ID NO: 4869274 - DNA, 20 bp, Homo sapiens
cctgaaatggcctgtcccta

SEQ ID NO: 4869275 - DNA, 22 bp, Homo sapiens
cctgaaatggcctgtccctagg

SEQ ID NO: 4869276 - DNA, 18 bp, Homo sapiens
cctgaccccattcctgat

SEQ ID NO: 4869277 - DNA, 17 bp, Homo sapiens
cctgactagaactcctg

SEQ ID NO: 4869278 - DNA, 17 bp, Homo sapiens
cctgactaggttctgta

SEQ ID NO: 4869279 - DNA, 19 bp, Homo sapiens
cctgactaggttctgtaga

SEQ ID NO: 4869280 - DNA, 15 bp, Homo sapiens
cctgactcagtgacc

SEQ ID NO: 4869281 - DNA, 18 bp, Homo sapiens
cctgactcagtgaccagt

SEQ ID NO: 4869282 - DNA, 14 bp, Homo sapiens
cctgagaaacacta

SEQ ID NO: 4869283 - DNA, 13 bp, Homo sapiens
cctgagaattgag

SEQ ID NO: 4869284 - DNA, 16 bp, Homo sapiens
cctgatggagtgtgca

SEQ ID NO: 4869285 - DNA, 15 bp, Homo sapiens
cctgcagcagtcgcc

SEQ ID NO: 4869286 - DNA, 15 bp, Homo sapiens
cctgcatagccggtg

SEQ ID NO: 4869287 - DNA, 14 bp, Homo sapiens
cctgccaaggagca

SEQ ID NO: 4869288 - DNA, 22 bp, Homo sapiens
cctgccaaggagcatccttggc

SEQ ID NO: 4869289 - DNA, 15 bp, Homo sapiens
cctgccagctgcagc

SEQ ID NO: 4869290 - DNA, 23 bp, Homo sapiens
cctgccctctgctctgcctggag

SEQ ID NO: 4869291 - DNA, 17 bp, Homo sapiens
cctgcccttcctcctga

SEQ ID NO: 4869292 - DNA, 14 bp, Homo sapiens
cctgcctggaggct

SEQ ID NO: 4869293 - DNA, 20 bp, Homo sapiens
cctgcctggaggctcctcta

SEQ ID NO: 4869294 - DNA, 22 bp, Homo sapiens
cctgcctggaggctcctctagg

SEQ ID NO: 4869295 - DNA, 23 bp, Homo sapiens
cctgcctggaggctcctctaggc

SEQ ID NO: 4869296 - DNA, 17 bp, Homo sapiens
cctgctcaactctaccc

SEQ ID NO: 4869297 - DNA, 21 bp, Homo sapiens
cctgctcaactctacccctgc

SEQ ID NO: 4869298 - DNA, 15 bp, Homo sapiens
cctgctgctgctact

SEQ ID NO: 4869299 - DNA, 22 bp, Homo sapiens
cctgcttaatcttcaaagcctt

SEQ ID NO: 4869300 - DNA, 16 bp, Homo sapiens
cctgcttcccacaact

SEQ ID NO: 4869301 - DNA, 17 bp, Homo sapiens
cctgcttgactttccag

SEQ ID NO: 4869302 - DNA, 19 bp, Homo sapiens
cctgcttgactttccagaa

SEQ ID NO: 4869303 - DNA, 20 bp, Homo sapiens
cctgcttgactttccagaat

SEQ ID NO: 4869304 - DNA, 15 bp, Homo sapiens
cctgctttttggaaa

SEQ ID NO: 4869305 - DNA, 20 bp, Homo sapiens
cctgctttttggaaagtcag

SEQ ID NO: 4869306 - DNA, 21 bp, Homo sapiens
cctggacctgccctgggccac

SEQ ID NO: 4869307 - DNA, 23 bp, Homo sapiens
cctggagcaggcccaatgctgct

SEQ ID NO: 4869308 - DNA, 12 bp, Homo sapiens
cctggagctcag

SEQ ID NO: 4869309 - DNA, 23 bp, Homo sapiens
cctggagcttcagccaggtctga

SEQ ID NO: 4869310 - DNA, 13 bp, Homo sapiens
cctggaggctcct

SEQ ID NO: 4869311 - DNA, 23 bp, Homo sapiens
cctggaggctcctctaggccctg

SEQ ID NO: 4869312 - DNA, 17 bp, Homo sapiens
cctggcagatgggggcc

SEQ ID NO: 4869313 - DNA, 13 bp, Homo sapiens
cctggccaggcag

SEQ ID NO: 4869314 - DNA, 21 bp, Homo sapiens
cctggcctagaaagggcaagg

SEQ ID NO: 4869315 - DNA, 12 bp, Homo sapiens
cctgggaagctg

SEQ ID NO: 4869316 - DNA, 14 bp, Homo sapiens
cctgggaaggccag

SEQ ID NO: 4869317 - DNA, 23 bp, Homo sapiens
cctgggcatgcccagcccctggt

SEQ ID NO: 4869318 - DNA, 18 bp, Homo sapiens
cctgggcattagcaaggc

SEQ ID NO: 4869319 - DNA, 19 bp, Homo sapiens
cctgggcattagcaaggca

SEQ ID NO: 4869320 - DNA, 21 bp, Homo sapiens
cctggggcctccagaagctgc

SEQ ID NO: 4869321 - DNA, 14 bp, Homo sapiens
cctgggtgacattt

SEQ ID NO: 4869322 - DNA, 17 bp, Homo sapiens
cctgggtttgggagcca

SEQ ID NO: 4869323 - DNA, 13 bp, Homo sapiens
cctggtttctggg

SEQ ID NO: 4869324 - DNA, 24 bp, Homo sapiens
cctgtccctagggctctccaagca

SEQ ID NO: 4869325 - DNA, 21 bp, Homo sapiens
cctgtctcccggctcccctcc

SEQ ID NO: 4869326 - DNA, 13 bp, Homo sapiens
cctgtcttctttc

SEQ ID NO: 4869327 - DNA, 21 bp, Homo sapiens
cctgtcttctttctccatgga

SEQ ID NO: 4869328 - DNA, 18 bp, Homo sapiens
cctgtgagcacaaagaag

SEQ ID NO: 4869329 - DNA, 19 bp, Homo sapiens
cctgtgagcatggggccag

SEQ ID NO: 4869330 - DNA, 13 bp, Homo sapiens
cctgtgaggactg

SEQ ID NO: 4869331 - DNA, 11 bp, Homo sapiens
cctgtgaggat

SEQ ID NO: 4869332 - DNA, 13 bp, Homo sapiens
cctgtgagtaggc

SEQ ID NO: 4869333 - DNA, 19 bp, Homo sapiens
cctgtggcactcagggagc

SEQ ID NO: 4869334 - DNA, 13 bp, Homo sapiens
cctgtggcaggag

SEQ ID NO: 4869335 - DNA, 23 bp, Homo sapiens
cctgtggtcatgtgagtctggga

SEQ ID NO: 4869336 - DNA, 15 bp, Homo sapiens
cctgtgtgaccctgg

SEQ ID NO: 4869337 - DNA, 20 bp, Homo sapiens
cctgtgtgaccctgggcagt

SEQ ID NO: 4869338 - DNA, 20 bp, Homo sapiens
cctgttcatgtttttgtttt

SEQ ID NO: 4869339 - DNA, 14 bp, Homo sapiens
ccttaatttaactt

SEQ ID NO: 4869340 - DNA, 23 bp, Homo sapiens
ccttacttcaaagtgcctgggct

SEQ ID NO: 4869341 - DNA, 16 bp, Homo sapiens
ccttagagctcttgtg

SEQ ID NO: 4869342 - DNA, 20 bp, Homo sapiens
ccttaggtttttttccttct

SEQ ID NO: 4869343 - DNA, 18 bp, Homo sapiens
ccttcaagggtcagggtg

SEQ ID NO: 4869344 - DNA, 22 bp, Homo sapiens
ccttcaggagcctggccaggca

SEQ ID NO: 4869345 - DNA, 15 bp, Homo sapiens
ccttcaggcagctga

SEQ ID NO: 4869346 - DNA, 15 bp, Homo sapiens
ccttcatccatcctg

SEQ ID NO: 4869347 - DNA, 17 bp, Homo sapiens
ccttcatgacagcctcc

SEQ ID NO: 4869348 - DNA, 18 bp, Homo sapiens
ccttcatgacagcctcca

SEQ ID NO: 4869349 - DNA, 23 bp, Homo sapiens
ccttccatccatctttccatcca

SEQ ID NO: 4869350 - DNA, 21 bp, Homo sapiens
ccttcccctaaaccccaagct

SEQ ID NO: 4869351 - DNA, 19 bp, Homo sapiens
ccttccctttacagctctc

SEQ ID NO: 4869352 - DNA, 23 bp, Homo sapiens
ccttccctttctaagcaaccaca

SEQ ID NO: 4869353 - DNA, 14 bp, Homo sapiens
ccttcctcctctca

SEQ ID NO: 4869354 - DNA, 21 bp, Homo sapiens
ccttcctcttgtctgatttct

SEQ ID NO: 4869355 - DNA, 14 bp, Homo sapiens
ccttcctgctgctg

SEQ ID NO: 4869356 - DNA, 14 bp, Homo sapiens
ccttcgtttatatt

SEQ ID NO: 4869357 - DNA, 16 bp, Homo sapiens
ccttctaaattcccaa

SEQ ID NO: 4869358 - DNA, 17 bp, Homo sapiens
ccttctagttgccccca

SEQ ID NO: 4869359 - DNA, 22 bp, Homo sapiens
ccttctccctagctcctcccct

SEQ ID NO: 4869360 - DNA, 14 bp, Homo sapiens
ccttctctttgggg

SEQ ID NO: 4869361 - DNA, 14 bp, Homo sapiens
ccttctgggtccag

SEQ ID NO: 4869362 - DNA, 18 bp, Homo sapiens
ccttgaaactttgggaaa

SEQ ID NO: 4869363 - DNA, 19 bp, Homo sapiens
ccttgaaactttgggaaaa

SEQ ID NO: 4869364 - DNA, 22 bp, Homo sapiens
ccttgaccaaaatcagctttgt

SEQ ID NO: 4869365 - DNA, 16 bp, Homo sapiens
ccttgagagttccggg

SEQ ID NO: 4869366 - DNA, 18 bp, Homo sapiens
ccttgagagttccgggga

SEQ ID NO: 4869367 - DNA, 14 bp, Homo sapiens
ccttgagtctctga

SEQ ID NO: 4869368 - DNA, 13 bp, Homo sapiens
ccttgatggggtg

SEQ ID NO: 4869369 - DNA, 14 bp, Homo sapiens
ccttgattcattct

SEQ ID NO: 4869370 - DNA, 14 bp, Homo sapiens
ccttgcaacccaag

SEQ ID NO: 4869371 - DNA, 21 bp, Homo sapiens
ccttgcagatatctgcatgtg

SEQ ID NO: 4869372 - DNA, 18 bp, Homo sapiens
ccttgcaggggtcccccc

SEQ ID NO: 4869373 - DNA, 13 bp, Homo sapiens
ccttgcttcctga

SEQ ID NO: 4869374 - DNA, 16 bp, Homo sapiens
ccttgcttccttctca

SEQ ID NO: 4869375 - DNA, 17 bp, Homo sapiens
ccttgcttccttctcat

SEQ ID NO: 4869376 - DNA, 12 bp, Homo sapiens
ccttgcttctgt

SEQ ID NO: 4869377 - DNA, 20 bp, Homo sapiens
ccttgcttctgtatttcctt

SEQ ID NO: 4869378 - DNA, 16 bp, Homo sapiens
ccttggacattttatg

SEQ ID NO: 4869379 - DNA, 15 bp, Homo sapiens
ccttggattttcctg

SEQ ID NO: 4869380 - DNA, 15 bp, Homo sapiens
ccttgtacagtctgc

SEQ ID NO: 4869381 - DNA, 20 bp, Homo sapiens
ccttgtacagtctgctcctc

SEQ ID NO: 4869382 - DNA, 21 bp, Homo sapiens
ccttgtacagtctgctcctct

SEQ ID NO: 4869383 - DNA, 21 bp, Homo sapiens
ccttgtttctgccctgccagc

SEQ ID NO: 4869384 - DNA, 22 bp, Homo sapiens
ccttgtttctgccctgccagct

SEQ ID NO: 4869385 - DNA, 22 bp, Homo sapiens
cctttacagctctcctccagcc

SEQ ID NO: 4869386 - DNA, 20 bp, Homo sapiens
cctttcctgatgcccctgac

SEQ ID NO: 4869387 - DNA, 18 bp, Homo sapiens
ccttttaagcatgtgatg

SEQ ID NO: 4869388 - DNA, 13 bp, Homo sapiens
ccttttcaggaga

SEQ ID NO: 4869389 - DNA, 15 bp, Homo sapiens
cgaacagccttagag

SEQ ID NO: 4869390 - DNA, 16 bp, Homo sapiens
cgaagactgagccaga

SEQ ID NO: 4869391 - DNA, 19 bp, Homo sapiens
cgaagtctttgccttctct

SEQ ID NO: 4869392 - DNA, 15 bp, Homo sapiens
cgaatctcaaaatta

SEQ ID NO: 4869393 - DNA, 16 bp, Homo sapiens
cgacctccccacccgc

SEQ ID NO: 4869394 - DNA, 18 bp, Homo sapiens
cgactactgctcctgtgg

SEQ ID NO: 4869395 - DNA, 13 bp, Homo sapiens
cgactcagcctca

SEQ ID NO: 4869396 - DNA, 19 bp, Homo sapiens
cgactgtcagtggggcagc

SEQ ID NO: 4869397 - DNA, 16 bp, Homo sapiens
cgagagatcaaagatg

SEQ ID NO: 4869398 - DNA, 17 bp, Homo sapiens
cgagggatgatgaggga

SEQ ID NO: 4869399 - DNA, 17 bp, Homo sapiens
cgatgcatttaataaag

SEQ ID NO: 4869400 - DNA, 14 bp, Homo sapiens
cgcagacctggagc

SEQ ID NO: 4869401 - DNA, 15 bp, Homo sapiens
cgcagacctggagct

SEQ ID NO: 4869402 - DNA, 18 bp, Homo sapiens
cgcagagaaatgccccag

SEQ ID NO: 4869403 - DNA, 12 bp, Homo sapiens
cgcagaggtggg

SEQ ID NO: 4869404 - DNA, 19 bp, Homo sapiens
cgcaggtgctcatgctgct

SEQ ID NO: 4869405 - DNA, 16 bp, Homo sapiens
cgccagcgtgtggagc

SEQ ID NO: 4869406 - DNA, 22 bp, Homo sapiens
cgccagcgtgtggagcagagct

SEQ ID NO: 4869407 - DNA, 15 bp, Homo sapiens
cgccagtcactgctg

SEQ ID NO: 4869408 - DNA, 17 bp, Homo sapiens
cgccagtcactgctgca

SEQ ID NO: 4869409 - DNA, 14 bp, Homo sapiens
cgcccccacctcca

SEQ ID NO: 4869410 - DNA, 16 bp, Homo sapiens
cgcccctcccacgcct

SEQ ID NO: 4869411 - DNA, 13 bp, Homo sapiens
cgccgccgccgct

SEQ ID NO: 4869412 - DNA, 15 bp, Homo sapiens
cgccgccgctgccct

SEQ ID NO: 4869413 - DNA, 22 bp, Homo sapiens
cgccgctgcccttgggtccccc

SEQ ID NO: 4869414 - DNA, 13 bp, Homo sapiens
cgcctcaccagcc

SEQ ID NO: 4869415 - DNA, 21 bp, Homo sapiens
cgcgcgcccaccctccggcgg

SEQ ID NO: 4869416 - DNA, 20 bp, Homo sapiens
cgctccccttaccccagtca

SEQ ID NO: 4869417 - DNA, 20 bp, Homo sapiens
cgctgcccttgggtcccccc

SEQ ID NO: 4869418 - DNA, 18 bp, Homo sapiens
cggaaagaagagcgagag

SEQ ID NO: 4869419 - DNA, 17 bp, Homo sapiens
cggacccttctgggtcc

SEQ ID NO: 4869420 - DNA, 23 bp, Homo sapiens
cggacccttctgggtccagggag

SEQ ID NO: 4869421 - DNA, 17 bp, Homo sapiens
cggagcaaactctgctg

SEQ ID NO: 4869422 - DNA, 13 bp, Homo sapiens
cggaggctgctcg

SEQ ID NO: 4869423 - DNA, 16 bp, Homo sapiens
cggagtccactcccag

SEQ ID NO: 4869424 - DNA, 20 bp, Homo sapiens
cggagtccactcccagtgct

SEQ ID NO: 4869425 - DNA, 13 bp, Homo sapiens
cggcaaaaggaaa

SEQ ID NO: 4869426 - DNA, 21 bp, Homo sapiens
cggcccttacctttcctgatg

SEQ ID NO: 4869427 - DNA, 15 bp, Homo sapiens
cggcctgagaaacac

SEQ ID NO: 4869428 - DNA, 20 bp, Homo sapiens
cggctgccaggggctctgtg

SEQ ID NO: 4869429 - DNA, 20 bp, Homo sapiens
cggggcagggggtatgcaga

SEQ ID NO: 4869430 - DNA, 22 bp, Homo sapiens
cggggcagggggtatgcagagc

SEQ ID NO: 4869431 - DNA, 16 bp, Homo sapiens
cgggggcagtgtgagg

SEQ ID NO: 4869432 - DNA, 15 bp, Homo sapiens
cggggtcccctctgt

SEQ ID NO: 4869433 - DNA, 18 bp, Homo sapiens
cggggtcccctctgtgct

SEQ ID NO: 4869434 - DNA, 18 bp, Homo sapiens
cggggtgtgtcatttcta

SEQ ID NO: 4869435 - DNA, 20 bp, Homo sapiens
cgggtgggcggcacagcctt

SEQ ID NO: 4869436 - DNA, 15 bp, Homo sapiens
cgggttctcccatga

SEQ ID NO: 4869437 - DNA, 15 bp, Homo sapiens
cggtggaggcagagg

SEQ ID NO: 4869438 - DNA, 15 bp, Homo sapiens
cggttctaaggctca

SEQ ID NO: 4869439 - DNA, 16 bp, Homo sapiens
cggtttcccggccctt

SEQ ID NO: 4869440 - DNA, 12 bp, Homo sapiens
cgtaatttaact

SEQ ID NO: 4869441 - DNA, 15 bp, Homo sapiens
cgtattaaaaaacaa

SEQ ID NO: 4869442 - DNA, 13 bp, Homo sapiens
cgtccatctccct

SEQ ID NO: 4869443 - DNA, 13 bp, Homo sapiens
cgtcctctcggct

SEQ ID NO: 4869444 - DNA, 18 bp, Homo sapiens
cgtcctctcggctgccag

SEQ ID NO: 4869445 - DNA, 13 bp, Homo sapiens
cgtctcctccctc

SEQ ID NO: 4869446 - DNA, 17 bp, Homo sapiens
cgtcttctccctattcc

SEQ ID NO: 4869447 - DNA, 15 bp, Homo sapiens
cgtgatgggctaggc

SEQ ID NO: 4869448 - DNA, 15 bp, Homo sapiens
cgtggatcgagtgta

SEQ ID NO: 4869449 - DNA, 14 bp, Homo sapiens
cgtggctctgctgg

SEQ ID NO: 4869450 - DNA, 15 bp, Homo sapiens
cgtggctctgctggc

SEQ ID NO: 4869451 - DNA, 20 bp, Homo sapiens
cgtggggaacggaggaggac

SEQ ID NO: 4869452 - DNA, 17 bp, Homo sapiens
cgtgtgtgacactgatg

SEQ ID NO: 4869453 - DNA, 14 bp, Homo sapiens
cgttctaaatatga

SEQ ID NO: 4869454 - DNA, 15 bp, Homo sapiens
cgttgtctggttgct

SEQ ID NO: 4869455 - DNA, 21 bp, Homo sapiens
cgtttaaggtgagcataaatc

SEQ ID NO: 4869456 - DNA, 21 bp, Homo sapiens
cgtttatatttttttaactgt

SEQ ID NO: 4869457 - DNA, 23 bp, Homo sapiens
cgtttcctttttgttgatgagga

SEQ ID NO: 4869458 - DNA, 14 bp, Homo sapiens
cgtttgtgtttcta

SEQ ID NO: 4869459 - DNA, 23 bp, Homo sapiens
ctaaaaaggcccttagagggaat

SEQ ID NO: 4869460 - DNA, 15 bp, Homo sapiens
ctaaaaagtataaaa

SEQ ID NO: 4869461 - DNA, 17 bp, Homo sapiens
ctaaaaagtataaaata

SEQ ID NO: 4869462 - DNA, 18 bp, Homo sapiens
ctaaaagttctcaatgta

SEQ ID NO: 4869463 - DNA, 15 bp, Homo sapiens
ctaaagccaggctca

SEQ ID NO: 4869464 - DNA, 22 bp, Homo sapiens
ctaaagccaggctcaggagaag

SEQ ID NO: 4869465 - DNA, 16 bp, Homo sapiens
ctaaaggaaaaaactt

SEQ ID NO: 4869466 - DNA, 21 bp, Homo sapiens
ctaaatgtgcaatagaaggtg

SEQ ID NO: 4869467 - DNA, 23 bp, Homo sapiens
ctaaatgtgtaataatgtaacat

SEQ ID NO: 4869468 - DNA, 14 bp, Homo sapiens
ctaaattatttact

SEQ ID NO: 4869469 - DNA, 13 bp, Homo sapiens
ctaacccagtctt

SEQ ID NO: 4869470 - DNA, 17 bp, Homo sapiens
ctaacccagtctttctt

SEQ ID NO: 4869471 - DNA, 15 bp, Homo sapiens
ctaacctgggacctg

SEQ ID NO: 4869472 - DNA, 18 bp, Homo sapiens
ctaacctgggacctgtgg

SEQ ID NO: 4869473 - DNA, 14 bp, Homo sapiens
ctaactcaaataca

SEQ ID NO: 4869474 - DNA, 24 bp, Homo sapiens
ctaactcctataaagtgcctcgga

SEQ ID NO: 4869475 - DNA, 18 bp, Homo sapiens
ctaacttggggaaggggc

SEQ ID NO: 4869476 - DNA, 20 bp, Homo sapiens
ctaagaaatgccagtggtgg

SEQ ID NO: 4869477 - DNA, 16 bp, Homo sapiens
ctaagaagaaggccag

SEQ ID NO: 4869478 - DNA, 17 bp, Homo sapiens
ctaagaagaaggccaga

SEQ ID NO: 4869479 - DNA, 13 bp, Homo sapiens
ctaagactatata

SEQ ID NO: 4869480 - DNA, 15 bp, Homo sapiens
ctaagcaaccacact

SEQ ID NO: 4869481 - DNA, 20 bp, Homo sapiens
ctaagcaaccacactgcttg

SEQ ID NO: 4869482 - DNA, 13 bp, Homo sapiens
ctaaggagaaatg

SEQ ID NO: 4869483 - DNA, 23 bp, Homo sapiens
ctaaggccatggcatcccttttt

SEQ ID NO: 4869484 - DNA, 16 bp, Homo sapiens
ctaaggctcctgtttt

SEQ ID NO: 4869485 - DNA, 13 bp, Homo sapiens
ctaagtgatataa

SEQ ID NO: 4869486 - DNA, 16 bp, Homo sapiens
ctaagtgatataaatc

SEQ ID NO: 4869487 - DNA, 17 bp, Homo sapiens
ctaagtgctaagtgctt

SEQ ID NO: 4869488 - DNA, 17 bp, Homo sapiens
ctaagtgctgctgtgga

SEQ ID NO: 4869489 - DNA, 21 bp, Homo sapiens
ctaattaatatattaaaattc

SEQ ID NO: 4869490 - DNA, 14 bp, Homo sapiens
ctaattatttaatt

SEQ ID NO: 4869491 - DNA, 15 bp, Homo sapiens
ctaattgtgccccta

SEQ ID NO: 4869492 - DNA, 13 bp, Homo sapiens
ctacaatctcttt

SEQ ID NO: 4869493 - DNA, 13 bp, Homo sapiens
ctacacaaagcag

SEQ ID NO: 4869494 - DNA, 15 bp, Homo sapiens
ctacagacagcttac

SEQ ID NO: 4869495 - DNA, 15 bp, Homo sapiens
ctacagttttaactg

SEQ ID NO: 4869496 - DNA, 17 bp, Homo sapiens
ctacagttttaactgtg

SEQ ID NO: 4869497 - DNA, 18 bp, Homo sapiens
ctacatgtattgcacatt

SEQ ID NO: 4869498 - DNA, 13 bp, Homo sapiens
ctacatgtgagtg

SEQ ID NO: 4869499 - DNA, 11 bp, Homo sapiens
ctacattccac

SEQ ID NO: 4869500 - DNA, 17 bp, Homo sapiens
ctaccagggtctctcag

SEQ ID NO: 4869501 - DNA, 21 bp, Homo sapiens
ctaccagggtctctcagggat

SEQ ID NO: 4869502 - DNA, 23 bp, Homo sapiens
ctacccctgctcccattcctccc

SEQ ID NO: 4869503 - DNA, 16 bp, Homo sapiens
ctactagtgtgactcc

SEQ ID NO: 4869504 - DNA, 17 bp, Homo sapiens
ctactagtgtgactcct

SEQ ID NO: 4869505 - DNA, 19 bp, Homo sapiens
ctactatttaaatccttgg

SEQ ID NO: 4869506 - DNA, 18 bp, Homo sapiens
ctactgaacacatgtgta

SEQ ID NO: 4869507 - DNA, 14 bp, Homo sapiens
ctactgctcctgtg

SEQ ID NO: 4869508 - DNA, 21 bp, Homo sapiens
ctactgctcctgtggcaggag

SEQ ID NO: 4869509 - DNA, 23 bp, Homo sapiens
ctactgctgctgctgctgccgcc

SEQ ID NO: 4869510 - DNA, 23 bp, Homo sapiens
ctactggtgtaatctcaatgcaa

SEQ ID NO: 4869511 - DNA, 15 bp, Homo sapiens
ctactggttacctgg

SEQ ID NO: 4869512 - DNA, 20 bp, Homo sapiens
ctactggttacctggagaag

SEQ ID NO: 4869513 - DNA, 22 bp, Homo sapiens
ctactgtaatgctgcctcagga

SEQ ID NO: 4869514 - DNA, 20 bp, Homo sapiens
ctactgttatcagtaatgct

SEQ ID NO: 4869515 - DNA, 17 bp, Homo sapiens
ctacttctgtaattgtg

SEQ ID NO: 4869516 - DNA, 13 bp, Homo sapiens
ctagaactcctgt

SEQ ID NO: 4869517 - DNA, 13 bp, Homo sapiens
ctagaatcacagc

SEQ ID NO: 4869518 - DNA, 15 bp, Homo sapiens
ctagactgctcctgg

SEQ ID NO: 4869519 - DNA, 17 bp, Homo sapiens
ctagagggcgagggatg

SEQ ID NO: 4869520 - DNA, 21 bp, Homo sapiens
ctagattgctaaggagctgat

SEQ ID NO: 4869521 - DNA, 20 bp, Homo sapiens
ctagccccaaaccagcccag

SEQ ID NO: 4869522 - DNA, 13 bp, Homo sapiens
ctagcctctggac

SEQ ID NO: 4869523 - DNA, 20 bp, Homo sapiens
ctagcctctggactggaaag

SEQ ID NO: 4869524 - DNA, 21 bp, Homo sapiens
ctagcctctggactggaaagc

SEQ ID NO: 4869525 - DNA, 14 bp, Homo sapiens
ctagccttcccagc

SEQ ID NO: 4869526 - DNA, 15 bp, Homo sapiens
ctagccttcccagct

SEQ ID NO: 4869527 - DNA, 14 bp, Homo sapiens
ctagctaattattt

SEQ ID NO: 4869528 - DNA, 15 bp, Homo sapiens
ctagctaattattta

SEQ ID NO: 4869529 - DNA, 16 bp, Homo sapiens
ctaggcactgagcagg

SEQ ID NO: 4869530 - DNA, 16 bp, Homo sapiens
ctaggccctgtgagca

SEQ ID NO: 4869531 - DNA, 22 bp, Homo sapiens
ctaggccctgtgagcacaaaga

SEQ ID NO: 4869532 - DNA, 18 bp, Homo sapiens
ctagggctctccaagcac

SEQ ID NO: 4869533 - DNA, 19 bp, Homo sapiens
ctagggctctccaagcact

SEQ ID NO: 4869534 - DNA, 19 bp, Homo sapiens
ctaggtacgatgacagtgt

SEQ ID NO: 4869535 - DNA, 21 bp, Homo sapiens
ctaggttctgtagagccaatt

SEQ ID NO: 4869536 - DNA, 13 bp, Homo sapiens
ctagtaagaagac

SEQ ID NO: 4869537 - DNA, 20 bp, Homo sapiens
ctagtgggccctctctctgg

SEQ ID NO: 4869538 - DNA, 22 bp, Homo sapiens
ctagtggtatggggctgagccc

SEQ ID NO: 4869539 - DNA, 13 bp, Homo sapiens
ctagtgtgactcc

SEQ ID NO: 4869540 - DNA, 18 bp, Homo sapiens
ctagttaaagaaaggaaa

SEQ ID NO: 4869541 - DNA, 16 bp, Homo sapiens
ctagttatacttattt

SEQ ID NO: 4869542 - DNA, 14 bp, Homo sapiens
ctataatctgtttt

SEQ ID NO: 4869543 - DNA, 13 bp, Homo sapiens
ctatactgtggcc

SEQ ID NO: 4869544 - DNA, 15 bp, Homo sapiens
ctatactgtggcctg

SEQ ID NO: 4869545 - DNA, 21 bp, Homo sapiens
ctatactgtggcctgcaggag

SEQ ID NO: 4869546 - DNA, 10 bp, Homo sapiens
ctatagcacc

SEQ ID NO: 4869547 - DNA, 14 bp, Homo sapiens
ctatatatataaat

SEQ ID NO: 4869548 - DNA, 17 bp, Homo sapiens
ctatattcctccagctg

SEQ ID NO: 4869549 - DNA, 21 bp, Homo sapiens
ctatccacactgtcaaacagg

SEQ ID NO: 4869550 - DNA, 15 bp, Homo sapiens
ctatctcttcctgtc

SEQ ID NO: 4869551 - DNA, 16 bp, Homo sapiens
ctatctcttcctgtct

SEQ ID NO: 4869552 - DNA, 22 bp, Homo sapiens
ctatcttctttggacttctgaa

SEQ ID NO: 4869553 - DNA, 21 bp, Homo sapiens
ctatggtgctgccttgcttct

SEQ ID NO: 4869554 - DNA, 13 bp, Homo sapiens
ctatgtctggcag

SEQ ID NO: 4869555 - DNA, 17 bp, Homo sapiens
ctatgttaatattttag

SEQ ID NO: 4869556 - DNA, 12 bp, Homo sapiens
ctatgttcccca

SEQ ID NO: 4869557 - DNA, 16 bp, Homo sapiens
ctattatttttataat

SEQ ID NO: 4869558 - DNA, 22 bp, Homo sapiens
ctattctataaaactctgcatg

SEQ ID NO: 4869559 - DNA, 12 bp, Homo sapiens
ctattctccaga

SEQ ID NO: 4869560 - DNA, 15 bp, Homo sapiens
ctattctccagacat

SEQ ID NO: 4869561 - DNA, 21 bp, Homo sapiens
ctatttataatacagaatctt

SEQ ID NO: 4869562 - DNA, 13 bp, Homo sapiens
ctatttttgtgaa

SEQ ID NO: 4869563 - DNA, 15 bp, Homo sapiens
ctatttttgtgaaga

SEQ ID NO: 4869564 - DNA, 14 bp, Homo sapiens
ctcaaaaagaaatc

SEQ ID NO: 4869565 - DNA, 14 bp, Homo sapiens
ctcaaagcagcagg

SEQ ID NO: 4869566 - DNA, 15 bp, Homo sapiens
ctcaaagcagcagga

SEQ ID NO: 4869567 - DNA, 21 bp, Homo sapiens
ctcaaataggctattaaaaaa

SEQ ID NO: 4869568 - DNA, 19 bp, Homo sapiens
ctcaagtcactcccaagcc

SEQ ID NO: 4869569 - DNA, 15 bp, Homo sapiens
ctcaatccctgagga

SEQ ID NO: 4869570 - DNA, 21 bp, Homo sapiens
ctcaatgcaagccccaacttt

SEQ ID NO: 4869571 - DNA, 17 bp, Homo sapiens
ctcacctgcactaacag

SEQ ID NO: 4869572 - DNA, 14 bp, Homo sapiens
ctcacgtcaaatgc

SEQ ID NO: 4869573 - DNA, 21 bp, Homo sapiens
ctcacgtgtcagaagcctcca

SEQ ID NO: 4869574 - DNA, 13 bp, Homo sapiens
ctcactactgaac

SEQ ID NO: 4869575 - DNA, 21 bp, Homo sapiens
ctcactactgaacacatgtgt

SEQ ID NO: 4869576 - DNA, 18 bp, Homo sapiens
ctcactcccaagggacag

SEQ ID NO: 4869577 - DNA, 15 bp, Homo sapiens
ctcacttagtccttt

SEQ ID NO: 4869578 - DNA, 21 bp, Homo sapiens
ctcagacccagacgtggtgct

SEQ ID NO: 4869579 - DNA, 13 bp, Homo sapiens
ctcagcagagtga

SEQ ID NO: 4869580 - DNA, 21 bp, Homo sapiens
ctcagcctgctttcctgcagc

SEQ ID NO: 4869581 - DNA, 20 bp, Homo sapiens
ctcagcctggtttctgggtg

SEQ ID NO: 4869582 - DNA, 21 bp, Homo sapiens
ctcagctctctgggacctcct

SEQ ID NO: 4869583 - DNA, 17 bp, Homo sapiens
ctcaggacccatccctg

SEQ ID NO: 4869584 - DNA, 12 bp, Homo sapiens
ctcaggagaagc

SEQ ID NO: 4869585 - DNA, 14 bp, Homo sapiens
ctcaggagaagcca

SEQ ID NO: 4869586 - DNA, 20 bp, Homo sapiens
ctcaggctcctaaagagaca

SEQ ID NO: 4869587 - DNA, 15 bp, Homo sapiens
ctcagggatggaggg

SEQ ID NO: 4869588 - DNA, 22 bp, Homo sapiens
ctcagggatggagggaagacct

SEQ ID NO: 4869589 - DNA, 18 bp, Homo sapiens
ctcagggattctgggctt

SEQ ID NO: 4869590 - DNA, 18 bp, Homo sapiens
ctcagggctcgggagcca

SEQ ID NO: 4869591 - DNA, 14 bp, Homo sapiens
ctcagggtgggggg

SEQ ID NO: 4869592 - DNA, 17 bp, Homo sapiens
ctcagggtggggggtga

SEQ ID NO: 4869593 - DNA, 17 bp, Homo sapiens
ctcaggtcaactgacct

SEQ ID NO: 4869594 - DNA, 19 bp, Homo sapiens
ctcagtgttggtatatttt

SEQ ID NO: 4869595 - DNA, 21 bp, Homo sapiens
ctcagtgttggtatattttat

SEQ ID NO: 4869596 - DNA, 12 bp, Homo sapiens
ctcagttctcaa

SEQ ID NO: 4869597 - DNA, 15 bp, Homo sapiens
ctcataggttaaaaa

SEQ ID NO: 4869598 - DNA, 13 bp, Homo sapiens
ctcatataagaca

SEQ ID NO: 4869599 - DNA, 18 bp, Homo sapiens
ctcattctgaattaatta

SEQ ID NO: 4869600 - DNA, 21 bp, Homo sapiens
ctcattgacttttataaagca

SEQ ID NO: 4869601 - DNA, 19 bp, Homo sapiens
ctcattgcttacaagccta

SEQ ID NO: 4869602 - DNA, 20 bp, Homo sapiens
ctccaagcactagccttccc

SEQ ID NO: 4869603 - DNA, 19 bp, Homo sapiens
ctccaagccctggggcagg

SEQ ID NO: 4869604 - DNA, 13 bp, Homo sapiens
ctccacactcaga

SEQ ID NO: 4869605 - DNA, 21 bp, Homo sapiens
ctccacccataataagagaat

SEQ ID NO: 4869606 - DNA, 23 bp, Homo sapiens
ctccactggccggagtcagtgcc

SEQ ID NO: 4869607 - DNA, 12 bp, Homo sapiens
ctccagaagctg

SEQ ID NO: 4869608 - DNA, 14 bp, Homo sapiens
ctccagaagctgct

SEQ ID NO: 4869609 - DNA, 18 bp, Homo sapiens
ctccagacatggagggga

SEQ ID NO: 4869610 - DNA, 20 bp, Homo sapiens
ctccagacatggaggggatg

SEQ ID NO: 4869611 - DNA, 21 bp, Homo sapiens
ctccagactcagcagagtgag

SEQ ID NO: 4869612 - DNA, 22 bp, Homo sapiens
ctccagactcagcagagtgagg

SEQ ID NO: 4869613 - DNA, 23 bp, Homo sapiens
ctccagagaaagcacaatttaaa

SEQ ID NO: 4869614 - DNA, 13 bp, Homo sapiens
ctccagccctggg

SEQ ID NO: 4869615 - DNA, 11 bp, Homo sapiens
ctccagctcct

SEQ ID NO: 4869616 - DNA, 18 bp, Homo sapiens
ctccagctgacagccaca

SEQ ID NO: 4869617 - DNA, 21 bp, Homo sapiens
ctccagctgacagccacaccg

SEQ ID NO: 4869618 - DNA, 13 bp, Homo sapiens
ctccagctgggat

SEQ ID NO: 4869619 - DNA, 18 bp, Homo sapiens
ctccagcttcggagggcc

SEQ ID NO: 4869620 - DNA, 15 bp, Homo sapiens
ctccaggagggctcg

SEQ ID NO: 4869621 - DNA, 14 bp, Homo sapiens
ctccaggcaggact

SEQ ID NO: 4869622 - DNA, 22 bp, Homo sapiens
ctccaggcatgtgtctggccct

SEQ ID NO: 4869623 - DNA, 23 bp, Homo sapiens
ctccaggcatgtgtctggcccta

SEQ ID NO: 4869624 - DNA, 19 bp, Homo sapiens
ctccagggtgacaaggcct

SEQ ID NO: 4869625 - DNA, 22 bp, Homo sapiens
ctccagggtgacaaggcctgct

SEQ ID NO: 4869626 - DNA, 22 bp, Homo sapiens
ctccagtcattatgttaatatt

SEQ ID NO: 4869627 - DNA, 13 bp, Homo sapiens
ctccatccatcct

SEQ ID NO: 4869628 - DNA, 14 bp, Homo sapiens
ctccatgctcctca

SEQ ID NO: 4869629 - DNA, 13 bp, Homo sapiens
ctccattcatcct

SEQ ID NO: 4869630 - DNA, 21 bp, Homo sapiens
ctccattcatccttccatcca

SEQ ID NO: 4869631 - DNA, 14 bp, Homo sapiens
ctcccaagctgatg

SEQ ID NO: 4869632 - DNA, 19 bp, Homo sapiens
ctcccaaggtcctctcagt

SEQ ID NO: 4869633 - DNA, 15 bp, Homo sapiens
ctcccacagcagccc

SEQ ID NO: 4869634 - DNA, 17 bp, Homo sapiens
ctcccacccaccgccac

SEQ ID NO: 4869635 - DNA, 12 bp, Homo sapiens
ctcccagaacct

SEQ ID NO: 4869636 - DNA, 24 bp, Homo sapiens
ctcccagaacctctaagtgctgct

SEQ ID NO: 4869637 - DNA, 17 bp, Homo sapiens
ctcccagctctagcctc

SEQ ID NO: 4869638 - DNA, 20 bp, Homo sapiens
ctcccaggggagccagctgc

SEQ ID NO: 4869639 - DNA, 22 bp, Homo sapiens
ctcccatgggggcacttgagtt

SEQ ID NO: 4869640 - DNA, 15 bp, Homo sapiens
ctcccattcctccct

SEQ ID NO: 4869641 - DNA, 11 bp, Homo sapiens
ctcccccagag

SEQ ID NO: 4869642 - DNA, 14 bp, Homo sapiens
ctcccccagaggtg

SEQ ID NO: 4869643 - DNA, 21 bp, Homo sapiens
ctcccctaaagccaggctcag

SEQ ID NO: 4869644 - DNA, 16 bp, Homo sapiens
ctcccctcctgctggg

SEQ ID NO: 4869645 - DNA, 17 bp, Homo sapiens
ctcccctcgctgctggg

SEQ ID NO: 4869646 - DNA, 15 bp, Homo sapiens
ctcccctgcccttcc

SEQ ID NO: 4869647 - DNA, 21 bp, Homo sapiens
ctcccctgcccttcctcctga

SEQ ID NO: 4869648 - DNA, 13 bp, Homo sapiens
ctcccctgggcag

SEQ ID NO: 4869649 - DNA, 20 bp, Homo sapiens
ctcccctgggcagggttctc

SEQ ID NO: 4869650 - DNA, 13 bp, Homo sapiens
ctcccgccccgcc

SEQ ID NO: 4869651 - DNA, 18 bp, Homo sapiens
ctcccgccccgcccctcc

SEQ ID NO: 4869652 - DNA, 18 bp, Homo sapiens
ctccctcagctctctggg

SEQ ID NO: 4869653 - DNA, 17 bp, Homo sapiens
ctcccttcctctctcct

SEQ ID NO: 4869654 - DNA, 18 bp, Homo sapiens
ctccgactctgcacccgc

SEQ ID NO: 4869655 - DNA, 19 bp, Homo sapiens
ctccgactctgcacccgcc

SEQ ID NO: 4869656 - DNA, 21 bp, Homo sapiens
ctccggcgggtgacagctccg

SEQ ID NO: 4869657 - DNA, 17 bp, Homo sapiens
ctccgggcaccaggggc

SEQ ID NO: 4869658 - DNA, 19 bp, Homo sapiens
ctccgggcaccaggggcca

SEQ ID NO: 4869659 - DNA, 20 bp, Homo sapiens
ctcctaactgccagccccct

SEQ ID NO: 4869660 - DNA, 16 bp, Homo sapiens
ctcctataaagtgcct

SEQ ID NO: 4869661 - DNA, 20 bp, Homo sapiens
ctcctattctataaaactct

SEQ ID NO: 4869662 - DNA, 17 bp, Homo sapiens
ctcctccagccctgggc

SEQ ID NO: 4869663 - DNA, 10 bp, Homo sapiens
ctcctccctc

SEQ ID NO: 4869664 - DNA, 18 bp, Homo sapiens
ctcctccttgcccagact

SEQ ID NO: 4869665 - DNA, 16 bp, Homo sapiens
ctcctctaggccctgt

SEQ ID NO: 4869666 - DNA, 19 bp, Homo sapiens
ctcctctaggccctgtgag

SEQ ID NO: 4869667 - DNA, 19 bp, Homo sapiens
ctcctctcaaacctggcag

SEQ ID NO: 4869668 - DNA, 21 bp, Homo sapiens
ctcctctcaaacctggcagat

SEQ ID NO: 4869669 - DNA, 15 bp, Homo sapiens
ctcctctccctccca

SEQ ID NO: 4869670 - DNA, 16 bp, Homo sapiens
ctcctcttgttcctga

SEQ ID NO: 4869671 - DNA, 20 bp, Homo sapiens
ctcctgatggagtgtgcaga

SEQ ID NO: 4869672 - DNA, 13 bp, Homo sapiens
ctcctgccctctg

SEQ ID NO: 4869673 - DNA, 15 bp, Homo sapiens
ctcctgccctctgct

SEQ ID NO: 4869674 - DNA, 19 bp, Homo sapiens
ctcctgcttaatcttcaaa

SEQ ID NO: 4869675 - DNA, 22 bp, Homo sapiens
ctcctgggcattagcaaggcag

SEQ ID NO: 4869676 - DNA, 17 bp, Homo sapiens
ctcctgtcttctttctc

SEQ ID NO: 4869677 - DNA, 15 bp, Homo sapiens
ctcctgtggcaggag

SEQ ID NO: 4869678 - DNA, 19 bp, Homo sapiens
ctcctgttttgcacagcca

SEQ ID NO: 4869679 - DNA, 16 bp, Homo sapiens
ctccttcatgtttgga

SEQ ID NO: 4869680 - DNA, 18 bp, Homo sapiens
ctccttctcctgttccat

SEQ ID NO: 4869681 - DNA, 13 bp, Homo sapiens
ctccttctgcagt

SEQ ID NO: 4869682 - DNA, 21 bp, Homo sapiens
ctccttctgcagtcagactga

SEQ ID NO: 4869683 - DNA, 16 bp, Homo sapiens
ctcctttcccctctca

SEQ ID NO: 4869684 - DNA, 20 bp, Homo sapiens
ctcctttgaagaaggcaagg

SEQ ID NO: 4869685 - DNA, 15 bp, Homo sapiens
ctcgacctccccacc

SEQ ID NO: 4869686 - DNA, 22 bp, Homo sapiens
ctcgacctccccacccgctccc

SEQ ID NO: 4869687 - DNA, 12 bp, Homo sapiens
ctcgagagcctt

SEQ ID NO: 4869688 - DNA, 20 bp, Homo sapiens
ctcggctactggttacctgg

SEQ ID NO: 4869689 - DNA, 13 bp, Homo sapiens
ctcggctgccagg

SEQ ID NO: 4869690 - DNA, 19 bp, Homo sapiens
ctcggctgccaggggctct

SEQ ID NO: 4869691 - DNA, 21 bp, Homo sapiens
ctcggctgccaggggctctgt

SEQ ID NO: 4869692 - DNA, 19 bp, Homo sapiens
ctcggggtgtgtcatttct

SEQ ID NO: 4869693 - DNA, 15 bp, Homo sapiens
ctctaagtgctgctg

SEQ ID NO: 4869694 - DNA, 15 bp, Homo sapiens
ctctagatttattag

SEQ ID NO: 4869695 - DNA, 14 bp, Homo sapiens
ctctagcctctgga

SEQ ID NO: 4869696 - DNA, 16 bp, Homo sapiens
ctctagcctctggact

SEQ ID NO: 4869697 - DNA, 20 bp, Homo sapiens
ctctagggcctcagtctgga

SEQ ID NO: 4869698 - DNA, 23 bp, Homo sapiens
ctctaggtacgatgacagtgttc

SEQ ID NO: 4869699 - DNA, 17 bp, Homo sapiens
ctctagtgcggtttact

SEQ ID NO: 4869700 - DNA, 22 bp, Homo sapiens
ctctataagcaaattgcttttt

SEQ ID NO: 4869701 - DNA, 15 bp, Homo sapiens
ctctcaaacctggca

SEQ ID NO: 4869702 - DNA, 20 bp, Homo sapiens
ctctccatatcccttcctct

SEQ ID NO: 4869703 - DNA, 18 bp, Homo sapiens
ctctcccctcctgctggg

SEQ ID NO: 4869704 - DNA, 17 bp, Homo sapiens
ctctccgactctgcacc

SEQ ID NO: 4869705 - DNA, 20 bp, Homo sapiens
ctctccgactctgcacccgc

SEQ ID NO: 4869706 - DNA, 23 bp, Homo sapiens
ctctccgactctgcacccgcctc

SEQ ID NO: 4869707 - DNA, 22 bp, Homo sapiens
ctctcctaactgccagccccct

SEQ ID NO: 4869708 - DNA, 14 bp, Homo sapiens
ctctcctcccctac

SEQ ID NO: 4869709 - DNA, 14 bp, Homo sapiens
ctctcctgccctct

SEQ ID NO: 4869710 - DNA, 15 bp, Homo sapiens
ctctcctgccctctg

SEQ ID NO: 4869711 - DNA, 16 bp, Homo sapiens
ctctcctgccctctgc

SEQ ID NO: 4869712 - DNA, 16 bp, Homo sapiens
ctctctatagcaccag

SEQ ID NO: 4869713 - DNA, 19 bp, Homo sapiens
ctctctggaagagggaggg

SEQ ID NO: 4869714 - DNA, 16 bp, Homo sapiens
ctctctgggacctcct

SEQ ID NO: 4869715 - DNA, 17 bp, Homo sapiens
ctctgaaataatgggat

SEQ ID NO: 4869716 - DNA, 15 bp, Homo sapiens
ctctgaaatcttccc

SEQ ID NO: 4869717 - DNA, 23 bp, Homo sapiens
ctctgaaatcttcccatgcattc

SEQ ID NO: 4869718 - DNA, 20 bp, Homo sapiens
ctctgaatttgtcgggttct

SEQ ID NO: 4869719 - DNA, 22 bp, Homo sapiens
ctctgcaagcttcttgctgatc

SEQ ID NO: 4869720 - DNA, 22 bp, Homo sapiens
ctctgccagttacttgggcttc

SEQ ID NO: 4869721 - DNA, 11 bp, Homo sapiens
ctctgcctggg

SEQ ID NO: 4869722 - DNA, 14 bp, Homo sapiens
ctctgctctgcctg

SEQ ID NO: 4869723 - DNA, 23 bp, Homo sapiens
ctctggactggaaagcacaagac

SEQ ID NO: 4869724 - DNA, 13 bp, Homo sapiens
ctctggagcagcc

SEQ ID NO: 4869725 - DNA, 18 bp, Homo sapiens
ctctggagcagccaaggc

SEQ ID NO: 4869726 - DNA, 22 bp, Homo sapiens
ctctggcttcaaaaagccacag

SEQ ID NO: 4869727 - DNA, 12 bp, Homo sapiens
ctctgggaccca

SEQ ID NO: 4869728 - DNA, 16 bp, Homo sapiens
ctctgggacccacaga

SEQ ID NO: 4869729 - DNA, 17 bp, Homo sapiens
ctctgggacccacagaa

SEQ ID NO: 4869730 - DNA, 15 bp, Homo sapiens
ctctgtccttccccc

SEQ ID NO: 4869731 - DNA, 22 bp, Homo sapiens
ctctgtccttcccccagcacaa

SEQ ID NO: 4869732 - DNA, 15 bp, Homo sapiens
ctctgtcttgtgttt

SEQ ID NO: 4869733 - DNA, 11 bp, Homo sapiens
ctctgtgcttc

SEQ ID NO: 4869734 - DNA, 12 bp, Homo sapiens
ctctgtgcttcg

SEQ ID NO: 4869735 - DNA, 13 bp, Homo sapiens
ctctgttccccca

SEQ ID NO: 4869736 - DNA, 20 bp, Homo sapiens
ctcttaaagaaaacccaccc

SEQ ID NO: 4869737 - DNA, 21 bp, Homo sapiens
ctcttaagtcctaaaagttct

SEQ ID NO: 4869738 - DNA, 16 bp, Homo sapiens
ctcttatgtgtgcctt

SEQ ID NO: 4869739 - DNA, 23 bp, Homo sapiens
ctcttcaaccccgaggtccctgt

SEQ ID NO: 4869740 - DNA, 11 bp, Homo sapiens
ctcttcccact

SEQ ID NO: 4869741 - DNA, 17 bp, Homo sapiens
ctcttcccactccagct

SEQ ID NO: 4869742 - DNA, 15 bp, Homo sapiens
ctcttcctcctccca

SEQ ID NO: 4869743 - DNA, 18 bp, Homo sapiens
ctcttcctcctcccaagg

SEQ ID NO: 4869744 - DNA, 11 bp, Homo sapiens
ctcttcctgtc

SEQ ID NO: 4869745 - DNA, 15 bp, Homo sapiens
ctcttcttcctcacc

SEQ ID NO: 4869746 - DNA, 16 bp, Homo sapiens
ctcttgaaacctgatg

SEQ ID NO: 4869747 - DNA, 13 bp, Homo sapiens
ctcttgcagggtc

SEQ ID NO: 4869748 - DNA, 14 bp, Homo sapiens
ctcttgcagggtct

SEQ ID NO: 4869749 - DNA, 15 bp, Homo sapiens
ctcttggtcccatgg

SEQ ID NO: 4869750 - DNA, 21 bp, Homo sapiens
ctcttgtattatctcctttga

SEQ ID NO: 4869751 - DNA, 14 bp, Homo sapiens
ctcttgtgttcaga

SEQ ID NO: 4869752 - DNA, 17 bp, Homo sapiens
ctcttgtgttcagaaga

SEQ ID NO: 4869753 - DNA, 19 bp, Homo sapiens
ctcttgtgttcagaagaat

SEQ ID NO: 4869754 - DNA, 17 bp, Homo sapiens
ctcttgttcctgaaatg

SEQ ID NO: 4869755 - DNA, 24 bp, Homo sapiens
ctcttgtttacgatttcactagga

SEQ ID NO: 4869756 - DNA, 13 bp, Homo sapiens
ctctttccaccat

SEQ ID NO: 4869757 - DNA, 22 bp, Homo sapiens
ctgaaaagtgtgtatatatttt

SEQ ID NO: 4869758 - DNA, 14 bp, Homo sapiens
ctgaaagagaggac

SEQ ID NO: 4869759 - DNA, 14 bp, Homo sapiens
ctgaaataatggga

SEQ ID NO: 4869760 - DNA, 13 bp, Homo sapiens
ctgaaattttaga

SEQ ID NO: 4869761 - DNA, 18 bp, Homo sapiens
ctgaaattttagaaatat

SEQ ID NO: 4869762 - DNA, 14 bp, Homo sapiens
ctgaacacatgtgt

SEQ ID NO: 4869763 - DNA, 16 bp, Homo sapiens
ctgaagctggagcagc

SEQ ID NO: 4869764 - DNA, 17 bp, Homo sapiens
ctgaagctggagcagcg

SEQ ID NO: 4869765 - DNA, 14 bp, Homo sapiens
ctgaagtatgaagt

SEQ ID NO: 4869766 - DNA, 17 bp, Homo sapiens
ctgaattatctatttca

SEQ ID NO: 4869767 - DNA, 18 bp, Homo sapiens
ctgaattatctatttcat

SEQ ID NO: 4869768 - DNA, 12 bp, Homo sapiens
ctgaatttggag

SEQ ID NO: 4869769 - DNA, 23 bp, Homo sapiens
ctgaatttgtcgggttctcccat

SEQ ID NO: 4869770 - DNA, 17 bp, Homo sapiens
ctgacagagctctgggt

SEQ ID NO: 4869771 - DNA, 13 bp, Homo sapiens
ctgacagccacac

SEQ ID NO: 4869772 - DNA, 14 bp, Homo sapiens
ctgaccaagtttct

SEQ ID NO: 4869773 - DNA, 13 bp, Homo sapiens
ctgaccccaaggg

SEQ ID NO: 4869774 - DNA, 20 bp, Homo sapiens
ctgaccccaagggggctgct

SEQ ID NO: 4869775 - DNA, 21 bp, Homo sapiens
ctgaccccaagggggctgctg

SEQ ID NO: 4869776 - DNA, 23 bp, Homo sapiens
ctgacctggcatctaattctgat

SEQ ID NO: 4869777 - DNA, 15 bp, Homo sapiens
ctgactccaaagctg

SEQ ID NO: 4869778 - DNA, 18 bp, Homo sapiens
ctgactccaaagctgttc

SEQ ID NO: 4869779 - DNA, 16 bp, Homo sapiens
ctgactgccctccgaa

SEQ ID NO: 4869780 - DNA, 22 bp, Homo sapiens
ctgacttatggcatgactcttc

SEQ ID NO: 4869781 - DNA, 16 bp, Homo sapiens
ctgagacagtgaattt

SEQ ID NO: 4869782 - DNA, 16 bp, Homo sapiens
ctgagcagggatctgc

SEQ ID NO: 4869783 - DNA, 20 bp, Homo sapiens
ctgagcagggatctgccccc

SEQ ID NO: 4869784 - DNA, 18 bp, Homo sapiens
ctgagccctcctgagggc

SEQ ID NO: 4869785 - DNA, 14 bp, Homo sapiens
ctgaggactgattt

SEQ ID NO: 4869786 - DNA, 13 bp, Homo sapiens
ctgaggaggtgct

SEQ ID NO: 4869787 - DNA, 21 bp, Homo sapiens
ctgaggccaggacgtctgggg

SEQ ID NO: 4869788 - DNA, 18 bp, Homo sapiens
ctgaggcccagagaggga

SEQ ID NO: 4869789 - DNA, 17 bp, Homo sapiens
ctgaggctgagaaagct

SEQ ID NO: 4869790 - DNA, 17 bp, Homo sapiens
ctgataccatatgaatg

SEQ ID NO: 4869791 - DNA, 19 bp, Homo sapiens
ctgataccatatgaatgaa

SEQ ID NO: 4869792 - DNA, 20 bp, Homo sapiens
ctgataccatatgaatgaaa

SEQ ID NO: 4869793 - DNA, 21 bp, Homo sapiens
ctgataccattctattctcca

SEQ ID NO: 4869794 - DNA, 23 bp, Homo sapiens
ctgataccattctattctccaga

SEQ ID NO: 4869795 - DNA, 17 bp, Homo sapiens
ctgatcccatggccagg

SEQ ID NO: 4869796 - DNA, 15 bp, Homo sapiens
ctgatgagagaatgt

SEQ ID NO: 4869797 - DNA, 19 bp, Homo sapiens
ctgatgagagaatgtggaa

SEQ ID NO: 4869798 - DNA, 23 bp, Homo sapiens
ctgatgagtttcactgtactgca

SEQ ID NO: 4869799 - DNA, 15 bp, Homo sapiens
ctgatggagtgtgca

SEQ ID NO: 4869800 - DNA, 16 bp, Homo sapiens
ctgatgggtgcccttt

SEQ ID NO: 4869801 - DNA, 21 bp, Homo sapiens
ctgatgtcagctgctgttgaa

SEQ ID NO: 4869802 - DNA, 14 bp, Homo sapiens
ctgcaaaaagaaaa

SEQ ID NO: 4869803 - DNA, 15 bp, Homo sapiens
ctgcaaaaattatat

SEQ ID NO: 4869804 - DNA, 16 bp, Homo sapiens
ctgcaaagtcgccagt

SEQ ID NO: 4869805 - DNA, 19 bp, Homo sapiens
ctgcaaatactgtatattc

SEQ ID NO: 4869806 - DNA, 13 bp, Homo sapiens
ctgcacaggcaga

SEQ ID NO: 4869807 - DNA, 21 bp, Homo sapiens
ctgcagcagtcgcccaagcag

SEQ ID NO: 4869808 - DNA, 22 bp, Homo sapiens
ctgcagccttcatcagaactct

SEQ ID NO: 4869809 - DNA, 23 bp, Homo sapiens
ctgcagccttcatcagaactctt

SEQ ID NO: 4869810 - DNA, 23 bp, Homo sapiens
ctgcaggagggttggagtgctct

SEQ ID NO: 4869811 - DNA, 22 bp, Homo sapiens
ctgcataatgtttctggatttc

SEQ ID NO: 4869812 - DNA, 13 bp, Homo sapiens
ctgcatagccggt

SEQ ID NO: 4869813 - DNA, 21 bp, Homo sapiens
ctgcatgatttttgccctgcg

SEQ ID NO: 4869814 - DNA, 12 bp, Homo sapiens
ctgcatggggag

SEQ ID NO: 4869815 - DNA, 18 bp, Homo sapiens
ctgcatggggaggcagca

SEQ ID NO: 4869816 - DNA, 22 bp, Homo sapiens
ctgcatgtgacttctcccctgc

SEQ ID NO: 4869817 - DNA, 22 bp, Homo sapiens
ctgcatgtgtcatgaagaatgt

SEQ ID NO: 4869818 - DNA, 19 bp, Homo sapiens
ctgccaaaggatgtgatat

SEQ ID NO: 4869819 - DNA, 13 bp, Homo sapiens
ctgccaaggagca

SEQ ID NO: 4869820 - DNA, 21 bp, Homo sapiens
ctgccaaggagcatccttggc

SEQ ID NO: 4869821 - DNA, 18 bp, Homo sapiens
ctgccaatctgtacaaaa

SEQ ID NO: 4869822 - DNA, 12 bp, Homo sapiens
ctgccaccttca

SEQ ID NO: 4869823 - DNA, 19 bp, Homo sapiens
ctgccagctctcaggaccg

SEQ ID NO: 4869824 - DNA, 15 bp, Homo sapiens
ctgccaggggctctg

SEQ ID NO: 4869825 - DNA, 17 bp, Homo sapiens
ctgccaggggctctgtg

SEQ ID NO: 4869826 - DNA, 18 bp, Homo sapiens
ctgccaggggctctgtgg

SEQ ID NO: 4869827 - DNA, 23 bp, Homo sapiens
ctgccatggctaggtagaagtga

SEQ ID NO: 4869828 - DNA, 23 bp, Homo sapiens
ctgccattacagaggtattaaaa

SEQ ID NO: 4869829 - DNA, 23 bp, Homo sapiens
ctgcccacaactcccttgcacgt

SEQ ID NO: 4869830 - DNA, 21 bp, Homo sapiens
ctgccccaagtggtgagcaag

SEQ ID NO: 4869831 - DNA, 19 bp, Homo sapiens
ctgcccgcctaagaccctg

SEQ ID NO: 4869832 - DNA, 21 bp, Homo sapiens
ctgccctccgaagagagttct

SEQ ID NO: 4869833 - DNA, 11 bp, Homo sapiens
ctgccctctgc

SEQ ID NO: 4869834 - DNA, 19 bp, Homo sapiens
ctgccctctgctctgcctg

SEQ ID NO: 4869835 - DNA, 15 bp, Homo sapiens
ctgccgtaatttaac

SEQ ID NO: 4869836 - DNA, 19 bp, Homo sapiens
ctgccgtagcttcagccag

SEQ ID NO: 4869837 - DNA, 20 bp, Homo sapiens
ctgccgtagcttcagccagg

SEQ ID NO: 4869838 - DNA, 19 bp, Homo sapiens
ctgccgttttctgggctga

SEQ ID NO: 4869839 - DNA, 14 bp, Homo sapiens
ctgcctggaggctc

SEQ ID NO: 4869840 - DNA, 16 bp, Homo sapiens
ctgcctggaggctcct

SEQ ID NO: 4869841 - DNA, 20 bp, Homo sapiens
ctgcctttgcagttggactc

SEQ ID NO: 4869842 - DNA, 19 bp, Homo sapiens
ctgctaaggctcctccttg

SEQ ID NO: 4869843 - DNA, 23 bp, Homo sapiens
ctgctatttttaatttcctgtga

SEQ ID NO: 4869844 - DNA, 22 bp, Homo sapiens
ctgctcaactctacccctgctc

SEQ ID NO: 4869845 - DNA, 21 bp, Homo sapiens
ctgctccatcggggcaggggg

SEQ ID NO: 4869846 - DNA, 17 bp, Homo sapiens
ctgctcccacaggggcc

SEQ ID NO: 4869847 - DNA, 14 bp, Homo sapiens
ctgctcccattcct

SEQ ID NO: 4869848 - DNA, 17 bp, Homo sapiens
ctgctcccattcctccc

SEQ ID NO: 4869849 - DNA, 18 bp, Homo sapiens
ctgctcccctaaagccag

SEQ ID NO: 4869850 - DNA, 22 bp, Homo sapiens
ctgctcccctaaagccaggctc

SEQ ID NO: 4869851 - DNA, 11 bp, Homo sapiens
ctgctcctctt

SEQ ID NO: 4869852 - DNA, 12 bp, Homo sapiens
ctgctcctcttg

SEQ ID NO: 4869853 - DNA, 13 bp, Homo sapiens
ctgctcctcttgt

SEQ ID NO: 4869854 - DNA, 15 bp, Homo sapiens
ctgctcctgtggcag

SEQ ID NO: 4869855 - DNA, 16 bp, Homo sapiens
ctgctcctgtggcagg

SEQ ID NO: 4869856 - DNA, 18 bp, Homo sapiens
ctgctcctgtggcaggag

SEQ ID NO: 4869857 - DNA, 16 bp, Homo sapiens
ctgctcctttaccctc

SEQ ID NO: 4869858 - DNA, 18 bp, Homo sapiens
ctgctcctttaccctctt

SEQ ID NO: 4869859 - DNA, 19 bp, Homo sapiens
ctgctcctttaccctcttg

SEQ ID NO: 4869860 - DNA, 15 bp, Homo sapiens
ctgctcggctactgg

SEQ ID NO: 4869861 - DNA, 16 bp, Homo sapiens
ctgctcggctactggt

SEQ ID NO: 4869862 - DNA, 14 bp, Homo sapiens
ctgctctgcctgga

SEQ ID NO: 4869863 - DNA, 15 bp, Homo sapiens
ctgctctgcctggag

SEQ ID NO: 4869864 - DNA, 21 bp, Homo sapiens
ctgctgcaaggtggcctctgc

SEQ ID NO: 4869865 - DNA, 22 bp, Homo sapiens
ctgctgcaaggtggcctctgcc

SEQ ID NO: 4869866 - DNA, 16 bp, Homo sapiens
ctgctgctgctgccgc

SEQ ID NO: 4869867 - DNA, 16 bp, Homo sapiens
ctgctggccggagcaa

SEQ ID NO: 4869868 - DNA, 21 bp, Homo sapiens
ctgctgggccccatctccaca

SEQ ID NO: 4869869 - DNA, 19 bp, Homo sapiens
ctgctgggcgtgtgtgaca

SEQ ID NO: 4869870 - DNA, 16 bp, Homo sapiens
ctgctgttgaactttt

SEQ ID NO: 4869871 - DNA, 13 bp, Homo sapiens
ctgcttaattgct

SEQ ID NO: 4869872 - DNA, 23 bp, Homo sapiens
ctgcttcccacaactactagtgt

SEQ ID NO: 4869873 - DNA, 17 bp, Homo sapiens
ctgcttgactttccaga

SEQ ID NO: 4869874 - DNA, 22 bp, Homo sapiens
ctgcttgactttccagaatgac

SEQ ID NO: 4869875 - DNA, 17 bp, Homo sapiens
ctggaaccacattgaag

SEQ ID NO: 4869876 - DNA, 20 bp, Homo sapiens
ctggaaccacattgaagaat

SEQ ID NO: 4869877 - DNA, 12 bp, Homo sapiens
ctggaagaggga

SEQ ID NO: 4869878 - DNA, 23 bp, Homo sapiens
ctggacccttgattcattctgaa

SEQ ID NO: 4869879 - DNA, 14 bp, Homo sapiens
ctggactgcatggg

SEQ ID NO: 4869880 - DNA, 21 bp, Homo sapiens
ctggactgcatggggaggcag

SEQ ID NO: 4869881 - DNA, 23 bp, Homo sapiens
ctggactgcatggggaggcagca

SEQ ID NO: 4869882 - DNA, 20 bp, Homo sapiens
ctggactggaaagcacaaga

SEQ ID NO: 4869883 - DNA, 18 bp, Homo sapiens
ctggagcagccaaggccg

SEQ ID NO: 4869884 - DNA, 20 bp, Homo sapiens
ctggagcagccaaggccgcc

SEQ ID NO: 4869885 - DNA, 23 bp, Homo sapiens
ctggagcagcggattgctctgga

SEQ ID NO: 4869886 - DNA, 19 bp, Homo sapiens
ctggagcaggcccaatgct

SEQ ID NO: 4869887 - DNA, 21 bp, Homo sapiens
ctggagcaggcccaatgctgc

SEQ ID NO: 4869888 - DNA, 17 bp, Homo sapiens
ctggagcttcagccagg

SEQ ID NO: 4869889 - DNA, 20 bp, Homo sapiens
ctggagcttcagccaggtct

SEQ ID NO: 4869890 - DNA, 14 bp, Homo sapiens
ctggaggagcacac

SEQ ID NO: 4869891 - DNA, 18 bp, Homo sapiens
ctggaggtaaacaaagac

SEQ ID NO: 4869892 - DNA, 23 bp, Homo sapiens
ctggagtgtcggatcctgtgagt

SEQ ID NO: 4869893 - DNA, 17 bp, Homo sapiens
ctggatggaaagacaaa

SEQ ID NO: 4869894 - DNA, 21 bp, Homo sapiens
ctggatggaaagacaaactgc

SEQ ID NO: 4869895 - DNA, 15 bp, Homo sapiens
ctggatttgcagaag

SEQ ID NO: 4869896 - DNA, 21 bp, Homo sapiens
ctggcacaatgttggagcagc

SEQ ID NO: 4869897 - DNA, 19 bp, Homo sapiens
ctggcagatgagggctggc

SEQ ID NO: 4869898 - DNA, 12 bp, Homo sapiens
ctggccaggcag

SEQ ID NO: 4869899 - DNA, 14 bp, Homo sapiens
ctggccaggcaggg

SEQ ID NO: 4869900 - DNA, 18 bp, Homo sapiens
ctggccaggcagggagag

SEQ ID NO: 4869901 - DNA, 14 bp, Homo sapiens
ctggcccagtgcca

SEQ ID NO: 4869902 - DNA, 16 bp, Homo sapiens
ctggccctctagcttc

SEQ ID NO: 4869903 - DNA, 21 bp, Homo sapiens
ctggccggagcaaactctgct

SEQ ID NO: 4869904 - DNA, 18 bp, Homo sapiens
ctggccggagtcagtgcc

SEQ ID NO: 4869905 - DNA, 22 bp, Homo sapiens
ctggcctgagaattgaggggag

SEQ ID NO: 4869906 - DNA, 14 bp, Homo sapiens
ctggccttgcctcc

SEQ ID NO: 4869907 - DNA, 14 bp, Homo sapiens
ctggcggaggctgc

SEQ ID NO: 4869908 - DNA, 15 bp, Homo sapiens
ctggcggaggctgct

SEQ ID NO: 4869909 - DNA, 19 bp, Homo sapiens
ctggctgccgttttctggg

SEQ ID NO: 4869910 - DNA, 21 bp, Homo sapiens
ctggctgccgttttctgggct

SEQ ID NO: 4869911 - DNA, 19 bp, Homo sapiens
ctggcttcaaaaagccaca

SEQ ID NO: 4869912 - DNA, 20 bp, Homo sapiens
ctggcttcaaaaagccacag

SEQ ID NO: 4869913 - DNA, 22 bp, Homo sapiens
ctggcttcaaaaagccacagca

SEQ ID NO: 4869914 - DNA, 16 bp, Homo sapiens
ctggctttaagccttc

SEQ ID NO: 4869915 - DNA, 13 bp, Homo sapiens
ctgggaaggccag

SEQ ID NO: 4869916 - DNA, 23 bp, Homo sapiens
ctgggaaggccagccttgtacag

SEQ ID NO: 4869917 - DNA, 22 bp, Homo sapiens
ctgggacaccattaccaaaata

SEQ ID NO: 4869918 - DNA, 14 bp, Homo sapiens
ctgggacctgtggt

SEQ ID NO: 4869919 - DNA, 16 bp, Homo sapiens
ctgggacctgtggtca

SEQ ID NO: 4869920 - DNA, 21 bp, Homo sapiens
ctgggcaatgaggcagatagc

SEQ ID NO: 4869921 - DNA, 17 bp, Homo sapiens
ctgggcattagcaaggc

SEQ ID NO: 4869922 - DNA, 15 bp, Homo sapiens
ctgggcctcccctgg

SEQ ID NO: 4869923 - DNA, 23 bp, Homo sapiens
ctgggctcagcctggtttctggg

SEQ ID NO: 4869924 - DNA, 14 bp, Homo sapiens
ctgggctgtgagga

SEQ ID NO: 4869925 - DNA, 23 bp, Homo sapiens
ctgggcttggggtgtggggtggg

SEQ ID NO: 4869926 - DNA, 14 bp, Homo sapiens
ctgggctttgggaa

SEQ ID NO: 4869927 - DNA, 23 bp, Homo sapiens
ctggggacacaggatcctggcct

SEQ ID NO: 4869928 - DNA, 12 bp, Homo sapiens
ctggggcagggt

SEQ ID NO: 4869929 - DNA, 21 bp, Homo sapiens
ctggggcagggtggggggcca

SEQ ID NO: 4869930 - DNA, 15 bp, Homo sapiens
ctggggggcaggcct

SEQ ID NO: 4869931 - DNA, 22 bp, Homo sapiens
ctggggtcaccttctagttgcc

SEQ ID NO: 4869932 - DNA, 13 bp, Homo sapiens
ctggggtggagtg

SEQ ID NO: 4869933 - DNA, 15 bp, Homo sapiens
ctggggtggagtggg

SEQ ID NO: 4869934 - DNA, 15 bp, Homo sapiens
ctgggtttgggagcc

SEQ ID NO: 4869935 - DNA, 22 bp, Homo sapiens
ctgggtttgggagccaggactc

SEQ ID NO: 4869936 - DNA, 19 bp, Homo sapiens
ctggtaatattgacttgta

SEQ ID NO: 4869937 - DNA, 18 bp, Homo sapiens
ctggtgaacactgtgacc

SEQ ID NO: 4869938 - DNA, 14 bp, Homo sapiens
ctggttacctggag

SEQ ID NO: 4869939 - DNA, 22 bp, Homo sapiens
ctggttcggctctagggcctca

SEQ ID NO: 4869940 - DNA, 20 bp, Homo sapiens
ctggttctgaggccagaaag

SEQ ID NO: 4869941 - DNA, 21 bp, Homo sapiens
ctgtaaagatgtttatttcag

SEQ ID NO: 4869942 - DNA, 19 bp, Homo sapiens
ctgtaacttccaaataaat

SEQ ID NO: 4869943 - DNA, 18 bp, Homo sapiens
ctgtaatgctgcctcagg

SEQ ID NO: 4869944 - DNA, 23 bp, Homo sapiens
ctgtaatgctgcctcaggaccca

SEQ ID NO: 4869945 - DNA, 13 bp, Homo sapiens
ctgtacaaaatgg

SEQ ID NO: 4869946 - DNA, 14 bp, Homo sapiens
ctgtacaaaatggt

SEQ ID NO: 4869947 - DNA, 19 bp, Homo sapiens
ctgtactaaggagaaatga

SEQ ID NO: 4869948 - DNA, 12 bp, Homo sapiens
ctgtactgcatg

SEQ ID NO: 4869949 - DNA, 15 bp, Homo sapiens
ctgtactgcatgtga

SEQ ID NO: 4869950 - DNA, 18 bp, Homo sapiens
ctgtactgcatgtgactt

SEQ ID NO: 4869951 - DNA, 16 bp, Homo sapiens
ctgtagagccaattag

SEQ ID NO: 4869952 - DNA, 22 bp, Homo sapiens
ctgtatgggggagattgaactt

SEQ ID NO: 4869953 - DNA, 16 bp, Homo sapiens
ctgtcaatgagagcat

SEQ ID NO: 4869954 - DNA, 17 bp, Homo sapiens
ctgtcactgtccagagt

SEQ ID NO: 4869955 - DNA, 18 bp, Homo sapiens
ctgtcagtggggcagcct

SEQ ID NO: 4869956 - DNA, 15 bp, Homo sapiens
ctgtccagagtctct

SEQ ID NO: 4869957 - DNA, 23 bp, Homo sapiens
ctgtccctagggctctccaagca

SEQ ID NO: 4869958 - DNA, 20 bp, Homo sapiens
ctgtccgtgccccttccctg

SEQ ID NO: 4869959 - DNA, 21 bp, Homo sapiens
ctgtcctattatattcattct

SEQ ID NO: 4869960 - DNA, 18 bp, Homo sapiens
ctgtccttcccccagcac

SEQ ID NO: 4869961 - DNA, 16 bp, Homo sapiens
ctgtctcttggctttg

SEQ ID NO: 4869962 - DNA, 13 bp, Homo sapiens
ctgtcttctttct

SEQ ID NO: 4869963 - DNA, 22 bp, Homo sapiens
ctgtcttctttctccatggagc

SEQ ID NO: 4869964 - DNA, 23 bp, Homo sapiens
ctgtcttctttctccatggagcc

SEQ ID NO: 4869965 - DNA, 23 bp, Homo sapiens
ctgtgactcttagccctcaccac

SEQ ID NO: 4869966 - DNA, 23 bp, Homo sapiens
ctgtgagcacaaagaagaaagct

SEQ ID NO: 4869967 - DNA, 19 bp, Homo sapiens
ctgtgagcatggggccagg

SEQ ID NO: 4869968 - DNA, 17 bp, Homo sapiens
ctgtgagccttgcatga

SEQ ID NO: 4869969 - DNA, 17 bp, Homo sapiens
ctgtgaggacagggccc

SEQ ID NO: 4869970 - DNA, 14 bp, Homo sapiens
ctgtgagtaggctg

SEQ ID NO: 4869971 - DNA, 16 bp, Homo sapiens
ctgtgattactgcaat

SEQ ID NO: 4869972 - DNA, 18 bp, Homo sapiens
ctgtgattactgcaatca

SEQ ID NO: 4869973 - DNA, 23 bp, Homo sapiens
ctgtgctatcggcagatgatgct

SEQ ID NO: 4869974 - DNA, 20 bp, Homo sapiens
ctgtgctccacactcagaaa

SEQ ID NO: 4869975 - DNA, 11 bp, Homo sapiens
ctgtgctgaac

SEQ ID NO: 4869976 - DNA, 11 bp, Homo sapiens
ctgtgctttgg

SEQ ID NO: 4869977 - DNA, 14 bp, Homo sapiens
ctgtgctttggaac

SEQ ID NO: 4869978 - DNA, 18 bp, Homo sapiens
ctgtggaaggcagagaaa

SEQ ID NO: 4869979 - DNA, 13 bp, Homo sapiens
ctgtggcaaaaag

SEQ ID NO: 4869980 - DNA, 22 bp, Homo sapiens
ctgtggcaaaaagagtcagaca

SEQ ID NO: 4869981 - DNA, 12 bp, Homo sapiens
ctgtggcaggag

SEQ ID NO: 4869982 - DNA, 14 bp, Homo sapiens
ctgtggcataaatt

SEQ ID NO: 4869983 - DNA, 15 bp, Homo sapiens
ctgtggcataaattg

SEQ ID NO: 4869984 - DNA, 15 bp, Homo sapiens
ctgtggccgtctcct

SEQ ID NO: 4869985 - DNA, 15 bp, Homo sapiens
ctgtggcctgcagga

SEQ ID NO: 4869986 - DNA, 19 bp, Homo sapiens
ctgtggctttcagcctctg

SEQ ID NO: 4869987 - DNA, 14 bp, Homo sapiens
ctgtggtcatgtga

SEQ ID NO: 4869988 - DNA, 18 bp, Homo sapiens
ctgtgtgaatacctgctc

SEQ ID NO: 4869989 - DNA, 17 bp, Homo sapiens
ctgtgtgaccctgggca

SEQ ID NO: 4869990 - DNA, 18 bp, Homo sapiens
ctgtgtgaccctgggcag

SEQ ID NO: 4869991 - DNA, 23 bp, Homo sapiens
ctgtgttactaaaaaaaagatga

SEQ ID NO: 4869992 - DNA, 16 bp, Homo sapiens
ctgtgtttatatggaa

SEQ ID NO: 4869993 - DNA, 16 bp, Homo sapiens
ctgtgttttgaaagaa

SEQ ID NO: 4869994 - DNA, 22 bp, Homo sapiens
ctgttaaggacccttttaagca

SEQ ID NO: 4869995 - DNA, 21 bp, Homo sapiens
ctgttacttatgtagaaactg

SEQ ID NO: 4869996 - DNA, 14 bp, Homo sapiens
ctgttagcagagtc

SEQ ID NO: 4869997 - DNA, 15 bp, Homo sapiens
ctgttagcagagtct

SEQ ID NO: 4869998 - DNA, 19 bp, Homo sapiens
ctgttagcagagtctgtct

SEQ ID NO: 4869999 - DNA, 20 bp, Homo sapiens
ctgttagcagagtctgtctc

SEQ ID NO: 4870000 - DNA, 23 bp, Homo sapiens
ctgttagcagagtctgtctcttg

SEQ ID NO: 4870001 - DNA, 17 bp, Homo sapiens
ctgttatcagtaatgct

SEQ ID NO: 4870002 - DNA, 20 bp, Homo sapiens
ctgttatcagtaatgctaaa

SEQ ID NO: 4870003 - DNA, 13 bp, Homo sapiens
ctgttatgggctt

SEQ ID NO: 4870004 - DNA, 22 bp, Homo sapiens
ctgttcagctactcccactccc

SEQ ID NO: 4870005 - DNA, 13 bp, Homo sapiens
ctgttccattaca

SEQ ID NO: 4870006 - DNA, 21 bp, Homo sapiens
ctgttccattacaccacagca

SEQ ID NO: 4870007 - DNA, 14 bp, Homo sapiens
ctgttcccccaccc

SEQ ID NO: 4870008 - DNA, 13 bp, Homo sapiens
ctgttcccttgca

SEQ ID NO: 4870009 - DNA, 15 bp, Homo sapiens
ctgttgataaaaact

SEQ ID NO: 4870010 - DNA, 16 bp, Homo sapiens
ctgttgcacttttgaa

SEQ ID NO: 4870011 - DNA, 19 bp, Homo sapiens
ctgttgtaagaattctgat

SEQ ID NO: 4870012 - DNA, 19 bp, Homo sapiens
cttaaacgaagagttccct

SEQ ID NO: 4870013 - DNA, 14 bp, Homo sapiens
cttaaactaaatgt

SEQ ID NO: 4870014 - DNA, 12 bp, Homo sapiens
cttaaatttaat

SEQ ID NO: 4870015 - DNA, 23 bp, Homo sapiens
cttaagtcctaaaagttctcaat

SEQ ID NO: 4870016 - DNA, 21 bp, Homo sapiens
cttacaacccagggtgtgaac

SEQ ID NO: 4870017 - DNA, 18 bp, Homo sapiens
cttacaagcctaagaatc

SEQ ID NO: 4870018 - DNA, 16 bp, Homo sapiens
cttacagcctctgact

SEQ ID NO: 4870019 - DNA, 12 bp, Homo sapiens
cttacaggagcc

SEQ ID NO: 4870020 - DNA, 15 bp, Homo sapiens
cttacaggagccagc

SEQ ID NO: 4870021 - DNA, 19 bp, Homo sapiens
cttacaggagccagcctgc

SEQ ID NO: 4870022 - DNA, 19 bp, Homo sapiens
cttaccccaaagagaaaga

SEQ ID NO: 4870023 - DNA, 18 bp, Homo sapiens
cttacctgggcacaaaca

SEQ ID NO: 4870024 - DNA, 22 bp, Homo sapiens
cttacctgggcacaaacagaat

SEQ ID NO: 4870025 - DNA, 23 bp, Homo sapiens
cttacttcaaagtgcctgggctc

SEQ ID NO: 4870026 - DNA, 21 bp, Homo sapiens
cttacttttaaggataaatca

SEQ ID NO: 4870027 - DNA, 20 bp, Homo sapiens
cttagagattgcatttttat

SEQ ID NO: 4870028 - DNA, 14 bp, Homo sapiens
cttagcatggtacc

SEQ ID NO: 4870029 - DNA, 15 bp, Homo sapiens
cttagctgaggctga

SEQ ID NO: 4870030 - DNA, 18 bp, Homo sapiens
cttagctgaggctgagaa

SEQ ID NO: 4870031 - DNA, 21 bp, Homo sapiens
cttagctgaggctgagaaagc

SEQ ID NO: 4870032 - DNA, 21 bp, Homo sapiens
cttaggctactgtaatgctgc

SEQ ID NO: 4870033 - DNA, 23 bp, Homo sapiens
cttagggactacccatagacatg

SEQ ID NO: 4870034 - DNA, 19 bp, Homo sapiens
cttataacctagttaaaga

SEQ ID NO: 4870035 - DNA, 21 bp, Homo sapiens
cttatagtctaagactatata

SEQ ID NO: 4870036 - DNA, 14 bp, Homo sapiens
cttatctctttcca

SEQ ID NO: 4870037 - DNA, 24 bp, Homo sapiens
cttatctgaaaggccagcagctga

SEQ ID NO: 4870038 - DNA, 15 bp, Homo sapiens
cttatgtagaaactg

SEQ ID NO: 4870039 - DNA, 22 bp, Homo sapiens
cttatgtagaaactgaggccca

SEQ ID NO: 4870040 - DNA, 13 bp, Homo sapiens
cttattgaatata

SEQ ID NO: 4870041 - DNA, 17 bp, Homo sapiens
cttattttctcaatctc

SEQ ID NO: 4870042 - DNA, 22 bp, Homo sapiens
cttattttgttggtgctttgca

SEQ ID NO: 4870043 - DNA, 21 bp, Homo sapiens
cttcaaaaagccacagcagag

SEQ ID NO: 4870044 - DNA, 22 bp, Homo sapiens
cttcaaaaagccacagcagagc

SEQ ID NO: 4870045 - DNA, 15 bp, Homo sapiens
cttcaaagccttctc

SEQ ID NO: 4870046 - DNA, 13 bp, Homo sapiens
cttcaaagtgcct

SEQ ID NO: 4870047 - DNA, 14 bp, Homo sapiens
cttcaaagtgcctg

SEQ ID NO: 4870048 - DNA, 16 bp, Homo sapiens
cttcaaagtgcctggg

SEQ ID NO: 4870049 - DNA, 18 bp, Homo sapiens
cttcaaagtgcctgggct

SEQ ID NO: 4870050 - DNA, 14 bp, Homo sapiens
cttcaacagccaag

SEQ ID NO: 4870051 - DNA, 21 bp, Homo sapiens
cttcaacagccaagctggcac

SEQ ID NO: 4870052 - DNA, 19 bp, Homo sapiens
cttcaaccccgaggtccct

SEQ ID NO: 4870053 - DNA, 16 bp, Homo sapiens
cttcaaggctcttctt

SEQ ID NO: 4870054 - DNA, 22 bp, Homo sapiens
cttcaatttctagtacctgtga

SEQ ID NO: 4870055 - DNA, 14 bp, Homo sapiens
cttcacctccttct

SEQ ID NO: 4870056 - DNA, 16 bp, Homo sapiens
cttcacctccttctgc

SEQ ID NO: 4870057 - DNA, 17 bp, Homo sapiens
cttcactcaaattttgg

SEQ ID NO: 4870058 - DNA, 15 bp, Homo sapiens
cttcagcattgtaat

SEQ ID NO: 4870059 - DNA, 16 bp, Homo sapiens
cttcagcattgtaatt

SEQ ID NO: 4870060 - DNA, 23 bp, Homo sapiens
cttcagcattgtaattatgtaaa

SEQ ID NO: 4870061 - DNA, 15 bp, Homo sapiens
cttcagccaggcaag

SEQ ID NO: 4870062 - DNA, 22 bp, Homo sapiens
cttcagccaggtctgactccaa

SEQ ID NO: 4870063 - DNA, 18 bp, Homo sapiens
cttcaggagcctggccag

SEQ ID NO: 4870064 - DNA, 22 bp, Homo sapiens
cttcaggagcctggccaggcag

SEQ ID NO: 4870065 - DNA, 18 bp, Homo sapiens
cttcaggcagctgaaatt

SEQ ID NO: 4870066 - DNA, 23 bp, Homo sapiens
cttcagttgcttgtcttctggta

SEQ ID NO: 4870067 - DNA, 14 bp, Homo sapiens
cttcatcagaactc

SEQ ID NO: 4870068 - DNA, 22 bp, Homo sapiens
cttcatcagaactcttcctcct

SEQ ID NO: 4870069 - DNA, 13 bp, Homo sapiens
cttcatccatcct

SEQ ID NO: 4870070 - DNA, 15 bp, Homo sapiens
cttcatccatcctga

SEQ ID NO: 4870071 - DNA, 16 bp, Homo sapiens
cttcatccatcctgag

SEQ ID NO: 4870072 - DNA, 22 bp, Homo sapiens
cttcatccatcctgagccaaat

SEQ ID NO: 4870073 - DNA, 20 bp, Homo sapiens
cttcatgcctgatgaaagct

SEQ ID NO: 4870074 - DNA, 21 bp, Homo sapiens
cttcatgtaattttattttaa

SEQ ID NO: 4870075 - DNA, 11 bp, Homo sapiens
cttcatttgta

SEQ ID NO: 4870076 - DNA, 13 bp, Homo sapiens
cttccacccacaa

SEQ ID NO: 4870077 - DNA, 17 bp, Homo sapiens
cttccacccacaaactc

SEQ ID NO: 4870078 - DNA, 22 bp, Homo sapiens
cttccagagaacctgtgggctg

SEQ ID NO: 4870079 - DNA, 15 bp, Homo sapiens
cttcccaacagatca

SEQ ID NO: 4870080 - DNA, 14 bp, Homo sapiens
cttcccactccagc

SEQ ID NO: 4870081 - DNA, 15 bp, Homo sapiens
cttcccatctgaaga

SEQ ID NO: 4870082 - DNA, 13 bp, Homo sapiens
cttcccatgcatt

SEQ ID NO: 4870083 - DNA, 23 bp, Homo sapiens
cttcccccagcacaaagcactgg

SEQ ID NO: 4870084 - DNA, 19 bp, Homo sapiens
cttccctgggtttgggagc

SEQ ID NO: 4870085 - DNA, 15 bp, Homo sapiens
cttcctcctcccaag

SEQ ID NO: 4870086 - DNA, 13 bp, Homo sapiens
cttcctctcaggc

SEQ ID NO: 4870087 - DNA, 16 bp, Homo sapiens
cttcctcttgtctgat

SEQ ID NO: 4870088 - DNA, 18 bp, Homo sapiens
cttcctcttgtctgattt

SEQ ID NO: 4870089 - DNA, 23 bp, Homo sapiens
cttcctggcacaatgttggagca

SEQ ID NO: 4870090 - DNA, 19 bp, Homo sapiens
cttccttctcatcttgcct

SEQ ID NO: 4870091 - DNA, 18 bp, Homo sapiens
cttcgactactgctcctg

SEQ ID NO: 4870092 - DNA, 15 bp, Homo sapiens
cttctaaattcccaa

SEQ ID NO: 4870093 - DNA, 17 bp, Homo sapiens
cttctaccctttgtccc

SEQ ID NO: 4870094 - DNA, 22 bp, Homo sapiens
cttctatttatttatttattca

SEQ ID NO: 4870095 - DNA, 14 bp, Homo sapiens
cttctcatgtatat

SEQ ID NO: 4870096 - DNA, 16 bp, Homo sapiens
cttctcccctgccctt

SEQ ID NO: 4870097 - DNA, 16 bp, Homo sapiens
cttctctgctgagaag

SEQ ID NO: 4870098 - DNA, 17 bp, Homo sapiens
cttctctttggggctcc

SEQ ID NO: 4870099 - DNA, 18 bp, Homo sapiens
cttctctttggggctcct

SEQ ID NO: 4870100 - DNA, 18 bp, Homo sapiens
cttctgcaacaagcatgc

SEQ ID NO: 4870101 - DNA, 17 bp, Homo sapiens
cttctgcagtcagactg

SEQ ID NO: 4870102 - DNA, 18 bp, Homo sapiens
cttctgcagtcagactga

SEQ ID NO: 4870103 - DNA, 19 bp, Homo sapiens
cttctgcctcccactccat

SEQ ID NO: 4870104 - DNA, 17 bp, Homo sapiens
cttctgggtccagggag

SEQ ID NO: 4870105 - DNA, 20 bp, Homo sapiens
cttctgtaattgtgtggatt

SEQ ID NO: 4870106 - DNA, 14 bp, Homo sapiens
cttctgtatttcct

SEQ ID NO: 4870107 - DNA, 16 bp, Homo sapiens
cttcttgaatataaaa

SEQ ID NO: 4870108 - DNA, 19 bp, Homo sapiens
cttcttgaatataaaaaat

SEQ ID NO: 4870109 - DNA, 19 bp, Homo sapiens
cttctttggacttctgaag

SEQ ID NO: 4870110 - DNA, 16 bp, Homo sapiens
cttctttggttccatg

SEQ ID NO: 4870111 - DNA, 14 bp, Homo sapiens
cttgaaaaaaaaca

SEQ ID NO: 4870112 - DNA, 14 bp, Homo sapiens
cttgaaacctgatg

SEQ ID NO: 4870113 - DNA, 16 bp, Homo sapiens
cttgaatataaaaaat

SEQ ID NO: 4870114 - DNA, 20 bp, Homo sapiens
cttgaatataaaaaatcatg

SEQ ID NO: 4870115 - DNA, 13 bp, Homo sapiens
cttgacacctgct

SEQ ID NO: 4870116 - DNA, 15 bp, Homo sapiens
cttgacacctgctga

SEQ ID NO: 4870117 - DNA, 19 bp, Homo sapiens
cttgactacctactggtgt

SEQ ID NO: 4870118 - DNA, 14 bp, Homo sapiens
cttgactttccaga

SEQ ID NO: 4870119 - DNA, 13 bp, Homo sapiens
cttgagtctctga

SEQ ID NO: 4870120 - DNA, 17 bp, Homo sapiens
cttgatggggtgagaag

SEQ ID NO: 4870121 - DNA, 15 bp, Homo sapiens
cttgattcattctga

SEQ ID NO: 4870122 - DNA, 15 bp, Homo sapiens
cttgcaacccaaggt

SEQ ID NO: 4870123 - DNA, 20 bp, Homo sapiens
cttgcaacccaaggtgaggt

SEQ ID NO: 4870124 - DNA, 14 bp, Homo sapiens
cttgcagaactgta

SEQ ID NO: 4870125 - DNA, 19 bp, Homo sapiens
cttgcagatatctgcatgt

SEQ ID NO: 4870126 - DNA, 15 bp, Homo sapiens
cttgcagcggctcct

SEQ ID NO: 4870127 - DNA, 17 bp, Homo sapiens
cttgcagcggctcctgc

SEQ ID NO: 4870128 - DNA, 18 bp, Homo sapiens
cttgcagcggctcctgca

SEQ ID NO: 4870129 - DNA, 19 bp, Homo sapiens
cttgcaggggtcccccctc

SEQ ID NO: 4870130 - DNA, 22 bp, Homo sapiens
cttgcagttagactcaaagaag

SEQ ID NO: 4870131 - DNA, 13 bp, Homo sapiens
cttgcatggagaa

SEQ ID NO: 4870132 - DNA, 19 bp, Homo sapiens
cttgcccagactacagggc

SEQ ID NO: 4870133 - DNA, 12 bp, Homo sapiens
cttgctcccaac

SEQ ID NO: 4870134 - DNA, 22 bp, Homo sapiens
cttgctgatcagagttcctcct

SEQ ID NO: 4870135 - DNA, 18 bp, Homo sapiens
cttgctgggctttgggaa

SEQ ID NO: 4870136 - DNA, 12 bp, Homo sapiens
cttgcttcctga

SEQ ID NO: 4870137 - DNA, 14 bp, Homo sapiens
cttgcttccttctc

SEQ ID NO: 4870138 - DNA, 15 bp, Homo sapiens
cttgcttccttctca

SEQ ID NO: 4870139 - DNA, 20 bp, Homo sapiens
cttggaaattcctgtactgt

SEQ ID NO: 4870140 - DNA, 16 bp, Homo sapiens
cttggaagctgtttgg

SEQ ID NO: 4870141 - DNA, 17 bp, Homo sapiens
cttggcccccttcagga

SEQ ID NO: 4870142 - DNA, 20 bp, Homo sapiens
cttgggcttcaacagccaag

SEQ ID NO: 4870143 - DNA, 15 bp, Homo sapiens
cttggggaaggggcc

SEQ ID NO: 4870144 - DNA, 11 bp, Homo sapiens
cttggggaggc

SEQ ID NO: 4870145 - DNA, 23 bp, Homo sapiens
cttgggtagggtagtggctgggg

SEQ ID NO: 4870146 - DNA, 16 bp, Homo sapiens
cttggttctgtgaaca

SEQ ID NO: 4870147 - DNA, 22 bp, Homo sapiens
cttggtttgttatatcagggaa

SEQ ID NO: 4870148 - DNA, 21 bp, Homo sapiens
cttgtatagcatgaaataaaa

SEQ ID NO: 4870149 - DNA, 18 bp, Homo sapiens
cttgtattatctcctttg

SEQ ID NO: 4870150 - DNA, 19 bp, Homo sapiens
cttgtgagagcccattccc

SEQ ID NO: 4870151 - DNA, 14 bp, Homo sapiens
cttgtgggagacag

SEQ ID NO: 4870152 - DNA, 16 bp, Homo sapiens
cttgtgggagacagca

SEQ ID NO: 4870153 - DNA, 16 bp, Homo sapiens
cttgtgttcagaagaa

SEQ ID NO: 4870154 - DNA, 19 bp, Homo sapiens
cttgtttacctttctctct

SEQ ID NO: 4870155 - DNA, 12 bp, Homo sapiens
ctttaaattatg

SEQ ID NO: 4870156 - DNA, 18 bp, Homo sapiens
ctttaagccttcaaaact

SEQ ID NO: 4870157 - DNA, 16 bp, Homo sapiens
ctttagcttacctggg

SEQ ID NO: 4870158 - DNA, 20 bp, Homo sapiens
ctttagcttacctgggcaca

SEQ ID NO: 4870159 - DNA, 13 bp, Homo sapiens
ctttagtttttgg

SEQ ID NO: 4870160 - DNA, 11 bp, Homo sapiens
ctttatatttc

SEQ ID NO: 4870161 - DNA, 16 bp, Homo sapiens
ctttatatttcaataa

SEQ ID NO: 4870162 - DNA, 19 bp, Homo sapiens
ctttattaatgttttcaaa

SEQ ID NO: 4870163 - DNA, 14 bp, Homo sapiens
ctttattgcaatgc

SEQ ID NO: 4870164 - DNA, 15 bp, Homo sapiens
ctttcagaaatataa

SEQ ID NO: 4870165 - DNA, 24 bp, Homo sapiens
ctttcattaccctacagacagctt

SEQ ID NO: 4870166 - DNA, 17 bp, Homo sapiens
ctttccagaatgacctt

SEQ ID NO: 4870167 - DNA, 19 bp, Homo sapiens
ctttccagaatgaccttga

SEQ ID NO: 4870168 - DNA, 21 bp, Homo sapiens
ctttccagaatgaccttgagt

SEQ ID NO: 4870169 - DNA, 22 bp, Homo sapiens
ctttcccctctcatacataaaa

SEQ ID NO: 4870170 - DNA, 15 bp, Homo sapiens
ctttcctactttcta

SEQ ID NO: 4870171 - DNA, 12 bp, Homo sapiens
ctttcctccacc

SEQ ID NO: 4870172 - DNA, 13 bp, Homo sapiens
ctttcctccaccc

SEQ ID NO: 4870173 - DNA, 15 bp, Homo sapiens
ctttcctccacccat

SEQ ID NO: 4870174 - DNA, 22 bp, Homo sapiens
ctttcttcactctggcttcaaa

SEQ ID NO: 4870175 - DNA, 14 bp, Homo sapiens
ctttcttttaatga

SEQ ID NO: 4870176 - DNA, 19 bp, Homo sapiens
ctttcttttaatgatgcca

SEQ ID NO: 4870177 - DNA, 18 bp, Homo sapiens
ctttgaagaaggcaaggc

SEQ ID NO: 4870178 - DNA, 20 bp, Homo sapiens
ctttgactctataagcaaat

SEQ ID NO: 4870179 - DNA, 19 bp, Homo sapiens
ctttgatactaccagggtc

SEQ ID NO: 4870180 - DNA, 21 bp, Homo sapiens
ctttgcagttggactctcagg

SEQ ID NO: 4870181 - DNA, 23 bp, Homo sapiens
ctttgcagttggactctcaggga

SEQ ID NO: 4870182 - DNA, 16 bp, Homo sapiens
ctttgcattttgatat

SEQ ID NO: 4870183 - DNA, 17 bp, Homo sapiens
ctttggaagatgcagaa

SEQ ID NO: 4870184 - DNA, 19 bp, Homo sapiens
ctttggaagatgcagaagc

SEQ ID NO: 4870185 - DNA, 14 bp, Homo sapiens
ctttggacttctga

SEQ ID NO: 4870186 - DNA, 14 bp, Homo sapiens
ctttggattctaaa

SEQ ID NO: 4870187 - DNA, 18 bp, Homo sapiens
ctttggattctaaataca

SEQ ID NO: 4870188 - DNA, 22 bp, Homo sapiens
ctttgggaagtttgctgtgctt

SEQ ID NO: 4870189 - DNA, 17 bp, Homo sapiens
ctttgggaggctgaggc

SEQ ID NO: 4870190 - DNA, 14 bp, Homo sapiens
ctttggttccatgt

SEQ ID NO: 4870191 - DNA, 13 bp, Homo sapiens
ctttgtcagtgtt

SEQ ID NO: 4870192 - DNA, 22 bp, Homo sapiens
ctttgtctaagtagggccaggg

SEQ ID NO: 4870193 - DNA, 22 bp, Homo sapiens
ctttgtttgtcacaagtggtgt

SEQ ID NO: 4870194 - DNA, 23 bp, Homo sapiens
cttttaaggataaatcataaagt

SEQ ID NO: 4870195 - DNA, 16 bp, Homo sapiens
cttttaatccatttca

SEQ ID NO: 4870196 - DNA, 19 bp, Homo sapiens
cttttaatccatttcagga

SEQ ID NO: 4870197 - DNA, 20 bp, Homo sapiens
cttttaggagaaagtgtatt

SEQ ID NO: 4870198 - DNA, 13 bp, Homo sapiens
cttttataaagca

SEQ ID NO: 4870199 - DNA, 16 bp, Homo sapiens
cttttataaagcatgt

SEQ ID NO: 4870200 - DNA, 17 bp, Homo sapiens
cttttctctggtaatat

SEQ ID NO: 4870201 - DNA, 21 bp, Homo sapiens
cttttgaagcatagataatat

SEQ ID NO: 4870202 - DNA, 15 bp, Homo sapiens
cttttgtagatggcg

SEQ ID NO: 4870203 - DNA, 15 bp, Homo sapiens
cttttgtttggtaaa

SEQ ID NO: 4870204 - DNA, 18 bp, Homo sapiens
cttttgtttggtaaatgt

SEQ ID NO: 4870205 - DNA, 18 bp, Homo sapiens
ctttttaaaaattgttat

SEQ ID NO: 4870206 - DNA, 21 bp, Homo sapiens
ctttttaaaaattgttattta

SEQ ID NO: 4870207 - DNA, 21 bp, Homo sapiens
ctttttaaagaagtgcatgaa

SEQ ID NO: 4870208 - DNA, 22 bp, Homo sapiens
ctttttaaagaagtgcatgaaa

SEQ ID NO: 4870209 - DNA, 22 bp, Homo sapiens
ctttttacacttcacctccttc

SEQ ID NO: 4870210 - DNA, 13 bp, Homo sapiens
ctttttattaaaa

SEQ ID NO: 4870211 - DNA, 14 bp, Homo sapiens
ctttttcatagtaa

SEQ ID NO: 4870212 - DNA, 16 bp, Homo sapiens
gaaaaaaaacagtgga

SEQ ID NO: 4870213 - DNA, 18 bp, Homo sapiens
gaaaaaaagctgcaaaaa

SEQ ID NO: 4870214 - DNA, 12 bp, Homo sapiens
gaaaaatataaa

SEQ ID NO: 4870215 - DNA, 17 bp, Homo sapiens
gaaaaatataaaattat

SEQ ID NO: 4870216 - DNA, 14 bp, Homo sapiens
gaaaaccactttat

SEQ ID NO: 4870217 - DNA, 15 bp, Homo sapiens
gaaaagaaaacaaaa

SEQ ID NO: 4870218 - DNA, 19 bp, Homo sapiens
gaaaagataaagaccagaa

SEQ ID NO: 4870219 - DNA, 22 bp, Homo sapiens
gaaaagataaagaccagaaatt

SEQ ID NO: 4870220 - DNA, 13 bp, Homo sapiens
gaaaaggttgaat

SEQ ID NO: 4870221 - DNA, 20 bp, Homo sapiens
gaaaagtatattgataacct

SEQ ID NO: 4870222 - DNA, 13 bp, Homo sapiens
gaaaataactgaa

SEQ ID NO: 4870223 - DNA, 16 bp, Homo sapiens
gaaaatataatgatca

SEQ ID NO: 4870224 - DNA, 15 bp, Homo sapiens
gaaacaaataatttg

SEQ ID NO: 4870225 - DNA, 18 bp, Homo sapiens
gaaacaaataatttgaac

SEQ ID NO: 4870226 - DNA, 18 bp, Homo sapiens
gaaacaacatttatatgt

SEQ ID NO: 4870227 - DNA, 23 bp, Homo sapiens
gaaacactatttgtgacttttta

SEQ ID NO: 4870228 - DNA, 17 bp, Homo sapiens
gaaaccaacaagaacca

SEQ ID NO: 4870229 - DNA, 22 bp, Homo sapiens
gaaagagctaggaaccctggag

SEQ ID NO: 4870230 - DNA, 20 bp, Homo sapiens
gaaagcaaaggtgcactcca

SEQ ID NO: 4870231 - DNA, 22 bp, Homo sapiens
gaaagcaaaggtgcactccaga

SEQ ID NO: 4870232 - DNA, 15 bp, Homo sapiens
gaaagcttccttcaa

SEQ ID NO: 4870233 - DNA, 12 bp, Homo sapiens
gaaaggcagggc

SEQ ID NO: 4870234 - DNA, 21 bp, Homo sapiens
gaaaggccagcagctgatgct

SEQ ID NO: 4870235 - DNA, 17 bp, Homo sapiens
gaaaggtgtgaggagag

SEQ ID NO: 4870236 - DNA, 11 bp, Homo sapiens
gaaagtttttt

SEQ ID NO: 4870237 - DNA, 13 bp, Homo sapiens
gaaataataaaaa

SEQ ID NO: 4870238 - DNA, 23 bp, Homo sapiens
gaaataatgctacaattttaaga

SEQ ID NO: 4870239 - DNA, 15 bp, Homo sapiens
gaaatactcatgtgc

SEQ ID NO: 4870240 - DNA, 16 bp, Homo sapiens
gaaatagaattataac

SEQ ID NO: 4870241 - DNA, 13 bp, Homo sapiens
gaaatagacaaaa

SEQ ID NO: 4870242 - DNA, 19 bp, Homo sapiens
gaaatagacaaaaagtata

SEQ ID NO: 4870243 - DNA, 19 bp, Homo sapiens
gaaataggatctccactgg

SEQ ID NO: 4870244 - DNA, 18 bp, Homo sapiens
gaaatataacacattttt

SEQ ID NO: 4870245 - DNA, 20 bp, Homo sapiens
gaaatatattacttaactgt

SEQ ID NO: 4870246 - DNA, 20 bp, Homo sapiens
gaaatcagtaatatttatat

SEQ ID NO: 4870247 - DNA, 15 bp, Homo sapiens
gaaatggaaagcaga

SEQ ID NO: 4870248 - DNA, 21 bp, Homo sapiens
gaaatggaggatctctaaaga

SEQ ID NO: 4870249 - DNA, 23 bp, Homo sapiens
gaaatggcctgtccctagggctc

SEQ ID NO: 4870250 - DNA, 13 bp, Homo sapiens
gaaattgcatact

SEQ ID NO: 4870251 - DNA, 20 bp, Homo sapiens
gaacactgtgaccaggcttt

SEQ ID NO: 4870252 - DNA, 19 bp, Homo sapiens
gaacagagtgcaacccagt

SEQ ID NO: 4870253 - DNA, 18 bp, Homo sapiens
gaacagccttagagctct

SEQ ID NO: 4870254 - DNA, 12 bp, Homo sapiens
gaacaggaaaga

SEQ ID NO: 4870255 - DNA, 17 bp, Homo sapiens
gaacaggaaagagctag

SEQ ID NO: 4870256 - DNA, 16 bp, Homo sapiens
gaacataacttctcat

SEQ ID NO: 4870257 - DNA, 22 bp, Homo sapiens
gaacataacttctcatgtatat

SEQ ID NO: 4870258 - DNA, 13 bp, Homo sapiens
gaaccataaattc

SEQ ID NO: 4870259 - DNA, 15 bp, Homo sapiens
gaaccataaattcaa

SEQ ID NO: 4870260 - DNA, 21 bp, Homo sapiens
gaacccccctcccacccaccg

SEQ ID NO: 4870261 - DNA, 13 bp, Homo sapiens
gaaccctccaaag

SEQ ID NO: 4870262 - DNA, 16 bp, Homo sapiens
gaaccctggaggtaaa

SEQ ID NO: 4870263 - DNA, 21 bp, Homo sapiens
gaaccgcagaagcctccccag

SEQ ID NO: 4870264 - DNA, 16 bp, Homo sapiens
gaacctctaagtgctg

SEQ ID NO: 4870265 - DNA, 14 bp, Homo sapiens
gaactcccccagag

SEQ ID NO: 4870266 - DNA, 24 bp, Homo sapiens
gaactcctgtcttctttctccatg

SEQ ID NO: 4870267 - DNA, 11 bp, Homo sapiens
gaactgaaatc

SEQ ID NO: 4870268 - DNA, 19 bp, Homo sapiens
gaactgaaatccttgagag

SEQ ID NO: 4870269 - DNA, 20 bp, Homo sapiens
gaactgtagctgccatggct

SEQ ID NO: 4870270 - DNA, 21 bp, Homo sapiens
gaagaaaatttgccaatcttt

SEQ ID NO: 4870271 - DNA, 12 bp, Homo sapiens
gaagaaagatgt

SEQ ID NO: 4870272 - DNA, 10 bp, Homo sapiens
gaagaaggca

SEQ ID NO: 4870273 - DNA, 16 bp, Homo sapiens
gaagaaggccagagag

SEQ ID NO: 4870274 - DNA, 17 bp, Homo sapiens
gaagaaggccagagagg

SEQ ID NO: 4870275 - DNA, 20 bp, Homo sapiens
gaagaaggccagagagggaa

SEQ ID NO: 4870276 - DNA, 19 bp, Homo sapiens
gaagaagtgagcagtgttg

SEQ ID NO: 4870277 - DNA, 20 bp, Homo sapiens
gaagaatcttcctggcacaa

SEQ ID NO: 4870278 - DNA, 12 bp, Homo sapiens
gaagaatgaaag

SEQ ID NO: 4870279 - DNA, 16 bp, Homo sapiens
gaagaatgaaagctgt

SEQ ID NO: 4870280 - DNA, 22 bp, Homo sapiens
gaagaattgaaaagtttttgtt

SEQ ID NO: 4870281 - DNA, 13 bp, Homo sapiens
gaagacctgaaag

SEQ ID NO: 4870282 - DNA, 15 bp, Homo sapiens
gaagacctgaaagag

SEQ ID NO: 4870283 - DNA, 20 bp, Homo sapiens
gaagagttcccttgaaactt

SEQ ID NO: 4870284 - DNA, 21 bp, Homo sapiens
gaagagttcccttgaaacttt

SEQ ID NO: 4870285 - DNA, 21 bp, Homo sapiens
gaagatagtcttggaagctgt

SEQ ID NO: 4870286 - DNA, 17 bp, Homo sapiens
gaagatctttatatttc

SEQ ID NO: 4870287 - DNA, 20 bp, Homo sapiens
gaagattctatgttaatatt

SEQ ID NO: 4870288 - DNA, 23 bp, Homo sapiens
gaagcaagaggcaagctgaaatt

SEQ ID NO: 4870289 - DNA, 16 bp, Homo sapiens
gaagcaataggtagct

SEQ ID NO: 4870290 - DNA, 13 bp, Homo sapiens
gaagcagtatttt

SEQ ID NO: 4870291 - DNA, 16 bp, Homo sapiens
gaagccaccgggagat

SEQ ID NO: 4870292 - DNA, 18 bp, Homo sapiens
gaagccagtgtctaggca

SEQ ID NO: 4870293 - DNA, 13 bp, Homo sapiens
gaagctggagcag

SEQ ID NO: 4870294 - DNA, 12 bp, Homo sapiens
gaaggagaatgg

SEQ ID NO: 4870295 - DNA, 19 bp, Homo sapiens
gaaggagaatggcatggca

SEQ ID NO: 4870296 - DNA, 13 bp, Homo sapiens
gaaggccagagag

SEQ ID NO: 4870297 - DNA, 17 bp, Homo sapiens
gaaggctctcaccccca

SEQ ID NO: 4870298 - DNA, 14 bp, Homo sapiens
gaagggaaagtttt

SEQ ID NO: 4870299 - DNA, 19 bp, Homo sapiens
gaagggagcattgcagcct

SEQ ID NO: 4870300 - DNA, 16 bp, Homo sapiens
gaaggggcctgggctg

SEQ ID NO: 4870301 - DNA, 19 bp, Homo sapiens
gaaggggctggtggagatg

SEQ ID NO: 4870302 - DNA, 15 bp, Homo sapiens
gaaggtagaatgttt

SEQ ID NO: 4870303 - DNA, 20 bp, Homo sapiens
gaaggtagaatgttttcaaa

SEQ ID NO: 4870304 - DNA, 17 bp, Homo sapiens
gaaggtgataagggaaa

SEQ ID NO: 4870305 - DNA, 20 bp, Homo sapiens
gaagtcagaatttttaactg

SEQ ID NO: 4870306 - DNA, 22 bp, Homo sapiens
gaagtcagaatttttaactgta

SEQ ID NO: 4870307 - DNA, 15 bp, Homo sapiens
gaagtttcaagtttt

SEQ ID NO: 4870308 - DNA, 21 bp, Homo sapiens
gaagtttcaagttttaaagtt

SEQ ID NO: 4870309 - DNA, 18 bp, Homo sapiens
gaataatttccttcaggc

SEQ ID NO: 4870310 - DNA, 22 bp, Homo sapiens
gaataatttccttcaggcagct

SEQ ID NO: 4870311 - DNA, 16 bp, Homo sapiens
gaatagatatgaaagc

SEQ ID NO: 4870312 - DNA, 19 bp, Homo sapiens
gaatagatatgaaagctga

SEQ ID NO: 4870313 - DNA, 13 bp, Homo sapiens
gaatattaaaaaa

SEQ ID NO: 4870314 - DNA, 15 bp, Homo sapiens
gaatcagacagcagg

SEQ ID NO: 4870315 - DNA, 16 bp, Homo sapiens
gaatcttgttttgaaa

SEQ ID NO: 4870316 - DNA, 20 bp, Homo sapiens
gaatgaaaataactgaattt

SEQ ID NO: 4870317 - DNA, 23 bp, Homo sapiens
gaatgaaaataactgaatttgga

SEQ ID NO: 4870318 - DNA, 16 bp, Homo sapiens
gaatgaagcagtattt

SEQ ID NO: 4870319 - DNA, 22 bp, Homo sapiens
gaatgaatgggatattttgaaa

SEQ ID NO: 4870320 - DNA, 16 bp, Homo sapiens
gaatgaggaaaattct

SEQ ID NO: 4870321 - DNA, 21 bp, Homo sapiens
gaatgcttttagtgtgtgcat

SEQ ID NO: 4870322 - DNA, 17 bp, Homo sapiens
gaatggcatggcaggag

SEQ ID NO: 4870323 - DNA, 19 bp, Homo sapiens
gaatggcatggcaggagtc

SEQ ID NO: 4870324 - DNA, 17 bp, Homo sapiens
gaatggccacaaacctg

SEQ ID NO: 4870325 - DNA, 20 bp, Homo sapiens
gaatggccacaaacctgccc

SEQ ID NO: 4870326 - DNA, 13 bp, Homo sapiens
gaatggcctggag

SEQ ID NO: 4870327 - DNA, 16 bp, Homo sapiens
gaatggcctggagcag

SEQ ID NO: 4870328 - DNA, 19 bp, Homo sapiens
gaatggcctggagcaggcc

SEQ ID NO: 4870329 - DNA, 21 bp, Homo sapiens
gaatgtcagttgttatttatt

SEQ ID NO: 4870330 - DNA, 19 bp, Homo sapiens
gaatgtgctggtgaacact

SEQ ID NO: 4870331 - DNA, 13 bp, Homo sapiens
gaatgttaaaggg

SEQ ID NO: 4870332 - DNA, 21 bp, Homo sapiens
gaattaatatccctacatgta

SEQ ID NO: 4870333 - DNA, 21 bp, Homo sapiens
gaattataactgtaaagatgt

SEQ ID NO: 4870334 - DNA, 15 bp, Homo sapiens
gaattctgattgatt

SEQ ID NO: 4870335 - DNA, 19 bp, Homo sapiens
gaattgaggggaggtggcc

SEQ ID NO: 4870336 - DNA, 20 bp, Homo sapiens
gaattgaggggaggtggcca

SEQ ID NO: 4870337 - DNA, 21 bp, Homo sapiens
gaattgaggggaggtggccag

SEQ ID NO: 4870338 - DNA, 15 bp, Homo sapiens
gaatttaatatatat

SEQ ID NO: 4870339 - DNA, 20 bp, Homo sapiens
gaatttgaggtctagagaga

SEQ ID NO: 4870340 - DNA, 18 bp, Homo sapiens
gacaaccattaaagtcag

SEQ ID NO: 4870341 - DNA, 19 bp, Homo sapiens
gacaaccattaaagtcaga

SEQ ID NO: 4870342 - DNA, 13 bp, Homo sapiens
gacaaccttgtcc

SEQ ID NO: 4870343 - DNA, 22 bp, Homo sapiens
gacaagagttggggacagaact

SEQ ID NO: 4870344 - DNA, 15 bp, Homo sapiens
gacaaggcctgcttg

SEQ ID NO: 4870345 - DNA, 14 bp, Homo sapiens
gacaagtgctgttg

SEQ ID NO: 4870346 - DNA, 23 bp, Homo sapiens
gacaccattaccaaaataataaa

SEQ ID NO: 4870347 - DNA, 18 bp, Homo sapiens
gacactgttgataaaaac

SEQ ID NO: 4870348 - DNA, 13 bp, Homo sapiens
gacagagctctgg

SEQ ID NO: 4870349 - DNA, 20 bp, Homo sapiens
gacagaggtttgaaggagaa

SEQ ID NO: 4870350 - DNA, 22 bp, Homo sapiens
gacagaggtttgaaggagaatg

SEQ ID NO: 4870351 - DNA, 16 bp, Homo sapiens
gacagcaagtgagcag

SEQ ID NO: 4870352 - DNA, 11 bp, Homo sapiens
gacagccacac

SEQ ID NO: 4870353 - DNA, 15 bp, Homo sapiens
gacagccatgcgtgg

SEQ ID NO: 4870354 - DNA, 15 bp, Homo sapiens
gacagctccgggatc

SEQ ID NO: 4870355 - DNA, 22 bp, Homo sapiens
gacagctggcggaggctgctcg

SEQ ID NO: 4870356 - DNA, 16 bp, Homo sapiens
gacagcttacaggagc

SEQ ID NO: 4870357 - DNA, 18 bp, Homo sapiens
gacagcttacaggagcca

SEQ ID NO: 4870358 - DNA, 16 bp, Homo sapiens
gacaggaaagagagga

SEQ ID NO: 4870359 - DNA, 20 bp, Homo sapiens
gacagggcccccacagggga

SEQ ID NO: 4870360 - DNA, 21 bp, Homo sapiens
gacaggtgcctaacctgggac

SEQ ID NO: 4870361 - DNA, 20 bp, Homo sapiens
gacagttgatggagccccag

SEQ ID NO: 4870362 - DNA, 21 bp, Homo sapiens
gacagttgatggagccccagg

SEQ ID NO: 4870363 - DNA, 14 bp, Homo sapiens
gacagtttttgaca

SEQ ID NO: 4870364 - DNA, 21 bp, Homo sapiens
gacatcatcattcttgtggga

SEQ ID NO: 4870365 - DNA, 14 bp, Homo sapiens
gacatctgacccca

SEQ ID NO: 4870366 - DNA, 15 bp, Homo sapiens
gacatctgaccccaa

SEQ ID NO: 4870367 - DNA, 17 bp, Homo sapiens
gacatgcaataaaattt

SEQ ID NO: 4870368 - DNA, 20 bp, Homo sapiens
gacatgcaataaaatttaaa

SEQ ID NO: 4870369 - DNA, 18 bp, Homo sapiens
gacatttatattaaataa

SEQ ID NO: 4870370 - DNA, 13 bp, Homo sapiens
gacatttctttgg

SEQ ID NO: 4870371 - DNA, 21 bp, Homo sapiens
gacatttgtgggcaagcagat

SEQ ID NO: 4870372 - DNA, 16 bp, Homo sapiens
gacattttatgtcttt

SEQ ID NO: 4870373 - DNA, 14 bp, Homo sapiens
gaccaaaatcagct

SEQ ID NO: 4870374 - DNA, 15 bp, Homo sapiens
gaccaatgcttgcat

SEQ ID NO: 4870375 - DNA, 15 bp, Homo sapiens
gaccagagctgtctg

SEQ ID NO: 4870376 - DNA, 22 bp, Homo sapiens
gaccagtttaagccgcagacct

SEQ ID NO: 4870377 - DNA, 17 bp, Homo sapiens
gacccatccctgcctgg

SEQ ID NO: 4870378 - DNA, 21 bp, Homo sapiens
gacccatccctgcctggaggc

SEQ ID NO: 4870379 - DNA, 18 bp, Homo sapiens
gaccccaagggggctgct

SEQ ID NO: 4870380 - DNA, 22 bp, Homo sapiens
gaccccaagggggctgctgctc

SEQ ID NO: 4870381 - DNA, 20 bp, Homo sapiens
gaccccagatacctgtgagg

SEQ ID NO: 4870382 - DNA, 22 bp, Homo sapiens
gaccccattcctgatcccatgg

SEQ ID NO: 4870383 - DNA, 20 bp, Homo sapiens
gacccttacagcctctgact

SEQ ID NO: 4870384 - DNA, 13 bp, Homo sapiens
gacccttttaagc

SEQ ID NO: 4870385 - DNA, 21 bp, Homo sapiens
gacctactaggagaggggggc

SEQ ID NO: 4870386 - DNA, 19 bp, Homo sapiens
gacctagctctttgggcct

SEQ ID NO: 4870387 - DNA, 15 bp, Homo sapiens
gacctccccacccgc

SEQ ID NO: 4870388 - DNA, 19 bp, Homo sapiens
gacctccccacccgctccc

SEQ ID NO: 4870389 - DNA, 14 bp, Homo sapiens
gacctccctgtctc

SEQ ID NO: 4870390 - DNA, 20 bp, Homo sapiens
gacctccttagccctgtctg

SEQ ID NO: 4870391 - DNA, 18 bp, Homo sapiens
gacctgaccccattcctg

SEQ ID NO: 4870392 - DNA, 12 bp, Homo sapiens
gacctgccccaa

SEQ ID NO: 4870393 - DNA, 17 bp, Homo sapiens
gacgctccctgctccac

SEQ ID NO: 4870394 - DNA, 14 bp, Homo sapiens
gacgggatgacctc

SEQ ID NO: 4870395 - DNA, 19 bp, Homo sapiens
gacgtctggggtgtgggga

SEQ ID NO: 4870396 - DNA, 20 bp, Homo sapiens
gacgtctggggtgtggggat

SEQ ID NO: 4870397 - DNA, 17 bp, Homo sapiens
gacgttaggccaggcct

SEQ ID NO: 4870398 - DNA, 19 bp, Homo sapiens
gactacttggaactaggct

SEQ ID NO: 4870399 - DNA, 23 bp, Homo sapiens
gactagaactcctgtcttctttc

SEQ ID NO: 4870400 - DNA, 24 bp, Homo sapiens
gactaggacctgagcctggtcctg

SEQ ID NO: 4870401 - DNA, 22 bp, Homo sapiens
gactaggttctgtagagccaat

SEQ ID NO: 4870402 - DNA, 18 bp, Homo sapiens
gactatatatataaatgt

SEQ ID NO: 4870403 - DNA, 19 bp, Homo sapiens
gactatatatataaatgta

SEQ ID NO: 4870404 - DNA, 15 bp, Homo sapiens
gactcagcagagtga

SEQ ID NO: 4870405 - DNA, 18 bp, Homo sapiens
gactcagtgaccagtgcc

SEQ ID NO: 4870406 - DNA, 13 bp, Homo sapiens
gactccaaagctg

SEQ ID NO: 4870407 - DNA, 22 bp, Homo sapiens
gactccaagccctggggcaggg

SEQ ID NO: 4870408 - DNA, 12 bp, Homo sapiens
gactctcaggga

SEQ ID NO: 4870409 - DNA, 14 bp, Homo sapiens
gactctctccagga

SEQ ID NO: 4870410 - DNA, 21 bp, Homo sapiens
gactctgcacccgcctcgacc

SEQ ID NO: 4870411 - DNA, 19 bp, Homo sapiens
gactcttatttatagaatt

SEQ ID NO: 4870412 - DNA, 23 bp, Homo sapiens
gactgacttatggcatgactctt

SEQ ID NO: 4870413 - DNA, 13 bp, Homo sapiens
gactgagccagat

SEQ ID NO: 4870414 - DNA, 17 bp, Homo sapiens
gactgcatggggaggca

SEQ ID NO: 4870415 - DNA, 22 bp, Homo sapiens
gactgctcctgggcattagcaa

SEQ ID NO: 4870416 - DNA, 15 bp, Homo sapiens
gactggaaagcacaa

SEQ ID NO: 4870417 - DNA, 16 bp, Homo sapiens
gactggaaagcacaag

SEQ ID NO: 4870418 - DNA, 24 bp, Homo sapiens
gactggcccagtgccagcaagtcc

SEQ ID NO: 4870419 - DNA, 18 bp, Homo sapiens
gactggttctgaggccag

SEQ ID NO: 4870420 - DNA, 15 bp, Homo sapiens
gactggttgtctctc

SEQ ID NO: 4870421 - DNA, 14 bp, Homo sapiens
gactgtcagtgggg

SEQ ID NO: 4870422 - DNA, 13 bp, Homo sapiens
gactgttgagtta

SEQ ID NO: 4870423 - DNA, 14 bp, Homo sapiens
gacttatggcatga

SEQ ID NO: 4870424 - DNA, 20 bp, Homo sapiens
gacttatggcatgactcttc

SEQ ID NO: 4870425 - DNA, 15 bp, Homo sapiens
gacttctcccctgcc

SEQ ID NO: 4870426 - DNA, 22 bp, Homo sapiens
gacttctcccctgcccttcctc

SEQ ID NO: 4870427 - DNA, 13 bp, Homo sapiens
gacttgaaagaaa

SEQ ID NO: 4870428 - DNA, 15 bp, Homo sapiens
gacttgcagttagac

SEQ ID NO: 4870429 - DNA, 14 bp, Homo sapiens
gactttccagaatg

SEQ ID NO: 4870430 - DNA, 14 bp, Homo sapiens
gagaaacccagaga

SEQ ID NO: 4870431 - DNA, 13 bp, Homo sapiens
gagaaatgcccca

SEQ ID NO: 4870432 - DNA, 20 bp, Homo sapiens
gagaaggggctttgtgacca

SEQ ID NO: 4870433 - DNA, 16 bp, Homo sapiens
gagaagtatacataag

SEQ ID NO: 4870434 - DNA, 20 bp, Homo sapiens
gagaagtcttctatttattt

SEQ ID NO: 4870435 - DNA, 16 bp, Homo sapiens
gagaatactgccaaaa

SEQ ID NO: 4870436 - DNA, 20 bp, Homo sapiens
gagaatggcctggagcaggc

SEQ ID NO: 4870437 - DNA, 21 bp, Homo sapiens
gagaatggcctggagcaggcc

SEQ ID NO: 4870438 - DNA, 22 bp, Homo sapiens
gagaatggcctggagcaggccc

SEQ ID NO: 4870439 - DNA, 20 bp, Homo sapiens
gagaatgggacgaggacatt

SEQ ID NO: 4870440 - DNA, 21 bp, Homo sapiens
gagaatgtattttcatagatg

SEQ ID NO: 4870441 - DNA, 16 bp, Homo sapiens
gagacactgttgataa

SEQ ID NO: 4870442 - DNA, 12 bp, Homo sapiens
gagacagcagcc

SEQ ID NO: 4870443 - DNA, 22 bp, Homo sapiens
gagacaggtgcctaacctggga

SEQ ID NO: 4870444 - DNA, 13 bp, Homo sapiens
gagacatgtgaca

SEQ ID NO: 4870445 - DNA, 20 bp, Homo sapiens
gagacgtttataaacagaaa

SEQ ID NO: 4870446 - DNA, 22 bp, Homo sapiens
gagactgataacttggggaggc

SEQ ID NO: 4870447 - DNA, 22 bp, Homo sapiens
gagactttgatactaccagggt

SEQ ID NO: 4870448 - DNA, 21 bp, Homo sapiens
gagagagttgttttaataact

SEQ ID NO: 4870449 - DNA, 15 bp, Homo sapiens
gagagatcaaagatg

SEQ ID NO: 4870450 - DNA, 23 bp, Homo sapiens
gagagccttacttcaaagtgcct

SEQ ID NO: 4870451 - DNA, 15 bp, Homo sapiens
gagagggaagatgac

SEQ ID NO: 4870452 - DNA, 20 bp, Homo sapiens
gagaggtagcactctcagag

SEQ ID NO: 4870453 - DNA, 23 bp, Homo sapiens
gagagtagctgcagccttcatca

SEQ ID NO: 4870454 - DNA, 15 bp, Homo sapiens
gagagttccggggag

SEQ ID NO: 4870455 - DNA, 19 bp, Homo sapiens
gagatactcttctgcctcc

SEQ ID NO: 4870456 - DNA, 17 bp, Homo sapiens
gagatcgggaagcagaa

SEQ ID NO: 4870457 - DNA, 17 bp, Homo sapiens
gagattcccaccttcca

SEQ ID NO: 4870458 - DNA, 20 bp, Homo sapiens
gagatttctggatggtggtg

SEQ ID NO: 4870459 - DNA, 21 bp, Homo sapiens
gagcacaaaattcaaagcatg

SEQ ID NO: 4870460 - DNA, 12 bp, Homo sapiens
gagcacaaagaa

SEQ ID NO: 4870461 - DNA, 13 bp, Homo sapiens
gagcagagctctc

SEQ ID NO: 4870462 - DNA, 22 bp, Homo sapiens
gagcagagctctcccctcctgc

SEQ ID NO: 4870463 - DNA, 17 bp, Homo sapiens
gagcagcaggcctctgg

SEQ ID NO: 4870464 - DNA, 20 bp, Homo sapiens
gagcagcaggcctctgggac

SEQ ID NO: 4870465 - DNA, 23 bp, Homo sapiens
gagcagcggattgctctggagca

SEQ ID NO: 4870466 - DNA, 22 bp, Homo sapiens
gagcaggcccaatgctgctttt

SEQ ID NO: 4870467 - DNA, 18 bp, Homo sapiens
gagcagggatctgccccc

SEQ ID NO: 4870468 - DNA, 15 bp, Homo sapiens
gagcagggtctctct

SEQ ID NO: 4870469 - DNA, 17 bp, Homo sapiens
gagcataatttaaaaat

SEQ ID NO: 4870470 - DNA, 12 bp, Homo sapiens
gagcatcctgat

SEQ ID NO: 4870471 - DNA, 24 bp, Homo sapiens
gagcattgcagcctaagaagaagg

SEQ ID NO: 4870472 - DNA, 22 bp, Homo sapiens
gagcatttaatggcagctagtg

SEQ ID NO: 4870473 - DNA, 22 bp, Homo sapiens
gagccaaaatggttaatttttc

SEQ ID NO: 4870474 - DNA, 16 bp, Homo sapiens
gagccaattagacttg

SEQ ID NO: 4870475 - DNA, 19 bp, Homo sapiens
gagccaattagacttgaaa

SEQ ID NO: 4870476 - DNA, 20 bp, Homo sapiens
gagccaattagacttgaaat

SEQ ID NO: 4870477 - DNA, 14 bp, Homo sapiens
gagccacttctccc

SEQ ID NO: 4870478 - DNA, 17 bp, Homo sapiens
gagccagcctgcttccc

SEQ ID NO: 4870479 - DNA, 18 bp, Homo sapiens
gagccagcctgcttccca

SEQ ID NO: 4870480 - DNA, 13 bp, Homo sapiens
gagccagctgctt

SEQ ID NO: 4870481 - DNA, 23 bp, Homo sapiens
gagccagctgcttgacctagctc

SEQ ID NO: 4870482 - DNA, 14 bp, Homo sapiens
gagccatacataaa

SEQ ID NO: 4870483 - DNA, 13 bp, Homo sapiens
gagcccattccca

SEQ ID NO: 4870484 - DNA, 14 bp, Homo sapiens
gagcccctactgtg

SEQ ID NO: 4870485 - DNA, 17 bp, Homo sapiens
gagccctattgctgcta

SEQ ID NO: 4870486 - DNA, 21 bp, Homo sapiens
gagcctacctctgtctgagac

SEQ ID NO: 4870487 - DNA, 16 bp, Homo sapiens
gagcctggccaggcag

SEQ ID NO: 4870488 - DNA, 19 bp, Homo sapiens
gagcctggccaggcaggga

SEQ ID NO: 4870489 - DNA, 20 bp, Homo sapiens
gagcctggccaggcagggag

SEQ ID NO: 4870490 - DNA, 20 bp, Homo sapiens
gagcctttttacctggccta

SEQ ID NO: 4870491 - DNA, 17 bp, Homo sapiens
gagcgagagatcaaaga

SEQ ID NO: 4870492 - DNA, 20 bp, Homo sapiens
gagcgagagatcaaagatga

SEQ ID NO: 4870493 - DNA, 16 bp, Homo sapiens
gagctactcccacagc

SEQ ID NO: 4870494 - DNA, 19 bp, Homo sapiens
gagctaggaaccctggagg

SEQ ID NO: 4870495 - DNA, 16 bp, Homo sapiens
gagctctcccctcctg

SEQ ID NO: 4870496 - DNA, 20 bp, Homo sapiens
gagctctcccctcctgctgg

SEQ ID NO: 4870497 - DNA, 22 bp, Homo sapiens
gagctctcccctcctgctgggc

SEQ ID NO: 4870498 - DNA, 21 bp, Homo sapiens
gagctcttcctatccctctcc

SEQ ID NO: 4870499 - DNA, 20 bp, Homo sapiens
gagctcttgtgttcagaaga

SEQ ID NO: 4870500 - DNA, 15 bp, Homo sapiens
gagcttgattaaatc

SEQ ID NO: 4870501 - DNA, 16 bp, Homo sapiens
gaggaaaagtcttcct

SEQ ID NO: 4870502 - DNA, 13 bp, Homo sapiens
gaggaaaattctt

SEQ ID NO: 4870503 - DNA, 18 bp, Homo sapiens
gaggaaccagaggcactt

SEQ ID NO: 4870504 - DNA, 20 bp, Homo sapiens
gaggacatttgtgggcaagc

SEQ ID NO: 4870505 - DNA, 23 bp, Homo sapiens
gaggacatttgtgggcaagcaga

SEQ ID NO: 4870506 - DNA, 24 bp, Homo sapiens
gaggaccaatgcttgcatggagaa

SEQ ID NO: 4870507 - DNA, 18 bp, Homo sapiens
gaggactcacttgcccac

SEQ ID NO: 4870508 - DNA, 21 bp, Homo sapiens
gaggacttggttgatgtttaa

SEQ ID NO: 4870509 - DNA, 20 bp, Homo sapiens
gaggatccagggcagcaggc

SEQ ID NO: 4870510 - DNA, 21 bp, Homo sapiens
gaggatccagggcagcaggcc

SEQ ID NO: 4870511 - DNA, 23 bp, Homo sapiens
gaggatccagggcagcaggccag

SEQ ID NO: 4870512 - DNA, 14 bp, Homo sapiens
gaggcaaaaatgtc

SEQ ID NO: 4870513 - DNA, 14 bp, Homo sapiens
gaggcaagagactg

SEQ ID NO: 4870514 - DNA, 13 bp, Homo sapiens
gaggcagcagagc

SEQ ID NO: 4870515 - DNA, 14 bp, Homo sapiens
gaggccagaaaggt

SEQ ID NO: 4870516 - DNA, 12 bp, Homo sapiens
gaggcccagaga

SEQ ID NO: 4870517 - DNA, 13 bp, Homo sapiens
gaggcccagagag

SEQ ID NO: 4870518 - DNA, 17 bp, Homo sapiens
gaggcccagagagggaa

SEQ ID NO: 4870519 - DNA, 18 bp, Homo sapiens
gaggcctcaccccaggga

SEQ ID NO: 4870520 - DNA, 16 bp, Homo sapiens
gaggctcagagaggta

SEQ ID NO: 4870521 - DNA, 21 bp, Homo sapiens
gaggctcctctaggccctgtg

SEQ ID NO: 4870522 - DNA, 19 bp, Homo sapiens
gagggaaaaggcaggtgct

SEQ ID NO: 4870523 - DNA, 20 bp, Homo sapiens
gagggaagacctgaaagaga

SEQ ID NO: 4870524 - DNA, 15 bp, Homo sapiens
gagggaatctagccc

SEQ ID NO: 4870525 - DNA, 16 bp, Homo sapiens
gagggaatctagccca

SEQ ID NO: 4870526 - DNA, 14 bp, Homo sapiens
gagggactccaagc

SEQ ID NO: 4870527 - DNA, 18 bp, Homo sapiens
gagggactccaagccctg

SEQ ID NO: 4870528 - DNA, 18 bp, Homo sapiens
gagggatgatgagggaag

SEQ ID NO: 4870529 - DNA, 22 bp, Homo sapiens
gagggatgatgagggaagcaat

SEQ ID NO: 4870530 - DNA, 13 bp, Homo sapiens
gagggcccctgcg

SEQ ID NO: 4870531 - DNA, 19 bp, Homo sapiens
gagggcccctgcgtggggg

SEQ ID NO: 4870532 - DNA, 20 bp, Homo sapiens
gagggcccctgcgtgggggc

SEQ ID NO: 4870533 - DNA, 20 bp, Homo sapiens
gagggccggttctaaggctc

SEQ ID NO: 4870534 - DNA, 16 bp, Homo sapiens
gaggggcgcgggaggg

SEQ ID NO: 4870535 - DNA, 20 bp, Homo sapiens
gagggtggttcaacaaagaa

SEQ ID NO: 4870536 - DNA, 15 bp, Homo sapiens
gagggttctaagtgg

SEQ ID NO: 4870537 - DNA, 17 bp, Homo sapiens
gaggtagcactctcaga

SEQ ID NO: 4870538 - DNA, 19 bp, Homo sapiens
gaggtgaactccaggcatg

SEQ ID NO: 4870539 - DNA, 18 bp, Homo sapiens
gaggtggatactgggggg

SEQ ID NO: 4870540 - DNA, 23 bp, Homo sapiens
gaggtggatactggggggcaggc

SEQ ID NO: 4870541 - DNA, 19 bp, Homo sapiens
gaggtttgaaggagaatgg

SEQ ID NO: 4870542 - DNA, 20 bp, Homo sapiens
gaggtttgaaggagaatggc

SEQ ID NO: 4870543 - DNA, 13 bp, Homo sapiens
gagtagggccctg

SEQ ID NO: 4870544 - DNA, 14 bp, Homo sapiens
gagtctctgccagt

SEQ ID NO: 4870545 - DNA, 11 bp, Homo sapiens
gagtctgggat

SEQ ID NO: 4870546 - DNA, 16 bp, Homo sapiens
gagtgactacacacag

SEQ ID NO: 4870547 - DNA, 15 bp, Homo sapiens
gagtgctcttcccac

SEQ ID NO: 4870548 - DNA, 21 bp, Homo sapiens
gagtgctcttcccactccagc

SEQ ID NO: 4870549 - DNA, 19 bp, Homo sapiens
gagtgtcggatcctgtgag

SEQ ID NO: 4870550 - DNA, 13 bp, Homo sapiens
gagtgtgcagaca

SEQ ID NO: 4870551 - DNA, 16 bp, Homo sapiens
gagtgtgcagacagcc

SEQ ID NO: 4870552 - DNA, 16 bp, Homo sapiens
gagttaacaggacagt

SEQ ID NO: 4870553 - DNA, 18 bp, Homo sapiens
gagttatcatgaatttta

SEQ ID NO: 4870554 - DNA, 22 bp, Homo sapiens
gagttatgataacaccagtggg

SEQ ID NO: 4870555 - DNA, 17 bp, Homo sapiens
gagttccggggagaaac

SEQ ID NO: 4870556 - DNA, 17 bp, Homo sapiens
gagttctggatgtctgg

SEQ ID NO: 4870557 - DNA, 19 bp, Homo sapiens
gagttctggatgtctggct

SEQ ID NO: 4870558 - DNA, 16 bp, Homo sapiens
gagttgattgtctagt

SEQ ID NO: 4870559 - DNA, 16 bp, Homo sapiens
gataaccttgaaaaaa

SEQ ID NO: 4870560 - DNA, 14 bp, Homo sapiens
gataagggaaaaga

SEQ ID NO: 4870561 - DNA, 16 bp, Homo sapiens
gataagggaaaagata

SEQ ID NO: 4870562 - DNA, 23 bp, Homo sapiens
gataccattctattctccagaca

SEQ ID NO: 4870563 - DNA, 12 bp, Homo sapiens
gatacctgtgag

SEQ ID NO: 4870564 - DNA, 14 bp, Homo sapiens
gatacctgtgagga

SEQ ID NO: 4870565 - DNA, 17 bp, Homo sapiens
gatactggggggcaggc

SEQ ID NO: 4870566 - DNA, 13 bp, Homo sapiens
gatagtaagcata

SEQ ID NO: 4870567 - DNA, 19 bp, Homo sapiens
gatagtgggatttccagaa

SEQ ID NO: 4870568 - DNA, 16 bp, Homo sapiens
gatataccaaattaaa

SEQ ID NO: 4870569 - DNA, 15 bp, Homo sapiens
gatatataagtgtac

SEQ ID NO: 4870570 - DNA, 20 bp, Homo sapiens
gatatatcatgagtgaataa

SEQ ID NO: 4870571 - DNA, 21 bp, Homo sapiens
gatatatcatgagtgaataaa

SEQ ID NO: 4870572 - DNA, 15 bp, Homo sapiens
gatatgaaagctgat

SEQ ID NO: 4870573 - DNA, 17 bp, Homo sapiens
gatattcagatgtatgt

SEQ ID NO: 4870574 - DNA, 13 bp, Homo sapiens
gatattgaatgtt

SEQ ID NO: 4870575 - DNA, 17 bp, Homo sapiens
gatccagggcagcaggc

SEQ ID NO: 4870576 - DNA, 17 bp, Homo sapiens
gatccagtataagacta

SEQ ID NO: 4870577 - DNA, 14 bp, Homo sapiens
gatccggaaagaag

SEQ ID NO: 4870578 - DNA, 22 bp, Homo sapiens
gatcggccatcaagggaagaac

SEQ ID NO: 4870579 - DNA, 20 bp, Homo sapiens
gatctacttctgtaattgtg

SEQ ID NO: 4870580 - DNA, 18 bp, Homo sapiens
gatctattgtttgttgca

SEQ ID NO: 4870581 - DNA, 20 bp, Homo sapiens
gatctgcttgatatcccaag

SEQ ID NO: 4870582 - DNA, 21 bp, Homo sapiens
gatgaaaagtatattgataac

SEQ ID NO: 4870583 - DNA, 14 bp, Homo sapiens
gatgaaacttctca

SEQ ID NO: 4870584 - DNA, 23 bp, Homo sapiens
gatgacagaggtttgaaggagaa

SEQ ID NO: 4870585 - DNA, 14 bp, Homo sapiens
gatgacctccagaa

SEQ ID NO: 4870586 - DNA, 15 bp, Homo sapiens
gatgacctccagaag

SEQ ID NO: 4870587 - DNA, 14 bp, Homo sapiens
gatgacctgcccca

SEQ ID NO: 4870588 - DNA, 13 bp, Homo sapiens
gatgagagaatgt

SEQ ID NO: 4870589 - DNA, 12 bp, Homo sapiens
gatgaggaccca

SEQ ID NO: 4870590 - DNA, 20 bp, Homo sapiens
gatgaggacccagagctgct

SEQ ID NO: 4870591 - DNA, 23 bp, Homo sapiens
gatgaggctcagagaggtagcac

SEQ ID NO: 4870592 - DNA, 19 bp, Homo sapiens
gatgaggtcagttgtgttt

SEQ ID NO: 4870593 - DNA, 24 bp, Homo sapiens
gatgagtttcactgtactgcatgt

SEQ ID NO: 4870594 - DNA, 13 bp, Homo sapiens
gatgataaaggaa

SEQ ID NO: 4870595 - DNA, 21 bp, Homo sapiens
gatgcaaatagattcagagaa

SEQ ID NO: 4870596 - DNA, 18 bp, Homo sapiens
gatgcatcatctcttcct

SEQ ID NO: 4870597 - DNA, 19 bp, Homo sapiens
gatgcatcatctcttcctc

SEQ ID NO: 4870598 - DNA, 22 bp, Homo sapiens
gatgcatttaataaagatgagt

SEQ ID NO: 4870599 - DNA, 17 bp, Homo sapiens
gatgctgggcaatgagg

SEQ ID NO: 4870600 - DNA, 18 bp, Homo sapiens
gatgctttggaagatgca

SEQ ID NO: 4870601 - DNA, 12 bp, Homo sapiens
gatggagcccat

SEQ ID NO: 4870602 - DNA, 13 bp, Homo sapiens
gatggagggaaga

SEQ ID NO: 4870603 - DNA, 22 bp, Homo sapiens
gatggagggaagacctgaaaga

SEQ ID NO: 4870604 - DNA, 13 bp, Homo sapiens
gatggcttgtcta

SEQ ID NO: 4870605 - DNA, 21 bp, Homo sapiens
gatggggtgagaagtacaggg

SEQ ID NO: 4870606 - DNA, 23 bp, Homo sapiens
gatggggtgagaagtacagggca

SEQ ID NO: 4870607 - DNA, 22 bp, Homo sapiens
gatgggtgccctttcctggcag

SEQ ID NO: 4870608 - DNA, 21 bp, Homo sapiens
gatgtaagtttgtgtaaatta

SEQ ID NO: 4870609 - DNA, 19 bp, Homo sapiens
gatgtgctataatctgttt

SEQ ID NO: 4870610 - DNA, 23 bp, Homo sapiens
gatgttgtcttagcatggtacct

SEQ ID NO: 4870611 - DNA, 22 bp, Homo sapiens
gattaaaaggtatactttagta

SEQ ID NO: 4870612 - DNA, 14 bp, Homo sapiens
gattactgcaatca

SEQ ID NO: 4870613 - DNA, 20 bp, Homo sapiens
gattagaaacaaacaaaact

SEQ ID NO: 4870614 - DNA, 19 bp, Homo sapiens
gattaggtttcagcagagc

SEQ ID NO: 4870615 - DNA, 17 bp, Homo sapiens
gattattttttttttct

SEQ ID NO: 4870616 - DNA, 13 bp, Homo sapiens
gattcagagaaat

SEQ ID NO: 4870617 - DNA, 14 bp, Homo sapiens
gattcagagaaatt

SEQ ID NO: 4870618 - DNA, 20 bp, Homo sapiens
gattctatgttaatatttta

SEQ ID NO: 4870619 - DNA, 20 bp, Homo sapiens
gattctttcagttctttgga

SEQ ID NO: 4870620 - DNA, 11 bp, Homo sapiens
gattgaacttt

SEQ ID NO: 4870621 - DNA, 13 bp, Homo sapiens
gattgctctggag

SEQ ID NO: 4870622 - DNA, 20 bp, Homo sapiens
gattgctctggagcagccaa

SEQ ID NO: 4870623 - DNA, 21 bp, Homo sapiens
gattggggggtgggctttgtt

SEQ ID NO: 4870624 - DNA, 18 bp, Homo sapiens
gatttaaaagcctgctca

SEQ ID NO: 4870625 - DNA, 19 bp, Homo sapiens
gatttccctccagagaaag

SEQ ID NO: 4870626 - DNA, 16 bp, Homo sapiens
gatttggggtgatttc

SEQ ID NO: 4870627 - DNA, 13 bp, Homo sapiens
gatttttctttaa

SEQ ID NO: 4870628 - DNA, 17 bp, Homo sapiens
gatttttgccctgcgtc

SEQ ID NO: 4870629 - DNA, 20 bp, Homo sapiens
gcaaaaagagtcagacattt

SEQ ID NO: 4870630 - DNA, 22 bp, Homo sapiens
gcaaaaatgtccagccaccccc

SEQ ID NO: 4870631 - DNA, 17 bp, Homo sapiens
gcaaactgaggcagcat

SEQ ID NO: 4870632 - DNA, 20 bp, Homo sapiens
gcaaaggtgcactccagact

SEQ ID NO: 4870633 - DNA, 22 bp, Homo sapiens
gcaaaggtgcactccagactct

SEQ ID NO: 4870634 - DNA, 23 bp, Homo sapiens
gcaaaggtgcactccagactctg

SEQ ID NO: 4870635 - DNA, 14 bp, Homo sapiens
gcaaagtcctcctt

SEQ ID NO: 4870636 - DNA, 15 bp, Homo sapiens
gcaaagtgacaaagc

SEQ ID NO: 4870637 - DNA, 20 bp, Homo sapiens
gcaaataaaacgctttcccc

SEQ ID NO: 4870638 - DNA, 16 bp, Homo sapiens
gcaaatgagctctgaa

SEQ ID NO: 4870639 - DNA, 17 bp, Homo sapiens
gcaaattccagatttgt

SEQ ID NO: 4870640 - DNA, 20 bp, Homo sapiens
gcaacccttcctgctgctgc

SEQ ID NO: 4870641 - DNA, 16 bp, Homo sapiens
gcaagaaagcttcctt

SEQ ID NO: 4870642 - DNA, 20 bp, Homo sapiens
gcaagagtaagcagtgttac

SEQ ID NO: 4870643 - DNA, 15 bp, Homo sapiens
gcaagcaccaacctc

SEQ ID NO: 4870644 - DNA, 18 bp, Homo sapiens
gcaagcaccaacctccag

SEQ ID NO: 4870645 - DNA, 18 bp, Homo sapiens
gcaagcagatgacagagg

SEQ ID NO: 4870646 - DNA, 14 bp, Homo sapiens
gcaagctgaaattt

SEQ ID NO: 4870647 - DNA, 13 bp, Homo sapiens
gcaaggcagagcc

SEQ ID NO: 4870648 - DNA, 17 bp, Homo sapiens
gcaaggtggcctctgcc

SEQ ID NO: 4870649 - DNA, 18 bp, Homo sapiens
gcaaggtggcctctgcct

SEQ ID NO: 4870650 - DNA, 22 bp, Homo sapiens
gcaaggtggcctctgcctgggg

SEQ ID NO: 4870651 - DNA, 12 bp, Homo sapiens
gcaataaaattt

SEQ ID NO: 4870652 - DNA, 21 bp, Homo sapiens
gcaataaaatttaaaaaataa

SEQ ID NO: 4870653 - DNA, 16 bp, Homo sapiens
gcaataataaagtact

SEQ ID NO: 4870654 - DNA, 19 bp, Homo sapiens
gcaataggtgagagaatgt

SEQ ID NO: 4870655 - DNA, 21 bp, Homo sapiens
gcaattaaacttccaaagaaa

SEQ ID NO: 4870656 - DNA, 22 bp, Homo sapiens
gcaattaaacttccaaagaaag

SEQ ID NO: 4870657 - DNA, 22 bp, Homo sapiens
gcaatttactgatgagagaatg

SEQ ID NO: 4870658 - DNA, 13 bp, Homo sapiens
gcacaaaagacag

SEQ ID NO: 4870659 - DNA, 14 bp, Homo sapiens
gcacaaacagaatt

SEQ ID NO: 4870660 - DNA, 18 bp, Homo sapiens
gcacaaagcactggcctt

SEQ ID NO: 4870661 - DNA, 19 bp, Homo sapiens
gcacaaagcactggccttg

SEQ ID NO: 4870662 - DNA, 22 bp, Homo sapiens
gcacaatgttggagcagcaggc

SEQ ID NO: 4870663 - DNA, 15 bp, Homo sapiens
gcacaatttaaaaca

SEQ ID NO: 4870664 - DNA, 17 bp, Homo sapiens
gcacacatccaagaggg

SEQ ID NO: 4870665 - DNA, 17 bp, Homo sapiens
gcacagccaaatttaaa

SEQ ID NO: 4870666 - DNA, 23 bp, Homo sapiens
gcacagcctagggtcttgggggt

SEQ ID NO: 4870667 - DNA, 18 bp, Homo sapiens
gcacagtgtaatccaggg

SEQ ID NO: 4870668 - DNA, 19 bp, Homo sapiens
gcacatagcataggctggg

SEQ ID NO: 4870669 - DNA, 17 bp, Homo sapiens
gcaccaacctccagact

SEQ ID NO: 4870670 - DNA, 22 bp, Homo sapiens
gcaccaggggccaacctcaggc

SEQ ID NO: 4870671 - DNA, 13 bp, Homo sapiens
gcaccgtattcct

SEQ ID NO: 4870672 - DNA, 16 bp, Homo sapiens
gcactaaaatgaggat

SEQ ID NO: 4870673 - DNA, 23 bp, Homo sapiens
gcactaaaatgaggatccagggc

SEQ ID NO: 4870674 - DNA, 16 bp, Homo sapiens
gcactagccttcccag

SEQ ID NO: 4870675 - DNA, 17 bp, Homo sapiens
gcactccagactctggg

SEQ ID NO: 4870676 - DNA, 15 bp, Homo sapiens
gcactgagcagggat

SEQ ID NO: 4870677 - DNA, 17 bp, Homo sapiens
gcactgagcagggatct

SEQ ID NO: 4870678 - DNA, 21 bp, Homo sapiens
gcactgagcagggatctgccc

SEQ ID NO: 4870679 - DNA, 15 bp, Homo sapiens
gcactggccttgcct

SEQ ID NO: 4870680 - DNA, 19 bp, Homo sapiens
gcactggccttgcctccag

SEQ ID NO: 4870681 - DNA, 17 bp, Homo sapiens
gcacttattgaatatat

SEQ ID NO: 4870682 - DNA, 13 bp, Homo sapiens
gcacttttgaatg

SEQ ID NO: 4870683 - DNA, 20 bp, Homo sapiens
gcagaaaccaacaagaacca

SEQ ID NO: 4870684 - DNA, 16 bp, Homo sapiens
gcagaaatagacaaaa

SEQ ID NO: 4870685 - DNA, 20 bp, Homo sapiens
gcagaaccaagaacataaac

SEQ ID NO: 4870686 - DNA, 15 bp, Homo sapiens
gcagaagcaataata

SEQ ID NO: 4870687 - DNA, 14 bp, Homo sapiens
gcagacagccatgc

SEQ ID NO: 4870688 - DNA, 16 bp, Homo sapiens
gcagacagccctggca

SEQ ID NO: 4870689 - DNA, 13 bp, Homo sapiens
gcagacctggagc

SEQ ID NO: 4870690 - DNA, 16 bp, Homo sapiens
gcagacctggagcttc

SEQ ID NO: 4870691 - DNA, 19 bp, Homo sapiens
gcagagaccataagagaaa

SEQ ID NO: 4870692 - DNA, 22 bp, Homo sapiens
gcagagatgtactgcaaagtcg

SEQ ID NO: 4870693 - DNA, 16 bp, Homo sapiens
gcagagatttctcatt

SEQ ID NO: 4870694 - DNA, 14 bp, Homo sapiens
gcagaggtggggtg

SEQ ID NO: 4870695 - DNA, 18 bp, Homo sapiens
gcagaggtggggtgctgg

SEQ ID NO: 4870696 - DNA, 23 bp, Homo sapiens
gcagaggtggggtgctggggctg

SEQ ID NO: 4870697 - DNA, 14 bp, Homo sapiens
gcagagtcctggag

SEQ ID NO: 4870698 - DNA, 13 bp, Homo sapiens
gcagagtctgtct

SEQ ID NO: 4870699 - DNA, 16 bp, Homo sapiens
gcagagtctgtctctt

SEQ ID NO: 4870700 - DNA, 22 bp, Homo sapiens
gcagagtgagggggtaaagcag

SEQ ID NO: 4870701 - DNA, 21 bp, Homo sapiens
gcagagttaaatctcaaatag

SEQ ID NO: 4870702 - DNA, 13 bp, Homo sapiens
gcagatgacagag

SEQ ID NO: 4870703 - DNA, 16 bp, Homo sapiens
gcagcaggactgtggg

SEQ ID NO: 4870704 - DNA, 17 bp, Homo sapiens
gcagcaggactgtggga

SEQ ID NO: 4870705 - DNA, 11 bp, Homo sapiens
gcagcaggcca

SEQ ID NO: 4870706 - DNA, 19 bp, Homo sapiens
gcagcaggccagagaaagc

SEQ ID NO: 4870707 - DNA, 21 bp, Homo sapiens
gcagcaggccagagaaagcaa

SEQ ID NO: 4870708 - DNA, 16 bp, Homo sapiens
gcagcaggcctctggg

SEQ ID NO: 4870709 - DNA, 17 bp, Homo sapiens
gcagcagtcgcccaagc

SEQ ID NO: 4870710 - DNA, 17 bp, Homo sapiens
gcagcatctgctccatc

SEQ ID NO: 4870711 - DNA, 15 bp, Homo sapiens
gcagccgcagagaaa

SEQ ID NO: 4870712 - DNA, 16 bp, Homo sapiens
gcagccgcagagaaat

SEQ ID NO: 4870713 - DNA, 22 bp, Homo sapiens
gcagccgcagagaaatgcccca

SEQ ID NO: 4870714 - DNA, 15 bp, Homo sapiens
gcagcctaagaagaa

SEQ ID NO: 4870715 - DNA, 21 bp, Homo sapiens
gcagcctaagaagaaggccag

SEQ ID NO: 4870716 - DNA, 22 bp, Homo sapiens
gcagcctaagaagaaggccaga

SEQ ID NO: 4870717 - DNA, 19 bp, Homo sapiens
gcagccttcatcagaactc

SEQ ID NO: 4870718 - DNA, 12 bp, Homo sapiens
gcagcggctcct

SEQ ID NO: 4870719 - DNA, 15 bp, Homo sapiens
gcagcggctcctgca

SEQ ID NO: 4870720 - DNA, 12 bp, Homo sapiens
gcagctagtgcc

SEQ ID NO: 4870721 - DNA, 13 bp, Homo sapiens
gcagcttgctggg

SEQ ID NO: 4870722 - DNA, 14 bp, Homo sapiens
gcagcttgctgggc

SEQ ID NO: 4870723 - DNA, 17 bp, Homo sapiens
gcagcttgctgggcttt

SEQ ID NO: 4870724 - DNA, 20 bp, Homo sapiens
gcaggacctactaggagagg

SEQ ID NO: 4870725 - DNA, 18 bp, Homo sapiens
gcaggacctgggacagga

SEQ ID NO: 4870726 - DNA, 15 bp, Homo sapiens
gcaggccagagaaag

SEQ ID NO: 4870727 - DNA, 16 bp, Homo sapiens
gcaggccagagaaagc

SEQ ID NO: 4870728 - DNA, 14 bp, Homo sapiens
gcaggcccaatgct

SEQ ID NO: 4870729 - DNA, 16 bp, Homo sapiens
gcaggcccaatgctgc

SEQ ID NO: 4870730 - DNA, 17 bp, Homo sapiens
gcaggcccaatgctgct

SEQ ID NO: 4870731 - DNA, 19 bp, Homo sapiens
gcaggcccaatgctgcttt

SEQ ID NO: 4870732 - DNA, 15 bp, Homo sapiens
gcaggcctctgggac

SEQ ID NO: 4870733 - DNA, 16 bp, Homo sapiens
gcaggcctctgggacc

SEQ ID NO: 4870734 - DNA, 13 bp, Homo sapiens
gcagggagagagt

SEQ ID NO: 4870735 - DNA, 20 bp, Homo sapiens
gcagggaggggaggcagatg

SEQ ID NO: 4870736 - DNA, 20 bp, Homo sapiens
gcagggggtatgcagagctt

SEQ ID NO: 4870737 - DNA, 17 bp, Homo sapiens
gcaggtgctcatgctgc

SEQ ID NO: 4870738 - DNA, 15 bp, Homo sapiens
gcaggtgcttttggc

SEQ ID NO: 4870739 - DNA, 21 bp, Homo sapiens
gcaggtgcttttggcagagac

SEQ ID NO: 4870740 - DNA, 18 bp, Homo sapiens
gcagtaggggagagagca

SEQ ID NO: 4870741 - DNA, 11 bp, Homo sapiens
gcagtcagact

SEQ ID NO: 4870742 - DNA, 23 bp, Homo sapiens
gcagtcgtggggaacggaggagg

SEQ ID NO: 4870743 - DNA, 21 bp, Homo sapiens
gcagtgggaatgttctttctg

SEQ ID NO: 4870744 - DNA, 18 bp, Homo sapiens
gcagtgttggagtgagga

SEQ ID NO: 4870745 - DNA, 17 bp, Homo sapiens
gcagttagctgaagaat

SEQ ID NO: 4870746 - DNA, 16 bp, Homo sapiens
gcagttgtagcagaaa

SEQ ID NO: 4870747 - DNA, 19 bp, Homo sapiens
gcataaagctcaaatgaaa

SEQ ID NO: 4870748 - DNA, 21 bp, Homo sapiens
gcataaagctcaaatgaaatg

SEQ ID NO: 4870749 - DNA, 18 bp, Homo sapiens
gcatactttgtattttga

SEQ ID NO: 4870750 - DNA, 12 bp, Homo sapiens
gcataggctggg

SEQ ID NO: 4870751 - DNA, 18 bp, Homo sapiens
gcatagttgtagacaaag

SEQ ID NO: 4870752 - DNA, 17 bp, Homo sapiens
gcatataatgaataaat

SEQ ID NO: 4870753 - DNA, 18 bp, Homo sapiens
gcatataatgaataaatc

SEQ ID NO: 4870754 - DNA, 19 bp, Homo sapiens
gcatataatgaataaatca

SEQ ID NO: 4870755 - DNA, 13 bp, Homo sapiens
gcatccactagct

SEQ ID NO: 4870756 - DNA, 22 bp, Homo sapiens
gcatccctttttcataaattat

SEQ ID NO: 4870757 - DNA, 16 bp, Homo sapiens
gcatctgttagcagag

SEQ ID NO: 4870758 - DNA, 17 bp, Homo sapiens
gcatctgttagcagagt

SEQ ID NO: 4870759 - DNA, 18 bp, Homo sapiens
gcatctgttagcagagtc

SEQ ID NO: 4870760 - DNA, 19 bp, Homo sapiens
gcatctgttagcagagtct

SEQ ID NO: 4870761 - DNA, 22 bp, Homo sapiens
gcatgaaaaaccatttttgaac

SEQ ID NO: 4870762 - DNA, 14 bp, Homo sapiens
gcatgaaataaaat

SEQ ID NO: 4870763 - DNA, 15 bp, Homo sapiens
gcatgaaataaaata

SEQ ID NO: 4870764 - DNA, 17 bp, Homo sapiens
gcatgaggcaaaaatgt

SEQ ID NO: 4870765 - DNA, 18 bp, Homo sapiens
gcatgaggcaaaaatgtc

SEQ ID NO: 4870766 - DNA, 18 bp, Homo sapiens
gcatgcttaaattttaac

SEQ ID NO: 4870767 - DNA, 16 bp, Homo sapiens
gcatggtggctcatgc

SEQ ID NO: 4870768 - DNA, 18 bp, Homo sapiens
gcatggtggctcatgcct

SEQ ID NO: 4870769 - DNA, 21 bp, Homo sapiens
gcatggtggctcatgcctgta

SEQ ID NO: 4870770 - DNA, 18 bp, Homo sapiens
gcatgtagaggcttgttt

SEQ ID NO: 4870771 - DNA, 20 bp, Homo sapiens
gcatgtagaggcttgtttac

SEQ ID NO: 4870772 - DNA, 16 bp, Homo sapiens
gcattctttgcaatac

SEQ ID NO: 4870773 - DNA, 20 bp, Homo sapiens
gcattctttgcaatactgct

SEQ ID NO: 4870774 - DNA, 12 bp, Homo sapiens
gcattgcagcct

SEQ ID NO: 4870775 - DNA, 18 bp, Homo sapiens
gcattggatattttttac

SEQ ID NO: 4870776 - DNA, 21 bp, Homo sapiens
gcattgtaattatgtaaataa

SEQ ID NO: 4870777 - DNA, 13 bp, Homo sapiens
gcatttaaaaaaa

SEQ ID NO: 4870778 - DNA, 12 bp, Homo sapiens
gcatttaataaa

SEQ ID NO: 4870779 - DNA, 15 bp, Homo sapiens
gcatttaataaagat

SEQ ID NO: 4870780 - DNA, 23 bp, Homo sapiens
gcatttgtgtgtgtgtgtgtgtt

SEQ ID NO: 4870781 - DNA, 23 bp, Homo sapiens
gccaaaatggttaatttttcctg

SEQ ID NO: 4870782 - DNA, 15 bp, Homo sapiens
gccaaagtacagaat

SEQ ID NO: 4870783 - DNA, 21 bp, Homo sapiens
gccaaatgcagggaggggagg

SEQ ID NO: 4870784 - DNA, 21 bp, Homo sapiens
gccaaatttaaaactgttgga

SEQ ID NO: 4870785 - DNA, 15 bp, Homo sapiens
gccaagctggcacaa

SEQ ID NO: 4870786 - DNA, 12 bp, Homo sapiens
gccaaggagcat

SEQ ID NO: 4870787 - DNA, 17 bp, Homo sapiens
gccaatctgtacaaaat

SEQ ID NO: 4870788 - DNA, 19 bp, Homo sapiens
gccaattaaaaacgaaaac

SEQ ID NO: 4870789 - DNA, 15 bp, Homo sapiens
gccacagaaggtgaa

SEQ ID NO: 4870790 - DNA, 19 bp, Homo sapiens
gccacagaaggtgaacttt

SEQ ID NO: 4870791 - DNA, 16 bp, Homo sapiens
gccagagagggaaaag

SEQ ID NO: 4870792 - DNA, 19 bp, Homo sapiens
gccagattggccaattaaa

SEQ ID NO: 4870793 - DNA, 21 bp, Homo sapiens
gccagattggccaattaaaaa

SEQ ID NO: 4870794 - DNA, 14 bp, Homo sapiens
gccagcaagtcctt

SEQ ID NO: 4870795 - DNA, 18 bp, Homo sapiens
gccagcaagtccttaggc

SEQ ID NO: 4870796 - DNA, 20 bp, Homo sapiens
gccagcagctgatgctgtac

SEQ ID NO: 4870797 - DNA, 22 bp, Homo sapiens
gccagcagctgatgctgtacta

SEQ ID NO: 4870798 - DNA, 22 bp, Homo sapiens
gccagccaagctttaaattatg

SEQ ID NO: 4870799 - DNA, 19 bp, Homo sapiens
gccagcccgcagaggtggg

SEQ ID NO: 4870800 - DNA, 18 bp, Homo sapiens
gccagcctgcttcccaca

SEQ ID NO: 4870801 - DNA, 19 bp, Homo sapiens
gccagcctgcttcccacaa

SEQ ID NO: 4870802 - DNA, 15 bp, Homo sapiens
gccagcgtgtggagc

SEQ ID NO: 4870803 - DNA, 17 bp, Homo sapiens
gccagctgcagcctggt

SEQ ID NO: 4870804 - DNA, 17 bp, Homo sapiens
gccaggactcccagaac

SEQ ID NO: 4870805 - DNA, 16 bp, Homo sapiens
gccaggatccccctct

SEQ ID NO: 4870806 - DNA, 17 bp, Homo sapiens
gccaggatccccctctt

SEQ ID NO: 4870807 - DNA, 20 bp, Homo sapiens
gccaggatccccctctttgc

SEQ ID NO: 4870808 - DNA, 21 bp, Homo sapiens
gccaggatccccctctttgca

SEQ ID NO: 4870809 - DNA, 14 bp, Homo sapiens
gccaggcagggaga

SEQ ID NO: 4870810 - DNA, 23 bp, Homo sapiens
gccaggcagggagagagtagctg

SEQ ID NO: 4870811 - DNA, 17 bp, Homo sapiens
gccaggccttatctgaa

SEQ ID NO: 4870812 - DNA, 15 bp, Homo sapiens
gccaggctcaggaga

SEQ ID NO: 4870813 - DNA, 16 bp, Homo sapiens
gccaggggctctgtgg

SEQ ID NO: 4870814 - DNA, 17 bp, Homo sapiens
gccaggtctgactccaa

SEQ ID NO: 4870815 - DNA, 20 bp, Homo sapiens
gccaggtctgactccaaagc

SEQ ID NO: 4870816 - DNA, 21 bp, Homo sapiens
gccaggtctgactccaaagct

SEQ ID NO: 4870817 - DNA, 20 bp, Homo sapiens
gccaggtggttgtcttattg

SEQ ID NO: 4870818 - DNA, 22 bp, Homo sapiens
gccaggtggttgtcttattgca

SEQ ID NO: 4870819 - DNA, 15 bp, Homo sapiens
gccagtcactgctgc

SEQ ID NO: 4870820 - DNA, 17 bp, Homo sapiens
gccagtcactgctgcaa

SEQ ID NO: 4870821 - DNA, 17 bp, Homo sapiens
gccagtggtggaggtgg

SEQ ID NO: 4870822 - DNA, 16 bp, Homo sapiens
gccagtgtctaggcac

SEQ ID NO: 4870823 - DNA, 18 bp, Homo sapiens
gccagttacttgggcttc

SEQ ID NO: 4870824 - DNA, 19 bp, Homo sapiens
gccatcgccgggactccag

SEQ ID NO: 4870825 - DNA, 23 bp, Homo sapiens
gccatcgccgggactccagaacc

SEQ ID NO: 4870826 - DNA, 13 bp, Homo sapiens
gccatcttctttc

SEQ ID NO: 4870827 - DNA, 16 bp, Homo sapiens
gccattccaaaatatt

SEQ ID NO: 4870828 - DNA, 15 bp, Homo sapiens
gcccaaacctgggaa

SEQ ID NO: 4870829 - DNA, 13 bp, Homo sapiens
gcccaatgctgct

SEQ ID NO: 4870830 - DNA, 13 bp, Homo sapiens
gcccactcctggg

SEQ ID NO: 4870831 - DNA, 15 bp, Homo sapiens
gcccagagagggaag

SEQ ID NO: 4870832 - DNA, 14 bp, Homo sapiens
gcccagtacattta

SEQ ID NO: 4870833 - DNA, 19 bp, Homo sapiens
gcccagtacatttaaattt

SEQ ID NO: 4870834 - DNA, 15 bp, Homo sapiens
gcccagtgccagcaa

SEQ ID NO: 4870835 - DNA, 16 bp, Homo sapiens
gccccactttcaagaa

SEQ ID NO: 4870836 - DNA, 13 bp, Homo sapiens
gccccaggagaag

SEQ ID NO: 4870837 - DNA, 24 bp, Homo sapiens
gccccagtgttatttattccccag

SEQ ID NO: 4870838 - DNA, 13 bp, Homo sapiens
gcccccacctcca

SEQ ID NO: 4870839 - DNA, 15 bp, Homo sapiens
gcccccacctccacc

SEQ ID NO: 4870840 - DNA, 16 bp, Homo sapiens
gcccccacctccaccc

SEQ ID NO: 4870841 - DNA, 20 bp, Homo sapiens
gccccccgcgcgcccaccct

SEQ ID NO: 4870842 - DNA, 21 bp, Homo sapiens
gccccccgcgcgcccaccctc

SEQ ID NO: 4870843 - DNA, 16 bp, Homo sapiens
gcccccttcaggagcc

SEQ ID NO: 4870844 - DNA, 18 bp, Homo sapiens
gcccccttcaggagcctg

SEQ ID NO: 4870845 - DNA, 16 bp, Homo sapiens
gccccgcccctcccac

SEQ ID NO: 4870846 - DNA, 23 bp, Homo sapiens
gccccgcccctcccacgcctcac

SEQ ID NO: 4870847 - DNA, 19 bp, Homo sapiens
gcccctaaagagcatcctg

SEQ ID NO: 4870848 - DNA, 20 bp, Homo sapiens
gcccctaaagagcatcctga

SEQ ID NO: 4870849 - DNA, 19 bp, Homo sapiens
gcccctcccacgcctcacc

SEQ ID NO: 4870850 - DNA, 13 bp, Homo sapiens
gccccttccctgg

SEQ ID NO: 4870851 - DNA, 15 bp, Homo sapiens
gccccttccctgggt

SEQ ID NO: 4870852 - DNA, 16 bp, Homo sapiens
gccccttccctgggtt

SEQ ID NO: 4870853 - DNA, 22 bp, Homo sapiens
gccccttccctgggtttgggag

SEQ ID NO: 4870854 - DNA, 15 bp, Homo sapiens
gcccgcagaggtggg

SEQ ID NO: 4870855 - DNA, 15 bp, Homo sapiens
gccctattgctgcta

SEQ ID NO: 4870856 - DNA, 14 bp, Homo sapiens
gccctcaccacagc

SEQ ID NO: 4870857 - DNA, 14 bp, Homo sapiens
gccctctctctggg

SEQ ID NO: 4870858 - DNA, 23 bp, Homo sapiens
gccctctgctctgcctggagtgt

SEQ ID NO: 4870859 - DNA, 17 bp, Homo sapiens
gccctgccagctgcagc

SEQ ID NO: 4870860 - DNA, 15 bp, Homo sapiens
gccctgcggccccgt

SEQ ID NO: 4870861 - DNA, 14 bp, Homo sapiens
gccctggggcaggg

SEQ ID NO: 4870862 - DNA, 15 bp, Homo sapiens
gccctggggcagggt

SEQ ID NO: 4870863 - DNA, 18 bp, Homo sapiens
gccctggggcagggtggg

SEQ ID NO: 4870864 - DNA, 11 bp, Homo sapiens
gccctgtcact

SEQ ID NO: 4870865 - DNA, 17 bp, Homo sapiens
gcccttcctcctgatgg

SEQ ID NO: 4870866 - DNA, 22 bp, Homo sapiens
gcccttcctcctgatggagtgt

SEQ ID NO: 4870867 - DNA, 19 bp, Homo sapiens
gcccttgggtccccccgag

SEQ ID NO: 4870868 - DNA, 14 bp, Homo sapiens
gccctttcctggca

SEQ ID NO: 4870869 - DNA, 17 bp, Homo sapiens
gccgcagacctggagct

SEQ ID NO: 4870870 - DNA, 13 bp, Homo sapiens
gccgcagagaaat

SEQ ID NO: 4870871 - DNA, 14 bp, Homo sapiens
gccgcagagaaatg

SEQ ID NO: 4870872 - DNA, 19 bp, Homo sapiens
gccgcagagaaatgcccca

SEQ ID NO: 4870873 - DNA, 17 bp, Homo sapiens
gccgccagcgtgtggag

SEQ ID NO: 4870874 - DNA, 19 bp, Homo sapiens
gccgccagcgtgtggagca

SEQ ID NO: 4870875 - DNA, 21 bp, Homo sapiens
gccggagtccactcccagtgc

SEQ ID NO: 4870876 - DNA, 18 bp, Homo sapiens
gccggatgaaacttctca

SEQ ID NO: 4870877 - DNA, 20 bp, Homo sapiens
gccggatgaaacttctcagt

SEQ ID NO: 4870878 - DNA, 13 bp, Homo sapiens
gccgggggagggg

SEQ ID NO: 4870879 - DNA, 23 bp, Homo sapiens
gccgtcctaacctcgggcctgct

SEQ ID NO: 4870880 - DNA, 13 bp, Homo sapiens
gccgttttctggg

SEQ ID NO: 4870881 - DNA, 15 bp, Homo sapiens
gcctaacctgggacc

SEQ ID NO: 4870882 - DNA, 18 bp, Homo sapiens
gcctaagaagaaggccag

SEQ ID NO: 4870883 - DNA, 22 bp, Homo sapiens
gcctagaaagggcaaggggtga

SEQ ID NO: 4870884 - DNA, 22 bp, Homo sapiens
gcctagcctatgtctggcagat

SEQ ID NO: 4870885 - DNA, 15 bp, Homo sapiens
gcctattgatacttg

SEQ ID NO: 4870886 - DNA, 14 bp, Homo sapiens
gcctcagcctgctt

SEQ ID NO: 4870887 - DNA, 19 bp, Homo sapiens
gcctcagcctgctttcctg

SEQ ID NO: 4870888 - DNA, 22 bp, Homo sapiens
gcctcagcctgctttcctgcag

SEQ ID NO: 4870889 - DNA, 14 bp, Homo sapiens
gcctcaggacccat

SEQ ID NO: 4870890 - DNA, 17 bp, Homo sapiens
gcctcaggacccatccc

SEQ ID NO: 4870891 - DNA, 21 bp, Homo sapiens
gcctcattttgcttcccatct

SEQ ID NO: 4870892 - DNA, 20 bp, Homo sapiens
gcctcccaaggtcctctcag

SEQ ID NO: 4870893 - DNA, 21 bp, Homo sapiens
gcctcccaaggtcctctcagt

SEQ ID NO: 4870894 - DNA, 17 bp, Homo sapiens
gcctccccagctcaccc

SEQ ID NO: 4870895 - DNA, 14 bp, Homo sapiens
gcctcggacagtcc

SEQ ID NO: 4870896 - DNA, 23 bp, Homo sapiens
gcctctccgactctgcacccgcc

SEQ ID NO: 4870897 - DNA, 14 bp, Homo sapiens
gcctctcctgccct

SEQ ID NO: 4870898 - DNA, 19 bp, Homo sapiens
gcctctcctgccctctgct

SEQ ID NO: 4870899 - DNA, 18 bp, Homo sapiens
gcctctctggaagaggga

SEQ ID NO: 4870900 - DNA, 23 bp, Homo sapiens
gcctctgccaaaggatgtgatat

SEQ ID NO: 4870901 - DNA, 17 bp, Homo sapiens
gcctctgggacccacag

SEQ ID NO: 4870902 - DNA, 18 bp, Homo sapiens
gcctctgggacccacaga

SEQ ID NO: 4870903 - DNA, 16 bp, Homo sapiens
gcctcttgcagggtct

SEQ ID NO: 4870904 - DNA, 22 bp, Homo sapiens
gcctgactagaactcctgtctt

SEQ ID NO: 4870905 - DNA, 15 bp, Homo sapiens
gcctgagaaacacta

SEQ ID NO: 4870906 - DNA, 22 bp, Homo sapiens
gcctgagaaacactatttgtga

SEQ ID NO: 4870907 - DNA, 19 bp, Homo sapiens
gcctgagaattgaggggag

SEQ ID NO: 4870908 - DNA, 16 bp, Homo sapiens
gcctgatttcattcct

SEQ ID NO: 4870909 - DNA, 13 bp, Homo sapiens
gcctgccaccttc

SEQ ID NO: 4870910 - DNA, 15 bp, Homo sapiens
gcctgcttcccacaa

SEQ ID NO: 4870911 - DNA, 22 bp, Homo sapiens
gcctgcttgactttccagaatg

SEQ ID NO: 4870912 - DNA, 16 bp, Homo sapiens
gcctgctttttggaaa

SEQ ID NO: 4870913 - DNA, 12 bp, Homo sapiens
gcctggagcagg

SEQ ID NO: 4870914 - DNA, 13 bp, Homo sapiens
gcctggagcaggc

SEQ ID NO: 4870915 - DNA, 17 bp, Homo sapiens
gcctggagcaggcccaa

SEQ ID NO: 4870916 - DNA, 17 bp, Homo sapiens
gcctggaggctcctcta

SEQ ID NO: 4870917 - DNA, 12 bp, Homo sapiens
gcctggccaggc

SEQ ID NO: 4870918 - DNA, 15 bp, Homo sapiens
gcctggccaggcagg

SEQ ID NO: 4870919 - DNA, 21 bp, Homo sapiens
gcctgggctgtgaggacaggg

SEQ ID NO: 4870920 - DNA, 19 bp, Homo sapiens
gcctgtatgtggtgtgggg

SEQ ID NO: 4870921 - DNA, 17 bp, Homo sapiens
gcctgtccctagggctc

SEQ ID NO: 4870922 - DNA, 22 bp, Homo sapiens
gcctgtccctagggctctccaa

SEQ ID NO: 4870923 - DNA, 23 bp, Homo sapiens
gcctgtccctagggctctccaag

SEQ ID NO: 4870924 - DNA, 16 bp, Homo sapiens
gccttacttcaaagtg

SEQ ID NO: 4870925 - DNA, 14 bp, Homo sapiens
gccttatctgaaag

SEQ ID NO: 4870926 - DNA, 24 bp, Homo sapiens
gccttatctgaaaggccagcagct

SEQ ID NO: 4870927 - DNA, 20 bp, Homo sapiens
gccttccctttacagctctc

SEQ ID NO: 4870928 - DNA, 17 bp, Homo sapiens
gccttcctcctctcaaa

SEQ ID NO: 4870929 - DNA, 15 bp, Homo sapiens
gccttcgtttatatt

SEQ ID NO: 4870930 - DNA, 16 bp, Homo sapiens
gccttctaaattccca

SEQ ID NO: 4870931 - DNA, 14 bp, Homo sapiens
gccttgagtctctg

SEQ ID NO: 4870932 - DNA, 16 bp, Homo sapiens
gccttgcaacccaagg

SEQ ID NO: 4870933 - DNA, 19 bp, Homo sapiens
gccttgcagatatctgcat

SEQ ID NO: 4870934 - DNA, 21 bp, Homo sapiens
gccttgcagatatctgcatgt

SEQ ID NO: 4870935 - DNA, 13 bp, Homo sapiens
gccttgcctccag

SEQ ID NO: 4870936 - DNA, 22 bp, Homo sapiens
gccttgtataatattgaaaatt

SEQ ID NO: 4870937 - DNA, 15 bp, Homo sapiens
gccttgtttaatggt

SEQ ID NO: 4870938 - DNA, 22 bp, Homo sapiens
gcctttgcagttggactctcag

SEQ ID NO: 4870939 - DNA, 23 bp, Homo sapiens
gcctttttacctggcctagaaag

SEQ ID NO: 4870940 - DNA, 16 bp, Homo sapiens
gcgaacagccttagag

SEQ ID NO: 4870941 - DNA, 21 bp, Homo sapiens
gcgaacagccttagagctctt

SEQ ID NO: 4870942 - DNA, 15 bp, Homo sapiens
gcggattgctctgga

SEQ ID NO: 4870943 - DNA, 22 bp, Homo sapiens
gcggattgctctggagcagcca

SEQ ID NO: 4870944 - DNA, 14 bp, Homo sapiens
gcggcaaaaggaaa

SEQ ID NO: 4870945 - DNA, 15 bp, Homo sapiens
gcggccgaagcccac

SEQ ID NO: 4870946 - DNA, 17 bp, Homo sapiens
gcggccgaagcccacca

SEQ ID NO: 4870947 - DNA, 19 bp, Homo sapiens
gcggggtcccctctgtgct

SEQ ID NO: 4870948 - DNA, 23 bp, Homo sapiens
gcgggtacttatttctcagctgt

SEQ ID NO: 4870949 - DNA, 16 bp, Homo sapiens
gcgtagcagagttaaa

SEQ ID NO: 4870950 - DNA, 22 bp, Homo sapiens
gcgtcccttctctttggggctc

SEQ ID NO: 4870951 - DNA, 12 bp, Homo sapiens
gcgtggctgact

SEQ ID NO: 4870952 - DNA, 13 bp, Homo sapiens
gcgtgtgtgacac

SEQ ID NO: 4870953 - DNA, 17 bp, Homo sapiens
gcgtgtgtgacactgat

SEQ ID NO: 4870954 - DNA, 18 bp, Homo sapiens
gctaaaaatgagcttgat

SEQ ID NO: 4870955 - DNA, 22 bp, Homo sapiens
gctaaaaatgagcttgattaaa

SEQ ID NO: 4870956 - DNA, 19 bp, Homo sapiens
gctaaggtttccagtcaga

SEQ ID NO: 4870957 - DNA, 14 bp, Homo sapiens
gctaccaaaacagt

SEQ ID NO: 4870958 - DNA, 21 bp, Homo sapiens
gctaccaacttgtatccaggc

SEQ ID NO: 4870959 - DNA, 17 bp, Homo sapiens
gctactggttacctgga

SEQ ID NO: 4870960 - DNA, 19 bp, Homo sapiens
gctactggttacctggaga

SEQ ID NO: 4870961 - DNA, 16 bp, Homo sapiens
gctactgtaatgctgc

SEQ ID NO: 4870962 - DNA, 22 bp, Homo sapiens
gctactgtaatgctgcctcagg

SEQ ID NO: 4870963 - DNA, 23 bp, Homo sapiens
gctactgtaatgctgcctcagga

SEQ ID NO: 4870964 - DNA, 21 bp, Homo sapiens
gctaggcctccgttgtctggt

SEQ ID NO: 4870965 - DNA, 15 bp, Homo sapiens
gctatgtcagtacta

SEQ ID NO: 4870966 - DNA, 22 bp, Homo sapiens
gctattttctaaagacttgtat

SEQ ID NO: 4870967 - DNA, 22 bp, Homo sapiens
gctatttttaatttcctgtgag

SEQ ID NO: 4870968 - DNA, 15 bp, Homo sapiens
gctcaaagcagcagg

SEQ ID NO: 4870969 - DNA, 15 bp, Homo sapiens
gctcaaatgaaatgt

SEQ ID NO: 4870970 - DNA, 17 bp, Homo sapiens
gctcaagcattctgttt

SEQ ID NO: 4870971 - DNA, 19 bp, Homo sapiens
gctcaagcattctgtttat

SEQ ID NO: 4870972 - DNA, 20 bp, Homo sapiens
gctcaagcattctgtttatc

SEQ ID NO: 4870973 - DNA, 16 bp, Homo sapiens
gctcaatccctgagga

SEQ ID NO: 4870974 - DNA, 14 bp, Homo sapiens
gctcagactgggca

SEQ ID NO: 4870975 - DNA, 22 bp, Homo sapiens
gctcagactgggcactggggcc

SEQ ID NO: 4870976 - DNA, 23 bp, Homo sapiens
gctcagagaggtagcactctcag

SEQ ID NO: 4870977 - DNA, 17 bp, Homo sapiens
gctcagcctggtttctg

SEQ ID NO: 4870978 - DNA, 18 bp, Homo sapiens
gctcagcctggtttctgg

SEQ ID NO: 4870979 - DNA, 13 bp, Homo sapiens
gctcatgctgctc

SEQ ID NO: 4870980 - DNA, 22 bp, Homo sapiens
gctccacactcagaaaattccc

SEQ ID NO: 4870981 - DNA, 18 bp, Homo sapiens
gctcccctaaagccaggc

SEQ ID NO: 4870982 - DNA, 19 bp, Homo sapiens
gctcccctaaagccaggct

SEQ ID NO: 4870983 - DNA, 20 bp, Homo sapiens
gctcccctaaagccaggctc

SEQ ID NO: 4870984 - DNA, 21 bp, Homo sapiens
gctcccctaaagccaggctca

SEQ ID NO: 4870985 - DNA, 21 bp, Homo sapiens
gctcccctcccaggggagcca

SEQ ID NO: 4870986 - DNA, 15 bp, Homo sapiens
gctcctcacctgtct

SEQ ID NO: 4870987 - DNA, 19 bp, Homo sapiens
gctcctccttgcccagact

SEQ ID NO: 4870988 - DNA, 17 bp, Homo sapiens
gctcctcttgttcctga

SEQ ID NO: 4870989 - DNA, 18 bp, Homo sapiens
gctcctcttgttcctgaa

SEQ ID NO: 4870990 - DNA, 22 bp, Homo sapiens
gctcctcttgttcctgaaatgt

SEQ ID NO: 4870991 - DNA, 20 bp, Homo sapiens
gctcctgcaaaaggaggtga

SEQ ID NO: 4870992 - DNA, 21 bp, Homo sapiens
gctcctgcaaaaggaggtgaa

SEQ ID NO: 4870993 - DNA, 18 bp, Homo sapiens
gctcctgtggcaggaggc

SEQ ID NO: 4870994 - DNA, 17 bp, Homo sapiens
gctcctttcccctctca

SEQ ID NO: 4870995 - DNA, 13 bp, Homo sapiens
gctcggctactgg

SEQ ID NO: 4870996 - DNA, 15 bp, Homo sapiens
gctcggggtgtgtca

SEQ ID NO: 4870997 - DNA, 20 bp, Homo sapiens
gctcggggtgtgtcatttct

SEQ ID NO: 4870998 - DNA, 15 bp, Homo sapiens
gctctagcctctgga

SEQ ID NO: 4870999 - DNA, 21 bp, Homo sapiens
gctctatactgtggcctgcag

SEQ ID NO: 4871000 - DNA, 16 bp, Homo sapiens
gctctcccctcctgct

SEQ ID NO: 4871001 - DNA, 20 bp, Homo sapiens
gctctcctcccgccccgccc

SEQ ID NO: 4871002 - DNA, 17 bp, Homo sapiens
gctctctgggacctcct

SEQ ID NO: 4871003 - DNA, 18 bp, Homo sapiens
gctctctgtactaaggag

SEQ ID NO: 4871004 - DNA, 15 bp, Homo sapiens
gctctgcctggagtg

SEQ ID NO: 4871005 - DNA, 12 bp, Homo sapiens
gctctggagcag

SEQ ID NO: 4871006 - DNA, 13 bp, Homo sapiens
gctctggagcagc

SEQ ID NO: 4871007 - DNA, 22 bp, Homo sapiens
gctctgtggcaaaaagagtcag

SEQ ID NO: 4871008 - DNA, 23 bp, Homo sapiens
gctctgtggcaaaaagagtcaga

SEQ ID NO: 4871009 - DNA, 17 bp, Homo sapiens
gctcttatgtgtgcctt

SEQ ID NO: 4871010 - DNA, 19 bp, Homo sapiens
gctcttatgtgtgcctttg

SEQ ID NO: 4871011 - DNA, 16 bp, Homo sapiens
gctcttcccactccag

SEQ ID NO: 4871012 - DNA, 20 bp, Homo sapiens
gctcttcccactccagctga

SEQ ID NO: 4871013 - DNA, 12 bp, Homo sapiens
gctcttcttcct

SEQ ID NO: 4871014 - DNA, 18 bp, Homo sapiens
gctcttgtgttcagaaga

SEQ ID NO: 4871015 - DNA, 19 bp, Homo sapiens
gctgaaagctggtggcaga

SEQ ID NO: 4871016 - DNA, 19 bp, Homo sapiens
gctgaaattcaccaagaac

SEQ ID NO: 4871017 - DNA, 20 bp, Homo sapiens
gctgaaattcaccaagaaca

SEQ ID NO: 4871018 - DNA, 17 bp, Homo sapiens
gctgaaattttagaaat

SEQ ID NO: 4871019 - DNA, 19 bp, Homo sapiens
gctgaaattttagaaatat

SEQ ID NO: 4871020 - DNA, 16 bp, Homo sapiens
gctgaagctggagcag

SEQ ID NO: 4871021 - DNA, 17 bp, Homo sapiens
gctgacagagctctggg

SEQ ID NO: 4871022 - DNA, 19 bp, Homo sapiens
gctgagccctcctgagggc

SEQ ID NO: 4871023 - DNA, 20 bp, Homo sapiens
gctgataccatatgaatgaa

SEQ ID NO: 4871024 - DNA, 20 bp, Homo sapiens
gctgatcagagttcctccta

SEQ ID NO: 4871025 - DNA, 18 bp, Homo sapiens
gctgatgggtgccctttc

SEQ ID NO: 4871026 - DNA, 23 bp, Homo sapiens
gctgcaaggtggcctctgcctgg

SEQ ID NO: 4871027 - DNA, 18 bp, Homo sapiens
gctgcagaggcacctcaa

SEQ ID NO: 4871028 - DNA, 22 bp, Homo sapiens
gctgcagccttcatcagaactc

SEQ ID NO: 4871029 - DNA, 19 bp, Homo sapiens
gctgccagctctcaggacc

SEQ ID NO: 4871030 - DNA, 13 bp, Homo sapiens
gctgccaggggct

SEQ ID NO: 4871031 - DNA, 22 bp, Homo sapiens
gctgccaggggctctgtggcaa

SEQ ID NO: 4871032 - DNA, 19 bp, Homo sapiens
gctgccccacaggtgtgtt

SEQ ID NO: 4871033 - DNA, 20 bp, Homo sapiens
gctgccgtagcttcagccag

SEQ ID NO: 4871034 - DNA, 12 bp, Homo sapiens
gctgcctcagga

SEQ ID NO: 4871035 - DNA, 20 bp, Homo sapiens
gctgcctcaggacccatccc

SEQ ID NO: 4871036 - DNA, 21 bp, Homo sapiens
gctgcctcaggacccatccct

SEQ ID NO: 4871037 - DNA, 22 bp, Homo sapiens
gctgcctcaggacccatccctg

SEQ ID NO: 4871038 - DNA, 21 bp, Homo sapiens
gctgctcccctaaagccaggc

SEQ ID NO: 4871039 - DNA, 17 bp, Homo sapiens
gctgctcctctcttggg

SEQ ID NO: 4871040 - DNA, 14 bp, Homo sapiens
gctgctgctgctgc

SEQ ID NO: 4871041 - DNA, 14 bp, Homo sapiens
gctggcacaaaaga

SEQ ID NO: 4871042 - DNA, 15 bp, Homo sapiens
gctggcacaaaagac

SEQ ID NO: 4871043 - DNA, 19 bp, Homo sapiens
gctggcacaaaagacagct

SEQ ID NO: 4871044 - DNA, 22 bp, Homo sapiens
gctggcggaggctgctcggcta

SEQ ID NO: 4871045 - DNA, 21 bp, Homo sapiens
gctggctctataaggcagcct

SEQ ID NO: 4871046 - DNA, 15 bp, Homo sapiens
gctgggcgtgtgtga

SEQ ID NO: 4871047 - DNA, 16 bp, Homo sapiens
gctgggcgtgtgtgac

SEQ ID NO: 4871048 - DNA, 11 bp, Homo sapiens
gctggggctgc

SEQ ID NO: 4871049 - DNA, 18 bp, Homo sapiens
gctggtgaacactgtgac

SEQ ID NO: 4871050 - DNA, 21 bp, Homo sapiens
gctggtgaacactgtgaccag

SEQ ID NO: 4871051 - DNA, 22 bp, Homo sapiens
gctggtgaacactgtgaccagg

SEQ ID NO: 4871052 - DNA, 24 bp, Homo sapiens
gctggtgaacactgtgaccaggct

SEQ ID NO: 4871053 - DNA, 20 bp, Homo sapiens
gctgtactaacccagtcttt

SEQ ID NO: 4871054 - DNA, 21 bp, Homo sapiens
gctgtcattgcacataagctt

SEQ ID NO: 4871055 - DNA, 18 bp, Homo sapiens
gctgtgaggacagggccc

SEQ ID NO: 4871056 - DNA, 22 bp, Homo sapiens
gctgtgctccacactcagaaaa

SEQ ID NO: 4871057 - DNA, 15 bp, Homo sapiens
gctgtgctttggaac

SEQ ID NO: 4871058 - DNA, 22 bp, Homo sapiens
gctgtgtttatatggaagaaag

SEQ ID NO: 4871059 - DNA, 21 bp, Homo sapiens
gctgttccattacaccacagc

SEQ ID NO: 4871060 - DNA, 16 bp, Homo sapiens
gcttaatgctacatgt

SEQ ID NO: 4871061 - DNA, 14 bp, Homo sapiens
gcttacaggagcca

SEQ ID NO: 4871062 - DNA, 22 bp, Homo sapiens
gcttacaggagccagcctgctt

SEQ ID NO: 4871063 - DNA, 13 bp, Homo sapiens
gcttacctgggca

SEQ ID NO: 4871064 - DNA, 22 bp, Homo sapiens
gcttataacctagttaaagaaa

SEQ ID NO: 4871065 - DNA, 18 bp, Homo sapiens
gcttcaaaaagccacagc

SEQ ID NO: 4871066 - DNA, 14 bp, Homo sapiens
gcttcaacagccaa

SEQ ID NO: 4871067 - DNA, 16 bp, Homo sapiens
gcttcaacagccaagc

SEQ ID NO: 4871068 - DNA, 17 bp, Homo sapiens
gcttcaacagccaagct

SEQ ID NO: 4871069 - DNA, 16 bp, Homo sapiens
gcttcagccaggtctg

SEQ ID NO: 4871070 - DNA, 22 bp, Homo sapiens
gcttcagccaggtctgactcca

SEQ ID NO: 4871071 - DNA, 19 bp, Homo sapiens
gcttccattttaattttaa

SEQ ID NO: 4871072 - DNA, 13 bp, Homo sapiens
gcttcccaacaga

SEQ ID NO: 4871073 - DNA, 17 bp, Homo sapiens
gcttcccatctgaagag

SEQ ID NO: 4871074 - DNA, 15 bp, Homo sapiens
gcttcccttactttg

SEQ ID NO: 4871075 - DNA, 21 bp, Homo sapiens
gcttccttctcatcttgcctc

SEQ ID NO: 4871076 - DNA, 17 bp, Homo sapiens
gcttcgactactgctcc

SEQ ID NO: 4871077 - DNA, 18 bp, Homo sapiens
gcttcttcacaggcactc

SEQ ID NO: 4871078 - DNA, 15 bp, Homo sapiens
gcttgactttccaga

SEQ ID NO: 4871079 - DNA, 16 bp, Homo sapiens
gcttgactttccagaa

SEQ ID NO: 4871080 - DNA, 15 bp, Homo sapiens
gcttgatatcccaag

SEQ ID NO: 4871081 - DNA, 16 bp, Homo sapiens
gcttgcatggagaatg

SEQ ID NO: 4871082 - DNA, 18 bp, Homo sapiens
gcttgcatggagaatggg

SEQ ID NO: 4871083 - DNA, 21 bp, Homo sapiens
gcttgccaaagtacagaattt

SEQ ID NO: 4871084 - DNA, 18 bp, Homo sapiens
gcttgcggcaaaaggaaa

SEQ ID NO: 4871085 - DNA, 20 bp, Homo sapiens
gcttggggtgtggggtgggg

SEQ ID NO: 4871086 - DNA, 15 bp, Homo sapiens
gcttggttctgtgaa

SEQ ID NO: 4871087 - DNA, 13 bp, Homo sapiens
gctttaatcagaa

SEQ ID NO: 4871088 - DNA, 14 bp, Homo sapiens
gctttcctgcagca

SEQ ID NO: 4871089 - DNA, 17 bp, Homo sapiens
gctttctttgacctctt

SEQ ID NO: 4871090 - DNA, 19 bp, Homo sapiens
gctttgggaagtttgctgt

SEQ ID NO: 4871091 - DNA, 17 bp, Homo sapiens
gctttggtggccaggga

SEQ ID NO: 4871092 - DNA, 21 bp, Homo sapiens
gctttggtggccagggaggca

SEQ ID NO: 4871093 - DNA, 16 bp, Homo sapiens
gctttgtaggtgtctc

SEQ ID NO: 4871094 - DNA, 20 bp, Homo sapiens
gctttgtgaccagaaagctt

SEQ ID NO: 4871095 - DNA, 19 bp, Homo sapiens
gctttgttgtgagaatggc

SEQ ID NO: 4871096 - DNA, 14 bp, Homo sapiens
gcttttggcagaga

SEQ ID NO: 4871097 - DNA, 12 bp, Homo sapiens
ggaaaacatttg

SEQ ID NO: 4871098 - DNA, 13 bp, Homo sapiens
ggaaaacatttgc

SEQ ID NO: 4871099 - DNA, 17 bp, Homo sapiens
ggaaaaggcaggtgctt

SEQ ID NO: 4871100 - DNA, 18 bp, Homo sapiens
ggaaagagctaggaaccc

SEQ ID NO: 4871101 - DNA, 21 bp, Homo sapiens
ggaaagcacaagactggccca

SEQ ID NO: 4871102 - DNA, 18 bp, Homo sapiens
ggaaaggcagggccctga

SEQ ID NO: 4871103 - DNA, 11 bp, Homo sapiens
ggaaagtcaga

SEQ ID NO: 4871104 - DNA, 18 bp, Homo sapiens
ggaaatagatgtgcagtt

SEQ ID NO: 4871105 - DNA, 13 bp, Homo sapiens
ggaaatcttaaac

SEQ ID NO: 4871106 - DNA, 15 bp, Homo sapiens
ggaaatgaagcaggg

SEQ ID NO: 4871107 - DNA, 21 bp, Homo sapiens
ggaacccccctcccacccacc

SEQ ID NO: 4871108 - DNA, 18 bp, Homo sapiens
ggaacggtggaggcagag

SEQ ID NO: 4871109 - DNA, 15 bp, Homo sapiens
ggaactcccccagag

SEQ ID NO: 4871110 - DNA, 17 bp, Homo sapiens
ggaagaagtgagcagtg

SEQ ID NO: 4871111 - DNA, 16 bp, Homo sapiens
ggaagaatgaaagctg

SEQ ID NO: 4871112 - DNA, 12 bp, Homo sapiens
ggaagacctgaa

SEQ ID NO: 4871113 - DNA, 16 bp, Homo sapiens
ggaagagggaggggcc

SEQ ID NO: 4871114 - DNA, 18 bp, Homo sapiens
ggaagatgacctgcccca

SEQ ID NO: 4871115 - DNA, 16 bp, Homo sapiens
ggaaggagaagtaaga

SEQ ID NO: 4871116 - DNA, 15 bp, Homo sapiens
ggaagggaaagtttt

SEQ ID NO: 4871117 - DNA, 16 bp, Homo sapiens
ggaagggaccccagat

SEQ ID NO: 4871118 - DNA, 17 bp, Homo sapiens
ggaaggggcctgggctg

SEQ ID NO: 4871119 - DNA, 20 bp, Homo sapiens
ggaaggggcctgggctgtga

SEQ ID NO: 4871120 - DNA, 18 bp, Homo sapiens
ggaagtatgtatattaaa

SEQ ID NO: 4871121 - DNA, 22 bp, Homo sapiens
ggaagtcagaatttttaactgt

SEQ ID NO: 4871122 - DNA, 17 bp, Homo sapiens
ggaagtttgctgtgctt

SEQ ID NO: 4871123 - DNA, 21 bp, Homo sapiens
ggaatctttgtaccaaaattt

SEQ ID NO: 4871124 - DNA, 17 bp, Homo sapiens
ggaatgaggaaaattct

SEQ ID NO: 4871125 - DNA, 20 bp, Homo sapiens
ggaatggatttttctttaac

SEQ ID NO: 4871126 - DNA, 15 bp, Homo sapiens
ggaatggccacaaac

SEQ ID NO: 4871127 - DNA, 18 bp, Homo sapiens
ggaatggccacaaacctg

SEQ ID NO: 4871128 - DNA, 15 bp, Homo sapiens
ggaatgttctttctg

SEQ ID NO: 4871129 - DNA, 20 bp, Homo sapiens
ggaatgttctttctgctcta

SEQ ID NO: 4871130 - DNA, 11 bp, Homo sapiens
ggacagggccc

SEQ ID NO: 4871131 - DNA, 18 bp, Homo sapiens
ggacagggccctggagct

SEQ ID NO: 4871132 - DNA, 11 bp, Homo sapiens
ggacagtggtg

SEQ ID NO: 4871133 - DNA, 18 bp, Homo sapiens
ggacagttgatggagccc

SEQ ID NO: 4871134 - DNA, 19 bp, Homo sapiens
ggacatgcaataaaattta

SEQ ID NO: 4871135 - DNA, 22 bp, Homo sapiens
ggacatgcaataaaatttaaaa

SEQ ID NO: 4871136 - DNA, 19 bp, Homo sapiens
ggacatttgtgggcaagca

SEQ ID NO: 4871137 - DNA, 21 bp, Homo sapiens
ggacccatccctgcctggagg

SEQ ID NO: 4871138 - DNA, 22 bp, Homo sapiens
ggaccccagatacctgtgagga

SEQ ID NO: 4871139 - DNA, 22 bp, Homo sapiens
ggacccttctgggtccagggag

SEQ ID NO: 4871140 - DNA, 15 bp, Homo sapiens
ggacctccctgtctc

SEQ ID NO: 4871141 - DNA, 11 bp, Homo sapiens
ggacctcctta

SEQ ID NO: 4871142 - DNA, 14 bp, Homo sapiens
ggacgactctgacc

SEQ ID NO: 4871143 - DNA, 19 bp, Homo sapiens
ggacgggatgacctccaga

SEQ ID NO: 4871144 - DNA, 18 bp, Homo sapiens
ggacgttaggccaggcct

SEQ ID NO: 4871145 - DNA, 15 bp, Homo sapiens
ggactccaagccctg

SEQ ID NO: 4871146 - DNA, 23 bp, Homo sapiens
ggactccaagccctggggcaggg

SEQ ID NO: 4871147 - DNA, 22 bp, Homo sapiens
ggactccatccacctcatcact

SEQ ID NO: 4871148 - DNA, 14 bp, Homo sapiens
ggactcccagaacc

SEQ ID NO: 4871149 - DNA, 15 bp, Homo sapiens
ggactcccagaacct

SEQ ID NO: 4871150 - DNA, 14 bp, Homo sapiens
ggactctctccagg

SEQ ID NO: 4871151 - DNA, 21 bp, Homo sapiens
ggactggaaagcacaagactg

SEQ ID NO: 4871152 - DNA, 18 bp, Homo sapiens
ggacttctgaagagacca

SEQ ID NO: 4871153 - DNA, 13 bp, Homo sapiens
ggagaaacccaga

SEQ ID NO: 4871154 - DNA, 15 bp, Homo sapiens
ggagaaacccagaga

SEQ ID NO: 4871155 - DNA, 24 bp, Homo sapiens
ggagaaagcttggttctgtgaaca

SEQ ID NO: 4871156 - DNA, 12 bp, Homo sapiens
ggagaatactgc

SEQ ID NO: 4871157 - DNA, 16 bp, Homo sapiens
ggagaatggcatggca

SEQ ID NO: 4871158 - DNA, 22 bp, Homo sapiens
ggagaatggcatggcaggagtc

SEQ ID NO: 4871159 - DNA, 23 bp, Homo sapiens
ggagaatggcatggcaggagtct

SEQ ID NO: 4871160 - DNA, 11 bp, Homo sapiens
ggagacagcag

SEQ ID NO: 4871161 - DNA, 16 bp, Homo sapiens
ggagacagcagcctgt

SEQ ID NO: 4871162 - DNA, 15 bp, Homo sapiens
ggagacatgtgacat

SEQ ID NO: 4871163 - DNA, 22 bp, Homo sapiens
ggagacgtttataaacagaaat

SEQ ID NO: 4871164 - DNA, 17 bp, Homo sapiens
ggagagaggaggaaaag

SEQ ID NO: 4871165 - DNA, 19 bp, Homo sapiens
ggagagagtagctgcagcc

SEQ ID NO: 4871166 - DNA, 21 bp, Homo sapiens
ggagagccatacataaaagaa

SEQ ID NO: 4871167 - DNA, 12 bp, Homo sapiens
ggagaggggggc

SEQ ID NO: 4871168 - DNA, 20 bp, Homo sapiens
ggagatggggaataatttcc

SEQ ID NO: 4871169 - DNA, 17 bp, Homo sapiens
ggagattgaactttccc

SEQ ID NO: 4871170 - DNA, 22 bp, Homo sapiens
ggagcacacatccaagagggac

SEQ ID NO: 4871171 - DNA, 16 bp, Homo sapiens
ggagcagcaggcctct

SEQ ID NO: 4871172 - DNA, 22 bp, Homo sapiens
ggagcagcaggcctctgggacc

SEQ ID NO: 4871173 - DNA, 21 bp, Homo sapiens
ggagcagccaaggccgccagc

SEQ ID NO: 4871174 - DNA, 12 bp, Homo sapiens
ggagcaggccca

SEQ ID NO: 4871175 - DNA, 16 bp, Homo sapiens
ggagccagcctgcttc

SEQ ID NO: 4871176 - DNA, 21 bp, Homo sapiens
ggagccagcctgcttcccaca

SEQ ID NO: 4871177 - DNA, 11 bp, Homo sapiens
ggagccagctg

SEQ ID NO: 4871178 - DNA, 12 bp, Homo sapiens
ggagccaggact

SEQ ID NO: 4871179 - DNA, 21 bp, Homo sapiens
ggagccaggactcccagaacc

SEQ ID NO: 4871180 - DNA, 22 bp, Homo sapiens
ggagccaggactcccagaacct

SEQ ID NO: 4871181 - DNA, 21 bp, Homo sapiens
ggagcccataggccaccccct

SEQ ID NO: 4871182 - DNA, 22 bp, Homo sapiens
ggagcctacctctgtctgagac

SEQ ID NO: 4871183 - DNA, 16 bp, Homo sapiens
ggagcctggccaggca

SEQ ID NO: 4871184 - DNA, 17 bp, Homo sapiens
ggagcctggccaggcag

SEQ ID NO: 4871185 - DNA, 18 bp, Homo sapiens
ggaggaaaagtcttccta

SEQ ID NO: 4871186 - DNA, 23 bp, Homo sapiens
ggaggacttggttgatgtttaaa

SEQ ID NO: 4871187 - DNA, 14 bp, Homo sapiens
ggaggcagcagagc

SEQ ID NO: 4871188 - DNA, 22 bp, Homo sapiens
ggaggcctcaccccagggacag

SEQ ID NO: 4871189 - DNA, 21 bp, Homo sapiens
ggaggctttgggtggctcact

SEQ ID NO: 4871190 - DNA, 22 bp, Homo sapiens
ggagggaagacctgaaagagag

SEQ ID NO: 4871191 - DNA, 14 bp, Homo sapiens
ggagggcccctgcg

SEQ ID NO: 4871192 - DNA, 15 bp, Homo sapiens
ggaggggccctgtca

SEQ ID NO: 4871193 - DNA, 23 bp, Homo sapiens
ggagggggtttgctggggaactg

SEQ ID NO: 4871194 - DNA, 15 bp, Homo sapiens
ggagtcagtgccagg

SEQ ID NO: 4871195 - DNA, 15 bp, Homo sapiens
ggagtccactcccag

SEQ ID NO: 4871196 - DNA, 22 bp, Homo sapiens
ggagtctctgccagttacttgg

SEQ ID NO: 4871197 - DNA, 14 bp, Homo sapiens
ggagtgctcttccc

SEQ ID NO: 4871198 - DNA, 12 bp, Homo sapiens
ggagtgtgcaga

SEQ ID NO: 4871199 - DNA, 14 bp, Homo sapiens
ggagtgtgcagaca

SEQ ID NO: 4871200 - DNA, 16 bp, Homo sapiens
ggatactggggggcag

SEQ ID NO: 4871201 - DNA, 16 bp, Homo sapiens
ggatcccgtcttccag

SEQ ID NO: 4871202 - DNA, 17 bp, Homo sapiens
ggatcctccctcatggc

SEQ ID NO: 4871203 - DNA, 18 bp, Homo sapiens
ggatcgagtgtagctgtg

SEQ ID NO: 4871204 - DNA, 19 bp, Homo sapiens
ggatctccactggaccctt

SEQ ID NO: 4871205 - DNA, 15 bp, Homo sapiens
ggatgataaaggaaa

SEQ ID NO: 4871206 - DNA, 21 bp, Homo sapiens
ggatgcaaatagattcagaga

SEQ ID NO: 4871207 - DNA, 23 bp, Homo sapiens
ggatgcaaatagattcagagaaa

SEQ ID NO: 4871208 - DNA, 14 bp, Homo sapiens
ggatggtggtgcat

SEQ ID NO: 4871209 - DNA, 17 bp, Homo sapiens
ggatgtgtgggccagga

SEQ ID NO: 4871210 - DNA, 17 bp, Homo sapiens
ggatttaaaagcctgct

SEQ ID NO: 4871211 - DNA, 23 bp, Homo sapiens
ggcaaaaatgtccagccaccccc

SEQ ID NO: 4871212 - DNA, 14 bp, Homo sapiens
ggcaaggggtgagg

SEQ ID NO: 4871213 - DNA, 13 bp, Homo sapiens
ggcacaaacagaa

SEQ ID NO: 4871214 - DNA, 15 bp, Homo sapiens
ggcacagcctagggt

SEQ ID NO: 4871215 - DNA, 16 bp, Homo sapiens
ggcacatagcataggc

SEQ ID NO: 4871216 - DNA, 21 bp, Homo sapiens
ggcacccaccagttgctgctg

SEQ ID NO: 4871217 - DNA, 12 bp, Homo sapiens
ggcagatgaggg

SEQ ID NO: 4871218 - DNA, 16 bp, Homo sapiens
ggcagatggagcccat

SEQ ID NO: 4871219 - DNA, 23 bp, Homo sapiens
ggcagatgggggcctctctggaa

SEQ ID NO: 4871220 - DNA, 17 bp, Homo sapiens
ggcagatgtttgcctca

SEQ ID NO: 4871221 - DNA, 12 bp, Homo sapiens
ggcagcagagcg

SEQ ID NO: 4871222 - DNA, 20 bp, Homo sapiens
ggcagcaggccagagaaagc

SEQ ID NO: 4871223 - DNA, 15 bp, Homo sapiens
ggcagctagtgcctt

SEQ ID NO: 4871224 - DNA, 17 bp, Homo sapiens
ggcagctagtgccttta

SEQ ID NO: 4871225 - DNA, 13 bp, Homo sapiens
ggcagctgaaatt

SEQ ID NO: 4871226 - DNA, 21 bp, Homo sapiens
ggcaggacttctcaccagcag

SEQ ID NO: 4871227 - DNA, 19 bp, Homo sapiens
ggcaggagtctctgccagt

SEQ ID NO: 4871228 - DNA, 13 bp, Homo sapiens
ggcagggagagag

SEQ ID NO: 4871229 - DNA, 22 bp, Homo sapiens
ggcagggggtatgcagagcttg

SEQ ID NO: 4871230 - DNA, 21 bp, Homo sapiens
ggcaggtgcttttggcagaga

SEQ ID NO: 4871231 - DNA, 20 bp, Homo sapiens
ggcagttccttacctccctg

SEQ ID NO: 4871232 - DNA, 22 bp, Homo sapiens
ggcatccctttttcataaatta

SEQ ID NO: 4871233 - DNA, 17 bp, Homo sapiens
ggcattagcaaggcaga

SEQ ID NO: 4871234 - DNA, 14 bp, Homo sapiens
ggcattctcccagc

SEQ ID NO: 4871235 - DNA, 11 bp, Homo sapiens
ggcattgagta

SEQ ID NO: 4871236 - DNA, 19 bp, Homo sapiens
ggccaagctgaggaggtgc

SEQ ID NO: 4871237 - DNA, 13 bp, Homo sapiens
ggccacaaacctg

SEQ ID NO: 4871238 - DNA, 19 bp, Homo sapiens
ggccacagaaggtgaactt

SEQ ID NO: 4871239 - DNA, 18 bp, Homo sapiens
ggccacgggggcagtgtg

SEQ ID NO: 4871240 - DNA, 15 bp, Homo sapiens
ggccagagaaagcaa

SEQ ID NO: 4871241 - DNA, 20 bp, Homo sapiens
ggccagcagctgatgctgta

SEQ ID NO: 4871242 - DNA, 14 bp, Homo sapiens
ggccatcttctttc

SEQ ID NO: 4871243 - DNA, 23 bp, Homo sapiens
ggccatcttctttcttccaccca

SEQ ID NO: 4871244 - DNA, 16 bp, Homo sapiens
ggccatgtcctctctt

SEQ ID NO: 4871245 - DNA, 17 bp, Homo sapiens
ggccatgttcccagaac

SEQ ID NO: 4871246 - DNA, 17 bp, Homo sapiens
ggcccaatgctgctttt

SEQ ID NO: 4871247 - DNA, 21 bp, Homo sapiens
ggcccaggcagacaaccttgt

SEQ ID NO: 4871248 - DNA, 21 bp, Homo sapiens
ggcccattcagagctatggtg

SEQ ID NO: 4871249 - DNA, 13 bp, Homo sapiens
ggcccccttcagg

SEQ ID NO: 4871250 - DNA, 23 bp, Homo sapiens
ggcccccttcaggagcctggcca

SEQ ID NO: 4871251 - DNA, 14 bp, Homo sapiens
ggccctctctctgg

SEQ ID NO: 4871252 - DNA, 16 bp, Homo sapiens
ggccctctctctgggc

SEQ ID NO: 4871253 - DNA, 12 bp, Homo sapiens
ggccctgacagg

SEQ ID NO: 4871254 - DNA, 21 bp, Homo sapiens
ggccctgtcactgtccagagt

SEQ ID NO: 4871255 - DNA, 22 bp, Homo sapiens
ggccctgtgagcacaaagaaga

SEQ ID NO: 4871256 - DNA, 20 bp, Homo sapiens
ggccggagtcagtgccaggt

SEQ ID NO: 4871257 - DNA, 13 bp, Homo sapiens
ggcctcaggctcc

SEQ ID NO: 4871258 - DNA, 14 bp, Homo sapiens
ggcctcaggctccg

SEQ ID NO: 4871259 - DNA, 16 bp, Homo sapiens
ggcctccagaagctgc

SEQ ID NO: 4871260 - DNA, 17 bp, Homo sapiens
ggcctccagaagctgct

SEQ ID NO: 4871261 - DNA, 14 bp, Homo sapiens
ggcctcccctgggc

SEQ ID NO: 4871262 - DNA, 17 bp, Homo sapiens
ggcctcccctgggcagg

SEQ ID NO: 4871263 - DNA, 21 bp, Homo sapiens
ggcctcccctgggcagggttc

SEQ ID NO: 4871264 - DNA, 19 bp, Homo sapiens
ggcctctcctgccctctgc

SEQ ID NO: 4871265 - DNA, 12 bp, Homo sapiens
ggcctctgggac

SEQ ID NO: 4871266 - DNA, 20 bp, Homo sapiens
ggcctgctaaggctcctcct

SEQ ID NO: 4871267 - DNA, 19 bp, Homo sapiens
ggcctgcttgactttccag

SEQ ID NO: 4871268 - DNA, 16 bp, Homo sapiens
ggcctggagcaggccc

SEQ ID NO: 4871269 - DNA, 18 bp, Homo sapiens
ggcctgggctgtgaggac

SEQ ID NO: 4871270 - DNA, 21 bp, Homo sapiens
ggccttatctgaaaggccagc

SEQ ID NO: 4871271 - DNA, 23 bp, Homo sapiens
ggccttccctttacagctctcct

SEQ ID NO: 4871272 - DNA, 15 bp, Homo sapiens
ggccttgcctccagg

SEQ ID NO: 4871273 - DNA, 15 bp, Homo sapiens
ggcggcacagccttc

SEQ ID NO: 4871274 - DNA, 10 bp, Homo sapiens
ggcgggtgac

SEQ ID NO: 4871275 - DNA, 12 bp, Homo sapiens
ggctaggcctcc

SEQ ID NO: 4871276 - DNA, 18 bp, Homo sapiens
ggctattttctaaagact

SEQ ID NO: 4871277 - DNA, 20 bp, Homo sapiens
ggctattttctaaagacttg

SEQ ID NO: 4871278 - DNA, 16 bp, Homo sapiens
ggctcactactgaaca

SEQ ID NO: 4871279 - DNA, 18 bp, Homo sapiens
ggctcactactgaacaca

SEQ ID NO: 4871280 - DNA, 18 bp, Homo sapiens
ggctcagagaggtagcac

SEQ ID NO: 4871281 - DNA, 13 bp, Homo sapiens
ggctcagcctggt

SEQ ID NO: 4871282 - DNA, 23 bp, Homo sapiens
ggctcagcctggtttctgggtgc

SEQ ID NO: 4871283 - DNA, 18 bp, Homo sapiens
ggctcaggagaagccagt

SEQ ID NO: 4871284 - DNA, 21 bp, Homo sapiens
ggctcatgcctgtaatctcag

SEQ ID NO: 4871285 - DNA, 16 bp, Homo sapiens
ggctcctccttgccca

SEQ ID NO: 4871286 - DNA, 23 bp, Homo sapiens
ggctcctgcaaaaggaggtgaaa

SEQ ID NO: 4871287 - DNA, 22 bp, Homo sapiens
ggctctctatagcaccagggct

SEQ ID NO: 4871288 - DNA, 13 bp, Homo sapiens
ggctgaagctgga

SEQ ID NO: 4871289 - DNA, 15 bp, Homo sapiens
ggctgaagctggagc

SEQ ID NO: 4871290 - DNA, 20 bp, Homo sapiens
ggctgaagctggagcagcgg

SEQ ID NO: 4871291 - DNA, 17 bp, Homo sapiens
ggctgagccctcctgag

SEQ ID NO: 4871292 - DNA, 20 bp, Homo sapiens
ggctgccaggggctctgtgg

SEQ ID NO: 4871293 - DNA, 11 bp, Homo sapiens
ggctgctgctc

SEQ ID NO: 4871294 - DNA, 16 bp, Homo sapiens
ggctgctgctcctctc

SEQ ID NO: 4871295 - DNA, 20 bp, Homo sapiens
ggctgctgctcctctcttgg

SEQ ID NO: 4871296 - DNA, 23 bp, Homo sapiens
ggctggggtggagtgggaaggga

SEQ ID NO: 4871297 - DNA, 21 bp, Homo sapiens
ggctgtggccgtctcctccct

SEQ ID NO: 4871298 - DNA, 17 bp, Homo sapiens
ggcttcaacagccaagc

SEQ ID NO: 4871299 - DNA, 21 bp, Homo sapiens
ggctttgggtggctcactact

SEQ ID NO: 4871300 - DNA, 13 bp, Homo sapiens
gggaaaaggcagg

SEQ ID NO: 4871301 - DNA, 14 bp, Homo sapiens
gggaactcccccag

SEQ ID NO: 4871302 - DNA, 16 bp, Homo sapiens
gggaactcccccagag

SEQ ID NO: 4871303 - DNA, 20 bp, Homo sapiens
gggaagacctgaaagagagg

SEQ ID NO: 4871304 - DNA, 19 bp, Homo sapiens
gggaagatgacctgcccca

SEQ ID NO: 4871305 - DNA, 16 bp, Homo sapiens
gggaagggcctgccca

SEQ ID NO: 4871306 - DNA, 18 bp, Homo sapiens
gggaagtttgctgtgctt

SEQ ID NO: 4871307 - DNA, 22 bp, Homo sapiens
gggaagtttgctgtgctttgga

SEQ ID NO: 4871308 - DNA, 22 bp, Homo sapiens
gggaataatttccttcaggcag

SEQ ID NO: 4871309 - DNA, 16 bp, Homo sapiens
gggacaggaaagagag

SEQ ID NO: 4871310 - DNA, 19 bp, Homo sapiens
gggaccaggtttgcaggag

SEQ ID NO: 4871311 - DNA, 20 bp, Homo sapiens
gggaccaggtttgcaggagc

SEQ ID NO: 4871312 - DNA, 13 bp, Homo sapiens
gggactccaagcc

SEQ ID NO: 4871313 - DNA, 16 bp, Homo sapiens
gggactccaagccctg

SEQ ID NO: 4871314 - DNA, 17 bp, Homo sapiens
gggactccaagccctgg

SEQ ID NO: 4871315 - DNA, 13 bp, Homo sapiens
gggagacagcagc

SEQ ID NO: 4871316 - DNA, 15 bp, Homo sapiens
gggagacagcagcct

SEQ ID NO: 4871317 - DNA, 18 bp, Homo sapiens
gggagacagcagcctgta

SEQ ID NO: 4871318 - DNA, 14 bp, Homo sapiens
gggagattgaactt

SEQ ID NO: 4871319 - DNA, 22 bp, Homo sapiens
gggagcatttaatggcagctag

SEQ ID NO: 4871320 - DNA, 19 bp, Homo sapiens
gggagccacttctccccag

SEQ ID NO: 4871321 - DNA, 13 bp, Homo sapiens
gggagccagctgc

SEQ ID NO: 4871322 - DNA, 14 bp, Homo sapiens
gggagccagctgct

SEQ ID NO: 4871323 - DNA, 17 bp, Homo sapiens
gggagccagctgcttga

SEQ ID NO: 4871324 - DNA, 12 bp, Homo sapiens
gggagccaggac

SEQ ID NO: 4871325 - DNA, 14 bp, Homo sapiens
gggagccaggactc

SEQ ID NO: 4871326 - DNA, 19 bp, Homo sapiens
gggaggcagatggagccca

SEQ ID NO: 4871327 - DNA, 13 bp, Homo sapiens
gggaggtggccag

SEQ ID NO: 4871328 - DNA, 19 bp, Homo sapiens
gggatacagatctcagggc

SEQ ID NO: 4871329 - DNA, 19 bp, Homo sapiens
gggatggtaagagaaaaga

SEQ ID NO: 4871330 - DNA, 14 bp, Homo sapiens
gggcacagcctagg

SEQ ID NO: 4871331 - DNA, 20 bp, Homo sapiens
gggcacatagcataggctgg

SEQ ID NO: 4871332 - DNA, 19 bp, Homo sapiens
gggcacccaccagttgctg

SEQ ID NO: 4871333 - DNA, 19 bp, Homo sapiens
gggcaccgtattcctctcc

SEQ ID NO: 4871334 - DNA, 13 bp, Homo sapiens
gggcactggggcc

SEQ ID NO: 4871335 - DNA, 14 bp, Homo sapiens
gggcagcaggccag

SEQ ID NO: 4871336 - DNA, 15 bp, Homo sapiens
gggcagcaggccaga

SEQ ID NO: 4871337 - DNA, 22 bp, Homo sapiens
gggcagggggtatgcagagctt

SEQ ID NO: 4871338 - DNA, 18 bp, Homo sapiens
gggcagggtggggggcca

SEQ ID NO: 4871339 - DNA, 16 bp, Homo sapiens
gggcagtgtgaggacc

SEQ ID NO: 4871340 - DNA, 14 bp, Homo sapiens
gggcataaagtaaa

SEQ ID NO: 4871341 - DNA, 14 bp, Homo sapiens
gggcatgcccagcc

SEQ ID NO: 4871342 - DNA, 21 bp, Homo sapiens
gggcatggtggctcatgcctg

SEQ ID NO: 4871343 - DNA, 15 bp, Homo sapiens
gggcattagcaaggc

SEQ ID NO: 4871344 - DNA, 18 bp, Homo sapiens
gggccaacctcaggctcc

SEQ ID NO: 4871345 - DNA, 20 bp, Homo sapiens
gggccaacctcaggctccta

SEQ ID NO: 4871346 - DNA, 15 bp, Homo sapiens
gggccaaggtcctgc

SEQ ID NO: 4871347 - DNA, 18 bp, Homo sapiens
gggccatgttcccagaac

SEQ ID NO: 4871348 - DNA, 21 bp, Homo sapiens
gggccctctctctgggcccag

SEQ ID NO: 4871349 - DNA, 23 bp, Homo sapiens
gggccctgaaatggcctgtccct

SEQ ID NO: 4871350 - DNA, 17 bp, Homo sapiens
gggcctccagaagctgc

SEQ ID NO: 4871351 - DNA, 19 bp, Homo sapiens
gggcctccagaagctgctc

SEQ ID NO: 4871352 - DNA, 17 bp, Homo sapiens
gggcctcccctgggcag

SEQ ID NO: 4871353 - DNA, 18 bp, Homo sapiens
gggcctctcctgccctct

SEQ ID NO: 4871354 - DNA, 17 bp, Homo sapiens
gggcctgggctgtgagg

SEQ ID NO: 4871355 - DNA, 21 bp, Homo sapiens
gggcgtgtgtgacactgatga

SEQ ID NO: 4871356 - DNA, 15 bp, Homo sapiens
gggctctgtggcaaa

SEQ ID NO: 4871357 - DNA, 22 bp, Homo sapiens
gggctgcatgatttttgccctg

SEQ ID NO: 4871358 - DNA, 12 bp, Homo sapiens
gggctgctgctc

SEQ ID NO: 4871359 - DNA, 17 bp, Homo sapiens
gggctgctgctcctctc

SEQ ID NO: 4871360 - DNA, 16 bp, Homo sapiens
gggctggaaggacctg

SEQ ID NO: 4871361 - DNA, 15 bp, Homo sapiens
gggctggtgggacag

SEQ ID NO: 4871362 - DNA, 20 bp, Homo sapiens
gggcttaatggagttcttgt

SEQ ID NO: 4871363 - DNA, 22 bp, Homo sapiens
gggctttgtgaccagaaagctt

SEQ ID NO: 4871364 - DNA, 18 bp, Homo sapiens
ggggaactcccccagagg

SEQ ID NO: 4871365 - DNA, 12 bp, Homo sapiens
ggggaaggggcc

SEQ ID NO: 4871366 - DNA, 16 bp, Homo sapiens
ggggagaaacccagag

SEQ ID NO: 4871367 - DNA, 15 bp, Homo sapiens
ggggagattgaactt

SEQ ID NO: 4871368 - DNA, 13 bp, Homo sapiens
ggggaggtggcca

SEQ ID NO: 4871369 - DNA, 17 bp, Homo sapiens
ggggaggttgtggggcc

SEQ ID NO: 4871370 - DNA, 12 bp, Homo sapiens
ggggcaggcctc

SEQ ID NO: 4871371 - DNA, 13 bp, Homo sapiens
ggggcaggcctcc

SEQ ID NO: 4871372 - DNA, 23 bp, Homo sapiens
ggggcaggcctcccaagctgatg

SEQ ID NO: 4871373 - DNA, 19 bp, Homo sapiens
ggggccaacctcaggctcc

SEQ ID NO: 4871374 - DNA, 20 bp, Homo sapiens
ggggccaacctcaggctcct

SEQ ID NO: 4871375 - DNA, 12 bp, Homo sapiens
ggggccaggaaa

SEQ ID NO: 4871376 - DNA, 15 bp, Homo sapiens
ggggcctccagaagc

SEQ ID NO: 4871377 - DNA, 17 bp, Homo sapiens
ggggcctccagaagctg

SEQ ID NO: 4871378 - DNA, 12 bp, Homo sapiens
ggggcctgggct

SEQ ID NO: 4871379 - DNA, 14 bp, Homo sapiens
ggggcctgggctgt

SEQ ID NO: 4871380 - DNA, 22 bp, Homo sapiens
ggggctaaggtttccagtcaga

SEQ ID NO: 4871381 - DNA, 14 bp, Homo sapiens
ggggctaatttaac

SEQ ID NO: 4871382 - DNA, 20 bp, Homo sapiens
ggggtcaggggagacgaggc

SEQ ID NO: 4871383 - DNA, 13 bp, Homo sapiens
ggggtcccctctg

SEQ ID NO: 4871384 - DNA, 12 bp, Homo sapiens
ggggtccctgca

SEQ ID NO: 4871385 - DNA, 21 bp, Homo sapiens
ggggtgagaagtacagggcag

SEQ ID NO: 4871386 - DNA, 20 bp, Homo sapiens
ggggttccttccacttctgg

SEQ ID NO: 4871387 - DNA, 12 bp, Homo sapiens
gggtaaagcagt

SEQ ID NO: 4871388 - DNA, 12 bp, Homo sapiens
gggtcagggggg

SEQ ID NO: 4871389 - DNA, 23 bp, Homo sapiens
gggtcttgctttctttgacctct

SEQ ID NO: 4871390 - DNA, 22 bp, Homo sapiens
gggtgagaagtacagggcagaa

SEQ ID NO: 4871391 - DNA, 16 bp, Homo sapiens
gggtgtggggtggggt

SEQ ID NO: 4871392 - DNA, 15 bp, Homo sapiens
gggtttattcactga

SEQ ID NO: 4871393 - DNA, 21 bp, Homo sapiens
ggtaaagcagttcctgtccca

SEQ ID NO: 4871394 - DNA, 12 bp, Homo sapiens
ggtaaatgtttc

SEQ ID NO: 4871395 - DNA, 20 bp, Homo sapiens
ggtacttatttctcagctgt

SEQ ID NO: 4871396 - DNA, 17 bp, Homo sapiens
ggtagctggggagccct

SEQ ID NO: 4871397 - DNA, 21 bp, Homo sapiens
ggtaggaccctcgagagcctt

SEQ ID NO: 4871398 - DNA, 15 bp, Homo sapiens
ggtagtggctggggt

SEQ ID NO: 4871399 - DNA, 16 bp, Homo sapiens
ggtagtggctggggtg

SEQ ID NO: 4871400 - DNA, 16 bp, Homo sapiens
ggtatgtagccagctg

SEQ ID NO: 4871401 - DNA, 18 bp, Homo sapiens
ggtatgtagccagctgtg

SEQ ID NO: 4871402 - DNA, 14 bp, Homo sapiens
ggtcacatccatcc

SEQ ID NO: 4871403 - DNA, 20 bp, Homo sapiens
ggtcagcatccagtgtgaga

SEQ ID NO: 4871404 - DNA, 11 bp, Homo sapiens
ggtccagggag

SEQ ID NO: 4871405 - DNA, 12 bp, Homo sapiens
ggtcccctctgt

SEQ ID NO: 4871406 - DNA, 16 bp, Homo sapiens
ggtccctgttgtcaga

SEQ ID NO: 4871407 - DNA, 15 bp, Homo sapiens
ggtcctagtaagaag

SEQ ID NO: 4871408 - DNA, 23 bp, Homo sapiens
ggtccttgtttctgccctgccag

SEQ ID NO: 4871409 - DNA, 14 bp, Homo sapiens
ggtctagagagaac

SEQ ID NO: 4871410 - DNA, 18 bp, Homo sapiens
ggtctcctcagggtgggg

SEQ ID NO: 4871411 - DNA, 15 bp, Homo sapiens
ggtctctcagggatg

SEQ ID NO: 4871412 - DNA, 11 bp, Homo sapiens
ggtctgccaat

SEQ ID NO: 4871413 - DNA, 23 bp, Homo sapiens
ggtctggcttgggtgaatttcag

SEQ ID NO: 4871414 - DNA, 14 bp, Homo sapiens
ggtgaaggggctgg

SEQ ID NO: 4871415 - DNA, 16 bp, Homo sapiens
ggtgaaggggctggtg

SEQ ID NO: 4871416 - DNA, 19 bp, Homo sapiens
ggtgaggtgaactccaggc

SEQ ID NO: 4871417 - DNA, 21 bp, Homo sapiens
ggtgaggtgaactccaggcat

SEQ ID NO: 4871418 - DNA, 20 bp, Homo sapiens
ggtgcactccagactctggg

SEQ ID NO: 4871419 - DNA, 21 bp, Homo sapiens
ggtgcactccagactctgggg

SEQ ID NO: 4871420 - DNA, 14 bp, Homo sapiens
ggtgccctttcctg

SEQ ID NO: 4871421 - DNA, 15 bp, Homo sapiens
ggtgctcatgctgct

SEQ ID NO: 4871422 - DNA, 17 bp, Homo sapiens
ggtgctttgcattttga

SEQ ID NO: 4871423 - DNA, 22 bp, Homo sapiens
ggtggaagtgtgtgccaagagc

SEQ ID NO: 4871424 - DNA, 18 bp, Homo sapiens
ggtggacatctgacccca

SEQ ID NO: 4871425 - DNA, 21 bp, Homo sapiens
ggtggatactggggggcaggc

SEQ ID NO: 4871426 - DNA, 17 bp, Homo sapiens
ggtggccttgagtctct

SEQ ID NO: 4871427 - DNA, 14 bp, Homo sapiens
ggtggctcactact

SEQ ID NO: 4871428 - DNA, 17 bp, Homo sapiens
ggtggtgaaggggctgg

SEQ ID NO: 4871429 - DNA, 19 bp, Homo sapiens
ggtggtgaaggggctggtg

SEQ ID NO: 4871430 - DNA, 15 bp, Homo sapiens
ggtgtctccttaagc

SEQ ID NO: 4871431 - DNA, 15 bp, Homo sapiens
ggtgtgaacatgttc

SEQ ID NO: 4871432 - DNA, 16 bp, Homo sapiens
ggtgtgaacatgttct

SEQ ID NO: 4871433 - DNA, 14 bp, Homo sapiens
ggtgtgaggagaga

SEQ ID NO: 4871434 - DNA, 15 bp, Homo sapiens
ggtgtggggtggggt

SEQ ID NO: 4871435 - DNA, 19 bp, Homo sapiens
ggtgttgcagccgcagaga

SEQ ID NO: 4871436 - DNA, 23 bp, Homo sapiens
ggtgttgcagccgcagagaaatg

SEQ ID NO: 4871437 - DNA, 15 bp, Homo sapiens
ggtgtttttaataaa

SEQ ID NO: 4871438 - DNA, 23 bp, Homo sapiens
ggttcaacaaagaaacaaagatg

SEQ ID NO: 4871439 - DNA, 16 bp, Homo sapiens
ggttcagacccctgcc

SEQ ID NO: 4871440 - DNA, 17 bp, Homo sapiens
ggttcagacccctgcct

SEQ ID NO: 4871441 - DNA, 18 bp, Homo sapiens
ggttcagacccctgcctg

SEQ ID NO: 4871442 - DNA, 16 bp, Homo sapiens
ggttccatgttgactg

SEQ ID NO: 4871443 - DNA, 14 bp, Homo sapiens
ggttgtctctcttc

SEQ ID NO: 4871444 - DNA, 23 bp, Homo sapiens
ggttgtctctcttcggtggcctt

SEQ ID NO: 4871445 - DNA, 16 bp, Homo sapiens
ggttgtgcacatttct

SEQ ID NO: 4871446 - DNA, 20 bp, Homo sapiens
ggttgtggggcctcaggctc

SEQ ID NO: 4871447 - DNA, 13 bp, Homo sapiens
ggtttattctttg

SEQ ID NO: 4871448 - DNA, 18 bp, Homo sapiens
ggtttgaaggagaatggc

SEQ ID NO: 4871449 - DNA, 14 bp, Homo sapiens
ggtttgggagccag

SEQ ID NO: 4871450 - DNA, 15 bp, Homo sapiens
ggtttgggagccagg

SEQ ID NO: 4871451 - DNA, 16 bp, Homo sapiens
ggtttgggagccagga

SEQ ID NO: 4871452 - DNA, 17 bp, Homo sapiens
gtaaaatactattgcct

SEQ ID NO: 4871453 - DNA, 21 bp, Homo sapiens
gtaaagatgtttatttcaggc

SEQ ID NO: 4871454 - DNA, 16 bp, Homo sapiens
gtaaatgaagatcttt

SEQ ID NO: 4871455 - DNA, 21 bp, Homo sapiens
gtaaatgaagatctttatatt

SEQ ID NO: 4871456 - DNA, 16 bp, Homo sapiens
gtaaccagctcagtgt

SEQ ID NO: 4871457 - DNA, 19 bp, Homo sapiens
gtaacgtattggacctgcc

SEQ ID NO: 4871458 - DNA, 22 bp, Homo sapiens
gtaactgtttagatgaatgtca

SEQ ID NO: 4871459 - DNA, 19 bp, Homo sapiens
gtaagagaaaagagagaaa

SEQ ID NO: 4871460 - DNA, 17 bp, Homo sapiens
gtaaggtgcttggagtt

SEQ ID NO: 4871461 - DNA, 17 bp, Homo sapiens
gtaagtggagtcctgga

SEQ ID NO: 4871462 - DNA, 21 bp, Homo sapiens
gtaataagcactgtaaacttc

SEQ ID NO: 4871463 - DNA, 16 bp, Homo sapiens
gtaataatagactgta

SEQ ID NO: 4871464 - DNA, 17 bp, Homo sapiens
gtaatacttccagaagt

SEQ ID NO: 4871465 - DNA, 18 bp, Homo sapiens
gtaatatttatatattta

SEQ ID NO: 4871466 - DNA, 15 bp, Homo sapiens
gtaatccaggggtgt

SEQ ID NO: 4871467 - DNA, 20 bp, Homo sapiens
gtaatcccctaaaataacag

SEQ ID NO: 4871468 - DNA, 20 bp, Homo sapiens
gtaatctatgtttataatac

SEQ ID NO: 4871469 - DNA, 15 bp, Homo sapiens
gtaatctcaatgcaa

SEQ ID NO: 4871470 - DNA, 21 bp, Homo sapiens
gtaatgctgcctcaggaccca

SEQ ID NO: 4871471 - DNA, 14 bp, Homo sapiens
gtaattgggaactg

SEQ ID NO: 4871472 - DNA, 19 bp, Homo sapiens
gtaatttaaatgaaagaaa

SEQ ID NO: 4871473 - DNA, 21 bp, Homo sapiens
gtaatttaaatgaaagaaaat

SEQ ID NO: 4871474 - DNA, 16 bp, Homo sapiens
gtacaaaatggtccta

SEQ ID NO: 4871475 - DNA, 12 bp, Homo sapiens
gtacaaaattaa

SEQ ID NO: 4871476 - DNA, 17 bp, Homo sapiens
gtacagaatttgaatta

SEQ ID NO: 4871477 - DNA, 18 bp, Homo sapiens
gtacaggtcatctgctgg

SEQ ID NO: 4871478 - DNA, 19 bp, Homo sapiens
gtaccaaaattttaaaaaa

SEQ ID NO: 4871479 - DNA, 23 bp, Homo sapiens
gtacgaacctacagttttaactg

SEQ ID NO: 4871480 - DNA, 14 bp, Homo sapiens
gtactgatttcagt

SEQ ID NO: 4871481 - DNA, 20 bp, Homo sapiens
gtactgatttcagtaagtct

SEQ ID NO: 4871482 - DNA, 12 bp, Homo sapiens
gtactgcatgtg

SEQ ID NO: 4871483 - DNA, 16 bp, Homo sapiens
gtactgtactttccca

SEQ ID NO: 4871484 - DNA, 23 bp, Homo sapiens
gtactgtactttcccaggttgac

SEQ ID NO: 4871485 - DNA, 18 bp, Homo sapiens
gtacttatttctcagctg

SEQ ID NO: 4871486 - DNA, 19 bp, Homo sapiens
gtacttatttctcagctgt

SEQ ID NO: 4871487 - DNA, 18 bp, Homo sapiens
gtacttcttgaatataaa

SEQ ID NO: 4871488 - DNA, 23 bp, Homo sapiens
gtacttggcccccttcaggagcc

SEQ ID NO: 4871489 - DNA, 20 bp, Homo sapiens
gtactttcccaggttgacta

SEQ ID NO: 4871490 - DNA, 20 bp, Homo sapiens
gtagagccaattagacttga

SEQ ID NO: 4871491 - DNA, 21 bp, Homo sapiens
gtagagcccctactgtgggca

SEQ ID NO: 4871492 - DNA, 16 bp, Homo sapiens
gtagctggggagccct

SEQ ID NO: 4871493 - DNA, 16 bp, Homo sapiens
gtaggaccctcgagag

SEQ ID NO: 4871494 - DNA, 17 bp, Homo sapiens
gtagggccctgacaggc

SEQ ID NO: 4871495 - DNA, 21 bp, Homo sapiens
gtagggccctgacaggccttc

SEQ ID NO: 4871496 - DNA, 21 bp, Homo sapiens
gtaggggagagagcagagaag

SEQ ID NO: 4871497 - DNA, 13 bp, Homo sapiens
gtagtggctgggg

SEQ ID NO: 4871498 - DNA, 21 bp, Homo sapiens
gtatacttccttacttttaag

SEQ ID NO: 4871499 - DNA, 17 bp, Homo sapiens
gtatataaactgggatg

SEQ ID NO: 4871500 - DNA, 22 bp, Homo sapiens
gtatatattttgtgtgaaattg

SEQ ID NO: 4871501 - DNA, 16 bp, Homo sapiens
gtatatgactgcattt

SEQ ID NO: 4871502 - DNA, 20 bp, Homo sapiens
gtatatgactgcatttgtgt

SEQ ID NO: 4871503 - DNA, 22 bp, Homo sapiens
gtatctagagcttaatgctaca

SEQ ID NO: 4871504 - DNA, 15 bp, Homo sapiens
gtatgatactaaaga

SEQ ID NO: 4871505 - DNA, 13 bp, Homo sapiens
gtatgcagagctt

SEQ ID NO: 4871506 - DNA, 20 bp, Homo sapiens
gtatgtgctatacacacaca

SEQ ID NO: 4871507 - DNA, 20 bp, Homo sapiens
gtattatacatgtgatacat

SEQ ID NO: 4871508 - DNA, 22 bp, Homo sapiens
gtattatacatgtgatacattt

SEQ ID NO: 4871509 - DNA, 15 bp, Homo sapiens
gtattatctcctttg

SEQ ID NO: 4871510 - DNA, 11 bp, Homo sapiens
gtattcctctc

SEQ ID NO: 4871511 - DNA, 16 bp, Homo sapiens
gtattgcacattgtaa

SEQ ID NO: 4871512 - DNA, 22 bp, Homo sapiens
gtattggtgttgcagccgcaga

SEQ ID NO: 4871513 - DNA, 22 bp, Homo sapiens
gtatttatgggtggatttatcc

SEQ ID NO: 4871514 - DNA, 22 bp, Homo sapiens
gtattttatcttattttctcaa

SEQ ID NO: 4871515 - DNA, 16 bp, Homo sapiens
gtcacactgtggccag

SEQ ID NO: 4871516 - DNA, 22 bp, Homo sapiens
gtcaccaaatagtgtgaaatat

SEQ ID NO: 4871517 - DNA, 14 bp, Homo sapiens
gtcactcccaagcc

SEQ ID NO: 4871518 - DNA, 14 bp, Homo sapiens
gtcacttttccttt

SEQ ID NO: 4871519 - DNA, 18 bp, Homo sapiens
gtcagaatttttaactgt

SEQ ID NO: 4871520 - DNA, 13 bp, Homo sapiens
gtcagacatttct

SEQ ID NO: 4871521 - DNA, 12 bp, Homo sapiens
gtcagatgaggc

SEQ ID NO: 4871522 - DNA, 15 bp, Homo sapiens
gtcagcagtcctagc

SEQ ID NO: 4871523 - DNA, 17 bp, Homo sapiens
gtcagcagtcctagccc

SEQ ID NO: 4871524 - DNA, 17 bp, Homo sapiens
gtcagttgttatttatt

SEQ ID NO: 4871525 - DNA, 18 bp, Homo sapiens
gtcagttgttatttattg

SEQ ID NO: 4871526 - DNA, 16 bp, Homo sapiens
gtcatgtgagtctggg

SEQ ID NO: 4871527 - DNA, 16 bp, Homo sapiens
gtccactcccagtgct

SEQ ID NO: 4871528 - DNA, 13 bp, Homo sapiens
gtccagagtctct

SEQ ID NO: 4871529 - DNA, 18 bp, Homo sapiens
gtccagccacccccaggc

SEQ ID NO: 4871530 - DNA, 20 bp, Homo sapiens
gtcccaaggaatcagcagga

SEQ ID NO: 4871531 - DNA, 14 bp, Homo sapiens
gtcccacatggcca

SEQ ID NO: 4871532 - DNA, 20 bp, Homo sapiens
gtcccatggctgaagctgga

SEQ ID NO: 4871533 - DNA, 14 bp, Homo sapiens
gtcccctctgtgct

SEQ ID NO: 4871534 - DNA, 16 bp, Homo sapiens
gtcccctctgtgcttc

SEQ ID NO: 4871535 - DNA, 20 bp, Homo sapiens
gtcccctctgtgcttcgact

SEQ ID NO: 4871536 - DNA, 21 bp, Homo sapiens
gtcccggttcagacccctgcc

SEQ ID NO: 4871537 - DNA, 20 bp, Homo sapiens
gtccctgcaaaactccaggc

SEQ ID NO: 4871538 - DNA, 22 bp, Homo sapiens
gtccctgcaaaactccaggcag

SEQ ID NO: 4871539 - DNA, 20 bp, Homo sapiens
gtccgcagttgtagcagaaa

SEQ ID NO: 4871540 - DNA, 19 bp, Homo sapiens
gtccgtgccccttccctgg

SEQ ID NO: 4871541 - DNA, 22 bp, Homo sapiens
gtcctaacctcgggcctgctgc

SEQ ID NO: 4871542 - DNA, 23 bp, Homo sapiens
gtcctctcagttctctcccttcc

SEQ ID NO: 4871543 - DNA, 17 bp, Homo sapiens
gtcctctcggctgccag

SEQ ID NO: 4871544 - DNA, 19 bp, Homo sapiens
gtccttgatttcaaagttt

SEQ ID NO: 4871545 - DNA, 17 bp, Homo sapiens
gtcgtcatcagatgctt

SEQ ID NO: 4871546 - DNA, 23 bp, Homo sapiens
gtctaacttggggaaggggcctg

SEQ ID NO: 4871547 - DNA, 15 bp, Homo sapiens
gtctaccaatacaaa

SEQ ID NO: 4871548 - DNA, 20 bp, Homo sapiens
gtctaggcactgagcaggga

SEQ ID NO: 4871549 - DNA, 18 bp, Homo sapiens
gtctaggtctcctcaggg

SEQ ID NO: 4871550 - DNA, 22 bp, Homo sapiens
gtctcaggtttgttttgtgaat

SEQ ID NO: 4871551 - DNA, 17 bp, Homo sapiens
gtctccgggactgccct

SEQ ID NO: 4871552 - DNA, 12 bp, Homo sapiens
gtctcctccctc

SEQ ID NO: 4871553 - DNA, 19 bp, Homo sapiens
gtctcctccctcagctctc

SEQ ID NO: 4871554 - DNA, 21 bp, Homo sapiens
gtctctgccagttacttgggc

SEQ ID NO: 4871555 - DNA, 12 bp, Homo sapiens
gtctgagacagg

SEQ ID NO: 4871556 - DNA, 21 bp, Homo sapiens
gtctgagtcatggccgggtgg

SEQ ID NO: 4871557 - DNA, 22 bp, Homo sapiens
gtctgccaatctgtacaaaatg

SEQ ID NO: 4871558 - DNA, 13 bp, Homo sapiens
gtctgctcctctt

SEQ ID NO: 4871559 - DNA, 15 bp, Homo sapiens
gtctggggtgtgggg

SEQ ID NO: 4871560 - DNA, 23 bp, Homo sapiens
gtctggttcctgtgtgaccctgg

SEQ ID NO: 4871561 - DNA, 20 bp, Homo sapiens
gtctgtggctttcagcctct

SEQ ID NO: 4871562 - DNA, 21 bp, Homo sapiens
gtctgtggctttcagcctctg

SEQ ID NO: 4871563 - DNA, 17 bp, Homo sapiens
gtctgtgttttgaaaga

SEQ ID NO: 4871564 - DNA, 22 bp, Homo sapiens
gtcttaaactaaatgtgcaata

SEQ ID NO: 4871565 - DNA, 21 bp, Homo sapiens
gtcttcctaattgtgccccta

SEQ ID NO: 4871566 - DNA, 14 bp, Homo sapiens
gtcttctatttatt

SEQ ID NO: 4871567 - DNA, 17 bp, Homo sapiens
gtcttctatttatttat

SEQ ID NO: 4871568 - DNA, 20 bp, Homo sapiens
gtcttctcacaagccagcca

SEQ ID NO: 4871569 - DNA, 21 bp, Homo sapiens
gtcttctttctccatggagcc

SEQ ID NO: 4871570 - DNA, 23 bp, Homo sapiens
gtcttctttctccatggagccta

SEQ ID NO: 4871571 - DNA, 22 bp, Homo sapiens
gtcttggaagctgtttggaaaa

SEQ ID NO: 4871572 - DNA, 15 bp, Homo sapiens
gtcttggatatatag

SEQ ID NO: 4871573 - DNA, 23 bp, Homo sapiens
gtcttgtgtttccacagcctgca

SEQ ID NO: 4871574 - DNA, 22 bp, Homo sapiens
gtctttcttcactctggcttca

SEQ ID NO: 4871575 - DNA, 13 bp, Homo sapiens
gtgaacactgtga

SEQ ID NO: 4871576 - DNA, 14 bp, Homo sapiens
gtgaactccaggca

SEQ ID NO: 4871577 - DNA, 14 bp, Homo sapiens
gtgaagtttggaga

SEQ ID NO: 4871578 - DNA, 16 bp, Homo sapiens
gtgaataaatgtcttg

SEQ ID NO: 4871579 - DNA, 15 bp, Homo sapiens
gtgaatacctgctca

SEQ ID NO: 4871580 - DNA, 18 bp, Homo sapiens
gtgaatgtgtgagaaaaa

SEQ ID NO: 4871581 - DNA, 13 bp, Homo sapiens
gtgacaaagcaat

SEQ ID NO: 4871582 - DNA, 13 bp, Homo sapiens
gtgaccaggcttt

SEQ ID NO: 4871583 - DNA, 20 bp, Homo sapiens
gtgactcagcatcacccacc

SEQ ID NO: 4871584 - DNA, 20 bp, Homo sapiens
gtgactccagggtgacaagg

SEQ ID NO: 4871585 - DNA, 17 bp, Homo sapiens
gtgactccttatctctt

SEQ ID NO: 4871586 - DNA, 20 bp, Homo sapiens
gtgactccttatctctttcc

SEQ ID NO: 4871587 - DNA, 19 bp, Homo sapiens
gtgacttctcccctgccct

SEQ ID NO: 4871588 - DNA, 11 bp, Homo sapiens
gtgagaatggc

SEQ ID NO: 4871589 - DNA, 23 bp, Homo sapiens
gtgagacgtgatgggctaggcct

SEQ ID NO: 4871590 - DNA, 15 bp, Homo sapiens
gtgagatactgtgta

SEQ ID NO: 4871591 - DNA, 16 bp, Homo sapiens
gtgagcatggggccag

SEQ ID NO: 4871592 - DNA, 14 bp, Homo sapiens
gtgaggacagggcc

SEQ ID NO: 4871593 - DNA, 20 bp, Homo sapiens
gtgaggtgaactccaggcat

SEQ ID NO: 4871594 - DNA, 18 bp, Homo sapiens
gtgagtgacgatgatgta

SEQ ID NO: 4871595 - DNA, 15 bp, Homo sapiens
gtgagtggcctgcta

SEQ ID NO: 4871596 - DNA, 21 bp, Homo sapiens
gtgatatataagtgtacatat

SEQ ID NO: 4871597 - DNA, 23 bp, Homo sapiens
gtgatttgaaaaatataaaatta

SEQ ID NO: 4871598 - DNA, 12 bp, Homo sapiens
gtgcaatagaag

SEQ ID NO: 4871599 - DNA, 21 bp, Homo sapiens
gtgcaataggtgagagaatgt

SEQ ID NO: 4871600 - DNA, 11 bp, Homo sapiens
gtgcactccag

SEQ ID NO: 4871601 - DNA, 12 bp, Homo sapiens
gtgcactccaga

SEQ ID NO: 4871602 - DNA, 14 bp, Homo sapiens
gtgcactccagact

SEQ ID NO: 4871603 - DNA, 15 bp, Homo sapiens
gtgcactccagactc

SEQ ID NO: 4871604 - DNA, 14 bp, Homo sapiens
gtgcagacagccat

SEQ ID NO: 4871605 - DNA, 14 bp, Homo sapiens
gtgcagtttggaat

SEQ ID NO: 4871606 - DNA, 13 bp, Homo sapiens
gtgccaagagcta

SEQ ID NO: 4871607 - DNA, 17 bp, Homo sapiens
gtgccaagagctactcc

SEQ ID NO: 4871608 - DNA, 20 bp, Homo sapiens
gtgccagcaagtccttaggc

SEQ ID NO: 4871609 - DNA, 17 bp, Homo sapiens
gtgcccctaaagagcat

SEQ ID NO: 4871610 - DNA, 19 bp, Homo sapiens
gtgcctaacctgggacctg

SEQ ID NO: 4871611 - DNA, 15 bp, Homo sapiens
gtgcctaatgtgttt

SEQ ID NO: 4871612 - DNA, 18 bp, Homo sapiens
gtgcctttctacaactga

SEQ ID NO: 4871613 - DNA, 14 bp, Homo sapiens
gtgcgaagactgag

SEQ ID NO: 4871614 - DNA, 12 bp, Homo sapiens
gtgctgctgtgg

SEQ ID NO: 4871615 - DNA, 13 bp, Homo sapiens
gtgctgctgtgga

SEQ ID NO: 4871616 - DNA, 14 bp, Homo sapiens
gtgctgctgtggag

SEQ ID NO: 4871617 - DNA, 23 bp, Homo sapiens
gtgcttgctggtgcctgccacct

SEQ ID NO: 4871618 - DNA, 20 bp, Homo sapiens
gtggacgttaggccaggcct

SEQ ID NO: 4871619 - DNA, 14 bp, Homo sapiens
gtggagcagagctc

SEQ ID NO: 4871620 - DNA, 19 bp, Homo sapiens
gtggatactggggggcagg

SEQ ID NO: 4871621 - DNA, 23 bp, Homo sapiens
gtggatcgagtgtagctgtgaaa

SEQ ID NO: 4871622 - DNA, 17 bp, Homo sapiens
gtggattgcctctgaaa

SEQ ID NO: 4871623 - DNA, 18 bp, Homo sapiens
gtggcaaaaagagtcaga

SEQ ID NO: 4871624 - DNA, 18 bp, Homo sapiens
gtggcagcttgctgggct

SEQ ID NO: 4871625 - DNA, 20 bp, Homo sapiens
gtggcagcttgctgggcttt

SEQ ID NO: 4871626 - DNA, 20 bp, Homo sapiens
gtggccacgggggcagtgtg

SEQ ID NO: 4871627 - DNA, 21 bp, Homo sapiens
gtggccacgggggcagtgtga

SEQ ID NO: 4871628 - DNA, 13 bp, Homo sapiens
gtggccagcccgc

SEQ ID NO: 4871629 - DNA, 18 bp, Homo sapiens
gtggccagcccgcagagg

SEQ ID NO: 4871630 - DNA, 18 bp, Homo sapiens
gtggccgtctcctccctc

SEQ ID NO: 4871631 - DNA, 16 bp, Homo sapiens
gtggcctctgcctggg

SEQ ID NO: 4871632 - DNA, 14 bp, Homo sapiens
gtggcctgcaggag

SEQ ID NO: 4871633 - DNA, 22 bp, Homo sapiens
gtggctggaaccacattgaaga

SEQ ID NO: 4871634 - DNA, 16 bp, Homo sapiens
gtgggagacagcagcc

SEQ ID NO: 4871635 - DNA, 16 bp, Homo sapiens
gtgggatcctccctca

SEQ ID NO: 4871636 - DNA, 20 bp, Homo sapiens
gtgggatttccagaaccaca

SEQ ID NO: 4871637 - DNA, 14 bp, Homo sapiens
gtgggccaggatcc

SEQ ID NO: 4871638 - DNA, 23 bp, Homo sapiens
gtggggggccatgttcccagaac

SEQ ID NO: 4871639 - DNA, 12 bp, Homo sapiens
gtggggggtgac

SEQ ID NO: 4871640 - DNA, 16 bp, Homo sapiens
gtggggtgctggggct

SEQ ID NO: 4871641 - DNA, 21 bp, Homo sapiens
gtggggtgctggggctgcatg

SEQ ID NO: 4871642 - DNA, 18 bp, Homo sapiens
gtggtgaaggggctggtg

SEQ ID NO: 4871643 - DNA, 18 bp, Homo sapiens
gtggtgatttgaaaaata

SEQ ID NO: 4871644 - DNA, 21 bp, Homo sapiens
gtggtgatttgaaaaatataa

SEQ ID NO: 4871645 - DNA, 15 bp, Homo sapiens
gtggtggtgaagggg

SEQ ID NO: 4871646 - DNA, 15 bp, Homo sapiens
gtggtggtggtgaag

SEQ ID NO: 4871647 - DNA, 15 bp, Homo sapiens
gtgtacatatgtgct

SEQ ID NO: 4871648 - DNA, 14 bp, Homo sapiens
gtgtagctgtgaaa

SEQ ID NO: 4871649 - DNA, 20 bp, Homo sapiens
gtgtagtcccggaggccttc

SEQ ID NO: 4871650 - DNA, 16 bp, Homo sapiens
gtgtattggtgttgca

SEQ ID NO: 4871651 - DNA, 14 bp, Homo sapiens
gtgtccctaatgtg

SEQ ID NO: 4871652 - DNA, 16 bp, Homo sapiens
gtgtcggatcctgtga

SEQ ID NO: 4871653 - DNA, 19 bp, Homo sapiens
gtgtctaggcactgagcag

SEQ ID NO: 4871654 - DNA, 20 bp, Homo sapiens
gtgtctggccctaactccta

SEQ ID NO: 4871655 - DNA, 23 bp, Homo sapiens
gtgtctggccctaactcctataa

SEQ ID NO: 4871656 - DNA, 16 bp, Homo sapiens
gtgtgaagtttggaga

SEQ ID NO: 4871657 - DNA, 17 bp, Homo sapiens
gtgtgaagtttggagat

SEQ ID NO: 4871658 - DNA, 18 bp, Homo sapiens
gtgtgaagtttggagata

SEQ ID NO: 4871659 - DNA, 22 bp, Homo sapiens
gtgtgaatttgccagaggacca

SEQ ID NO: 4871660 - DNA, 15 bp, Homo sapiens
gtgtggagcagagct

SEQ ID NO: 4871661 - DNA, 19 bp, Homo sapiens
gtgtggattgcctctgaaa

SEQ ID NO: 4871662 - DNA, 21 bp, Homo sapiens
gtgtgtggcagccaggatgac

SEQ ID NO: 4871663 - DNA, 21 bp, Homo sapiens
gtgttcagaagaatcttcctg

SEQ ID NO: 4871664 - DNA, 15 bp, Homo sapiens
gtgttgcctcttgca

SEQ ID NO: 4871665 - DNA, 20 bp, Homo sapiens
gtgtttccttttcaggagat

SEQ ID NO: 4871666 - DNA, 20 bp, Homo sapiens
gtgttttgaaagaatagaac

SEQ ID NO: 4871667 - DNA, 15 bp, Homo sapiens
gttaaagaaaggaaa

SEQ ID NO: 4871668 - DNA, 15 bp, Homo sapiens
gttaaagagaatgag

SEQ ID NO: 4871669 - DNA, 21 bp, Homo sapiens
gttaaagggatatttttttct

SEQ ID NO: 4871670 - DNA, 19 bp, Homo sapiens
gttaaggacccttttaagc

SEQ ID NO: 4871671 - DNA, 15 bp, Homo sapiens
gttaatatttaagac

SEQ ID NO: 4871672 - DNA, 18 bp, Homo sapiens
gttaattttattaaaatg

SEQ ID NO: 4871673 - DNA, 20 bp, Homo sapiens
gttaatttttcctgcatgtt

SEQ ID NO: 4871674 - DNA, 13 bp, Homo sapiens
gttagcagagtct

SEQ ID NO: 4871675 - DNA, 17 bp, Homo sapiens
gttagcagagtctgtct

SEQ ID NO: 4871676 - DNA, 18 bp, Homo sapiens
gttagcagagtctgtctc

SEQ ID NO: 4871677 - DNA, 21 bp, Homo sapiens
gttagcagagtctgtctcttg

SEQ ID NO: 4871678 - DNA, 12 bp, Homo sapiens
gttaggccaggc

SEQ ID NO: 4871679 - DNA, 13 bp, Homo sapiens
gttataagaagaa

SEQ ID NO: 4871680 - DNA, 18 bp, Homo sapiens
gttatcagtaatgctaaa

SEQ ID NO: 4871681 - DNA, 13 bp, Homo sapiens
gttatcatgaatt

SEQ ID NO: 4871682 - DNA, 18 bp, Homo sapiens
gttatcatgaattttaaa

SEQ ID NO: 4871683 - DNA, 15 bp, Homo sapiens
gttattacttcctca

SEQ ID NO: 4871684 - DNA, 19 bp, Homo sapiens
gttatttattttttaagaa

SEQ ID NO: 4871685 - DNA, 19 bp, Homo sapiens
gttcactccccgcctcccc

SEQ ID NO: 4871686 - DNA, 15 bp, Homo sapiens
gttcagacccctgcc

SEQ ID NO: 4871687 - DNA, 17 bp, Homo sapiens
gttcagacccctgcctg

SEQ ID NO: 4871688 - DNA, 18 bp, Homo sapiens
gttcatgtttttgtttta

SEQ ID NO: 4871689 - DNA, 22 bp, Homo sapiens
gttcattggcattctttgcaat

SEQ ID NO: 4871690 - DNA, 20 bp, Homo sapiens
gttccatgagttatcatgaa

SEQ ID NO: 4871691 - DNA, 21 bp, Homo sapiens
gttcccttgaaactttgggaa

SEQ ID NO: 4871692 - DNA, 15 bp, Homo sapiens
gttcctgtcccacat

SEQ ID NO: 4871693 - DNA, 16 bp, Homo sapiens
gttcctgtcccacatg

SEQ ID NO: 4871694 - DNA, 22 bp, Homo sapiens
gttcctgtgtgaccctgggcag

SEQ ID NO: 4871695 - DNA, 18 bp, Homo sapiens
gttctaaatatgaatgaa

SEQ ID NO: 4871696 - DNA, 22 bp, Homo sapiens
gttctaacagtgaagttttact

SEQ ID NO: 4871697 - DNA, 19 bp, Homo sapiens
gttctcctatatcctcctt

SEQ ID NO: 4871698 - DNA, 15 bp, Homo sapiens
gttctgaggccagaa

SEQ ID NO: 4871699 - DNA, 16 bp, Homo sapiens
gttctgaggccagaaa

SEQ ID NO: 4871700 - DNA, 18 bp, Homo sapiens
gttctgtagagccaatta

SEQ ID NO: 4871701 - DNA, 19 bp, Homo sapiens
gttcttctttctctgtatt

SEQ ID NO: 4871702 - DNA, 20 bp, Homo sapiens
gttgaagagacagagacaag

SEQ ID NO: 4871703 - DNA, 18 bp, Homo sapiens
gttgagaggaggacttgg

SEQ ID NO: 4871704 - DNA, 16 bp, Homo sapiens
gttgatgtttaaagag

SEQ ID NO: 4871705 - DNA, 18 bp, Homo sapiens
gttgcagccgcagagaaa

SEQ ID NO: 4871706 - DNA, 20 bp, Homo sapiens
gttgcagccgcagagaaatg

SEQ ID NO: 4871707 - DNA, 23 bp, Homo sapiens
gttgcattttaaccctattttac

SEQ ID NO: 4871708 - DNA, 18 bp, Homo sapiens
gttgcccccattcccagc

SEQ ID NO: 4871709 - DNA, 18 bp, Homo sapiens
gttgcctcttgcaatgcc

SEQ ID NO: 4871710 - DNA, 15 bp, Homo sapiens
gttgctaatgacagc

SEQ ID NO: 4871711 - DNA, 22 bp, Homo sapiens
gttgctaatgacagccttgcaa

SEQ ID NO: 4871712 - DNA, 13 bp, Homo sapiens
gttgcttgtcttc

SEQ ID NO: 4871713 - DNA, 18 bp, Homo sapiens
gttggaagggaccccaga

SEQ ID NO: 4871714 - DNA, 15 bp, Homo sapiens
gttggaatggatttt

SEQ ID NO: 4871715 - DNA, 17 bp, Homo sapiens
gttggaatggatttttc

SEQ ID NO: 4871716 - DNA, 21 bp, Homo sapiens
gttggacgggatgacctccag

SEQ ID NO: 4871717 - DNA, 22 bp, Homo sapiens
gttggacgggatgacctccaga

SEQ ID NO: 4871718 - DNA, 18 bp, Homo sapiens
gttggagcagcaggcctc

SEQ ID NO: 4871719 - DNA, 21 bp, Homo sapiens
gttgggtgtctccttaagctg

SEQ ID NO: 4871720 - DNA, 18 bp, Homo sapiens
gttggtatattttatatt

SEQ ID NO: 4871721 - DNA, 14 bp, Homo sapiens
gttgtagcagaaac

SEQ ID NO: 4871722 - DNA, 14 bp, Homo sapiens
gttgtccaggaagt

SEQ ID NO: 4871723 - DNA, 23 bp, Homo sapiens
gttgtctctcttcggtggccttg

SEQ ID NO: 4871724 - DNA, 15 bp, Homo sapiens
gttgtcttattgcac

SEQ ID NO: 4871725 - DNA, 20 bp, Homo sapiens
gttgtgagaatggcctggag

SEQ ID NO: 4871726 - DNA, 20 bp, Homo sapiens
gttgtgagtttaccttgtat

SEQ ID NO: 4871727 - DNA, 15 bp, Homo sapiens
gttgtttataataaa

SEQ ID NO: 4871728 - DNA, 13 bp, Homo sapiens
gtttaaaatgtaa

SEQ ID NO: 4871729 - DNA, 22 bp, Homo sapiens
gtttaagccgcagacctggagc

SEQ ID NO: 4871730 - DNA, 23 bp, Homo sapiens
gtttaagccgcagacctggagct

SEQ ID NO: 4871731 - DNA, 12 bp, Homo sapiens
gtttaatggtag

SEQ ID NO: 4871732 - DNA, 13 bp, Homo sapiens
gtttacctttctc

SEQ ID NO: 4871733 - DNA, 17 bp, Homo sapiens
gtttagatgaatgtcag

SEQ ID NO: 4871734 - DNA, 18 bp, Homo sapiens
gtttagatgaatgtcagt

SEQ ID NO: 4871735 - DNA, 21 bp, Homo sapiens
gtttagatgaggctcagagag

SEQ ID NO: 4871736 - DNA, 14 bp, Homo sapiens
gtttataaacagaa

SEQ ID NO: 4871737 - DNA, 19 bp, Homo sapiens
gtttatatggaagaaagta

SEQ ID NO: 4871738 - DNA, 15 bp, Homo sapiens
gtttattaaatgctt

SEQ ID NO: 4871739 - DNA, 15 bp, Homo sapiens
gtttattctttgcaa

SEQ ID NO: 4871740 - DNA, 17 bp, Homo sapiens
gtttcaagttttaaagt

SEQ ID NO: 4871741 - DNA, 18 bp, Homo sapiens
gtttcactgtactgcatg

SEQ ID NO: 4871742 - DNA, 21 bp, Homo sapiens
gtttcagtttgttggaaagta

SEQ ID NO: 4871743 - DNA, 16 bp, Homo sapiens
gtttccacagcctgca

SEQ ID NO: 4871744 - DNA, 21 bp, Homo sapiens
gtttcccatcccactgctccc

SEQ ID NO: 4871745 - DNA, 18 bp, Homo sapiens
gtttccttttcaggagat

SEQ ID NO: 4871746 - DNA, 23 bp, Homo sapiens
gtttctaccggagagagaatgta

SEQ ID NO: 4871747 - DNA, 14 bp, Homo sapiens
gtttctggatttca

SEQ ID NO: 4871748 - DNA, 20 bp, Homo sapiens
gtttgcaacctctttgctca

SEQ ID NO: 4871749 - DNA, 19 bp, Homo sapiens
gtttgggaaaggcagggcc

SEQ ID NO: 4871750 - DNA, 15 bp, Homo sapiens
gtttgtcacaagtgg

SEQ ID NO: 4871751 - DNA, 17 bp, Homo sapiens
gtttgtggggctggaag

SEQ ID NO: 4871752 - DNA, 20 bp, Homo sapiens
gttttaaagttcattgcaat

SEQ ID NO: 4871753 - DNA, 16 bp, Homo sapiens
gttttaactgtggata

SEQ ID NO: 4871754 - DNA, 22 bp, Homo sapiens
gttttaactgtggatattgtta

SEQ ID NO: 4871755 - DNA, 14 bp, Homo sapiens
gttttacagtgttt

SEQ ID NO: 4871756 - DNA, 15 bp, Homo sapiens
gttttactgtctatt

SEQ ID NO: 4871757 - DNA, 17 bp, Homo sapiens
gttttgtggtttggaat

SEQ ID NO: 4871758 - DNA, 19 bp, Homo sapiens
gtttttaaataaagaacaa

SEQ ID NO: 4871759 - DNA, 15 bp, Homo sapiens
gtttttgacatttat

SEQ ID NO: 4871760 - DNA, 20 bp, Homo sapiens
taaaaactcaggcaaagaaa

SEQ ID NO: 4871761 - DNA, 12 bp, Homo sapiens
taaaaagaaaga

SEQ ID NO: 4871762 - DNA, 20 bp, Homo sapiens
taaaaagttttagttttgat

SEQ ID NO: 4871763 - DNA, 11 bp, Homo sapiens
taaaaatcttt

SEQ ID NO: 4871764 - DNA, 23 bp, Homo sapiens
taaaaatggaaaaataaacacta

SEQ ID NO: 4871765 - DNA, 23 bp, Homo sapiens
taaaaatggcagggggtggaatt

SEQ ID NO: 4871766 - DNA, 21 bp, Homo sapiens
taaaacaattctgtgacatac

SEQ ID NO: 4871767 - DNA, 20 bp, Homo sapiens
taaaagatgtctctgcaaac

SEQ ID NO: 4871768 - DNA, 12 bp, Homo sapiens
taaaagcctgct

SEQ ID NO: 4871769 - DNA, 14 bp, Homo sapiens
taaaagttctcaat

SEQ ID NO: 4871770 - DNA, 19 bp, Homo sapiens
taaaagttttatatgcttt

SEQ ID NO: 4871771 - DNA, 15 bp, Homo sapiens
taaaataatgggatt

SEQ ID NO: 4871772 - DNA, 16 bp, Homo sapiens
taaaatagtatgaaaa

SEQ ID NO: 4871773 - DNA, 21 bp, Homo sapiens
taaaatgaggatccagggcag

SEQ ID NO: 4871774 - DNA, 16 bp, Homo sapiens
taaaatgatgttatac

SEQ ID NO: 4871775 - DNA, 21 bp, Homo sapiens
taaaatgtaatttaaatgaaa

SEQ ID NO: 4871776 - DNA, 22 bp, Homo sapiens
taaaattatgagattggttttc

SEQ ID NO: 4871777 - DNA, 15 bp, Homo sapiens
taaaattatttcatg

SEQ ID NO: 4871778 - DNA, 14 bp, Homo sapiens
taaaattcagtttt

SEQ ID NO: 4871779 - DNA, 16 bp, Homo sapiens
taaaattgttatcaaa

SEQ ID NO: 4871780 - DNA, 12 bp, Homo sapiens
taaacaaacaag

SEQ ID NO: 4871781 - DNA, 14 bp, Homo sapiens
taaacaaacaagcc

SEQ ID NO: 4871782 - DNA, 23 bp, Homo sapiens
taaacaaagtttcagagtatatt

SEQ ID NO: 4871783 - DNA, 14 bp, Homo sapiens
taaacagaaatgga

SEQ ID NO: 4871784 - DNA, 11 bp, Homo sapiens
taaacattttc

SEQ ID NO: 4871785 - DNA, 13 bp, Homo sapiens
taaaccctccaag

SEQ ID NO: 4871786 - DNA, 14 bp, Homo sapiens
taaaccctccaagg

SEQ ID NO: 4871787 - DNA, 23 bp, Homo sapiens
taaacttctgcaacaagcatgca

SEQ ID NO: 4871788 - DNA, 16 bp, Homo sapiens
taaagaaaggaaaaga

SEQ ID NO: 4871789 - DNA, 22 bp, Homo sapiens
taaagaaaggaaaagaaaacaa

SEQ ID NO: 4871790 - DNA, 16 bp, Homo sapiens
taaagaaggatgatgt

SEQ ID NO: 4871791 - DNA, 19 bp, Homo sapiens
taaagaccctcctattcta

SEQ ID NO: 4871792 - DNA, 12 bp, Homo sapiens
taaagagaatga

SEQ ID NO: 4871793 - DNA, 11 bp, Homo sapiens
taaagagcatc

SEQ ID NO: 4871794 - DNA, 13 bp, Homo sapiens
taaagagcatcct

SEQ ID NO: 4871795 - DNA, 16 bp, Homo sapiens
taaagagcatcctgat

SEQ ID NO: 4871796 - DNA, 16 bp, Homo sapiens
taaagatattctttag

SEQ ID NO: 4871797 - DNA, 13 bp, Homo sapiens
taaagatgagttg

SEQ ID NO: 4871798 - DNA, 18 bp, Homo sapiens
taaagctcaaatgaaatg

SEQ ID NO: 4871799 - DNA, 19 bp, Homo sapiens
taaagctcaaatgaaatgt

SEQ ID NO: 4871800 - DNA, 20 bp, Homo sapiens
taaagctcaaatgaaatgta

SEQ ID NO: 4871801 - DNA, 20 bp, Homo sapiens
taaagggcccaatgaattat

SEQ ID NO: 4871802 - DNA, 15 bp, Homo sapiens
taaagtcagaagttt

SEQ ID NO: 4871803 - DNA, 15 bp, Homo sapiens
taaagtgatctgtgt

SEQ ID NO: 4871804 - DNA, 17 bp, Homo sapiens
taaagttcattgcaatt

SEQ ID NO: 4871805 - DNA, 18 bp, Homo sapiens
taaagtttggttttgaca

SEQ ID NO: 4871806 - DNA, 20 bp, Homo sapiens
taaatacatgcatataatga

SEQ ID NO: 4871807 - DNA, 21 bp, Homo sapiens
taaatacatgcatataatgaa

SEQ ID NO: 4871808 - DNA, 20 bp, Homo sapiens
taaatacatgccacatcaaa

SEQ ID NO: 4871809 - DNA, 23 bp, Homo sapiens
taaataggaatcattcagaaatg

SEQ ID NO: 4871810 - DNA, 16 bp, Homo sapiens
taaatcataaagtcag

SEQ ID NO: 4871811 - DNA, 17 bp, Homo sapiens
taaatcattcttactaa

SEQ ID NO: 4871812 - DNA, 22 bp, Homo sapiens
taaatgaaagaaaattgagttg

SEQ ID NO: 4871813 - DNA, 15 bp, Homo sapiens
taaattaatggttta

SEQ ID NO: 4871814 - DNA, 24 bp, Homo sapiens
taaattaatggtttattctttgca

SEQ ID NO: 4871815 - DNA, 22 bp, Homo sapiens
taaattatgtgaccataatgta

SEQ ID NO: 4871816 - DNA, 21 bp, Homo sapiens
taaattcccaaatcctagact

SEQ ID NO: 4871817 - DNA, 16 bp, Homo sapiens
taaattgcatcactgt

SEQ ID NO: 4871818 - DNA, 19 bp, Homo sapiens
taaattgcatcactgtatc

SEQ ID NO: 4871819 - DNA, 18 bp, Homo sapiens
taaatttaaacttacaaa

SEQ ID NO: 4871820 - DNA, 14 bp, Homo sapiens
taaatttaatacca

SEQ ID NO: 4871821 - DNA, 17 bp, Homo sapiens
taaatttaataccagat

SEQ ID NO: 4871822 - DNA, 21 bp, Homo sapiens
taaatttcactactagattga

SEQ ID NO: 4871823 - DNA, 18 bp, Homo sapiens
taaattttcatgaatgtg

SEQ ID NO: 4871824 - DNA, 15 bp, Homo sapiens
taacaggccaaagag

SEQ ID NO: 4871825 - DNA, 20 bp, Homo sapiens
taacatctttattgaaattc

SEQ ID NO: 4871826 - DNA, 13 bp, Homo sapiens
taacatgtttctc

SEQ ID NO: 4871827 - DNA, 17 bp, Homo sapiens
taacatgtttctctata

SEQ ID NO: 4871828 - DNA, 21 bp, Homo sapiens
taacattcaggaattcttgga

SEQ ID NO: 4871829 - DNA, 17 bp, Homo sapiens
taacctagttaaagaaa

SEQ ID NO: 4871830 - DNA, 20 bp, Homo sapiens
taacctagttaaagaaagga

SEQ ID NO: 4871831 - DNA, 14 bp, Homo sapiens
taactaaattttaa

SEQ ID NO: 4871832 - DNA, 20 bp, Homo sapiens
taactcaaatacacatttgc

SEQ ID NO: 4871833 - DNA, 20 bp, Homo sapiens
taactctaaccaaggctgtg

SEQ ID NO: 4871834 - DNA, 17 bp, Homo sapiens
taactgccgtaatttaa

SEQ ID NO: 4871835 - DNA, 15 bp, Homo sapiens
taacttccaaataaa

SEQ ID NO: 4871836 - DNA, 19 bp, Homo sapiens
taacttccaaataaataat

SEQ ID NO: 4871837 - DNA, 16 bp, Homo sapiens
taacttctcatgtata

SEQ ID NO: 4871838 - DNA, 20 bp, Homo sapiens
taacttggggaaggggcctg

SEQ ID NO: 4871839 - DNA, 13 bp, Homo sapiens
taacttggggagg

SEQ ID NO: 4871840 - DNA, 14 bp, Homo sapiens
taagaagaaggcca

SEQ ID NO: 4871841 - DNA, 17 bp, Homo sapiens
taagaagaagttcatgt

SEQ ID NO: 4871842 - DNA, 18 bp, Homo sapiens
taagaataccacatcaaa

SEQ ID NO: 4871843 - DNA, 18 bp, Homo sapiens
taagaatagtagatgtgg

SEQ ID NO: 4871844 - DNA, 20 bp, Homo sapiens
taagaattctgattgatttg

SEQ ID NO: 4871845 - DNA, 23 bp, Homo sapiens
taagacactgaaaaatctaagtg

SEQ ID NO: 4871846 - DNA, 18 bp, Homo sapiens
taagactatatatataaa

SEQ ID NO: 4871847 - DNA, 20 bp, Homo sapiens
taagagaaaagagagaaaca

SEQ ID NO: 4871848 - DNA, 17 bp, Homo sapiens
taagagaaacctgccaa

SEQ ID NO: 4871849 - DNA, 15 bp, Homo sapiens
taagagatgggacta

SEQ ID NO: 4871850 - DNA, 17 bp, Homo sapiens
taagataaaatgatgtt

SEQ ID NO: 4871851 - DNA, 14 bp, Homo sapiens
taagcaaatgttaa

SEQ ID NO: 4871852 - DNA, 18 bp, Homo sapiens
taagccgcagacctggag

SEQ ID NO: 4871853 - DNA, 23 bp, Homo sapiens
taagccgcagacctggagcttca

SEQ ID NO: 4871854 - DNA, 21 bp, Homo sapiens
taagcgaagtctttgccttct

SEQ ID NO: 4871855 - DNA, 23 bp, Homo sapiens
taagcgaagtctttgccttctct

SEQ ID NO: 4871856 - DNA, 22 bp, Homo sapiens
taagctgtgtctgcccaatgaa

SEQ ID NO: 4871857 - DNA, 13 bp, Homo sapiens
taaggagaaatga

SEQ ID NO: 4871858 - DNA, 15 bp, Homo sapiens
taaggggaagaatga

SEQ ID NO: 4871859 - DNA, 21 bp, Homo sapiens
taaggtttccagtcagatgag

SEQ ID NO: 4871860 - DNA, 17 bp, Homo sapiens
taagtcattggcaaagt

SEQ ID NO: 4871861 - DNA, 23 bp, Homo sapiens
taagtgcgaagactgagccagat

SEQ ID NO: 4871862 - DNA, 14 bp, Homo sapiens
taagtgctgctgtg

SEQ ID NO: 4871863 - DNA, 18 bp, Homo sapiens
taagtgtacatatgtgct

SEQ ID NO: 4871864 - DNA, 22 bp, Homo sapiens
taagttcatattccatatttat

SEQ ID NO: 4871865 - DNA, 14 bp, Homo sapiens
taataaaaagaaag

SEQ ID NO: 4871866 - DNA, 12 bp, Homo sapiens
taataaagtact

SEQ ID NO: 4871867 - DNA, 13 bp, Homo sapiens
taataaagtactt

SEQ ID NO: 4871868 - DNA, 19 bp, Homo sapiens
taataagagaatgttccta

SEQ ID NO: 4871869 - DNA, 22 bp, Homo sapiens
taatagactgtaacttccaaat

SEQ ID NO: 4871870 - DNA, 19 bp, Homo sapiens
taatagctttagtgaatta

SEQ ID NO: 4871871 - DNA, 12 bp, Homo sapiens
taatatattaaa

SEQ ID NO: 4871872 - DNA, 21 bp, Homo sapiens
taatattcagggtaaatagga

SEQ ID NO: 4871873 - DNA, 17 bp, Homo sapiens
taatattgaaaattgaa

SEQ ID NO: 4871874 - DNA, 21 bp, Homo sapiens
taatattgtttggtaaatgtt

SEQ ID NO: 4871875 - DNA, 22 bp, Homo sapiens
taatcaaattctgtctggggac

SEQ ID NO: 4871876 - DNA, 12 bp, Homo sapiens
taatccatttca

SEQ ID NO: 4871877 - DNA, 15 bp, Homo sapiens
taatctatgtttata

SEQ ID NO: 4871878 - DNA, 17 bp, Homo sapiens
taatcttcaaagccttc

SEQ ID NO: 4871879 - DNA, 17 bp, Homo sapiens
taatgacagccttgcaa

SEQ ID NO: 4871880 - DNA, 15 bp, Homo sapiens
taatgcctgcttttt

SEQ ID NO: 4871881 - DNA, 18 bp, Homo sapiens
taatgctaaatgtgtaat

SEQ ID NO: 4871882 - DNA, 15 bp, Homo sapiens
taatgctacaatttt

SEQ ID NO: 4871883 - DNA, 15 bp, Homo sapiens
taatgggattttctt

SEQ ID NO: 4871884 - DNA, 15 bp, Homo sapiens
taattaatttggagc

SEQ ID NO: 4871885 - DNA, 18 bp, Homo sapiens
taattatgtaaataactc

SEQ ID NO: 4871886 - DNA, 18 bp, Homo sapiens
taattcaatcctactttt

SEQ ID NO: 4871887 - DNA, 17 bp, Homo sapiens
taattgtacaaaattaa

SEQ ID NO: 4871888 - DNA, 12 bp, Homo sapiens
taattgtgcccc

SEQ ID NO: 4871889 - DNA, 14 bp, Homo sapiens
taattgtgtggatt

SEQ ID NO: 4871890 - DNA, 16 bp, Homo sapiens
taatttaaatgaaaga

SEQ ID NO: 4871891 - DNA, 19 bp, Homo sapiens
taatttaactttctgggtt

SEQ ID NO: 4871892 - DNA, 11 bp, Homo sapiens
taatttcagtg

SEQ ID NO: 4871893 - DNA, 16 bp, Homo sapiens
taatttcagtgtaaag

SEQ ID NO: 4871894 - DNA, 17 bp, Homo sapiens
taatttcctgtgaggat

SEQ ID NO: 4871895 - DNA, 18 bp, Homo sapiens
taatttgaactttggaac

SEQ ID NO: 4871896 - DNA, 15 bp, Homo sapiens
taatttgtgtgtttt

SEQ ID NO: 4871897 - DNA, 14 bp, Homo sapiens
taattttaaagtgc

SEQ ID NO: 4871898 - DNA, 19 bp, Homo sapiens
taattttattttaaaattt

SEQ ID NO: 4871899 - DNA, 15 bp, Homo sapiens
taatttttcctgcat

SEQ ID NO: 4871900 - DNA, 20 bp, Homo sapiens
tacaaaaattatgcaattca

SEQ ID NO: 4871901 - DNA, 14 bp, Homo sapiens
tacaaaattaagca

SEQ ID NO: 4871902 - DNA, 23 bp, Homo sapiens
tacaaaattaagcaaatgttaaa

SEQ ID NO: 4871903 - DNA, 14 bp, Homo sapiens
tacaaagtgtacca

SEQ ID NO: 4871904 - DNA, 19 bp, Homo sapiens
tacaagggcataaagtaaa

SEQ ID NO: 4871905 - DNA, 15 bp, Homo sapiens
tacaatattgattgg

SEQ ID NO: 4871906 - DNA, 23 bp, Homo sapiens
tacaatattgattgggaaaacat

SEQ ID NO: 4871907 - DNA, 17 bp, Homo sapiens
tacacttcacctccttc

SEQ ID NO: 4871908 - DNA, 20 bp, Homo sapiens
tacacttcacctccttctgc

SEQ ID NO: 4871909 - DNA, 16 bp, Homo sapiens
tacagaggtattaaaa

SEQ ID NO: 4871910 - DNA, 14 bp, Homo sapiens
tacagctgtgctcc

SEQ ID NO: 4871911 - DNA, 17 bp, Homo sapiens
tacaggagccagcctgc

SEQ ID NO: 4871912 - DNA, 19 bp, Homo sapiens
tacaggtcatctgctggga

SEQ ID NO: 4871913 - DNA, 14 bp, Homo sapiens
tacagttttaactg

SEQ ID NO: 4871914 - DNA, 17 bp, Homo sapiens
tacagttttaactgtgg

SEQ ID NO: 4871915 - DNA, 15 bp, Homo sapiens
tacatactgcatctt

SEQ ID NO: 4871916 - DNA, 16 bp, Homo sapiens
tacatcaatatgtata

SEQ ID NO: 4871917 - DNA, 14 bp, Homo sapiens
tacatgaagcagaa

SEQ ID NO: 4871918 - DNA, 20 bp, Homo sapiens
tacatgcatataatgaataa

SEQ ID NO: 4871919 - DNA, 15 bp, Homo sapiens
tacatgtattgcaca

SEQ ID NO: 4871920 - DNA, 19 bp, Homo sapiens
tacatgtattgcacattgt

SEQ ID NO: 4871921 - DNA, 22 bp, Homo sapiens
tacatgtattgcacattgtaaa

SEQ ID NO: 4871922 - DNA, 16 bp, Homo sapiens
tacatgtgatacattt

SEQ ID NO: 4871923 - DNA, 17 bp, Homo sapiens
tacatgtgatacatttt

SEQ ID NO: 4871924 - DNA, 18 bp, Homo sapiens
tacatgtgatacattttt

SEQ ID NO: 4871925 - DNA, 15 bp, Homo sapiens
tacattccaccctgt

SEQ ID NO: 4871926 - DNA, 14 bp, Homo sapiens
taccaaaattttaa

SEQ ID NO: 4871927 - DNA, 14 bp, Homo sapiens
taccaatacaaaat

SEQ ID NO: 4871928 - DNA, 16 bp, Homo sapiens
taccagcaaagcaaat

SEQ ID NO: 4871929 - DNA, 20 bp, Homo sapiens
taccagggtctctcagggat

SEQ ID NO: 4871930 - DNA, 14 bp, Homo sapiens
taccatatgaatga

SEQ ID NO: 4871931 - DNA, 15 bp, Homo sapiens
taccatatgaatgaa

SEQ ID NO: 4871932 - DNA, 19 bp, Homo sapiens
taccatatgaatgaaacat

SEQ ID NO: 4871933 - DNA, 18 bp, Homo sapiens
taccatgcttcacaatgt

SEQ ID NO: 4871934 - DNA, 19 bp, Homo sapiens
taccattctattctccaga

SEQ ID NO: 4871935 - DNA, 18 bp, Homo sapiens
taccatttagtaagaata

SEQ ID NO: 4871936 - DNA, 14 bp, Homo sapiens
tacccctgctccca

SEQ ID NO: 4871937 - DNA, 16 bp, Homo sapiens
tacctactggtgtaat

SEQ ID NO: 4871938 - DNA, 19 bp, Homo sapiens
tacctctgtctgagacagg

SEQ ID NO: 4871939 - DNA, 12 bp, Homo sapiens
tacctcttttgc

SEQ ID NO: 4871940 - DNA, 15 bp, Homo sapiens
tacctggatgttctt

SEQ ID NO: 4871941 - DNA, 14 bp, Homo sapiens
tacctgtgaggact

SEQ ID NO: 4871942 - DNA, 13 bp, Homo sapiens
tacgatttcacta

SEQ ID NO: 4871943 - DNA, 21 bp, Homo sapiens
tacgtagcctaaggctcctgt

SEQ ID NO: 4871944 - DNA, 16 bp, Homo sapiens
tactaaaaagtataaa

SEQ ID NO: 4871945 - DNA, 21 bp, Homo sapiens
tactaaaaagtataaaatagt

SEQ ID NO: 4871946 - DNA, 24 bp, Homo sapiens
tactaacccagtctttcttcactc

SEQ ID NO: 4871947 - DNA, 20 bp, Homo sapiens
tactaccagggtctctcagg

SEQ ID NO: 4871948 - DNA, 15 bp, Homo sapiens
tactactactgttat

SEQ ID NO: 4871949 - DNA, 14 bp, Homo sapiens
tactagtgtgactc

SEQ ID NO: 4871950 - DNA, 22 bp, Homo sapiens
tactcccactcccggcctgtca

SEQ ID NO: 4871951 - DNA, 14 bp, Homo sapiens
tactgacatttctt

SEQ ID NO: 4871952 - DNA, 16 bp, Homo sapiens
tactgacatttcttct

SEQ ID NO: 4871953 - DNA, 11 bp, Homo sapiens
tactgatgaga

SEQ ID NO: 4871954 - DNA, 21 bp, Homo sapiens
tactgatgagagaatgtggaa

SEQ ID NO: 4871955 - DNA, 19 bp, Homo sapiens
tactgatttcagtaagtct

SEQ ID NO: 4871956 - DNA, 14 bp, Homo sapiens
tactgcaatcactg

SEQ ID NO: 4871957 - DNA, 17 bp, Homo sapiens
tactgcatgtgacttct

SEQ ID NO: 4871958 - DNA, 20 bp, Homo sapiens
tactgccaaaacatttatga

SEQ ID NO: 4871959 - DNA, 15 bp, Homo sapiens
tactgctcctgtggc

SEQ ID NO: 4871960 - DNA, 19 bp, Homo sapiens
tactgctcctgtggcagga

SEQ ID NO: 4871961 - DNA, 14 bp, Homo sapiens
tactggggggcagg

SEQ ID NO: 4871962 - DNA, 18 bp, Homo sapiens
tactggggggcaggcctc

SEQ ID NO: 4871963 - DNA, 20 bp, Homo sapiens
tactggtgtaatctcaatgc

SEQ ID NO: 4871964 - DNA, 15 bp, Homo sapiens
tactggttacctgga

SEQ ID NO: 4871965 - DNA, 21 bp, Homo sapiens
tactgtaatgctgcctcagga

SEQ ID NO: 4871966 - DNA, 17 bp, Homo sapiens
tactgtctattaatatt

SEQ ID NO: 4871967 - DNA, 16 bp, Homo sapiens
tactgtggcctgcagg

SEQ ID NO: 4871968 - DNA, 13 bp, Homo sapiens
tactgtgtgccag

SEQ ID NO: 4871969 - DNA, 22 bp, Homo sapiens
tacttatttctcagctgtgcct

SEQ ID NO: 4871970 - DNA, 23 bp, Homo sapiens
tacttatttctcagctgtgcctt

SEQ ID NO: 4871971 - DNA, 21 bp, Homo sapiens
tacttcaaagtgcctgggctc

SEQ ID NO: 4871972 - DNA, 22 bp, Homo sapiens
tactttatcatgaatgctttta

SEQ ID NO: 4871973 - DNA, 15 bp, Homo sapiens
tactttgacagtgtt

SEQ ID NO: 4871974 - DNA, 17 bp, Homo sapiens
tactttggaattcttag

SEQ ID NO: 4871975 - DNA, 20 bp, Homo sapiens
tactttggggctaatttaac

SEQ ID NO: 4871976 - DNA, 19 bp, Homo sapiens
tagaaactgaggcccagag

SEQ ID NO: 4871977 - DNA, 20 bp, Homo sapiens
tagaaactgaggcccagaga

SEQ ID NO: 4871978 - DNA, 12 bp, Homo sapiens
tagaactcctgt

SEQ ID NO: 4871979 - DNA, 21 bp, Homo sapiens
tagaagcctgacaactcattt

SEQ ID NO: 4871980 - DNA, 20 bp, Homo sapiens
tagaagtgagcaaaaaagag

SEQ ID NO: 4871981 - DNA, 17 bp, Homo sapiens
tagaatttaatatatat

SEQ ID NO: 4871982 - DNA, 16 bp, Homo sapiens
tagacaaaaagtatat

SEQ ID NO: 4871983 - DNA, 11 bp, Homo sapiens
tagacatgaaa

SEQ ID NO: 4871984 - DNA, 22 bp, Homo sapiens
tagacttggagaatactgccaa

SEQ ID NO: 4871985 - DNA, 23 bp, Homo sapiens
tagacttggagaatactgccaaa

SEQ ID NO: 4871986 - DNA, 22 bp, Homo sapiens
tagagaacaaagtaaaagtagt

SEQ ID NO: 4871987 - DNA, 23 bp, Homo sapiens
tagagagaaccaataaaagtggt

SEQ ID NO: 4871988 - DNA, 20 bp, Homo sapiens
tagagattgcatttttatta

SEQ ID NO: 4871989 - DNA, 23 bp, Homo sapiens
tagagggcgagggatgatgaggg

SEQ ID NO: 4871990 - DNA, 15 bp, Homo sapiens
tagagtaatgaaatg

SEQ ID NO: 4871991 - DNA, 18 bp, Homo sapiens
tagagtcaactacacaaa

SEQ ID NO: 4871992 - DNA, 22 bp, Homo sapiens
tagatatgtattcttttctcag

SEQ ID NO: 4871993 - DNA, 19 bp, Homo sapiens
tagatccagcccaaacctg

SEQ ID NO: 4871994 - DNA, 18 bp, Homo sapiens
tagatccatttccattgc

SEQ ID NO: 4871995 - DNA, 14 bp, Homo sapiens
tagatgaggctcag

SEQ ID NO: 4871996 - DNA, 18 bp, Homo sapiens
tagatgattttttgaaag

SEQ ID NO: 4871997 - DNA, 19 bp, Homo sapiens
tagatgattttttgaaagt

SEQ ID NO: 4871998 - DNA, 15 bp, Homo sapiens
tagattcagagaaat

SEQ ID NO: 4871999 - DNA, 16 bp, Homo sapiens
tagattgtattaacta

SEQ ID NO: 4872000 - DNA, 11 bp, Homo sapiens
tagatttatgg

SEQ ID NO: 4872001 - DNA, 18 bp, Homo sapiens
tagcaaggcagagccttt

SEQ ID NO: 4872002 - DNA, 15 bp, Homo sapiens
tagcagagtctgtct

SEQ ID NO: 4872003 - DNA, 18 bp, Homo sapiens
tagcagccagttcaaaaa

SEQ ID NO: 4872004 - DNA, 13 bp, Homo sapiens
tagcataggctgg

SEQ ID NO: 4872005 - DNA, 12 bp, Homo sapiens
tagcccaaccta

SEQ ID NO: 4872006 - DNA, 18 bp, Homo sapiens
tagcctatgtctggcaga

SEQ ID NO: 4872007 - DNA, 13 bp, Homo sapiens
tagccttcccagc

SEQ ID NO: 4872008 - DNA, 15 bp, Homo sapiens
tagctggggagccct

SEQ ID NO: 4872009 - DNA, 17 bp, Homo sapiens
tagctgtacttcttgaa

SEQ ID NO: 4872010 - DNA, 11 bp, Homo sapiens
tagctgtgaaa

SEQ ID NO: 4872011 - DNA, 22 bp, Homo sapiens
tagctgtgtgaatacctgctca

SEQ ID NO: 4872012 - DNA, 17 bp, Homo sapiens
tagcttgcagaactgta

SEQ ID NO: 4872013 - DNA, 9 bp, Homo sapiens
taggacaga

SEQ ID NO: 4872014 - DNA, 18 bp, Homo sapiens
taggcactgagcagggat

SEQ ID NO: 4872015 - DNA, 22 bp, Homo sapiens
taggccacagaaggtgaacttt

SEQ ID NO: 4872016 - DNA, 22 bp, Homo sapiens
taggccaggccttatctgaaag

SEQ ID NO: 4872017 - DNA, 20 bp, Homo sapiens
taggctattttctaaagact

SEQ ID NO: 4872018 - DNA, 19 bp, Homo sapiens
tagggactacccatagaca

SEQ ID NO: 4872019 - DNA, 20 bp, Homo sapiens
tagggactacccatagacat

SEQ ID NO: 4872020 - DNA, 22 bp, Homo sapiens
tagggagttcatctggagggtt

SEQ ID NO: 4872021 - DNA, 17 bp, Homo sapiens
tagggccctgacaggcc

SEQ ID NO: 4872022 - DNA, 20 bp, Homo sapiens
taggggagagagcagagaag

SEQ ID NO: 4872023 - DNA, 19 bp, Homo sapiens
taggttctgtagagccaat

SEQ ID NO: 4872024 - DNA, 15 bp, Homo sapiens
taggtttcaggaagt

SEQ ID NO: 4872025 - DNA, 20 bp, Homo sapiens
taggtttttttccttctgaa

SEQ ID NO: 4872026 - DNA, 18 bp, Homo sapiens
tagtaagaagacaaactg

SEQ ID NO: 4872027 - DNA, 16 bp, Homo sapiens
tagtaagcatagaaac

SEQ ID NO: 4872028 - DNA, 17 bp, Homo sapiens
tagtacctgtgactctt

SEQ ID NO: 4872029 - DNA, 19 bp, Homo sapiens
tagtgacatttaatgccat

SEQ ID NO: 4872030 - DNA, 19 bp, Homo sapiens
tagtgatgatggttcacgt

SEQ ID NO: 4872031 - DNA, 18 bp, Homo sapiens
tagtgcaacatctctgaa

SEQ ID NO: 4872032 - DNA, 18 bp, Homo sapiens
tagtgcaatagtgcaaca

SEQ ID NO: 4872033 - DNA, 20 bp, Homo sapiens
tagtgggccctctctctggg

SEQ ID NO: 4872034 - DNA, 22 bp, Homo sapiens
tagtgggggatgggtcctctag

SEQ ID NO: 4872035 - DNA, 17 bp, Homo sapiens
tagtgtgaaatatatta

SEQ ID NO: 4872036 - DNA, 12 bp, Homo sapiens
tagtgtgactcc

SEQ ID NO: 4872037 - DNA, 14 bp, Homo sapiens
tagtgttgtccagg

SEQ ID NO: 4872038 - DNA, 16 bp, Homo sapiens
tagtgttgtccaggaa

SEQ ID NO: 4872039 - DNA, 13 bp, Homo sapiens
tagttaaagaaag

SEQ ID NO: 4872040 - DNA, 18 bp, Homo sapiens
tagttaaagaaaggaaaa

SEQ ID NO: 4872041 - DNA, 20 bp, Homo sapiens
tagttgcatagcagtatatg

SEQ ID NO: 4872042 - DNA, 19 bp, Homo sapiens
tagttgcccccattcccag

SEQ ID NO: 4872043 - DNA, 22 bp, Homo sapiens
tagttgcccccattcccagcct

SEQ ID NO: 4872044 - DNA, 16 bp, Homo sapiens
tataaacagaaatgga

SEQ ID NO: 4872045 - DNA, 18 bp, Homo sapiens
tataaacagaaatggaaa

SEQ ID NO: 4872046 - DNA, 16 bp, Homo sapiens
tataaaggataaagaa

SEQ ID NO: 4872047 - DNA, 14 bp, Homo sapiens
tataaatgtataaa

SEQ ID NO: 4872048 - DNA, 22 bp, Homo sapiens
tataacacatttttttgcatgc

SEQ ID NO: 4872049 - DNA, 16 bp, Homo sapiens
tataacagtgtttaaa

SEQ ID NO: 4872050 - DNA, 17 bp, Homo sapiens
tataacctagttaaaga

SEQ ID NO: 4872051 - DNA, 12 bp, Homo sapiens
tataataaaaat

SEQ ID NO: 4872052 - DNA, 18 bp, Homo sapiens
tataataaaaatatattt

SEQ ID NO: 4872053 - DNA, 13 bp, Homo sapiens
tataatactacta

SEQ ID NO: 4872054 - DNA, 18 bp, Homo sapiens
tataatgtttattaaatg

SEQ ID NO: 4872055 - DNA, 16 bp, Homo sapiens
tataattgtacaaaat

SEQ ID NO: 4872056 - DNA, 14 bp, Homo sapiens
tatacacacacaca

SEQ ID NO: 4872057 - DNA, 20 bp, Homo sapiens
tatacatgtgatacattttt

SEQ ID NO: 4872058 - DNA, 18 bp, Homo sapiens
tatactgtggcctgcagg

SEQ ID NO: 4872059 - DNA, 21 bp, Homo sapiens
tatacttccttacttttaagg

SEQ ID NO: 4872060 - DNA, 19 bp, Homo sapiens
tatactttagtagacattt

SEQ ID NO: 4872061 - DNA, 20 bp, Homo sapiens
tatagacggtgctcactccc

SEQ ID NO: 4872062 - DNA, 23 bp, Homo sapiens
tatagacttggagaatactgcca

SEQ ID NO: 4872063 - DNA, 16 bp, Homo sapiens
tatagcatgaaataaa

SEQ ID NO: 4872064 - DNA, 19 bp, Homo sapiens
tatagtctaagactatata

SEQ ID NO: 4872065 - DNA, 16 bp, Homo sapiens
tatataaactgggatg

SEQ ID NO: 4872066 - DNA, 14 bp, Homo sapiens
tatataatgtatat

SEQ ID NO: 4872067 - DNA, 14 bp, Homo sapiens
tatatatataaatg

SEQ ID NO: 4872068 - DNA, 16 bp, Homo sapiens
tatatatataaatgta

SEQ ID NO: 4872069 - DNA, 16 bp, Homo sapiens
tatatatgtatttcta

SEQ ID NO: 4872070 - DNA, 16 bp, Homo sapiens
tatatattttgtgtga

SEQ ID NO: 4872071 - DNA, 12 bp, Homo sapiens
tatatgactgca

SEQ ID NO: 4872072 - DNA, 18 bp, Homo sapiens
tatatgctttattaatgt

SEQ ID NO: 4872073 - DNA, 21 bp, Homo sapiens
tatatgtattttttgaatcta

SEQ ID NO: 4872074 - DNA, 13 bp, Homo sapiens
tatattaaaattc

SEQ ID NO: 4872075 - DNA, 13 bp, Homo sapiens
tatattaaacaaa

SEQ ID NO: 4872076 - DNA, 17 bp, Homo sapiens
tatattacccaatggaa

SEQ ID NO: 4872077 - DNA, 16 bp, Homo sapiens
tatattactgacattt

SEQ ID NO: 4872078 - DNA, 19 bp, Homo sapiens
tatattcattctttttgaa

SEQ ID NO: 4872079 - DNA, 12 bp, Homo sapiens
tatatttattga

SEQ ID NO: 4872080 - DNA, 13 bp, Homo sapiens
tatattttaagaa

SEQ ID NO: 4872081 - DNA, 18 bp, Homo sapiens
tatattttgtgtgaaatt

SEQ ID NO: 4872082 - DNA, 17 bp, Homo sapiens
tatatttttttaactgt

SEQ ID NO: 4872083 - DNA, 18 bp, Homo sapiens
tatatttttttaactgtg

SEQ ID NO: 4872084 - DNA, 20 bp, Homo sapiens
tatatttttttaactgtgat

SEQ ID NO: 4872085 - DNA, 21 bp, Homo sapiens
tatatttttttaactgtgata

SEQ ID NO: 4872086 - DNA, 12 bp, Homo sapiens
tatcaaagtcat

SEQ ID NO: 4872087 - DNA, 14 bp, Homo sapiens
tatcagcaaagaaa

SEQ ID NO: 4872088 - DNA, 23 bp, Homo sapiens
tatcagtaatgctaaatgtgtaa

SEQ ID NO: 4872089 - DNA, 15 bp, Homo sapiens
tatccacactgtcaa

SEQ ID NO: 4872090 - DNA, 18 bp, Homo sapiens
tatcccttggacatttta

SEQ ID NO: 4872091 - DNA, 18 bp, Homo sapiens
tatcgtttttgtattttc

SEQ ID NO: 4872092 - DNA, 20 bp, Homo sapiens
tatcgtttttgtattttcat

SEQ ID NO: 4872093 - DNA, 17 bp, Homo sapiens
tatctgaaaggccagca

SEQ ID NO: 4872094 - DNA, 18 bp, Homo sapiens
tatctgaaaggccagcag

SEQ ID NO: 4872095 - DNA, 20 bp, Homo sapiens
tatctgaaaggccagcagct

SEQ ID NO: 4872096 - DNA, 15 bp, Homo sapiens
tatctttgaatatgt

SEQ ID NO: 4872097 - DNA, 14 bp, Homo sapiens
tatgaaaatggaaa

SEQ ID NO: 4872098 - DNA, 20 bp, Homo sapiens
tatgagattggttttcctgt

SEQ ID NO: 4872099 - DNA, 10 bp, Homo sapiens
tatgatgaca

SEQ ID NO: 4872100 - DNA, 16 bp, Homo sapiens
tatgcaattcagtgtt

SEQ ID NO: 4872101 - DNA, 17 bp, Homo sapiens
tatgcattattaaattg

SEQ ID NO: 4872102 - DNA, 19 bp, Homo sapiens
tatgccccaccaaggctga

SEQ ID NO: 4872103 - DNA, 13 bp, Homo sapiens
tatggaagaaagt

SEQ ID NO: 4872104 - DNA, 14 bp, Homo sapiens
tatggaagaaagta

SEQ ID NO: 4872105 - DNA, 17 bp, Homo sapiens
tatggcatgactcttca

SEQ ID NO: 4872106 - DNA, 15 bp, Homo sapiens
tatgtaaataactct

SEQ ID NO: 4872107 - DNA, 19 bp, Homo sapiens
tatgtagtatctatatgac

SEQ ID NO: 4872108 - DNA, 18 bp, Homo sapiens
tatgtatattaaaaaaga

SEQ ID NO: 4872109 - DNA, 21 bp, Homo sapiens
tatgtgggatattgaatgtta

SEQ ID NO: 4872110 - DNA, 13 bp, Homo sapiens
tatgttaatattt

SEQ ID NO: 4872111 - DNA, 16 bp, Homo sapiens
tatgttggtgtgaatt

SEQ ID NO: 4872112 - DNA, 20 bp, Homo sapiens
tatgttgtttataataaaaa

SEQ ID NO: 4872113 - DNA, 15 bp, Homo sapiens
tattaaaaaacttca

SEQ ID NO: 4872114 - DNA, 15 bp, Homo sapiens
tattaaaaaagtcta

SEQ ID NO: 4872115 - DNA, 14 bp, Homo sapiens
tattaaaactaaat

SEQ ID NO: 4872116 - DNA, 14 bp, Homo sapiens
tattaaaattccaa

SEQ ID NO: 4872117 - DNA, 18 bp, Homo sapiens
tattaaacaaagtttcag

SEQ ID NO: 4872118 - DNA, 22 bp, Homo sapiens
tattaatattcagggtaaatag

SEQ ID NO: 4872119 - DNA, 16 bp, Homo sapiens
tattactgacatttct

SEQ ID NO: 4872120 - DNA, 19 bp, Homo sapiens
tattaggaagtgtttatgt

SEQ ID NO: 4872121 - DNA, 18 bp, Homo sapiens
tattataaaggataaaga

SEQ ID NO: 4872122 - DNA, 19 bp, Homo sapiens
tattatacatgtgatacat

SEQ ID NO: 4872123 - DNA, 13 bp, Homo sapiens
tattatatacata

SEQ ID NO: 4872124 - DNA, 21 bp, Homo sapiens
tattatcttgttcaggaaaag

SEQ ID NO: 4872125 - DNA, 18 bp, Homo sapiens
tattatgtaggtaagact

SEQ ID NO: 4872126 - DNA, 20 bp, Homo sapiens
tattatttttttaaaatttt

SEQ ID NO: 4872127 - DNA, 16 bp, Homo sapiens
tattcatctaatgtat

SEQ ID NO: 4872128 - DNA, 23 bp, Homo sapiens
tattcattctttttgaaatgtca

SEQ ID NO: 4872129 - DNA, 15 bp, Homo sapiens
tattccccagtgact

SEQ ID NO: 4872130 - DNA, 17 bp, Homo sapiens
tattccccagtgactcc

SEQ ID NO: 4872131 - DNA, 20 bp, Homo sapiens
tattccccagtgactccagg

SEQ ID NO: 4872132 - DNA, 19 bp, Homo sapiens
tattccgatacaaagtgtt

SEQ ID NO: 4872133 - DNA, 12 bp, Homo sapiens
tattctccagac

SEQ ID NO: 4872134 - DNA, 13 bp, Homo sapiens
tattcttttctca

SEQ ID NO: 4872135 - DNA, 14 bp, Homo sapiens
tattgaatgttaaa

SEQ ID NO: 4872136 - DNA, 15 bp, Homo sapiens
tattgacttgtatat

SEQ ID NO: 4872137 - DNA, 18 bp, Homo sapiens
tattgattgggaaaacat

SEQ ID NO: 4872138 - DNA, 22 bp, Homo sapiens
tattgattgggaaaacatttgc

SEQ ID NO: 4872139 - DNA, 17 bp, Homo sapiens
tattgcacattgtaaaa

SEQ ID NO: 4872140 - DNA, 19 bp, Homo sapiens
tattgctgtgagccttgca

SEQ ID NO: 4872141 - DNA, 16 bp, Homo sapiens
tattggtgttgcagcc

SEQ ID NO: 4872142 - DNA, 22 bp, Homo sapiens
tattgtgtggtctggttcctgt

SEQ ID NO: 4872143 - DNA, 13 bp, Homo sapiens
tatttaatttgaa

SEQ ID NO: 4872144 - DNA, 17 bp, Homo sapiens
tatttacagctgtgctc

SEQ ID NO: 4872145 - DNA, 22 bp, Homo sapiens
tatttacagctgtgctccacac

SEQ ID NO: 4872146 - DNA, 19 bp, Homo sapiens
tatttatgcactgtgggat

SEQ ID NO: 4872147 - DNA, 16 bp, Homo sapiens
tatttattgaaatgat

SEQ ID NO: 4872148 - DNA, 20 bp, Homo sapiens
tatttattgaaatgatttca

SEQ ID NO: 4872149 - DNA, 23 bp, Homo sapiens
tatttattgagtacctactgtgt

SEQ ID NO: 4872150 - DNA, 14 bp, Homo sapiens
tatttgattattta

SEQ ID NO: 4872151 - DNA, 18 bp, Homo sapiens
tatttgtataaaagtgtg

SEQ ID NO: 4872152 - DNA, 22 bp, Homo sapiens
tatttgtataaaagtgtgaaat

SEQ ID NO: 4872153 - DNA, 15 bp, Homo sapiens
tattttaaaatttca

SEQ ID NO: 4872154 - DNA, 12 bp, Homo sapiens
tattttagaaat

SEQ ID NO: 4872155 - DNA, 22 bp, Homo sapiens
tattttaggtgtaaaataatta

SEQ ID NO: 4872156 - DNA, 15 bp, Homo sapiens
tattttctaaagact

SEQ ID NO: 4872157 - DNA, 18 bp, Homo sapiens
tattttctcaatctcctc

SEQ ID NO: 4872158 - DNA, 19 bp, Homo sapiens
tattttgggcctgttcctt

SEQ ID NO: 4872159 - DNA, 17 bp, Homo sapiens
tattttgtgtgaaattg

SEQ ID NO: 4872160 - DNA, 13 bp, Homo sapiens
tattttttaagaa

SEQ ID NO: 4872161 - DNA, 19 bp, Homo sapiens
tattttttcttttctttac

SEQ ID NO: 4872162 - DNA, 19 bp, Homo sapiens
tattttttgaatctatgaa

SEQ ID NO: 4872163 - DNA, 16 bp, Homo sapiens
tatttttttaaaattt

SEQ ID NO: 4872164 - DNA, 17 bp, Homo sapiens
tatttttttaactgtga

SEQ ID NO: 4872165 - DNA, 19 bp, Homo sapiens
tatttttttaactgtgata

SEQ ID NO: 4872166 - DNA, 14 bp, Homo sapiens
tcaaaaagaaatca

SEQ ID NO: 4872167 - DNA, 14 bp, Homo sapiens
tcaaaaagccacag

SEQ ID NO: 4872168 - DNA, 13 bp, Homo sapiens
tcaaagcagcagg

SEQ ID NO: 4872169 - DNA, 18 bp, Homo sapiens
tcaaagtcattaaagaca

SEQ ID NO: 4872170 - DNA, 21 bp, Homo sapiens
tcaaagtctgctctcatataa

SEQ ID NO: 4872171 - DNA, 13 bp, Homo sapiens
tcaaagtgcctgg

SEQ ID NO: 4872172 - DNA, 13 bp, Homo sapiens
tcaaagttttgtt

SEQ ID NO: 4872173 - DNA, 13 bp, Homo sapiens
tcaaataagaaat

SEQ ID NO: 4872174 - DNA, 20 bp, Homo sapiens
tcaaataggctattaaaaaa

SEQ ID NO: 4872175 - DNA, 13 bp, Homo sapiens
tcaaatgaaatgt

SEQ ID NO: 4872176 - DNA, 14 bp, Homo sapiens
tcaaatgaaatgta

SEQ ID NO: 4872177 - DNA, 20 bp, Homo sapiens
tcaaatgaaatgtatgcatt

SEQ ID NO: 4872178 - DNA, 12 bp, Homo sapiens
tcaaattctgtc

SEQ ID NO: 4872179 - DNA, 20 bp, Homo sapiens
tcaacaaagaaacaaagatg

SEQ ID NO: 4872180 - DNA, 20 bp, Homo sapiens
tcaacagaacatatgttgca

SEQ ID NO: 4872181 - DNA, 12 bp, Homo sapiens
tcaacagccaag

SEQ ID NO: 4872182 - DNA, 16 bp, Homo sapiens
tcaacagccaagctgg

SEQ ID NO: 4872183 - DNA, 14 bp, Homo sapiens
tcaactctacccct

SEQ ID NO: 4872184 - DNA, 23 bp, Homo sapiens
tcaactctacccctgctcccatt

SEQ ID NO: 4872185 - DNA, 13 bp, Homo sapiens
tcaactttgtaaa

SEQ ID NO: 4872186 - DNA, 15 bp, Homo sapiens
tcaagcattctgttt

SEQ ID NO: 4872187 - DNA, 16 bp, Homo sapiens
tcaagcattctgttta

SEQ ID NO: 4872188 - DNA, 17 bp, Homo sapiens
tcaaggctcttcttcct

SEQ ID NO: 4872189 - DNA, 15 bp, Homo sapiens
tcaagggctgtcatt

SEQ ID NO: 4872190 - DNA, 15 bp, Homo sapiens
tcaagtcactcccaa

SEQ ID NO: 4872191 - DNA, 15 bp, Homo sapiens
tcaagttttaaagtt

SEQ ID NO: 4872192 - DNA, 17 bp, Homo sapiens
tcaagttttaaagttca

SEQ ID NO: 4872193 - DNA, 19 bp, Homo sapiens
tcaatctggattcatattt

SEQ ID NO: 4872194 - DNA, 16 bp, Homo sapiens
tcaatgaaccataaat

SEQ ID NO: 4872195 - DNA, 14 bp, Homo sapiens
tcaatgagagcata

SEQ ID NO: 4872196 - DNA, 22 bp, Homo sapiens
tcaatttctagtacctgtgact

SEQ ID NO: 4872197 - DNA, 14 bp, Homo sapiens
tcacacccctgccc

SEQ ID NO: 4872198 - DNA, 19 bp, Homo sapiens
tcacacgaggggccccgtg

SEQ ID NO: 4872199 - DNA, 16 bp, Homo sapiens
tcacagggaatggcca

SEQ ID NO: 4872200 - DNA, 20 bp, Homo sapiens
tcacatctatccacactgtc

SEQ ID NO: 4872201 - DNA, 19 bp, Homo sapiens
tcacatttagaaaagtgaa

SEQ ID NO: 4872202 - DNA, 20 bp, Homo sapiens
tcaccagccccccgcgcgcc

SEQ ID NO: 4872203 - DNA, 18 bp, Homo sapiens
tcaccatgtgagctcttc

SEQ ID NO: 4872204 - DNA, 14 bp, Homo sapiens
tcacccatcctagg

SEQ ID NO: 4872205 - DNA, 17 bp, Homo sapiens
tcacccatcctaggaac

SEQ ID NO: 4872206 - DNA, 23 bp, Homo sapiens
tcacccattccgggttcactccc

SEQ ID NO: 4872207 - DNA, 17 bp, Homo sapiens
tcaccgagcatgcttcc

SEQ ID NO: 4872208 - DNA, 12 bp, Homo sapiens
tcacctccttct

SEQ ID NO: 4872209 - DNA, 13 bp, Homo sapiens
tcacctccttctg

SEQ ID NO: 4872210 - DNA, 15 bp, Homo sapiens
tcacctccttctgca

SEQ ID NO: 4872211 - DNA, 17 bp, Homo sapiens
tcaccttttcaggaaaa

SEQ ID NO: 4872212 - DNA, 20 bp, Homo sapiens
tcactactgaacacatgtgt

SEQ ID NO: 4872213 - DNA, 19 bp, Homo sapiens
tcactcccaagggacagca

SEQ ID NO: 4872214 - DNA, 14 bp, Homo sapiens
tcactgccccctcc

SEQ ID NO: 4872215 - DNA, 16 bp, Homo sapiens
tcactgcctctttgca

SEQ ID NO: 4872216 - DNA, 15 bp, Homo sapiens
tcactgtactgcatg

SEQ ID NO: 4872217 - DNA, 21 bp, Homo sapiens
tcactgtactgcatgtgactt

SEQ ID NO: 4872218 - DNA, 12 bp, Homo sapiens
tcactttcataa

SEQ ID NO: 4872219 - DNA, 15 bp, Homo sapiens
tcacttttccttttc

SEQ ID NO: 4872220 - DNA, 16 bp, Homo sapiens
tcacttttccttttct

SEQ ID NO: 4872221 - DNA, 16 bp, Homo sapiens
tcagaaaattccctgg

SEQ ID NO: 4872222 - DNA, 22 bp, Homo sapiens
tcagaaacgagatcgggaagca

SEQ ID NO: 4872223 - DNA, 13 bp, Homo sapiens
tcagaaatataac

SEQ ID NO: 4872224 - DNA, 20 bp, Homo sapiens
tcagaaatataacacatttt

SEQ ID NO: 4872225 - DNA, 17 bp, Homo sapiens
tcagaagaatcttcctg

SEQ ID NO: 4872226 - DNA, 15 bp, Homo sapiens
tcagaagcctccaag

SEQ ID NO: 4872227 - DNA, 23 bp, Homo sapiens
tcagaagcctccaagcctgcctc

SEQ ID NO: 4872228 - DNA, 17 bp, Homo sapiens
tcagaaggatgcccaga

SEQ ID NO: 4872229 - DNA, 13 bp, Homo sapiens
tcagacagcagga

SEQ ID NO: 4872230 - DNA, 13 bp, Homo sapiens
tcagacccctgcc

SEQ ID NO: 4872231 - DNA, 16 bp, Homo sapiens
tcagacccctgcctgg

SEQ ID NO: 4872232 - DNA, 15 bp, Homo sapiens
tcagcaaagaaaaaa

SEQ ID NO: 4872233 - DNA, 23 bp, Homo sapiens
tcagcaacccttcctgctgctgc

SEQ ID NO: 4872234 - DNA, 20 bp, Homo sapiens
tcagcacttaactatgagcc

SEQ ID NO: 4872235 - DNA, 14 bp, Homo sapiens
tcagcatccagtgt

SEQ ID NO: 4872236 - DNA, 16 bp, Homo sapiens
tcagccaaatgcaggg

SEQ ID NO: 4872237 - DNA, 22 bp, Homo sapiens
tcagccaggtctgactccaaag

SEQ ID NO: 4872238 - DNA, 14 bp, Homo sapiens
tcagctctctggga

SEQ ID NO: 4872239 - DNA, 18 bp, Homo sapiens
tcagctgctgttgaactt

SEQ ID NO: 4872240 - DNA, 22 bp, Homo sapiens
tcagctgctgttgaacttttta

SEQ ID NO: 4872241 - DNA, 22 bp, Homo sapiens
tcaggacccatccctgcctgga

SEQ ID NO: 4872242 - DNA, 16 bp, Homo sapiens
tcaggactctctccag

SEQ ID NO: 4872243 - DNA, 16 bp, Homo sapiens
tcaggacttgaaagaa

SEQ ID NO: 4872244 - DNA, 13 bp, Homo sapiens
tcaggagaagcca

SEQ ID NO: 4872245 - DNA, 17 bp, Homo sapiens
tcaggagaagccagtgt

SEQ ID NO: 4872246 - DNA, 10 bp, Homo sapiens
tcaggagatg

SEQ ID NO: 4872247 - DNA, 14 bp, Homo sapiens
tcaggagatgggga

SEQ ID NO: 4872248 - DNA, 13 bp, Homo sapiens
tcaggagcctggc

SEQ ID NO: 4872249 - DNA, 18 bp, Homo sapiens
tcaggagcctggccaggc

SEQ ID NO: 4872250 - DNA, 20 bp, Homo sapiens
tcaggagcctggccaggcag

SEQ ID NO: 4872251 - DNA, 16 bp, Homo sapiens
tcaggcaaagaaaatg

SEQ ID NO: 4872252 - DNA, 16 bp, Homo sapiens
tcaggcagctgaaatt

SEQ ID NO: 4872253 - DNA, 20 bp, Homo sapiens
tcaggcattggatatttttt

SEQ ID NO: 4872254 - DNA, 11 bp, Homo sapiens
tcaggctccta

SEQ ID NO: 4872255 - DNA, 16 bp, Homo sapiens
tcagggatggagggaa

SEQ ID NO: 4872256 - DNA, 22 bp, Homo sapiens
tcagggatggagggaagacctg

SEQ ID NO: 4872257 - DNA, 13 bp, Homo sapiens
tcaggggggagaa

SEQ ID NO: 4872258 - DNA, 17 bp, Homo sapiens
tcagggtaaataggaat

SEQ ID NO: 4872259 - DNA, 17 bp, Homo sapiens
tcagtagcatctcagtg

SEQ ID NO: 4872260 - DNA, 15 bp, Homo sapiens
tcagtggggcagcct

SEQ ID NO: 4872261 - DNA, 17 bp, Homo sapiens
tcagttctcaaatgtgt

SEQ ID NO: 4872262 - DNA, 15 bp, Homo sapiens
tcagttgcttgtctt

SEQ ID NO: 4872263 - DNA, 13 bp, Homo sapiens
tcagttgtgtttt

SEQ ID NO: 4872264 - DNA, 14 bp, Homo sapiens
tcagttgtgttttt

SEQ ID NO: 4872265 - DNA, 19 bp, Homo sapiens
tcagtttgttggaaagtaa

SEQ ID NO: 4872266 - DNA, 20 bp, Homo sapiens
tcataggttaaaaaaaaaag

SEQ ID NO: 4872267 - DNA, 19 bp, Homo sapiens
tcatatttgggggctaagg

SEQ ID NO: 4872268 - DNA, 15 bp, Homo sapiens
tcatcactggactgc

SEQ ID NO: 4872269 - DNA, 16 bp, Homo sapiens
tcatcactggactgca

SEQ ID NO: 4872270 - DNA, 18 bp, Homo sapiens
tcatcactggactgcatg

SEQ ID NO: 4872271 - DNA, 21 bp, Homo sapiens
tcatcactttgacctaaatta

SEQ ID NO: 4872272 - DNA, 19 bp, Homo sapiens
tcatcattcttgtgggaga

SEQ ID NO: 4872273 - DNA, 15 bp, Homo sapiens
tcatccatcctgagc

SEQ ID NO: 4872274 - DNA, 15 bp, Homo sapiens
tcatccttccatcca

SEQ ID NO: 4872275 - DNA, 22 bp, Homo sapiens
tcatctaatgtattatgagcca

SEQ ID NO: 4872276 - DNA, 12 bp, Homo sapiens
tcatgaaaatac

SEQ ID NO: 4872277 - DNA, 14 bp, Homo sapiens
tcatgaatgtgctg

SEQ ID NO: 4872278 - DNA, 20 bp, Homo sapiens
tcatgaatgtgctggtgaac

SEQ ID NO: 4872279 - DNA, 12 bp, Homo sapiens
tcatgaatttta

SEQ ID NO: 4872280 - DNA, 16 bp, Homo sapiens
tcatgaattttaaagt

SEQ ID NO: 4872281 - DNA, 18 bp, Homo sapiens
tcatgaattttaaagtat

SEQ ID NO: 4872282 - DNA, 23 bp, Homo sapiens
tcatgattagaaattacctgtgg

SEQ ID NO: 4872283 - DNA, 14 bp, Homo sapiens
tcatgctgctcccc

SEQ ID NO: 4872284 - DNA, 16 bp, Homo sapiens
tcatggctgctgttgc

SEQ ID NO: 4872285 - DNA, 21 bp, Homo sapiens
tcatgtccaaacgtcctcttt

SEQ ID NO: 4872286 - DNA, 17 bp, Homo sapiens
tcatgtgaccactctgt

SEQ ID NO: 4872287 - DNA, 16 bp, Homo sapiens
tcatgtgagtctggga

SEQ ID NO: 4872288 - DNA, 17 bp, Homo sapiens
tcatgtttttgttttaa

SEQ ID NO: 4872289 - DNA, 16 bp, Homo sapiens
tcattaccctacagac

SEQ ID NO: 4872290 - DNA, 23 bp, Homo sapiens
tcattagttttgaagattctatg

SEQ ID NO: 4872291 - DNA, 13 bp, Homo sapiens
tcattcagaaatg

SEQ ID NO: 4872292 - DNA, 20 bp, Homo sapiens
tcattcttactaaaaagtat

SEQ ID NO: 4872293 - DNA, 12 bp, Homo sapiens
tcattgactttt

SEQ ID NO: 4872294 - DNA, 16 bp, Homo sapiens
tcattgacttttataa

SEQ ID NO: 4872295 - DNA, 17 bp, Homo sapiens
tcattgcacataagctt

SEQ ID NO: 4872296 - DNA, 13 bp, Homo sapiens
tcattgcttacaa

SEQ ID NO: 4872297 - DNA, 16 bp, Homo sapiens
tcatttgtatgtcaaa

SEQ ID NO: 4872298 - DNA, 17 bp, Homo sapiens
tcattttatttacagct

SEQ ID NO: 4872299 - DNA, 23 bp, Homo sapiens
tcattttatttacagctgtgctc

SEQ ID NO: 4872300 - DNA, 17 bp, Homo sapiens
tccaaaggaactctaga

SEQ ID NO: 4872301 - DNA, 18 bp, Homo sapiens
tccaaaggaactctagag

SEQ ID NO: 4872302 - DNA, 19 bp, Homo sapiens
tccaaattcaccttcccct

SEQ ID NO: 4872303 - DNA, 19 bp, Homo sapiens
tccaacatatatttattga

SEQ ID NO: 4872304 - DNA, 19 bp, Homo sapiens
tccaagcctgcctcccaag

SEQ ID NO: 4872305 - DNA, 17 bp, Homo sapiens
tccaagtctctgtgtaa

SEQ ID NO: 4872306 - DNA, 12 bp, Homo sapiens
tccacactcaga

SEQ ID NO: 4872307 - DNA, 16 bp, Homo sapiens
tccaccataccttaga

SEQ ID NO: 4872308 - DNA, 10 bp, Homo sapiens
tccacccaca

SEQ ID NO: 4872309 - DNA, 11 bp, Homo sapiens
tccacccacaa

SEQ ID NO: 4872310 - DNA, 20 bp, Homo sapiens
tccacccacaaactccaggc

SEQ ID NO: 4872311 - DNA, 21 bp, Homo sapiens
tccacccacaaactccaggct

SEQ ID NO: 4872312 - DNA, 16 bp, Homo sapiens
tccacctcatcactgg

SEQ ID NO: 4872313 - DNA, 17 bp, Homo sapiens
tccacctcatcactgga

SEQ ID NO: 4872314 - DNA, 23 bp, Homo sapiens
tccaccttggctgggaagactat

SEQ ID NO: 4872315 - DNA, 14 bp, Homo sapiens
tccactggaccctt

SEQ ID NO: 4872316 - DNA, 13 bp, Homo sapiens
tccagaagctgct

SEQ ID NO: 4872317 - DNA, 14 bp, Homo sapiens
tccagaagctgctc

SEQ ID NO: 4872318 - DNA, 15 bp, Homo sapiens
tccagatagtgtagc

SEQ ID NO: 4872319 - DNA, 22 bp, Homo sapiens
tccagatagtgtagctgaggag

SEQ ID NO: 4872320 - DNA, 17 bp, Homo sapiens
tccagatctttcagaaa

SEQ ID NO: 4872321 - DNA, 12 bp, Homo sapiens
tccagccacccc

SEQ ID NO: 4872322 - DNA, 18 bp, Homo sapiens
tccagccacccccaggca

SEQ ID NO: 4872323 - DNA, 16 bp, Homo sapiens
tccagcccaaacctgg

SEQ ID NO: 4872324 - DNA, 17 bp, Homo sapiens
tccagcccaaacctggg

SEQ ID NO: 4872325 - DNA, 18 bp, Homo sapiens
tccagcccaaacctggga

SEQ ID NO: 4872326 - DNA, 23 bp, Homo sapiens
tccagcttcggagggcccctgcg

SEQ ID NO: 4872327 - DNA, 10 bp, Homo sapiens
tccaggaagt

SEQ ID NO: 4872328 - DNA, 23 bp, Homo sapiens
tccaggaccttgcttccttctca

SEQ ID NO: 4872329 - DNA, 14 bp, Homo sapiens
tccaggctggaagt

SEQ ID NO: 4872330 - DNA, 18 bp, Homo sapiens
tccagggcagcaggccag

SEQ ID NO: 4872331 - DNA, 23 bp, Homo sapiens
tccagggcagcaggccagagaaa

SEQ ID NO: 4872332 - DNA, 19 bp, Homo sapiens
tccagggtgacaaggcctg

SEQ ID NO: 4872333 - DNA, 14 bp, Homo sapiens
tccagtcagatgag

SEQ ID NO: 4872334 - DNA, 15 bp, Homo sapiens
tccagtcttagctga

SEQ ID NO: 4872335 - DNA, 20 bp, Homo sapiens
tccagtgtgagatactgtgt

SEQ ID NO: 4872336 - DNA, 21 bp, Homo sapiens
tccagttagagtcttcatctg

SEQ ID NO: 4872337 - DNA, 21 bp, Homo sapiens
tccagttgaagttagtggaaa

SEQ ID NO: 4872338 - DNA, 20 bp, Homo sapiens
tccataccccgccaaggaaa

SEQ ID NO: 4872339 - DNA, 14 bp, Homo sapiens
tccatatttattca

SEQ ID NO: 4872340 - DNA, 12 bp, Homo sapiens
tccatccatcct

SEQ ID NO: 4872341 - DNA, 13 bp, Homo sapiens
tccatccatcctt

SEQ ID NO: 4872342 - DNA, 17 bp, Homo sapiens
tccatccatccttccaa

SEQ ID NO: 4872343 - DNA, 12 bp, Homo sapiens
tccatccatctt

SEQ ID NO: 4872344 - DNA, 16 bp, Homo sapiens
tccatccctccattca

SEQ ID NO: 4872345 - DNA, 12 bp, Homo sapiens
tccatcctgagc

SEQ ID NO: 4872346 - DNA, 16 bp, Homo sapiens
tccatcctgagccaaa

SEQ ID NO: 4872347 - DNA, 15 bp, Homo sapiens
tccatcggggcaggg

SEQ ID NO: 4872348 - DNA, 16 bp, Homo sapiens
tccatcgtattaaaaa

SEQ ID NO: 4872349 - DNA, 21 bp, Homo sapiens
tccatgctcctcacctgtcta

SEQ ID NO: 4872350 - DNA, 19 bp, Homo sapiens
tccatggagcctacctctg

SEQ ID NO: 4872351 - DNA, 12 bp, Homo sapiens
tccatgttgact

SEQ ID NO: 4872352 - DNA, 13 bp, Homo sapiens
tccatgttgactg

SEQ ID NO: 4872353 - DNA, 14 bp, Homo sapiens
tccattacctccat

SEQ ID NO: 4872354 - DNA, 16 bp, Homo sapiens
tccattacctccatcc

SEQ ID NO: 4872355 - DNA, 20 bp, Homo sapiens
tccattcctaatcaaattct

SEQ ID NO: 4872356 - DNA, 14 bp, Homo sapiens
tccatttcaggact

SEQ ID NO: 4872357 - DNA, 22 bp, Homo sapiens
tccatttcaggactctctccag

SEQ ID NO: 4872358 - DNA, 22 bp, Homo sapiens
tcccaagctgatggacatgaga

SEQ ID NO: 4872359 - DNA, 20 bp, Homo sapiens
tcccaaggcattctcccagc

SEQ ID NO: 4872360 - DNA, 13 bp, Homo sapiens
tcccaagggacag

SEQ ID NO: 4872361 - DNA, 16 bp, Homo sapiens
tcccaagggacagcaa

SEQ ID NO: 4872362 - DNA, 21 bp, Homo sapiens
tcccaagggacagcaagtgag

SEQ ID NO: 4872363 - DNA, 22 bp, Homo sapiens
tcccaagggacagcaagtgagc

SEQ ID NO: 4872364 - DNA, 16 bp, Homo sapiens
tcccaaggtcctctca

SEQ ID NO: 4872365 - DNA, 17 bp, Homo sapiens
tcccaaggtcctctcag

SEQ ID NO: 4872366 - DNA, 18 bp, Homo sapiens
tcccacagcagccccagg

SEQ ID NO: 4872367 - DNA, 21 bp, Homo sapiens
tcccacagcagccccaggaga

SEQ ID NO: 4872368 - DNA, 22 bp, Homo sapiens
tcccacagcagccccaggagaa

SEQ ID NO: 4872369 - DNA, 22 bp, Homo sapiens
tcccacatggccatcttctttc

SEQ ID NO: 4872370 - DNA, 12 bp, Homo sapiens
tcccacccaccg

SEQ ID NO: 4872371 - DNA, 19 bp, Homo sapiens
tcccacccaccgccacaat

SEQ ID NO: 4872372 - DNA, 17 bp, Homo sapiens
tcccaccccctccttct

SEQ ID NO: 4872373 - DNA, 16 bp, Homo sapiens
tcccactccagctgac

SEQ ID NO: 4872374 - DNA, 21 bp, Homo sapiens
tcccagaacctctaagtgctg

SEQ ID NO: 4872375 - DNA, 22 bp, Homo sapiens
tcccagaacctctaagtgctgc

SEQ ID NO: 4872376 - DNA, 23 bp, Homo sapiens
tcccagaacctctaagtgctgct

SEQ ID NO: 4872377 - DNA, 21 bp, Homo sapiens
tcccagaggtgggatcctccc

SEQ ID NO: 4872378 - DNA, 18 bp, Homo sapiens
tcccagctctagcctctg

SEQ ID NO: 4872379 - DNA, 17 bp, Homo sapiens
tcccaggggagccagct

SEQ ID NO: 4872380 - DNA, 18 bp, Homo sapiens
tcccaggggagccagctg

SEQ ID NO: 4872381 - DNA, 21 bp, Homo sapiens
tcccaggggagccagctgctt

SEQ ID NO: 4872382 - DNA, 17 bp, Homo sapiens
tcccatctgaagagtgg

SEQ ID NO: 4872383 - DNA, 18 bp, Homo sapiens
tcccatgatttggggtga

SEQ ID NO: 4872384 - DNA, 12 bp, Homo sapiens
tcccatggctga

SEQ ID NO: 4872385 - DNA, 22 bp, Homo sapiens
tcccatggctgaagctggagca

SEQ ID NO: 4872386 - DNA, 16 bp, Homo sapiens
tccccagtgactccag

SEQ ID NO: 4872387 - DNA, 19 bp, Homo sapiens
tccccagtgactccagggt

SEQ ID NO: 4872388 - DNA, 17 bp, Homo sapiens
tcccccaccctccatgc

SEQ ID NO: 4872389 - DNA, 15 bp, Homo sapiens
tcccccttcatccat

SEQ ID NO: 4872390 - DNA, 22 bp, Homo sapiens
tcccccttcatccatcctgagc

SEQ ID NO: 4872391 - DNA, 22 bp, Homo sapiens
tcccctaaagccaggctcagga

SEQ ID NO: 4872392 - DNA, 15 bp, Homo sapiens
tcccctcccagggga

SEQ ID NO: 4872393 - DNA, 16 bp, Homo sapiens
tcccctcccaggggag

SEQ ID NO: 4872394 - DNA, 14 bp, Homo sapiens
tcccctcctgctgg

SEQ ID NO: 4872395 - DNA, 15 bp, Homo sapiens
tcccctcctgctggg

SEQ ID NO: 4872396 - DNA, 16 bp, Homo sapiens
tcccctcctgctgggc

SEQ ID NO: 4872397 - DNA, 18 bp, Homo sapiens
tcccctctcatacataaa

SEQ ID NO: 4872398 - DNA, 14 bp, Homo sapiens
tcccctctgtgctt

SEQ ID NO: 4872399 - DNA, 23 bp, Homo sapiens
tcccctctgtgcttcgactactg

SEQ ID NO: 4872400 - DNA, 20 bp, Homo sapiens
tcccctgcccttcctcctga

SEQ ID NO: 4872401 - DNA, 16 bp, Homo sapiens
tcccgccccgcccctc

SEQ ID NO: 4872402 - DNA, 15 bp, Homo sapiens
tcccgccgccccccc

SEQ ID NO: 4872403 - DNA, 16 bp, Homo sapiens
tcccggctcccctccc

SEQ ID NO: 4872404 - DNA, 16 bp, Homo sapiens
tcccgtcttccagaga

SEQ ID NO: 4872405 - DNA, 14 bp, Homo sapiens
tccctaatgtgttt

SEQ ID NO: 4872406 - DNA, 24 bp, Homo sapiens
tccctacatgtattgcacattgta

SEQ ID NO: 4872407 - DNA, 20 bp, Homo sapiens
tccctagggctctccaagca

SEQ ID NO: 4872408 - DNA, 12 bp, Homo sapiens
tccctcacctgt

SEQ ID NO: 4872409 - DNA, 17 bp, Homo sapiens
tccctcagctctctggg

SEQ ID NO: 4872410 - DNA, 18 bp, Homo sapiens
tccctcagctctctggga

SEQ ID NO: 4872411 - DNA, 15 bp, Homo sapiens
tccctgaggactgat

SEQ ID NO: 4872412 - DNA, 21 bp, Homo sapiens
tccctgaggactgatttcaga

SEQ ID NO: 4872413 - DNA, 15 bp, Homo sapiens
tccctgcaaaactcc

SEQ ID NO: 4872414 - DNA, 20 bp, Homo sapiens
tccctgcaaaactccaggca

SEQ ID NO: 4872415 - DNA, 12 bp, Homo sapiens
tccctgcctgga

SEQ ID NO: 4872416 - DNA, 16 bp, Homo sapiens
tccctgcctggaggct

SEQ ID NO: 4872417 - DNA, 17 bp, Homo sapiens
tccctgctccacgtctg

SEQ ID NO: 4872418 - DNA, 21 bp, Homo sapiens
tccctgggggccttgggtgag

SEQ ID NO: 4872419 - DNA, 15 bp, Homo sapiens
tccctgtctcccggc

SEQ ID NO: 4872420 - DNA, 20 bp, Homo sapiens
tcccttaaggggtatcatgt

SEQ ID NO: 4872421 - DNA, 15 bp, Homo sapiens
tcccttgcaggggtc

SEQ ID NO: 4872422 - DNA, 16 bp, Homo sapiens
tcccttggacatttta

SEQ ID NO: 4872423 - DNA, 19 bp, Homo sapiens
tcccttggacattttatgt

SEQ ID NO: 4872424 - DNA, 20 bp, Homo sapiens
tccctttttcataaattatt

SEQ ID NO: 4872425 - DNA, 22 bp, Homo sapiens
tccgcagttgtagcagaaacca

SEQ ID NO: 4872426 - DNA, 19 bp, Homo sapiens
tccgggcaccaggggccaa

SEQ ID NO: 4872427 - DNA, 14 bp, Homo sapiens
tccggggagaaacc

SEQ ID NO: 4872428 - DNA, 17 bp, Homo sapiens
tccgtacttgggtcaca

SEQ ID NO: 4872429 - DNA, 17 bp, Homo sapiens
tcctaaaagttctcaat

SEQ ID NO: 4872430 - DNA, 20 bp, Homo sapiens
tcctaagatgtgttcttatt

SEQ ID NO: 4872431 - DNA, 17 bp, Homo sapiens
tcctagactgctcctgg

SEQ ID NO: 4872432 - DNA, 20 bp, Homo sapiens
tcctagactgctcctgggca

SEQ ID NO: 4872433 - DNA, 18 bp, Homo sapiens
tcctaggaaccagccaac

SEQ ID NO: 4872434 - DNA, 19 bp, Homo sapiens
tcctataaagtgcctcgga

SEQ ID NO: 4872435 - DNA, 21 bp, Homo sapiens
tcctataaagtgcctcggaca

SEQ ID NO: 4872436 - DNA, 18 bp, Homo sapiens
tcctatatcctccttctc

SEQ ID NO: 4872437 - DNA, 17 bp, Homo sapiens
tcctatttttgtgaaga

SEQ ID NO: 4872438 - DNA, 17 bp, Homo sapiens
tcctcacctgtctaggt

SEQ ID NO: 4872439 - DNA, 20 bp, Homo sapiens
tcctcatgtcttctcacaag

SEQ ID NO: 4872440 - DNA, 17 bp, Homo sapiens
tcctccacccataataa

SEQ ID NO: 4872441 - DNA, 13 bp, Homo sapiens
tcctccagccctg

SEQ ID NO: 4872442 - DNA, 16 bp, Homo sapiens
tcctcccgccccgccc

SEQ ID NO: 4872443 - DNA, 19 bp, Homo sapiens
tcctcccgccccgcccctc

SEQ ID NO: 4872444 - DNA, 20 bp, Homo sapiens
tcctccctcatggctctggc

SEQ ID NO: 4872445 - DNA, 14 bp, Homo sapiens
tcctcctacttaca

SEQ ID NO: 4872446 - DNA, 18 bp, Homo sapiens
tcctcctgatggagtgtg

SEQ ID NO: 4872447 - DNA, 18 bp, Homo sapiens
tcctctcggctgccaggg

SEQ ID NO: 4872448 - DNA, 19 bp, Homo sapiens
tcctctctctttcctccac

SEQ ID NO: 4872449 - DNA, 16 bp, Homo sapiens
tcctctcttgggtagg

SEQ ID NO: 4872450 - DNA, 13 bp, Homo sapiens
tcctctgcaagct

SEQ ID NO: 4872451 - DNA, 16 bp, Homo sapiens
tcctcttgttcctgaa

SEQ ID NO: 4872452 - DNA, 18 bp, Homo sapiens
tcctcttgttcctgaaat

SEQ ID NO: 4872453 - DNA, 19 bp, Homo sapiens
tcctcttgttcctgaaatg

SEQ ID NO: 4872454 - DNA, 15 bp, Homo sapiens
tcctgaaatgtgttt

SEQ ID NO: 4872455 - DNA, 16 bp, Homo sapiens
tcctgataccattcta

SEQ ID NO: 4872456 - DNA, 21 bp, Homo sapiens
tcctgatggagtgtgcagaca

SEQ ID NO: 4872457 - DNA, 20 bp, Homo sapiens
tcctgcaaaaggaggtgaaa

SEQ ID NO: 4872458 - DNA, 11 bp, Homo sapiens
tcctgcatgtt

SEQ ID NO: 4872459 - DNA, 18 bp, Homo sapiens
tcctgccctctgctctgc

SEQ ID NO: 4872460 - DNA, 22 bp, Homo sapiens
tcctgctcaactctacccctgc

SEQ ID NO: 4872461 - DNA, 18 bp, Homo sapiens
tcctgggcattagcaagg

SEQ ID NO: 4872462 - DNA, 19 bp, Homo sapiens
tcctgtctaacttggggaa

SEQ ID NO: 4872463 - DNA, 18 bp, Homo sapiens
tcctgtcttctttctcca

SEQ ID NO: 4872464 - DNA, 23 bp, Homo sapiens
tcctgtcttctttctccatggag

SEQ ID NO: 4872465 - DNA, 22 bp, Homo sapiens
tcctgtggaaggcagagaaatc

SEQ ID NO: 4872466 - DNA, 14 bp, Homo sapiens
tcctgtggcaggag

SEQ ID NO: 4872467 - DNA, 20 bp, Homo sapiens
tcctgtgtgaccctgggcag

SEQ ID NO: 4872468 - DNA, 17 bp, Homo sapiens
tccttaagctgcagaga

SEQ ID NO: 4872469 - DNA, 20 bp, Homo sapiens
tccttaagctgcagagattt

SEQ ID NO: 4872470 - DNA, 15 bp, Homo sapiens
tccttagccctgtct

SEQ ID NO: 4872471 - DNA, 22 bp, Homo sapiens
tccttaggtttttttccttctg

SEQ ID NO: 4872472 - DNA, 18 bp, Homo sapiens
tccttatagacacttgct

SEQ ID NO: 4872473 - DNA, 16 bp, Homo sapiens
tccttcaggcagctga

SEQ ID NO: 4872474 - DNA, 13 bp, Homo sapiens
tccttccatccat

SEQ ID NO: 4872475 - DNA, 16 bp, Homo sapiens
tccttgagtgtatgag

SEQ ID NO: 4872476 - DNA, 19 bp, Homo sapiens
tcgactactgctcctgtgg

SEQ ID NO: 4872477 - DNA, 16 bp, Homo sapiens
tcgagtgtagctgtga

SEQ ID NO: 4872478 - DNA, 17 bp, Homo sapiens
tcgagtgtagctgtgaa

SEQ ID NO: 4872479 - DNA, 14 bp, Homo sapiens
tcgcagaccagagc

SEQ ID NO: 4872480 - DNA, 19 bp, Homo sapiens
tcgcagaccagagctgtct

SEQ ID NO: 4872481 - DNA, 21 bp, Homo sapiens
tcgcagaccagagctgtctga

SEQ ID NO: 4872482 - DNA, 21 bp, Homo sapiens
tcgccagtcactgctgcaagg

SEQ ID NO: 4872483 - DNA, 22 bp, Homo sapiens
tcgccagtcactgctgcaaggt

SEQ ID NO: 4872484 - DNA, 23 bp, Homo sapiens
tcgccagtcactgctgcaaggtg

SEQ ID NO: 4872485 - DNA, 12 bp, Homo sapiens
tcggaaacactg

SEQ ID NO: 4872486 - DNA, 23 bp, Homo sapiens
tcggctgccaggggctctgtggc

SEQ ID NO: 4872487 - DNA, 11 bp, Homo sapiens
tcgtttttgta

SEQ ID NO: 4872488 - DNA, 20 bp, Homo sapiens
tcgtttttgtattttcatga

SEQ ID NO: 4872489 - DNA, 17 bp, Homo sapiens
tctaaaaggtaatgtgt

SEQ ID NO: 4872490 - DNA, 18 bp, Homo sapiens
tctaaaattataaatgac

SEQ ID NO: 4872491 - DNA, 23 bp, Homo sapiens
tctaagactatatatataaatgt

SEQ ID NO: 4872492 - DNA, 19 bp, Homo sapiens
tctaagtgctgctgtggag

SEQ ID NO: 4872493 - DNA, 14 bp, Homo sapiens
tctaattctgattc

SEQ ID NO: 4872494 - DNA, 14 bp, Homo sapiens
tctacaatctcttt

SEQ ID NO: 4872495 - DNA, 14 bp, Homo sapiens
tctaccaatacaaa
